United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 158

SEQ ID NO: 6706120 - DNA, 21 bp, Homo sapiens
caggccccccgcagcaccctg

SEQ ID NO: 6706121 - DNA, 18 bp, Homo sapiens
caggcccccggctttcct

SEQ ID NO: 6706122 - DNA, 22 bp, Homo sapiens
caggcccccgttgaagccgctc

SEQ ID NO: 6706123 - DNA, 16 bp, Homo sapiens
caggccccctgcatct

SEQ ID NO: 6706124 - DNA, 22 bp, Homo sapiens
caggccccgaggacccagaccc

SEQ ID NO: 6706125 - DNA, 23 bp, Homo sapiens
caggccccgcttgtccagcgcct

SEQ ID NO: 6706126 - DNA, 13 bp, Homo sapiens
caggcccctctcc

SEQ ID NO: 6706127 - DNA, 17 bp, Homo sapiens
caggcccctctcctccg

SEQ ID NO: 6706128 - DNA, 18 bp, Homo sapiens
caggcccctctcctccgt

SEQ ID NO: 6706129 - DNA, 14 bp, Homo sapiens
caggcccctgagga

SEQ ID NO: 6706130 - DNA, 15 bp, Homo sapiens
caggcccctgaggac

SEQ ID NO: 6706131 - DNA, 20 bp, Homo sapiens
caggcccctggaggctgcct

SEQ ID NO: 6706132 - DNA, 14 bp, Homo sapiens
caggcccctgggtt

SEQ ID NO: 6706133 - DNA, 20 bp, Homo sapiens
caggcccgaaggtctctctg

SEQ ID NO: 6706134 - DNA, 16 bp, Homo sapiens
caggcccgagcgcctg

SEQ ID NO: 6706135 - DNA, 17 bp, Homo sapiens
caggcccgagcgcctgc

SEQ ID NO: 6706136 - DNA, 15 bp, Homo sapiens
caggcccgccctgcc

SEQ ID NO: 6706137 - DNA, 21 bp, Homo sapiens
caggcccgcgggcacagccag

SEQ ID NO: 6706138 - DNA, 13 bp, Homo sapiens
caggcccgcttgc

SEQ ID NO: 6706139 - DNA, 16 bp, Homo sapiens
caggcccgcttgctgg

SEQ ID NO: 6706140 - DNA, 17 bp, Homo sapiens
caggcccggactcacca

SEQ ID NO: 6706141 - DNA, 18 bp, Homo sapiens
caggcccggcatgaggcc

SEQ ID NO: 6706142 - DNA, 21 bp, Homo sapiens
caggcccggcatgaggccccg

SEQ ID NO: 6706143 - DNA, 20 bp, Homo sapiens
caggcccggcatgcgggcca

SEQ ID NO: 6706144 - DNA, 13 bp, Homo sapiens
caggcccggctcc

SEQ ID NO: 6706145 - DNA, 15 bp, Homo sapiens
caggcccggctccag

SEQ ID NO: 6706146 - DNA, 23 bp, Homo sapiens
caggcccgtcagcatcactgatg

SEQ ID NO: 6706147 - DNA, 16 bp, Homo sapiens
caggcccgtcggagct

SEQ ID NO: 6706148 - DNA, 20 bp, Homo sapiens
caggcccgtcggagctgcct

SEQ ID NO: 6706149 - DNA, 22 bp, Homo sapiens
caggcccgtcggagctgcctgc

SEQ ID NO: 6706150 - DNA, 15 bp, Homo sapiens
caggcccgtctgtcc

SEQ ID NO: 6706151 - DNA, 16 bp, Homo sapiens
caggcccgtctgtcca

SEQ ID NO: 6706152 - DNA, 12 bp, Homo sapiens
caggccctcagc

SEQ ID NO: 6706153 - DNA, 18 bp, Homo sapiens
caggccctcagctgtcgg

SEQ ID NO: 6706154 - DNA, 23 bp, Homo sapiens
caggccctcagctgtcgggggcc

SEQ ID NO: 6706155 - DNA, 16 bp, Homo sapiens
caggccctccagcagg

SEQ ID NO: 6706156 - DNA, 15 bp, Homo sapiens
caggccctccagtgg

SEQ ID NO: 6706157 - DNA, 20 bp, Homo sapiens
caggccctccagtgggctga

SEQ ID NO: 6706158 - DNA, 19 bp, Homo sapiens
caggccctccatgggctag

SEQ ID NO: 6706159 - DNA, 21 bp, Homo sapiens
caggccctccatgggctagtg

SEQ ID NO: 6706160 - DNA, 16 bp, Homo sapiens
caggccctcccaccac

SEQ ID NO: 6706161 - DNA, 13 bp, Homo sapiens
caggccctccctc

SEQ ID NO: 6706162 - DNA, 14 bp, Homo sapiens
caggccctccctct

SEQ ID NO: 6706163 - DNA, 17 bp, Homo sapiens
caggccctccctgtctc

SEQ ID NO: 6706164 - DNA, 23 bp, Homo sapiens
caggccctccctgttccccagag

SEQ ID NO: 6706165 - DNA, 18 bp, Homo sapiens
caggccctcctccctccc

SEQ ID NO: 6706166 - DNA, 20 bp, Homo sapiens
caggccctcctccctcccag

SEQ ID NO: 6706167 - DNA, 18 bp, Homo sapiens
caggccctcctgctggct

SEQ ID NO: 6706168 - DNA, 20 bp, Homo sapiens
caggccctcctgctggctga

SEQ ID NO: 6706169 - DNA, 21 bp, Homo sapiens
caggccctcctgctggctgag

SEQ ID NO: 6706170 - DNA, 16 bp, Homo sapiens
caggccctctgcccac

SEQ ID NO: 6706171 - DNA, 17 bp, Homo sapiens
caggccctctgcccact

SEQ ID NO: 6706172 - DNA, 17 bp, Homo sapiens
caggccctctgcctgca

SEQ ID NO: 6706173 - DNA, 22 bp, Homo sapiens
caggccctctgcctgcactccc

SEQ ID NO: 6706174 - DNA, 13 bp, Homo sapiens
caggccctgactc

SEQ ID NO: 6706175 - DNA, 20 bp, Homo sapiens
caggccctgactcctctggc

SEQ ID NO: 6706176 - DNA, 14 bp, Homo sapiens
caggccctgagagt

SEQ ID NO: 6706177 - DNA, 11 bp, Homo sapiens
caggccctgca

SEQ ID NO: 6706178 - DNA, 16 bp, Homo sapiens
caggccctgcagtgtt

SEQ ID NO: 6706179 - DNA, 13 bp, Homo sapiens
caggccctgccag

SEQ ID NO: 6706180 - DNA, 20 bp, Homo sapiens
caggccctgccagagcaggg

SEQ ID NO: 6706181 - DNA, 14 bp, Homo sapiens
caggccctgcccag

SEQ ID NO: 6706182 - DNA, 19 bp, Homo sapiens
caggccctgcccagccagc

SEQ ID NO: 6706183 - DNA, 13 bp, Homo sapiens
caggccctgctcc

SEQ ID NO: 6706184 - DNA, 16 bp, Homo sapiens
caggccctgctcctgc

SEQ ID NO: 6706185 - DNA, 20 bp, Homo sapiens
caggccctgctcctgcagca

SEQ ID NO: 6706186 - DNA, 15 bp, Homo sapiens
caggccctggaactc

SEQ ID NO: 6706187 - DNA, 17 bp, Homo sapiens
caggccctggcctcccc

SEQ ID NO: 6706188 - DNA, 18 bp, Homo sapiens
caggccctggcctcccct

SEQ ID NO: 6706189 - DNA, 20 bp, Homo sapiens
caggccctggcctcccctgc

SEQ ID NO: 6706190 - DNA, 22 bp, Homo sapiens
caggccctggcctcccctgcca

SEQ ID NO: 6706191 - DNA, 20 bp, Homo sapiens
caggccctggctaagaccca

SEQ ID NO: 6706192 - DNA, 13 bp, Homo sapiens
caggccctgggcc

SEQ ID NO: 6706193 - DNA, 14 bp, Homo sapiens
caggccctgggcct

SEQ ID NO: 6706194 - DNA, 13 bp, Homo sapiens
caggccctgggtc

SEQ ID NO: 6706195 - DNA, 13 bp, Homo sapiens
caggccctggtgg

SEQ ID NO: 6706196 - DNA, 13 bp, Homo sapiens
caggccctgtcca

SEQ ID NO: 6706197 - DNA, 19 bp, Homo sapiens
caggccctgtccagccccc

SEQ ID NO: 6706198 - DNA, 21 bp, Homo sapiens
caggcccttattttcaagaaa

SEQ ID NO: 6706199 - DNA, 19 bp, Homo sapiens
caggcccttcctctccact

SEQ ID NO: 6706200 - DNA, 20 bp, Homo sapiens
caggcccttcctctccactg

SEQ ID NO: 6706201 - DNA, 14 bp, Homo sapiens
caggcccttggctg

SEQ ID NO: 6706202 - DNA, 15 bp, Homo sapiens
caggcccttggctgc

SEQ ID NO: 6706203 - DNA, 20 bp, Homo sapiens
caggcccttgtcggccccac

SEQ ID NO: 6706204 - DNA, 16 bp, Homo sapiens
caggccctttcctcag

SEQ ID NO: 6706205 - DNA, 19 bp, Homo sapiens
caggccctttgaagcctca

SEQ ID NO: 6706206 - DNA, 13 bp, Homo sapiens
caggccctttggc

SEQ ID NO: 6706207 - DNA, 23 bp, Homo sapiens
caggccgacagtcggtgacccca

SEQ ID NO: 6706208 - DNA, 16 bp, Homo sapiens
caggccgagagcctta

SEQ ID NO: 6706209 - DNA, 13 bp, Homo sapiens
caggccgcagctc

SEQ ID NO: 6706210 - DNA, 15 bp, Homo sapiens
caggccgcagctctt

SEQ ID NO: 6706211 - DNA, 15 bp, Homo sapiens
caggccgcatggccc

SEQ ID NO: 6706212 - DNA, 21 bp, Homo sapiens
caggccgcatggcccctccag

SEQ ID NO: 6706213 - DNA, 21 bp, Homo sapiens
caggccgccccagcctctgag

SEQ ID NO: 6706214 - DNA, 24 bp, Homo sapiens
caggccgcctgccataccgctggg

SEQ ID NO: 6706215 - DNA, 21 bp, Homo sapiens
caggccgcgcccagcagaggc

SEQ ID NO: 6706216 - DNA, 19 bp, Homo sapiens
caggccggaaccacagggc

SEQ ID NO: 6706217 - DNA, 17 bp, Homo sapiens
caggccggagcccagat

SEQ ID NO: 6706218 - DNA, 18 bp, Homo sapiens
caggccggagcccagata

SEQ ID NO: 6706219 - DNA, 17 bp, Homo sapiens
caggccggcagccccag

SEQ ID NO: 6706220 - DNA, 22 bp, Homo sapiens
caggccggcagccccagcctgc

SEQ ID NO: 6706221 - DNA, 23 bp, Homo sapiens
caggccggcagccccagcctgct

SEQ ID NO: 6706222 - DNA, 20 bp, Homo sapiens
caggccgggaagagccacct

SEQ ID NO: 6706223 - DNA, 13 bp, Homo sapiens
caggccgggcaga

SEQ ID NO: 6706224 - DNA, 14 bp, Homo sapiens
caggccgggcagag

SEQ ID NO: 6706225 - DNA, 18 bp, Homo sapiens
caggccgggcctgtacag

SEQ ID NO: 6706226 - DNA, 22 bp, Homo sapiens
caggccggtgtgggctgtgtcg

SEQ ID NO: 6706227 - DNA, 22 bp, Homo sapiens
caggccgtcctcccgggccctc

SEQ ID NO: 6706228 - DNA, 20 bp, Homo sapiens
caggccgtgacgtctgggtg

SEQ ID NO: 6706229 - DNA, 20 bp, Homo sapiens
caggccgtgggacccaggct

SEQ ID NO: 6706230 - DNA, 23 bp, Homo sapiens
caggccgttccccttggcttcct

SEQ ID NO: 6706231 - DNA, 18 bp, Homo sapiens
caggcctacagccacatc

SEQ ID NO: 6706232 - DNA, 23 bp, Homo sapiens
caggcctacctcaagttcttgga

SEQ ID NO: 6706233 - DNA, 20 bp, Homo sapiens
caggcctactcctgtcttct

SEQ ID NO: 6706234 - DNA, 11 bp, Homo sapiens
caggcctagga

SEQ ID NO: 6706235 - DNA, 19 bp, Homo sapiens
caggcctaggacctcaggc

SEQ ID NO: 6706236 - DNA, 19 bp, Homo sapiens
caggcctaggtgcagctcc

SEQ ID NO: 6706237 - DNA, 20 bp, Homo sapiens
caggcctaggtgcagctcct

SEQ ID NO: 6706238 - DNA, 22 bp, Homo sapiens
caggcctagtaaccaaggccct

SEQ ID NO: 6706239 - DNA, 23 bp, Homo sapiens
caggcctagtaaccaaggccctg

SEQ ID NO: 6706240 - DNA, 15 bp, Homo sapiens
caggcctatttaaca

SEQ ID NO: 6706241 - DNA, 13 bp, Homo sapiens
caggcctcaagcg

SEQ ID NO: 6706242 - DNA, 17 bp, Homo sapiens
caggcctcaagcgtgga

SEQ ID NO: 6706243 - DNA, 19 bp, Homo sapiens
caggcctcacccctcccct

SEQ ID NO: 6706244 - DNA, 20 bp, Homo sapiens
caggcctcacccctcccctg

SEQ ID NO: 6706245 - DNA, 22 bp, Homo sapiens
caggcctcacccctcccctggg

SEQ ID NO: 6706246 - DNA, 22 bp, Homo sapiens
caggcctcacctcccagggcta

SEQ ID NO: 6706247 - DNA, 21 bp, Homo sapiens
caggcctcacctggcttccca

SEQ ID NO: 6706248 - DNA, 23 bp, Homo sapiens
caggcctcacctggcttcccagg

SEQ ID NO: 6706249 - DNA, 12 bp, Homo sapiens
caggcctcactg

SEQ ID NO: 6706250 - DNA, 21 bp, Homo sapiens
caggcctcactggctcatgcc

SEQ ID NO: 6706251 - DNA, 16 bp, Homo sapiens
caggcctcagggacca

SEQ ID NO: 6706252 - DNA, 14 bp, Homo sapiens
caggcctcagggtg

SEQ ID NO: 6706253 - DNA, 15 bp, Homo sapiens
caggcctcatcctcc

SEQ ID NO: 6706254 - DNA, 16 bp, Homo sapiens
caggcctcatcctcct

SEQ ID NO: 6706255 - DNA, 21 bp, Homo sapiens
caggcctccaacgcccctgtg

SEQ ID NO: 6706256 - DNA, 23 bp, Homo sapiens
caggcctccaacgcccctgtggc

SEQ ID NO: 6706257 - DNA, 24 bp, Homo sapiens
caggcctccaacgcccctgtggcc

SEQ ID NO: 6706258 - DNA, 16 bp, Homo sapiens
caggcctccagcctct

SEQ ID NO: 6706259 - DNA, 19 bp, Homo sapiens
caggcctccagcctctccc

SEQ ID NO: 6706260 - DNA, 10 bp, Homo sapiens
caggcctccc

SEQ ID NO: 6706261 - DNA, 15 bp, Homo sapiens
caggcctcccaagct

SEQ ID NO: 6706262 - DNA, 16 bp, Homo sapiens
caggcctcccaagctg

SEQ ID NO: 6706263 - DNA, 16 bp, Homo sapiens
caggcctccctagcac

SEQ ID NO: 6706264 - DNA, 20 bp, Homo sapiens
caggcctccctgaaacactg

SEQ ID NO: 6706265 - DNA, 17 bp, Homo sapiens
caggcctccctgcagac

SEQ ID NO: 6706266 - DNA, 18 bp, Homo sapiens
caggcctccctgccagta

SEQ ID NO: 6706267 - DNA, 14 bp, Homo sapiens
caggcctccctgtt

SEQ ID NO: 6706268 - DNA, 23 bp, Homo sapiens
caggcctccgtcttcccagcggt

SEQ ID NO: 6706269 - DNA, 12 bp, Homo sapiens
caggcctcctac

SEQ ID NO: 6706270 - DNA, 13 bp, Homo sapiens
caggcctcctagg

SEQ ID NO: 6706271 - DNA, 20 bp, Homo sapiens
caggcctcctaggggaaggg

SEQ ID NO: 6706272 - DNA, 21 bp, Homo sapiens
caggcctcctaggggaagggg

SEQ ID NO: 6706273 - DNA, 15 bp, Homo sapiens
caggcctcgcctgcc

SEQ ID NO: 6706274 - DNA, 16 bp, Homo sapiens
caggcctcgcctgccc

SEQ ID NO: 6706275 - DNA, 18 bp, Homo sapiens
caggcctcgcctgccctc

SEQ ID NO: 6706276 - DNA, 21 bp, Homo sapiens
caggcctctactaggtctgct

SEQ ID NO: 6706277 - DNA, 15 bp, Homo sapiens
caggcctctctctgc

SEQ ID NO: 6706278 - DNA, 18 bp, Homo sapiens
caggcctctgagcccaag

SEQ ID NO: 6706279 - DNA, 19 bp, Homo sapiens
caggcctctgagcccaagc

SEQ ID NO: 6706280 - DNA, 20 bp, Homo sapiens
caggcctctgagcccaagct

SEQ ID NO: 6706281 - DNA, 14 bp, Homo sapiens
caggcctctgagga

SEQ ID NO: 6706282 - DNA, 12 bp, Homo sapiens
caggcctctgcc

SEQ ID NO: 6706283 - DNA, 13 bp, Homo sapiens
caggcctctgccc

SEQ ID NO: 6706284 - DNA, 14 bp, Homo sapiens
caggcctctgcccc

SEQ ID NO: 6706285 - DNA, 17 bp, Homo sapiens
caggcctctgccccaag

SEQ ID NO: 6706286 - DNA, 23 bp, Homo sapiens
caggcctctgccccaagagcagg

SEQ ID NO: 6706287 - DNA, 14 bp, Homo sapiens
caggcctctgcctg

SEQ ID NO: 6706288 - DNA, 15 bp, Homo sapiens
caggcctctgcctgc

SEQ ID NO: 6706289 - DNA, 15 bp, Homo sapiens
caggcctctgctggc

SEQ ID NO: 6706290 - DNA, 21 bp, Homo sapiens
caggcctctgctggctcagga

SEQ ID NO: 6706291 - DNA, 14 bp, Homo sapiens
caggcctctgggac

SEQ ID NO: 6706292 - DNA, 17 bp, Homo sapiens
caggcctctgggaccca

SEQ ID NO: 6706293 - DNA, 18 bp, Homo sapiens
caggcctctgggacccac

SEQ ID NO: 6706294 - DNA, 23 bp, Homo sapiens
caggcctctgggacccacagaac

SEQ ID NO: 6706295 - DNA, 23 bp, Homo sapiens
caggcctgaaagaggctgaggcc

SEQ ID NO: 6706296 - DNA, 22 bp, Homo sapiens
caggcctgaacccgtccattca

SEQ ID NO: 6706297 - DNA, 21 bp, Homo sapiens
caggcctgacccacggggcag

SEQ ID NO: 6706298 - DNA, 15 bp, Homo sapiens
caggcctgactctca

SEQ ID NO: 6706299 - DNA, 13 bp, Homo sapiens
caggcctgagaat

SEQ ID NO: 6706300 - DNA, 15 bp, Homo sapiens
caggcctgagaatga

SEQ ID NO: 6706301 - DNA, 16 bp, Homo sapiens
caggcctgagatttca

SEQ ID NO: 6706302 - DNA, 19 bp, Homo sapiens
caggcctgagatttcatct

SEQ ID NO: 6706303 - DNA, 21 bp, Homo sapiens
caggcctgagatttcatctgc

SEQ ID NO: 6706304 - DNA, 23 bp, Homo sapiens
caggcctgagatttcatctgctc

SEQ ID NO: 6706305 - DNA, 16 bp, Homo sapiens
caggcctgagctgctt

SEQ ID NO: 6706306 - DNA, 17 bp, Homo sapiens
caggcctgattcactgg

SEQ ID NO: 6706307 - DNA, 19 bp, Homo sapiens
caggcctgattcactggcc

SEQ ID NO: 6706308 - DNA, 13 bp, Homo sapiens
caggcctgcagac

SEQ ID NO: 6706309 - DNA, 19 bp, Homo sapiens
caggcctgcagacagacct

SEQ ID NO: 6706310 - DNA, 13 bp, Homo sapiens
caggcctgcagcc

SEQ ID NO: 6706311 - DNA, 14 bp, Homo sapiens
caggcctgcagccc

SEQ ID NO: 6706312 - DNA, 19 bp, Homo sapiens
caggcctgcagcccctaag

SEQ ID NO: 6706313 - DNA, 12 bp, Homo sapiens
caggcctgcagg

SEQ ID NO: 6706314 - DNA, 22 bp, Homo sapiens
caggcctgcattactccttcag

SEQ ID NO: 6706315 - DNA, 12 bp, Homo sapiens
caggcctgccaa

SEQ ID NO: 6706316 - DNA, 22 bp, Homo sapiens
caggcctgccaatgccacagcc

SEQ ID NO: 6706317 - DNA, 18 bp, Homo sapiens
caggcctgccagacggca

SEQ ID NO: 6706318 - DNA, 13 bp, Homo sapiens
caggcctgccagc

SEQ ID NO: 6706319 - DNA, 14 bp, Homo sapiens
caggcctgccctca

SEQ ID NO: 6706320 - DNA, 13 bp, Homo sapiens
caggcctgccctg

SEQ ID NO: 6706321 - DNA, 15 bp, Homo sapiens
caggcctgccctgct

SEQ ID NO: 6706322 - DNA, 13 bp, Homo sapiens
caggcctgcctcc

SEQ ID NO: 6706323 - DNA, 14 bp, Homo sapiens
caggcctgcctgca

SEQ ID NO: 6706324 - DNA, 20 bp, Homo sapiens
caggcctgcctgttcccatt

SEQ ID NO: 6706325 - DNA, 23 bp, Homo sapiens
caggcctgcgggcccctggtgat

SEQ ID NO: 6706326 - DNA, 22 bp, Homo sapiens
caggcctgcgtgcgctggttcc

SEQ ID NO: 6706327 - DNA, 17 bp, Homo sapiens
caggcctgctagtcact

SEQ ID NO: 6706328 - DNA, 12 bp, Homo sapiens
caggcctgctgg

SEQ ID NO: 6706329 - DNA, 17 bp, Homo sapiens
caggcctggacgggccc

SEQ ID NO: 6706330 - DNA, 20 bp, Homo sapiens
caggcctggcaagtgggtga

SEQ ID NO: 6706331 - DNA, 12 bp, Homo sapiens
caggcctggccc

SEQ ID NO: 6706332 - DNA, 15 bp, Homo sapiens
caggcctggcccagc

SEQ ID NO: 6706333 - DNA, 16 bp, Homo sapiens
caggcctggcccagcc

SEQ ID NO: 6706334 - DNA, 19 bp, Homo sapiens
caggcctggcccagccagc

SEQ ID NO: 6706335 - DNA, 20 bp, Homo sapiens
caggcctggcccagccagca

SEQ ID NO: 6706336 - DNA, 17 bp, Homo sapiens
caggcctggccctttca

SEQ ID NO: 6706337 - DNA, 20 bp, Homo sapiens
caggcctggcctcgcctgcc

SEQ ID NO: 6706338 - DNA, 22 bp, Homo sapiens
caggcctggcctcggggcaggg

SEQ ID NO: 6706339 - DNA, 14 bp, Homo sapiens
caggcctggcctct

SEQ ID NO: 6706340 - DNA, 15 bp, Homo sapiens
caggcctggcctctg

SEQ ID NO: 6706341 - DNA, 13 bp, Homo sapiens
caggcctggcgta

SEQ ID NO: 6706342 - DNA, 17 bp, Homo sapiens
caggcctggctccccga

SEQ ID NO: 6706343 - DNA, 18 bp, Homo sapiens
caggcctggctccccgag

SEQ ID NO: 6706344 - DNA, 19 bp, Homo sapiens
caggcctggctccccgagg

SEQ ID NO: 6706345 - DNA, 13 bp, Homo sapiens
caggcctgggacc

SEQ ID NO: 6706346 - DNA, 16 bp, Homo sapiens
caggcctgggacccag

SEQ ID NO: 6706347 - DNA, 17 bp, Homo sapiens
caggcctgggatgcagt

SEQ ID NO: 6706348 - DNA, 14 bp, Homo sapiens
caggcctgggcagg

SEQ ID NO: 6706349 - DNA, 15 bp, Homo sapiens
caggcctgggcagga

SEQ ID NO: 6706350 - DNA, 18 bp, Homo sapiens
caggcctgggcaggaccc

SEQ ID NO: 6706351 - DNA, 20 bp, Homo sapiens
caggcctgggcaggaccctg

SEQ ID NO: 6706352 - DNA, 17 bp, Homo sapiens
caggcctgggccagagt

SEQ ID NO: 6706353 - DNA, 20 bp, Homo sapiens
caggcctgggggctgggcag

SEQ ID NO: 6706354 - DNA, 23 bp, Homo sapiens
caggcctgggggctgggcagagg

SEQ ID NO: 6706355 - DNA, 13 bp, Homo sapiens
caggcctgggtca

SEQ ID NO: 6706356 - DNA, 23 bp, Homo sapiens
caggcctgggtcacgctcaagga

SEQ ID NO: 6706357 - DNA, 16 bp, Homo sapiens
caggcctgggtctgtg

SEQ ID NO: 6706358 - DNA, 10 bp, Homo sapiens
caggcctggt

SEQ ID NO: 6706359 - DNA, 20 bp, Homo sapiens
caggcctggtggagggggag

SEQ ID NO: 6706360 - DNA, 12 bp, Homo sapiens
caggcctgtcca

SEQ ID NO: 6706361 - DNA, 18 bp, Homo sapiens
caggcctgtccaccctgc

SEQ ID NO: 6706362 - DNA, 17 bp, Homo sapiens
caggcctgtccctggga

SEQ ID NO: 6706363 - DNA, 18 bp, Homo sapiens
caggcctgtccctgggag

SEQ ID NO: 6706364 - DNA, 19 bp, Homo sapiens
caggcctgtccctgggagt

SEQ ID NO: 6706365 - DNA, 15 bp, Homo sapiens
caggcctgtggctcc

SEQ ID NO: 6706366 - DNA, 20 bp, Homo sapiens
caggcctgtgtagctgtgac

SEQ ID NO: 6706367 - DNA, 22 bp, Homo sapiens
caggcctgtgtagctgtgacct

SEQ ID NO: 6706368 - DNA, 19 bp, Homo sapiens
caggcctgtgtgactccat

SEQ ID NO: 6706369 - DNA, 13 bp, Homo sapiens
caggcctgttccc

SEQ ID NO: 6706370 - DNA, 14 bp, Homo sapiens
caggcctgttgctt

SEQ ID NO: 6706371 - DNA, 16 bp, Homo sapiens
caggcctgttgctttt

SEQ ID NO: 6706372 - DNA, 20 bp, Homo sapiens
caggccttacatctggctgg

SEQ ID NO: 6706373 - DNA, 19 bp, Homo sapiens
caggccttagtacggctgc

SEQ ID NO: 6706374 - DNA, 21 bp, Homo sapiens
caggccttagtacggctgctg

SEQ ID NO: 6706375 - DNA, 17 bp, Homo sapiens
caggccttatctccaag

SEQ ID NO: 6706376 - DNA, 18 bp, Homo sapiens
caggccttatctgaaagg

SEQ ID NO: 6706377 - DNA, 22 bp, Homo sapiens
caggccttcatcctcctcccca

SEQ ID NO: 6706378 - DNA, 16 bp, Homo sapiens
caggccttgagcacaa

SEQ ID NO: 6706379 - DNA, 16 bp, Homo sapiens
caggccttgcctggga

SEQ ID NO: 6706380 - DNA, 11 bp, Homo sapiens
caggccttgcg

SEQ ID NO: 6706381 - DNA, 23 bp, Homo sapiens
caggccttgctgactctctgagc

SEQ ID NO: 6706382 - DNA, 21 bp, Homo sapiens
caggccttgctggggtccagg

SEQ ID NO: 6706383 - DNA, 22 bp, Homo sapiens
caggccttgctggggtccaggg

SEQ ID NO: 6706384 - DNA, 23 bp, Homo sapiens
caggccttgtcctacgtccaagg

SEQ ID NO: 6706385 - DNA, 17 bp, Homo sapiens
caggcctttcaggaagg

SEQ ID NO: 6706386 - DNA, 22 bp, Homo sapiens
caggcctttcaggaagggagag

SEQ ID NO: 6706387 - DNA, 15 bp, Homo sapiens
caggcctttccctgc

SEQ ID NO: 6706388 - DNA, 12 bp, Homo sapiens
caggcctttcct

SEQ ID NO: 6706389 - DNA, 22 bp, Homo sapiens
caggcctttggaggggaaatgg

SEQ ID NO: 6706390 - DNA, 20 bp, Homo sapiens
caggcgagagaggagccaga

SEQ ID NO: 6706391 - DNA, 16 bp, Homo sapiens
caggcgatccacctgt

SEQ ID NO: 6706392 - DNA, 23 bp, Homo sapiens
caggcgatggggcaagacagaaa

SEQ ID NO: 6706393 - DNA, 16 bp, Homo sapiens
caggcgcagaggtccc

SEQ ID NO: 6706394 - DNA, 13 bp, Homo sapiens
caggcgcagccct

SEQ ID NO: 6706395 - DNA, 14 bp, Homo sapiens
caggcgcagcccta

SEQ ID NO: 6706396 - DNA, 23 bp, Homo sapiens
caggcgcatgagtatctgtggga

SEQ ID NO: 6706397 - DNA, 16 bp, Homo sapiens
caggcgcatgtctgca

SEQ ID NO: 6706398 - DNA, 23 bp, Homo sapiens
caggcgcatgtctgcacctccgc

SEQ ID NO: 6706399 - DNA, 15 bp, Homo sapiens
caggcgccccttccc

SEQ ID NO: 6706400 - DNA, 18 bp, Homo sapiens
caggcgccgcctcgcccc

SEQ ID NO: 6706401 - DNA, 24 bp, Homo sapiens
caggcgcctataatcccagctact

SEQ ID NO: 6706402 - DNA, 15 bp, Homo sapiens
caggcgcctgccatc

SEQ ID NO: 6706403 - DNA, 16 bp, Homo sapiens
caggcgcctggcacat

SEQ ID NO: 6706404 - DNA, 17 bp, Homo sapiens
caggcgcctggcacatt

SEQ ID NO: 6706405 - DNA, 18 bp, Homo sapiens
caggcgcctggcacattt

SEQ ID NO: 6706406 - DNA, 21 bp, Homo sapiens
caggcgcctggcacatttcag

SEQ ID NO: 6706407 - DNA, 15 bp, Homo sapiens
caggcgctaattcaa

SEQ ID NO: 6706408 - DNA, 16 bp, Homo sapiens
caggcgctagcacagc

SEQ ID NO: 6706409 - DNA, 20 bp, Homo sapiens
caggcgctagcacagctccc

SEQ ID NO: 6706410 - DNA, 12 bp, Homo sapiens
caggcgctgcat

SEQ ID NO: 6706411 - DNA, 23 bp, Homo sapiens
caggcgctgcggacaccgtggcc

SEQ ID NO: 6706412 - DNA, 19 bp, Homo sapiens
caggcgctgggggctggac

SEQ ID NO: 6706413 - DNA, 23 bp, Homo sapiens
caggcgcttctccaatgctctgg

SEQ ID NO: 6706414 - DNA, 22 bp, Homo sapiens
caggcggagctgctgagtgaca

SEQ ID NO: 6706415 - DNA, 13 bp, Homo sapiens
caggcggaggggc

SEQ ID NO: 6706416 - DNA, 20 bp, Homo sapiens
caggcggaggggcttggagc

SEQ ID NO: 6706417 - DNA, 12 bp, Homo sapiens
caggcggccagg

SEQ ID NO: 6706418 - DNA, 17 bp, Homo sapiens
caggcggccagggcggc

SEQ ID NO: 6706419 - DNA, 19 bp, Homo sapiens
caggcggccagggcggcca

SEQ ID NO: 6706420 - DNA, 17 bp, Homo sapiens
caggcggccctcagtgc

SEQ ID NO: 6706421 - DNA, 21 bp, Homo sapiens
caggcggccctcagtgcatcc

SEQ ID NO: 6706422 - DNA, 23 bp, Homo sapiens
caggcggccctcagtgcatcccc

SEQ ID NO: 6706423 - DNA, 14 bp, Homo sapiens
caggcggccctggg

SEQ ID NO: 6706424 - DNA, 13 bp, Homo sapiens
caggcggctcctc

SEQ ID NO: 6706425 - DNA, 20 bp, Homo sapiens
caggcgggactatcaggagt

SEQ ID NO: 6706426 - DNA, 23 bp, Homo sapiens
caggcgggagatggacccctccc

SEQ ID NO: 6706427 - DNA, 13 bp, Homo sapiens
caggcgggagggg

SEQ ID NO: 6706428 - DNA, 20 bp, Homo sapiens
caggcgggccggggcaggga

SEQ ID NO: 6706429 - DNA, 12 bp, Homo sapiens
caggcggggagg

SEQ ID NO: 6706430 - DNA, 15 bp, Homo sapiens
caggcggggaggagg

SEQ ID NO: 6706431 - DNA, 16 bp, Homo sapiens
caggcggggaggagga

SEQ ID NO: 6706432 - DNA, 20 bp, Homo sapiens
caggcggggaggaggagctg

SEQ ID NO: 6706433 - DNA, 22 bp, Homo sapiens
caggcggggcccagcgctctcc

SEQ ID NO: 6706434 - DNA, 15 bp, Homo sapiens
caggcggggctcctc

SEQ ID NO: 6706435 - DNA, 23 bp, Homo sapiens
caggcggggctcctcctgaagga

SEQ ID NO: 6706436 - DNA, 19 bp, Homo sapiens
caggcggggtgctgtggtg

SEQ ID NO: 6706437 - DNA, 20 bp, Homo sapiens
caggcggtatccagaggtga

SEQ ID NO: 6706438 - DNA, 16 bp, Homo sapiens
caggcggtcactgccc

SEQ ID NO: 6706439 - DNA, 18 bp, Homo sapiens
caggcggtcactgcccac

SEQ ID NO: 6706440 - DNA, 22 bp, Homo sapiens
caggcggtgaggagtccagcac

SEQ ID NO: 6706441 - DNA, 15 bp, Homo sapiens
caggcggtgggcacc

SEQ ID NO: 6706442 - DNA, 18 bp, Homo sapiens
caggcgtagggccagggc

SEQ ID NO: 6706443 - DNA, 14 bp, Homo sapiens
caggcgtctgccac

SEQ ID NO: 6706444 - DNA, 13 bp, Homo sapiens
caggcgtgagcca

SEQ ID NO: 6706445 - DNA, 18 bp, Homo sapiens
caggcgtgagccacctcg

SEQ ID NO: 6706446 - DNA, 20 bp, Homo sapiens
caggcgtgggacgtggtcag

SEQ ID NO: 6706447 - DNA, 19 bp, Homo sapiens
caggcgtgtggcagccaca

SEQ ID NO: 6706448 - DNA, 23 bp, Homo sapiens
caggcgtgtggcagccacacgca

SEQ ID NO: 6706449 - DNA, 19 bp, Homo sapiens
caggcgttcagctcactgt

SEQ ID NO: 6706450 - DNA, 14 bp, Homo sapiens
caggcgttctcagc

SEQ ID NO: 6706451 - DNA, 23 bp, Homo sapiens
caggctaaacatccaatattttc

SEQ ID NO: 6706452 - DNA, 15 bp, Homo sapiens
caggctaagaccctg

SEQ ID NO: 6706453 - DNA, 24 bp, Homo sapiens
caggctaagaccctgtgtcctcca

SEQ ID NO: 6706454 - DNA, 13 bp, Homo sapiens
caggctaattttt

SEQ ID NO: 6706455 - DNA, 14 bp, Homo sapiens
caggctacaaagca

SEQ ID NO: 6706456 - DNA, 18 bp, Homo sapiens
caggctacaaagcagaga

SEQ ID NO: 6706457 - DNA, 16 bp, Homo sapiens
caggctacaagagaac

SEQ ID NO: 6706458 - DNA, 21 bp, Homo sapiens
caggctacaatcttcatttaa

SEQ ID NO: 6706459 - DNA, 16 bp, Homo sapiens
caggctactctcctcg

SEQ ID NO: 6706460 - DNA, 18 bp, Homo sapiens
caggctactctcctcggc

SEQ ID NO: 6706461 - DNA, 18 bp, Homo sapiens
caggctactgttcttgac

SEQ ID NO: 6706462 - DNA, 14 bp, Homo sapiens
caggctagagtgca

SEQ ID NO: 6706463 - DNA, 19 bp, Homo sapiens
caggctagatgtatgtact

SEQ ID NO: 6706464 - DNA, 17 bp, Homo sapiens
caggctagctggagcct

SEQ ID NO: 6706465 - DNA, 16 bp, Homo sapiens
caggctagctgtgctg

SEQ ID NO: 6706466 - DNA, 21 bp, Homo sapiens
caggctaggccagcaggggct

SEQ ID NO: 6706467 - DNA, 22 bp, Homo sapiens
caggctaggccagcaggggctg

SEQ ID NO: 6706468 - DNA, 18 bp, Homo sapiens
caggctatggttgccacc

SEQ ID NO: 6706469 - DNA, 19 bp, Homo sapiens
caggctatggttgccaccc

SEQ ID NO: 6706470 - DNA, 20 bp, Homo sapiens
caggctatggttgccacccc

SEQ ID NO: 6706471 - DNA, 22 bp, Homo sapiens
caggctatggttgccaccccaa

SEQ ID NO: 6706472 - DNA, 21 bp, Homo sapiens
caggctcaagctatccttgca

SEQ ID NO: 6706473 - DNA, 15 bp, Homo sapiens
caggctcaagttttt

SEQ ID NO: 6706474 - DNA, 15 bp, Homo sapiens
caggctcactcacag

SEQ ID NO: 6706475 - DNA, 16 bp, Homo sapiens
caggctcactcacaga

SEQ ID NO: 6706476 - DNA, 13 bp, Homo sapiens
caggctcactgcc

SEQ ID NO: 6706477 - DNA, 16 bp, Homo sapiens
caggctcagactctgg

SEQ ID NO: 6706478 - DNA, 15 bp, Homo sapiens
caggctcagagggtg

SEQ ID NO: 6706479 - DNA, 12 bp, Homo sapiens
caggctcagcat

SEQ ID NO: 6706480 - DNA, 17 bp, Homo sapiens
caggctcaggctgccca

SEQ ID NO: 6706481 - DNA, 22 bp, Homo sapiens
caggctcatagggaagacctgc

SEQ ID NO: 6706482 - DNA, 14 bp, Homo sapiens
caggctccaatggg

SEQ ID NO: 6706483 - DNA, 23 bp, Homo sapiens
caggctccaatggggcggggctt

SEQ ID NO: 6706484 - DNA, 14 bp, Homo sapiens
caggctccagcaca

SEQ ID NO: 6706485 - DNA, 14 bp, Homo sapiens
caggctccaggctg

SEQ ID NO: 6706486 - DNA, 14 bp, Homo sapiens
caggctccagttga

SEQ ID NO: 6706487 - DNA, 14 bp, Homo sapiens
caggctccatgcac

SEQ ID NO: 6706488 - DNA, 16 bp, Homo sapiens
caggctccatgcacct

SEQ ID NO: 6706489 - DNA, 19 bp, Homo sapiens
caggctccatgcacctccc

SEQ ID NO: 6706490 - DNA, 12 bp, Homo sapiens
caggctccatgg

SEQ ID NO: 6706491 - DNA, 14 bp, Homo sapiens
caggctccatgggg

SEQ ID NO: 6706492 - DNA, 18 bp, Homo sapiens
caggctccatggggaagt

SEQ ID NO: 6706493 - DNA, 23 bp, Homo sapiens
caggctccatggggaagtgctcc

SEQ ID NO: 6706494 - DNA, 22 bp, Homo sapiens
caggctcccactgcccctgcac

SEQ ID NO: 6706495 - DNA, 20 bp, Homo sapiens
caggctcccagcctaaggga

SEQ ID NO: 6706496 - DNA, 21 bp, Homo sapiens
caggctcccagcctaagggag

SEQ ID NO: 6706497 - DNA, 14 bp, Homo sapiens
caggctcccaggga

SEQ ID NO: 6706498 - DNA, 19 bp, Homo sapiens
caggctcccagggacacct

SEQ ID NO: 6706499 - DNA, 14 bp, Homo sapiens
caggctccccaaga

SEQ ID NO: 6706500 - DNA, 18 bp, Homo sapiens
caggctccccaagacttg

SEQ ID NO: 6706501 - DNA, 16 bp, Homo sapiens
caggctcccgacccca

SEQ ID NO: 6706502 - DNA, 20 bp, Homo sapiens
caggctcccgaccccatcca

SEQ ID NO: 6706503 - DNA, 19 bp, Homo sapiens
caggctccctgaccaccct

SEQ ID NO: 6706504 - DNA, 16 bp, Homo sapiens
caggctccgcccttag

SEQ ID NO: 6706505 - DNA, 21 bp, Homo sapiens
caggctccgggcaccaggggc

SEQ ID NO: 6706506 - DNA, 22 bp, Homo sapiens
caggctccgggcaccaggggcc

SEQ ID NO: 6706507 - DNA, 14 bp, Homo sapiens
caggctccgggctt

SEQ ID NO: 6706508 - DNA, 22 bp, Homo sapiens
caggctcctacctgtctgctgc

SEQ ID NO: 6706509 - DNA, 20 bp, Homo sapiens
caggctcctcagccctctct

SEQ ID NO: 6706510 - DNA, 21 bp, Homo sapiens
caggctcctcagccctctctt

SEQ ID NO: 6706511 - DNA, 13 bp, Homo sapiens
caggctcctccct

SEQ ID NO: 6706512 - DNA, 14 bp, Homo sapiens
caggctcctccctc

SEQ ID NO: 6706513 - DNA, 15 bp, Homo sapiens
caggctcctgccacc

SEQ ID NO: 6706514 - DNA, 15 bp, Homo sapiens
caggctcctggctgt

SEQ ID NO: 6706515 - DNA, 19 bp, Homo sapiens
caggctcctggctgtgccc

SEQ ID NO: 6706516 - DNA, 23 bp, Homo sapiens
caggctcctggctgtgcccagca

SEQ ID NO: 6706517 - DNA, 24 bp, Homo sapiens
caggctcctggctgtgcccagcag

SEQ ID NO: 6706518 - DNA, 12 bp, Homo sapiens
caggctccttcc

SEQ ID NO: 6706519 - DNA, 14 bp, Homo sapiens
caggctccttcctg

SEQ ID NO: 6706520 - DNA, 17 bp, Homo sapiens
caggctccttcctgtct

SEQ ID NO: 6706521 - DNA, 18 bp, Homo sapiens
caggctccttcctgtctt

SEQ ID NO: 6706522 - DNA, 15 bp, Homo sapiens
caggctcgccaaggc

SEQ ID NO: 6706523 - DNA, 16 bp, Homo sapiens
caggctcggcctgccc

SEQ ID NO: 6706524 - DNA, 19 bp, Homo sapiens
caggctcggcctgccccca

SEQ ID NO: 6706525 - DNA, 20 bp, Homo sapiens
caggctcgggctccccagcc

SEQ ID NO: 6706526 - DNA, 17 bp, Homo sapiens
caggctctagagagagg

SEQ ID NO: 6706527 - DNA, 14 bp, Homo sapiens
caggctctcaacag

SEQ ID NO: 6706528 - DNA, 23 bp, Homo sapiens
caggctctcaggccagctgcttg

SEQ ID NO: 6706529 - DNA, 13 bp, Homo sapiens
caggctctccatt

SEQ ID NO: 6706530 - DNA, 18 bp, Homo sapiens
caggctctccctctctgc

SEQ ID NO: 6706531 - DNA, 14 bp, Homo sapiens
caggctctctcctc

SEQ ID NO: 6706532 - DNA, 15 bp, Homo sapiens
caggctctctgggct

SEQ ID NO: 6706533 - DNA, 17 bp, Homo sapiens
caggctctgagacacac

SEQ ID NO: 6706534 - DNA, 18 bp, Homo sapiens
caggctctgagacacacc

SEQ ID NO: 6706535 - DNA, 14 bp, Homo sapiens
caggctctgcacag

SEQ ID NO: 6706536 - DNA, 17 bp, Homo sapiens
caggctctgcacagaca

SEQ ID NO: 6706537 - DNA, 13 bp, Homo sapiens
caggctctgccct

SEQ ID NO: 6706538 - DNA, 15 bp, Homo sapiens
caggctctgccctgc

SEQ ID NO: 6706539 - DNA, 13 bp, Homo sapiens
caggctctgctga

SEQ ID NO: 6706540 - DNA, 17 bp, Homo sapiens
caggctctgctgacttc

SEQ ID NO: 6706541 - DNA, 18 bp, Homo sapiens
caggctctggagccagag

SEQ ID NO: 6706542 - DNA, 18 bp, Homo sapiens
caggctctgggaaggggt

SEQ ID NO: 6706543 - DNA, 13 bp, Homo sapiens
caggctctgggca

SEQ ID NO: 6706544 - DNA, 14 bp, Homo sapiens
caggctctgggcac

SEQ ID NO: 6706545 - DNA, 17 bp, Homo sapiens
caggctctgggcacagt

SEQ ID NO: 6706546 - DNA, 22 bp, Homo sapiens
caggctctgggcacagtgctgc

SEQ ID NO: 6706547 - DNA, 14 bp, Homo sapiens
caggctctgggctc

SEQ ID NO: 6706548 - DNA, 17 bp, Homo sapiens
caggctctgggctcagg

SEQ ID NO: 6706549 - DNA, 19 bp, Homo sapiens
caggctctgggctcagggc

SEQ ID NO: 6706550 - DNA, 13 bp, Homo sapiens
caggctctgtgct

SEQ ID NO: 6706551 - DNA, 21 bp, Homo sapiens
caggctctgtgctgaccctcc

SEQ ID NO: 6706552 - DNA, 23 bp, Homo sapiens
caggctctgtgctgaccctcctg

SEQ ID NO: 6706553 - DNA, 13 bp, Homo sapiens
caggctctgtgga

SEQ ID NO: 6706554 - DNA, 16 bp, Homo sapiens
caggctctgttcctca

SEQ ID NO: 6706555 - DNA, 12 bp, Homo sapiens
caggctcttagc

SEQ ID NO: 6706556 - DNA, 22 bp, Homo sapiens
caggctcttagcagcttccaga

SEQ ID NO: 6706557 - DNA, 21 bp, Homo sapiens
caggctcttccttgaatcttc

SEQ ID NO: 6706558 - DNA, 12 bp, Homo sapiens
caggctcttctc

SEQ ID NO: 6706559 - DNA, 15 bp, Homo sapiens
caggctcttctcctt

SEQ ID NO: 6706560 - DNA, 18 bp, Homo sapiens
caggctcttctcctttca

SEQ ID NO: 6706561 - DNA, 22 bp, Homo sapiens
caggctcttctcctttcacaac

SEQ ID NO: 6706562 - DNA, 19 bp, Homo sapiens
caggctcttctttcccaaa

SEQ ID NO: 6706563 - DNA, 22 bp, Homo sapiens
caggctctttggggtcagccag

SEQ ID NO: 6706564 - DNA, 23 bp, Homo sapiens
caggctctttggggtcagccagg

SEQ ID NO: 6706565 - DNA, 22 bp, Homo sapiens
caggctgaaatatccacccagc

SEQ ID NO: 6706566 - DNA, 16 bp, Homo sapiens
caggctgaagagaggg

SEQ ID NO: 6706567 - DNA, 18 bp, Homo sapiens
caggctgaagcaggttcc

SEQ ID NO: 6706568 - DNA, 19 bp, Homo sapiens
caggctgaattacagtgaa

SEQ ID NO: 6706569 - DNA, 14 bp, Homo sapiens
caggctgaccacag

SEQ ID NO: 6706570 - DNA, 17 bp, Homo sapiens
caggctgacgttccggg

SEQ ID NO: 6706571 - DNA, 15 bp, Homo sapiens
caggctgactggggg

SEQ ID NO: 6706572 - DNA, 23 bp, Homo sapiens
caggctgagaactcgttcacctc

SEQ ID NO: 6706573 - DNA, 22 bp, Homo sapiens
caggctgagacacagcccagag

SEQ ID NO: 6706574 - DNA, 23 bp, Homo sapiens
caggctgagacacagcccagaga

SEQ ID NO: 6706575 - DNA, 17 bp, Homo sapiens
caggctgagagccggcc

SEQ ID NO: 6706576 - DNA, 12 bp, Homo sapiens
caggctgagcca

SEQ ID NO: 6706577 - DNA, 17 bp, Homo sapiens
caggctgagccatgagg

SEQ ID NO: 6706578 - DNA, 19 bp, Homo sapiens
caggctgagccatgaggag

SEQ ID NO: 6706579 - DNA, 20 bp, Homo sapiens
caggctgagccatgaggagc

SEQ ID NO: 6706580 - DNA, 13 bp, Homo sapiens
caggctgagccca

SEQ ID NO: 6706581 - DNA, 15 bp, Homo sapiens
caggctgagcccagc

SEQ ID NO: 6706582 - DNA, 17 bp, Homo sapiens
caggctgagcccagcca

SEQ ID NO: 6706583 - DNA, 21 bp, Homo sapiens
caggctgagcccagccacctc

SEQ ID NO: 6706584 - DNA, 14 bp, Homo sapiens
caggctgagcctca

SEQ ID NO: 6706585 - DNA, 15 bp, Homo sapiens
caggctgagcctcag

SEQ ID NO: 6706586 - DNA, 19 bp, Homo sapiens
caggctgaggcatgagaat

SEQ ID NO: 6706587 - DNA, 15 bp, Homo sapiens
caggctgagtgagcc

SEQ ID NO: 6706588 - DNA, 20 bp, Homo sapiens
caggctgagtgagccacaga

SEQ ID NO: 6706589 - DNA, 23 bp, Homo sapiens
caggctgagtgcactggcaggat

SEQ ID NO: 6706590 - DNA, 17 bp, Homo sapiens
caggctgagtgcaggcc

SEQ ID NO: 6706591 - DNA, 22 bp, Homo sapiens
caggctgagtgcaggcccaccc

SEQ ID NO: 6706592 - DNA, 23 bp, Homo sapiens
caggctgagtgcaggcccaccct

SEQ ID NO: 6706593 - DNA, 13 bp, Homo sapiens
caggctgcaaccc

SEQ ID NO: 6706594 - DNA, 20 bp, Homo sapiens
caggctgcacctctggctag

SEQ ID NO: 6706595 - DNA, 13 bp, Homo sapiens
caggctgcactgc

SEQ ID NO: 6706596 - DNA, 16 bp, Homo sapiens
caggctgcactgcagt

SEQ ID NO: 6706597 - DNA, 14 bp, Homo sapiens
caggctgcagagcc

SEQ ID NO: 6706598 - DNA, 15 bp, Homo sapiens
caggctgcagagccc

SEQ ID NO: 6706599 - DNA, 17 bp, Homo sapiens
caggctgcagagcccgg

SEQ ID NO: 6706600 - DNA, 22 bp, Homo sapiens
caggctgcagagcccggcccca

SEQ ID NO: 6706601 - DNA, 15 bp, Homo sapiens
caggctgcagcaggc

SEQ ID NO: 6706602 - DNA, 18 bp, Homo sapiens
caggctgcagcaggcaga

SEQ ID NO: 6706603 - DNA, 21 bp, Homo sapiens
caggctgcagcaggcagagga

SEQ ID NO: 6706604 - DNA, 23 bp, Homo sapiens
caggctgcagcaggcagaggaga

SEQ ID NO: 6706605 - DNA, 16 bp, Homo sapiens
caggctgcagcctcca

SEQ ID NO: 6706606 - DNA, 14 bp, Homo sapiens
caggctgcagctgg

SEQ ID NO: 6706607 - DNA, 20 bp, Homo sapiens
caggctgcagctggacagag

SEQ ID NO: 6706608 - DNA, 16 bp, Homo sapiens
caggctgcagtggctc

SEQ ID NO: 6706609 - DNA, 21 bp, Homo sapiens
caggctgcatagaaggaggag

SEQ ID NO: 6706610 - DNA, 14 bp, Homo sapiens
caggctgccagtgc

SEQ ID NO: 6706611 - DNA, 18 bp, Homo sapiens
caggctgcccccaacact

SEQ ID NO: 6706612 - DNA, 22 bp, Homo sapiens
caggctgcccccaacactccag

SEQ ID NO: 6706613 - DNA, 16 bp, Homo sapiens
caggctgccgtggggc

SEQ ID NO: 6706614 - DNA, 19 bp, Homo sapiens
caggctgcctcatgaccct

SEQ ID NO: 6706615 - DNA, 21 bp, Homo sapiens
caggctgcctcatgaccctcc

SEQ ID NO: 6706616 - DNA, 15 bp, Homo sapiens
caggctgcctcggac

SEQ ID NO: 6706617 - DNA, 12 bp, Homo sapiens
caggctgcctga

SEQ ID NO: 6706618 - DNA, 15 bp, Homo sapiens
caggctgcctgagca

SEQ ID NO: 6706619 - DNA, 13 bp, Homo sapiens
caggctgcgcctg

SEQ ID NO: 6706620 - DNA, 15 bp, Homo sapiens
caggctgcggcccct

SEQ ID NO: 6706621 - DNA, 20 bp, Homo sapiens
caggctgcggtgggcagcca

SEQ ID NO: 6706622 - DNA, 16 bp, Homo sapiens
caggctgctccttctc

SEQ ID NO: 6706623 - DNA, 23 bp, Homo sapiens
caggctgctcttgaactcctgac

SEQ ID NO: 6706624 - DNA, 15 bp, Homo sapiens
caggctgctggagga

SEQ ID NO: 6706625 - DNA, 12 bp, Homo sapiens
caggctgctggc

SEQ ID NO: 6706626 - DNA, 16 bp, Homo sapiens
caggctgctggcgcct

SEQ ID NO: 6706627 - DNA, 20 bp, Homo sapiens
caggctgctggcgcctctgc

SEQ ID NO: 6706628 - DNA, 20 bp, Homo sapiens
caggctggaatgagggaggc

SEQ ID NO: 6706629 - DNA, 16 bp, Homo sapiens
caggctggacaccctc

SEQ ID NO: 6706630 - DNA, 19 bp, Homo sapiens
caggctggacaccctctgc

SEQ ID NO: 6706631 - DNA, 15 bp, Homo sapiens
caggctggagactgg

SEQ ID NO: 6706632 - DNA, 18 bp, Homo sapiens
caggctggagagcactgc

SEQ ID NO: 6706633 - DNA, 22 bp, Homo sapiens
caggctggagataacagcctct

SEQ ID NO: 6706634 - DNA, 19 bp, Homo sapiens
caggctggagattttcaca

SEQ ID NO: 6706635 - DNA, 13 bp, Homo sapiens
caggctggagtga

SEQ ID NO: 6706636 - DNA, 16 bp, Homo sapiens
caggctggagtgcagt

SEQ ID NO: 6706637 - DNA, 20 bp, Homo sapiens
caggctggagtgcagtggct

SEQ ID NO: 6706638 - DNA, 13 bp, Homo sapiens
caggctggatgct

SEQ ID NO: 6706639 - DNA, 15 bp, Homo sapiens
caggctggatgctgg

SEQ ID NO: 6706640 - DNA, 17 bp, Homo sapiens
caggctggatgctgggt

SEQ ID NO: 6706641 - DNA, 21 bp, Homo sapiens
caggctggcatctcccccacc

SEQ ID NO: 6706642 - DNA, 13 bp, Homo sapiens
caggctggccagc

SEQ ID NO: 6706643 - DNA, 16 bp, Homo sapiens
caggctggccagcccc

SEQ ID NO: 6706644 - DNA, 19 bp, Homo sapiens
caggctggccagccccaca

SEQ ID NO: 6706645 - DNA, 20 bp, Homo sapiens
caggctggccagccccacag

SEQ ID NO: 6706646 - DNA, 21 bp, Homo sapiens
caggctggccagccccacagc

SEQ ID NO: 6706647 - DNA, 21 bp, Homo sapiens
caggctggccagtccaggctg

SEQ ID NO: 6706648 - DNA, 24 bp, Homo sapiens
caggctggccagtgctgcccatga

SEQ ID NO: 6706649 - DNA, 19 bp, Homo sapiens
caggctggcccccacccac

SEQ ID NO: 6706650 - DNA, 14 bp, Homo sapiens
caggctggccctgc

SEQ ID NO: 6706651 - DNA, 17 bp, Homo sapiens
caggctggccctgccct

SEQ ID NO: 6706652 - DNA, 18 bp, Homo sapiens
caggctggccctgccctg

SEQ ID NO: 6706653 - DNA, 20 bp, Homo sapiens
caggctggccctgccctggt

SEQ ID NO: 6706654 - DNA, 12 bp, Homo sapiens
caggctggccga

SEQ ID NO: 6706655 - DNA, 12 bp, Homo sapiens
caggctggcctg

SEQ ID NO: 6706656 - DNA, 21 bp, Homo sapiens
caggctggcctggggtcaggc

SEQ ID NO: 6706657 - DNA, 20 bp, Homo sapiens
caggctggcgcagccaaggc

SEQ ID NO: 6706658 - DNA, 21 bp, Homo sapiens
caggctggcgcagccaaggcc

SEQ ID NO: 6706659 - DNA, 17 bp, Homo sapiens
caggctggcgtgcagtg

SEQ ID NO: 6706660 - DNA, 18 bp, Homo sapiens
caggctggcgtgcagtgg

SEQ ID NO: 6706661 - DNA, 16 bp, Homo sapiens
caggctggcttgcccg

SEQ ID NO: 6706662 - DNA, 18 bp, Homo sapiens
caggctgggaactcatct

SEQ ID NO: 6706663 - DNA, 13 bp, Homo sapiens
caggctgggacag

SEQ ID NO: 6706664 - DNA, 12 bp, Homo sapiens
caggctgggaga

SEQ ID NO: 6706665 - DNA, 20 bp, Homo sapiens
caggctgggagagccttcca

SEQ ID NO: 6706666 - DNA, 23 bp, Homo sapiens
caggctgggagagccttccaggg

SEQ ID NO: 6706667 - DNA, 10 bp, Homo sapiens
caggctgggc

SEQ ID NO: 6706668 - DNA, 22 bp, Homo sapiens
caggctgggcacggctccgagg

SEQ ID NO: 6706669 - DNA, 14 bp, Homo sapiens
caggctgggcagcc

SEQ ID NO: 6706670 - DNA, 19 bp, Homo sapiens
caggctgggcagccccaga

SEQ ID NO: 6706671 - DNA, 22 bp, Homo sapiens
caggctgggcagccccagagag

SEQ ID NO: 6706672 - DNA, 18 bp, Homo sapiens
caggctgggccatgtcca

SEQ ID NO: 6706673 - DNA, 22 bp, Homo sapiens
caggctgggccatgtccaaaga

SEQ ID NO: 6706674 - DNA, 12 bp, Homo sapiens
caggctgggccc

SEQ ID NO: 6706675 - DNA, 22 bp, Homo sapiens
caggctgggccgcaagggcctg

SEQ ID NO: 6706676 - DNA, 22 bp, Homo sapiens
caggctgggctctgcctgtctg

SEQ ID NO: 6706677 - DNA, 23 bp, Homo sapiens
caggctgggctctgcctgtctgg

SEQ ID NO: 6706678 - DNA, 13 bp, Homo sapiens
caggctgggctgg

SEQ ID NO: 6706679 - DNA, 21 bp, Homo sapiens
caggctgggctgttcactctc

SEQ ID NO: 6706680 - DNA, 17 bp, Homo sapiens
caggctgggcttcagtg

SEQ ID NO: 6706681 - DNA, 21 bp, Homo sapiens
caggctgggcttcagtggcag

SEQ ID NO: 6706682 - DNA, 18 bp, Homo sapiens
caggctggggaggtgctg

SEQ ID NO: 6706683 - DNA, 14 bp, Homo sapiens
caggctggggcctg

SEQ ID NO: 6706684 - DNA, 19 bp, Homo sapiens
caggctggggcctggccta

SEQ ID NO: 6706685 - DNA, 13 bp, Homo sapiens
caggctggggctg

SEQ ID NO: 6706686 - DNA, 21 bp, Homo sapiens
caggctgggtcaaaagagccc

SEQ ID NO: 6706687 - DNA, 15 bp, Homo sapiens
caggctgggtcctgc

SEQ ID NO: 6706688 - DNA, 16 bp, Homo sapiens
caggctgggtcctgcc

SEQ ID NO: 6706689 - DNA, 18 bp, Homo sapiens
caggctgggtcctgccag

SEQ ID NO: 6706690 - DNA, 18 bp, Homo sapiens
caggctgggtgacagagc

SEQ ID NO: 6706691 - DNA, 18 bp, Homo sapiens
caggctgggttgtcactg

SEQ ID NO: 6706692 - DNA, 14 bp, Homo sapiens
caggctggtctcaa

SEQ ID NO: 6706693 - DNA, 23 bp, Homo sapiens
caggctggtctcaaactcctgac

SEQ ID NO: 6706694 - DNA, 14 bp, Homo sapiens
caggctggtctcga

SEQ ID NO: 6706695 - DNA, 16 bp, Homo sapiens
caggctggtctgaaac

SEQ ID NO: 6706696 - DNA, 22 bp, Homo sapiens
caggctggtcttgaactcctga

SEQ ID NO: 6706697 - DNA, 23 bp, Homo sapiens
caggctggtcttgaactcctgac

SEQ ID NO: 6706698 - DNA, 18 bp, Homo sapiens
caggctggtgggaggggc

SEQ ID NO: 6706699 - DNA, 23 bp, Homo sapiens
caggctggtttcaaactcctgac

SEQ ID NO: 6706700 - DNA, 22 bp, Homo sapiens
caggctgtaagcattctgagct

SEQ ID NO: 6706701 - DNA, 16 bp, Homo sapiens
caggctgtcagcgcct

SEQ ID NO: 6706702 - DNA, 16 bp, Homo sapiens
caggctgtcccaagct

SEQ ID NO: 6706703 - DNA, 16 bp, Homo sapiens
caggctgtctggccag

SEQ ID NO: 6706704 - DNA, 19 bp, Homo sapiens
caggctgtgactcttctct

SEQ ID NO: 6706705 - DNA, 22 bp, Homo sapiens
caggctgtgcgctgacaaccac

SEQ ID NO: 6706706 - DNA, 19 bp, Homo sapiens
caggctgtggggtggagca

SEQ ID NO: 6706707 - DNA, 14 bp, Homo sapiens
caggctgtgtactt

SEQ ID NO: 6706708 - DNA, 16 bp, Homo sapiens
caggctgttctcagcg

SEQ ID NO: 6706709 - DNA, 15 bp, Homo sapiens
caggctgttctccag

SEQ ID NO: 6706710 - DNA, 16 bp, Homo sapiens
caggctgttctccagg

SEQ ID NO: 6706711 - DNA, 22 bp, Homo sapiens
caggctgttcttcaactcctgg

SEQ ID NO: 6706712 - DNA, 23 bp, Homo sapiens
caggctgttcttcaactcctggg

SEQ ID NO: 6706713 - DNA, 22 bp, Homo sapiens
caggctgttggaaaatccagaa

SEQ ID NO: 6706714 - DNA, 13 bp, Homo sapiens
caggctgtttcag

SEQ ID NO: 6706715 - DNA, 15 bp, Homo sapiens
caggctgtttcagcc

SEQ ID NO: 6706716 - DNA, 16 bp, Homo sapiens
caggcttagggacagg

SEQ ID NO: 6706717 - DNA, 17 bp, Homo sapiens
caggcttagggacagga

SEQ ID NO: 6706718 - DNA, 17 bp, Homo sapiens
caggcttagtcactgag

SEQ ID NO: 6706719 - DNA, 23 bp, Homo sapiens
caggcttagtcactgagacagcc

SEQ ID NO: 6706720 - DNA, 18 bp, Homo sapiens
caggcttatttttaaaat

SEQ ID NO: 6706721 - DNA, 20 bp, Homo sapiens
caggcttatttttaaaataa

SEQ ID NO: 6706722 - DNA, 21 bp, Homo sapiens
caggcttatttttaaaataaa

SEQ ID NO: 6706723 - DNA, 22 bp, Homo sapiens
caggcttcaccctgaatggttc

SEQ ID NO: 6706724 - DNA, 12 bp, Homo sapiens
caggcttccaca

SEQ ID NO: 6706725 - DNA, 20 bp, Homo sapiens
caggcttccatccccgtcca

SEQ ID NO: 6706726 - DNA, 23 bp, Homo sapiens
caggcttcccaaaccaagtgcct

SEQ ID NO: 6706727 - DNA, 21 bp, Homo sapiens
caggcttcctgcaattttcta

SEQ ID NO: 6706728 - DNA, 15 bp, Homo sapiens
caggcttcctgggtc

SEQ ID NO: 6706729 - DNA, 16 bp, Homo sapiens
caggcttcctgggtcc

SEQ ID NO: 6706730 - DNA, 16 bp, Homo sapiens
caggcttcgtttgcct

SEQ ID NO: 6706731 - DNA, 13 bp, Homo sapiens
caggcttctcacc

SEQ ID NO: 6706732 - DNA, 12 bp, Homo sapiens
caggcttctcag

SEQ ID NO: 6706733 - DNA, 19 bp, Homo sapiens
caggcttctgctggggcct

SEQ ID NO: 6706734 - DNA, 20 bp, Homo sapiens
caggcttctttcaaagtgta

SEQ ID NO: 6706735 - DNA, 17 bp, Homo sapiens
caggcttgagttttcat

SEQ ID NO: 6706736 - DNA, 16 bp, Homo sapiens
caggcttgcattaaaa

SEQ ID NO: 6706737 - DNA, 14 bp, Homo sapiens
caggcttgccaccg

SEQ ID NO: 6706738 - DNA, 17 bp, Homo sapiens
caggcttgcctgggctg

SEQ ID NO: 6706739 - DNA, 18 bp, Homo sapiens
caggcttgcctgggctgg

SEQ ID NO: 6706740 - DNA, 21 bp, Homo sapiens
caggcttgcctgggctgggca

SEQ ID NO: 6706741 - DNA, 15 bp, Homo sapiens
caggcttgctgtatg

SEQ ID NO: 6706742 - DNA, 20 bp, Homo sapiens
caggcttgctgtatgacccc

SEQ ID NO: 6706743 - DNA, 22 bp, Homo sapiens
caggcttgctgtatgacccctg

SEQ ID NO: 6706744 - DNA, 16 bp, Homo sapiens
caggcttggcggaggg

SEQ ID NO: 6706745 - DNA, 23 bp, Homo sapiens
caggcttgggctccattcccatc

SEQ ID NO: 6706746 - DNA, 11 bp, Homo sapiens
caggctttcta

SEQ ID NO: 6706747 - DNA, 15 bp, Homo sapiens
caggctttgtgagag

SEQ ID NO: 6706748 - DNA, 15 bp, Homo sapiens
caggctttttccata

SEQ ID NO: 6706749 - DNA, 14 bp, Homo sapiens
cagggaaaacacag

SEQ ID NO: 6706750 - DNA, 15 bp, Homo sapiens
cagggaaaacacaga

SEQ ID NO: 6706751 - DNA, 17 bp, Homo sapiens
cagggaaaagcagctct

SEQ ID NO: 6706752 - DNA, 12 bp, Homo sapiens
cagggaaacagc

SEQ ID NO: 6706753 - DNA, 14 bp, Homo sapiens
cagggaaacagcct

SEQ ID NO: 6706754 - DNA, 20 bp, Homo sapiens
cagggaaacagcctctctct

SEQ ID NO: 6706755 - DNA, 13 bp, Homo sapiens
cagggaaactaat

SEQ ID NO: 6706756 - DNA, 15 bp, Homo sapiens
cagggaaagctccac

SEQ ID NO: 6706757 - DNA, 14 bp, Homo sapiens
cagggaaaggaaaa

SEQ ID NO: 6706758 - DNA, 20 bp, Homo sapiens
cagggaaagggatggtcagg

SEQ ID NO: 6706759 - DNA, 22 bp, Homo sapiens
cagggaaagggatggtcaggcc

SEQ ID NO: 6706760 - DNA, 19 bp, Homo sapiens
cagggaaatggagggtggg

SEQ ID NO: 6706761 - DNA, 23 bp, Homo sapiens
cagggaaatggagggtggggccg

SEQ ID NO: 6706762 - DNA, 16 bp, Homo sapiens
cagggaaatggccttc

SEQ ID NO: 6706763 - DNA, 17 bp, Homo sapiens
cagggaaatggccttcc

SEQ ID NO: 6706764 - DNA, 15 bp, Homo sapiens
cagggaaatgtatgt

SEQ ID NO: 6706765 - DNA, 13 bp, Homo sapiens
cagggaaatgtgt

SEQ ID NO: 6706766 - DNA, 14 bp, Homo sapiens
cagggaaattaatc

SEQ ID NO: 6706767 - DNA, 15 bp, Homo sapiens
cagggaaattaatca

SEQ ID NO: 6706768 - DNA, 13 bp, Homo sapiens
cagggaacagccc

SEQ ID NO: 6706769 - DNA, 19 bp, Homo sapiens
cagggaaccctgcttgcac

SEQ ID NO: 6706770 - DNA, 15 bp, Homo sapiens
cagggaactgcttgc

SEQ ID NO: 6706771 - DNA, 13 bp, Homo sapiens
cagggaactggga

SEQ ID NO: 6706772 - DNA, 21 bp, Homo sapiens
cagggaactgggaagatgctg

SEQ ID NO: 6706773 - DNA, 13 bp, Homo sapiens
cagggaagaaatc

SEQ ID NO: 6706774 - DNA, 12 bp, Homo sapiens
cagggaagaggg

SEQ ID NO: 6706775 - DNA, 14 bp, Homo sapiens
cagggaagagggca

SEQ ID NO: 6706776 - DNA, 15 bp, Homo sapiens
cagggaagagggcag

SEQ ID NO: 6706777 - DNA, 16 bp, Homo sapiens
cagggaagagggcagt

SEQ ID NO: 6706778 - DNA, 22 bp, Homo sapiens
cagggaagagggcagtacctgg

SEQ ID NO: 6706779 - DNA, 14 bp, Homo sapiens
cagggaagaggggt

SEQ ID NO: 6706780 - DNA, 12 bp, Homo sapiens
cagggaagcagg

SEQ ID NO: 6706781 - DNA, 18 bp, Homo sapiens
cagggaagcaggcagagc

SEQ ID NO: 6706782 - DNA, 22 bp, Homo sapiens
cagggaagcatgtgacacccac

SEQ ID NO: 6706783 - DNA, 23 bp, Homo sapiens
cagggaagcatgtgacacccaca

SEQ ID NO: 6706784 - DNA, 12 bp, Homo sapiens
cagggaagccca

SEQ ID NO: 6706785 - DNA, 15 bp, Homo sapiens
cagggaagcccagct

SEQ ID NO: 6706786 - DNA, 19 bp, Homo sapiens
cagggaagcccagctccag

SEQ ID NO: 6706787 - DNA, 17 bp, Homo sapiens
cagggaagccccacatg

SEQ ID NO: 6706788 - DNA, 14 bp, Homo sapiens
cagggaagccctcg

SEQ ID NO: 6706789 - DNA, 20 bp, Homo sapiens
cagggaagccctcggcctcc

SEQ ID NO: 6706790 - DNA, 14 bp, Homo sapiens
cagggaagcctggg

SEQ ID NO: 6706791 - DNA, 19 bp, Homo sapiens
cagggaagcgtcgccccag

SEQ ID NO: 6706792 - DNA, 15 bp, Homo sapiens
cagggaagctacagg

SEQ ID NO: 6706793 - DNA, 17 bp, Homo sapiens
cagggaagctacaggtt

SEQ ID NO: 6706794 - DNA, 18 bp, Homo sapiens
cagggaagctacaggtta

SEQ ID NO: 6706795 - DNA, 19 bp, Homo sapiens
cagggaagctacaggttac

SEQ ID NO: 6706796 - DNA, 21 bp, Homo sapiens
cagggaagctacaggttacaa

SEQ ID NO: 6706797 - DNA, 19 bp, Homo sapiens
cagggaagctcacacatcc

SEQ ID NO: 6706798 - DNA, 14 bp, Homo sapiens
cagggaagctcttt

SEQ ID NO: 6706799 - DNA, 17 bp, Homo sapiens
cagggaagctgtcctgg

SEQ ID NO: 6706800 - DNA, 12 bp, Homo sapiens
cagggaaggaaa

SEQ ID NO: 6706801 - DNA, 19 bp, Homo sapiens
cagggaaggaatcctggtg

SEQ ID NO: 6706802 - DNA, 16 bp, Homo sapiens
cagggaaggacaggac

SEQ ID NO: 6706803 - DNA, 19 bp, Homo sapiens
cagggaaggacttggagag

SEQ ID NO: 6706804 - DNA, 15 bp, Homo sapiens
cagggaaggagacac

SEQ ID NO: 6706805 - DNA, 22 bp, Homo sapiens
cagggaaggagacaccaagctc

SEQ ID NO: 6706806 - DNA, 14 bp, Homo sapiens
cagggaaggaggag

SEQ ID NO: 6706807 - DNA, 18 bp, Homo sapiens
cagggaaggaggagcctg

SEQ ID NO: 6706808 - DNA, 23 bp, Homo sapiens
cagggaaggaggagcctgtcctg

SEQ ID NO: 6706809 - DNA, 13 bp, Homo sapiens
cagggaaggatcc

SEQ ID NO: 6706810 - DNA, 15 bp, Homo sapiens
cagggaaggatgaca

SEQ ID NO: 6706811 - DNA, 13 bp, Homo sapiens
cagggaaggcagg

SEQ ID NO: 6706812 - DNA, 14 bp, Homo sapiens
cagggaaggcaggc

SEQ ID NO: 6706813 - DNA, 16 bp, Homo sapiens
cagggaaggcaggcag

SEQ ID NO: 6706814 - DNA, 21 bp, Homo sapiens
cagggaaggcaggcagggctc

SEQ ID NO: 6706815 - DNA, 15 bp, Homo sapiens
cagggaaggctaagc

SEQ ID NO: 6706816 - DNA, 23 bp, Homo sapiens
cagggaaggctaagcatggcctg

SEQ ID NO: 6706817 - DNA, 17 bp, Homo sapiens
cagggaaggctgtgcag

SEQ ID NO: 6706818 - DNA, 19 bp, Homo sapiens
cagggaaggggaggcagcc

SEQ ID NO: 6706819 - DNA, 15 bp, Homo sapiens
cagggaagggtgcct

SEQ ID NO: 6706820 - DNA, 19 bp, Homo sapiens
cagggaagggtgcctggct

SEQ ID NO: 6706821 - DNA, 21 bp, Homo sapiens
cagggaagggtgcctggctgg

SEQ ID NO: 6706822 - DNA, 22 bp, Homo sapiens
cagggaagggtgcctggctggg

SEQ ID NO: 6706823 - DNA, 17 bp, Homo sapiens
cagggaagtccccaggc

SEQ ID NO: 6706824 - DNA, 21 bp, Homo sapiens
cagggaagtgtaagaaacaca

SEQ ID NO: 6706825 - DNA, 23 bp, Homo sapiens
cagggaatagtgggatcaaagct

SEQ ID NO: 6706826 - DNA, 15 bp, Homo sapiens
cagggaatcagaaag

SEQ ID NO: 6706827 - DNA, 18 bp, Homo sapiens
cagggaatcagggaccag

SEQ ID NO: 6706828 - DNA, 17 bp, Homo sapiens
cagggaatcagggagca

SEQ ID NO: 6706829 - DNA, 18 bp, Homo sapiens
cagggaatccaagcctcc

SEQ ID NO: 6706830 - DNA, 12 bp, Homo sapiens
cagggaatccag

SEQ ID NO: 6706831 - DNA, 17 bp, Homo sapiens
cagggaatccagctccc

SEQ ID NO: 6706832 - DNA, 22 bp, Homo sapiens
cagggaatccagctccctagac

SEQ ID NO: 6706833 - DNA, 23 bp, Homo sapiens
cagggaatgcaatccttccctgc

SEQ ID NO: 6706834 - DNA, 16 bp, Homo sapiens
cagggaatgcagcagg

SEQ ID NO: 6706835 - DNA, 18 bp, Homo sapiens
cagggaatgcctggaggg

SEQ ID NO: 6706836 - DNA, 21 bp, Homo sapiens
cagggaatgctgaggcctcga

SEQ ID NO: 6706837 - DNA, 23 bp, Homo sapiens
cagggaattttcattggatgcag

SEQ ID NO: 6706838 - DNA, 13 bp, Homo sapiens
cagggacaaagaa

SEQ ID NO: 6706839 - DNA, 18 bp, Homo sapiens
cagggacaaagaggcctt

SEQ ID NO: 6706840 - DNA, 19 bp, Homo sapiens
cagggacacaaagaggaat

SEQ ID NO: 6706841 - DNA, 20 bp, Homo sapiens
cagggacaccagccaggctc

SEQ ID NO: 6706842 - DNA, 21 bp, Homo sapiens
cagggacaccagccaggctct

SEQ ID NO: 6706843 - DNA, 23 bp, Homo sapiens
cagggacaccagccaggctctgt

SEQ ID NO: 6706844 - DNA, 22 bp, Homo sapiens
cagggacacccacacaggtggc

SEQ ID NO: 6706845 - DNA, 20 bp, Homo sapiens
cagggacactccaactctac

SEQ ID NO: 6706846 - DNA, 15 bp, Homo sapiens
cagggacagaagcag

SEQ ID NO: 6706847 - DNA, 17 bp, Homo sapiens
cagggacagaagcagga

SEQ ID NO: 6706848 - DNA, 18 bp, Homo sapiens
cagggacagagacacctg

SEQ ID NO: 6706849 - DNA, 15 bp, Homo sapiens
cagggacagagccat

SEQ ID NO: 6706850 - DNA, 17 bp, Homo sapiens
cagggacagagccatgc

SEQ ID NO: 6706851 - DNA, 14 bp, Homo sapiens
cagggacagaggcc

SEQ ID NO: 6706852 - DNA, 17 bp, Homo sapiens
cagggacagaggccaag

SEQ ID NO: 6706853 - DNA, 18 bp, Homo sapiens
cagggacagaggccaagg

SEQ ID NO: 6706854 - DNA, 21 bp, Homo sapiens
cagggacagaggccccagcct

SEQ ID NO: 6706855 - DNA, 14 bp, Homo sapiens
cagggacagagggg

SEQ ID NO: 6706856 - DNA, 20 bp, Homo sapiens
cagggacagagggggtggcc

SEQ ID NO: 6706857 - DNA, 14 bp, Homo sapiens
cagggacagcaact

SEQ ID NO: 6706858 - DNA, 18 bp, Homo sapiens
cagggacagcagcctccc

SEQ ID NO: 6706859 - DNA, 20 bp, Homo sapiens
cagggacagcagcctccctg

SEQ ID NO: 6706860 - DNA, 20 bp, Homo sapiens
cagggacagcctgcacagtg

SEQ ID NO: 6706861 - DNA, 12 bp, Homo sapiens
cagggacaggat

SEQ ID NO: 6706862 - DNA, 13 bp, Homo sapiens
cagggacagggcc

SEQ ID NO: 6706863 - DNA, 17 bp, Homo sapiens
cagggacatgccctgtg

SEQ ID NO: 6706864 - DNA, 23 bp, Homo sapiens
cagggacatgccctgtgtggctg

SEQ ID NO: 6706865 - DNA, 16 bp, Homo sapiens
cagggacatggggcaa

SEQ ID NO: 6706866 - DNA, 18 bp, Homo sapiens
cagggacatggggcaagc

SEQ ID NO: 6706867 - DNA, 21 bp, Homo sapiens
cagggacatggggcaagccag

SEQ ID NO: 6706868 - DNA, 23 bp, Homo sapiens
cagggacatggggcaagccaggg

SEQ ID NO: 6706869 - DNA, 20 bp, Homo sapiens
cagggacatgtatgcttcca

SEQ ID NO: 6706870 - DNA, 22 bp, Homo sapiens
cagggaccacaccctgtactgt

SEQ ID NO: 6706871 - DNA, 13 bp, Homo sapiens
cagggaccacagc

SEQ ID NO: 6706872 - DNA, 21 bp, Homo sapiens
cagggaccacatccaccccag

SEQ ID NO: 6706873 - DNA, 10 bp, Homo sapiens
cagggaccag

SEQ ID NO: 6706874 - DNA, 21 bp, Homo sapiens
cagggaccagcccagcctgca

SEQ ID NO: 6706875 - DNA, 15 bp, Homo sapiens
cagggaccagctccc

SEQ ID NO: 6706876 - DNA, 18 bp, Homo sapiens
cagggaccagctccccgg

SEQ ID NO: 6706877 - DNA, 19 bp, Homo sapiens
cagggaccagggccaccgc

SEQ ID NO: 6706878 - DNA, 22 bp, Homo sapiens
cagggaccagggccaccgcagg

SEQ ID NO: 6706879 - DNA, 15 bp, Homo sapiens
cagggacccaaagca

SEQ ID NO: 6706880 - DNA, 23 bp, Homo sapiens
cagggacccaggtgtgcctgtgc

SEQ ID NO: 6706881 - DNA, 14 bp, Homo sapiens
cagggaccccagaa

SEQ ID NO: 6706882 - DNA, 15 bp, Homo sapiens
cagggacccccagaa

SEQ ID NO: 6706883 - DNA, 19 bp, Homo sapiens
cagggacccccgaggcccc

SEQ ID NO: 6706884 - DNA, 21 bp, Homo sapiens
cagggacccggggtctcctgg

SEQ ID NO: 6706885 - DNA, 23 bp, Homo sapiens
cagggacccggggtctcctggac

SEQ ID NO: 6706886 - DNA, 19 bp, Homo sapiens
cagggaccctggagtattt

SEQ ID NO: 6706887 - DNA, 19 bp, Homo sapiens
cagggacccttgcctgcct

SEQ ID NO: 6706888 - DNA, 20 bp, Homo sapiens
cagggacccttgcctgcctc

SEQ ID NO: 6706889 - DNA, 21 bp, Homo sapiens
cagggacccttgcctgcctcc

SEQ ID NO: 6706890 - DNA, 21 bp, Homo sapiens
cagggaccgccccctgtctct

SEQ ID NO: 6706891 - DNA, 15 bp, Homo sapiens
cagggaccggcagag

SEQ ID NO: 6706892 - DNA, 20 bp, Homo sapiens
cagggaccggcagagctcta

SEQ ID NO: 6706893 - DNA, 23 bp, Homo sapiens
cagggacctgagagcatctcagg

SEQ ID NO: 6706894 - DNA, 14 bp, Homo sapiens
cagggacctgctgc

SEQ ID NO: 6706895 - DNA, 18 bp, Homo sapiens
cagggacctgctgctcag

SEQ ID NO: 6706896 - DNA, 18 bp, Homo sapiens
cagggaccttggaaacag

SEQ ID NO: 6706897 - DNA, 19 bp, Homo sapiens
cagggacgaagaagagcca

SEQ ID NO: 6706898 - DNA, 22 bp, Homo sapiens
cagggacgaagaagagccacag

SEQ ID NO: 6706899 - DNA, 17 bp, Homo sapiens
cagggacggggactggc

SEQ ID NO: 6706900 - DNA, 20 bp, Homo sapiens
cagggacggggactggccct

SEQ ID NO: 6706901 - DNA, 21 bp, Homo sapiens
cagggacgtctcatctcccat

SEQ ID NO: 6706902 - DNA, 21 bp, Homo sapiens
cagggacgtgataatgcagat

SEQ ID NO: 6706903 - DNA, 17 bp, Homo sapiens
cagggactatctttgct

SEQ ID NO: 6706904 - DNA, 19 bp, Homo sapiens
cagggactcggcccagggc

SEQ ID NO: 6706905 - DNA, 14 bp, Homo sapiens
cagggactctccat

SEQ ID NO: 6706906 - DNA, 15 bp, Homo sapiens
cagggactgcagctg

SEQ ID NO: 6706907 - DNA, 19 bp, Homo sapiens
cagggactgtacctgtagg

SEQ ID NO: 6706908 - DNA, 20 bp, Homo sapiens
cagggactgtacctgtagga

SEQ ID NO: 6706909 - DNA, 23 bp, Homo sapiens
cagggactgtacctgtaggaaac

SEQ ID NO: 6706910 - DNA, 18 bp, Homo sapiens
cagggactgttcctgtct

SEQ ID NO: 6706911 - DNA, 23 bp, Homo sapiens
cagggactgttcctgtctcagca

SEQ ID NO: 6706912 - DNA, 21 bp, Homo sapiens
cagggacttcaggatcaagtc

SEQ ID NO: 6706913 - DNA, 16 bp, Homo sapiens
cagggacttcgcagag

SEQ ID NO: 6706914 - DNA, 15 bp, Homo sapiens
cagggacttctgcgg

SEQ ID NO: 6706915 - DNA, 17 bp, Homo sapiens
cagggacttgcctccac

SEQ ID NO: 6706916 - DNA, 16 bp, Homo sapiens
cagggacttggacagg

SEQ ID NO: 6706917 - DNA, 19 bp, Homo sapiens
cagggacttgtttagagag

SEQ ID NO: 6706918 - DNA, 20 bp, Homo sapiens
cagggagaaactccaaagtc

SEQ ID NO: 6706919 - DNA, 19 bp, Homo sapiens
cagggagaagttgagcagg

SEQ ID NO: 6706920 - DNA, 19 bp, Homo sapiens
cagggagacatctgcaccc

SEQ ID NO: 6706921 - DNA, 19 bp, Homo sapiens
cagggagaccaggcttccc

SEQ ID NO: 6706922 - DNA, 19 bp, Homo sapiens
cagggagacccgtccattt

SEQ ID NO: 6706923 - DNA, 13 bp, Homo sapiens
cagggagaccctg

SEQ ID NO: 6706924 - DNA, 18 bp, Homo sapiens
cagggagaccctgggaga

SEQ ID NO: 6706925 - DNA, 19 bp, Homo sapiens
cagggagaccctgggagag

SEQ ID NO: 6706926 - DNA, 22 bp, Homo sapiens
cagggagaccgagcgctttctg

SEQ ID NO: 6706927 - DNA, 22 bp, Homo sapiens
cagggagacggtttccagggag

SEQ ID NO: 6706928 - DNA, 22 bp, Homo sapiens
cagggagactgggtaggaaaga

SEQ ID NO: 6706929 - DNA, 16 bp, Homo sapiens
cagggagactttctga

SEQ ID NO: 6706930 - DNA, 20 bp, Homo sapiens
cagggagactttctgaagta

SEQ ID NO: 6706931 - DNA, 13 bp, Homo sapiens
cagggagagccca

SEQ ID NO: 6706932 - DNA, 13 bp, Homo sapiens
cagggagagctgg

SEQ ID NO: 6706933 - DNA, 23 bp, Homo sapiens
cagggagaggagtgactgagctt

SEQ ID NO: 6706934 - DNA, 15 bp, Homo sapiens
cagggagaggcctcg

SEQ ID NO: 6706935 - DNA, 17 bp, Homo sapiens
cagggagaggcctcggc

SEQ ID NO: 6706936 - DNA, 13 bp, Homo sapiens
cagggagaggctg

SEQ ID NO: 6706937 - DNA, 19 bp, Homo sapiens
cagggagaggtcaccagct

SEQ ID NO: 6706938 - DNA, 21 bp, Homo sapiens
cagggagaggtcaccagctgc

SEQ ID NO: 6706939 - DNA, 17 bp, Homo sapiens
cagggagcaactctcca

SEQ ID NO: 6706940 - DNA, 23 bp, Homo sapiens
cagggagcaactctccactccat

SEQ ID NO: 6706941 - DNA, 16 bp, Homo sapiens
cagggagcaagacaga

SEQ ID NO: 6706942 - DNA, 19 bp, Homo sapiens
cagggagcaagacagagac

SEQ ID NO: 6706943 - DNA, 13 bp, Homo sapiens
cagggagcaatgg

SEQ ID NO: 6706944 - DNA, 15 bp, Homo sapiens
cagggagcaatggga

SEQ ID NO: 6706945 - DNA, 22 bp, Homo sapiens
cagggagcaatgggagggggct

SEQ ID NO: 6706946 - DNA, 17 bp, Homo sapiens
cagggagcaccacggcc

SEQ ID NO: 6706947 - DNA, 19 bp, Homo sapiens
cagggagcaccacggccag

SEQ ID NO: 6706948 - DNA, 21 bp, Homo sapiens
cagggagcactggaggcctct

SEQ ID NO: 6706949 - DNA, 22 bp, Homo sapiens
cagggagcactggaggcctctg

SEQ ID NO: 6706950 - DNA, 12 bp, Homo sapiens
cagggagcagca

SEQ ID NO: 6706951 - DNA, 15 bp, Homo sapiens
cagggagcagccccc

SEQ ID NO: 6706952 - DNA, 16 bp, Homo sapiens
cagggagcagggaagg

SEQ ID NO: 6706953 - DNA, 21 bp, Homo sapiens
cagggagcagggaaggcctga

SEQ ID NO: 6706954 - DNA, 19 bp, Homo sapiens
cagggagcagtacacaact

SEQ ID NO: 6706955 - DNA, 23 bp, Homo sapiens
cagggagcatgagaggaggcagc

SEQ ID NO: 6706956 - DNA, 15 bp, Homo sapiens
cagggagcatggctg

SEQ ID NO: 6706957 - DNA, 22 bp, Homo sapiens
cagggagcatttaatggcagct

SEQ ID NO: 6706958 - DNA, 19 bp, Homo sapiens
cagggagcattttcctcca

SEQ ID NO: 6706959 - DNA, 16 bp, Homo sapiens
cagggagcccctagga

SEQ ID NO: 6706960 - DNA, 20 bp, Homo sapiens
cagggagcccctaggaaagc

SEQ ID NO: 6706961 - DNA, 13 bp, Homo sapiens
cagggagcctccc

SEQ ID NO: 6706962 - DNA, 13 bp, Homo sapiens
cagggagcctcct

SEQ ID NO: 6706963 - DNA, 19 bp, Homo sapiens
cagggagcgatccagggga

SEQ ID NO: 6706964 - DNA, 13 bp, Homo sapiens
cagggagcggaaa

SEQ ID NO: 6706965 - DNA, 18 bp, Homo sapiens
cagggagcggaaagcagc

SEQ ID NO: 6706966 - DNA, 15 bp, Homo sapiens
cagggagcggccggc

SEQ ID NO: 6706967 - DNA, 21 bp, Homo sapiens
cagggagcggccggccagccc

SEQ ID NO: 6706968 - DNA, 21 bp, Homo sapiens
cagggagctcgcattctcttg

SEQ ID NO: 6706969 - DNA, 17 bp, Homo sapiens
cagggagctctggggac

SEQ ID NO: 6706970 - DNA, 18 bp, Homo sapiens
cagggagctgcaggggca

SEQ ID NO: 6706971 - DNA, 19 bp, Homo sapiens
cagggagctgggcccgaca

SEQ ID NO: 6706972 - DNA, 17 bp, Homo sapiens
cagggagctgggcttcc

SEQ ID NO: 6706973 - DNA, 17 bp, Homo sapiens
cagggagcttcctggct

SEQ ID NO: 6706974 - DNA, 23 bp, Homo sapiens
cagggagcttcctggctctgggg

SEQ ID NO: 6706975 - DNA, 20 bp, Homo sapiens
cagggagcttgccacactct

SEQ ID NO: 6706976 - DNA, 22 bp, Homo sapiens
cagggagcttgccacactcttc

SEQ ID NO: 6706977 - DNA, 17 bp, Homo sapiens
cagggaggaagaagctt

SEQ ID NO: 6706978 - DNA, 22 bp, Homo sapiens
cagggaggacgctctctggcct

SEQ ID NO: 6706979 - DNA, 12 bp, Homo sapiens
cagggaggagag

SEQ ID NO: 6706980 - DNA, 18 bp, Homo sapiens
cagggaggaggtggcagc

SEQ ID NO: 6706981 - DNA, 20 bp, Homo sapiens
cagggaggaggtggcagccc

SEQ ID NO: 6706982 - DNA, 21 bp, Homo sapiens
cagggaggaggtggcagccct

SEQ ID NO: 6706983 - DNA, 16 bp, Homo sapiens
cagggaggatgccaca

SEQ ID NO: 6706984 - DNA, 22 bp, Homo sapiens
cagggaggatgccacagcccca

SEQ ID NO: 6706985 - DNA, 22 bp, Homo sapiens
cagggaggcaccattcaggaac

SEQ ID NO: 6706986 - DNA, 21 bp, Homo sapiens
cagggaggcagagcgggaggg

SEQ ID NO: 6706987 - DNA, 13 bp, Homo sapiens
cagggaggcagcg

SEQ ID NO: 6706988 - DNA, 19 bp, Homo sapiens
cagggaggcagcgtgggct

SEQ ID NO: 6706989 - DNA, 12 bp, Homo sapiens
cagggaggccac

SEQ ID NO: 6706990 - DNA, 22 bp, Homo sapiens
cagggaggccacgtcccacccc

SEQ ID NO: 6706991 - DNA, 23 bp, Homo sapiens
cagggaggccacgtcccacccca

SEQ ID NO: 6706992 - DNA, 14 bp, Homo sapiens
cagggaggcgcagg

SEQ ID NO: 6706993 - DNA, 20 bp, Homo sapiens
cagggaggctcccggggcct

SEQ ID NO: 6706994 - DNA, 19 bp, Homo sapiens
cagggagggaacagacctc

SEQ ID NO: 6706995 - DNA, 20 bp, Homo sapiens
cagggagggaaggggatgga

SEQ ID NO: 6706996 - DNA, 17 bp, Homo sapiens
cagggagggaagtgtga

SEQ ID NO: 6706997 - DNA, 14 bp, Homo sapiens
cagggagggccagg

SEQ ID NO: 6706998 - DNA, 18 bp, Homo sapiens
cagggagggccagggagg

SEQ ID NO: 6706999 - DNA, 20 bp, Homo sapiens
cagggagggccagggaggca

SEQ ID NO: 6707000 - DNA, 22 bp, Homo sapiens
cagggagggccggcggctctga

SEQ ID NO: 6707001 - DNA, 12 bp, Homo sapiens
cagggagggcct

SEQ ID NO: 6707002 - DNA, 12 bp, Homo sapiens
cagggaggggac

SEQ ID NO: 6707003 - DNA, 12 bp, Homo sapiens
cagggaggggcc

SEQ ID NO: 6707004 - DNA, 16 bp, Homo sapiens
cagggaggggccggcc

SEQ ID NO: 6707005 - DNA, 19 bp, Homo sapiens
cagggaggggccggccctg

SEQ ID NO: 6707006 - DNA, 19 bp, Homo sapiens
cagggaggggctggggcag

SEQ ID NO: 6707007 - DNA, 16 bp, Homo sapiens
cagggagggggacctg

SEQ ID NO: 6707008 - DNA, 21 bp, Homo sapiens
cagggagggggacctgtcccc

SEQ ID NO: 6707009 - DNA, 12 bp, Homo sapiens
cagggagggggc

SEQ ID NO: 6707010 - DNA, 13 bp, Homo sapiens
cagggagggggct

SEQ ID NO: 6707011 - DNA, 18 bp, Homo sapiens
cagggagggttagcctgc

SEQ ID NO: 6707012 - DNA, 21 bp, Homo sapiens
cagggagggttagcctgcacc

SEQ ID NO: 6707013 - DNA, 14 bp, Homo sapiens
cagggaggtcaggc

SEQ ID NO: 6707014 - DNA, 17 bp, Homo sapiens
cagggaggtcaggccct

SEQ ID NO: 6707015 - DNA, 18 bp, Homo sapiens
cagggaggtcaggccctg

SEQ ID NO: 6707016 - DNA, 19 bp, Homo sapiens
cagggaggtcaggccctgg

SEQ ID NO: 6707017 - DNA, 20 bp, Homo sapiens
cagggaggtcaggccctgga

SEQ ID NO: 6707018 - DNA, 16 bp, Homo sapiens
cagggaggtcattttg

SEQ ID NO: 6707019 - DNA, 23 bp, Homo sapiens
cagggaggtggaaggaccctgtg

SEQ ID NO: 6707020 - DNA, 19 bp, Homo sapiens
cagggaggtggcagggaag

SEQ ID NO: 6707021 - DNA, 21 bp, Homo sapiens
cagggaggtgggggcctcctc

SEQ ID NO: 6707022 - DNA, 23 bp, Homo sapiens
cagggaggttaagtgacttgccc

SEQ ID NO: 6707023 - DNA, 13 bp, Homo sapiens
cagggagtccagg

SEQ ID NO: 6707024 - DNA, 14 bp, Homo sapiens
cagggagtccaggg

SEQ ID NO: 6707025 - DNA, 13 bp, Homo sapiens
cagggagtcccct

SEQ ID NO: 6707026 - DNA, 22 bp, Homo sapiens
cagggagtccgaaagggacttg

SEQ ID NO: 6707027 - DNA, 13 bp, Homo sapiens
cagggagtgagca

SEQ ID NO: 6707028 - DNA, 14 bp, Homo sapiens
cagggagtgagcag

SEQ ID NO: 6707029 - DNA, 15 bp, Homo sapiens
cagggagtgagcagc

SEQ ID NO: 6707030 - DNA, 17 bp, Homo sapiens
cagggagtgagcagcta

SEQ ID NO: 6707031 - DNA, 23 bp, Homo sapiens
cagggagtgagcagctactgtaa

SEQ ID NO: 6707032 - DNA, 15 bp, Homo sapiens
cagggagtgatgatt

SEQ ID NO: 6707033 - DNA, 16 bp, Homo sapiens
cagggagtggggagga

SEQ ID NO: 6707034 - DNA, 22 bp, Homo sapiens
cagggagtgtctgcagtcctgg

SEQ ID NO: 6707035 - DNA, 20 bp, Homo sapiens
cagggagtgtgatgcaggaa

SEQ ID NO: 6707036 - DNA, 23 bp, Homo sapiens
cagggataggaagtgccccaggg

SEQ ID NO: 6707037 - DNA, 22 bp, Homo sapiens
cagggatcctctctccaggccc

SEQ ID NO: 6707038 - DNA, 16 bp, Homo sapiens
cagggatcttctccct

SEQ ID NO: 6707039 - DNA, 12 bp, Homo sapiens
cagggatgagca

SEQ ID NO: 6707040 - DNA, 21 bp, Homo sapiens
cagggatgagcatggagctgg

SEQ ID NO: 6707041 - DNA, 17 bp, Homo sapiens
cagggatgatggcagag

SEQ ID NO: 6707042 - DNA, 19 bp, Homo sapiens
cagggatgatggcagagcc

SEQ ID NO: 6707043 - DNA, 23 bp, Homo sapiens
cagggatgccatctgtgggcacg

SEQ ID NO: 6707044 - DNA, 21 bp, Homo sapiens
cagggatgccctggaggtggc

SEQ ID NO: 6707045 - DNA, 19 bp, Homo sapiens
cagggatgctatctcgcta

SEQ ID NO: 6707046 - DNA, 22 bp, Homo sapiens
cagggatgctcattccatgact

SEQ ID NO: 6707047 - DNA, 18 bp, Homo sapiens
cagggatgctgggctggg

SEQ ID NO: 6707048 - DNA, 14 bp, Homo sapiens
cagggatgctggtg

SEQ ID NO: 6707049 - DNA, 16 bp, Homo sapiens
cagggatgctggtggc

SEQ ID NO: 6707050 - DNA, 19 bp, Homo sapiens
cagggatgctggtggctgg

SEQ ID NO: 6707051 - DNA, 18 bp, Homo sapiens
cagggatggagatgggaa

SEQ ID NO: 6707052 - DNA, 16 bp, Homo sapiens
cagggatggcagtggc

SEQ ID NO: 6707053 - DNA, 21 bp, Homo sapiens
cagggatggcagtggctgtga

SEQ ID NO: 6707054 - DNA, 15 bp, Homo sapiens
cagggatggcccagc

SEQ ID NO: 6707055 - DNA, 20 bp, Homo sapiens
cagggatggccgttggccac

SEQ ID NO: 6707056 - DNA, 19 bp, Homo sapiens
cagggatgggcagcccaac

SEQ ID NO: 6707057 - DNA, 17 bp, Homo sapiens
cagggatggggccacag

SEQ ID NO: 6707058 - DNA, 19 bp, Homo sapiens
cagggatggggccacagcc

SEQ ID NO: 6707059 - DNA, 17 bp, Homo sapiens
cagggatgggggatggg

SEQ ID NO: 6707060 - DNA, 16 bp, Homo sapiens
cagggatgggggtggc

SEQ ID NO: 6707061 - DNA, 18 bp, Homo sapiens
cagggatgtacaaggcga

SEQ ID NO: 6707062 - DNA, 12 bp, Homo sapiens
cagggatgtggg

SEQ ID NO: 6707063 - DNA, 20 bp, Homo sapiens
cagggatgtgggttccacag

SEQ ID NO: 6707064 - DNA, 20 bp, Homo sapiens
cagggattaacctctgcact

SEQ ID NO: 6707065 - DNA, 16 bp, Homo sapiens
cagggattgattttaa

SEQ ID NO: 6707066 - DNA, 16 bp, Homo sapiens
cagggattgctgccac

SEQ ID NO: 6707067 - DNA, 13 bp, Homo sapiens
cagggatttgagg

SEQ ID NO: 6707068 - DNA, 11 bp, Homo sapiens
cagggatttgc

SEQ ID NO: 6707069 - DNA, 19 bp, Homo sapiens
cagggatttgcctcacctt

SEQ ID NO: 6707070 - DNA, 20 bp, Homo sapiens
cagggcaaaagggcagctgt

SEQ ID NO: 6707071 - DNA, 12 bp, Homo sapiens
cagggcaaagcc

SEQ ID NO: 6707072 - DNA, 16 bp, Homo sapiens
cagggcaaagccaggt

SEQ ID NO: 6707073 - DNA, 17 bp, Homo sapiens
cagggcaaagccaggtc

SEQ ID NO: 6707074 - DNA, 18 bp, Homo sapiens
cagggcaaagccaggtcc

SEQ ID NO: 6707075 - DNA, 20 bp, Homo sapiens
cagggcaaagccaggtccct

SEQ ID NO: 6707076 - DNA, 22 bp, Homo sapiens
cagggcaaaggtcaagactgtg

SEQ ID NO: 6707077 - DNA, 20 bp, Homo sapiens
cagggcaaatgacatgcact

SEQ ID NO: 6707078 - DNA, 23 bp, Homo sapiens
cagggcaacaagcccgttagccc

SEQ ID NO: 6707079 - DNA, 21 bp, Homo sapiens
cagggcaactcttggaagaaa

SEQ ID NO: 6707080 - DNA, 13 bp, Homo sapiens
cagggcaagctcc

SEQ ID NO: 6707081 - DNA, 21 bp, Homo sapiens
cagggcaaggacacagcgcgg

SEQ ID NO: 6707082 - DNA, 14 bp, Homo sapiens
cagggcaaggcccc

SEQ ID NO: 6707083 - DNA, 20 bp, Homo sapiens
cagggcaagggttaaggcct

SEQ ID NO: 6707084 - DNA, 21 bp, Homo sapiens
cagggcaagggttaaggcctg

SEQ ID NO: 6707085 - DNA, 17 bp, Homo sapiens
cagggcaatcttgtcca

SEQ ID NO: 6707086 - DNA, 18 bp, Homo sapiens
cagggcaatgccatcagc

SEQ ID NO: 6707087 - DNA, 14 bp, Homo sapiens
cagggcacaccggg

SEQ ID NO: 6707088 - DNA, 18 bp, Homo sapiens
cagggcacagaaggctgg

SEQ ID NO: 6707089 - DNA, 19 bp, Homo sapiens
cagggcacagatgaccaaa

SEQ ID NO: 6707090 - DNA, 16 bp, Homo sapiens
cagggcacagctggag

SEQ ID NO: 6707091 - DNA, 15 bp, Homo sapiens
cagggcacaggagct

SEQ ID NO: 6707092 - DNA, 15 bp, Homo sapiens
cagggcacagggcct

SEQ ID NO: 6707093 - DNA, 20 bp, Homo sapiens
cagggcacagggcctggccc

SEQ ID NO: 6707094 - DNA, 22 bp, Homo sapiens
cagggcacagggcctggcccat

SEQ ID NO: 6707095 - DNA, 15 bp, Homo sapiens
cagggcaccagaggc

SEQ ID NO: 6707096 - DNA, 15 bp, Homo sapiens
cagggcacctgccac

SEQ ID NO: 6707097 - DNA, 17 bp, Homo sapiens
cagggcacgcaggacca

SEQ ID NO: 6707098 - DNA, 13 bp, Homo sapiens
cagggcacgggga

SEQ ID NO: 6707099 - DNA, 18 bp, Homo sapiens
cagggcacggggacctgg

SEQ ID NO: 6707100 - DNA, 13 bp, Homo sapiens
cagggcactgact

SEQ ID NO: 6707101 - DNA, 18 bp, Homo sapiens
cagggcactgccagccca

SEQ ID NO: 6707102 - DNA, 22 bp, Homo sapiens
cagggcactgccagcccacccc

SEQ ID NO: 6707103 - DNA, 14 bp, Homo sapiens
cagggcacttcaca

SEQ ID NO: 6707104 - DNA, 16 bp, Homo sapiens
cagggcagaaatgatt

SEQ ID NO: 6707105 - DNA, 12 bp, Homo sapiens
cagggcagagga

SEQ ID NO: 6707106 - DNA, 15 bp, Homo sapiens
cagggcagaggaatg

SEQ ID NO: 6707107 - DNA, 13 bp, Homo sapiens
cagggcagagtga

SEQ ID NO: 6707108 - DNA, 13 bp, Homo sapiens
cagggcagatgtg

SEQ ID NO: 6707109 - DNA, 19 bp, Homo sapiens
cagggcagcaagggacctg

SEQ ID NO: 6707110 - DNA, 14 bp, Homo sapiens
cagggcagcaggag

SEQ ID NO: 6707111 - DNA, 16 bp, Homo sapiens
cagggcagcaggccag

SEQ ID NO: 6707112 - DNA, 19 bp, Homo sapiens
cagggcagcaggccagaga

SEQ ID NO: 6707113 - DNA, 13 bp, Homo sapiens
cagggcagcagtg

SEQ ID NO: 6707114 - DNA, 14 bp, Homo sapiens
cagggcagcagtgg

SEQ ID NO: 6707115 - DNA, 12 bp, Homo sapiens
cagggcagccag

SEQ ID NO: 6707116 - DNA, 13 bp, Homo sapiens
cagggcagccagg

SEQ ID NO: 6707117 - DNA, 14 bp, Homo sapiens
cagggcagccaggg

SEQ ID NO: 6707118 - DNA, 18 bp, Homo sapiens
cagggcagccagggagag

SEQ ID NO: 6707119 - DNA, 20 bp, Homo sapiens
cagggcagccagggagagcc

SEQ ID NO: 6707120 - DNA, 22 bp, Homo sapiens
cagggcagccagggagagccca

SEQ ID NO: 6707121 - DNA, 12 bp, Homo sapiens
cagggcagcccc

SEQ ID NO: 6707122 - DNA, 13 bp, Homo sapiens
cagggcagcccct

SEQ ID NO: 6707123 - DNA, 14 bp, Homo sapiens
cagggcagcccctg

SEQ ID NO: 6707124 - DNA, 17 bp, Homo sapiens
cagggcagcctgcctgg

SEQ ID NO: 6707125 - DNA, 20 bp, Homo sapiens
cagggcagcctgtgggagaa

SEQ ID NO: 6707126 - DNA, 22 bp, Homo sapiens
cagggcagcgccaggctgacca

SEQ ID NO: 6707127 - DNA, 12 bp, Homo sapiens
cagggcagcggc

SEQ ID NO: 6707128 - DNA, 15 bp, Homo sapiens
cagggcagcggctcc

SEQ ID NO: 6707129 - DNA, 14 bp, Homo sapiens
cagggcagctgcct

SEQ ID NO: 6707130 - DNA, 18 bp, Homo sapiens
cagggcagctgcctggcc

SEQ ID NO: 6707131 - DNA, 23 bp, Homo sapiens
cagggcagctgcctggccatgct

SEQ ID NO: 6707132 - DNA, 14 bp, Homo sapiens
cagggcagctgggc

SEQ ID NO: 6707133 - DNA, 15 bp, Homo sapiens
cagggcagctgggcc

SEQ ID NO: 6707134 - DNA, 18 bp, Homo sapiens
cagggcagctgggcccaa

SEQ ID NO: 6707135 - DNA, 20 bp, Homo sapiens
cagggcagctgggcccaacc

SEQ ID NO: 6707136 - DNA, 21 bp, Homo sapiens
cagggcagctgggcccaaccc

SEQ ID NO: 6707137 - DNA, 17 bp, Homo sapiens
cagggcaggaccagccc

SEQ ID NO: 6707138 - DNA, 22 bp, Homo sapiens
cagggcaggaccagcccacgct

SEQ ID NO: 6707139 - DNA, 17 bp, Homo sapiens
cagggcaggagcttggc

SEQ ID NO: 6707140 - DNA, 10 bp, Homo sapiens
cagggcaggc

SEQ ID NO: 6707141 - DNA, 17 bp, Homo sapiens
cagggcaggcagagctc

SEQ ID NO: 6707142 - DNA, 21 bp, Homo sapiens
cagggcaggcagagctcagca

SEQ ID NO: 6707143 - DNA, 16 bp, Homo sapiens
cagggcaggccttgct

SEQ ID NO: 6707144 - DNA, 11 bp, Homo sapiens
cagggcagggc

SEQ ID NO: 6707145 - DNA, 15 bp, Homo sapiens
cagggcagggcagcc

SEQ ID NO: 6707146 - DNA, 14 bp, Homo sapiens
cagggcagggccac

SEQ ID NO: 6707147 - DNA, 16 bp, Homo sapiens
cagggcagggccaccc

SEQ ID NO: 6707148 - DNA, 22 bp, Homo sapiens
cagggcagggccaccccactct

SEQ ID NO: 6707149 - DNA, 20 bp, Homo sapiens
cagggcagggcgagctgcag

SEQ ID NO: 6707150 - DNA, 22 bp, Homo sapiens
cagggcagggcgagctgcagga

SEQ ID NO: 6707151 - DNA, 19 bp, Homo sapiens
cagggcagggcggctaggc

SEQ ID NO: 6707152 - DNA, 17 bp, Homo sapiens
cagggcagggtagtgca

SEQ ID NO: 6707153 - DNA, 18 bp, Homo sapiens
cagggcagggtctgggct

SEQ ID NO: 6707154 - DNA, 22 bp, Homo sapiens
cagggcagtccttactccccca

SEQ ID NO: 6707155 - DNA, 16 bp, Homo sapiens
cagggcagtgacaagt

SEQ ID NO: 6707156 - DNA, 22 bp, Homo sapiens
cagggcagtgacaagtggaggg

SEQ ID NO: 6707157 - DNA, 12 bp, Homo sapiens
cagggcagtggc

SEQ ID NO: 6707158 - DNA, 23 bp, Homo sapiens
cagggcagtggccaagcctgctg

SEQ ID NO: 6707159 - DNA, 23 bp, Homo sapiens
cagggcagtgtggtgggaggggt

SEQ ID NO: 6707160 - DNA, 18 bp, Homo sapiens
cagggcatattaaaggct

SEQ ID NO: 6707161 - DNA, 14 bp, Homo sapiens
cagggcatcggcag

SEQ ID NO: 6707162 - DNA, 15 bp, Homo sapiens
cagggcatctccagg

SEQ ID NO: 6707163 - DNA, 18 bp, Homo sapiens
cagggcatctccaggaag

SEQ ID NO: 6707164 - DNA, 13 bp, Homo sapiens
cagggcatctcct

SEQ ID NO: 6707165 - DNA, 15 bp, Homo sapiens
cagggcatctcctgt

SEQ ID NO: 6707166 - DNA, 16 bp, Homo sapiens
cagggcatctctgggc

SEQ ID NO: 6707167 - DNA, 19 bp, Homo sapiens
cagggcatctctgggctgg

SEQ ID NO: 6707168 - DNA, 24 bp, Homo sapiens
cagggcatctctgggctggatgag

SEQ ID NO: 6707169 - DNA, 15 bp, Homo sapiens
cagggcatcttgctg

SEQ ID NO: 6707170 - DNA, 15 bp, Homo sapiens
cagggcatgccacgt

SEQ ID NO: 6707171 - DNA, 21 bp, Homo sapiens
cagggcatgccccggccacct

SEQ ID NO: 6707172 - DNA, 22 bp, Homo sapiens
cagggcatgccccggccacctc

SEQ ID NO: 6707173 - DNA, 23 bp, Homo sapiens
cagggcatgccccggccacctct

SEQ ID NO: 6707174 - DNA, 13 bp, Homo sapiens
cagggcatgcctg

SEQ ID NO: 6707175 - DNA, 14 bp, Homo sapiens
cagggcatgcctgg

SEQ ID NO: 6707176 - DNA, 15 bp, Homo sapiens
cagggcatgcctggc

SEQ ID NO: 6707177 - DNA, 17 bp, Homo sapiens
cagggcatgcctggcct

SEQ ID NO: 6707178 - DNA, 22 bp, Homo sapiens
cagggcattcgggccacagggc

SEQ ID NO: 6707179 - DNA, 22 bp, Homo sapiens
cagggcattctgttggcctaag

SEQ ID NO: 6707180 - DNA, 17 bp, Homo sapiens
cagggcattgctcagcc

SEQ ID NO: 6707181 - DNA, 20 bp, Homo sapiens
cagggcattgtgttcactgt

SEQ ID NO: 6707182 - DNA, 19 bp, Homo sapiens
cagggccaaaagcttccct

SEQ ID NO: 6707183 - DNA, 16 bp, Homo sapiens
cagggccaaagcacag

SEQ ID NO: 6707184 - DNA, 21 bp, Homo sapiens
cagggccaaagcacagctggg

SEQ ID NO: 6707185 - DNA, 13 bp, Homo sapiens
cagggccaaccct

SEQ ID NO: 6707186 - DNA, 18 bp, Homo sapiens
cagggccaagcgggggcg

SEQ ID NO: 6707187 - DNA, 17 bp, Homo sapiens
cagggccacctgcagga

SEQ ID NO: 6707188 - DNA, 16 bp, Homo sapiens
cagggccacgctccag

SEQ ID NO: 6707189 - DNA, 18 bp, Homo sapiens
cagggccacgctccagct

SEQ ID NO: 6707190 - DNA, 20 bp, Homo sapiens
cagggccacgctccagctgc

SEQ ID NO: 6707191 - DNA, 22 bp, Homo sapiens
cagggccacgctccagctgccc

SEQ ID NO: 6707192 - DNA, 15 bp, Homo sapiens
cagggccacgtgcca

SEQ ID NO: 6707193 - DNA, 20 bp, Homo sapiens
cagggccacgtgccaggccc

SEQ ID NO: 6707194 - DNA, 23 bp, Homo sapiens
cagggccactcaacagagaggac

SEQ ID NO: 6707195 - DNA, 17 bp, Homo sapiens
cagggccactctgcctc

SEQ ID NO: 6707196 - DNA, 20 bp, Homo sapiens
cagggccactctgcctctgc

SEQ ID NO: 6707197 - DNA, 23 bp, Homo sapiens
cagggccagaaggagggcagagc

SEQ ID NO: 6707198 - DNA, 17 bp, Homo sapiens
cagggccagactggaag

SEQ ID NO: 6707199 - DNA, 15 bp, Homo sapiens
cagggccagagcagc

SEQ ID NO: 6707200 - DNA, 19 bp, Homo sapiens
cagggccagagcagctcca

SEQ ID NO: 6707201 - DNA, 12 bp, Homo sapiens
cagggccagagg

SEQ ID NO: 6707202 - DNA, 16 bp, Homo sapiens
cagggccagagggagc

SEQ ID NO: 6707203 - DNA, 17 bp, Homo sapiens
cagggccagagggagct

SEQ ID NO: 6707204 - DNA, 19 bp, Homo sapiens
cagggccagcaggcagcgc

SEQ ID NO: 6707205 - DNA, 15 bp, Homo sapiens
cagggccagcctcta

SEQ ID NO: 6707206 - DNA, 14 bp, Homo sapiens
cagggccaggaagg

SEQ ID NO: 6707207 - DNA, 15 bp, Homo sapiens
cagggccaggaagga

SEQ ID NO: 6707208 - DNA, 16 bp, Homo sapiens
cagggccaggaaggac

SEQ ID NO: 6707209 - DNA, 20 bp, Homo sapiens
cagggccaggaaggacagac

SEQ ID NO: 6707210 - DNA, 15 bp, Homo sapiens
cagggccaggactga

SEQ ID NO: 6707211 - DNA, 16 bp, Homo sapiens
cagggccaggcccagg

SEQ ID NO: 6707212 - DNA, 17 bp, Homo sapiens
cagggccaggcctctcc

SEQ ID NO: 6707213 - DNA, 13 bp, Homo sapiens
cagggccagggca

SEQ ID NO: 6707214 - DNA, 16 bp, Homo sapiens
cagggccagggccctg

SEQ ID NO: 6707215 - DNA, 12 bp, Homo sapiens
cagggccaggtc

SEQ ID NO: 6707216 - DNA, 13 bp, Homo sapiens
cagggccaggtcc

SEQ ID NO: 6707217 - DNA, 21 bp, Homo sapiens
cagggccagtcctcctgggag

SEQ ID NO: 6707218 - DNA, 15 bp, Homo sapiens
cagggccagtggggc

SEQ ID NO: 6707219 - DNA, 16 bp, Homo sapiens
cagggccagtggggcc

SEQ ID NO: 6707220 - DNA, 20 bp, Homo sapiens
cagggccagtggggcctgtg

SEQ ID NO: 6707221 - DNA, 22 bp, Homo sapiens
cagggccagtggggcctgtgga

SEQ ID NO: 6707222 - DNA, 18 bp, Homo sapiens
cagggccatctgactgcc

SEQ ID NO: 6707223 - DNA, 12 bp, Homo sapiens
cagggccatgca

SEQ ID NO: 6707224 - DNA, 16 bp, Homo sapiens
cagggccatggctcag

SEQ ID NO: 6707225 - DNA, 20 bp, Homo sapiens
cagggccatgtcagacacag

SEQ ID NO: 6707226 - DNA, 21 bp, Homo sapiens
cagggccatgtcagacacaga

SEQ ID NO: 6707227 - DNA, 15 bp, Homo sapiens
cagggccatgtgctg

SEQ ID NO: 6707228 - DNA, 19 bp, Homo sapiens
cagggccatgtgctgccct

SEQ ID NO: 6707229 - DNA, 21 bp, Homo sapiens
cagggccatgtgctgccctgt

SEQ ID NO: 6707230 - DNA, 18 bp, Homo sapiens
cagggcccaaataacagt

SEQ ID NO: 6707231 - DNA, 17 bp, Homo sapiens
cagggcccaagtccctg

SEQ ID NO: 6707232 - DNA, 17 bp, Homo sapiens
cagggcccacaccccct

SEQ ID NO: 6707233 - DNA, 19 bp, Homo sapiens
cagggcccaccccagcctc

SEQ ID NO: 6707234 - DNA, 16 bp, Homo sapiens
cagggcccacctcctc

SEQ ID NO: 6707235 - DNA, 19 bp, Homo sapiens
cagggcccagagcccagct

SEQ ID NO: 6707236 - DNA, 19 bp, Homo sapiens
cagggcccagagcccttga

SEQ ID NO: 6707237 - DNA, 13 bp, Homo sapiens
cagggcccagagg

SEQ ID NO: 6707238 - DNA, 13 bp, Homo sapiens
cagggcccagcag

SEQ ID NO: 6707239 - DNA, 16 bp, Homo sapiens
cagggcccaggccatg

SEQ ID NO: 6707240 - DNA, 18 bp, Homo sapiens
cagggcccaggccatgtg

SEQ ID NO: 6707241 - DNA, 20 bp, Homo sapiens
cagggcccaggccatgtggc

SEQ ID NO: 6707242 - DNA, 19 bp, Homo sapiens
cagggcccaggcctggagc

SEQ ID NO: 6707243 - DNA, 23 bp, Homo sapiens
cagggcccagggaggtggcaggg

SEQ ID NO: 6707244 - DNA, 20 bp, Homo sapiens
cagggcccaggttcgagacc

SEQ ID NO: 6707245 - DNA, 22 bp, Homo sapiens
cagggccccagcactaaagcag

SEQ ID NO: 6707246 - DNA, 19 bp, Homo sapiens
cagggcccccaataaacca

SEQ ID NO: 6707247 - DNA, 22 bp, Homo sapiens
cagggcccccaataaaccagtg

SEQ ID NO: 6707248 - DNA, 17 bp, Homo sapiens
cagggcccccacaggag

SEQ ID NO: 6707249 - DNA, 18 bp, Homo sapiens
cagggcccccacaggagc

SEQ ID NO: 6707250 - DNA, 20 bp, Homo sapiens
cagggcccccacaggggatg

SEQ ID NO: 6707251 - DNA, 21 bp, Homo sapiens
cagggcccccacaggggatgg

SEQ ID NO: 6707252 - DNA, 22 bp, Homo sapiens
cagggccccccaaatcccaggg

SEQ ID NO: 6707253 - DNA, 22 bp, Homo sapiens
cagggcccccctccccccactt

SEQ ID NO: 6707254 - DNA, 18 bp, Homo sapiens
cagggcccccggccacgc

SEQ ID NO: 6707255 - DNA, 21 bp, Homo sapiens
cagggcccctcaccctgcctt

SEQ ID NO: 6707256 - DNA, 15 bp, Homo sapiens
cagggcccctccctc

SEQ ID NO: 6707257 - DNA, 20 bp, Homo sapiens
cagggcccctccctctgccc

SEQ ID NO: 6707258 - DNA, 22 bp, Homo sapiens
cagggcccctctccccagggaa

SEQ ID NO: 6707259 - DNA, 15 bp, Homo sapiens
cagggcccctgaagt

SEQ ID NO: 6707260 - DNA, 16 bp, Homo sapiens
cagggcccctgttccc

SEQ ID NO: 6707261 - DNA, 12 bp, Homo sapiens
cagggcccgagc

SEQ ID NO: 6707262 - DNA, 15 bp, Homo sapiens
cagggcccgagcgcg

SEQ ID NO: 6707263 - DNA, 17 bp, Homo sapiens
cagggcccgcagtgctg

SEQ ID NO: 6707264 - DNA, 15 bp, Homo sapiens
cagggcccggcacag

SEQ ID NO: 6707265 - DNA, 17 bp, Homo sapiens
cagggcccggcacagag

SEQ ID NO: 6707266 - DNA, 15 bp, Homo sapiens
cagggcccggccaca

SEQ ID NO: 6707267 - DNA, 20 bp, Homo sapiens
cagggcccggccacacccag

SEQ ID NO: 6707268 - DNA, 22 bp, Homo sapiens
cagggcccggccacacccagcg

SEQ ID NO: 6707269 - DNA, 19 bp, Homo sapiens
cagggcccgggcccaggca

SEQ ID NO: 6707270 - DNA, 12 bp, Homo sapiens
cagggccctcag

SEQ ID NO: 6707271 - DNA, 14 bp, Homo sapiens
cagggccctcagag

SEQ ID NO: 6707272 - DNA, 15 bp, Homo sapiens
cagggccctcagagg

SEQ ID NO: 6707273 - DNA, 17 bp, Homo sapiens
cagggccctcagaggaa

SEQ ID NO: 6707274 - DNA, 23 bp, Homo sapiens
cagggccctcccagcccattgct

SEQ ID NO: 6707275 - DNA, 10 bp, Homo sapiens
cagggccctg

SEQ ID NO: 6707276 - DNA, 20 bp, Homo sapiens
cagggccctgaaatggcctg

SEQ ID NO: 6707277 - DNA, 12 bp, Homo sapiens
cagggccctgcc

SEQ ID NO: 6707278 - DNA, 15 bp, Homo sapiens
cagggccctgcccca

SEQ ID NO: 6707279 - DNA, 17 bp, Homo sapiens
cagggccctgccccagg

SEQ ID NO: 6707280 - DNA, 19 bp, Homo sapiens
cagggccctgccccaggcc

SEQ ID NO: 6707281 - DNA, 22 bp, Homo sapiens
cagggccctgccccaggcctgg

SEQ ID NO: 6707282 - DNA, 14 bp, Homo sapiens
cagggccctgctca

SEQ ID NO: 6707283 - DNA, 19 bp, Homo sapiens
cagggccctgctcaggcct

SEQ ID NO: 6707284 - DNA, 20 bp, Homo sapiens
cagggccctggagctcaggg

SEQ ID NO: 6707285 - DNA, 12 bp, Homo sapiens
cagggccctggc

SEQ ID NO: 6707286 - DNA, 14 bp, Homo sapiens
cagggccctggcca

SEQ ID NO: 6707287 - DNA, 16 bp, Homo sapiens
cagggccctggccagc

SEQ ID NO: 6707288 - DNA, 18 bp, Homo sapiens
cagggccctggccagccg

SEQ ID NO: 6707289 - DNA, 20 bp, Homo sapiens
cagggccctgtgccaggcca

SEQ ID NO: 6707290 - DNA, 14 bp, Homo sapiens
cagggccctgtggc

SEQ ID NO: 6707291 - DNA, 21 bp, Homo sapiens
cagggccctgtggctccagga

SEQ ID NO: 6707292 - DNA, 19 bp, Homo sapiens
cagggcccttggggctggg

SEQ ID NO: 6707293 - DNA, 20 bp, Homo sapiens
cagggcccttggggctgggg

SEQ ID NO: 6707294 - DNA, 21 bp, Homo sapiens
cagggccgagaggacagaatg

SEQ ID NO: 6707295 - DNA, 19 bp, Homo sapiens
cagggccgatggggcagtc

SEQ ID NO: 6707296 - DNA, 18 bp, Homo sapiens
cagggccgcagggcgctc

SEQ ID NO: 6707297 - DNA, 20 bp, Homo sapiens
cagggccgcagggcgctccg

SEQ ID NO: 6707298 - DNA, 20 bp, Homo sapiens
cagggccgcccgggcccaga

SEQ ID NO: 6707299 - DNA, 22 bp, Homo sapiens
cagggccgccgaagggcagccc

SEQ ID NO: 6707300 - DNA, 20 bp, Homo sapiens
cagggccgcgagaggccgag

SEQ ID NO: 6707301 - DNA, 21 bp, Homo sapiens
cagggccgcggccgcccgcac

SEQ ID NO: 6707302 - DNA, 14 bp, Homo sapiens
cagggccgggcagg

SEQ ID NO: 6707303 - DNA, 19 bp, Homo sapiens
cagggcctagctgctacaa

SEQ ID NO: 6707304 - DNA, 21 bp, Homo sapiens
cagggcctagctgctacaaag

SEQ ID NO: 6707305 - DNA, 23 bp, Homo sapiens
cagggcctagctgctacaaagaa

SEQ ID NO: 6707306 - DNA, 13 bp, Homo sapiens
cagggcctaggac

SEQ ID NO: 6707307 - DNA, 14 bp, Homo sapiens
cagggcctcaggca

SEQ ID NO: 6707308 - DNA, 15 bp, Homo sapiens
cagggcctcaggcac

SEQ ID NO: 6707309 - DNA, 21 bp, Homo sapiens
cagggcctcagtttccctatc

SEQ ID NO: 6707310 - DNA, 14 bp, Homo sapiens
cagggcctcatctc

SEQ ID NO: 6707311 - DNA, 14 bp, Homo sapiens
cagggcctccagga

SEQ ID NO: 6707312 - DNA, 17 bp, Homo sapiens
cagggcctccaggactg

SEQ ID NO: 6707313 - DNA, 12 bp, Homo sapiens
cagggcctcctg

SEQ ID NO: 6707314 - DNA, 20 bp, Homo sapiens
cagggcctctccaaccactg

SEQ ID NO: 6707315 - DNA, 14 bp, Homo sapiens
cagggcctctgcgg

SEQ ID NO: 6707316 - DNA, 14 bp, Homo sapiens
cagggcctctggct

SEQ ID NO: 6707317 - DNA, 16 bp, Homo sapiens
cagggcctctggcttc

SEQ ID NO: 6707318 - DNA, 21 bp, Homo sapiens
cagggcctctggcttccctgc

SEQ ID NO: 6707319 - DNA, 12 bp, Homo sapiens
cagggcctctgt

SEQ ID NO: 6707320 - DNA, 17 bp, Homo sapiens
cagggcctgacaccccc

SEQ ID NO: 6707321 - DNA, 19 bp, Homo sapiens
cagggcctgacaccccctc

SEQ ID NO: 6707322 - DNA, 18 bp, Homo sapiens
cagggcctgacttgagcc

SEQ ID NO: 6707323 - DNA, 19 bp, Homo sapiens
cagggcctgacttgagcca

SEQ ID NO: 6707324 - DNA, 22 bp, Homo sapiens
cagggcctgacttgagccactc

SEQ ID NO: 6707325 - DNA, 16 bp, Homo sapiens
cagggcctgactttta

SEQ ID NO: 6707326 - DNA, 20 bp, Homo sapiens
cagggcctgacttttacagc

SEQ ID NO: 6707327 - DNA, 17 bp, Homo sapiens
cagggcctgagcctggc

SEQ ID NO: 6707328 - DNA, 18 bp, Homo sapiens
cagggcctgagcctggcc

SEQ ID NO: 6707329 - DNA, 20 bp, Homo sapiens
cagggcctgagtgacctcct

SEQ ID NO: 6707330 - DNA, 13 bp, Homo sapiens
cagggcctgcccc

SEQ ID NO: 6707331 - DNA, 14 bp, Homo sapiens
cagggcctgccccc

SEQ ID NO: 6707332 - DNA, 18 bp, Homo sapiens
cagggcctgccccctggg

SEQ ID NO: 6707333 - DNA, 12 bp, Homo sapiens
cagggcctgcta

SEQ ID NO: 6707334 - DNA, 18 bp, Homo sapiens
cagggcctggaagacaga

SEQ ID NO: 6707335 - DNA, 14 bp, Homo sapiens
cagggcctggagcc

SEQ ID NO: 6707336 - DNA, 11 bp, Homo sapiens
cagggcctggc

SEQ ID NO: 6707337 - DNA, 12 bp, Homo sapiens
cagggcctggca

SEQ ID NO: 6707338 - DNA, 17 bp, Homo sapiens
cagggcctggcaggcca

SEQ ID NO: 6707339 - DNA, 18 bp, Homo sapiens
cagggcctggcaggccag

SEQ ID NO: 6707340 - DNA, 14 bp, Homo sapiens
cagggcctggcata

SEQ ID NO: 6707341 - DNA, 15 bp, Homo sapiens
cagggcctggcccat

SEQ ID NO: 6707342 - DNA, 19 bp, Homo sapiens
cagggcctggctcaggtgg

SEQ ID NO: 6707343 - DNA, 14 bp, Homo sapiens
cagggcctggctcc

SEQ ID NO: 6707344 - DNA, 15 bp, Homo sapiens
cagggcctggctcca

SEQ ID NO: 6707345 - DNA, 16 bp, Homo sapiens
cagggcctggctccag

SEQ ID NO: 6707346 - DNA, 14 bp, Homo sapiens
cagggcctgggcct

SEQ ID NO: 6707347 - DNA, 20 bp, Homo sapiens
cagggcctggggcctgagag

SEQ ID NO: 6707348 - DNA, 21 bp, Homo sapiens
cagggcctggggcctgagaga

SEQ ID NO: 6707349 - DNA, 11 bp, Homo sapiens
cagggcctggt

SEQ ID NO: 6707350 - DNA, 12 bp, Homo sapiens
cagggcctggtg

SEQ ID NO: 6707351 - DNA, 14 bp, Homo sapiens
cagggcctggtgtg

SEQ ID NO: 6707352 - DNA, 15 bp, Homo sapiens
cagggcctggtgtga

SEQ ID NO: 6707353 - DNA, 14 bp, Homo sapiens
cagggcctgtctca

SEQ ID NO: 6707354 - DNA, 14 bp, Homo sapiens
cagggcctgtctcc

SEQ ID NO: 6707355 - DNA, 14 bp, Homo sapiens
cagggccttctgcc

SEQ ID NO: 6707356 - DNA, 16 bp, Homo sapiens
cagggccttgcccaga

SEQ ID NO: 6707357 - DNA, 18 bp, Homo sapiens
cagggccttgcccagaga

SEQ ID NO: 6707358 - DNA, 18 bp, Homo sapiens
cagggccttggcccaggg

SEQ ID NO: 6707359 - DNA, 20 bp, Homo sapiens
cagggcctttctcctcccca

SEQ ID NO: 6707360 - DNA, 23 bp, Homo sapiens
cagggcctttctcctccccacct

SEQ ID NO: 6707361 - DNA, 14 bp, Homo sapiens
cagggcgctcagac

SEQ ID NO: 6707362 - DNA, 19 bp, Homo sapiens
cagggcgctccggcagagg

SEQ ID NO: 6707363 - DNA, 21 bp, Homo sapiens
cagggcgctccggcagaggca

SEQ ID NO: 6707364 - DNA, 22 bp, Homo sapiens
cagggcggccagggacccaaag

SEQ ID NO: 6707365 - DNA, 13 bp, Homo sapiens
cagggcggcctcc

SEQ ID NO: 6707366 - DNA, 18 bp, Homo sapiens
cagggcggctaggccggc

SEQ ID NO: 6707367 - DNA, 21 bp, Homo sapiens
cagggcggctaggccggccag

SEQ ID NO: 6707368 - DNA, 13 bp, Homo sapiens
cagggcggctgcc

SEQ ID NO: 6707369 - DNA, 14 bp, Homo sapiens
cagggcggctgccg

SEQ ID NO: 6707370 - DNA, 16 bp, Homo sapiens
cagggcgggcagaggg

SEQ ID NO: 6707371 - DNA, 19 bp, Homo sapiens
cagggcgggcagagggctg

SEQ ID NO: 6707372 - DNA, 13 bp, Homo sapiens
cagggcgggccag

SEQ ID NO: 6707373 - DNA, 15 bp, Homo sapiens
cagggcgggccagga

SEQ ID NO: 6707374 - DNA, 20 bp, Homo sapiens
cagggcggggctggccagct

SEQ ID NO: 6707375 - DNA, 23 bp, Homo sapiens
cagggcgggggggggggcggtgt

SEQ ID NO: 6707376 - DNA, 15 bp, Homo sapiens
cagggcgggggtggc

SEQ ID NO: 6707377 - DNA, 23 bp, Homo sapiens
cagggcggtaccttgtgcccagg

SEQ ID NO: 6707378 - DNA, 17 bp, Homo sapiens
cagggctaaataaagag

SEQ ID NO: 6707379 - DNA, 18 bp, Homo sapiens
cagggctaaataaagagg

SEQ ID NO: 6707380 - DNA, 19 bp, Homo sapiens
cagggctaaataaagagga

SEQ ID NO: 6707381 - DNA, 20 bp, Homo sapiens
cagggctaaataaagaggag

SEQ ID NO: 6707382 - DNA, 15 bp, Homo sapiens
cagggctaccctccc

SEQ ID NO: 6707383 - DNA, 14 bp, Homo sapiens
cagggctaccctga

SEQ ID NO: 6707384 - DNA, 19 bp, Homo sapiens
cagggctaccctgagctga

SEQ ID NO: 6707385 - DNA, 22 bp, Homo sapiens
cagggctaccctgagctgaggc

SEQ ID NO: 6707386 - DNA, 24 bp, Homo sapiens
cagggctaccctgagctgaggcag

SEQ ID NO: 6707387 - DNA, 14 bp, Homo sapiens
cagggctagtataa

SEQ ID NO: 6707388 - DNA, 17 bp, Homo sapiens
cagggctagtataaaca

SEQ ID NO: 6707389 - DNA, 20 bp, Homo sapiens
cagggctagtgaagtggcct

SEQ ID NO: 6707390 - DNA, 18 bp, Homo sapiens
cagggctagtgacttgtg

SEQ ID NO: 6707391 - DNA, 19 bp, Homo sapiens
cagggctcacactcctggg

SEQ ID NO: 6707392 - DNA, 13 bp, Homo sapiens
cagggctcacagg

SEQ ID NO: 6707393 - DNA, 14 bp, Homo sapiens
cagggctcacaggg

SEQ ID NO: 6707394 - DNA, 15 bp, Homo sapiens
cagggctcacagggc

SEQ ID NO: 6707395 - DNA, 14 bp, Homo sapiens
cagggctcagagtg

SEQ ID NO: 6707396 - DNA, 22 bp, Homo sapiens
cagggctcagagtgaccctcag

SEQ ID NO: 6707397 - DNA, 21 bp, Homo sapiens
cagggctcagatggggcctgg

SEQ ID NO: 6707398 - DNA, 20 bp, Homo sapiens
cagggctcagcggggacagc

SEQ ID NO: 6707399 - DNA, 23 bp, Homo sapiens
cagggctcagcggggacagctcc

SEQ ID NO: 6707400 - DNA, 14 bp, Homo sapiens
cagggctcagctcc

SEQ ID NO: 6707401 - DNA, 16 bp, Homo sapiens
cagggctcatgatttt

SEQ ID NO: 6707402 - DNA, 13 bp, Homo sapiens
cagggctccaaat

SEQ ID NO: 6707403 - DNA, 15 bp, Homo sapiens
cagggctccacagag

SEQ ID NO: 6707404 - DNA, 21 bp, Homo sapiens
cagggctccacgggggcctag

SEQ ID NO: 6707405 - DNA, 12 bp, Homo sapiens
cagggctccagc

SEQ ID NO: 6707406 - DNA, 19 bp, Homo sapiens
cagggctcccacagagaca

SEQ ID NO: 6707407 - DNA, 12 bp, Homo sapiens
cagggctcccag

SEQ ID NO: 6707408 - DNA, 23 bp, Homo sapiens
cagggctcccggagagggagtca

SEQ ID NO: 6707409 - DNA, 12 bp, Homo sapiens
cagggctccctc

SEQ ID NO: 6707410 - DNA, 18 bp, Homo sapiens
cagggctccctcctggag

SEQ ID NO: 6707411 - DNA, 13 bp, Homo sapiens
cagggctcctccc

SEQ ID NO: 6707412 - DNA, 15 bp, Homo sapiens
cagggctcctcccag

SEQ ID NO: 6707413 - DNA, 20 bp, Homo sapiens
cagggctcctcccagcttgt

SEQ ID NO: 6707414 - DNA, 14 bp, Homo sapiens
cagggctcctccct

SEQ ID NO: 6707415 - DNA, 15 bp, Homo sapiens
cagggctcctccctg

SEQ ID NO: 6707416 - DNA, 16 bp, Homo sapiens
cagggctcctccctgg

SEQ ID NO: 6707417 - DNA, 17 bp, Homo sapiens
cagggctcctccctgga

SEQ ID NO: 6707418 - DNA, 19 bp, Homo sapiens
cagggctcctccctggagc

SEQ ID NO: 6707419 - DNA, 20 bp, Homo sapiens
cagggctcctccctggagct

SEQ ID NO: 6707420 - DNA, 11 bp, Homo sapiens
cagggctcctg

SEQ ID NO: 6707421 - DNA, 23 bp, Homo sapiens
cagggctcctgccttctgtcctg

SEQ ID NO: 6707422 - DNA, 14 bp, Homo sapiens
cagggctccttgtg

SEQ ID NO: 6707423 - DNA, 21 bp, Homo sapiens
cagggctccttgtgggcctgg

SEQ ID NO: 6707424 - DNA, 20 bp, Homo sapiens
cagggctcgggcgctgtggc

SEQ ID NO: 6707425 - DNA, 23 bp, Homo sapiens
cagggctcgggcgctgtggctcc

SEQ ID NO: 6707426 - DNA, 17 bp, Homo sapiens
cagggctctaccaagac

SEQ ID NO: 6707427 - DNA, 18 bp, Homo sapiens
cagggctctaccaagaca

SEQ ID NO: 6707428 - DNA, 16 bp, Homo sapiens
cagggctctcctggct

SEQ ID NO: 6707429 - DNA, 15 bp, Homo sapiens
cagggctctctggac

SEQ ID NO: 6707430 - DNA, 21 bp, Homo sapiens
cagggctctctttccttcttg

SEQ ID NO: 6707431 - DNA, 21 bp, Homo sapiens
cagggctctgactctgccagg

SEQ ID NO: 6707432 - DNA, 13 bp, Homo sapiens
cagggctctgcag

SEQ ID NO: 6707433 - DNA, 17 bp, Homo sapiens
cagggctctgcagcacc

SEQ ID NO: 6707434 - DNA, 20 bp, Homo sapiens
cagggctctgcaggccactg

SEQ ID NO: 6707435 - DNA, 15 bp, Homo sapiens
cagggctctgcccca

SEQ ID NO: 6707436 - DNA, 20 bp, Homo sapiens
cagggctctgccccagaggc

SEQ ID NO: 6707437 - DNA, 17 bp, Homo sapiens
cagggctctggggccag

SEQ ID NO: 6707438 - DNA, 13 bp, Homo sapiens
cagggctcttcca

SEQ ID NO: 6707439 - DNA, 17 bp, Homo sapiens
cagggctgagcgtggaa

SEQ ID NO: 6707440 - DNA, 17 bp, Homo sapiens
cagggctgagtgttctg

SEQ ID NO: 6707441 - DNA, 13 bp, Homo sapiens
cagggctgcaggg

SEQ ID NO: 6707442 - DNA, 20 bp, Homo sapiens
cagggctgccactaacctgt

SEQ ID NO: 6707443 - DNA, 23 bp, Homo sapiens
cagggctgccactaacctgtaga

SEQ ID NO: 6707444 - DNA, 22 bp, Homo sapiens
cagggctgccctgagaagctgc

SEQ ID NO: 6707445 - DNA, 24 bp, Homo sapiens
cagggctgctccccaacacctgcc

SEQ ID NO: 6707446 - DNA, 15 bp, Homo sapiens
cagggctgctctttc

SEQ ID NO: 6707447 - DNA, 23 bp, Homo sapiens
cagggctgctgggggcaactggc

SEQ ID NO: 6707448 - DNA, 13 bp, Homo sapiens
cagggctgctgtg

SEQ ID NO: 6707449 - DNA, 14 bp, Homo sapiens
cagggctgctgtgg

SEQ ID NO: 6707450 - DNA, 18 bp, Homo sapiens
cagggctgctgtggccca

SEQ ID NO: 6707451 - DNA, 20 bp, Homo sapiens
cagggctgctgtggcccagt

SEQ ID NO: 6707452 - DNA, 10 bp, Homo sapiens
cagggctgga

SEQ ID NO: 6707453 - DNA, 23 bp, Homo sapiens
cagggctggaaaagtcacacaga

SEQ ID NO: 6707454 - DNA, 21 bp, Homo sapiens
cagggctggactgaggcctga

SEQ ID NO: 6707455 - DNA, 23 bp, Homo sapiens
cagggctggactgaggcctgagc

SEQ ID NO: 6707456 - DNA, 18 bp, Homo sapiens
cagggctggagtgcgctc

SEQ ID NO: 6707457 - DNA, 22 bp, Homo sapiens
cagggctggagtgcgctcttgg

SEQ ID NO: 6707458 - DNA, 17 bp, Homo sapiens
cagggctggatggacag

SEQ ID NO: 6707459 - DNA, 22 bp, Homo sapiens
cagggctggatggacagacacc

SEQ ID NO: 6707460 - DNA, 22 bp, Homo sapiens
cagggctggcacgtgacaggct

SEQ ID NO: 6707461 - DNA, 13 bp, Homo sapiens
cagggctggccca

SEQ ID NO: 6707462 - DNA, 18 bp, Homo sapiens
cagggctggcccagccct

SEQ ID NO: 6707463 - DNA, 20 bp, Homo sapiens
cagggctggcccagccctgc

SEQ ID NO: 6707464 - DNA, 23 bp, Homo sapiens
cagggctggccccagggcaccct

SEQ ID NO: 6707465 - DNA, 14 bp, Homo sapiens
cagggctggcccta

SEQ ID NO: 6707466 - DNA, 15 bp, Homo sapiens
cagggctggccctag

SEQ ID NO: 6707467 - DNA, 19 bp, Homo sapiens
cagggctggccctaggcac

SEQ ID NO: 6707468 - DNA, 17 bp, Homo sapiens
cagggctggctcctctg

SEQ ID NO: 6707469 - DNA, 18 bp, Homo sapiens
cagggctggctcctctgc

SEQ ID NO: 6707470 - DNA, 11 bp, Homo sapiens
cagggctggga

SEQ ID NO: 6707471 - DNA, 17 bp, Homo sapiens
cagggctgggagaactt

SEQ ID NO: 6707472 - DNA, 12 bp, Homo sapiens
cagggctgggcc

SEQ ID NO: 6707473 - DNA, 14 bp, Homo sapiens
cagggctgggccag

SEQ ID NO: 6707474 - DNA, 19 bp, Homo sapiens
cagggctgggccaggtctc

SEQ ID NO: 6707475 - DNA, 13 bp, Homo sapiens
cagggctgggcct

SEQ ID NO: 6707476 - DNA, 14 bp, Homo sapiens
cagggctgggcctg

SEQ ID NO: 6707477 - DNA, 16 bp, Homo sapiens
cagggctgggccttgt

SEQ ID NO: 6707478 - DNA, 17 bp, Homo sapiens
cagggctgggcgcctct

SEQ ID NO: 6707479 - DNA, 18 bp, Homo sapiens
cagggctgggcgcctctg

SEQ ID NO: 6707480 - DNA, 23 bp, Homo sapiens
cagggctgggcgcctctgtcctg

SEQ ID NO: 6707481 - DNA, 20 bp, Homo sapiens
cagggctggggcagcctctg

SEQ ID NO: 6707482 - DNA, 13 bp, Homo sapiens
cagggctggggcc

SEQ ID NO: 6707483 - DNA, 19 bp, Homo sapiens
cagggctggggccaagagg

SEQ ID NO: 6707484 - DNA, 23 bp, Homo sapiens
cagggctggggccaagaggaaaa

SEQ ID NO: 6707485 - DNA, 19 bp, Homo sapiens
cagggctggggtgagcctg

SEQ ID NO: 6707486 - DNA, 20 bp, Homo sapiens
cagggctggggtgagcctga

SEQ ID NO: 6707487 - DNA, 21 bp, Homo sapiens
cagggctgggtcacaggaagg

SEQ ID NO: 6707488 - DNA, 15 bp, Homo sapiens
cagggctggtcttgg

SEQ ID NO: 6707489 - DNA, 20 bp, Homo sapiens
cagggctggtgtggctgctc

SEQ ID NO: 6707490 - DNA, 18 bp, Homo sapiens
cagggctgtaactgccag

SEQ ID NO: 6707491 - DNA, 21 bp, Homo sapiens
cagggctgtaactgccaggct

SEQ ID NO: 6707492 - DNA, 15 bp, Homo sapiens
cagggctgtcatctg

SEQ ID NO: 6707493 - DNA, 12 bp, Homo sapiens
cagggctgtccc

SEQ ID NO: 6707494 - DNA, 13 bp, Homo sapiens
cagggctgtcctt

SEQ ID NO: 6707495 - DNA, 16 bp, Homo sapiens
cagggctgtccttaga

SEQ ID NO: 6707496 - DNA, 22 bp, Homo sapiens
cagggctgtcttggtggatggg

SEQ ID NO: 6707497 - DNA, 14 bp, Homo sapiens
cagggctgtgcttg

SEQ ID NO: 6707498 - DNA, 23 bp, Homo sapiens
cagggctgtgcttgaaggccctg

SEQ ID NO: 6707499 - DNA, 15 bp, Homo sapiens
cagggctgtgggtgg

SEQ ID NO: 6707500 - DNA, 17 bp, Homo sapiens
cagggctgtgggtgggg

SEQ ID NO: 6707501 - DNA, 21 bp, Homo sapiens
cagggctgttggaggaccccg

SEQ ID NO: 6707502 - DNA, 19 bp, Homo sapiens
cagggcttacctgtacact

SEQ ID NO: 6707503 - DNA, 16 bp, Homo sapiens
cagggcttacggccct

SEQ ID NO: 6707504 - DNA, 23 bp, Homo sapiens
cagggcttacggccctggccttg

SEQ ID NO: 6707505 - DNA, 22 bp, Homo sapiens
cagggcttccccatcagctccc

SEQ ID NO: 6707506 - DNA, 17 bp, Homo sapiens
cagggcttctcctcctc

SEQ ID NO: 6707507 - DNA, 14 bp, Homo sapiens
cagggcttctcctg

SEQ ID NO: 6707508 - DNA, 14 bp, Homo sapiens
cagggcttggggag

SEQ ID NO: 6707509 - DNA, 15 bp, Homo sapiens
cagggcttggggagc

SEQ ID NO: 6707510 - DNA, 21 bp, Homo sapiens
cagggcttggggagcaggtct

SEQ ID NO: 6707511 - DNA, 21 bp, Homo sapiens
cagggcttgtccctccaactg

SEQ ID NO: 6707512 - DNA, 23 bp, Homo sapiens
cagggcttgtggactctctgcct

SEQ ID NO: 6707513 - DNA, 22 bp, Homo sapiens
cagggctttactccgtaacaga

SEQ ID NO: 6707514 - DNA, 21 bp, Homo sapiens
cagggctttggggggcactag

SEQ ID NO: 6707515 - DNA, 23 bp, Homo sapiens
cagggctttggggggcactagaa

SEQ ID NO: 6707516 - DNA, 21 bp, Homo sapiens
caggggaacactggggacttg

SEQ ID NO: 6707517 - DNA, 16 bp, Homo sapiens
caggggaactggcagc

SEQ ID NO: 6707518 - DNA, 15 bp, Homo sapiens
caggggaagagaaga

SEQ ID NO: 6707519 - DNA, 18 bp, Homo sapiens
caggggaagagaagacaa

SEQ ID NO: 6707520 - DNA, 14 bp, Homo sapiens
caggggaagcagga

SEQ ID NO: 6707521 - DNA, 15 bp, Homo sapiens
caggggaagccagtg

SEQ ID NO: 6707522 - DNA, 20 bp, Homo sapiens
caggggaagccagtgacact

SEQ ID NO: 6707523 - DNA, 16 bp, Homo sapiens
caggggaaggaaggag

SEQ ID NO: 6707524 - DNA, 19 bp, Homo sapiens
caggggaatattttattca

SEQ ID NO: 6707525 - DNA, 23 bp, Homo sapiens
caggggaatattttattcaaggt

SEQ ID NO: 6707526 - DNA, 16 bp, Homo sapiens
caggggacacccagaa

SEQ ID NO: 6707527 - DNA, 14 bp, Homo sapiens
caggggacactgaa

SEQ ID NO: 6707528 - DNA, 15 bp, Homo sapiens
caggggacactggcc

SEQ ID NO: 6707529 - DNA, 17 bp, Homo sapiens
caggggacactggcccc

SEQ ID NO: 6707530 - DNA, 22 bp, Homo sapiens
caggggacactggccccacagg

SEQ ID NO: 6707531 - DNA, 17 bp, Homo sapiens
caggggaccacacctcc

SEQ ID NO: 6707532 - DNA, 14 bp, Homo sapiens
caggggaccagagg

SEQ ID NO: 6707533 - DNA, 15 bp, Homo sapiens
caggggaccagaggg

SEQ ID NO: 6707534 - DNA, 18 bp, Homo sapiens
caggggaccagagggatg

SEQ ID NO: 6707535 - DNA, 21 bp, Homo sapiens
caggggaccagagggatggga

SEQ ID NO: 6707536 - DNA, 17 bp, Homo sapiens
caggggaccccactccc

SEQ ID NO: 6707537 - DNA, 20 bp, Homo sapiens
caggggaccccactcccctc

SEQ ID NO: 6707538 - DNA, 16 bp, Homo sapiens
caggggacgtggcgct

SEQ ID NO: 6707539 - DNA, 18 bp, Homo sapiens
caggggacgtgggccctg

SEQ ID NO: 6707540 - DNA, 22 bp, Homo sapiens
caggggacgtgggccctgcagg

SEQ ID NO: 6707541 - DNA, 20 bp, Homo sapiens
caggggactcagccctgagg

SEQ ID NO: 6707542 - DNA, 15 bp, Homo sapiens
caggggactgggcca

SEQ ID NO: 6707543 - DNA, 18 bp, Homo sapiens
caggggagaagctgaagc

SEQ ID NO: 6707544 - DNA, 17 bp, Homo sapiens
caggggagaatgcagcc

SEQ ID NO: 6707545 - DNA, 18 bp, Homo sapiens
caggggagaatgcagccc

SEQ ID NO: 6707546 - DNA, 19 bp, Homo sapiens
caggggagaatgcagccca

SEQ ID NO: 6707547 - DNA, 20 bp, Homo sapiens
caggggagaatgcagcccac

SEQ ID NO: 6707548 - DNA, 16 bp, Homo sapiens
caggggagacaggagc

SEQ ID NO: 6707549 - DNA, 22 bp, Homo sapiens
caggggagacaggagcctagcg

SEQ ID NO: 6707550 - DNA, 16 bp, Homo sapiens
caggggagacttaggc

SEQ ID NO: 6707551 - DNA, 13 bp, Homo sapiens
caggggagcaagc

SEQ ID NO: 6707552 - DNA, 12 bp, Homo sapiens
caggggagccag

SEQ ID NO: 6707553 - DNA, 16 bp, Homo sapiens
caggggagccagctgc

SEQ ID NO: 6707554 - DNA, 19 bp, Homo sapiens
caggggagccagctgcttg

SEQ ID NO: 6707555 - DNA, 20 bp, Homo sapiens
caggggagccagctgcttga

SEQ ID NO: 6707556 - DNA, 18 bp, Homo sapiens
caggggagccagggtaga

SEQ ID NO: 6707557 - DNA, 12 bp, Homo sapiens
caggggagccct

SEQ ID NO: 6707558 - DNA, 15 bp, Homo sapiens
caggggagccctcca

SEQ ID NO: 6707559 - DNA, 21 bp, Homo sapiens
caggggagccctccacgccgg

SEQ ID NO: 6707560 - DNA, 18 bp, Homo sapiens
caggggagcgtgttcctg

SEQ ID NO: 6707561 - DNA, 16 bp, Homo sapiens
caggggaggaaaaaag

SEQ ID NO: 6707562 - DNA, 13 bp, Homo sapiens
caggggaggagcc

SEQ ID NO: 6707563 - DNA, 12 bp, Homo sapiens
caggggaggctg

SEQ ID NO: 6707564 - DNA, 14 bp, Homo sapiens
caggggaggctgag

SEQ ID NO: 6707565 - DNA, 20 bp, Homo sapiens
caggggagggaaaagctaag

SEQ ID NO: 6707566 - DNA, 21 bp, Homo sapiens
caggggagggaaaagctaaga

SEQ ID NO: 6707567 - DNA, 21 bp, Homo sapiens
caggggaggggcgcaccccac

SEQ ID NO: 6707568 - DNA, 13 bp, Homo sapiens
caggggaggggtg

SEQ ID NO: 6707569 - DNA, 18 bp, Homo sapiens
caggggagggtgcggcag

SEQ ID NO: 6707570 - DNA, 20 bp, Homo sapiens
caggggatccagctcaaggg

SEQ ID NO: 6707571 - DNA, 16 bp, Homo sapiens
caggggatgcccagaa

SEQ ID NO: 6707572 - DNA, 20 bp, Homo sapiens
caggggatggggtgggggga

SEQ ID NO: 6707573 - DNA, 18 bp, Homo sapiens
caggggatgtttacctgg

SEQ ID NO: 6707574 - DNA, 22 bp, Homo sapiens
caggggcacagacctctcccac

SEQ ID NO: 6707575 - DNA, 16 bp, Homo sapiens
caggggcaccctccaa

SEQ ID NO: 6707576 - DNA, 17 bp, Homo sapiens
caggggcactgtgttct

SEQ ID NO: 6707577 - DNA, 15 bp, Homo sapiens
caggggcagcaaggc

SEQ ID NO: 6707578 - DNA, 14 bp, Homo sapiens
caggggcagcccca

SEQ ID NO: 6707579 - DNA, 14 bp, Homo sapiens
caggggcaggaacc

SEQ ID NO: 6707580 - DNA, 17 bp, Homo sapiens
caggggcaggagaggct

SEQ ID NO: 6707581 - DNA, 20 bp, Homo sapiens
caggggcaggagaggctggg

SEQ ID NO: 6707582 - DNA, 23 bp, Homo sapiens
caggggcaggagaggctgggctg

SEQ ID NO: 6707583 - DNA, 15 bp, Homo sapiens
caggggcaggaggga

SEQ ID NO: 6707584 - DNA, 11 bp, Homo sapiens
caggggcaggc

SEQ ID NO: 6707585 - DNA, 12 bp, Homo sapiens
caggggcaggca

SEQ ID NO: 6707586 - DNA, 13 bp, Homo sapiens
caggggcaggcac

SEQ ID NO: 6707587 - DNA, 13 bp, Homo sapiens
caggggcaggcag

SEQ ID NO: 6707588 - DNA, 14 bp, Homo sapiens
caggggcaggcagg

SEQ ID NO: 6707589 - DNA, 17 bp, Homo sapiens
caggggcaggcctggga

SEQ ID NO: 6707590 - DNA, 14 bp, Homo sapiens
caggggcaggcgca

SEQ ID NO: 6707591 - DNA, 18 bp, Homo sapiens
caggggcaggcgcagagg

SEQ ID NO: 6707592 - DNA, 13 bp, Homo sapiens
caggggcaggggc

SEQ ID NO: 6707593 - DNA, 11 bp, Homo sapiens
caggggcaggt

SEQ ID NO: 6707594 - DNA, 17 bp, Homo sapiens
caggggcaggtggtgga

SEQ ID NO: 6707595 - DNA, 21 bp, Homo sapiens
caggggcaggtggtggagggg

SEQ ID NO: 6707596 - DNA, 16 bp, Homo sapiens
caggggcagtggcctg

SEQ ID NO: 6707597 - DNA, 22 bp, Homo sapiens
caggggcagtggcctggatgca

SEQ ID NO: 6707598 - DNA, 20 bp, Homo sapiens
caggggcagttttagcagca

SEQ ID NO: 6707599 - DNA, 21 bp, Homo sapiens
caggggcagttttagcagcac

SEQ ID NO: 6707600 - DNA, 15 bp, Homo sapiens
caggggcatgactgt

SEQ ID NO: 6707601 - DNA, 20 bp, Homo sapiens
caggggccaacctcaggctc

SEQ ID NO: 6707602 - DNA, 21 bp, Homo sapiens
caggggccaacctcaggctcc

SEQ ID NO: 6707603 - DNA, 17 bp, Homo sapiens
caggggccaagcaggca

SEQ ID NO: 6707604 - DNA, 20 bp, Homo sapiens
caggggccaattttggatga

SEQ ID NO: 6707605 - DNA, 17 bp, Homo sapiens
caggggccagagagcag

SEQ ID NO: 6707606 - DNA, 21 bp, Homo sapiens
caggggccagatgattttcct

SEQ ID NO: 6707607 - DNA, 13 bp, Homo sapiens
caggggccaggag

SEQ ID NO: 6707608 - DNA, 11 bp, Homo sapiens
caggggccatg

SEQ ID NO: 6707609 - DNA, 20 bp, Homo sapiens
caggggcccacttggggcct

SEQ ID NO: 6707610 - DNA, 16 bp, Homo sapiens
caggggccccagatct

SEQ ID NO: 6707611 - DNA, 15 bp, Homo sapiens
caggggcccctccag

SEQ ID NO: 6707612 - DNA, 16 bp, Homo sapiens
caggggcccctccagc

SEQ ID NO: 6707613 - DNA, 17 bp, Homo sapiens
caggggcccctcctctg

SEQ ID NO: 6707614 - DNA, 19 bp, Homo sapiens
caggggcccctcctctgtg

SEQ ID NO: 6707615 - DNA, 20 bp, Homo sapiens
caggggcccctcctctgtgc

SEQ ID NO: 6707616 - DNA, 23 bp, Homo sapiens
caggggcccctcctctgtgctcc

SEQ ID NO: 6707617 - DNA, 14 bp, Homo sapiens
caggggccctacct

SEQ ID NO: 6707618 - DNA, 17 bp, Homo sapiens
caggggccctggagcag

SEQ ID NO: 6707619 - DNA, 18 bp, Homo sapiens
caggggccctggagcagc

SEQ ID NO: 6707620 - DNA, 18 bp, Homo sapiens
caggggcccttgggacag

SEQ ID NO: 6707621 - DNA, 19 bp, Homo sapiens
caggggcctaaggagggtc

SEQ ID NO: 6707622 - DNA, 14 bp, Homo sapiens
caggggcctggaga

SEQ ID NO: 6707623 - DNA, 15 bp, Homo sapiens
caggggcctggagat

SEQ ID NO: 6707624 - DNA, 15 bp, Homo sapiens
caggggcctggagga

SEQ ID NO: 6707625 - DNA, 16 bp, Homo sapiens
caggggcctggaggaa

SEQ ID NO: 6707626 - DNA, 15 bp, Homo sapiens
caggggcctggaggt

SEQ ID NO: 6707627 - DNA, 18 bp, Homo sapiens
caggggcctggaggtctg

SEQ ID NO: 6707628 - DNA, 22 bp, Homo sapiens
caggggcctggaggtctggctg

SEQ ID NO: 6707629 - DNA, 12 bp, Homo sapiens
caggggcctggg

SEQ ID NO: 6707630 - DNA, 16 bp, Homo sapiens
caggggcgagttcctc

SEQ ID NO: 6707631 - DNA, 21 bp, Homo sapiens
caggggcgcttgggaggggcc

SEQ ID NO: 6707632 - DNA, 19 bp, Homo sapiens
caggggcgggcggagggag

SEQ ID NO: 6707633 - DNA, 13 bp, Homo sapiens
caggggcggggca

SEQ ID NO: 6707634 - DNA, 20 bp, Homo sapiens
caggggcgggtgatgagacc

SEQ ID NO: 6707635 - DNA, 17 bp, Homo sapiens
caggggcgggtggatca

SEQ ID NO: 6707636 - DNA, 16 bp, Homo sapiens
caggggcggtccagag

SEQ ID NO: 6707637 - DNA, 17 bp, Homo sapiens
caggggctacaagaggg

SEQ ID NO: 6707638 - DNA, 18 bp, Homo sapiens
caggggctacaagaggga

SEQ ID NO: 6707639 - DNA, 19 bp, Homo sapiens
caggggctacaagagggaa

SEQ ID NO: 6707640 - DNA, 15 bp, Homo sapiens
caggggctccacctg

SEQ ID NO: 6707641 - DNA, 16 bp, Homo sapiens
caggggctccacctgt

SEQ ID NO: 6707642 - DNA, 13 bp, Homo sapiens
caggggctccatg

SEQ ID NO: 6707643 - DNA, 17 bp, Homo sapiens
caggggctccatgccag

SEQ ID NO: 6707644 - DNA, 21 bp, Homo sapiens
caggggctccatgctgggtct

SEQ ID NO: 6707645 - DNA, 13 bp, Homo sapiens
caggggctcccta

SEQ ID NO: 6707646 - DNA, 16 bp, Homo sapiens
caggggctccctacat

SEQ ID NO: 6707647 - DNA, 14 bp, Homo sapiens
caggggctcctggg

SEQ ID NO: 6707648 - DNA, 15 bp, Homo sapiens
caggggctcctgggt

SEQ ID NO: 6707649 - DNA, 16 bp, Homo sapiens
caggggctcctgggtt

SEQ ID NO: 6707650 - DNA, 17 bp, Homo sapiens
caggggctcctgggttg

SEQ ID NO: 6707651 - DNA, 16 bp, Homo sapiens
caggggctctgagccc

SEQ ID NO: 6707652 - DNA, 22 bp, Homo sapiens
caggggctctgcttcctcagcc

SEQ ID NO: 6707653 - DNA, 16 bp, Homo sapiens
caggggctctggagag

SEQ ID NO: 6707654 - DNA, 17 bp, Homo sapiens
caggggctctggagaga

SEQ ID NO: 6707655 - DNA, 18 bp, Homo sapiens
caggggctctggagagaa

SEQ ID NO: 6707656 - DNA, 16 bp, Homo sapiens
caggggctctgtggca

SEQ ID NO: 6707657 - DNA, 15 bp, Homo sapiens
caggggctctgtgtt

SEQ ID NO: 6707658 - DNA, 16 bp, Homo sapiens
caggggctctgtgtta

SEQ ID NO: 6707659 - DNA, 22 bp, Homo sapiens
caggggctgactctccagggag

SEQ ID NO: 6707660 - DNA, 16 bp, Homo sapiens
caggggctgcagcccc

SEQ ID NO: 6707661 - DNA, 13 bp, Homo sapiens
caggggctgcagt

SEQ ID NO: 6707662 - DNA, 23 bp, Homo sapiens
caggggctgcatcctcagcccca

SEQ ID NO: 6707663 - DNA, 13 bp, Homo sapiens
caggggctgcccg

SEQ ID NO: 6707664 - DNA, 16 bp, Homo sapiens
caggggctgcccgctc

SEQ ID NO: 6707665 - DNA, 20 bp, Homo sapiens
caggggctgcccgctcccag

SEQ ID NO: 6707666 - DNA, 22 bp, Homo sapiens
caggggctgctcatcacccagt

SEQ ID NO: 6707667 - DNA, 18 bp, Homo sapiens
caggggctgctgggggct

SEQ ID NO: 6707668 - DNA, 18 bp, Homo sapiens
caggggctgcttcctcct

SEQ ID NO: 6707669 - DNA, 19 bp, Homo sapiens
caggggctgcttcctcctg

SEQ ID NO: 6707670 - DNA, 22 bp, Homo sapiens
caggggctgcttcctcctggaa

SEQ ID NO: 6707671 - DNA, 12 bp, Homo sapiens
caggggctgggc

SEQ ID NO: 6707672 - DNA, 13 bp, Homo sapiens
caggggctgggca

SEQ ID NO: 6707673 - DNA, 17 bp, Homo sapiens
caggggctgggcagagg

SEQ ID NO: 6707674 - DNA, 13 bp, Homo sapiens
caggggctgggga

SEQ ID NO: 6707675 - DNA, 14 bp, Homo sapiens
caggggctggggac

SEQ ID NO: 6707676 - DNA, 15 bp, Homo sapiens
caggggctggggact

SEQ ID NO: 6707677 - DNA, 16 bp, Homo sapiens
caggggctggggactt

SEQ ID NO: 6707678 - DNA, 14 bp, Homo sapiens
caggggctgggggt

SEQ ID NO: 6707679 - DNA, 20 bp, Homo sapiens
caggggctgtggccgtctcc

SEQ ID NO: 6707680 - DNA, 15 bp, Homo sapiens
caggggcttcctggt

SEQ ID NO: 6707681 - DNA, 16 bp, Homo sapiens
caggggcttcctggtg

SEQ ID NO: 6707682 - DNA, 20 bp, Homo sapiens
caggggcttcctggtgctgg

SEQ ID NO: 6707683 - DNA, 15 bp, Homo sapiens
caggggcttctcccc

SEQ ID NO: 6707684 - DNA, 16 bp, Homo sapiens
caggggcttgagaagg

SEQ ID NO: 6707685 - DNA, 20 bp, Homo sapiens
caggggctttggaagctctg

SEQ ID NO: 6707686 - DNA, 21 bp, Homo sapiens
caggggctttggaagctctgt

SEQ ID NO: 6707687 - DNA, 16 bp, Homo sapiens
cagggggaaaatgttt

SEQ ID NO: 6707688 - DNA, 14 bp, Homo sapiens
cagggggaagaagc

SEQ ID NO: 6707689 - DNA, 20 bp, Homo sapiens
cagggggaagaagcagagag

SEQ ID NO: 6707690 - DNA, 19 bp, Homo sapiens
cagggggaagcaccagcct

SEQ ID NO: 6707691 - DNA, 16 bp, Homo sapiens
cagggggaaggcttgg

SEQ ID NO: 6707692 - DNA, 16 bp, Homo sapiens
cagggggacagcaggg

SEQ ID NO: 6707693 - DNA, 19 bp, Homo sapiens
cagggggagctgggcctgg

SEQ ID NO: 6707694 - DNA, 12 bp, Homo sapiens
cagggggaggag

SEQ ID NO: 6707695 - DNA, 16 bp, Homo sapiens
cagggggagtctttgc

SEQ ID NO: 6707696 - DNA, 22 bp, Homo sapiens
cagggggattctgagcagtgcc

SEQ ID NO: 6707697 - DNA, 16 bp, Homo sapiens
cagggggatttggtag

SEQ ID NO: 6707698 - DNA, 15 bp, Homo sapiens
cagggggcaagagga

SEQ ID NO: 6707699 - DNA, 17 bp, Homo sapiens
cagggggcatgaccaga

SEQ ID NO: 6707700 - DNA, 16 bp, Homo sapiens
cagggggccagctggg

SEQ ID NO: 6707701 - DNA, 18 bp, Homo sapiens
cagggggccagctgggga

SEQ ID NO: 6707702 - DNA, 20 bp, Homo sapiens
cagggggccagctggggaga

SEQ ID NO: 6707703 - DNA, 20 bp, Homo sapiens
cagggggcccaccagagctg

SEQ ID NO: 6707704 - DNA, 23 bp, Homo sapiens
cagggggcccctttgctgaccct

SEQ ID NO: 6707705 - DNA, 22 bp, Homo sapiens
cagggggcccgaacagggactt

SEQ ID NO: 6707706 - DNA, 20 bp, Homo sapiens
cagggggccctgccccaccc

SEQ ID NO: 6707707 - DNA, 23 bp, Homo sapiens
cagggggcctgcaggccccagcc

SEQ ID NO: 6707708 - DNA, 19 bp, Homo sapiens
cagggggcctggagcatgg

SEQ ID NO: 6707709 - DNA, 15 bp, Homo sapiens
cagggggctgctgct

SEQ ID NO: 6707710 - DNA, 21 bp, Homo sapiens
cagggggctgctgctgggctc

SEQ ID NO: 6707711 - DNA, 15 bp, Homo sapiens
cagggggcttcctga

SEQ ID NO: 6707712 - DNA, 22 bp, Homo sapiens
cagggggcttggctcgcacccc

SEQ ID NO: 6707713 - DNA, 13 bp, Homo sapiens
caggggggagaag

SEQ ID NO: 6707714 - DNA, 13 bp, Homo sapiens
caggggggagagg

SEQ ID NO: 6707715 - DNA, 15 bp, Homo sapiens
caggggggcctcctc

SEQ ID NO: 6707716 - DNA, 20 bp, Homo sapiens
caggggggtcggaagcctgt

SEQ ID NO: 6707717 - DNA, 15 bp, Homo sapiens
caggggggtgaggag

SEQ ID NO: 6707718 - DNA, 13 bp, Homo sapiens
caggggggttggg

SEQ ID NO: 6707719 - DNA, 23 bp, Homo sapiens
caggggggttgggttccagacag

SEQ ID NO: 6707720 - DNA, 20 bp, Homo sapiens
cagggggtaggagagcactg

SEQ ID NO: 6707721 - DNA, 23 bp, Homo sapiens
cagggggtaggagagcactgcct

SEQ ID NO: 6707722 - DNA, 16 bp, Homo sapiens
cagggggtctggctgg

SEQ ID NO: 6707723 - DNA, 19 bp, Homo sapiens
cagggggtctggctggtgt

SEQ ID NO: 6707724 - DNA, 19 bp, Homo sapiens
cagggggtgaaggcaggag

SEQ ID NO: 6707725 - DNA, 21 bp, Homo sapiens
cagggggtggacaaactggag

SEQ ID NO: 6707726 - DNA, 18 bp, Homo sapiens
cagggggtgggaagggga

SEQ ID NO: 6707727 - DNA, 17 bp, Homo sapiens
cagggggttctgggacc

SEQ ID NO: 6707728 - DNA, 20 bp, Homo sapiens
cagggggtttgaggaccctc

SEQ ID NO: 6707729 - DNA, 17 bp, Homo sapiens
caggggtacacagagct

SEQ ID NO: 6707730 - DNA, 22 bp, Homo sapiens
caggggtacacagagctaaggc

SEQ ID NO: 6707731 - DNA, 23 bp, Homo sapiens
caggggtaccaggcacatggctg

SEQ ID NO: 6707732 - DNA, 23 bp, Homo sapiens
caggggtaggggtagggagcctc

SEQ ID NO: 6707733 - DNA, 21 bp, Homo sapiens
caggggtatatttagaccctg

SEQ ID NO: 6707734 - DNA, 15 bp, Homo sapiens
caggggtcagtgcag

SEQ ID NO: 6707735 - DNA, 18 bp, Homo sapiens
caggggtccagcacagcc

SEQ ID NO: 6707736 - DNA, 15 bp, Homo sapiens
caggggtccaggccc

SEQ ID NO: 6707737 - DNA, 20 bp, Homo sapiens
caggggtcccagccaccccg

SEQ ID NO: 6707738 - DNA, 16 bp, Homo sapiens
caggggtcccccctca

SEQ ID NO: 6707739 - DNA, 17 bp, Homo sapiens
caggggtccctgctagt

SEQ ID NO: 6707740 - DNA, 13 bp, Homo sapiens
caggggtcctaac

SEQ ID NO: 6707741 - DNA, 18 bp, Homo sapiens
caggggtcgtcaccacct

SEQ ID NO: 6707742 - DNA, 16 bp, Homo sapiens
caggggtctccctgag

SEQ ID NO: 6707743 - DNA, 19 bp, Homo sapiens
caggggtctccctgagcct

SEQ ID NO: 6707744 - DNA, 16 bp, Homo sapiens
caggggtctccctgga

SEQ ID NO: 6707745 - DNA, 22 bp, Homo sapiens
caggggtctccctggctccctc

SEQ ID NO: 6707746 - DNA, 23 bp, Homo sapiens
caggggtctgagctccagctcct

SEQ ID NO: 6707747 - DNA, 17 bp, Homo sapiens
caggggtctgggagtca

SEQ ID NO: 6707748 - DNA, 21 bp, Homo sapiens
caggggtctgggagtcaggcc

SEQ ID NO: 6707749 - DNA, 13 bp, Homo sapiens
caggggtgacaca

SEQ ID NO: 6707750 - DNA, 15 bp, Homo sapiens
caggggtgacacaga

SEQ ID NO: 6707751 - DNA, 18 bp, Homo sapiens
caggggtgacacagactc

SEQ ID NO: 6707752 - DNA, 19 bp, Homo sapiens
caggggtgacacagactca

SEQ ID NO: 6707753 - DNA, 23 bp, Homo sapiens
caggggtgactttgtctctcctg

SEQ ID NO: 6707754 - DNA, 15 bp, Homo sapiens
caggggtgagccccg

SEQ ID NO: 6707755 - DNA, 18 bp, Homo sapiens
caggggtgcacagtccac

SEQ ID NO: 6707756 - DNA, 15 bp, Homo sapiens
caggggtgctggggc

SEQ ID NO: 6707757 - DNA, 17 bp, Homo sapiens
caggggtgctggggcag

SEQ ID NO: 6707758 - DNA, 20 bp, Homo sapiens
caggggtgctggggcagagt

SEQ ID NO: 6707759 - DNA, 19 bp, Homo sapiens
caggggtggagggaaattg

SEQ ID NO: 6707760 - DNA, 14 bp, Homo sapiens
caggggtgggacac

SEQ ID NO: 6707761 - DNA, 20 bp, Homo sapiens
caggggtgggacaccctgtg

SEQ ID NO: 6707762 - DNA, 12 bp, Homo sapiens
caggggtgggag

SEQ ID NO: 6707763 - DNA, 13 bp, Homo sapiens
caggggtgggaga

SEQ ID NO: 6707764 - DNA, 17 bp, Homo sapiens
caggggtgggagagcca

SEQ ID NO: 6707765 - DNA, 23 bp, Homo sapiens
caggggtgggagagccagctctc

SEQ ID NO: 6707766 - DNA, 15 bp, Homo sapiens
caggggtgggaggct

SEQ ID NO: 6707767 - DNA, 21 bp, Homo sapiens
caggggtgggaggctcccaga

SEQ ID NO: 6707768 - DNA, 19 bp, Homo sapiens
caggggtggggcccatggg

SEQ ID NO: 6707769 - DNA, 12 bp, Homo sapiens
caggggtggggg

SEQ ID NO: 6707770 - DNA, 19 bp, Homo sapiens
caggggtggggggtgcagg

SEQ ID NO: 6707771 - DNA, 18 bp, Homo sapiens
caggggttagcctggact

SEQ ID NO: 6707772 - DNA, 18 bp, Homo sapiens
caggggttccagcttccc

SEQ ID NO: 6707773 - DNA, 20 bp, Homo sapiens
caggggttccccaggagaga

SEQ ID NO: 6707774 - DNA, 19 bp, Homo sapiens
caggggttccttctgggca

SEQ ID NO: 6707775 - DNA, 17 bp, Homo sapiens
caggggttcgagaccag

SEQ ID NO: 6707776 - DNA, 16 bp, Homo sapiens
caggggttgagagctt

SEQ ID NO: 6707777 - DNA, 15 bp, Homo sapiens
caggggttgcagtga

SEQ ID NO: 6707778 - DNA, 16 bp, Homo sapiens
caggggttggctggga

SEQ ID NO: 6707779 - DNA, 19 bp, Homo sapiens
caggggttggtcaaggcca

SEQ ID NO: 6707780 - DNA, 12 bp, Homo sapiens
cagggtaactaa

SEQ ID NO: 6707781 - DNA, 19 bp, Homo sapiens
cagggtaactaactaaaac

SEQ ID NO: 6707782 - DNA, 22 bp, Homo sapiens
cagggtaactaactaaaacaaa

SEQ ID NO: 6707783 - DNA, 22 bp, Homo sapiens
cagggtacccgcctgagctcct

SEQ ID NO: 6707784 - DNA, 21 bp, Homo sapiens
cagggtaccctttggggagca

SEQ ID NO: 6707785 - DNA, 14 bp, Homo sapiens
cagggtagaaaaag

SEQ ID NO: 6707786 - DNA, 22 bp, Homo sapiens
cagggtagaattgtttggcaat

SEQ ID NO: 6707787 - DNA, 23 bp, Homo sapiens
cagggtagacttggagctgtcct

SEQ ID NO: 6707788 - DNA, 24 bp, Homo sapiens
cagggtagacttggagctgtcctc

SEQ ID NO: 6707789 - DNA, 23 bp, Homo sapiens
cagggtagataacctgtacttca

SEQ ID NO: 6707790 - DNA, 22 bp, Homo sapiens
cagggtagatttctcttgggca

SEQ ID NO: 6707791 - DNA, 16 bp, Homo sapiens
cagggtagcagcagag

SEQ ID NO: 6707792 - DNA, 15 bp, Homo sapiens
cagggtagcccgcct

SEQ ID NO: 6707793 - DNA, 16 bp, Homo sapiens
cagggtagcccgcctg

SEQ ID NO: 6707794 - DNA, 21 bp, Homo sapiens
cagggtagcccgcctgccagt

SEQ ID NO: 6707795 - DNA, 19 bp, Homo sapiens
cagggtaggcaaggctgcc

SEQ ID NO: 6707796 - DNA, 15 bp, Homo sapiens
cagggtaggggaggg

SEQ ID NO: 6707797 - DNA, 13 bp, Homo sapiens
cagggtataaatt

SEQ ID NO: 6707798 - DNA, 15 bp, Homo sapiens
cagggtataaattat

SEQ ID NO: 6707799 - DNA, 13 bp, Homo sapiens
cagggtatgaaga

SEQ ID NO: 6707800 - DNA, 17 bp, Homo sapiens
cagggtatgaagagtgt

SEQ ID NO: 6707801 - DNA, 17 bp, Homo sapiens
cagggtattaacgtgtc

SEQ ID NO: 6707802 - DNA, 18 bp, Homo sapiens
cagggtattgcttgccac

SEQ ID NO: 6707803 - DNA, 16 bp, Homo sapiens
cagggtcaaagacaga

SEQ ID NO: 6707804 - DNA, 19 bp, Homo sapiens
cagggtcaaagacagaatg

SEQ ID NO: 6707805 - DNA, 13 bp, Homo sapiens
cagggtcaagcct

SEQ ID NO: 6707806 - DNA, 20 bp, Homo sapiens
cagggtcactgaaggcctgg

SEQ ID NO: 6707807 - DNA, 21 bp, Homo sapiens
cagggtcactgaaggcctggc

SEQ ID NO: 6707808 - DNA, 16 bp, Homo sapiens
cagggtcactgtcctt

SEQ ID NO: 6707809 - DNA, 18 bp, Homo sapiens
cagggtcactgtccttga

SEQ ID NO: 6707810 - DNA, 18 bp, Homo sapiens
cagggtcagaaacaggac

SEQ ID NO: 6707811 - DNA, 19 bp, Homo sapiens
cagggtcagaaacaggacc

SEQ ID NO: 6707812 - DNA, 15 bp, Homo sapiens
cagggtcaggcggag

SEQ ID NO: 6707813 - DNA, 19 bp, Homo sapiens
cagggtccaaaggccagcg

SEQ ID NO: 6707814 - DNA, 13 bp, Homo sapiens
cagggtccacagc

SEQ ID NO: 6707815 - DNA, 15 bp, Homo sapiens
cagggtccacagctg

SEQ ID NO: 6707816 - DNA, 16 bp, Homo sapiens
cagggtccacagctgg

SEQ ID NO: 6707817 - DNA, 17 bp, Homo sapiens
cagggtccacagctgga

SEQ ID NO: 6707818 - DNA, 22 bp, Homo sapiens
cagggtccacaggaagtgaaga

SEQ ID NO: 6707819 - DNA, 14 bp, Homo sapiens
cagggtccagccct

SEQ ID NO: 6707820 - DNA, 15 bp, Homo sapiens
cagggtccagccctc

SEQ ID NO: 6707821 - DNA, 16 bp, Homo sapiens
cagggtccagccctcc

SEQ ID NO: 6707822 - DNA, 22 bp, Homo sapiens
cagggtccagccctccgccagc

SEQ ID NO: 6707823 - DNA, 20 bp, Homo sapiens
cagggtccaggaatggtgct

SEQ ID NO: 6707824 - DNA, 22 bp, Homo sapiens
cagggtccaggaatggtgcttt

SEQ ID NO: 6707825 - DNA, 21 bp, Homo sapiens
cagggtccaggagagcctggg

SEQ ID NO: 6707826 - DNA, 17 bp, Homo sapiens
cagggtcccacccccaa

SEQ ID NO: 6707827 - DNA, 17 bp, Homo sapiens
cagggtcccaggaagcc

SEQ ID NO: 6707828 - DNA, 17 bp, Homo sapiens
cagggtcccatttctca

SEQ ID NO: 6707829 - DNA, 19 bp, Homo sapiens
cagggtccccgagtgccta

SEQ ID NO: 6707830 - DNA, 16 bp, Homo sapiens
cagggtcccctgccac

SEQ ID NO: 6707831 - DNA, 12 bp, Homo sapiens
cagggtccctcc

SEQ ID NO: 6707832 - DNA, 15 bp, Homo sapiens
cagggtccctgctgt

SEQ ID NO: 6707833 - DNA, 12 bp, Homo sapiens
cagggtccctgg

SEQ ID NO: 6707834 - DNA, 15 bp, Homo sapiens
cagggtccctggtgg

SEQ ID NO: 6707835 - DNA, 22 bp, Homo sapiens
cagggtccctggtggcagctca

SEQ ID NO: 6707836 - DNA, 18 bp, Homo sapiens
cagggtccgcaccagctg

SEQ ID NO: 6707837 - DNA, 20 bp, Homo sapiens
cagggtcctctcttccacag

SEQ ID NO: 6707838 - DNA, 20 bp, Homo sapiens
cagggtcctcttctgggcct

SEQ ID NO: 6707839 - DNA, 13 bp, Homo sapiens
cagggtcctgccc

SEQ ID NO: 6707840 - DNA, 13 bp, Homo sapiens
cagggtcctgcta

SEQ ID NO: 6707841 - DNA, 13 bp, Homo sapiens
cagggtcctggga

SEQ ID NO: 6707842 - DNA, 22 bp, Homo sapiens
cagggtccttgtttctgccctg

SEQ ID NO: 6707843 - DNA, 14 bp, Homo sapiens
cagggtccttttga

SEQ ID NO: 6707844 - DNA, 19 bp, Homo sapiens
cagggtccttttgacactg

SEQ ID NO: 6707845 - DNA, 22 bp, Homo sapiens
cagggtcggtactgatggaggc

SEQ ID NO: 6707846 - DNA, 20 bp, Homo sapiens
cagggtcgtctttgtgtatg

SEQ ID NO: 6707847 - DNA, 20 bp, Homo sapiens
cagggtctaaggagcgctag

SEQ ID NO: 6707848 - DNA, 19 bp, Homo sapiens
cagggtctagccgctgccc

SEQ ID NO: 6707849 - DNA, 20 bp, Homo sapiens
cagggtctagccgctgccct

SEQ ID NO: 6707850 - DNA, 22 bp, Homo sapiens
cagggtctagccgctgccctgg

SEQ ID NO: 6707851 - DNA, 11 bp, Homo sapiens
cagggtctcac

SEQ ID NO: 6707852 - DNA, 21 bp, Homo sapiens
cagggtctcactatgttgccc

SEQ ID NO: 6707853 - DNA, 22 bp, Homo sapiens
cagggtctcactatgttgccca

SEQ ID NO: 6707854 - DNA, 21 bp, Homo sapiens
cagggtctcactctgtcgccc

SEQ ID NO: 6707855 - DNA, 17 bp, Homo sapiens
cagggtctcactctgtt

SEQ ID NO: 6707856 - DNA, 18 bp, Homo sapiens
cagggtctccagaaagcc

SEQ ID NO: 6707857 - DNA, 18 bp, Homo sapiens
cagggtctccttccttcc

SEQ ID NO: 6707858 - DNA, 20 bp, Homo sapiens
cagggtctcgctctgttgcc

SEQ ID NO: 6707859 - DNA, 18 bp, Homo sapiens
cagggtctcgtcaggagg

SEQ ID NO: 6707860 - DNA, 22 bp, Homo sapiens
cagggtctctagtgctgtgaaa

SEQ ID NO: 6707861 - DNA, 13 bp, Homo sapiens
cagggtctctcag

SEQ ID NO: 6707862 - DNA, 15 bp, Homo sapiens
cagggtctctccctc

SEQ ID NO: 6707863 - DNA, 16 bp, Homo sapiens
cagggtctctccctca

SEQ ID NO: 6707864 - DNA, 16 bp, Homo sapiens
cagggtctctgctcca

SEQ ID NO: 6707865 - DNA, 15 bp, Homo sapiens
cagggtctctgctgc

SEQ ID NO: 6707866 - DNA, 19 bp, Homo sapiens
cagggtctctgctgccgcc

SEQ ID NO: 6707867 - DNA, 19 bp, Homo sapiens
cagggtctgaaaggggtgt

SEQ ID NO: 6707868 - DNA, 13 bp, Homo sapiens
cagggtctgcctc

SEQ ID NO: 6707869 - DNA, 18 bp, Homo sapiens
cagggtctgcctccagcc

SEQ ID NO: 6707870 - DNA, 17 bp, Homo sapiens
cagggtctgctctttct

SEQ ID NO: 6707871 - DNA, 20 bp, Homo sapiens
cagggtctgctctttctctg

SEQ ID NO: 6707872 - DNA, 22 bp, Homo sapiens
cagggtctgctctttctctgcc

SEQ ID NO: 6707873 - DNA, 23 bp, Homo sapiens
cagggtctggcagagcctctgag

SEQ ID NO: 6707874 - DNA, 22 bp, Homo sapiens
cagggtctgggctgggcacctg

SEQ ID NO: 6707875 - DNA, 19 bp, Homo sapiens
cagggtctgtgtgaatgtg

SEQ ID NO: 6707876 - DNA, 18 bp, Homo sapiens
cagggtcttacctctctg

SEQ ID NO: 6707877 - DNA, 19 bp, Homo sapiens
cagggtcttacctctctgg

SEQ ID NO: 6707878 - DNA, 20 bp, Homo sapiens
cagggtcttacctctctggg

SEQ ID NO: 6707879 - DNA, 23 bp, Homo sapiens
cagggtcttacctctctgggacc

SEQ ID NO: 6707880 - DNA, 21 bp, Homo sapiens
cagggtcttccctacctcagg

SEQ ID NO: 6707881 - DNA, 15 bp, Homo sapiens
cagggtcttgctctg

SEQ ID NO: 6707882 - DNA, 16 bp, Homo sapiens
cagggtcttgctctgt

SEQ ID NO: 6707883 - DNA, 18 bp, Homo sapiens
cagggtcttgctctgtcc

SEQ ID NO: 6707884 - DNA, 13 bp, Homo sapiens
cagggtcttgggc

SEQ ID NO: 6707885 - DNA, 15 bp, Homo sapiens
cagggtcttgggcta

SEQ ID NO: 6707886 - DNA, 17 bp, Homo sapiens
cagggtcttgggctact

SEQ ID NO: 6707887 - DNA, 22 bp, Homo sapiens
cagggtcttgggctactggcag

SEQ ID NO: 6707888 - DNA, 15 bp, Homo sapiens
cagggtcttttcatc

SEQ ID NO: 6707889 - DNA, 22 bp, Homo sapiens
cagggtcttttcatctgggaaa

SEQ ID NO: 6707890 - DNA, 19 bp, Homo sapiens
cagggtcttttttcatttc

SEQ ID NO: 6707891 - DNA, 18 bp, Homo sapiens
cagggtgaactgcaaagc

SEQ ID NO: 6707892 - DNA, 20 bp, Homo sapiens
cagggtgaactgcaaagctt

SEQ ID NO: 6707893 - DNA, 18 bp, Homo sapiens
cagggtgaagcaccaggg

SEQ ID NO: 6707894 - DNA, 22 bp, Homo sapiens
cagggtgaagcaccagggagag

SEQ ID NO: 6707895 - DNA, 19 bp, Homo sapiens
cagggtgaataaagcaggg

SEQ ID NO: 6707896 - DNA, 17 bp, Homo sapiens
cagggtgaatcagatgg

SEQ ID NO: 6707897 - DNA, 13 bp, Homo sapiens
cagggtgacccct

SEQ ID NO: 6707898 - DNA, 16 bp, Homo sapiens
cagggtgacccctcat

SEQ ID NO: 6707899 - DNA, 22 bp, Homo sapiens
cagggtgacgcctgagacagca

SEQ ID NO: 6707900 - DNA, 15 bp, Homo sapiens
cagggtgagagctgc

SEQ ID NO: 6707901 - DNA, 22 bp, Homo sapiens
cagggtgagcagggccctcaga

SEQ ID NO: 6707902 - DNA, 18 bp, Homo sapiens
cagggtgagcccatgtgg

SEQ ID NO: 6707903 - DNA, 21 bp, Homo sapiens
cagggtgaggacccgccggat

SEQ ID NO: 6707904 - DNA, 22 bp, Homo sapiens
cagggtgagggccacctccaca

SEQ ID NO: 6707905 - DNA, 12 bp, Homo sapiens
cagggtgaggtg

SEQ ID NO: 6707906 - DNA, 16 bp, Homo sapiens
cagggtgatgccaggt

SEQ ID NO: 6707907 - DNA, 23 bp, Homo sapiens
cagggtgcagcccaatctgccag

SEQ ID NO: 6707908 - DNA, 17 bp, Homo sapiens
cagggtgcaggcgcgca

SEQ ID NO: 6707909 - DNA, 19 bp, Homo sapiens
cagggtgcaggcgcgcacc

SEQ ID NO: 6707910 - DNA, 22 bp, Homo sapiens
cagggtgcagtgtgagtgtgat

SEQ ID NO: 6707911 - DNA, 18 bp, Homo sapiens
cagggtgctccctcctca

SEQ ID NO: 6707912 - DNA, 17 bp, Homo sapiens
cagggtgctgggatggc

SEQ ID NO: 6707913 - DNA, 14 bp, Homo sapiens
cagggtggagctga

SEQ ID NO: 6707914 - DNA, 13 bp, Homo sapiens
cagggtggaggaa

SEQ ID NO: 6707915 - DNA, 15 bp, Homo sapiens
cagggtggagggaag

SEQ ID NO: 6707916 - DNA, 23 bp, Homo sapiens
cagggtggagggaaggtgagagg

SEQ ID NO: 6707917 - DNA, 14 bp, Homo sapiens
cagggtggcaccca

SEQ ID NO: 6707918 - DNA, 22 bp, Homo sapiens
cagggtggcacccaccactctc

SEQ ID NO: 6707919 - DNA, 13 bp, Homo sapiens
cagggtggccaca

SEQ ID NO: 6707920 - DNA, 22 bp, Homo sapiens
cagggtggccacacctctatcc

SEQ ID NO: 6707921 - DNA, 13 bp, Homo sapiens
cagggtggccagg

SEQ ID NO: 6707922 - DNA, 14 bp, Homo sapiens
cagggtggcccagg

SEQ ID NO: 6707923 - DNA, 17 bp, Homo sapiens
cagggtggcccaggtgg

SEQ ID NO: 6707924 - DNA, 18 bp, Homo sapiens
cagggtggctgccagccc

SEQ ID NO: 6707925 - DNA, 12 bp, Homo sapiens
cagggtggctgg

SEQ ID NO: 6707926 - DNA, 16 bp, Homo sapiens
cagggtgggaagagaa

SEQ ID NO: 6707927 - DNA, 15 bp, Homo sapiens
cagggtgggagccgg

SEQ ID NO: 6707928 - DNA, 14 bp, Homo sapiens
cagggtgggaggga

SEQ ID NO: 6707929 - DNA, 17 bp, Homo sapiens
cagggtgggagggagga

SEQ ID NO: 6707930 - DNA, 17 bp, Homo sapiens
cagggtgggcagcctat

SEQ ID NO: 6707931 - DNA, 20 bp, Homo sapiens
cagggtgggcagcctatggg

SEQ ID NO: 6707932 - DNA, 18 bp, Homo sapiens
cagggtgggccactctcc

SEQ ID NO: 6707933 - DNA, 20 bp, Homo sapiens
cagggtgggcttcctgccct

SEQ ID NO: 6707934 - DNA, 13 bp, Homo sapiens
cagggtggggctt

SEQ ID NO: 6707935 - DNA, 13 bp, Homo sapiens
cagggtggggggc

SEQ ID NO: 6707936 - DNA, 13 bp, Homo sapiens
cagggtggggggt

SEQ ID NO: 6707937 - DNA, 15 bp, Homo sapiens
cagggtggggggtga

SEQ ID NO: 6707938 - DNA, 19 bp, Homo sapiens
cagggtggggtctgggagg

SEQ ID NO: 6707939 - DNA, 21 bp, Homo sapiens
cagggtggggtctgggagggg

SEQ ID NO: 6707940 - DNA, 16 bp, Homo sapiens
cagggtggtcttcaag

SEQ ID NO: 6707941 - DNA, 16 bp, Homo sapiens
cagggtggtgctggga

SEQ ID NO: 6707942 - DNA, 19 bp, Homo sapiens
cagggtggtgctgggactg

SEQ ID NO: 6707943 - DNA, 15 bp, Homo sapiens
cagggtggtggcaca

SEQ ID NO: 6707944 - DNA, 20 bp, Homo sapiens
cagggtggtggtattctgtc

SEQ ID NO: 6707945 - DNA, 21 bp, Homo sapiens
cagggtggtggtattctgtca

SEQ ID NO: 6707946 - DNA, 17 bp, Homo sapiens
cagggtgtctcctgaag

SEQ ID NO: 6707947 - DNA, 23 bp, Homo sapiens
cagggtgtctctatgaaaagcac

SEQ ID NO: 6707948 - DNA, 16 bp, Homo sapiens
cagggtgtctgccccc

SEQ ID NO: 6707949 - DNA, 16 bp, Homo sapiens
cagggtgtgaggccac

SEQ ID NO: 6707950 - DNA, 22 bp, Homo sapiens
cagggtgtgaggtttcacctcc

SEQ ID NO: 6707951 - DNA, 18 bp, Homo sapiens
cagggtgtggccctgcca

SEQ ID NO: 6707952 - DNA, 21 bp, Homo sapiens
cagggtgtgggatctgaggag

SEQ ID NO: 6707953 - DNA, 19 bp, Homo sapiens
cagggtgtggtatgagggg

SEQ ID NO: 6707954 - DNA, 14 bp, Homo sapiens
cagggttaaactgc

SEQ ID NO: 6707955 - DNA, 21 bp, Homo sapiens
cagggttaaagaaaggcagag

SEQ ID NO: 6707956 - DNA, 16 bp, Homo sapiens
cagggttaagcctgta

SEQ ID NO: 6707957 - DNA, 13 bp, Homo sapiens
cagggttactgta

SEQ ID NO: 6707958 - DNA, 17 bp, Homo sapiens
cagggttatacacagaa

SEQ ID NO: 6707959 - DNA, 22 bp, Homo sapiens
cagggttcaagccttccaggga

SEQ ID NO: 6707960 - DNA, 18 bp, Homo sapiens
cagggttcacttgggctc

SEQ ID NO: 6707961 - DNA, 15 bp, Homo sapiens
cagggttccagacag

SEQ ID NO: 6707962 - DNA, 17 bp, Homo sapiens
cagggttccagacaggg

SEQ ID NO: 6707963 - DNA, 18 bp, Homo sapiens
cagggttccagacagggt

SEQ ID NO: 6707964 - DNA, 15 bp, Homo sapiens
cagggttcccccagc

SEQ ID NO: 6707965 - DNA, 22 bp, Homo sapiens
cagggttcccccagccctgtgg

SEQ ID NO: 6707966 - DNA, 19 bp, Homo sapiens
cagggttcccgcggggctg

SEQ ID NO: 6707967 - DNA, 21 bp, Homo sapiens
cagggttctcctctcccctct

SEQ ID NO: 6707968 - DNA, 23 bp, Homo sapiens
cagggttctcttagcaactcaga

SEQ ID NO: 6707969 - DNA, 18 bp, Homo sapiens
cagggttctgaccgggtc

SEQ ID NO: 6707970 - DNA, 14 bp, Homo sapiens
cagggttctgtatt

SEQ ID NO: 6707971 - DNA, 18 bp, Homo sapiens
cagggttgatcacactct

SEQ ID NO: 6707972 - DNA, 21 bp, Homo sapiens
cagggttgatcacactctggg

SEQ ID NO: 6707973 - DNA, 15 bp, Homo sapiens
cagggttggcccctg

SEQ ID NO: 6707974 - DNA, 13 bp, Homo sapiens
cagggttgggccc

SEQ ID NO: 6707975 - DNA, 21 bp, Homo sapiens
cagggttgggcccagatctgg

SEQ ID NO: 6707976 - DNA, 15 bp, Homo sapiens
cagggtttaacaata

SEQ ID NO: 6707977 - DNA, 16 bp, Homo sapiens
cagggtttaatagact

SEQ ID NO: 6707978 - DNA, 21 bp, Homo sapiens
cagggtttacatgaagcagaa

SEQ ID NO: 6707979 - DNA, 22 bp, Homo sapiens
cagggtttacatgaagcagaac

SEQ ID NO: 6707980 - DNA, 19 bp, Homo sapiens
cagggtttatcttttgaga

SEQ ID NO: 6707981 - DNA, 19 bp, Homo sapiens
cagggtttcaccatgttgc

SEQ ID NO: 6707982 - DNA, 22 bp, Homo sapiens
cagggtttcaccatgttggcca

SEQ ID NO: 6707983 - DNA, 17 bp, Homo sapiens
cagggtttcgagaagct

SEQ ID NO: 6707984 - DNA, 19 bp, Homo sapiens
cagggtttcgagaagctgc

SEQ ID NO: 6707985 - DNA, 20 bp, Homo sapiens
cagggtttcggaaatcatta

SEQ ID NO: 6707986 - DNA, 15 bp, Homo sapiens
cagggtttgagcaca

SEQ ID NO: 6707987 - DNA, 20 bp, Homo sapiens
cagggttttagagagcagtg

SEQ ID NO: 6707988 - DNA, 19 bp, Homo sapiens
cagggttttatctctgtct

SEQ ID NO: 6707989 - DNA, 16 bp, Homo sapiens
cagggttttgccatgt

SEQ ID NO: 6707990 - DNA, 21 bp, Homo sapiens
cagggttttggggtcctgggc

SEQ ID NO: 6707991 - DNA, 15 bp, Homo sapiens
cagggttttgtattc

SEQ ID NO: 6707992 - DNA, 19 bp, Homo sapiens
cagggtttttacctgtcac

SEQ ID NO: 6707993 - DNA, 20 bp, Homo sapiens
caggtaaacacataaatgaa

SEQ ID NO: 6707994 - DNA, 17 bp, Homo sapiens
caggtaaatgggcagtg

SEQ ID NO: 6707995 - DNA, 14 bp, Homo sapiens
caggtaacaggcag

SEQ ID NO: 6707996 - DNA, 21 bp, Homo sapiens
caggtaacaggtgtgtatgta

SEQ ID NO: 6707997 - DNA, 16 bp, Homo sapiens
caggtaacattataaa

SEQ ID NO: 6707998 - DNA, 12 bp, Homo sapiens
caggtaagatgt

SEQ ID NO: 6707999 - DNA, 17 bp, Homo sapiens
caggtaagtctggtttt

SEQ ID NO: 6708000 - DNA, 18 bp, Homo sapiens
caggtaataaaagctttg

SEQ ID NO: 6708001 - DNA, 18 bp, Homo sapiens
caggtaatcgacctgcct

SEQ ID NO: 6708002 - DNA, 19 bp, Homo sapiens
caggtaatgtgaataaatt

SEQ ID NO: 6708003 - DNA, 16 bp, Homo sapiens
caggtaatttaaattg

SEQ ID NO: 6708004 - DNA, 13 bp, Homo sapiens
caggtacacctcc

SEQ ID NO: 6708005 - DNA, 16 bp, Homo sapiens
caggtacacctccccc

SEQ ID NO: 6708006 - DNA, 19 bp, Homo sapiens
caggtacacctccccctgc

SEQ ID NO: 6708007 - DNA, 20 bp, Homo sapiens
caggtacacctccccctgcg

SEQ ID NO: 6708008 - DNA, 14 bp, Homo sapiens
caggtacagagaag

SEQ ID NO: 6708009 - DNA, 14 bp, Homo sapiens
caggtacagcaaca

SEQ ID NO: 6708010 - DNA, 12 bp, Homo sapiens
caggtacagcgg

SEQ ID NO: 6708011 - DNA, 21 bp, Homo sapiens
caggtacagcgggctgtgccc

SEQ ID NO: 6708012 - DNA, 13 bp, Homo sapiens
caggtacaggaga

SEQ ID NO: 6708013 - DNA, 17 bp, Homo sapiens
caggtacaggagaggca

SEQ ID NO: 6708014 - DNA, 15 bp, Homo sapiens
caggtacatttctga

SEQ ID NO: 6708015 - DNA, 20 bp, Homo sapiens
caggtacatttctgattctg

SEQ ID NO: 6708016 - DNA, 22 bp, Homo sapiens
caggtacatttctgattctgat

SEQ ID NO: 6708017 - DNA, 15 bp, Homo sapiens
caggtaccaaggaaa

SEQ ID NO: 6708018 - DNA, 18 bp, Homo sapiens
caggtaccacccttcaga

SEQ ID NO: 6708019 - DNA, 20 bp, Homo sapiens
caggtaccacccttcagacc

SEQ ID NO: 6708020 - DNA, 15 bp, Homo sapiens
caggtaccagctgcg

SEQ ID NO: 6708021 - DNA, 17 bp, Homo sapiens
caggtaccagctgcgct

SEQ ID NO: 6708022 - DNA, 15 bp, Homo sapiens
caggtaccagttctt

SEQ ID NO: 6708023 - DNA, 15 bp, Homo sapiens
caggtaccccagctc

SEQ ID NO: 6708024 - DNA, 14 bp, Homo sapiens
caggtaccgtgctc

SEQ ID NO: 6708025 - DNA, 23 bp, Homo sapiens
caggtaccttctcacctgtgaga

SEQ ID NO: 6708026 - DNA, 22 bp, Homo sapiens
caggtacgcacagacaggtttt

SEQ ID NO: 6708027 - DNA, 18 bp, Homo sapiens
caggtactgagtggggag

SEQ ID NO: 6708028 - DNA, 22 bp, Homo sapiens
caggtacttcctcctgatggcc

SEQ ID NO: 6708029 - DNA, 23 bp, Homo sapiens
caggtacttcctcctgatggcca

SEQ ID NO: 6708030 - DNA, 14 bp, Homo sapiens
caggtacttggagg

SEQ ID NO: 6708031 - DNA, 12 bp, Homo sapiens
caggtactttgt

SEQ ID NO: 6708032 - DNA, 13 bp, Homo sapiens
caggtagaaaaga

SEQ ID NO: 6708033 - DNA, 17 bp, Homo sapiens
caggtagaacgccaggg

SEQ ID NO: 6708034 - DNA, 22 bp, Homo sapiens
caggtagaattatctaatttat

SEQ ID NO: 6708035 - DNA, 23 bp, Homo sapiens
caggtagaccaggtgctcagccc

SEQ ID NO: 6708036 - DNA, 21 bp, Homo sapiens
caggtagacctgtctcctggc

SEQ ID NO: 6708037 - DNA, 22 bp, Homo sapiens
caggtagcacagattttgaatc

SEQ ID NO: 6708038 - DNA, 18 bp, Homo sapiens
caggtagctgaaagggga

SEQ ID NO: 6708039 - DNA, 22 bp, Homo sapiens
caggtagctgcccctggctctg

SEQ ID NO: 6708040 - DNA, 19 bp, Homo sapiens
caggtagctgggattacag

SEQ ID NO: 6708041 - DNA, 16 bp, Homo sapiens
caggtaggaaacaatt

SEQ ID NO: 6708042 - DNA, 14 bp, Homo sapiens
caggtaggccaagg

SEQ ID NO: 6708043 - DNA, 14 bp, Homo sapiens
caggtaggcccttg

SEQ ID NO: 6708044 - DNA, 22 bp, Homo sapiens
caggtaggcccttgtcctgcca

SEQ ID NO: 6708045 - DNA, 21 bp, Homo sapiens
caggtagggagctaaggaaga

SEQ ID NO: 6708046 - DNA, 23 bp, Homo sapiens
caggtaggggcccctctcagccc

SEQ ID NO: 6708047 - DNA, 22 bp, Homo sapiens
caggtagtactaagagtatgtg

SEQ ID NO: 6708048 - DNA, 21 bp, Homo sapiens
caggtagtatatggtggagcc

SEQ ID NO: 6708049 - DNA, 22 bp, Homo sapiens
caggtagtattacaccaccggc

SEQ ID NO: 6708050 - DNA, 20 bp, Homo sapiens
caggtagttggaactttctg

SEQ ID NO: 6708051 - DNA, 19 bp, Homo sapiens
caggtagttggtgaacaga

SEQ ID NO: 6708052 - DNA, 14 bp, Homo sapiens
caggtataaaacct

SEQ ID NO: 6708053 - DNA, 14 bp, Homo sapiens
caggtatacctcac

SEQ ID NO: 6708054 - DNA, 18 bp, Homo sapiens
caggtatatactttgaaa

SEQ ID NO: 6708055 - DNA, 13 bp, Homo sapiens
caggtatcaaatc

SEQ ID NO: 6708056 - DNA, 15 bp, Homo sapiens
caggtatccaaaaat

SEQ ID NO: 6708057 - DNA, 15 bp, Homo sapiens
caggtatctccagga

SEQ ID NO: 6708058 - DNA, 20 bp, Homo sapiens
caggtatgaccttctaggaa

SEQ ID NO: 6708059 - DNA, 22 bp, Homo sapiens
caggtatttagaagcagaggga

SEQ ID NO: 6708060 - DNA, 17 bp, Homo sapiens
caggtatttcagaagga

SEQ ID NO: 6708061 - DNA, 19 bp, Homo sapiens
caggtatttcagaaggaga

SEQ ID NO: 6708062 - DNA, 19 bp, Homo sapiens
caggtattttataattctg

SEQ ID NO: 6708063 - DNA, 23 bp, Homo sapiens
caggtattttataattctgggaa

SEQ ID NO: 6708064 - DNA, 21 bp, Homo sapiens
caggtcaacagaatgaaaaat

SEQ ID NO: 6708065 - DNA, 18 bp, Homo sapiens
caggtcaactctgaagag

SEQ ID NO: 6708066 - DNA, 22 bp, Homo sapiens
caggtcaatacagtacaggcag

SEQ ID NO: 6708067 - DNA, 12 bp, Homo sapiens
caggtcacagaa

SEQ ID NO: 6708068 - DNA, 13 bp, Homo sapiens
caggtcacaggca

SEQ ID NO: 6708069 - DNA, 17 bp, Homo sapiens
caggtcaccatcctcag

SEQ ID NO: 6708070 - DNA, 24 bp, Homo sapiens
caggtcaccatcctcagaggctga

SEQ ID NO: 6708071 - DNA, 17 bp, Homo sapiens
caggtcacccatcagga

SEQ ID NO: 6708072 - DNA, 15 bp, Homo sapiens
caggtcactctgacc

SEQ ID NO: 6708073 - DNA, 12 bp, Homo sapiens
caggtcactgtc

SEQ ID NO: 6708074 - DNA, 13 bp, Homo sapiens
caggtcactgtca

SEQ ID NO: 6708075 - DNA, 16 bp, Homo sapiens
caggtcactgtcactg

SEQ ID NO: 6708076 - DNA, 19 bp, Homo sapiens
caggtcactgtcactgccg

SEQ ID NO: 6708077 - DNA, 24 bp, Homo sapiens
caggtcagaaaccattgttcagaa

SEQ ID NO: 6708078 - DNA, 13 bp, Homo sapiens
caggtcagagccc

SEQ ID NO: 6708079 - DNA, 17 bp, Homo sapiens
caggtcagagcccagga

SEQ ID NO: 6708080 - DNA, 13 bp, Homo sapiens
caggtcagcccat

SEQ ID NO: 6708081 - DNA, 15 bp, Homo sapiens
caggtcagcccatgg

SEQ ID NO: 6708082 - DNA, 21 bp, Homo sapiens
caggtcagcccatggaggcag

SEQ ID NO: 6708083 - DNA, 12 bp, Homo sapiens
caggtcagccct

SEQ ID NO: 6708084 - DNA, 13 bp, Homo sapiens
caggtcagccctg

SEQ ID NO: 6708085 - DNA, 18 bp, Homo sapiens
caggtcagccctgtgtct

SEQ ID NO: 6708086 - DNA, 14 bp, Homo sapiens
caggtcagcctgga

SEQ ID NO: 6708087 - DNA, 16 bp, Homo sapiens
caggtcagcctggaag

SEQ ID NO: 6708088 - DNA, 21 bp, Homo sapiens
caggtcagctgggagccagtg

SEQ ID NO: 6708089 - DNA, 21 bp, Homo sapiens
caggtcagctgttactttctt

SEQ ID NO: 6708090 - DNA, 18 bp, Homo sapiens
caggtcaggaccaggacc

SEQ ID NO: 6708091 - DNA, 18 bp, Homo sapiens
caggtcaggatgcacatt

SEQ ID NO: 6708092 - DNA, 13 bp, Homo sapiens
caggtcagggctc

SEQ ID NO: 6708093 - DNA, 16 bp, Homo sapiens
caggtcaggggctccc

SEQ ID NO: 6708094 - DNA, 18 bp, Homo sapiens
caggtcaggggtgacaca

SEQ ID NO: 6708095 - DNA, 14 bp, Homo sapiens
caggtcagtagtca

SEQ ID NO: 6708096 - DNA, 17 bp, Homo sapiens
caggtcagttgtaataa

SEQ ID NO: 6708097 - DNA, 21 bp, Homo sapiens
caggtcatattaatatatttc

SEQ ID NO: 6708098 - DNA, 14 bp, Homo sapiens
caggtcatcagatg

SEQ ID NO: 6708099 - DNA, 23 bp, Homo sapiens
caggtcatgcagttcctggccca

SEQ ID NO: 6708100 - DNA, 15 bp, Homo sapiens
caggtcatggagcag

SEQ ID NO: 6708101 - DNA, 16 bp, Homo sapiens
caggtcatggagcagc

SEQ ID NO: 6708102 - DNA, 17 bp, Homo sapiens
caggtcatggagcagcc

SEQ ID NO: 6708103 - DNA, 12 bp, Homo sapiens
caggtccaagga

SEQ ID NO: 6708104 - DNA, 17 bp, Homo sapiens
caggtccaaggctggtc

SEQ ID NO: 6708105 - DNA, 19 bp, Homo sapiens
caggtccaaggctggtccc

SEQ ID NO: 6708106 - DNA, 17 bp, Homo sapiens
caggtccaatgagcttt

SEQ ID NO: 6708107 - DNA, 16 bp, Homo sapiens
caggtccagagagacc

SEQ ID NO: 6708108 - DNA, 18 bp, Homo sapiens
caggtccagagtatgagt

SEQ ID NO: 6708109 - DNA, 19 bp, Homo sapiens
caggtccagctctgtgggc

SEQ ID NO: 6708110 - DNA, 21 bp, Homo sapiens
caggtccagctttactgtggc

SEQ ID NO: 6708111 - DNA, 23 bp, Homo sapiens
caggtccagctttactgtggctg

SEQ ID NO: 6708112 - DNA, 18 bp, Homo sapiens
caggtccaggccagtggg

SEQ ID NO: 6708113 - DNA, 21 bp, Homo sapiens
caggtccattctgtttaaatc

SEQ ID NO: 6708114 - DNA, 17 bp, Homo sapiens
caggtcccacctccagc

SEQ ID NO: 6708115 - DNA, 16 bp, Homo sapiens
caggtcccacgccagg

SEQ ID NO: 6708116 - DNA, 20 bp, Homo sapiens
caggtcccacgtctggccag

SEQ ID NO: 6708117 - DNA, 16 bp, Homo sapiens
caggtcccagcccctc

SEQ ID NO: 6708118 - DNA, 23 bp, Homo sapiens
caggtcccagcccctcctccctc

SEQ ID NO: 6708119 - DNA, 12 bp, Homo sapiens
caggtcccagtg

SEQ ID NO: 6708120 - DNA, 13 bp, Homo sapiens
caggtcccagtgc

SEQ ID NO: 6708121 - DNA, 15 bp, Homo sapiens
caggtcccagtgcca

SEQ ID NO: 6708122 - DNA, 21 bp, Homo sapiens
caggtcccagtgccattggct

SEQ ID NO: 6708123 - DNA, 15 bp, Homo sapiens
caggtcccagttgct

SEQ ID NO: 6708124 - DNA, 12 bp, Homo sapiens
caggtccccaga

SEQ ID NO: 6708125 - DNA, 13 bp, Homo sapiens
caggtccccagac

SEQ ID NO: 6708126 - DNA, 13 bp, Homo sapiens
caggtccccatgg

SEQ ID NO: 6708127 - DNA, 17 bp, Homo sapiens
caggtccccctgcagct

SEQ ID NO: 6708128 - DNA, 19 bp, Homo sapiens
caggtcccctgccctgagg

SEQ ID NO: 6708129 - DNA, 20 bp, Homo sapiens
caggtcccctgccctgaggc

SEQ ID NO: 6708130 - DNA, 16 bp, Homo sapiens
caggtcccctggccct

SEQ ID NO: 6708131 - DNA, 22 bp, Homo sapiens
caggtcccctggcccttccttc

SEQ ID NO: 6708132 - DNA, 23 bp, Homo sapiens
caggtcccctggcccttccttca

SEQ ID NO: 6708133 - DNA, 16 bp, Homo sapiens
caggtcccctttcaga

SEQ ID NO: 6708134 - DNA, 21 bp, Homo sapiens
caggtcccgagccccctgtcc

SEQ ID NO: 6708135 - DNA, 12 bp, Homo sapiens
caggtccctaat

SEQ ID NO: 6708136 - DNA, 14 bp, Homo sapiens
caggtccctaataa

SEQ ID NO: 6708137 - DNA, 19 bp, Homo sapiens
caggtccctaataaagctg

SEQ ID NO: 6708138 - DNA, 21 bp, Homo sapiens
caggtccctaataaagctgtg

SEQ ID NO: 6708139 - DNA, 16 bp, Homo sapiens
caggtccctccccttc

SEQ ID NO: 6708140 - DNA, 14 bp, Homo sapiens
caggtccctctcat

SEQ ID NO: 6708141 - DNA, 21 bp, Homo sapiens
caggtccctggaccagcctcc

SEQ ID NO: 6708142 - DNA, 18 bp, Homo sapiens
caggtccggggaggaggt

SEQ ID NO: 6708143 - DNA, 20 bp, Homo sapiens
caggtccgtagctcccctgg

SEQ ID NO: 6708144 - DNA, 22 bp, Homo sapiens
caggtccgtagctcccctggct

SEQ ID NO: 6708145 - DNA, 23 bp, Homo sapiens
caggtccgtagctcccctggctg

SEQ ID NO: 6708146 - DNA, 17 bp, Homo sapiens
caggtcctactggggaa

SEQ ID NO: 6708147 - DNA, 19 bp, Homo sapiens
caggtcctagtcgggcagg

SEQ ID NO: 6708148 - DNA, 15 bp, Homo sapiens
caggtcctcacagca

SEQ ID NO: 6708149 - DNA, 17 bp, Homo sapiens
caggtcctcacagcagt

SEQ ID NO: 6708150 - DNA, 18 bp, Homo sapiens
caggtcctcacagcagtc

SEQ ID NO: 6708151 - DNA, 12 bp, Homo sapiens
caggtcctccat

SEQ ID NO: 6708152 - DNA, 22 bp, Homo sapiens
caggtcctcccgggagcacaga

SEQ ID NO: 6708153 - DNA, 12 bp, Homo sapiens
caggtcctgccc

SEQ ID NO: 6708154 - DNA, 17 bp, Homo sapiens
caggtcctgctcagcag

SEQ ID NO: 6708155 - DNA, 21 bp, Homo sapiens
caggtcctgctccgctgcctg

SEQ ID NO: 6708156 - DNA, 15 bp, Homo sapiens
caggtcctggggagg

SEQ ID NO: 6708157 - DNA, 17 bp, Homo sapiens
caggtcctggggaggct

SEQ ID NO: 6708158 - DNA, 14 bp, Homo sapiens
caggtcctggtggg

SEQ ID NO: 6708159 - DNA, 18 bp, Homo sapiens
caggtcctggtggggcag

SEQ ID NO: 6708160 - DNA, 21 bp, Homo sapiens
caggtcctggtggggcagctc

SEQ ID NO: 6708161 - DNA, 21 bp, Homo sapiens
caggtcctggtgggtcagccc

SEQ ID NO: 6708162 - DNA, 22 bp, Homo sapiens
caggtcctggtgggtcagccca

SEQ ID NO: 6708163 - DNA, 23 bp, Homo sapiens
caggtcctggtgggtcagcccag

SEQ ID NO: 6708164 - DNA, 15 bp, Homo sapiens
caggtcctgtctctg

SEQ ID NO: 6708165 - DNA, 18 bp, Homo sapiens
caggtcctgtctctgcac

SEQ ID NO: 6708166 - DNA, 18 bp, Homo sapiens
caggtcggagtgcctgga

SEQ ID NO: 6708167 - DNA, 19 bp, Homo sapiens
caggtcgggcagtggaggc

SEQ ID NO: 6708168 - DNA, 13 bp, Homo sapiens
caggtcgggctca

SEQ ID NO: 6708169 - DNA, 15 bp, Homo sapiens
caggtcgggctcagc

SEQ ID NO: 6708170 - DNA, 16 bp, Homo sapiens
caggtcgggctcagct

SEQ ID NO: 6708171 - DNA, 17 bp, Homo sapiens
caggtctagaaggccag

SEQ ID NO: 6708172 - DNA, 19 bp, Homo sapiens
caggtctagaaggccaggc

SEQ ID NO: 6708173 - DNA, 21 bp, Homo sapiens
caggtctagaaggccaggcct

SEQ ID NO: 6708174 - DNA, 23 bp, Homo sapiens
caggtctagaaggccaggcctct

SEQ ID NO: 6708175 - DNA, 17 bp, Homo sapiens
caggtctccaccaagga

SEQ ID NO: 6708176 - DNA, 20 bp, Homo sapiens
caggtctccacctgcacatt

SEQ ID NO: 6708177 - DNA, 19 bp, Homo sapiens
caggtctcccacgtgggag

SEQ ID NO: 6708178 - DNA, 22 bp, Homo sapiens
caggtctcccacgtgggagaca

SEQ ID NO: 6708179 - DNA, 17 bp, Homo sapiens
caggtctccccaggccc

SEQ ID NO: 6708180 - DNA, 14 bp, Homo sapiens
caggtctcctggga

SEQ ID NO: 6708181 - DNA, 22 bp, Homo sapiens
caggtctcctgggaaagggaga

SEQ ID NO: 6708182 - DNA, 15 bp, Homo sapiens
caggtctctccactg

SEQ ID NO: 6708183 - DNA, 19 bp, Homo sapiens
caggtctctccactgctct

SEQ ID NO: 6708184 - DNA, 20 bp, Homo sapiens
caggtctctccactgctctc

SEQ ID NO: 6708185 - DNA, 23 bp, Homo sapiens
caggtctctccactgctctcagc

SEQ ID NO: 6708186 - DNA, 22 bp, Homo sapiens
caggtctcttcctttgctctga

SEQ ID NO: 6708187 - DNA, 20 bp, Homo sapiens
caggtctgactccaaagctg

SEQ ID NO: 6708188 - DNA, 22 bp, Homo sapiens
caggtctgattcccagaaatac

SEQ ID NO: 6708189 - DNA, 14 bp, Homo sapiens
caggtctgcaaggg

SEQ ID NO: 6708190 - DNA, 20 bp, Homo sapiens
caggtctgcaagggcccaga

SEQ ID NO: 6708191 - DNA, 23 bp, Homo sapiens
caggtctgcaagggcccagagtg

SEQ ID NO: 6708192 - DNA, 13 bp, Homo sapiens
caggtctgcaggc

SEQ ID NO: 6708193 - DNA, 16 bp, Homo sapiens
caggtctgcaggccac

SEQ ID NO: 6708194 - DNA, 19 bp, Homo sapiens
caggtctgcaggccaccag

SEQ ID NO: 6708195 - DNA, 14 bp, Homo sapiens
caggtctgcctggt

SEQ ID NO: 6708196 - DNA, 15 bp, Homo sapiens
caggtctggcgccag

SEQ ID NO: 6708197 - DNA, 21 bp, Homo sapiens
caggtctggcgccaggggcag

SEQ ID NO: 6708198 - DNA, 18 bp, Homo sapiens
caggtctgggagaggcag

SEQ ID NO: 6708199 - DNA, 13 bp, Homo sapiens
caggtctgggcaa

SEQ ID NO: 6708200 - DNA, 14 bp, Homo sapiens
caggtctgggcaag

SEQ ID NO: 6708201 - DNA, 20 bp, Homo sapiens
caggtctgggtggggcccag

SEQ ID NO: 6708202 - DNA, 23 bp, Homo sapiens
caggtctgggtggggcccaggcc

SEQ ID NO: 6708203 - DNA, 13 bp, Homo sapiens
caggtctgtaact

SEQ ID NO: 6708204 - DNA, 22 bp, Homo sapiens
caggtctgtaactgcccagccc

SEQ ID NO: 6708205 - DNA, 18 bp, Homo sapiens
caggtctgtatgtcatgg

SEQ ID NO: 6708206 - DNA, 14 bp, Homo sapiens
caggtcttcatatt

SEQ ID NO: 6708207 - DNA, 18 bp, Homo sapiens
caggtcttcatatttttg

SEQ ID NO: 6708208 - DNA, 17 bp, Homo sapiens
caggtcttccagacctg

SEQ ID NO: 6708209 - DNA, 23 bp, Homo sapiens
caggtcttccggggccatgggca

SEQ ID NO: 6708210 - DNA, 22 bp, Homo sapiens
caggtcttgactcatggcagct

SEQ ID NO: 6708211 - DNA, 21 bp, Homo sapiens
caggtcttggagctgagcctc

SEQ ID NO: 6708212 - DNA, 19 bp, Homo sapiens
caggtctttcctaaggctg

SEQ ID NO: 6708213 - DNA, 19 bp, Homo sapiens
caggtctttgaaatatgca

SEQ ID NO: 6708214 - DNA, 22 bp, Homo sapiens
caggtctttgaaatatgcatgt

SEQ ID NO: 6708215 - DNA, 23 bp, Homo sapiens
caggtctttgaaatatgcatgta

SEQ ID NO: 6708216 - DNA, 13 bp, Homo sapiens
caggtgaaaatgt

SEQ ID NO: 6708217 - DNA, 17 bp, Homo sapiens
caggtgaaaatgttcat

SEQ ID NO: 6708218 - DNA, 16 bp, Homo sapiens
caggtgaaacccagtc

SEQ ID NO: 6708219 - DNA, 17 bp, Homo sapiens
caggtgaaaggaaatta

SEQ ID NO: 6708220 - DNA, 20 bp, Homo sapiens
caggtgaaagtttttctgaa

SEQ ID NO: 6708221 - DNA, 18 bp, Homo sapiens
caggtgaacacttagtga

SEQ ID NO: 6708222 - DNA, 20 bp, Homo sapiens
caggtgaagcaccaagctca

SEQ ID NO: 6708223 - DNA, 14 bp, Homo sapiens
caggtgaattgttt

SEQ ID NO: 6708224 - DNA, 14 bp, Homo sapiens
caggtgacagtgag

SEQ ID NO: 6708225 - DNA, 16 bp, Homo sapiens
caggtgacagtgaggt

SEQ ID NO: 6708226 - DNA, 19 bp, Homo sapiens
caggtgacagtgaggtcct

SEQ ID NO: 6708227 - DNA, 20 bp, Homo sapiens
caggtgacagtgaggtcctg

SEQ ID NO: 6708228 - DNA, 14 bp, Homo sapiens
caggtgacagtggc

SEQ ID NO: 6708229 - DNA, 15 bp, Homo sapiens
caggtgacagtggct

SEQ ID NO: 6708230 - DNA, 18 bp, Homo sapiens
caggtgacagtggctgct

SEQ ID NO: 6708231 - DNA, 21 bp, Homo sapiens
caggtgacagtggctgctctg

SEQ ID NO: 6708232 - DNA, 18 bp, Homo sapiens
caggtgacatgtgaaacc

SEQ ID NO: 6708233 - DNA, 21 bp, Homo sapiens
caggtgacccccccccatccc

SEQ ID NO: 6708234 - DNA, 17 bp, Homo sapiens
caggtgacgatttagct

SEQ ID NO: 6708235 - DNA, 22 bp, Homo sapiens
caggtgactaccctagttcaaa

SEQ ID NO: 6708236 - DNA, 13 bp, Homo sapiens
caggtgagaaact

SEQ ID NO: 6708237 - DNA, 16 bp, Homo sapiens
caggtgagaacatcca

SEQ ID NO: 6708238 - DNA, 21 bp, Homo sapiens
caggtgagcaaccagttggct

SEQ ID NO: 6708239 - DNA, 19 bp, Homo sapiens
caggtgagcaggcagggct

SEQ ID NO: 6708240 - DNA, 15 bp, Homo sapiens
caggtgagcccatgg

SEQ ID NO: 6708241 - DNA, 18 bp, Homo sapiens
caggtgaggaatttgaag

SEQ ID NO: 6708242 - DNA, 18 bp, Homo sapiens
caggtgaggggcaggacc

SEQ ID NO: 6708243 - DNA, 21 bp, Homo sapiens
caggtgaggggcaggacctga

SEQ ID NO: 6708244 - DNA, 21 bp, Homo sapiens
caggtgaggtcagcacatctc

SEQ ID NO: 6708245 - DNA, 20 bp, Homo sapiens
caggtgagtcctagagctac

SEQ ID NO: 6708246 - DNA, 23 bp, Homo sapiens
caggtgagtcctagagctacagg

SEQ ID NO: 6708247 - DNA, 20 bp, Homo sapiens
caggtgagtgtgagggcagc

SEQ ID NO: 6708248 - DNA, 17 bp, Homo sapiens
caggtgatcaaaataaa

SEQ ID NO: 6708249 - DNA, 17 bp, Homo sapiens
caggtgatccacccacc

SEQ ID NO: 6708250 - DNA, 19 bp, Homo sapiens
caggtgatccacccacctg

SEQ ID NO: 6708251 - DNA, 15 bp, Homo sapiens
caggtgatgctctgg

SEQ ID NO: 6708252 - DNA, 20 bp, Homo sapiens
caggtgatgttagtgtttta

SEQ ID NO: 6708253 - DNA, 15 bp, Homo sapiens
caggtgattctgatc

SEQ ID NO: 6708254 - DNA, 20 bp, Homo sapiens
caggtgattggaccaggcca

SEQ ID NO: 6708255 - DNA, 15 bp, Homo sapiens
caggtgcaaccaggg

SEQ ID NO: 6708256 - DNA, 16 bp, Homo sapiens
caggtgcaagagacag

SEQ ID NO: 6708257 - DNA, 18 bp, Homo sapiens
caggtgcaagagacagag

SEQ ID NO: 6708258 - DNA, 20 bp, Homo sapiens
caggtgcaagagacagagcc

SEQ ID NO: 6708259 - DNA, 15 bp, Homo sapiens
caggtgcacaagctc

SEQ ID NO: 6708260 - DNA, 17 bp, Homo sapiens
caggtgcacaagctcca

SEQ ID NO: 6708261 - DNA, 14 bp, Homo sapiens
caggtgcagaggaa

SEQ ID NO: 6708262 - DNA, 15 bp, Homo sapiens
caggtgcagaggaag

SEQ ID NO: 6708263 - DNA, 18 bp, Homo sapiens
caggtgcagatgggctgt

SEQ ID NO: 6708264 - DNA, 16 bp, Homo sapiens
caggtgcagccagagg

SEQ ID NO: 6708265 - DNA, 14 bp, Homo sapiens
caggtgcagcccca

SEQ ID NO: 6708266 - DNA, 23 bp, Homo sapiens
caggtgcagcccttcctccctgt

SEQ ID NO: 6708267 - DNA, 15 bp, Homo sapiens
caggtgcagtggctc

SEQ ID NO: 6708268 - DNA, 14 bp, Homo sapiens
caggtgcatgcatg

SEQ ID NO: 6708269 - DNA, 17 bp, Homo sapiens
caggtgccaccaataaa

SEQ ID NO: 6708270 - DNA, 20 bp, Homo sapiens
caggtgccaccaataaaaat

SEQ ID NO: 6708271 - DNA, 18 bp, Homo sapiens
caggtgccactccctgag

SEQ ID NO: 6708272 - DNA, 20 bp, Homo sapiens
caggtgccactccctgagct

SEQ ID NO: 6708273 - DNA, 15 bp, Homo sapiens
caggtgccactgacc

SEQ ID NO: 6708274 - DNA, 18 bp, Homo sapiens
caggtgccagcctgaggc

SEQ ID NO: 6708275 - DNA, 16 bp, Homo sapiens
caggtgccagggccca

SEQ ID NO: 6708276 - DNA, 15 bp, Homo sapiens
caggtgccatgcctg

SEQ ID NO: 6708277 - DNA, 16 bp, Homo sapiens
caggtgccatgcctgc

SEQ ID NO: 6708278 - DNA, 19 bp, Homo sapiens
caggtgccatgcctgctcc

SEQ ID NO: 6708279 - DNA, 23 bp, Homo sapiens
caggtgccatgcctgctccctgt

SEQ ID NO: 6708280 - DNA, 13 bp, Homo sapiens
caggtgcccacca

SEQ ID NO: 6708281 - DNA, 22 bp, Homo sapiens
caggtgcccagctatacctgtg

SEQ ID NO: 6708282 - DNA, 23 bp, Homo sapiens
caggtgcccagctatacctgtgc

SEQ ID NO: 6708283 - DNA, 14 bp, Homo sapiens
caggtgcccaggaa

SEQ ID NO: 6708284 - DNA, 14 bp, Homo sapiens
caggtgcccccagg

SEQ ID NO: 6708285 - DNA, 12 bp, Homo sapiens
caggtgcccctc

SEQ ID NO: 6708286 - DNA, 23 bp, Homo sapiens
caggtgcccgcgccaggccctca

SEQ ID NO: 6708287 - DNA, 19 bp, Homo sapiens
caggtgccctgtgggagag

SEQ ID NO: 6708288 - DNA, 17 bp, Homo sapiens
caggtgccgacactgag

SEQ ID NO: 6708289 - DNA, 22 bp, Homo sapiens
caggtgccgccagctgccgcac

SEQ ID NO: 6708290 - DNA, 14 bp, Homo sapiens
caggtgcctaacct

SEQ ID NO: 6708291 - DNA, 18 bp, Homo sapiens
caggtgcctaacctggga

SEQ ID NO: 6708292 - DNA, 20 bp, Homo sapiens
caggtgcctaacctgggacc

SEQ ID NO: 6708293 - DNA, 11 bp, Homo sapiens
caggtgcctcc

SEQ ID NO: 6708294 - DNA, 19 bp, Homo sapiens
caggtgcctccaggtgtgc

SEQ ID NO: 6708295 - DNA, 16 bp, Homo sapiens
caggtgcctggcttgc

SEQ ID NO: 6708296 - DNA, 21 bp, Homo sapiens
caggtgcctggcttgctgtgg

SEQ ID NO: 6708297 - DNA, 14 bp, Homo sapiens
caggtgcctggggc

SEQ ID NO: 6708298 - DNA, 18 bp, Homo sapiens
caggtgcctggtgggcca

SEQ ID NO: 6708299 - DNA, 21 bp, Homo sapiens
caggtgccttacatcttttct

SEQ ID NO: 6708300 - DNA, 14 bp, Homo sapiens
caggtgcggcctgg

SEQ ID NO: 6708301 - DNA, 14 bp, Homo sapiens
caggtgcggcgcgc

SEQ ID NO: 6708302 - DNA, 18 bp, Homo sapiens
caggtgcgggaccatctg

SEQ ID NO: 6708303 - DNA, 20 bp, Homo sapiens
caggtgctatgtcccaagag

SEQ ID NO: 6708304 - DNA, 15 bp, Homo sapiens
caggtgctattgtta

SEQ ID NO: 6708305 - DNA, 19 bp, Homo sapiens
caggtgctcagcccaggca

SEQ ID NO: 6708306 - DNA, 14 bp, Homo sapiens
caggtgctcatgct

SEQ ID NO: 6708307 - DNA, 16 bp, Homo sapiens
caggtgctcatgctgc

SEQ ID NO: 6708308 - DNA, 17 bp, Homo sapiens
caggtgctcatgctgct

SEQ ID NO: 6708309 - DNA, 20 bp, Homo sapiens
caggtgctgacttcatctcc

SEQ ID NO: 6708310 - DNA, 21 bp, Homo sapiens
caggtgctgacttcatctccc

SEQ ID NO: 6708311 - DNA, 13 bp, Homo sapiens
caggtgctgccat

SEQ ID NO: 6708312 - DNA, 16 bp, Homo sapiens
caggtgctgctaccct

SEQ ID NO: 6708313 - DNA, 13 bp, Homo sapiens
caggtgctgctgc

SEQ ID NO: 6708314 - DNA, 23 bp, Homo sapiens
caggtgctggagcactgggctcc

SEQ ID NO: 6708315 - DNA, 18 bp, Homo sapiens
caggtgctggaggcagac

SEQ ID NO: 6708316 - DNA, 15 bp, Homo sapiens
caggtgctggcccag

SEQ ID NO: 6708317 - DNA, 22 bp, Homo sapiens
caggtgctggcccagcatggaa

SEQ ID NO: 6708318 - DNA, 13 bp, Homo sapiens
caggtgctgtcca

SEQ ID NO: 6708319 - DNA, 14 bp, Homo sapiens
caggtgctgtccat

SEQ ID NO: 6708320 - DNA, 12 bp, Homo sapiens
caggtgctgtga

SEQ ID NO: 6708321 - DNA, 18 bp, Homo sapiens
caggtgcttctcaccacg

SEQ ID NO: 6708322 - DNA, 18 bp, Homo sapiens
caggtgcttttggcagag

SEQ ID NO: 6708323 - DNA, 21 bp, Homo sapiens
caggtggaacaggaggaactg

SEQ ID NO: 6708324 - DNA, 16 bp, Homo sapiens
caggtggaaggcagac

SEQ ID NO: 6708325 - DNA, 19 bp, Homo sapiens
caggtggaaggcagacagc

SEQ ID NO: 6708326 - DNA, 13 bp, Homo sapiens
caggtggaccctg

SEQ ID NO: 6708327 - DNA, 16 bp, Homo sapiens
caggtggacgctgcag

SEQ ID NO: 6708328 - DNA, 16 bp, Homo sapiens
caggtggactgactgt

SEQ ID NO: 6708329 - DNA, 19 bp, Homo sapiens
caggtggactgactgtgtt

SEQ ID NO: 6708330 - DNA, 14 bp, Homo sapiens
caggtggagagcac

SEQ ID NO: 6708331 - DNA, 17 bp, Homo sapiens
caggtggagagcactag

SEQ ID NO: 6708332 - DNA, 15 bp, Homo sapiens
caggtggaggcaaca

SEQ ID NO: 6708333 - DNA, 15 bp, Homo sapiens
caggtggaggcgagc

SEQ ID NO: 6708334 - DNA, 15 bp, Homo sapiens
caggtggagggcaca

SEQ ID NO: 6708335 - DNA, 16 bp, Homo sapiens
caggtggagggcacag

SEQ ID NO: 6708336 - DNA, 17 bp, Homo sapiens
caggtggaggtgccagg

SEQ ID NO: 6708337 - DNA, 22 bp, Homo sapiens
caggtggatctatttcatgttt

SEQ ID NO: 6708338 - DNA, 18 bp, Homo sapiens
caggtggatgaggagaca

SEQ ID NO: 6708339 - DNA, 22 bp, Homo sapiens
caggtggatgtttaccgtgtgt

SEQ ID NO: 6708340 - DNA, 14 bp, Homo sapiens
caggtggcacctgc

SEQ ID NO: 6708341 - DNA, 16 bp, Homo sapiens
caggtggcacctgcag

SEQ ID NO: 6708342 - DNA, 16 bp, Homo sapiens
caggtggcagagtgaa

SEQ ID NO: 6708343 - DNA, 18 bp, Homo sapiens
caggtggcaggaccagga

SEQ ID NO: 6708344 - DNA, 21 bp, Homo sapiens
caggtggcaggaccaggacta

SEQ ID NO: 6708345 - DNA, 15 bp, Homo sapiens
caggtggcatttgca

SEQ ID NO: 6708346 - DNA, 19 bp, Homo sapiens
caggtggcatttgcaggtg

SEQ ID NO: 6708347 - DNA, 17 bp, Homo sapiens
caggtggccaagttcct

SEQ ID NO: 6708348 - DNA, 15 bp, Homo sapiens
caggtggccactcca

SEQ ID NO: 6708349 - DNA, 18 bp, Homo sapiens
caggtggccagaagagct

SEQ ID NO: 6708350 - DNA, 20 bp, Homo sapiens
caggtggccagaagagcttg

SEQ ID NO: 6708351 - DNA, 15 bp, Homo sapiens
caggtggccaggcag

SEQ ID NO: 6708352 - DNA, 15 bp, Homo sapiens
caggtggccagggct

SEQ ID NO: 6708353 - DNA, 21 bp, Homo sapiens
caggtggccagggctccacgg

SEQ ID NO: 6708354 - DNA, 13 bp, Homo sapiens
caggtggccatgc

SEQ ID NO: 6708355 - DNA, 15 bp, Homo sapiens
caggtggccatgcct

SEQ ID NO: 6708356 - DNA, 15 bp, Homo sapiens
caggtggccctactg

SEQ ID NO: 6708357 - DNA, 19 bp, Homo sapiens
caggtggcccttcccggca

SEQ ID NO: 6708358 - DNA, 19 bp, Homo sapiens
caggtggccgcccctgagg

SEQ ID NO: 6708359 - DNA, 18 bp, Homo sapiens
caggtggcctagcaggca

SEQ ID NO: 6708360 - DNA, 19 bp, Homo sapiens
caggtggcctagcaggcac

SEQ ID NO: 6708361 - DNA, 20 bp, Homo sapiens
caggtggcctagcaggcaca

SEQ ID NO: 6708362 - DNA, 17 bp, Homo sapiens
caggtggcctcctggcc

SEQ ID NO: 6708363 - DNA, 14 bp, Homo sapiens
caggtggcctctgc

SEQ ID NO: 6708364 - DNA, 22 bp, Homo sapiens
caggtggctagcaaattagaaa

SEQ ID NO: 6708365 - DNA, 20 bp, Homo sapiens
caggtggctcagtgccacct

SEQ ID NO: 6708366 - DNA, 14 bp, Homo sapiens
caggtggctgaccc

SEQ ID NO: 6708367 - DNA, 20 bp, Homo sapiens
caggtggctgacccagtccc

SEQ ID NO: 6708368 - DNA, 23 bp, Homo sapiens
caggtgggagagacactcccagg

SEQ ID NO: 6708369 - DNA, 13 bp, Homo sapiens
caggtgggagctg

SEQ ID NO: 6708370 - DNA, 22 bp, Homo sapiens
caggtgggaggaaagggcctgg

SEQ ID NO: 6708371 - DNA, 12 bp, Homo sapiens
caggtgggcact

SEQ ID NO: 6708372 - DNA, 15 bp, Homo sapiens
caggtgggcagacag

SEQ ID NO: 6708373 - DNA, 12 bp, Homo sapiens
caggtgggcctg

SEQ ID NO: 6708374 - DNA, 15 bp, Homo sapiens
caggtgggcctggcg

SEQ ID NO: 6708375 - DNA, 16 bp, Homo sapiens
caggtgggcctggcgg

SEQ ID NO: 6708376 - DNA, 20 bp, Homo sapiens
caggtgggcctggcggcctg

SEQ ID NO: 6708377 - DNA, 14 bp, Homo sapiens
caggtgggcctggg

SEQ ID NO: 6708378 - DNA, 15 bp, Homo sapiens
caggtgggcctggga

SEQ ID NO: 6708379 - DNA, 22 bp, Homo sapiens
caggtgggcggacaaaagggcc

SEQ ID NO: 6708380 - DNA, 17 bp, Homo sapiens
caggtgggcgtggtcac

SEQ ID NO: 6708381 - DNA, 15 bp, Homo sapiens
caggtgggctgggcc

SEQ ID NO: 6708382 - DNA, 19 bp, Homo sapiens
caggtgggcttcccagtgg

SEQ ID NO: 6708383 - DNA, 22 bp, Homo sapiens
caggtgggcttcccagtggctg

SEQ ID NO: 6708384 - DNA, 23 bp, Homo sapiens
caggtgggcttcccagtggctgc

SEQ ID NO: 6708385 - DNA, 19 bp, Homo sapiens
caggtggggactgggcaca

SEQ ID NO: 6708386 - DNA, 14 bp, Homo sapiens
caggtggggcagct

SEQ ID NO: 6708387 - DNA, 19 bp, Homo sapiens
caggtggggcatgtcctca

SEQ ID NO: 6708388 - DNA, 14 bp, Homo sapiens
caggtggggcctca

SEQ ID NO: 6708389 - DNA, 23 bp, Homo sapiens
caggtggggcctcagcctggggc

SEQ ID NO: 6708390 - DNA, 13 bp, Homo sapiens
caggtgggggctg

SEQ ID NO: 6708391 - DNA, 22 bp, Homo sapiens
caggtgggggctgcgtccctgc

SEQ ID NO: 6708392 - DNA, 18 bp, Homo sapiens
caggtggggtcactctgg

SEQ ID NO: 6708393 - DNA, 23 bp, Homo sapiens
caggtggggtgatggccagagga

SEQ ID NO: 6708394 - DNA, 19 bp, Homo sapiens
caggtggggtttcctgcat

SEQ ID NO: 6708395 - DNA, 20 bp, Homo sapiens
caggtggggttttcacttcc

SEQ ID NO: 6708396 - DNA, 22 bp, Homo sapiens
caggtgggtcccggctctgtgg

SEQ ID NO: 6708397 - DNA, 17 bp, Homo sapiens
caggtgggtgtgggaca

SEQ ID NO: 6708398 - DNA, 15 bp, Homo sapiens
caggtggtcccatag

SEQ ID NO: 6708399 - DNA, 21 bp, Homo sapiens
caggtggtcccataggtcttg

SEQ ID NO: 6708400 - DNA, 16 bp, Homo sapiens
caggtggtcctgagac

SEQ ID NO: 6708401 - DNA, 20 bp, Homo sapiens
caggtggtcctgagacctga

SEQ ID NO: 6708402 - DNA, 15 bp, Homo sapiens
caggtggtggcactg

SEQ ID NO: 6708403 - DNA, 19 bp, Homo sapiens
caggtggtggcactgagcc

SEQ ID NO: 6708404 - DNA, 20 bp, Homo sapiens
caggtggtggcactgagccc

SEQ ID NO: 6708405 - DNA, 18 bp, Homo sapiens
caggtggttaccaggcac

SEQ ID NO: 6708406 - DNA, 20 bp, Homo sapiens
caggtggttgtcttattgca

SEQ ID NO: 6708407 - DNA, 14 bp, Homo sapiens
caggtgtaaatata

SEQ ID NO: 6708408 - DNA, 21 bp, Homo sapiens
caggtgtaaatatagtagcag

SEQ ID NO: 6708409 - DNA, 22 bp, Homo sapiens
caggtgtagctaacagttgcca

SEQ ID NO: 6708410 - DNA, 16 bp, Homo sapiens
caggtgtagctgagct

SEQ ID NO: 6708411 - DNA, 21 bp, Homo sapiens
caggtgtagctgagctgtgac

SEQ ID NO: 6708412 - DNA, 14 bp, Homo sapiens
caggtgtataaatg

SEQ ID NO: 6708413 - DNA, 15 bp, Homo sapiens
caggtgtataaatgt

SEQ ID NO: 6708414 - DNA, 14 bp, Homo sapiens
caggtgtcagccat

SEQ ID NO: 6708415 - DNA, 17 bp, Homo sapiens
caggtgtcagccattgc

SEQ ID NO: 6708416 - DNA, 20 bp, Homo sapiens
caggtgtcaggatagtcaca

SEQ ID NO: 6708417 - DNA, 17 bp, Homo sapiens
caggtgtccccagccca

SEQ ID NO: 6708418 - DNA, 18 bp, Homo sapiens
caggtgtccccagcccac

SEQ ID NO: 6708419 - DNA, 20 bp, Homo sapiens
caggtgtccccagcccactg

SEQ ID NO: 6708420 - DNA, 15 bp, Homo sapiens
caggtgtccctgcac

SEQ ID NO: 6708421 - DNA, 16 bp, Homo sapiens
caggtgtccctgcact

SEQ ID NO: 6708422 - DNA, 21 bp, Homo sapiens
caggtgtcctgactgtcctac

SEQ ID NO: 6708423 - DNA, 13 bp, Homo sapiens
caggtgtcctttc

SEQ ID NO: 6708424 - DNA, 14 bp, Homo sapiens
caggtgtcctttcc

SEQ ID NO: 6708425 - DNA, 17 bp, Homo sapiens
caggtgtcctttcccct

SEQ ID NO: 6708426 - DNA, 22 bp, Homo sapiens
caggtgtcctttcccctctctg

SEQ ID NO: 6708427 - DNA, 19 bp, Homo sapiens
caggtgtgaaccaccacac

SEQ ID NO: 6708428 - DNA, 22 bp, Homo sapiens
caggtgtgaaccaccacaccca

SEQ ID NO: 6708429 - DNA, 16 bp, Homo sapiens
caggtgtgaccctgag

SEQ ID NO: 6708430 - DNA, 22 bp, Homo sapiens
caggtgtgagcacctttcctga

SEQ ID NO: 6708431 - DNA, 14 bp, Homo sapiens
caggtgtgagccac

SEQ ID NO: 6708432 - DNA, 16 bp, Homo sapiens
caggtgtgagccactg

SEQ ID NO: 6708433 - DNA, 19 bp, Homo sapiens
caggtgtgagccactgcgc

SEQ ID NO: 6708434 - DNA, 15 bp, Homo sapiens
caggtgtgcacgtgg

SEQ ID NO: 6708435 - DNA, 23 bp, Homo sapiens
caggtgtgcacgtggcatgtggc

SEQ ID NO: 6708436 - DNA, 12 bp, Homo sapiens
caggtgtgcccc

SEQ ID NO: 6708437 - DNA, 13 bp, Homo sapiens
caggtgtgcccct

SEQ ID NO: 6708438 - DNA, 18 bp, Homo sapiens
caggtgtgccgacagaag

SEQ ID NO: 6708439 - DNA, 19 bp, Homo sapiens
caggtgtgccgacagaagg

SEQ ID NO: 6708440 - DNA, 17 bp, Homo sapiens
caggtgtgcctgtgctc

SEQ ID NO: 6708441 - DNA, 20 bp, Homo sapiens
caggtgtgcctgtgctcctg

SEQ ID NO: 6708442 - DNA, 14 bp, Homo sapiens
caggtgtgctcagg

SEQ ID NO: 6708443 - DNA, 14 bp, Homo sapiens
caggtgtgggctcc

SEQ ID NO: 6708444 - DNA, 19 bp, Homo sapiens
caggtgtgggctcccacgc

SEQ ID NO: 6708445 - DNA, 22 bp, Homo sapiens
caggtgtggtggctcacacctg

SEQ ID NO: 6708446 - DNA, 19 bp, Homo sapiens
caggtgtggtggctcatgg

SEQ ID NO: 6708447 - DNA, 20 bp, Homo sapiens
caggtgtggtgtaatttata

SEQ ID NO: 6708448 - DNA, 22 bp, Homo sapiens
caggtgtgtatgtaaagttaaa

SEQ ID NO: 6708449 - DNA, 21 bp, Homo sapiens
caggtgtgtccacctgggcat

SEQ ID NO: 6708450 - DNA, 16 bp, Homo sapiens
caggtgtgtgccatca

SEQ ID NO: 6708451 - DNA, 18 bp, Homo sapiens
caggtgtgtgccatcatg

SEQ ID NO: 6708452 - DNA, 14 bp, Homo sapiens
caggtgtgtgtgaa

SEQ ID NO: 6708453 - DNA, 21 bp, Homo sapiens
caggtgtgtgtgaactgggca

SEQ ID NO: 6708454 - DNA, 20 bp, Homo sapiens
caggtgtgttcagtagttcc

SEQ ID NO: 6708455 - DNA, 15 bp, Homo sapiens
caggtgttaaaaacc

SEQ ID NO: 6708456 - DNA, 16 bp, Homo sapiens
caggtgttaaaaacca

SEQ ID NO: 6708457 - DNA, 19 bp, Homo sapiens
caggtgttaacattccaag

SEQ ID NO: 6708458 - DNA, 20 bp, Homo sapiens
caggtgttaacattccaaga

SEQ ID NO: 6708459 - DNA, 18 bp, Homo sapiens
caggtgttgattgttata

SEQ ID NO: 6708460 - DNA, 13 bp, Homo sapiens
caggtgttgccaa

SEQ ID NO: 6708461 - DNA, 22 bp, Homo sapiens
caggtgttgccatttctctgct

SEQ ID NO: 6708462 - DNA, 20 bp, Homo sapiens
caggtgttggctgcctggcc

SEQ ID NO: 6708463 - DNA, 22 bp, Homo sapiens
caggtgttggctgcctggccca

SEQ ID NO: 6708464 - DNA, 18 bp, Homo sapiens
caggtgttgggacctgct

SEQ ID NO: 6708465 - DNA, 21 bp, Homo sapiens
caggtgttgggacctgctgct

SEQ ID NO: 6708466 - DNA, 20 bp, Homo sapiens
caggtgtttatatctccttt

SEQ ID NO: 6708467 - DNA, 18 bp, Homo sapiens
caggtgtttgtggggctg

SEQ ID NO: 6708468 - DNA, 17 bp, Homo sapiens
caggtgttttaagactg

SEQ ID NO: 6708469 - DNA, 17 bp, Homo sapiens
caggtgttttccttcac

SEQ ID NO: 6708470 - DNA, 17 bp, Homo sapiens
caggttaaatatataaa

SEQ ID NO: 6708471 - DNA, 13 bp, Homo sapiens
caggttaaatgtt

SEQ ID NO: 6708472 - DNA, 14 bp, Homo sapiens
caggttaagaaaat

SEQ ID NO: 6708473 - DNA, 14 bp, Homo sapiens
caggttacaacaga

SEQ ID NO: 6708474 - DNA, 21 bp, Homo sapiens
caggttacaacagatttgtga

SEQ ID NO: 6708475 - DNA, 17 bp, Homo sapiens
caggttacgaagacaaa

SEQ ID NO: 6708476 - DNA, 11 bp, Homo sapiens
caggttagaga

SEQ ID NO: 6708477 - DNA, 23 bp, Homo sapiens
caggttagatatttcgaccctgg

SEQ ID NO: 6708478 - DNA, 18 bp, Homo sapiens
caggttaggaaggcagca

SEQ ID NO: 6708479 - DNA, 15 bp, Homo sapiens
caggttataacagtg

SEQ ID NO: 6708480 - DNA, 17 bp, Homo sapiens
caggttataacagtgtt

SEQ ID NO: 6708481 - DNA, 20 bp, Homo sapiens
caggttatcgaaataacaat

SEQ ID NO: 6708482 - DNA, 16 bp, Homo sapiens
caggttatgtcagcag

SEQ ID NO: 6708483 - DNA, 18 bp, Homo sapiens
caggttatgtcagcagct

SEQ ID NO: 6708484 - DNA, 21 bp, Homo sapiens
caggttatgtcagcagctctg

SEQ ID NO: 6708485 - DNA, 21 bp, Homo sapiens
caggttattgcaataaagtat

SEQ ID NO: 6708486 - DNA, 14 bp, Homo sapiens
caggttattttagt

SEQ ID NO: 6708487 - DNA, 17 bp, Homo sapiens
caggttcaacccacagc

SEQ ID NO: 6708488 - DNA, 17 bp, Homo sapiens
caggttcacagcagctt

SEQ ID NO: 6708489 - DNA, 13 bp, Homo sapiens
caggttcagcttg

SEQ ID NO: 6708490 - DNA, 13 bp, Homo sapiens
caggttcaggtcc

SEQ ID NO: 6708491 - DNA, 14 bp, Homo sapiens
caggttcccagcag

SEQ ID NO: 6708492 - DNA, 21 bp, Homo sapiens
caggttcccagcagctgggcc

SEQ ID NO: 6708493 - DNA, 22 bp, Homo sapiens
caggttcccagcagctgggccg

SEQ ID NO: 6708494 - DNA, 14 bp, Homo sapiens
caggttccccaagg

SEQ ID NO: 6708495 - DNA, 22 bp, Homo sapiens
caggttccccaagggccctggc

SEQ ID NO: 6708496 - DNA, 15 bp, Homo sapiens
caggttcccccagca

SEQ ID NO: 6708497 - DNA, 18 bp, Homo sapiens
caggttcccccagcaagc

SEQ ID NO: 6708498 - DNA, 17 bp, Homo sapiens
caggttcctcctaggcg

SEQ ID NO: 6708499 - DNA, 13 bp, Homo sapiens
caggttcctcctt

SEQ ID NO: 6708500 - DNA, 12 bp, Homo sapiens
caggttcctggg

SEQ ID NO: 6708501 - DNA, 15 bp, Homo sapiens
caggttcctggggcc

SEQ ID NO: 6708502 - DNA, 16 bp, Homo sapiens
caggttcctggggccg

SEQ ID NO: 6708503 - DNA, 20 bp, Homo sapiens
caggttcctggggccgcctg

SEQ ID NO: 6708504 - DNA, 16 bp, Homo sapiens
caggttccttttaagt

SEQ ID NO: 6708505 - DNA, 17 bp, Homo sapiens
caggttcgtatagaaaa

SEQ ID NO: 6708506 - DNA, 18 bp, Homo sapiens
caggttcgtatagaaaaa

SEQ ID NO: 6708507 - DNA, 16 bp, Homo sapiens
caggttctatttggaa

SEQ ID NO: 6708508 - DNA, 17 bp, Homo sapiens
caggttctatttggaat

SEQ ID NO: 6708509 - DNA, 19 bp, Homo sapiens
caggttctatttggaattt

SEQ ID NO: 6708510 - DNA, 21 bp, Homo sapiens
caggttctccgttagctcctg

SEQ ID NO: 6708511 - DNA, 24 bp, Homo sapiens
caggttctccgttagctcctgtgg

SEQ ID NO: 6708512 - DNA, 17 bp, Homo sapiens
caggttctctctcactg

SEQ ID NO: 6708513 - DNA, 15 bp, Homo sapiens
caggttctctttgag

SEQ ID NO: 6708514 - DNA, 20 bp, Homo sapiens
caggttctgtctggtgcccc

SEQ ID NO: 6708515 - DNA, 12 bp, Homo sapiens
caggttcttcag

SEQ ID NO: 6708516 - DNA, 20 bp, Homo sapiens
caggttcttcttcctgaagc

SEQ ID NO: 6708517 - DNA, 18 bp, Homo sapiens
caggttcttgatgtcatg

SEQ ID NO: 6708518 - DNA, 17 bp, Homo sapiens
caggttcttgcctttct

SEQ ID NO: 6708519 - DNA, 21 bp, Homo sapiens
caggttcttgttggtgcacag

SEQ ID NO: 6708520 - DNA, 22 bp, Homo sapiens
caggttgaagacctaaccaggg

SEQ ID NO: 6708521 - DNA, 23 bp, Homo sapiens
caggttgaagacctaaccagggc

SEQ ID NO: 6708522 - DNA, 21 bp, Homo sapiens
caggttgaatgggttctcagt

SEQ ID NO: 6708523 - DNA, 19 bp, Homo sapiens
caggttgaggctaaaacaa

SEQ ID NO: 6708524 - DNA, 18 bp, Homo sapiens
caggttgataaatcattt

SEQ ID NO: 6708525 - DNA, 14 bp, Homo sapiens
caggttgcagctgc

SEQ ID NO: 6708526 - DNA, 15 bp, Homo sapiens
caggttgcagctgct

SEQ ID NO: 6708527 - DNA, 16 bp, Homo sapiens
caggttgcagctgctc

SEQ ID NO: 6708528 - DNA, 17 bp, Homo sapiens
caggttgcagctgctct

SEQ ID NO: 6708529 - DNA, 13 bp, Homo sapiens
caggttgcattgg

SEQ ID NO: 6708530 - DNA, 14 bp, Homo sapiens
caggttgcctcaac

SEQ ID NO: 6708531 - DNA, 18 bp, Homo sapiens
caggttgctggttgctgt

SEQ ID NO: 6708532 - DNA, 22 bp, Homo sapiens
caggttgctggttgctgtgtgg

SEQ ID NO: 6708533 - DNA, 19 bp, Homo sapiens
caggttgctttgccctggt

SEQ ID NO: 6708534 - DNA, 19 bp, Homo sapiens
caggttggaaaagaaatca

SEQ ID NO: 6708535 - DNA, 18 bp, Homo sapiens
caggttggaagagaatca

SEQ ID NO: 6708536 - DNA, 21 bp, Homo sapiens
caggttggatgggagtgggca

SEQ ID NO: 6708537 - DNA, 21 bp, Homo sapiens
caggttggcaaacgggcttga

SEQ ID NO: 6708538 - DNA, 19 bp, Homo sapiens
caggttggcggcagacaca

SEQ ID NO: 6708539 - DNA, 18 bp, Homo sapiens
caggttggctctgccagt

SEQ ID NO: 6708540 - DNA, 21 bp, Homo sapiens
caggttggctctgccagtcct

SEQ ID NO: 6708541 - DNA, 23 bp, Homo sapiens
caggttggctctgccagtcctgt

SEQ ID NO: 6708542 - DNA, 22 bp, Homo sapiens
caggttgggaatgaggcttgct

SEQ ID NO: 6708543 - DNA, 18 bp, Homo sapiens
caggttgggctagagaaa

SEQ ID NO: 6708544 - DNA, 21 bp, Homo sapiens
caggttggtgggggcctcggt

SEQ ID NO: 6708545 - DNA, 16 bp, Homo sapiens
caggttggttttgctg

SEQ ID NO: 6708546 - DNA, 18 bp, Homo sapiens
caggttgtagtaaagaaa

SEQ ID NO: 6708547 - DNA, 19 bp, Homo sapiens
caggttgtagtaaagaaat

SEQ ID NO: 6708548 - DNA, 15 bp, Homo sapiens
caggttgttctgtat

SEQ ID NO: 6708549 - DNA, 19 bp, Homo sapiens
caggttgttctgtataaaa

SEQ ID NO: 6708550 - DNA, 13 bp, Homo sapiens
caggttgttggtg

SEQ ID NO: 6708551 - DNA, 15 bp, Homo sapiens
caggttgttttctac

SEQ ID NO: 6708552 - DNA, 16 bp, Homo sapiens
caggtttaacatttgc

SEQ ID NO: 6708553 - DNA, 21 bp, Homo sapiens
caggtttactcagtgaaatca

SEQ ID NO: 6708554 - DNA, 22 bp, Homo sapiens
caggtttactggacaaaatcaa

SEQ ID NO: 6708555 - DNA, 20 bp, Homo sapiens
caggtttatattgggaagct

SEQ ID NO: 6708556 - DNA, 13 bp, Homo sapiens
caggtttccccaa

SEQ ID NO: 6708557 - DNA, 22 bp, Homo sapiens
caggtttctaagcataaaagat

SEQ ID NO: 6708558 - DNA, 17 bp, Homo sapiens
caggtttctggtctcta

SEQ ID NO: 6708559 - DNA, 20 bp, Homo sapiens
caggtttctggtctctaggc

SEQ ID NO: 6708560 - DNA, 17 bp, Homo sapiens
caggtttcttctctgga

SEQ ID NO: 6708561 - DNA, 18 bp, Homo sapiens
caggtttcttctctggag

SEQ ID NO: 6708562 - DNA, 14 bp, Homo sapiens
caggtttgaccagg

SEQ ID NO: 6708563 - DNA, 19 bp, Homo sapiens
caggtttgagaaaaaggaa

SEQ ID NO: 6708564 - DNA, 15 bp, Homo sapiens
caggtttgcaggagc

SEQ ID NO: 6708565 - DNA, 21 bp, Homo sapiens
caggtttgcaggagcccccct

SEQ ID NO: 6708566 - DNA, 15 bp, Homo sapiens
caggtttgccagtga

SEQ ID NO: 6708567 - DNA, 23 bp, Homo sapiens
caggtttgcccacttgattgaga

SEQ ID NO: 6708568 - DNA, 13 bp, Homo sapiens
caggtttgctgtg

SEQ ID NO: 6708569 - DNA, 16 bp, Homo sapiens
caggtttgctgtgtct

SEQ ID NO: 6708570 - DNA, 19 bp, Homo sapiens
caggtttgttttttcaaga

SEQ ID NO: 6708571 - DNA, 20 bp, Homo sapiens
caggttttaaggattctgca

SEQ ID NO: 6708572 - DNA, 18 bp, Homo sapiens
caggttttcagagaatta

SEQ ID NO: 6708573 - DNA, 15 bp, Homo sapiens
caggttttctgctct

SEQ ID NO: 6708574 - DNA, 15 bp, Homo sapiens
caggttttgtaaaga

SEQ ID NO: 6708575 - DNA, 20 bp, Homo sapiens
caggttttgttttttttcag

SEQ ID NO: 6708576 - DNA, 18 bp, Homo sapiens
caggtttttaagttgtct

SEQ ID NO: 6708577 - DNA, 13 bp, Homo sapiens
caggtttttcaat

SEQ ID NO: 6708578 - DNA, 19 bp, Homo sapiens
caggtttttcaattaaacg

SEQ ID NO: 6708579 - DNA, 22 bp, Homo sapiens
caggtttttcaattaaacggat

SEQ ID NO: 6708580 - DNA, 19 bp, Homo sapiens
caggtttttcatctgaaaa

SEQ ID NO: 6708581 - DNA, 15 bp, Homo sapiens
caggtttttcctttt

SEQ ID NO: 6708582 - DNA, 17 bp, Homo sapiens
caggtttttctgtctca

SEQ ID NO: 6708583 - DNA, 18 bp, Homo sapiens
caggtttttgcccatcct

SEQ ID NO: 6708584 - DNA, 13 bp, Homo sapiens
cagtaaaaatcca

SEQ ID NO: 6708585 - DNA, 13 bp, Homo sapiens
cagtaaaaatttc

SEQ ID NO: 6708586 - DNA, 17 bp, Homo sapiens
cagtaaaaccctgttta

SEQ ID NO: 6708587 - DNA, 14 bp, Homo sapiens
cagtaaaagcaaaa

SEQ ID NO: 6708588 - DNA, 23 bp, Homo sapiens
cagtaaaagccttattctaaggt

SEQ ID NO: 6708589 - DNA, 19 bp, Homo sapiens
cagtaaaagtaaagactat

SEQ ID NO: 6708590 - DNA, 17 bp, Homo sapiens
cagtaaaagtcttctcc

SEQ ID NO: 6708591 - DNA, 13 bp, Homo sapiens
cagtaaaataaaa

SEQ ID NO: 6708592 - DNA, 15 bp, Homo sapiens
cagtaaaattgccat

SEQ ID NO: 6708593 - DNA, 14 bp, Homo sapiens
cagtaaacactgtg

SEQ ID NO: 6708594 - DNA, 21 bp, Homo sapiens
cagtaaacatttgtaaaaata

SEQ ID NO: 6708595 - DNA, 14 bp, Homo sapiens
cagtaaaccactga

SEQ ID NO: 6708596 - DNA, 13 bp, Homo sapiens
cagtaaacctgtc

SEQ ID NO: 6708597 - DNA, 16 bp, Homo sapiens
cagtaaacctgtctga

SEQ ID NO: 6708598 - DNA, 23 bp, Homo sapiens
cagtaaacgggaacatgccccct

SEQ ID NO: 6708599 - DNA, 14 bp, Homo sapiens
cagtaaacttttaa

SEQ ID NO: 6708600 - DNA, 19 bp, Homo sapiens
cagtaaagagaaactttgt

SEQ ID NO: 6708601 - DNA, 20 bp, Homo sapiens
cagtaaagagaaactttgtg

SEQ ID NO: 6708602 - DNA, 17 bp, Homo sapiens
cagtaaagaggcttcca

SEQ ID NO: 6708603 - DNA, 22 bp, Homo sapiens
cagtaaagagtacactcagcca

SEQ ID NO: 6708604 - DNA, 23 bp, Homo sapiens
cagtaaagagtacactcagccac

SEQ ID NO: 6708605 - DNA, 18 bp, Homo sapiens
cagtaaagatatttgaat

SEQ ID NO: 6708606 - DNA, 15 bp, Homo sapiens
cagtaaagcacttgc

SEQ ID NO: 6708607 - DNA, 19 bp, Homo sapiens
cagtaaagtacctttatgt

SEQ ID NO: 6708608 - DNA, 17 bp, Homo sapiens
cagtaaataaattgttt

SEQ ID NO: 6708609 - DNA, 18 bp, Homo sapiens
cagtaaataactggaaaa

SEQ ID NO: 6708610 - DNA, 16 bp, Homo sapiens
cagtaaatacactgtg

SEQ ID NO: 6708611 - DNA, 18 bp, Homo sapiens
cagtaaatacttgcagtt

SEQ ID NO: 6708612 - DNA, 20 bp, Homo sapiens
cagtaaatagtgtcatataa

SEQ ID NO: 6708613 - DNA, 23 bp, Homo sapiens
cagtaaatagtgtcatataaact

SEQ ID NO: 6708614 - DNA, 15 bp, Homo sapiens
cagtaaatatacact

SEQ ID NO: 6708615 - DNA, 22 bp, Homo sapiens
cagtaaatccacagccaacaaa

SEQ ID NO: 6708616 - DNA, 18 bp, Homo sapiens
cagtaaatgggggtgcat

SEQ ID NO: 6708617 - DNA, 21 bp, Homo sapiens
cagtaaatgggggtgcatttg

SEQ ID NO: 6708618 - DNA, 21 bp, Homo sapiens
cagtaacaaaattgacagctt

SEQ ID NO: 6708619 - DNA, 18 bp, Homo sapiens
cagtaacaagtattggga

SEQ ID NO: 6708620 - DNA, 14 bp, Homo sapiens
cagtaacacaatta

SEQ ID NO: 6708621 - DNA, 22 bp, Homo sapiens
cagtaacacatagactgtgcgc

SEQ ID NO: 6708622 - DNA, 16 bp, Homo sapiens
cagtaacactggcctt

SEQ ID NO: 6708623 - DNA, 15 bp, Homo sapiens
cagtaacaggctcaa

SEQ ID NO: 6708624 - DNA, 17 bp, Homo sapiens
cagtaacagtattcagt

SEQ ID NO: 6708625 - DNA, 13 bp, Homo sapiens
cagtaacatagct

SEQ ID NO: 6708626 - DNA, 15 bp, Homo sapiens
cagtaacatgcaaca

SEQ ID NO: 6708627 - DNA, 17 bp, Homo sapiens
cagtaacatgcaacaaa

SEQ ID NO: 6708628 - DNA, 20 bp, Homo sapiens
cagtaacatttctgttctca

SEQ ID NO: 6708629 - DNA, 15 bp, Homo sapiens
cagtaaccaagagtt

SEQ ID NO: 6708630 - DNA, 18 bp, Homo sapiens
cagtaacccccttaaatt

SEQ ID NO: 6708631 - DNA, 21 bp, Homo sapiens
cagtaacgcgtcttcctgagt

SEQ ID NO: 6708632 - DNA, 16 bp, Homo sapiens
cagtaacgtgctgctc

SEQ ID NO: 6708633 - DNA, 14 bp, Homo sapiens
cagtaactaaagct

SEQ ID NO: 6708634 - DNA, 16 bp, Homo sapiens
cagtaactaagcacat

SEQ ID NO: 6708635 - DNA, 21 bp, Homo sapiens
cagtaactaattttgttgaaa

SEQ ID NO: 6708636 - DNA, 14 bp, Homo sapiens
cagtaactcatctg

SEQ ID NO: 6708637 - DNA, 17 bp, Homo sapiens
cagtaactgagtgtggc

SEQ ID NO: 6708638 - DNA, 18 bp, Homo sapiens
cagtaactgagtgtggcg

SEQ ID NO: 6708639 - DNA, 16 bp, Homo sapiens
cagtaactgccctttc

SEQ ID NO: 6708640 - DNA, 19 bp, Homo sapiens
cagtaactttatgtgtaaa

SEQ ID NO: 6708641 - DNA, 21 bp, Homo sapiens
cagtaagaccggaagctcctg

SEQ ID NO: 6708642 - DNA, 15 bp, Homo sapiens
cagtaagagtttaca

SEQ ID NO: 6708643 - DNA, 16 bp, Homo sapiens
cagtaagatcactgtt

SEQ ID NO: 6708644 - DNA, 17 bp, Homo sapiens
cagtaagatcactgttt

SEQ ID NO: 6708645 - DNA, 19 bp, Homo sapiens
cagtaagatcactgtttag

SEQ ID NO: 6708646 - DNA, 21 bp, Homo sapiens
cagtaagatcactgtttagat

SEQ ID NO: 6708647 - DNA, 21 bp, Homo sapiens
cagtaagattttatccctttc

SEQ ID NO: 6708648 - DNA, 15 bp, Homo sapiens
cagtaagccactgcc

SEQ ID NO: 6708649 - DNA, 19 bp, Homo sapiens
cagtaagtagcaaccctgt

SEQ ID NO: 6708650 - DNA, 18 bp, Homo sapiens
cagtaagtatctggagga

SEQ ID NO: 6708651 - DNA, 22 bp, Homo sapiens
cagtaagtctcataggttaaaa

SEQ ID NO: 6708652 - DNA, 21 bp, Homo sapiens
cagtaagtgttagagggaaca

SEQ ID NO: 6708653 - DNA, 15 bp, Homo sapiens
cagtaagttatcttt

SEQ ID NO: 6708654 - DNA, 22 bp, Homo sapiens
cagtaagttctgtggttccagt

SEQ ID NO: 6708655 - DNA, 14 bp, Homo sapiens
cagtaagtttcccc

SEQ ID NO: 6708656 - DNA, 21 bp, Homo sapiens
cagtaagtttcccctctggct

SEQ ID NO: 6708657 - DNA, 17 bp, Homo sapiens
cagtaataaaaagccac

SEQ ID NO: 6708658 - DNA, 14 bp, Homo sapiens
cagtaataaaacat

SEQ ID NO: 6708659 - DNA, 15 bp, Homo sapiens
cagtaataaaacatc

SEQ ID NO: 6708660 - DNA, 21 bp, Homo sapiens
cagtaataaatgaatgtcact

SEQ ID NO: 6708661 - DNA, 18 bp, Homo sapiens
cagtaatatgaaagccac

SEQ ID NO: 6708662 - DNA, 19 bp, Homo sapiens
cagtaatatgaaagccaca

SEQ ID NO: 6708663 - DNA, 20 bp, Homo sapiens
cagtaatcccatttcccaaa

SEQ ID NO: 6708664 - DNA, 21 bp, Homo sapiens
cagtaatcctgtaggaaggta

SEQ ID NO: 6708665 - DNA, 14 bp, Homo sapiens
cagtaatctaggtg

SEQ ID NO: 6708666 - DNA, 20 bp, Homo sapiens
cagtaatctaggtgtggctg

SEQ ID NO: 6708667 - DNA, 18 bp, Homo sapiens
cagtaatctttatactgg

SEQ ID NO: 6708668 - DNA, 11 bp, Homo sapiens
cagtaatgaaa

SEQ ID NO: 6708669 - DNA, 21 bp, Homo sapiens
cagtaatgagcttaagaaatt

SEQ ID NO: 6708670 - DNA, 21 bp, Homo sapiens
cagtaatgagttaaataaaac

SEQ ID NO: 6708671 - DNA, 18 bp, Homo sapiens
cagtaatgctaaatgtgt

SEQ ID NO: 6708672 - DNA, 19 bp, Homo sapiens
cagtaatgctaaatgtgta

SEQ ID NO: 6708673 - DNA, 20 bp, Homo sapiens
cagtaatgctaaatgtgtaa

SEQ ID NO: 6708674 - DNA, 13 bp, Homo sapiens
cagtaatgtagaa

SEQ ID NO: 6708675 - DNA, 15 bp, Homo sapiens
cagtaatgtagaaat

SEQ ID NO: 6708676 - DNA, 17 bp, Homo sapiens
cagtaatgtagaaatgt

SEQ ID NO: 6708677 - DNA, 13 bp, Homo sapiens
cagtaatgttatt

SEQ ID NO: 6708678 - DNA, 20 bp, Homo sapiens
cagtaattaacatatcaagg

SEQ ID NO: 6708679 - DNA, 19 bp, Homo sapiens
cagtaattaatatctcctg

SEQ ID NO: 6708680 - DNA, 18 bp, Homo sapiens
cagtaattacaaattaag

SEQ ID NO: 6708681 - DNA, 13 bp, Homo sapiens
cagtaattacttt

SEQ ID NO: 6708682 - DNA, 19 bp, Homo sapiens
cagtaattattatttaact

SEQ ID NO: 6708683 - DNA, 20 bp, Homo sapiens
cagtaattattatttaactc

SEQ ID NO: 6708684 - DNA, 21 bp, Homo sapiens
cagtaattcccatctgcttta

SEQ ID NO: 6708685 - DNA, 16 bp, Homo sapiens
cagtaattgtgaaaat

SEQ ID NO: 6708686 - DNA, 14 bp, Homo sapiens
cagtaattgtgaca

SEQ ID NO: 6708687 - DNA, 17 bp, Homo sapiens
cagtaattgtgtttaca

SEQ ID NO: 6708688 - DNA, 12 bp, Homo sapiens
cagtaatttata

SEQ ID NO: 6708689 - DNA, 14 bp, Homo sapiens
cagtaatttctgag

SEQ ID NO: 6708690 - DNA, 15 bp, Homo sapiens
cagtaatttctgaga

SEQ ID NO: 6708691 - DNA, 15 bp, Homo sapiens
cagtaattttcggat

SEQ ID NO: 6708692 - DNA, 22 bp, Homo sapiens
cagtacaacccataatcatgta

SEQ ID NO: 6708693 - DNA, 12 bp, Homo sapiens
cagtacaataat

SEQ ID NO: 6708694 - DNA, 19 bp, Homo sapiens
cagtacaataatgtactca

SEQ ID NO: 6708695 - DNA, 20 bp, Homo sapiens
cagtacaataatgtactcac

SEQ ID NO: 6708696 - DNA, 17 bp, Homo sapiens
cagtacaattctttgtt

SEQ ID NO: 6708697 - DNA, 20 bp, Homo sapiens
cagtacacaccagaagatgt

SEQ ID NO: 6708698 - DNA, 22 bp, Homo sapiens
cagtacacatccccagaatcca

SEQ ID NO: 6708699 - DNA, 23 bp, Homo sapiens
cagtacactgtcagcagggactg

SEQ ID NO: 6708700 - DNA, 15 bp, Homo sapiens
cagtacacttcctgt

SEQ ID NO: 6708701 - DNA, 21 bp, Homo sapiens
cagtacacttggtgtactggg

SEQ ID NO: 6708702 - DNA, 14 bp, Homo sapiens
cagtacagaaggca

SEQ ID NO: 6708703 - DNA, 21 bp, Homo sapiens
cagtacagagaaattctgtgg

SEQ ID NO: 6708704 - DNA, 23 bp, Homo sapiens
cagtacagagaaattctgtggtg

SEQ ID NO: 6708705 - DNA, 13 bp, Homo sapiens
cagtacaggcagc

SEQ ID NO: 6708706 - DNA, 16 bp, Homo sapiens
cagtacaggcagcaca

SEQ ID NO: 6708707 - DNA, 20 bp, Homo sapiens
cagtacaggcagcacagaga

SEQ ID NO: 6708708 - DNA, 13 bp, Homo sapiens
cagtacagggcag

SEQ ID NO: 6708709 - DNA, 21 bp, Homo sapiens
cagtacagggcaggagctgct

SEQ ID NO: 6708710 - DNA, 16 bp, Homo sapiens
cagtacatacgtctgc

SEQ ID NO: 6708711 - DNA, 17 bp, Homo sapiens
cagtacatcttgtgcat

SEQ ID NO: 6708712 - DNA, 19 bp, Homo sapiens
cagtacatcttgtgcatgc

SEQ ID NO: 6708713 - DNA, 14 bp, Homo sapiens
cagtacatgggaaa

SEQ ID NO: 6708714 - DNA, 15 bp, Homo sapiens
cagtacatgggaaag

SEQ ID NO: 6708715 - DNA, 16 bp, Homo sapiens
cagtacatgggtgact

SEQ ID NO: 6708716 - DNA, 17 bp, Homo sapiens
cagtacatgggtgacta

SEQ ID NO: 6708717 - DNA, 19 bp, Homo sapiens
cagtacattctaaagagag

SEQ ID NO: 6708718 - DNA, 21 bp, Homo sapiens
cagtacattctcagtttttct

SEQ ID NO: 6708719 - DNA, 16 bp, Homo sapiens
cagtacatttaaattt

SEQ ID NO: 6708720 - DNA, 12 bp, Homo sapiens
cagtaccacatg

SEQ ID NO: 6708721 - DNA, 15 bp, Homo sapiens
cagtaccataatctt

SEQ ID NO: 6708722 - DNA, 13 bp, Homo sapiens
cagtaccatccca

SEQ ID NO: 6708723 - DNA, 17 bp, Homo sapiens
cagtaccatcccactga

SEQ ID NO: 6708724 - DNA, 16 bp, Homo sapiens
cagtacccaccacctt

SEQ ID NO: 6708725 - DNA, 13 bp, Homo sapiens
cagtacccacctg

SEQ ID NO: 6708726 - DNA, 16 bp, Homo sapiens
cagtacccacctgagc

SEQ ID NO: 6708727 - DNA, 19 bp, Homo sapiens
cagtacccatggggctagg

SEQ ID NO: 6708728 - DNA, 16 bp, Homo sapiens
cagtaccctctcagct

SEQ ID NO: 6708729 - DNA, 20 bp, Homo sapiens
cagtaccctctcagctccag

SEQ ID NO: 6708730 - DNA, 17 bp, Homo sapiens
cagtaccctggttgtgt

SEQ ID NO: 6708731 - DNA, 22 bp, Homo sapiens
cagtacctataaagtaaagcta

SEQ ID NO: 6708732 - DNA, 16 bp, Homo sapiens
cagtacctccaagcaa

SEQ ID NO: 6708733 - DNA, 16 bp, Homo sapiens
cagtacctcccctccc

SEQ ID NO: 6708734 - DNA, 14 bp, Homo sapiens
cagtacctgagggt

SEQ ID NO: 6708735 - DNA, 21 bp, Homo sapiens
cagtacctgagggtctgtagg

SEQ ID NO: 6708736 - DNA, 16 bp, Homo sapiens
cagtacctgattgtat

SEQ ID NO: 6708737 - DNA, 20 bp, Homo sapiens
cagtacctgattgtattttt

SEQ ID NO: 6708738 - DNA, 12 bp, Homo sapiens
cagtacctggag

SEQ ID NO: 6708739 - DNA, 15 bp, Homo sapiens
cagtacctggaggag

SEQ ID NO: 6708740 - DNA, 21 bp, Homo sapiens
cagtacctggaggaggagcag

SEQ ID NO: 6708741 - DNA, 22 bp, Homo sapiens
cagtacctgggtccccagccct

SEQ ID NO: 6708742 - DNA, 17 bp, Homo sapiens
cagtacctttgtcacaa

SEQ ID NO: 6708743 - DNA, 15 bp, Homo sapiens
cagtacgatttgcag

SEQ ID NO: 6708744 - DNA, 17 bp, Homo sapiens
cagtacgtcccgctgct

SEQ ID NO: 6708745 - DNA, 17 bp, Homo sapiens
cagtactatgtaaattt

SEQ ID NO: 6708746 - DNA, 22 bp, Homo sapiens
cagtactattcaggtaacacta

SEQ ID NO: 6708747 - DNA, 15 bp, Homo sapiens
cagtactattcctta

SEQ ID NO: 6708748 - DNA, 20 bp, Homo sapiens
cagtactattttaatttgta

SEQ ID NO: 6708749 - DNA, 19 bp, Homo sapiens
cagtactcactttttccaa

SEQ ID NO: 6708750 - DNA, 19 bp, Homo sapiens
cagtactgactttctgatt

SEQ ID NO: 6708751 - DNA, 12 bp, Homo sapiens
cagtactgggaa

SEQ ID NO: 6708752 - DNA, 22 bp, Homo sapiens
cagtacttgtgaaacacagctg

SEQ ID NO: 6708753 - DNA, 15 bp, Homo sapiens
cagtactttattgta

SEQ ID NO: 6708754 - DNA, 20 bp, Homo sapiens
cagtacttttattaatattt

SEQ ID NO: 6708755 - DNA, 14 bp, Homo sapiens
cagtacttttctct

SEQ ID NO: 6708756 - DNA, 17 bp, Homo sapiens
cagtagaaagagtgtta

SEQ ID NO: 6708757 - DNA, 16 bp, Homo sapiens
cagtagaaagctaaag

SEQ ID NO: 6708758 - DNA, 21 bp, Homo sapiens
cagtagaaagctaaagtgatc

SEQ ID NO: 6708759 - DNA, 14 bp, Homo sapiens
cagtagaactccag

SEQ ID NO: 6708760 - DNA, 20 bp, Homo sapiens
cagtagaaggtcggaggctt

SEQ ID NO: 6708761 - DNA, 12 bp, Homo sapiens
cagtagaatttc

SEQ ID NO: 6708762 - DNA, 20 bp, Homo sapiens
cagtagacattttaacaaga

SEQ ID NO: 6708763 - DNA, 16 bp, Homo sapiens
cagtagactcatcttt

SEQ ID NO: 6708764 - DNA, 16 bp, Homo sapiens
cagtagagaaacattt

SEQ ID NO: 6708765 - DNA, 12 bp, Homo sapiens
cagtagagaaca

SEQ ID NO: 6708766 - DNA, 13 bp, Homo sapiens
cagtagagagcct

SEQ ID NO: 6708767 - DNA, 21 bp, Homo sapiens
cagtagagtagggtagaagga

SEQ ID NO: 6708768 - DNA, 23 bp, Homo sapiens
cagtagagtagggtagaaggaaa

SEQ ID NO: 6708769 - DNA, 17 bp, Homo sapiens
cagtagatgtgcttctg

SEQ ID NO: 6708770 - DNA, 18 bp, Homo sapiens
cagtagatgtgcttctga

SEQ ID NO: 6708771 - DNA, 19 bp, Homo sapiens
cagtagatgtgcttctgaa

SEQ ID NO: 6708772 - DNA, 21 bp, Homo sapiens
cagtagattcaagttgtgtct

SEQ ID NO: 6708773 - DNA, 23 bp, Homo sapiens
cagtagattcaagttgtgtctga

SEQ ID NO: 6708774 - DNA, 18 bp, Homo sapiens
cagtagattgcagaaaat

SEQ ID NO: 6708775 - DNA, 13 bp, Homo sapiens
cagtagattttct

SEQ ID NO: 6708776 - DNA, 21 bp, Homo sapiens
cagtagcacaagttatttaaa

SEQ ID NO: 6708777 - DNA, 16 bp, Homo sapiens
cagtagcagctgtgtt

SEQ ID NO: 6708778 - DNA, 14 bp, Homo sapiens
cagtagcaggacct

SEQ ID NO: 6708779 - DNA, 19 bp, Homo sapiens
cagtagcatactgatgaga

SEQ ID NO: 6708780 - DNA, 16 bp, Homo sapiens
cagtagcattgaagtg

SEQ ID NO: 6708781 - DNA, 20 bp, Homo sapiens
cagtagcattttaatagttt

SEQ ID NO: 6708782 - DNA, 23 bp, Homo sapiens
cagtagcattttaatagtttcta

SEQ ID NO: 6708783 - DNA, 17 bp, Homo sapiens
cagtagcatttttctaa

SEQ ID NO: 6708784 - DNA, 14 bp, Homo sapiens
cagtagccagcacg

SEQ ID NO: 6708785 - DNA, 18 bp, Homo sapiens
cagtagccattttgtaac

SEQ ID NO: 6708786 - DNA, 15 bp, Homo sapiens
cagtagccatttttt

SEQ ID NO: 6708787 - DNA, 20 bp, Homo sapiens
cagtagcctcctcctgggct

SEQ ID NO: 6708788 - DNA, 15 bp, Homo sapiens
cagtagctccaacac

SEQ ID NO: 6708789 - DNA, 12 bp, Homo sapiens
cagtagctctta

SEQ ID NO: 6708790 - DNA, 15 bp, Homo sapiens
cagtagctgaacctg

SEQ ID NO: 6708791 - DNA, 13 bp, Homo sapiens
cagtagctgccaa

SEQ ID NO: 6708792 - DNA, 20 bp, Homo sapiens
cagtagctgccaaaaagaac

SEQ ID NO: 6708793 - DNA, 22 bp, Homo sapiens
cagtagctgccaaaaagaacac

SEQ ID NO: 6708794 - DNA, 19 bp, Homo sapiens
cagtagctgtggggagctg

SEQ ID NO: 6708795 - DNA, 20 bp, Homo sapiens
cagtagctgtggggagctgg

SEQ ID NO: 6708796 - DNA, 21 bp, Homo sapiens
cagtagctgtggggagctggt

SEQ ID NO: 6708797 - DNA, 15 bp, Homo sapiens
cagtagcttaaataa

SEQ ID NO: 6708798 - DNA, 21 bp, Homo sapiens
cagtagcttaaataaattcaa

SEQ ID NO: 6708799 - DNA, 21 bp, Homo sapiens
cagtagcttaagggaatatgc

SEQ ID NO: 6708800 - DNA, 18 bp, Homo sapiens
cagtaggaaatcaggcag

SEQ ID NO: 6708801 - DNA, 18 bp, Homo sapiens
cagtaggaacaagctggc

SEQ ID NO: 6708802 - DNA, 19 bp, Homo sapiens
cagtaggaacccagctctc

SEQ ID NO: 6708803 - DNA, 14 bp, Homo sapiens
cagtaggagcccag

SEQ ID NO: 6708804 - DNA, 13 bp, Homo sapiens
cagtaggatattt

SEQ ID NO: 6708805 - DNA, 18 bp, Homo sapiens
cagtaggatatttctaca

SEQ ID NO: 6708806 - DNA, 18 bp, Homo sapiens
cagtaggctcaactaggg

SEQ ID NO: 6708807 - DNA, 23 bp, Homo sapiens
cagtaggcttttaccattagcat

SEQ ID NO: 6708808 - DNA, 20 bp, Homo sapiens
cagtagggtttgacatttca

SEQ ID NO: 6708809 - DNA, 18 bp, Homo sapiens
cagtaggtccaagggcca

SEQ ID NO: 6708810 - DNA, 23 bp, Homo sapiens
cagtaggtcccggccagctctgg

SEQ ID NO: 6708811 - DNA, 18 bp, Homo sapiens
cagtaggtctgaaggcct

SEQ ID NO: 6708812 - DNA, 22 bp, Homo sapiens
cagtaggtgacactatagttta

SEQ ID NO: 6708813 - DNA, 15 bp, Homo sapiens
cagtagtaccttgtt

SEQ ID NO: 6708814 - DNA, 17 bp, Homo sapiens
cagtagtaccttgtttt

SEQ ID NO: 6708815 - DNA, 15 bp, Homo sapiens
cagtagtatctgctt

SEQ ID NO: 6708816 - DNA, 17 bp, Homo sapiens
cagtagtcacaaactga

SEQ ID NO: 6708817 - DNA, 15 bp, Homo sapiens
cagtagtcagaagca

SEQ ID NO: 6708818 - DNA, 23 bp, Homo sapiens
cagtagtctctgtgctttgactc

SEQ ID NO: 6708819 - DNA, 14 bp, Homo sapiens
cagtagtgaccaat

SEQ ID NO: 6708820 - DNA, 22 bp, Homo sapiens
cagtagtgagaagaatattgtt

SEQ ID NO: 6708821 - DNA, 13 bp, Homo sapiens
cagtagtgccaaa

SEQ ID NO: 6708822 - DNA, 15 bp, Homo sapiens
cagtagtgcctgtga

SEQ ID NO: 6708823 - DNA, 17 bp, Homo sapiens
cagtagtgcctgtgatc

SEQ ID NO: 6708824 - DNA, 13 bp, Homo sapiens
cagtagtgctaat

SEQ ID NO: 6708825 - DNA, 19 bp, Homo sapiens
cagtagtgctaatgcattt

SEQ ID NO: 6708826 - DNA, 19 bp, Homo sapiens
cagtagtgtcatcactctt

SEQ ID NO: 6708827 - DNA, 13 bp, Homo sapiens
cagtagtgttctg

SEQ ID NO: 6708828 - DNA, 17 bp, Homo sapiens
cagtagtgttgggtgga

SEQ ID NO: 6708829 - DNA, 24 bp, Homo sapiens
cagtagtgttgggtggaggatgga

SEQ ID NO: 6708830 - DNA, 15 bp, Homo sapiens
cagtagtgtttggaa

SEQ ID NO: 6708831 - DNA, 17 bp, Homo sapiens
cagtagtgtttggaatt

SEQ ID NO: 6708832 - DNA, 15 bp, Homo sapiens
cagtagttcacttta

SEQ ID NO: 6708833 - DNA, 18 bp, Homo sapiens
cagtagttctcaaagtgt

SEQ ID NO: 6708834 - DNA, 13 bp, Homo sapiens
cagtagtttctca

SEQ ID NO: 6708835 - DNA, 19 bp, Homo sapiens
cagtagtttctcagggtca

SEQ ID NO: 6708836 - DNA, 23 bp, Homo sapiens
cagtagtttctcagggtcactgt

SEQ ID NO: 6708837 - DNA, 16 bp, Homo sapiens
cagtagtttgagacca

SEQ ID NO: 6708838 - DNA, 18 bp, Homo sapiens
cagtagtttgagaccagc

SEQ ID NO: 6708839 - DNA, 20 bp, Homo sapiens
cagtagtttgagaccagcct

SEQ ID NO: 6708840 - DNA, 23 bp, Homo sapiens
cagtagtttgagaccagcctggc

SEQ ID NO: 6708841 - DNA, 20 bp, Homo sapiens
cagtagtttggtttgacttg

SEQ ID NO: 6708842 - DNA, 18 bp, Homo sapiens
cagtagttttcaaaacac

SEQ ID NO: 6708843 - DNA, 18 bp, Homo sapiens
cagtataaaattacagtg

SEQ ID NO: 6708844 - DNA, 14 bp, Homo sapiens
cagtataaacaaag

SEQ ID NO: 6708845 - DNA, 14 bp, Homo sapiens
cagtataaagaata

SEQ ID NO: 6708846 - DNA, 21 bp, Homo sapiens
cagtataaagaataggacttg

SEQ ID NO: 6708847 - DNA, 12 bp, Homo sapiens
cagtataaatta

SEQ ID NO: 6708848 - DNA, 17 bp, Homo sapiens
cagtataaattacatgc

SEQ ID NO: 6708849 - DNA, 18 bp, Homo sapiens
cagtataaattacatgca

SEQ ID NO: 6708850 - DNA, 19 bp, Homo sapiens
cagtataaattacatgcat

SEQ ID NO: 6708851 - DNA, 15 bp, Homo sapiens
cagtataacctgtct

SEQ ID NO: 6708852 - DNA, 23 bp, Homo sapiens
cagtataatttgacaaagaaaaa

SEQ ID NO: 6708853 - DNA, 16 bp, Homo sapiens
cagtatacctcatttt

SEQ ID NO: 6708854 - DNA, 13 bp, Homo sapiens
cagtatactgtgt

SEQ ID NO: 6708855 - DNA, 15 bp, Homo sapiens
cagtatactgtgtgg

SEQ ID NO: 6708856 - DNA, 17 bp, Homo sapiens
cagtatactgtgtggga

SEQ ID NO: 6708857 - DNA, 18 bp, Homo sapiens
cagtatagaataggcact

SEQ ID NO: 6708858 - DNA, 22 bp, Homo sapiens
cagtatagaataggcactttaa

SEQ ID NO: 6708859 - DNA, 15 bp, Homo sapiens
cagtatataagctgt

SEQ ID NO: 6708860 - DNA, 16 bp, Homo sapiens
cagtatataagctgtt

SEQ ID NO: 6708861 - DNA, 14 bp, Homo sapiens
cagtatataagctt

SEQ ID NO: 6708862 - DNA, 16 bp, Homo sapiens
cagtatataataactt

SEQ ID NO: 6708863 - DNA, 19 bp, Homo sapiens
cagtatataataactttat

SEQ ID NO: 6708864 - DNA, 17 bp, Homo sapiens
cagtatatattctttca

SEQ ID NO: 6708865 - DNA, 21 bp, Homo sapiens
cagtatatattctttcacaag

SEQ ID NO: 6708866 - DNA, 14 bp, Homo sapiens
cagtatattagtat

SEQ ID NO: 6708867 - DNA, 20 bp, Homo sapiens
cagtatattcttgtaaatac

SEQ ID NO: 6708868 - DNA, 14 bp, Homo sapiens
cagtatatttaaac

SEQ ID NO: 6708869 - DNA, 16 bp, Homo sapiens
cagtatatttaaactc

SEQ ID NO: 6708870 - DNA, 15 bp, Homo sapiens
cagtatatttatagt

SEQ ID NO: 6708871 - DNA, 14 bp, Homo sapiens
cagtatatttgaaa

SEQ ID NO: 6708872 - DNA, 18 bp, Homo sapiens
cagtatatttgaaactgt

SEQ ID NO: 6708873 - DNA, 14 bp, Homo sapiens
cagtatatttggtt

SEQ ID NO: 6708874 - DNA, 14 bp, Homo sapiens
cagtatattttatt

SEQ ID NO: 6708875 - DNA, 14 bp, Homo sapiens
cagtatcaaggctg

SEQ ID NO: 6708876 - DNA, 19 bp, Homo sapiens
cagtatcaaggctgacttg

SEQ ID NO: 6708877 - DNA, 15 bp, Homo sapiens
cagtatcaaggctgc

SEQ ID NO: 6708878 - DNA, 17 bp, Homo sapiens
cagtatcaaggctgcct

SEQ ID NO: 6708879 - DNA, 19 bp, Homo sapiens
cagtatcagagggtggaga

SEQ ID NO: 6708880 - DNA, 17 bp, Homo sapiens
cagtatcaggcctgcca

SEQ ID NO: 6708881 - DNA, 15 bp, Homo sapiens
cagtatcatattatt

SEQ ID NO: 6708882 - DNA, 17 bp, Homo sapiens
cagtatcatctccatca

SEQ ID NO: 6708883 - DNA, 17 bp, Homo sapiens
cagtatcatgccctgtg

SEQ ID NO: 6708884 - DNA, 20 bp, Homo sapiens
cagtatcatgccctgtgcaa

SEQ ID NO: 6708885 - DNA, 24 bp, Homo sapiens
cagtatccgcgagcctgcttgctg

SEQ ID NO: 6708886 - DNA, 17 bp, Homo sapiens
cagtatcctgaaacagt

SEQ ID NO: 6708887 - DNA, 22 bp, Homo sapiens
cagtatcctgaaacagtgtttg

SEQ ID NO: 6708888 - DNA, 21 bp, Homo sapiens
cagtatcctggattcctctaa

SEQ ID NO: 6708889 - DNA, 16 bp, Homo sapiens
cagtatcggcactgta

SEQ ID NO: 6708890 - DNA, 19 bp, Homo sapiens
cagtatcggcactgtacaa

SEQ ID NO: 6708891 - DNA, 13 bp, Homo sapiens
cagtatctcaggg

SEQ ID NO: 6708892 - DNA, 11 bp, Homo sapiens
cagtatctctt

SEQ ID NO: 6708893 - DNA, 17 bp, Homo sapiens
cagtatctcttacatca

SEQ ID NO: 6708894 - DNA, 13 bp, Homo sapiens
cagtatctgctgt

SEQ ID NO: 6708895 - DNA, 15 bp, Homo sapiens
cagtatctgctgttc

SEQ ID NO: 6708896 - DNA, 18 bp, Homo sapiens
cagtatctgctgttcttc

SEQ ID NO: 6708897 - DNA, 19 bp, Homo sapiens
cagtatctgctgttcttca

SEQ ID NO: 6708898 - DNA, 22 bp, Homo sapiens
cagtatctgctgttcttcagtc

SEQ ID NO: 6708899 - DNA, 16 bp, Homo sapiens
cagtatcttagagttt

SEQ ID NO: 6708900 - DNA, 13 bp, Homo sapiens
cagtatcttcaaa

SEQ ID NO: 6708901 - DNA, 15 bp, Homo sapiens
cagtatcttcaaaaa

SEQ ID NO: 6708902 - DNA, 17 bp, Homo sapiens
cagtatcttcaaaaata

SEQ ID NO: 6708903 - DNA, 12 bp, Homo sapiens
cagtatcttgaa

SEQ ID NO: 6708904 - DNA, 18 bp, Homo sapiens
cagtatcttgaagacttt

SEQ ID NO: 6708905 - DNA, 13 bp, Homo sapiens
cagtatgaaaata

SEQ ID NO: 6708906 - DNA, 21 bp, Homo sapiens
cagtatgaaaatcagcatgcc

SEQ ID NO: 6708907 - DNA, 16 bp, Homo sapiens
cagtatgaagacactg

SEQ ID NO: 6708908 - DNA, 21 bp, Homo sapiens
cagtatgaatgatgttttaga

SEQ ID NO: 6708909 - DNA, 14 bp, Homo sapiens
cagtatgagaagaa

SEQ ID NO: 6708910 - DNA, 20 bp, Homo sapiens
cagtatgagtcaatgtgcag

SEQ ID NO: 6708911 - DNA, 14 bp, Homo sapiens
cagtatgatgaaaa

SEQ ID NO: 6708912 - DNA, 15 bp, Homo sapiens
cagtatgatttataa

SEQ ID NO: 6708913 - DNA, 15 bp, Homo sapiens
cagtatgatttatcc

SEQ ID NO: 6708914 - DNA, 12 bp, Homo sapiens
cagtatggcagc

SEQ ID NO: 6708915 - DNA, 15 bp, Homo sapiens
cagtatggcggaggc

SEQ ID NO: 6708916 - DNA, 21 bp, Homo sapiens
cagtatggcggaggccatggg

SEQ ID NO: 6708917 - DNA, 15 bp, Homo sapiens
cagtatgtattcttt

SEQ ID NO: 6708918 - DNA, 20 bp, Homo sapiens
cagtatgtgggggcttcatc

SEQ ID NO: 6708919 - DNA, 13 bp, Homo sapiens
cagtatgtgtgct

SEQ ID NO: 6708920 - DNA, 17 bp, Homo sapiens
cagtatgttacatgcat

SEQ ID NO: 6708921 - DNA, 15 bp, Homo sapiens
cagtatgttgtcaaa

SEQ ID NO: 6708922 - DNA, 18 bp, Homo sapiens
cagtatgttgtcaaagag

SEQ ID NO: 6708923 - DNA, 14 bp, Homo sapiens
cagtattaaactct

SEQ ID NO: 6708924 - DNA, 19 bp, Homo sapiens
cagtattaaactctccttt

SEQ ID NO: 6708925 - DNA, 22 bp, Homo sapiens
cagtattaaactctcctttgat

SEQ ID NO: 6708926 - DNA, 19 bp, Homo sapiens
cagtattaaaggggggagg

SEQ ID NO: 6708927 - DNA, 17 bp, Homo sapiens
cagtattaacactaaat

SEQ ID NO: 6708928 - DNA, 20 bp, Homo sapiens
cagtattaacatcaaagact

SEQ ID NO: 6708929 - DNA, 14 bp, Homo sapiens
cagtattaaggttt

SEQ ID NO: 6708930 - DNA, 19 bp, Homo sapiens
cagtattaatactaaaata

SEQ ID NO: 6708931 - DNA, 20 bp, Homo sapiens
cagtattaatactaaaatat

SEQ ID NO: 6708932 - DNA, 16 bp, Homo sapiens
cagtattactgctgct

SEQ ID NO: 6708933 - DNA, 19 bp, Homo sapiens
cagtattactgctgctgtg

SEQ ID NO: 6708934 - DNA, 21 bp, Homo sapiens
cagtattagcaatactggaat

SEQ ID NO: 6708935 - DNA, 19 bp, Homo sapiens
cagtattatagacaaaaga

SEQ ID NO: 6708936 - DNA, 21 bp, Homo sapiens
cagtattatagacaaaagaat

SEQ ID NO: 6708937 - DNA, 21 bp, Homo sapiens
cagtattatagatataaatat

SEQ ID NO: 6708938 - DNA, 13 bp, Homo sapiens
cagtattatctgt

SEQ ID NO: 6708939 - DNA, 18 bp, Homo sapiens
cagtattattgagctcta

SEQ ID NO: 6708940 - DNA, 14 bp, Homo sapiens
cagtattatttagt

SEQ ID NO: 6708941 - DNA, 20 bp, Homo sapiens
cagtattatttagtaaaatt

SEQ ID NO: 6708942 - DNA, 22 bp, Homo sapiens
cagtattatttctccatcccct

SEQ ID NO: 6708943 - DNA, 20 bp, Homo sapiens
cagtattatttgtatgtatt

SEQ ID NO: 6708944 - DNA, 21 bp, Homo sapiens
cagtattccatttctggacat

SEQ ID NO: 6708945 - DNA, 15 bp, Homo sapiens
cagtattcccactct

SEQ ID NO: 6708946 - DNA, 13 bp, Homo sapiens
cagtattcccttt

SEQ ID NO: 6708947 - DNA, 23 bp, Homo sapiens
cagtattccctttttaaatgagc

SEQ ID NO: 6708948 - DNA, 21 bp, Homo sapiens
cagtattctaaagttttgcaa

SEQ ID NO: 6708949 - DNA, 15 bp, Homo sapiens
cagtattctatttgg

SEQ ID NO: 6708950 - DNA, 18 bp, Homo sapiens
cagtattctgacatgtaa

SEQ ID NO: 6708951 - DNA, 15 bp, Homo sapiens
cagtattcttttaaa

SEQ ID NO: 6708952 - DNA, 18 bp, Homo sapiens
cagtattgaaaacttcaa

SEQ ID NO: 6708953 - DNA, 17 bp, Homo sapiens
cagtattgaagcatttt

SEQ ID NO: 6708954 - DNA, 22 bp, Homo sapiens
cagtattgacgacctacatctg

SEQ ID NO: 6708955 - DNA, 15 bp, Homo sapiens
cagtattgacttctt

SEQ ID NO: 6708956 - DNA, 21 bp, Homo sapiens
cagtattgagacactgtcaag

SEQ ID NO: 6708957 - DNA, 14 bp, Homo sapiens
cagtattgccacct

SEQ ID NO: 6708958 - DNA, 18 bp, Homo sapiens
cagtattgccacctctgg

SEQ ID NO: 6708959 - DNA, 17 bp, Homo sapiens
cagtattgctatttata

SEQ ID NO: 6708960 - DNA, 17 bp, Homo sapiens
cagtattgctgatttta

SEQ ID NO: 6708961 - DNA, 23 bp, Homo sapiens
cagtattggacggtttctagcct

SEQ ID NO: 6708962 - DNA, 17 bp, Homo sapiens
cagtattgggcaggagg

SEQ ID NO: 6708963 - DNA, 13 bp, Homo sapiens
cagtattgtacaa

SEQ ID NO: 6708964 - DNA, 19 bp, Homo sapiens
cagtattgtacaaagtatt

SEQ ID NO: 6708965 - DNA, 21 bp, Homo sapiens
cagtattgtacaaagtattaa

SEQ ID NO: 6708966 - DNA, 22 bp, Homo sapiens
cagtattgtacaaagtattaag

SEQ ID NO: 6708967 - DNA, 19 bp, Homo sapiens
cagtattgtagaaagctaa

SEQ ID NO: 6708968 - DNA, 16 bp, Homo sapiens
cagtattgtgtaaagg

SEQ ID NO: 6708969 - DNA, 20 bp, Homo sapiens
cagtattgttttggtttgct

SEQ ID NO: 6708970 - DNA, 12 bp, Homo sapiens
cagtatttaaca

SEQ ID NO: 6708971 - DNA, 13 bp, Homo sapiens
cagtatttaacta

SEQ ID NO: 6708972 - DNA, 14 bp, Homo sapiens
cagtatttaactaa

SEQ ID NO: 6708973 - DNA, 20 bp, Homo sapiens
cagtatttaagctttaaatg

SEQ ID NO: 6708974 - DNA, 15 bp, Homo sapiens
cagtatttatgtaat

SEQ ID NO: 6708975 - DNA, 13 bp, Homo sapiens
cagtatttattgg

SEQ ID NO: 6708976 - DNA, 18 bp, Homo sapiens
cagtatttcaactgctgt

SEQ ID NO: 6708977 - DNA, 15 bp, Homo sapiens
cagtatttccttcca

SEQ ID NO: 6708978 - DNA, 16 bp, Homo sapiens
cagtatttccttccac

SEQ ID NO: 6708979 - DNA, 20 bp, Homo sapiens
cagtatttccttccactgta

SEQ ID NO: 6708980 - DNA, 14 bp, Homo sapiens
cagtatttctacat

SEQ ID NO: 6708981 - DNA, 16 bp, Homo sapiens
cagtatttctacatta

SEQ ID NO: 6708982 - DNA, 12 bp, Homo sapiens
cagtatttgtaa

SEQ ID NO: 6708983 - DNA, 19 bp, Homo sapiens
cagtatttgtacaaatact

SEQ ID NO: 6708984 - DNA, 19 bp, Homo sapiens
cagtattttaaatgaagtg

SEQ ID NO: 6708985 - DNA, 11 bp, Homo sapiens
cagtattttag

SEQ ID NO: 6708986 - DNA, 11 bp, Homo sapiens
cagtattttat

SEQ ID NO: 6708987 - DNA, 18 bp, Homo sapiens
cagtattttattaaagca

SEQ ID NO: 6708988 - DNA, 12 bp, Homo sapiens
cagtattttcca

SEQ ID NO: 6708989 - DNA, 21 bp, Homo sapiens
cagtattttcccaatagcact

SEQ ID NO: 6708990 - DNA, 16 bp, Homo sapiens
cagtattttccctgct

SEQ ID NO: 6708991 - DNA, 13 bp, Homo sapiens
cagtattttctgt

SEQ ID NO: 6708992 - DNA, 16 bp, Homo sapiens
cagtattttcttccca

SEQ ID NO: 6708993 - DNA, 19 bp, Homo sapiens
cagtattttggttcttagt

SEQ ID NO: 6708994 - DNA, 10 bp, Homo sapiens
cagtattttt

SEQ ID NO: 6708995 - DNA, 14 bp, Homo sapiens
cagtatttttaaag

SEQ ID NO: 6708996 - DNA, 15 bp, Homo sapiens
cagtatttttaaagg

SEQ ID NO: 6708997 - DNA, 19 bp, Homo sapiens
cagtatttttaaaggcatt

SEQ ID NO: 6708998 - DNA, 13 bp, Homo sapiens
cagtatttttata

SEQ ID NO: 6708999 - DNA, 21 bp, Homo sapiens
cagtatttttatacggaaaaa

SEQ ID NO: 6709000 - DNA, 19 bp, Homo sapiens
cagtatttttcagatataa

SEQ ID NO: 6709001 - DNA, 22 bp, Homo sapiens
cagtatttttcagatataaata

SEQ ID NO: 6709002 - DNA, 19 bp, Homo sapiens
cagtatttttgctgcttct

SEQ ID NO: 6709003 - DNA, 20 bp, Homo sapiens
cagtatttttgctgcttctg

SEQ ID NO: 6709004 - DNA, 17 bp, Homo sapiens
cagtattttttttttta

SEQ ID NO: 6709005 - DNA, 19 bp, Homo sapiens
cagtcaaaacagagatgtg

SEQ ID NO: 6709006 - DNA, 15 bp, Homo sapiens
cagtcaaaataattc

SEQ ID NO: 6709007 - DNA, 20 bp, Homo sapiens
cagtcaaaggacggaagtgg

SEQ ID NO: 6709008 - DNA, 15 bp, Homo sapiens
cagtcaaatctgggc

SEQ ID NO: 6709009 - DNA, 17 bp, Homo sapiens
cagtcaaatctgggctc

SEQ ID NO: 6709010 - DNA, 15 bp, Homo sapiens
cagtcaacaagcctg

SEQ ID NO: 6709011 - DNA, 13 bp, Homo sapiens
cagtcaacagatt

SEQ ID NO: 6709012 - DNA, 14 bp, Homo sapiens
cagtcaacagttca

SEQ ID NO: 6709013 - DNA, 23 bp, Homo sapiens
cagtcaacggggggctcctgccc

SEQ ID NO: 6709014 - DNA, 13 bp, Homo sapiens
cagtcaagaagaa

SEQ ID NO: 6709015 - DNA, 20 bp, Homo sapiens
cagtcaagaagaaaaaggtt

SEQ ID NO: 6709016 - DNA, 21 bp, Homo sapiens
cagtcaagacggatccacagt

SEQ ID NO: 6709017 - DNA, 20 bp, Homo sapiens
cagtcaagctgttgaagtct

SEQ ID NO: 6709018 - DNA, 22 bp, Homo sapiens
cagtcaagctgttgaagtctca

SEQ ID NO: 6709019 - DNA, 16 bp, Homo sapiens
cagtcaaggagatgag

SEQ ID NO: 6709020 - DNA, 21 bp, Homo sapiens
cagtcaagttccctcctgcag

SEQ ID NO: 6709021 - DNA, 23 bp, Homo sapiens
cagtcaagttccgtctcctctcc

SEQ ID NO: 6709022 - DNA, 15 bp, Homo sapiens
cagtcaatattttta

SEQ ID NO: 6709023 - DNA, 14 bp, Homo sapiens
cagtcaattacatg

SEQ ID NO: 6709024 - DNA, 17 bp, Homo sapiens
cagtcaattctgatgtt

SEQ ID NO: 6709025 - DNA, 19 bp, Homo sapiens
cagtcacaaaccagcctgg

SEQ ID NO: 6709026 - DNA, 20 bp, Homo sapiens
cagtcacaaaccagcctggg

SEQ ID NO: 6709027 - DNA, 13 bp, Homo sapiens
cagtcacactgct

SEQ ID NO: 6709028 - DNA, 19 bp, Homo sapiens
cagtcacactgctgggaag

SEQ ID NO: 6709029 - DNA, 12 bp, Homo sapiens
cagtcacactgt

SEQ ID NO: 6709030 - DNA, 13 bp, Homo sapiens
cagtcacactgtt

SEQ ID NO: 6709031 - DNA, 20 bp, Homo sapiens
cagtcacactgttactccac

SEQ ID NO: 6709032 - DNA, 14 bp, Homo sapiens
cagtcacagccacc

SEQ ID NO: 6709033 - DNA, 17 bp, Homo sapiens
cagtcacagccatttca

SEQ ID NO: 6709034 - DNA, 13 bp, Homo sapiens
cagtcacaggccc

SEQ ID NO: 6709035 - DNA, 17 bp, Homo sapiens
cagtcacaggcccagga

SEQ ID NO: 6709036 - DNA, 21 bp, Homo sapiens
cagtcacagtggggttttttt

SEQ ID NO: 6709037 - DNA, 15 bp, Homo sapiens
cagtcacattccaag

SEQ ID NO: 6709038 - DNA, 17 bp, Homo sapiens
cagtcaccacccagccc

SEQ ID NO: 6709039 - DNA, 19 bp, Homo sapiens
cagtcaccacccagccctt

SEQ ID NO: 6709040 - DNA, 18 bp, Homo sapiens
cagtcaccactgtgctca

SEQ ID NO: 6709041 - DNA, 18 bp, Homo sapiens
cagtcaccccggccacct

SEQ ID NO: 6709042 - DNA, 19 bp, Homo sapiens
cagtcaccccggccacctg

SEQ ID NO: 6709043 - DNA, 20 bp, Homo sapiens
cagtcaccccggccacctgc

SEQ ID NO: 6709044 - DNA, 15 bp, Homo sapiens
cagtcaccctgtggc

SEQ ID NO: 6709045 - DNA, 17 bp, Homo sapiens
cagtcacccttctgggc

SEQ ID NO: 6709046 - DNA, 19 bp, Homo sapiens
cagtcacctcatggaattg

SEQ ID NO: 6709047 - DNA, 15 bp, Homo sapiens
cagtcacctcctgct

SEQ ID NO: 6709048 - DNA, 20 bp, Homo sapiens
cagtcacctcgtctccctgg

SEQ ID NO: 6709049 - DNA, 19 bp, Homo sapiens
cagtcacctcttctgccag

SEQ ID NO: 6709050 - DNA, 12 bp, Homo sapiens
cagtcaccttct

SEQ ID NO: 6709051 - DNA, 13 bp, Homo sapiens
cagtcacgcctga

SEQ ID NO: 6709052 - DNA, 16 bp, Homo sapiens
cagtcacgcctgaaac

SEQ ID NO: 6709053 - DNA, 18 bp, Homo sapiens
cagtcacgcctgaaactt

SEQ ID NO: 6709054 - DNA, 23 bp, Homo sapiens
cagtcacggggaggtgctggttc

SEQ ID NO: 6709055 - DNA, 20 bp, Homo sapiens
cagtcacgtgaggcccctgt

SEQ ID NO: 6709056 - DNA, 18 bp, Homo sapiens
cagtcacgtggaggagca

SEQ ID NO: 6709057 - DNA, 22 bp, Homo sapiens
cagtcactcctctctagggcag

SEQ ID NO: 6709058 - DNA, 23 bp, Homo sapiens
cagtcactcctctctagggcaga

SEQ ID NO: 6709059 - DNA, 20 bp, Homo sapiens
cagtcactctagtcaatgac

SEQ ID NO: 6709060 - DNA, 20 bp, Homo sapiens
cagtcactgcatttgcctgc

SEQ ID NO: 6709061 - DNA, 23 bp, Homo sapiens
cagtcactggaggttgaagccaa

SEQ ID NO: 6709062 - DNA, 21 bp, Homo sapiens
cagtcactgtccctcaaatga

SEQ ID NO: 6709063 - DNA, 12 bp, Homo sapiens
cagtcacttcct

SEQ ID NO: 6709064 - DNA, 16 bp, Homo sapiens
cagtcacttccttcag

SEQ ID NO: 6709065 - DNA, 21 bp, Homo sapiens
cagtcacttcggccagagctg

SEQ ID NO: 6709066 - DNA, 18 bp, Homo sapiens
cagtcactttttcccctg

SEQ ID NO: 6709067 - DNA, 21 bp, Homo sapiens
cagtcactttttcccctgcaa

SEQ ID NO: 6709068 - DNA, 22 bp, Homo sapiens
cagtcactttttcccctgcaat

SEQ ID NO: 6709069 - DNA, 16 bp, Homo sapiens
cagtcagaaaacttta

SEQ ID NO: 6709070 - DNA, 13 bp, Homo sapiens
cagtcagaaggac

SEQ ID NO: 6709071 - DNA, 23 bp, Homo sapiens
cagtcagacgccaggcaccacag

SEQ ID NO: 6709072 - DNA, 14 bp, Homo sapiens
cagtcagactgaaa

SEQ ID NO: 6709073 - DNA, 13 bp, Homo sapiens
cagtcagagtcca

SEQ ID NO: 6709074 - DNA, 21 bp, Homo sapiens
cagtcagagtccagtgctctg

SEQ ID NO: 6709075 - DNA, 18 bp, Homo sapiens
cagtcagcagatgctgtt

SEQ ID NO: 6709076 - DNA, 23 bp, Homo sapiens
cagtcagcatgcttcccagaggg

SEQ ID NO: 6709077 - DNA, 16 bp, Homo sapiens
cagtcagccagcttgg

SEQ ID NO: 6709078 - DNA, 16 bp, Homo sapiens
cagtcagcccagtggg

SEQ ID NO: 6709079 - DNA, 13 bp, Homo sapiens
cagtcagcctctc

SEQ ID NO: 6709080 - DNA, 22 bp, Homo sapiens
cagtcagcctctctcccagtct

SEQ ID NO: 6709081 - DNA, 17 bp, Homo sapiens
cagtcagcctggctggg

SEQ ID NO: 6709082 - DNA, 18 bp, Homo sapiens
cagtcagcctggctgggc

SEQ ID NO: 6709083 - DNA, 16 bp, Homo sapiens
cagtcagcggagagga

SEQ ID NO: 6709084 - DNA, 21 bp, Homo sapiens
cagtcaggaaaggaatcattt

SEQ ID NO: 6709085 - DNA, 12 bp, Homo sapiens
cagtcaggatga

SEQ ID NO: 6709086 - DNA, 18 bp, Homo sapiens
cagtcaggatgaggcccc

SEQ ID NO: 6709087 - DNA, 14 bp, Homo sapiens
cagtcaggcccagg

SEQ ID NO: 6709088 - DNA, 18 bp, Homo sapiens
cagtcaggctctctgggc

SEQ ID NO: 6709089 - DNA, 19 bp, Homo sapiens
cagtcaggctctctgggct

SEQ ID NO: 6709090 - DNA, 22 bp, Homo sapiens
cagtcaggctctctgggctgac

SEQ ID NO: 6709091 - DNA, 20 bp, Homo sapiens
cagtcaggctgcagaggcac

SEQ ID NO: 6709092 - DNA, 23 bp, Homo sapiens
cagtcagggaaggtgcctctgga

SEQ ID NO: 6709093 - DNA, 19 bp, Homo sapiens
cagtcagggacagcagcct

SEQ ID NO: 6709094 - DNA, 21 bp, Homo sapiens
cagtcagggcggggctggcca

SEQ ID NO: 6709095 - DNA, 15 bp, Homo sapiens
cagtcaggggctggg

SEQ ID NO: 6709096 - DNA, 16 bp, Homo sapiens
cagtcaggggctgggc

SEQ ID NO: 6709097 - DNA, 15 bp, Homo sapiens
cagtcagtattgttt

SEQ ID NO: 6709098 - DNA, 11 bp, Homo sapiens
cagtcagtgac

SEQ ID NO: 6709099 - DNA, 18 bp, Homo sapiens
cagtcagtgcaaatgtca

SEQ ID NO: 6709100 - DNA, 17 bp, Homo sapiens
cagtcagtgctggagaa

SEQ ID NO: 6709101 - DNA, 20 bp, Homo sapiens
cagtcagtggagagatgttt

SEQ ID NO: 6709102 - DNA, 15 bp, Homo sapiens
cagtcagtggagcct

SEQ ID NO: 6709103 - DNA, 19 bp, Homo sapiens
cagtcagtggagcctgggt

SEQ ID NO: 6709104 - DNA, 15 bp, Homo sapiens
cagtcagtgtttctt

SEQ ID NO: 6709105 - DNA, 17 bp, Homo sapiens
cagtcagttcccggagc

SEQ ID NO: 6709106 - DNA, 15 bp, Homo sapiens
cagtcataaatactg

SEQ ID NO: 6709107 - DNA, 18 bp, Homo sapiens
cagtcataaatactgtca

SEQ ID NO: 6709108 - DNA, 13 bp, Homo sapiens
cagtcatcaaagc

SEQ ID NO: 6709109 - DNA, 15 bp, Homo sapiens
cagtcatcactctca

SEQ ID NO: 6709110 - DNA, 21 bp, Homo sapiens
cagtcatcaggtgtgctcagg

SEQ ID NO: 6709111 - DNA, 20 bp, Homo sapiens
cagtcatcatcagggcctgg

SEQ ID NO: 6709112 - DNA, 12 bp, Homo sapiens
cagtcatcatct

SEQ ID NO: 6709113 - DNA, 13 bp, Homo sapiens
cagtcatcatctc

SEQ ID NO: 6709114 - DNA, 12 bp, Homo sapiens
cagtcatcattt

SEQ ID NO: 6709115 - DNA, 13 bp, Homo sapiens
cagtcatcattta

SEQ ID NO: 6709116 - DNA, 19 bp, Homo sapiens
cagtcatcctgccctgcag

SEQ ID NO: 6709117 - DNA, 22 bp, Homo sapiens
cagtcatcgagtggcccaacag

SEQ ID NO: 6709118 - DNA, 16 bp, Homo sapiens
cagtcatctagaattc

SEQ ID NO: 6709119 - DNA, 20 bp, Homo sapiens
cagtcatctccaaaaacagt

SEQ ID NO: 6709120 - DNA, 20 bp, Homo sapiens
cagtcatctgtctttcactg

SEQ ID NO: 6709121 - DNA, 14 bp, Homo sapiens
cagtcatgaggaaa

SEQ ID NO: 6709122 - DNA, 19 bp, Homo sapiens
cagtcatgaggaaagacac

SEQ ID NO: 6709123 - DNA, 13 bp, Homo sapiens
cagtcatgcataa

SEQ ID NO: 6709124 - DNA, 17 bp, Homo sapiens
cagtcatgcataaatat

SEQ ID NO: 6709125 - DNA, 18 bp, Homo sapiens
cagtcatggaatcttgct

SEQ ID NO: 6709126 - DNA, 20 bp, Homo sapiens
cagtcatggaatcttgctgc

SEQ ID NO: 6709127 - DNA, 21 bp, Homo sapiens
cagtcatggcctgagatgcag

SEQ ID NO: 6709128 - DNA, 12 bp, Homo sapiens
cagtcatggtac

SEQ ID NO: 6709129 - DNA, 18 bp, Homo sapiens
cagtcatggtactacccc

SEQ ID NO: 6709130 - DNA, 14 bp, Homo sapiens
cagtcatgtatgca

SEQ ID NO: 6709131 - DNA, 17 bp, Homo sapiens
cagtcatgtatgcaagt

SEQ ID NO: 6709132 - DNA, 11 bp, Homo sapiens
cagtcatgtgc

SEQ ID NO: 6709133 - DNA, 19 bp, Homo sapiens
cagtcattaaattactata

SEQ ID NO: 6709134 - DNA, 23 bp, Homo sapiens
cagtcattatgagaggcaatgat

SEQ ID NO: 6709135 - DNA, 21 bp, Homo sapiens
cagtcattatttaaagcacat

SEQ ID NO: 6709136 - DNA, 20 bp, Homo sapiens
cagtcattcagatatgattc

SEQ ID NO: 6709137 - DNA, 22 bp, Homo sapiens
cagtcattcagcagcaaatttt

SEQ ID NO: 6709138 - DNA, 18 bp, Homo sapiens
cagtcattctagagggat

SEQ ID NO: 6709139 - DNA, 18 bp, Homo sapiens
cagtcattctaggatgtg

SEQ ID NO: 6709140 - DNA, 13 bp, Homo sapiens
cagtcattggctg

SEQ ID NO: 6709141 - DNA, 22 bp, Homo sapiens
cagtcattgtaacctcgtgtct

SEQ ID NO: 6709142 - DNA, 12 bp, Homo sapiens
cagtcatttaaa

SEQ ID NO: 6709143 - DNA, 15 bp, Homo sapiens
cagtcatttgtggtt

SEQ ID NO: 6709144 - DNA, 16 bp, Homo sapiens
cagtcatttgtggtta

SEQ ID NO: 6709145 - DNA, 20 bp, Homo sapiens
cagtcatttgtggttagaat

SEQ ID NO: 6709146 - DNA, 21 bp, Homo sapiens
cagtccaaatgtcctccagaa

SEQ ID NO: 6709147 - DNA, 19 bp, Homo sapiens
cagtccaaattgtctgtct

SEQ ID NO: 6709148 - DNA, 23 bp, Homo sapiens
cagtccaaggaaaccacagctgc

SEQ ID NO: 6709149 - DNA, 22 bp, Homo sapiens
cagtccaaggggtcccctccag

SEQ ID NO: 6709150 - DNA, 13 bp, Homo sapiens
cagtccaattttc

SEQ ID NO: 6709151 - DNA, 13 bp, Homo sapiens
cagtccacagctg

SEQ ID NO: 6709152 - DNA, 14 bp, Homo sapiens
cagtccacagctga

SEQ ID NO: 6709153 - DNA, 18 bp, Homo sapiens
cagtccacaggggccacc

SEQ ID NO: 6709154 - DNA, 21 bp, Homo sapiens
cagtccacccccattgtgaat

SEQ ID NO: 6709155 - DNA, 17 bp, Homo sapiens
cagtccaccctgcctgc

SEQ ID NO: 6709156 - DNA, 15 bp, Homo sapiens
cagtccacctgagct

SEQ ID NO: 6709157 - DNA, 18 bp, Homo sapiens
cagtccacctgagctgcc

SEQ ID NO: 6709158 - DNA, 20 bp, Homo sapiens
cagtccacctgaggaactgt

SEQ ID NO: 6709159 - DNA, 15 bp, Homo sapiens
cagtccactcctgac

SEQ ID NO: 6709160 - DNA, 14 bp, Homo sapiens
cagtccactgagca

SEQ ID NO: 6709161 - DNA, 21 bp, Homo sapiens
cagtccacttctgacagcctc

SEQ ID NO: 6709162 - DNA, 14 bp, Homo sapiens
cagtccagaataag

SEQ ID NO: 6709163 - DNA, 21 bp, Homo sapiens
cagtccagaataagtgctgtt

SEQ ID NO: 6709164 - DNA, 12 bp, Homo sapiens
cagtccagaccc

SEQ ID NO: 6709165 - DNA, 12 bp, Homo sapiens
cagtccagagct

SEQ ID NO: 6709166 - DNA, 13 bp, Homo sapiens
cagtccagagctt

SEQ ID NO: 6709167 - DNA, 16 bp, Homo sapiens
cagtccagagcttttc

SEQ ID NO: 6709168 - DNA, 18 bp, Homo sapiens
cagtccagagcttttcag

SEQ ID NO: 6709169 - DNA, 17 bp, Homo sapiens
cagtccagatgccttcc

SEQ ID NO: 6709170 - DNA, 12 bp, Homo sapiens
cagtccagcaaa

SEQ ID NO: 6709171 - DNA, 14 bp, Homo sapiens
cagtccagccagct

SEQ ID NO: 6709172 - DNA, 16 bp, Homo sapiens
cagtccagccagctcc

SEQ ID NO: 6709173 - DNA, 17 bp, Homo sapiens
cagtccagccagctcct

SEQ ID NO: 6709174 - DNA, 15 bp, Homo sapiens
cagtccaggaacaag

SEQ ID NO: 6709175 - DNA, 23 bp, Homo sapiens
cagtccaggatgctaacatctaa

SEQ ID NO: 6709176 - DNA, 21 bp, Homo sapiens
cagtccaggcctctctctgct

SEQ ID NO: 6709177 - DNA, 15 bp, Homo sapiens
cagtccaggctgccg

SEQ ID NO: 6709178 - DNA, 18 bp, Homo sapiens
cagtccaggctgccgtgg

SEQ ID NO: 6709179 - DNA, 18 bp, Homo sapiens
cagtccagtcctatctgg

SEQ ID NO: 6709180 - DNA, 21 bp, Homo sapiens
cagtccagtcctatctgggct

SEQ ID NO: 6709181 - DNA, 17 bp, Homo sapiens
cagtccagttttgtgtg

SEQ ID NO: 6709182 - DNA, 16 bp, Homo sapiens
cagtccatagcagaga

SEQ ID NO: 6709183 - DNA, 13 bp, Homo sapiens
cagtccatgaaga

SEQ ID NO: 6709184 - DNA, 23 bp, Homo sapiens
cagtccatgcatgacagcctcta

SEQ ID NO: 6709185 - DNA, 14 bp, Homo sapiens
cagtccatgctcca

SEQ ID NO: 6709186 - DNA, 19 bp, Homo sapiens
cagtccatgctccagggtc

SEQ ID NO: 6709187 - DNA, 14 bp, Homo sapiens
cagtccattgaaag

SEQ ID NO: 6709188 - DNA, 17 bp, Homo sapiens
cagtccatttatatatg

SEQ ID NO: 6709189 - DNA, 20 bp, Homo sapiens
cagtccatttttgagtaaaa

SEQ ID NO: 6709190 - DNA, 16 bp, Homo sapiens
cagtcccaatgcacat

SEQ ID NO: 6709191 - DNA, 22 bp, Homo sapiens
cagtcccacaccgctggtccct

SEQ ID NO: 6709192 - DNA, 23 bp, Homo sapiens
cagtcccacactgtgcagaccca

SEQ ID NO: 6709193 - DNA, 22 bp, Homo sapiens
cagtcccacactgtggccaggc

SEQ ID NO: 6709194 - DNA, 20 bp, Homo sapiens
cagtcccacggctctgtgcc

SEQ ID NO: 6709195 - DNA, 22 bp, Homo sapiens
cagtcccacggctctgtgcccg

SEQ ID NO: 6709196 - DNA, 13 bp, Homo sapiens
cagtcccactgtg

SEQ ID NO: 6709197 - DNA, 15 bp, Homo sapiens
cagtcccactgtgca

SEQ ID NO: 6709198 - DNA, 21 bp, Homo sapiens
cagtcccagaaccacactgtt

SEQ ID NO: 6709199 - DNA, 16 bp, Homo sapiens
cagtcccagcacattt

SEQ ID NO: 6709200 - DNA, 17 bp, Homo sapiens
cagtcccagcagccagc

SEQ ID NO: 6709201 - DNA, 14 bp, Homo sapiens
cagtcccagcctct

SEQ ID NO: 6709202 - DNA, 16 bp, Homo sapiens
cagtcccagtccttga

SEQ ID NO: 6709203 - DNA, 14 bp, Homo sapiens
cagtcccagttccc

SEQ ID NO: 6709204 - DNA, 12 bp, Homo sapiens
cagtccccaccc

SEQ ID NO: 6709205 - DNA, 14 bp, Homo sapiens
cagtccccacccct

SEQ ID NO: 6709206 - DNA, 17 bp, Homo sapiens
cagtccccacccctgcc

SEQ ID NO: 6709207 - DNA, 14 bp, Homo sapiens
cagtccccacccgc

SEQ ID NO: 6709208 - DNA, 20 bp, Homo sapiens
cagtccccacccgcctgcag

SEQ ID NO: 6709209 - DNA, 16 bp, Homo sapiens
cagtccccagactcag

SEQ ID NO: 6709210 - DNA, 13 bp, Homo sapiens
cagtccccagccc

SEQ ID NO: 6709211 - DNA, 18 bp, Homo sapiens
cagtccccagccctgggc

SEQ ID NO: 6709212 - DNA, 19 bp, Homo sapiens
cagtccccagccctgggct

SEQ ID NO: 6709213 - DNA, 21 bp, Homo sapiens
cagtccccagccctgggcttg

SEQ ID NO: 6709214 - DNA, 13 bp, Homo sapiens
cagtccccagcta

SEQ ID NO: 6709215 - DNA, 19 bp, Homo sapiens
cagtccccatttctgcctc

SEQ ID NO: 6709216 - DNA, 18 bp, Homo sapiens
cagtcccccaaccccagc

SEQ ID NO: 6709217 - DNA, 17 bp, Homo sapiens
cagtcccccacccacct

SEQ ID NO: 6709218 - DNA, 21 bp, Homo sapiens
cagtcccccacccacctcctg

SEQ ID NO: 6709219 - DNA, 21 bp, Homo sapiens
cagtccccctatccttggcac

SEQ ID NO: 6709220 - DNA, 22 bp, Homo sapiens
cagtccccctatccttggcacc

SEQ ID NO: 6709221 - DNA, 17 bp, Homo sapiens
cagtccccctgccccag

SEQ ID NO: 6709222 - DNA, 16 bp, Homo sapiens
cagtccccctgtgcat

SEQ ID NO: 6709223 - DNA, 20 bp, Homo sapiens
cagtccccgaggagctgggc

SEQ ID NO: 6709224 - DNA, 22 bp, Homo sapiens
cagtccccgaggagctgggccc

SEQ ID NO: 6709225 - DNA, 14 bp, Homo sapiens
cagtccccgctagt

SEQ ID NO: 6709226 - DNA, 15 bp, Homo sapiens
cagtccccgctagtg

SEQ ID NO: 6709227 - DNA, 16 bp, Homo sapiens
cagtccccgggaaagg

SEQ ID NO: 6709228 - DNA, 19 bp, Homo sapiens
cagtcccctcccatctggg

SEQ ID NO: 6709229 - DNA, 13 bp, Homo sapiens
cagtccccttccc

SEQ ID NO: 6709230 - DNA, 18 bp, Homo sapiens
cagtcccgaaatttggat

SEQ ID NO: 6709231 - DNA, 17 bp, Homo sapiens
cagtccctacttaggaa

SEQ ID NO: 6709232 - DNA, 13 bp, Homo sapiens
cagtccctccaca

SEQ ID NO: 6709233 - DNA, 12 bp, Homo sapiens
cagtccctcctg

SEQ ID NO: 6709234 - DNA, 14 bp, Homo sapiens
cagtccctctgagt

SEQ ID NO: 6709235 - DNA, 17 bp, Homo sapiens
cagtccctgagcagtct

SEQ ID NO: 6709236 - DNA, 23 bp, Homo sapiens
cagtccctgaggcaggtccccag

SEQ ID NO: 6709237 - DNA, 14 bp, Homo sapiens
cagtccctgccaat

SEQ ID NO: 6709238 - DNA, 17 bp, Homo sapiens
cagtccctgccaatgga

SEQ ID NO: 6709239 - DNA, 13 bp, Homo sapiens
cagtccctgctta

SEQ ID NO: 6709240 - DNA, 13 bp, Homo sapiens
cagtccctggagc

SEQ ID NO: 6709241 - DNA, 23 bp, Homo sapiens
cagtccctgggagcaagttgcag

SEQ ID NO: 6709242 - DNA, 19 bp, Homo sapiens
cagtccgccaaacactcca

SEQ ID NO: 6709243 - DNA, 22 bp, Homo sapiens
cagtccgccaaacactccaccc

SEQ ID NO: 6709244 - DNA, 16 bp, Homo sapiens
cagtccgccccgtgct

SEQ ID NO: 6709245 - DNA, 11 bp, Homo sapiens
cagtccggtgc

SEQ ID NO: 6709246 - DNA, 18 bp, Homo sapiens
cagtccggtgccttccac

SEQ ID NO: 6709247 - DNA, 20 bp, Homo sapiens
cagtccggtgccttccaccc

SEQ ID NO: 6709248 - DNA, 22 bp, Homo sapiens
cagtccggtgccttccaccctg

SEQ ID NO: 6709249 - DNA, 19 bp, Homo sapiens
cagtccgtcaaaacagatt

SEQ ID NO: 6709250 - DNA, 19 bp, Homo sapiens
cagtccgtgtggatccaat

SEQ ID NO: 6709251 - DNA, 14 bp, Homo sapiens
cagtcctaatttga

SEQ ID NO: 6709252 - DNA, 16 bp, Homo sapiens
cagtcctaatttgaac

SEQ ID NO: 6709253 - DNA, 17 bp, Homo sapiens
cagtcctaatttgaaca

SEQ ID NO: 6709254 - DNA, 14 bp, Homo sapiens
cagtcctagagctc

SEQ ID NO: 6709255 - DNA, 15 bp, Homo sapiens
cagtcctagagctcc

SEQ ID NO: 6709256 - DNA, 21 bp, Homo sapiens
cagtcctagagctcctgtccc

SEQ ID NO: 6709257 - DNA, 17 bp, Homo sapiens
cagtcctagctgcacag

SEQ ID NO: 6709258 - DNA, 15 bp, Homo sapiens
cagtcctatctgggc

SEQ ID NO: 6709259 - DNA, 17 bp, Homo sapiens
cagtcctatgtacagag

SEQ ID NO: 6709260 - DNA, 19 bp, Homo sapiens
cagtcctatgtacagagct

SEQ ID NO: 6709261 - DNA, 19 bp, Homo sapiens
cagtcctcacagcctctcc

SEQ ID NO: 6709262 - DNA, 12 bp, Homo sapiens
cagtcctcagga

SEQ ID NO: 6709263 - DNA, 20 bp, Homo sapiens
cagtcctccagaccaccagc

SEQ ID NO: 6709264 - DNA, 11 bp, Homo sapiens
cagtcctccat

SEQ ID NO: 6709265 - DNA, 20 bp, Homo sapiens
cagtcctcccaccttggcct

SEQ ID NO: 6709266 - DNA, 12 bp, Homo sapiens
cagtcctcccat

SEQ ID NO: 6709267 - DNA, 16 bp, Homo sapiens
cagtcctcccatctca

SEQ ID NO: 6709268 - DNA, 14 bp, Homo sapiens
cagtcctcccctca

SEQ ID NO: 6709269 - DNA, 14 bp, Homo sapiens
cagtcctccctagc

SEQ ID NO: 6709270 - DNA, 14 bp, Homo sapiens
cagtcctcctcagg

SEQ ID NO: 6709271 - DNA, 14 bp, Homo sapiens
cagtcctcctggga

SEQ ID NO: 6709272 - DNA, 21 bp, Homo sapiens
cagtcctctcccaagtccaca

SEQ ID NO: 6709273 - DNA, 16 bp, Homo sapiens
cagtcctcttattcct

SEQ ID NO: 6709274 - DNA, 13 bp, Homo sapiens
cagtcctctttca

SEQ ID NO: 6709275 - DNA, 14 bp, Homo sapiens
cagtcctgaagcag

SEQ ID NO: 6709276 - DNA, 19 bp, Homo sapiens
cagtcctgccaccaccctg

SEQ ID NO: 6709277 - DNA, 22 bp, Homo sapiens
cagtcctgcctgaacagccctc

SEQ ID NO: 6709278 - DNA, 16 bp, Homo sapiens
cagtcctgcctggcca

SEQ ID NO: 6709279 - DNA, 14 bp, Homo sapiens
cagtcctgctccag

SEQ ID NO: 6709280 - DNA, 14 bp, Homo sapiens
cagtcctgctctct

SEQ ID NO: 6709281 - DNA, 22 bp, Homo sapiens
cagtcctgctctctacccagcc

SEQ ID NO: 6709282 - DNA, 13 bp, Homo sapiens
cagtcctgctgcc

SEQ ID NO: 6709283 - DNA, 17 bp, Homo sapiens
cagtcctgctgcctgga

SEQ ID NO: 6709284 - DNA, 18 bp, Homo sapiens
cagtcctgctgcctggag

SEQ ID NO: 6709285 - DNA, 19 bp, Homo sapiens
cagtcctgctgcctggagt

SEQ ID NO: 6709286 - DNA, 13 bp, Homo sapiens
cagtcctgctggc

SEQ ID NO: 6709287 - DNA, 16 bp, Homo sapiens
cagtcctgctggcctg

SEQ ID NO: 6709288 - DNA, 17 bp, Homo sapiens
cagtcctgctggcctgc

SEQ ID NO: 6709289 - DNA, 21 bp, Homo sapiens
cagtcctgctggcctgctctt

SEQ ID NO: 6709290 - DNA, 23 bp, Homo sapiens
cagtcctggccattttcttgcct

SEQ ID NO: 6709291 - DNA, 24 bp, Homo sapiens
cagtcctggccattttcttgcctg

SEQ ID NO: 6709292 - DNA, 16 bp, Homo sapiens
cagtcctgggcaaagg

SEQ ID NO: 6709293 - DNA, 19 bp, Homo sapiens
cagtcctgggccccctggg

SEQ ID NO: 6709294 - DNA, 12 bp, Homo sapiens
cagtcctgggtt

SEQ ID NO: 6709295 - DNA, 19 bp, Homo sapiens
cagtcctggtctgctcagg

SEQ ID NO: 6709296 - DNA, 22 bp, Homo sapiens
cagtcctggtggggctgagcct

SEQ ID NO: 6709297 - DNA, 18 bp, Homo sapiens
cagtcctggttgtctgaa

SEQ ID NO: 6709298 - DNA, 21 bp, Homo sapiens
cagtcctggttgtctgaaccc

SEQ ID NO: 6709299 - DNA, 17 bp, Homo sapiens
cagtcctgtagttttat

SEQ ID NO: 6709300 - DNA, 15 bp, Homo sapiens
cagtccttaaaaatc

SEQ ID NO: 6709301 - DNA, 16 bp, Homo sapiens
cagtccttaaaaatca

SEQ ID NO: 6709302 - DNA, 16 bp, Homo sapiens
cagtccttaatgtcac

SEQ ID NO: 6709303 - DNA, 21 bp, Homo sapiens
cagtccttattatcccagctt

SEQ ID NO: 6709304 - DNA, 15 bp, Homo sapiens
cagtccttccacctc

SEQ ID NO: 6709305 - DNA, 15 bp, Homo sapiens
cagtccttgctttgg

SEQ ID NO: 6709306 - DNA, 15 bp, Homo sapiens
cagtccttggcctgc

SEQ ID NO: 6709307 - DNA, 13 bp, Homo sapiens
cagtcctttccca

SEQ ID NO: 6709308 - DNA, 14 bp, Homo sapiens
cagtcctttgtaaa

SEQ ID NO: 6709309 - DNA, 18 bp, Homo sapiens
cagtcctttgttataatt

SEQ ID NO: 6709310 - DNA, 20 bp, Homo sapiens
cagtcctttgttataatttt

SEQ ID NO: 6709311 - DNA, 16 bp, Homo sapiens
cagtcgaactgggggc

SEQ ID NO: 6709312 - DNA, 15 bp, Homo sapiens
cagtcgaccccaaag

SEQ ID NO: 6709313 - DNA, 19 bp, Homo sapiens
cagtcgaccgcacttatgg

SEQ ID NO: 6709314 - DNA, 22 bp, Homo sapiens
cagtcgaccgcacttatggtaa

SEQ ID NO: 6709315 - DNA, 18 bp, Homo sapiens
cagtcgatattcccaggg

SEQ ID NO: 6709316 - DNA, 19 bp, Homo sapiens
cagtcgatattcccagggc

SEQ ID NO: 6709317 - DNA, 20 bp, Homo sapiens
cagtcgcaggatccgctgcc

SEQ ID NO: 6709318 - DNA, 17 bp, Homo sapiens
cagtcgccctctgtgcc

SEQ ID NO: 6709319 - DNA, 23 bp, Homo sapiens
cagtcgccctctgtgcctaataa

SEQ ID NO: 6709320 - DNA, 13 bp, Homo sapiens
cagtcgccctgtt

SEQ ID NO: 6709321 - DNA, 19 bp, Homo sapiens
cagtcgcgagcacatgttc

SEQ ID NO: 6709322 - DNA, 20 bp, Homo sapiens
cagtcgcgctgcctgtgtgg

SEQ ID NO: 6709323 - DNA, 14 bp, Homo sapiens
cagtcgctgcaggg

SEQ ID NO: 6709324 - DNA, 17 bp, Homo sapiens
cagtcgcttgccaaagc

SEQ ID NO: 6709325 - DNA, 17 bp, Homo sapiens
cagtcggaaaagcgtct

SEQ ID NO: 6709326 - DNA, 22 bp, Homo sapiens
cagtcggaaaagcgtctttaag

SEQ ID NO: 6709327 - DNA, 19 bp, Homo sapiens
cagtcggcacagtgcagca

SEQ ID NO: 6709328 - DNA, 16 bp, Homo sapiens
cagtcggcatgccagg

SEQ ID NO: 6709329 - DNA, 14 bp, Homo sapiens
cagtcgggaggagc

SEQ ID NO: 6709330 - DNA, 18 bp, Homo sapiens
cagtcgggggctggccta

SEQ ID NO: 6709331 - DNA, 16 bp, Homo sapiens
cagtcgtaagggttgc

SEQ ID NO: 6709332 - DNA, 18 bp, Homo sapiens
cagtcgtcccaggctgcc

SEQ ID NO: 6709333 - DNA, 15 bp, Homo sapiens
cagtcgtgatgtgga

SEQ ID NO: 6709334 - DNA, 19 bp, Homo sapiens
cagtcgtgatgtggaggaa

SEQ ID NO: 6709335 - DNA, 15 bp, Homo sapiens
cagtcgttagaatat

SEQ ID NO: 6709336 - DNA, 14 bp, Homo sapiens
cagtcgttcccagt

SEQ ID NO: 6709337 - DNA, 14 bp, Homo sapiens
cagtcgttgtgctt

SEQ ID NO: 6709338 - DNA, 14 bp, Homo sapiens
cagtcgttttagtg

SEQ ID NO: 6709339 - DNA, 21 bp, Homo sapiens
cagtctaaatttattatttaa

SEQ ID NO: 6709340 - DNA, 21 bp, Homo sapiens
cagtctaacagtttgcctgct

SEQ ID NO: 6709341 - DNA, 18 bp, Homo sapiens
cagtctaagtgtaaatgt

SEQ ID NO: 6709342 - DNA, 17 bp, Homo sapiens
cagtctaccctgtcctt

SEQ ID NO: 6709343 - DNA, 21 bp, Homo sapiens
cagtctaccctgtcctttgca

SEQ ID NO: 6709344 - DNA, 20 bp, Homo sapiens
cagtctacgttctccagccc

SEQ ID NO: 6709345 - DNA, 14 bp, Homo sapiens
cagtctacttctgt

SEQ ID NO: 6709346 - DNA, 15 bp, Homo sapiens
cagtctacttctgtg

SEQ ID NO: 6709347 - DNA, 19 bp, Homo sapiens
cagtctacttctgtgtctg

SEQ ID NO: 6709348 - DNA, 14 bp, Homo sapiens
cagtctagctttta

SEQ ID NO: 6709349 - DNA, 13 bp, Homo sapiens
cagtctatccaca

SEQ ID NO: 6709350 - DNA, 16 bp, Homo sapiens
cagtctatccacagag

SEQ ID NO: 6709351 - DNA, 17 bp, Homo sapiens
cagtctatccacagaga

SEQ ID NO: 6709352 - DNA, 14 bp, Homo sapiens
cagtctatgctgtg

SEQ ID NO: 6709353 - DNA, 21 bp, Homo sapiens
cagtctatgctgtgtgcagag

SEQ ID NO: 6709354 - DNA, 23 bp, Homo sapiens
cagtctatttccactgaacaaaa

SEQ ID NO: 6709355 - DNA, 18 bp, Homo sapiens
cagtctatttccattctt

SEQ ID NO: 6709356 - DNA, 16 bp, Homo sapiens
cagtctatttgagact

SEQ ID NO: 6709357 - DNA, 16 bp, Homo sapiens
cagtctcaaataataa

SEQ ID NO: 6709358 - DNA, 15 bp, Homo sapiens
cagtctcaattttgt

SEQ ID NO: 6709359 - DNA, 21 bp, Homo sapiens
cagtctcacagagaagctcct

SEQ ID NO: 6709360 - DNA, 22 bp, Homo sapiens
cagtctcacatgattccagcca

SEQ ID NO: 6709361 - DNA, 20 bp, Homo sapiens
cagtctcaccatttccccag

SEQ ID NO: 6709362 - DNA, 16 bp, Homo sapiens
cagtctcacctgccgg

SEQ ID NO: 6709363 - DNA, 22 bp, Homo sapiens
cagtctcacctgccggctctgg

SEQ ID NO: 6709364 - DNA, 14 bp, Homo sapiens
cagtctcagagacc

SEQ ID NO: 6709365 - DNA, 16 bp, Homo sapiens
cagtctcagagaccag

SEQ ID NO: 6709366 - DNA, 20 bp, Homo sapiens
cagtctcagagaccagcact

SEQ ID NO: 6709367 - DNA, 15 bp, Homo sapiens
cagtctcaggaaatc

SEQ ID NO: 6709368 - DNA, 21 bp, Homo sapiens
cagtctcagtccaaaagtgtt

SEQ ID NO: 6709369 - DNA, 19 bp, Homo sapiens
cagtctcagtccagatgcc

SEQ ID NO: 6709370 - DNA, 14 bp, Homo sapiens
cagtctcatcctcc

SEQ ID NO: 6709371 - DNA, 17 bp, Homo sapiens
cagtctcatcctcccat

SEQ ID NO: 6709372 - DNA, 15 bp, Homo sapiens
cagtctcatctcctg

SEQ ID NO: 6709373 - DNA, 23 bp, Homo sapiens
cagtctcatctcctgaccctccc

SEQ ID NO: 6709374 - DNA, 13 bp, Homo sapiens
cagtctcatttct

SEQ ID NO: 6709375 - DNA, 18 bp, Homo sapiens
cagtctccaatcccatct

SEQ ID NO: 6709376 - DNA, 16 bp, Homo sapiens
cagtctccagggaccc

SEQ ID NO: 6709377 - DNA, 24 bp, Homo sapiens
cagtctccagggacccttgcctgc

SEQ ID NO: 6709378 - DNA, 22 bp, Homo sapiens
cagtctccatgtgtgtgccaag

SEQ ID NO: 6709379 - DNA, 13 bp, Homo sapiens
cagtctcccaggc

SEQ ID NO: 6709380 - DNA, 14 bp, Homo sapiens
cagtctcccaggcc

SEQ ID NO: 6709381 - DNA, 20 bp, Homo sapiens
cagtctcccaggccccctgc

SEQ ID NO: 6709382 - DNA, 21 bp, Homo sapiens
cagtctcccaggccccctgca

SEQ ID NO: 6709383 - DNA, 14 bp, Homo sapiens
cagtctcccattct

SEQ ID NO: 6709384 - DNA, 18 bp, Homo sapiens
cagtctccccactccacc

SEQ ID NO: 6709385 - DNA, 19 bp, Homo sapiens
cagtctcccccacccttgt

SEQ ID NO: 6709386 - DNA, 15 bp, Homo sapiens
cagtctccccttcct

SEQ ID NO: 6709387 - DNA, 16 bp, Homo sapiens
cagtctccctgatgga

SEQ ID NO: 6709388 - DNA, 22 bp, Homo sapiens
cagtctcctcccctactctgcc

SEQ ID NO: 6709389 - DNA, 12 bp, Homo sapiens
cagtctcctctt

SEQ ID NO: 6709390 - DNA, 23 bp, Homo sapiens
cagtctcctctttaaaacaaaac

SEQ ID NO: 6709391 - DNA, 15 bp, Homo sapiens
cagtctcgggtggct

SEQ ID NO: 6709392 - DNA, 20 bp, Homo sapiens
cagtctctataccaataaag

SEQ ID NO: 6709393 - DNA, 13 bp, Homo sapiens
cagtctctatttg

SEQ ID NO: 6709394 - DNA, 15 bp, Homo sapiens
cagtctctatttgat

SEQ ID NO: 6709395 - DNA, 21 bp, Homo sapiens
cagtctctatttgatttgcaa

SEQ ID NO: 6709396 - DNA, 15 bp, Homo sapiens
cagtctctccctggg

SEQ ID NO: 6709397 - DNA, 20 bp, Homo sapiens
cagtctctgaatacacagta

SEQ ID NO: 6709398 - DNA, 14 bp, Homo sapiens
cagtctctgagcag

SEQ ID NO: 6709399 - DNA, 15 bp, Homo sapiens
cagtctctgagggct

SEQ ID NO: 6709400 - DNA, 12 bp, Homo sapiens
cagtctctgcct

SEQ ID NO: 6709401 - DNA, 13 bp, Homo sapiens
cagtctctgcctt

SEQ ID NO: 6709402 - DNA, 14 bp, Homo sapiens
cagtctctgccttg

SEQ ID NO: 6709403 - DNA, 18 bp, Homo sapiens
cagtctctgccttgcctt

SEQ ID NO: 6709404 - DNA, 19 bp, Homo sapiens
cagtctctgccttgccttt

SEQ ID NO: 6709405 - DNA, 16 bp, Homo sapiens
cagtctctgggagact

SEQ ID NO: 6709406 - DNA, 19 bp, Homo sapiens
cagtctctgggagactttc

SEQ ID NO: 6709407 - DNA, 17 bp, Homo sapiens
cagtctcttagaatttg

SEQ ID NO: 6709408 - DNA, 22 bp, Homo sapiens
cagtctcttagaatttgtttca

SEQ ID NO: 6709409 - DNA, 22 bp, Homo sapiens
cagtctctttaatcttcagttt

SEQ ID NO: 6709410 - DNA, 21 bp, Homo sapiens
cagtctctttattttactaga

SEQ ID NO: 6709411 - DNA, 18 bp, Homo sapiens
cagtctctttctgtacaa

SEQ ID NO: 6709412 - DNA, 16 bp, Homo sapiens
cagtctctttcttcct

SEQ ID NO: 6709413 - DNA, 19 bp, Homo sapiens
cagtctctttcttcctttc

SEQ ID NO: 6709414 - DNA, 22 bp, Homo sapiens
cagtctgaacccttgtgcttgg

SEQ ID NO: 6709415 - DNA, 17 bp, Homo sapiens
cagtctgaagctcgcat

SEQ ID NO: 6709416 - DNA, 18 bp, Homo sapiens
cagtctgaatgctgccac

SEQ ID NO: 6709417 - DNA, 12 bp, Homo sapiens
cagtctgaccct

SEQ ID NO: 6709418 - DNA, 18 bp, Homo sapiens
cagtctgagagaggccat

SEQ ID NO: 6709419 - DNA, 11 bp, Homo sapiens
cagtctgagct

SEQ ID NO: 6709420 - DNA, 22 bp, Homo sapiens
cagtctgatccatccatctctc

SEQ ID NO: 6709421 - DNA, 22 bp, Homo sapiens
cagtctgatcgtgacgctgaat

SEQ ID NO: 6709422 - DNA, 12 bp, Homo sapiens
cagtctgcagct

SEQ ID NO: 6709423 - DNA, 19 bp, Homo sapiens
cagtctgcccacgcagagg

SEQ ID NO: 6709424 - DNA, 20 bp, Homo sapiens
cagtctgcccacgcagagga

SEQ ID NO: 6709425 - DNA, 15 bp, Homo sapiens
cagtctgcgtcaggc

SEQ ID NO: 6709426 - DNA, 14 bp, Homo sapiens
cagtctgctccacc

SEQ ID NO: 6709427 - DNA, 16 bp, Homo sapiens
cagtctgctccaccaa

SEQ ID NO: 6709428 - DNA, 15 bp, Homo sapiens
cagtctgctctcagc

SEQ ID NO: 6709429 - DNA, 16 bp, Homo sapiens
cagtctgctctcagct

SEQ ID NO: 6709430 - DNA, 13 bp, Homo sapiens
cagtctgctgccc

SEQ ID NO: 6709431 - DNA, 15 bp, Homo sapiens
cagtctgctgccctc

SEQ ID NO: 6709432 - DNA, 22 bp, Homo sapiens
cagtctgctgccctccatcccg

SEQ ID NO: 6709433 - DNA, 17 bp, Homo sapiens
cagtctgcttagaaata

SEQ ID NO: 6709434 - DNA, 15 bp, Homo sapiens
cagtctggaagaaga

SEQ ID NO: 6709435 - DNA, 17 bp, Homo sapiens
cagtctggaagaagagg

SEQ ID NO: 6709436 - DNA, 15 bp, Homo sapiens
cagtctggagagctg

SEQ ID NO: 6709437 - DNA, 17 bp, Homo sapiens
cagtctggaggtcccag

SEQ ID NO: 6709438 - DNA, 18 bp, Homo sapiens
cagtctgggtctgggttt

SEQ ID NO: 6709439 - DNA, 21 bp, Homo sapiens
cagtctgtcacccaggctgga

SEQ ID NO: 6709440 - DNA, 19 bp, Homo sapiens
cagtctgtccacgtggaga

SEQ ID NO: 6709441 - DNA, 15 bp, Homo sapiens
cagtctgtctactgt

SEQ ID NO: 6709442 - DNA, 19 bp, Homo sapiens
cagtctgtgatccttggtg

SEQ ID NO: 6709443 - DNA, 20 bp, Homo sapiens
cagtctgtgatccttggtgc

SEQ ID NO: 6709444 - DNA, 15 bp, Homo sapiens
cagtctgtggatcag

SEQ ID NO: 6709445 - DNA, 15 bp, Homo sapiens
cagtctgtgtttaca

SEQ ID NO: 6709446 - DNA, 14 bp, Homo sapiens
cagtctgtgtttga

SEQ ID NO: 6709447 - DNA, 14 bp, Homo sapiens
cagtctgttatgca

SEQ ID NO: 6709448 - DNA, 16 bp, Homo sapiens
cagtctgttatgcact

SEQ ID NO: 6709449 - DNA, 22 bp, Homo sapiens
cagtctgttatgcactgtggtt

SEQ ID NO: 6709450 - DNA, 21 bp, Homo sapiens
cagtcttactctgtctcccag

SEQ ID NO: 6709451 - DNA, 19 bp, Homo sapiens
cagtcttatgcttccagaa

SEQ ID NO: 6709452 - DNA, 16 bp, Homo sapiens
cagtcttatttaacca

SEQ ID NO: 6709453 - DNA, 19 bp, Homo sapiens
cagtcttatttttctagtc

SEQ ID NO: 6709454 - DNA, 20 bp, Homo sapiens
cagtcttatttttctagtca

SEQ ID NO: 6709455 - DNA, 21 bp, Homo sapiens
cagtcttcacttgcactgggg

SEQ ID NO: 6709456 - DNA, 17 bp, Homo sapiens
cagtcttccacaaagaa

SEQ ID NO: 6709457 - DNA, 20 bp, Homo sapiens
cagtcttccacaaagaaaat

SEQ ID NO: 6709458 - DNA, 16 bp, Homo sapiens
cagtcttccagaaagc

SEQ ID NO: 6709459 - DNA, 17 bp, Homo sapiens
cagtcttccagaaagca

SEQ ID NO: 6709460 - DNA, 15 bp, Homo sapiens
cagtcttccatttgc

SEQ ID NO: 6709461 - DNA, 23 bp, Homo sapiens
cagtcttccctagggctgggtgt

SEQ ID NO: 6709462 - DNA, 18 bp, Homo sapiens
cagtcttctaccaaatgt

SEQ ID NO: 6709463 - DNA, 22 bp, Homo sapiens
cagtcttctaccaaatgtgtaa

SEQ ID NO: 6709464 - DNA, 11 bp, Homo sapiens
cagtcttctgg

SEQ ID NO: 6709465 - DNA, 18 bp, Homo sapiens
cagtcttcttcacccgct

SEQ ID NO: 6709466 - DNA, 19 bp, Homo sapiens
cagtcttcttcacccgctg

SEQ ID NO: 6709467 - DNA, 22 bp, Homo sapiens
cagtcttgaatttctaaaaaac

SEQ ID NO: 6709468 - DNA, 18 bp, Homo sapiens
cagtcttgacgagtgtga

SEQ ID NO: 6709469 - DNA, 20 bp, Homo sapiens
cagtcttgagtgggccccct

SEQ ID NO: 6709470 - DNA, 22 bp, Homo sapiens
cagtcttgagtgggccccctct

SEQ ID NO: 6709471 - DNA, 19 bp, Homo sapiens
cagtcttgatttaacctta

SEQ ID NO: 6709472 - DNA, 19 bp, Homo sapiens
cagtcttgccttacacaaa

SEQ ID NO: 6709473 - DNA, 14 bp, Homo sapiens
cagtcttgtactgt

SEQ ID NO: 6709474 - DNA, 18 bp, Homo sapiens
cagtcttgtagctagaac

SEQ ID NO: 6709475 - DNA, 17 bp, Homo sapiens
cagtctttaaaggccca

SEQ ID NO: 6709476 - DNA, 20 bp, Homo sapiens
cagtctttaaaggcccagcc

SEQ ID NO: 6709477 - DNA, 17 bp, Homo sapiens
cagtctttaagatcttg

SEQ ID NO: 6709478 - DNA, 22 bp, Homo sapiens
cagtctttaatctgagaggcca

SEQ ID NO: 6709479 - DNA, 21 bp, Homo sapiens
cagtctttatttttttcccat

SEQ ID NO: 6709480 - DNA, 23 bp, Homo sapiens
cagtctttatttttttcccatga

SEQ ID NO: 6709481 - DNA, 16 bp, Homo sapiens
cagtctttcccccagg

SEQ ID NO: 6709482 - DNA, 16 bp, Homo sapiens
cagtctttcttcactc

SEQ ID NO: 6709483 - DNA, 22 bp, Homo sapiens
cagtctttcttcactctggctt

SEQ ID NO: 6709484 - DNA, 15 bp, Homo sapiens
cagtctttcttgaaa

SEQ ID NO: 6709485 - DNA, 16 bp, Homo sapiens
cagtctttgaactgca

SEQ ID NO: 6709486 - DNA, 21 bp, Homo sapiens
cagtctttgaactgcagcaat

SEQ ID NO: 6709487 - DNA, 20 bp, Homo sapiens
cagtctttgccctgaatggt

SEQ ID NO: 6709488 - DNA, 14 bp, Homo sapiens
cagtctttggagag

SEQ ID NO: 6709489 - DNA, 14 bp, Homo sapiens
cagtcttttgtcct

SEQ ID NO: 6709490 - DNA, 14 bp, Homo sapiens
cagtctttttctgt

SEQ ID NO: 6709491 - DNA, 18 bp, Homo sapiens
cagtctttttctgttgta

SEQ ID NO: 6709492 - DNA, 22 bp, Homo sapiens
cagtgaaaaatatgttgagtgt

SEQ ID NO: 6709493 - DNA, 16 bp, Homo sapiens
cagtgaaaacaagtgc

SEQ ID NO: 6709494 - DNA, 18 bp, Homo sapiens
cagtgaaaacaagtgctg

SEQ ID NO: 6709495 - DNA, 22 bp, Homo sapiens
cagtgaaaagagagaagggaga

SEQ ID NO: 6709496 - DNA, 12 bp, Homo sapiens
cagtgaaaatgt

SEQ ID NO: 6709497 - DNA, 18 bp, Homo sapiens
cagtgaaacacttgcttg

SEQ ID NO: 6709498 - DNA, 15 bp, Homo sapiens
cagtgaaacttgtgc

SEQ ID NO: 6709499 - DNA, 16 bp, Homo sapiens
cagtgaaagaaaataa

SEQ ID NO: 6709500 - DNA, 15 bp, Homo sapiens
cagtgaaagaaactg

SEQ ID NO: 6709501 - DNA, 18 bp, Homo sapiens
cagtgaaagagtagtgca

SEQ ID NO: 6709502 - DNA, 14 bp, Homo sapiens
cagtgaaagccctg

SEQ ID NO: 6709503 - DNA, 16 bp, Homo sapiens
cagtgaaatgtgaagg

SEQ ID NO: 6709504 - DNA, 15 bp, Homo sapiens
cagtgaaattttcag

SEQ ID NO: 6709505 - DNA, 12 bp, Homo sapiens
cagtgaacaaat

SEQ ID NO: 6709506 - DNA, 15 bp, Homo sapiens
cagtgaacataactg

SEQ ID NO: 6709507 - DNA, 18 bp, Homo sapiens
cagtgaacattcccagcc

SEQ ID NO: 6709508 - DNA, 21 bp, Homo sapiens
cagtgaacattcccagcccag

SEQ ID NO: 6709509 - DNA, 23 bp, Homo sapiens
cagtgaaccaaagagactggagc

SEQ ID NO: 6709510 - DNA, 14 bp, Homo sapiens
cagtgaactatttt

SEQ ID NO: 6709511 - DNA, 20 bp, Homo sapiens
cagtgaactcctgccaggca

SEQ ID NO: 6709512 - DNA, 13 bp, Homo sapiens
cagtgaagacaga

SEQ ID NO: 6709513 - DNA, 16 bp, Homo sapiens
cagtgaagacagaagt

SEQ ID NO: 6709514 - DNA, 15 bp, Homo sapiens
cagtgaagactatga

SEQ ID NO: 6709515 - DNA, 17 bp, Homo sapiens
cagtgaagacttcttgg

SEQ ID NO: 6709516 - DNA, 14 bp, Homo sapiens
cagtgaagagtaag

SEQ ID NO: 6709517 - DNA, 19 bp, Homo sapiens
cagtgaagatgcaatcaga

SEQ ID NO: 6709518 - DNA, 18 bp, Homo sapiens
cagtgaagatgctgtaaa

SEQ ID NO: 6709519 - DNA, 19 bp, Homo sapiens
cagtgaagatgctgtaaat

SEQ ID NO: 6709520 - DNA, 20 bp, Homo sapiens
cagtgaagatgctgtaaata

SEQ ID NO: 6709521 - DNA, 15 bp, Homo sapiens
cagtgaagatgtgta

SEQ ID NO: 6709522 - DNA, 17 bp, Homo sapiens
cagtgaagatgtgtaaa

SEQ ID NO: 6709523 - DNA, 20 bp, Homo sapiens
cagtgaagcaacagctttgc

SEQ ID NO: 6709524 - DNA, 19 bp, Homo sapiens
cagtgaagcagcactgtga

SEQ ID NO: 6709525 - DNA, 22 bp, Homo sapiens
cagtgaagcccaggaggacctg

SEQ ID NO: 6709526 - DNA, 12 bp, Homo sapiens
cagtgaagcctc

SEQ ID NO: 6709527 - DNA, 22 bp, Homo sapiens
cagtgaaggagccacgtgaatg

SEQ ID NO: 6709528 - DNA, 15 bp, Homo sapiens
cagtgaagtgttctg

SEQ ID NO: 6709529 - DNA, 16 bp, Homo sapiens
cagtgaagtgttctgc

SEQ ID NO: 6709530 - DNA, 17 bp, Homo sapiens
cagtgaagttgctgctt

SEQ ID NO: 6709531 - DNA, 15 bp, Homo sapiens
cagtgaatccctggg

SEQ ID NO: 6709532 - DNA, 18 bp, Homo sapiens
cagtgaatccctgggagc

SEQ ID NO: 6709533 - DNA, 19 bp, Homo sapiens
cagtgaatcttatggtgga

SEQ ID NO: 6709534 - DNA, 17 bp, Homo sapiens
cagtgaatgattcagtg

SEQ ID NO: 6709535 - DNA, 18 bp, Homo sapiens
cagtgaatgattcagtgt

SEQ ID NO: 6709536 - DNA, 15 bp, Homo sapiens
cagtgaattgtcttt

SEQ ID NO: 6709537 - DNA, 15 bp, Homo sapiens
cagtgaatttctgat

SEQ ID NO: 6709538 - DNA, 11 bp, Homo sapiens
cagtgaatttg

SEQ ID NO: 6709539 - DNA, 18 bp, Homo sapiens
cagtgaatttttgcaata

SEQ ID NO: 6709540 - DNA, 15 bp, Homo sapiens
cagtgacaaaaggct

SEQ ID NO: 6709541 - DNA, 20 bp, Homo sapiens
cagtgacaaagactcctctg

SEQ ID NO: 6709542 - DNA, 21 bp, Homo sapiens
cagtgacaaagactcctctgg

SEQ ID NO: 6709543 - DNA, 18 bp, Homo sapiens
cagtgacaaattgtaact

SEQ ID NO: 6709544 - DNA, 16 bp, Homo sapiens
cagtgacaagtagggc

SEQ ID NO: 6709545 - DNA, 15 bp, Homo sapiens
cagtgacaataaatg

SEQ ID NO: 6709546 - DNA, 21 bp, Homo sapiens
cagtgacacaatctcggctca

SEQ ID NO: 6709547 - DNA, 13 bp, Homo sapiens
cagtgacacccag

SEQ ID NO: 6709548 - DNA, 17 bp, Homo sapiens
cagtgacacgtctcgcc

SEQ ID NO: 6709549 - DNA, 16 bp, Homo sapiens
cagtgacactggacca

SEQ ID NO: 6709550 - DNA, 16 bp, Homo sapiens
cagtgacacttcagag

SEQ ID NO: 6709551 - DNA, 15 bp, Homo sapiens
cagtgacagacaggc

SEQ ID NO: 6709552 - DNA, 21 bp, Homo sapiens
cagtgacatcaaagcctggcc

SEQ ID NO: 6709553 - DNA, 14 bp, Homo sapiens
cagtgaccagtgcc

SEQ ID NO: 6709554 - DNA, 16 bp, Homo sapiens
cagtgaccagtgcctg

SEQ ID NO: 6709555 - DNA, 14 bp, Homo sapiens
cagtgaccctggag

SEQ ID NO: 6709556 - DNA, 14 bp, Homo sapiens
cagtgacctgaccg

SEQ ID NO: 6709557 - DNA, 15 bp, Homo sapiens
cagtgacctgaccgg

SEQ ID NO: 6709558 - DNA, 18 bp, Homo sapiens
cagtgacctgccctacat

SEQ ID NO: 6709559 - DNA, 19 bp, Homo sapiens
cagtgacctgctgggtaaa

SEQ ID NO: 6709560 - DNA, 21 bp, Homo sapiens
cagtgacctttgacctcggtg

SEQ ID NO: 6709561 - DNA, 14 bp, Homo sapiens
cagtgacgctgctg

SEQ ID NO: 6709562 - DNA, 15 bp, Homo sapiens
cagtgacgctgctga

SEQ ID NO: 6709563 - DNA, 18 bp, Homo sapiens
cagtgacgtgactcagag

SEQ ID NO: 6709564 - DNA, 20 bp, Homo sapiens
cagtgacgtgactcagagct

SEQ ID NO: 6709565 - DNA, 16 bp, Homo sapiens
cagtgacgtgcacctg

SEQ ID NO: 6709566 - DNA, 13 bp, Homo sapiens
cataaaagaagaa

SEQ ID NO: 6709567 - DNA, 11 bp, Homo sapiens
cataaaagaat

SEQ ID NO: 6709568 - DNA, 13 bp, Homo sapiens
cataaaagaatgt

SEQ ID NO: 6709569 - DNA, 15 bp, Homo sapiens
cataaaagaatgtac

SEQ ID NO: 6709570 - DNA, 18 bp, Homo sapiens
cataaaagaatgtacaga

SEQ ID NO: 6709571 - DNA, 14 bp, Homo sapiens
cataaaagaatttt

SEQ ID NO: 6709572 - DNA, 19 bp, Homo sapiens
cataaaagatatgttgaag

SEQ ID NO: 6709573 - DNA, 14 bp, Homo sapiens
cataaaagccccag

SEQ ID NO: 6709574 - DNA, 16 bp, Homo sapiens
cataaaagccccagct

SEQ ID NO: 6709575 - DNA, 19 bp, Homo sapiens
cataaaagggtcaaacctg

SEQ ID NO: 6709576 - DNA, 22 bp, Homo sapiens
cataaaagggtcaaacctgtag

SEQ ID NO: 6709577 - DNA, 19 bp, Homo sapiens
cataaaataaagtatatat

SEQ ID NO: 6709578 - DNA, 14 bp, Homo sapiens
cataaaataaataa

SEQ ID NO: 6709579 - DNA, 16 bp, Homo sapiens
cataaaataaattttt

SEQ ID NO: 6709580 - DNA, 17 bp, Homo sapiens
cataaaatatacaaaca

SEQ ID NO: 6709581 - DNA, 14 bp, Homo sapiens
cataaaatctgtga

SEQ ID NO: 6709582 - DNA, 17 bp, Homo sapiens
cataaaatctgtgaatt

SEQ ID NO: 6709583 - DNA, 19 bp, Homo sapiens
cataaaatgctattttaaa

SEQ ID NO: 6709584 - DNA, 18 bp, Homo sapiens
cataaaatggaataacat

SEQ ID NO: 6709585 - DNA, 15 bp, Homo sapiens
cataaaattaaaatt

SEQ ID NO: 6709586 - DNA, 22 bp, Homo sapiens
cataaaattaaaatttaacatc

SEQ ID NO: 6709587 - DNA, 21 bp, Homo sapiens
cataaaattgcagtttcatgt

SEQ ID NO: 6709588 - DNA, 15 bp, Homo sapiens
cataaacaaagacat

SEQ ID NO: 6709589 - DNA, 14 bp, Homo sapiens
cataaacaacagta

SEQ ID NO: 6709590 - DNA, 22 bp, Homo sapiens
cataaacaagaccacgtttcta

SEQ ID NO: 6709591 - DNA, 18 bp, Homo sapiens
cataaacacaactgactc

SEQ ID NO: 6709592 - DNA, 11 bp, Homo sapiens
cataaacagca

SEQ ID NO: 6709593 - DNA, 13 bp, Homo sapiens
cataaacagcaca

SEQ ID NO: 6709594 - DNA, 16 bp, Homo sapiens
cataaacagcacacct

SEQ ID NO: 6709595 - DNA, 16 bp, Homo sapiens
cataaacagcatttat

SEQ ID NO: 6709596 - DNA, 15 bp, Homo sapiens
cataaacattctttt

SEQ ID NO: 6709597 - DNA, 19 bp, Homo sapiens
cataaaccaaaaccaaaca

SEQ ID NO: 6709598 - DNA, 22 bp, Homo sapiens
cataaaccaataaaacaagaat

SEQ ID NO: 6709599 - DNA, 23 bp, Homo sapiens
cataaaccaatgagctgtatctg

SEQ ID NO: 6709600 - DNA, 19 bp, Homo sapiens
cataaacccatctgtaata

SEQ ID NO: 6709601 - DNA, 19 bp, Homo sapiens
cataaacggttcctggtga

SEQ ID NO: 6709602 - DNA, 13 bp, Homo sapiens
cataaactaaaaa

SEQ ID NO: 6709603 - DNA, 17 bp, Homo sapiens
cataaactaagagaaac

SEQ ID NO: 6709604 - DNA, 18 bp, Homo sapiens
cataaactaagagaaact

SEQ ID NO: 6709605 - DNA, 13 bp, Homo sapiens
cataaactgactt

SEQ ID NO: 6709606 - DNA, 15 bp, Homo sapiens
cataaactgacttta

SEQ ID NO: 6709607 - DNA, 15 bp, Homo sapiens
cataaactgtgtgca

SEQ ID NO: 6709608 - DNA, 15 bp, Homo sapiens
cataaacttcatctt

SEQ ID NO: 6709609 - DNA, 14 bp, Homo sapiens
cataaacttttgca

SEQ ID NO: 6709610 - DNA, 21 bp, Homo sapiens
cataaagaagaaacttgtaaa

SEQ ID NO: 6709611 - DNA, 22 bp, Homo sapiens
cataaagaagaaacttgtaaat

SEQ ID NO: 6709612 - DNA, 19 bp, Homo sapiens
cataaagaagatgtttaac

SEQ ID NO: 6709613 - DNA, 11 bp, Homo sapiens
cataaagaagc

SEQ ID NO: 6709614 - DNA, 20 bp, Homo sapiens
cataaagaattaatgactta

SEQ ID NO: 6709615 - DNA, 13 bp, Homo sapiens
cataaagaatttg

SEQ ID NO: 6709616 - DNA, 17 bp, Homo sapiens
cataaagatgttaaatg

SEQ ID NO: 6709617 - DNA, 20 bp, Homo sapiens
cataaagatgttaaatggaa

SEQ ID NO: 6709618 - DNA, 21 bp, Homo sapiens
cataaagatgttaaatggaat

SEQ ID NO: 6709619 - DNA, 19 bp, Homo sapiens
cataaagcaattgtgaaat

SEQ ID NO: 6709620 - DNA, 19 bp, Homo sapiens
cataaagcaccagcagtgt

SEQ ID NO: 6709621 - DNA, 18 bp, Homo sapiens
cataaagcataagtatac

SEQ ID NO: 6709622 - DNA, 17 bp, Homo sapiens
cataaagcctctgactc

SEQ ID NO: 6709623 - DNA, 15 bp, Homo sapiens
cataaagctcccttg

SEQ ID NO: 6709624 - DNA, 15 bp, Homo sapiens
cataaaggaaaagac

SEQ ID NO: 6709625 - DNA, 19 bp, Homo sapiens
cataaaggaaaagacacat

SEQ ID NO: 6709626 - DNA, 13 bp, Homo sapiens
cataaaggacact

SEQ ID NO: 6709627 - DNA, 23 bp, Homo sapiens
cataaaggacactggatcaagtt

SEQ ID NO: 6709628 - DNA, 18 bp, Homo sapiens
cataaaggataaactttt

SEQ ID NO: 6709629 - DNA, 21 bp, Homo sapiens
cataaagggtgtaggggccac

SEQ ID NO: 6709630 - DNA, 16 bp, Homo sapiens
cataaaggtaaaacaa

SEQ ID NO: 6709631 - DNA, 23 bp, Homo sapiens
cataaaggtatttagaatatatt

SEQ ID NO: 6709632 - DNA, 20 bp, Homo sapiens
cataaaggtggtatgtgtgt

SEQ ID NO: 6709633 - DNA, 22 bp, Homo sapiens
cataaaggttattttctcctga

SEQ ID NO: 6709634 - DNA, 15 bp, Homo sapiens
cataaagtaaataca

SEQ ID NO: 6709635 - DNA, 22 bp, Homo sapiens
cataaagtaataactgttagaa

SEQ ID NO: 6709636 - DNA, 19 bp, Homo sapiens
cataaagtaatgatgaaat

SEQ ID NO: 6709637 - DNA, 16 bp, Homo sapiens
cataaagtacaaatga

SEQ ID NO: 6709638 - DNA, 15 bp, Homo sapiens
cataaagtcatcaaa

SEQ ID NO: 6709639 - DNA, 15 bp, Homo sapiens
cataaagtctgagaa

SEQ ID NO: 6709640 - DNA, 13 bp, Homo sapiens
cataaagtgtaat

SEQ ID NO: 6709641 - DNA, 22 bp, Homo sapiens
cataaagttagaatctattttc

SEQ ID NO: 6709642 - DNA, 18 bp, Homo sapiens
cataaataaaactgaatc

SEQ ID NO: 6709643 - DNA, 14 bp, Homo sapiens
cataaataaaagaa

SEQ ID NO: 6709644 - DNA, 18 bp, Homo sapiens
cataaataaaatgaccag

SEQ ID NO: 6709645 - DNA, 20 bp, Homo sapiens
cataaataaaggtgtagaaa

SEQ ID NO: 6709646 - DNA, 12 bp, Homo sapiens
cataaataaagt

SEQ ID NO: 6709647 - DNA, 20 bp, Homo sapiens
cataaataagaaaaaccaaa

SEQ ID NO: 6709648 - DNA, 16 bp, Homo sapiens
cataaataattttgtt

SEQ ID NO: 6709649 - DNA, 16 bp, Homo sapiens
cataaatacaaaaatg

SEQ ID NO: 6709650 - DNA, 23 bp, Homo sapiens
cataaatacagtattcccactct

SEQ ID NO: 6709651 - DNA, 14 bp, Homo sapiens
cataaatactgtca

SEQ ID NO: 6709652 - DNA, 15 bp, Homo sapiens
cataaatagtagaaa

SEQ ID NO: 6709653 - DNA, 18 bp, Homo sapiens
cataaatagtagaaaaat

SEQ ID NO: 6709654 - DNA, 21 bp, Homo sapiens
cataaatcaattcattgtgta

SEQ ID NO: 6709655 - DNA, 16 bp, Homo sapiens
cataaatcacagaaaa

SEQ ID NO: 6709656 - DNA, 17 bp, Homo sapiens
cataaatcagaaagttt

SEQ ID NO: 6709657 - DNA, 18 bp, Homo sapiens
cataaatcagaaagttta

SEQ ID NO: 6709658 - DNA, 16 bp, Homo sapiens
cataaatcatgttgtt

SEQ ID NO: 6709659 - DNA, 16 bp, Homo sapiens
cataaatccagttcta

SEQ ID NO: 6709660 - DNA, 22 bp, Homo sapiens
cataaatctgaagtggttcagt

SEQ ID NO: 6709661 - DNA, 18 bp, Homo sapiens
cataaatctgtctgattc

SEQ ID NO: 6709662 - DNA, 21 bp, Homo sapiens
cataaatctgtctgattctat

SEQ ID NO: 6709663 - DNA, 23 bp, Homo sapiens
cataaatctgtgaacttgaaatt

SEQ ID NO: 6709664 - DNA, 13 bp, Homo sapiens
cataaatcttaat

SEQ ID NO: 6709665 - DNA, 20 bp, Homo sapiens
cataaatcttcttattaaat

SEQ ID NO: 6709666 - DNA, 12 bp, Homo sapiens
cataaatgaaag

SEQ ID NO: 6709667 - DNA, 13 bp, Homo sapiens
cataaatgaaaga

SEQ ID NO: 6709668 - DNA, 14 bp, Homo sapiens
cataaatgcagccc

SEQ ID NO: 6709669 - DNA, 21 bp, Homo sapiens
cataaatgctccttgtggcct

SEQ ID NO: 6709670 - DNA, 16 bp, Homo sapiens
cataaatggattaatt

SEQ ID NO: 6709671 - DNA, 20 bp, Homo sapiens
cataaatggattaattacta

SEQ ID NO: 6709672 - DNA, 15 bp, Homo sapiens
cataaatgtcacaat

SEQ ID NO: 6709673 - DNA, 13 bp, Homo sapiens
cataaatgttcac

SEQ ID NO: 6709674 - DNA, 14 bp, Homo sapiens
cataaattaatgat

SEQ ID NO: 6709675 - DNA, 15 bp, Homo sapiens
cataaattaatttga

SEQ ID NO: 6709676 - DNA, 23 bp, Homo sapiens
cataaattacagtcatctgtctt

SEQ ID NO: 6709677 - DNA, 11 bp, Homo sapiens
cataaattatg

SEQ ID NO: 6709678 - DNA, 17 bp, Homo sapiens
cataaattatgagattt

SEQ ID NO: 6709679 - DNA, 12 bp, Homo sapiens
cataaattattg

SEQ ID NO: 6709680 - DNA, 16 bp, Homo sapiens
cataaattcaactttg

SEQ ID NO: 6709681 - DNA, 23 bp, Homo sapiens
cataaattccagaggactctgct

SEQ ID NO: 6709682 - DNA, 18 bp, Homo sapiens
cataaattggctcctttc

SEQ ID NO: 6709683 - DNA, 15 bp, Homo sapiens
cataaattgtaattt

SEQ ID NO: 6709684 - DNA, 21 bp, Homo sapiens
cataaattgtaatttgggaac

SEQ ID NO: 6709685 - DNA, 14 bp, Homo sapiens
cataaatttgtaat

SEQ ID NO: 6709686 - DNA, 15 bp, Homo sapiens
cataaatttgtaata

SEQ ID NO: 6709687 - DNA, 19 bp, Homo sapiens
cataaatttgtaatatatc

SEQ ID NO: 6709688 - DNA, 21 bp, Homo sapiens
cataaatttgttgtcatgtgt

SEQ ID NO: 6709689 - DNA, 14 bp, Homo sapiens
cataaattttaatt

SEQ ID NO: 6709690 - DNA, 18 bp, Homo sapiens
cataacaaataaccaacc

SEQ ID NO: 6709691 - DNA, 14 bp, Homo sapiens
cataacaattcctc

SEQ ID NO: 6709692 - DNA, 11 bp, Homo sapiens
cataacacaca

SEQ ID NO: 6709693 - DNA, 12 bp, Homo sapiens
cataacacacat

SEQ ID NO: 6709694 - DNA, 21 bp, Homo sapiens
cataacaccaatcccagggct

SEQ ID NO: 6709695 - DNA, 18 bp, Homo sapiens
cataacagccaagaagcc

SEQ ID NO: 6709696 - DNA, 16 bp, Homo sapiens
cataacaggcattgca

SEQ ID NO: 6709697 - DNA, 17 bp, Homo sapiens
cataacaggcattgcac

SEQ ID NO: 6709698 - DNA, 17 bp, Homo sapiens
cataacagggtaaatta

SEQ ID NO: 6709699 - DNA, 22 bp, Homo sapiens
cataacagggtaaattattcag

SEQ ID NO: 6709700 - DNA, 15 bp, Homo sapiens
cataacagtgcaggg

SEQ ID NO: 6709701 - DNA, 12 bp, Homo sapiens
cataacataaat

SEQ ID NO: 6709702 - DNA, 14 bp, Homo sapiens
cataacatccagag

SEQ ID NO: 6709703 - DNA, 13 bp, Homo sapiens
cataacatttaaa

SEQ ID NO: 6709704 - DNA, 17 bp, Homo sapiens
cataacatttaaagaga

SEQ ID NO: 6709705 - DNA, 20 bp, Homo sapiens
cataacattttcagaatagt

SEQ ID NO: 6709706 - DNA, 20 bp, Homo sapiens
cataaccaacattaaaactc

SEQ ID NO: 6709707 - DNA, 18 bp, Homo sapiens
cataaccaatttgtaatg

SEQ ID NO: 6709708 - DNA, 15 bp, Homo sapiens
cataaccactgcttc

SEQ ID NO: 6709709 - DNA, 20 bp, Homo sapiens
cataaccattcccattggtt

SEQ ID NO: 6709710 - DNA, 20 bp, Homo sapiens
cataaccccaggcatcccat

SEQ ID NO: 6709711 - DNA, 22 bp, Homo sapiens
cataaccccaggcatcccatcc

SEQ ID NO: 6709712 - DNA, 16 bp, Homo sapiens
cataaccccttgaaac

SEQ ID NO: 6709713 - DNA, 12 bp, Homo sapiens
cataacctctat

SEQ ID NO: 6709714 - DNA, 22 bp, Homo sapiens
cataacggatcagaaatacaga

SEQ ID NO: 6709715 - DNA, 18 bp, Homo sapiens
cataacgtgcccccagag

SEQ ID NO: 6709716 - DNA, 19 bp, Homo sapiens
cataacgtgcccccagagt

SEQ ID NO: 6709717 - DNA, 22 bp, Homo sapiens
cataactaaatttgatacttat

SEQ ID NO: 6709718 - DNA, 17 bp, Homo sapiens
cataactaatacagctg

SEQ ID NO: 6709719 - DNA, 14 bp, Homo sapiens
cataactagagcac

SEQ ID NO: 6709720 - DNA, 18 bp, Homo sapiens
cataactagagtatgtgt

SEQ ID NO: 6709721 - DNA, 21 bp, Homo sapiens
cataactagagtatgtgtatg

SEQ ID NO: 6709722 - DNA, 19 bp, Homo sapiens
cataactagtttaattaac

SEQ ID NO: 6709723 - DNA, 18 bp, Homo sapiens
cataactcacacccctgc

SEQ ID NO: 6709724 - DNA, 19 bp, Homo sapiens
cataactcacacccctgcc

SEQ ID NO: 6709725 - DNA, 21 bp, Homo sapiens
cataactcacacccctgcccc

SEQ ID NO: 6709726 - DNA, 22 bp, Homo sapiens
cataactcctgtcccttttccc

SEQ ID NO: 6709727 - DNA, 22 bp, Homo sapiens
cataactctgtaaaaacactga

SEQ ID NO: 6709728 - DNA, 15 bp, Homo sapiens
cataactgacaaatc

SEQ ID NO: 6709729 - DNA, 16 bp, Homo sapiens
cataactgacaaatca

SEQ ID NO: 6709730 - DNA, 20 bp, Homo sapiens
cataactgacaaatcaagtt

SEQ ID NO: 6709731 - DNA, 22 bp, Homo sapiens
cataactgacaaatcaagtttc

SEQ ID NO: 6709732 - DNA, 19 bp, Homo sapiens
cataactgacttagttctt

SEQ ID NO: 6709733 - DNA, 17 bp, Homo sapiens
cataactgatctattta

SEQ ID NO: 6709734 - DNA, 14 bp, Homo sapiens
cataactgccttga

SEQ ID NO: 6709735 - DNA, 19 bp, Homo sapiens
cataactgctacttgctct

SEQ ID NO: 6709736 - DNA, 16 bp, Homo sapiens
cataactgcttcttgg

SEQ ID NO: 6709737 - DNA, 18 bp, Homo sapiens
cataactgcttcttggag

SEQ ID NO: 6709738 - DNA, 20 bp, Homo sapiens
cataactgcttcttggagct

SEQ ID NO: 6709739 - DNA, 21 bp, Homo sapiens
cataactgcttcttggagctt

SEQ ID NO: 6709740 - DNA, 23 bp, Homo sapiens
cataactggttttgtttttttgc

SEQ ID NO: 6709741 - DNA, 10 bp, Homo sapiens
cataactgta

SEQ ID NO: 6709742 - DNA, 19 bp, Homo sapiens
cataactgtagctcaagtt

SEQ ID NO: 6709743 - DNA, 23 bp, Homo sapiens
cataacttattgctgattttaat

SEQ ID NO: 6709744 - DNA, 13 bp, Homo sapiens
cataacttcagtg

SEQ ID NO: 6709745 - DNA, 13 bp, Homo sapiens
cataacttcctgt

SEQ ID NO: 6709746 - DNA, 16 bp, Homo sapiens
cataacttctcatgta

SEQ ID NO: 6709747 - DNA, 12 bp, Homo sapiens
cataacttgaaa

SEQ ID NO: 6709748 - DNA, 19 bp, Homo sapiens
cataacttttaactggagt

SEQ ID NO: 6709749 - DNA, 19 bp, Homo sapiens
cataagaaatgtagctgaa

SEQ ID NO: 6709750 - DNA, 21 bp, Homo sapiens
cataagaaatgtagctgaagt

SEQ ID NO: 6709751 - DNA, 22 bp, Homo sapiens
cataagaaatgtattcctgaaa

SEQ ID NO: 6709752 - DNA, 21 bp, Homo sapiens
cataagaagaccctatttccc

SEQ ID NO: 6709753 - DNA, 12 bp, Homo sapiens
cataagaatgaa

SEQ ID NO: 6709754 - DNA, 21 bp, Homo sapiens
cataagaatgaataataatta

SEQ ID NO: 6709755 - DNA, 12 bp, Homo sapiens
cataagaatttt

SEQ ID NO: 6709756 - DNA, 17 bp, Homo sapiens
cataagacaaacactgc

SEQ ID NO: 6709757 - DNA, 18 bp, Homo sapiens
cataagactttgggatag

SEQ ID NO: 6709758 - DNA, 15 bp, Homo sapiens
cataagagaaacctg

SEQ ID NO: 6709759 - DNA, 19 bp, Homo sapiens
cataagagaaagaggccag

SEQ ID NO: 6709760 - DNA, 19 bp, Homo sapiens
cataagaggttctaacttc

SEQ ID NO: 6709761 - DNA, 22 bp, Homo sapiens
cataagagtaacagtcatcatt

SEQ ID NO: 6709762 - DNA, 12 bp, Homo sapiens
cataagataaaa

SEQ ID NO: 6709763 - DNA, 19 bp, Homo sapiens
cataagatagttacattta

SEQ ID NO: 6709764 - DNA, 16 bp, Homo sapiens
cataagatattcttta

SEQ ID NO: 6709765 - DNA, 21 bp, Homo sapiens
cataagatattctttacaaac

SEQ ID NO: 6709766 - DNA, 17 bp, Homo sapiens
cataagatcactgccag

SEQ ID NO: 6709767 - DNA, 16 bp, Homo sapiens
cataagattaaaggaa

SEQ ID NO: 6709768 - DNA, 23 bp, Homo sapiens
cataagattatatacaaagctgt

SEQ ID NO: 6709769 - DNA, 11 bp, Homo sapiens
cataagattgt

SEQ ID NO: 6709770 - DNA, 18 bp, Homo sapiens
cataagcaagtgagcaga

SEQ ID NO: 6709771 - DNA, 14 bp, Homo sapiens
cataagcaggagtt

SEQ ID NO: 6709772 - DNA, 21 bp, Homo sapiens
cataagcattgctcaagagga

SEQ ID NO: 6709773 - DNA, 17 bp, Homo sapiens
cataagccaatttttct

SEQ ID NO: 6709774 - DNA, 17 bp, Homo sapiens
cataagcctcaggcctg

SEQ ID NO: 6709775 - DNA, 19 bp, Homo sapiens
cataagcggcgtaagttta

SEQ ID NO: 6709776 - DNA, 14 bp, Homo sapiens
cataagctactgcc

SEQ ID NO: 6709777 - DNA, 15 bp, Homo sapiens
cataagctagaaaaa

SEQ ID NO: 6709778 - DNA, 22 bp, Homo sapiens
cataagctatagacccgaggaa

SEQ ID NO: 6709779 - DNA, 20 bp, Homo sapiens
cataagctatttttctaact

SEQ ID NO: 6709780 - DNA, 14 bp, Homo sapiens
cataagctcagaat

SEQ ID NO: 6709781 - DNA, 16 bp, Homo sapiens
cataagctcagaatcc

SEQ ID NO: 6709782 - DNA, 21 bp, Homo sapiens
cataagctgaactaaaataaa

SEQ ID NO: 6709783 - DNA, 18 bp, Homo sapiens
cataagcttatgcttaaa

SEQ ID NO: 6709784 - DNA, 13 bp, Homo sapiens
cataagcttccat

SEQ ID NO: 6709785 - DNA, 16 bp, Homo sapiens
cataagctttttctct

SEQ ID NO: 6709786 - DNA, 21 bp, Homo sapiens
cataaggagttagaaccacag

SEQ ID NO: 6709787 - DNA, 15 bp, Homo sapiens
cataaggatgacttt

SEQ ID NO: 6709788 - DNA, 18 bp, Homo sapiens
cataaggatgactttttt

SEQ ID NO: 6709789 - DNA, 22 bp, Homo sapiens
cataaggcatatacaaataaac

SEQ ID NO: 6709790 - DNA, 21 bp, Homo sapiens
cataaggccagaaactccttt

SEQ ID NO: 6709791 - DNA, 15 bp, Homo sapiens
cataaggcttcaaaa

SEQ ID NO: 6709792 - DNA, 21 bp, Homo sapiens
cataagggacatgtctttggc

SEQ ID NO: 6709793 - DNA, 21 bp, Homo sapiens
cataaggggtttgccatttga

SEQ ID NO: 6709794 - DNA, 22 bp, Homo sapiens
cataaggtctggtaactgcaga

SEQ ID NO: 6709795 - DNA, 15 bp, Homo sapiens
cataaggtttcgttt

SEQ ID NO: 6709796 - DNA, 21 bp, Homo sapiens
cataaggtttcgtttctgtat

SEQ ID NO: 6709797 - DNA, 22 bp, Homo sapiens
cataaggtttcgtttctgtata

SEQ ID NO: 6709798 - DNA, 15 bp, Homo sapiens
cataagtaactttta

SEQ ID NO: 6709799 - DNA, 16 bp, Homo sapiens
cataagtaattcaaga

SEQ ID NO: 6709800 - DNA, 16 bp, Homo sapiens
cataagtatacagttc

SEQ ID NO: 6709801 - DNA, 15 bp, Homo sapiens
cataagtatttcaaa

SEQ ID NO: 6709802 - DNA, 21 bp, Homo sapiens
cataagtccattaactgcttt

SEQ ID NO: 6709803 - DNA, 19 bp, Homo sapiens
cataagtcctttcaattcc

SEQ ID NO: 6709804 - DNA, 16 bp, Homo sapiens
cataagtgaatttata

SEQ ID NO: 6709805 - DNA, 20 bp, Homo sapiens
cataagtggagaaatgaaaa

SEQ ID NO: 6709806 - DNA, 21 bp, Homo sapiens
cataagtggagaaatgaaaag

SEQ ID NO: 6709807 - DNA, 22 bp, Homo sapiens
cataagtggggagagagccctt

SEQ ID NO: 6709808 - DNA, 18 bp, Homo sapiens
cataagttaatagaaagt

SEQ ID NO: 6709809 - DNA, 18 bp, Homo sapiens
cataagttagatgtttta

SEQ ID NO: 6709810 - DNA, 20 bp, Homo sapiens
cataagttatgcctctgaca

SEQ ID NO: 6709811 - DNA, 21 bp, Homo sapiens
cataagttgcatttagaaatc

SEQ ID NO: 6709812 - DNA, 19 bp, Homo sapiens
cataagttggaccagagga

SEQ ID NO: 6709813 - DNA, 17 bp, Homo sapiens
cataagtttgtttaaac

SEQ ID NO: 6709814 - DNA, 14 bp, Homo sapiens
cataagttttctct

SEQ ID NO: 6709815 - DNA, 23 bp, Homo sapiens
cataataaaaaattatgacaatg

SEQ ID NO: 6709816 - DNA, 17 bp, Homo sapiens
cataataaaaaggcaat

SEQ ID NO: 6709817 - DNA, 18 bp, Homo sapiens
cataataaaaggctttga

SEQ ID NO: 6709818 - DNA, 14 bp, Homo sapiens
cataataaagcaat

SEQ ID NO: 6709819 - DNA, 15 bp, Homo sapiens
cataataaagcaatc

SEQ ID NO: 6709820 - DNA, 15 bp, Homo sapiens
cataataaaggttgt

SEQ ID NO: 6709821 - DNA, 18 bp, Homo sapiens
cataataaagtattttct

SEQ ID NO: 6709822 - DNA, 18 bp, Homo sapiens
cataataaagttgtttta

SEQ ID NO: 6709823 - DNA, 19 bp, Homo sapiens
cataataaagttgttttat

SEQ ID NO: 6709824 - DNA, 20 bp, Homo sapiens
cataataaatcacacattca

SEQ ID NO: 6709825 - DNA, 19 bp, Homo sapiens
cataataaattttctaaaa

SEQ ID NO: 6709826 - DNA, 16 bp, Homo sapiens
cataataagtttcata

SEQ ID NO: 6709827 - DNA, 17 bp, Homo sapiens
cataataataatttgca

SEQ ID NO: 6709828 - DNA, 20 bp, Homo sapiens
cataataataatttgcactt

SEQ ID NO: 6709829 - DNA, 18 bp, Homo sapiens
cataatacataaagttct

SEQ ID NO: 6709830 - DNA, 23 bp, Homo sapiens
cataatacattccatcacagcca

SEQ ID NO: 6709831 - DNA, 14 bp, Homo sapiens
cataatactaattt

SEQ ID NO: 6709832 - DNA, 18 bp, Homo sapiens
cataatactgaaccactt

SEQ ID NO: 6709833 - DNA, 12 bp, Homo sapiens
cataatagaatt

SEQ ID NO: 6709834 - DNA, 14 bp, Homo sapiens
cataatagaatttc

SEQ ID NO: 6709835 - DNA, 15 bp, Homo sapiens
cataatagaatttcc

SEQ ID NO: 6709836 - DNA, 22 bp, Homo sapiens
cataatagacttcccactctag

SEQ ID NO: 6709837 - DNA, 20 bp, Homo sapiens
cataatatatgacttcctag

SEQ ID NO: 6709838 - DNA, 22 bp, Homo sapiens
cataatatattgtgttttaaca

SEQ ID NO: 6709839 - DNA, 17 bp, Homo sapiens
cataatatgaagccttt

SEQ ID NO: 6709840 - DNA, 19 bp, Homo sapiens
cataatatgaagcctttgg

SEQ ID NO: 6709841 - DNA, 17 bp, Homo sapiens
cataatatgatgcaaac

SEQ ID NO: 6709842 - DNA, 19 bp, Homo sapiens
cataatatgcatatatatg

SEQ ID NO: 6709843 - DNA, 21 bp, Homo sapiens
cataatatgcatatatatgta

SEQ ID NO: 6709844 - DNA, 14 bp, Homo sapiens
cataatcagtaaat

SEQ ID NO: 6709845 - DNA, 20 bp, Homo sapiens
cataatcatggctcttagaa

SEQ ID NO: 6709846 - DNA, 15 bp, Homo sapiens
cataatcatgtaaat

SEQ ID NO: 6709847 - DNA, 23 bp, Homo sapiens
cataatcatgttagagttacttc

SEQ ID NO: 6709848 - DNA, 18 bp, Homo sapiens
cataatcattcatttcga

SEQ ID NO: 6709849 - DNA, 16 bp, Homo sapiens
cataatctctttccat

SEQ ID NO: 6709850 - DNA, 19 bp, Homo sapiens
cataatctggactcctctg

SEQ ID NO: 6709851 - DNA, 20 bp, Homo sapiens
cataatctggactcctctgt

SEQ ID NO: 6709852 - DNA, 21 bp, Homo sapiens
cataatctggactcctctgtc

SEQ ID NO: 6709853 - DNA, 22 bp, Homo sapiens
cataatgaaaatattttttaca

SEQ ID NO: 6709854 - DNA, 15 bp, Homo sapiens
cataatgaacaattg

SEQ ID NO: 6709855 - DNA, 20 bp, Homo sapiens
cataatgaacagaatttatg

SEQ ID NO: 6709856 - DNA, 20 bp, Homo sapiens
cataatgaaccgtttacagt

SEQ ID NO: 6709857 - DNA, 15 bp, Homo sapiens
cataatgaagacata

SEQ ID NO: 6709858 - DNA, 19 bp, Homo sapiens
cataatgaataaagtgcaa

SEQ ID NO: 6709859 - DNA, 21 bp, Homo sapiens
cataatgagatgtgagccttg

SEQ ID NO: 6709860 - DNA, 22 bp, Homo sapiens
cataatgagatgtgagccttgt

SEQ ID NO: 6709861 - DNA, 23 bp, Homo sapiens
cataatgataaaataaataattt

SEQ ID NO: 6709862 - DNA, 14 bp, Homo sapiens
cataatgatactga

SEQ ID NO: 6709863 - DNA, 12 bp, Homo sapiens
cataatgcaatc

SEQ ID NO: 6709864 - DNA, 16 bp, Homo sapiens
cataatgcaattagat

SEQ ID NO: 6709865 - DNA, 20 bp, Homo sapiens
cataatgcagaagtattctt

SEQ ID NO: 6709866 - DNA, 20 bp, Homo sapiens
cataatgcattcttctctgt

SEQ ID NO: 6709867 - DNA, 22 bp, Homo sapiens
cataatgcattcttctctgttg

SEQ ID NO: 6709868 - DNA, 23 bp, Homo sapiens
cataatgcgtgcataccactttt

SEQ ID NO: 6709869 - DNA, 18 bp, Homo sapiens
cataatgctaatttaaag

SEQ ID NO: 6709870 - DNA, 22 bp, Homo sapiens
cataatgctaatttaaagagac

SEQ ID NO: 6709871 - DNA, 14 bp, Homo sapiens
cataatgctactgt

SEQ ID NO: 6709872 - DNA, 15 bp, Homo sapiens
cataatgctactgtc

SEQ ID NO: 6709873 - DNA, 19 bp, Homo sapiens
cataatgctcccatctcct

SEQ ID NO: 6709874 - DNA, 20 bp, Homo sapiens
cataatgctcccatctcctg

SEQ ID NO: 6709875 - DNA, 15 bp, Homo sapiens
cataatgctttgtta

SEQ ID NO: 6709876 - DNA, 12 bp, Homo sapiens
cataatggtact

SEQ ID NO: 6709877 - DNA, 16 bp, Homo sapiens
cataatggtactccca

SEQ ID NO: 6709878 - DNA, 22 bp, Homo sapiens
cataatggtactcccaaactga

SEQ ID NO: 6709879 - DNA, 17 bp, Homo sapiens
cataatggttgtgaaat

SEQ ID NO: 6709880 - DNA, 20 bp, Homo sapiens
cataatggttgtgaaatgta

SEQ ID NO: 6709881 - DNA, 22 bp, Homo sapiens
cataatgtaactgaagcataaa

SEQ ID NO: 6709882 - DNA, 13 bp, Homo sapiens
cataatgtaattt

SEQ ID NO: 6709883 - DNA, 23 bp, Homo sapiens
cataatgtagtgagtgtagactg

SEQ ID NO: 6709884 - DNA, 17 bp, Homo sapiens
cataatgtccctctctt

SEQ ID NO: 6709885 - DNA, 12 bp, Homo sapiens
cataatgtgaag

SEQ ID NO: 6709886 - DNA, 24 bp, Homo sapiens
cataatgttaagctttattgtgat

SEQ ID NO: 6709887 - DNA, 21 bp, Homo sapiens
cataatgttagtagcactgag

SEQ ID NO: 6709888 - DNA, 15 bp, Homo sapiens
cataatgttctgcta

SEQ ID NO: 6709889 - DNA, 21 bp, Homo sapiens
cataatgtttctggatttcat

SEQ ID NO: 6709890 - DNA, 16 bp, Homo sapiens
cataatgtttttcctt

SEQ ID NO: 6709891 - DNA, 19 bp, Homo sapiens
cataattaaaatttatctt

SEQ ID NO: 6709892 - DNA, 17 bp, Homo sapiens
cataattaaagtgtcca

SEQ ID NO: 6709893 - DNA, 18 bp, Homo sapiens
cataattaaagtgtccat

SEQ ID NO: 6709894 - DNA, 13 bp, Homo sapiens
cataattaaattt

SEQ ID NO: 6709895 - DNA, 18 bp, Homo sapiens
cataattacattcctaac

SEQ ID NO: 6709896 - DNA, 22 bp, Homo sapiens
cataattagaacaatagctatt

SEQ ID NO: 6709897 - DNA, 22 bp, Homo sapiens
cataattagatccattaattta

SEQ ID NO: 6709898 - DNA, 13 bp, Homo sapiens
cataattatgaaa

SEQ ID NO: 6709899 - DNA, 15 bp, Homo sapiens
cataattatgacagt

SEQ ID NO: 6709900 - DNA, 17 bp, Homo sapiens
cataattatgacagtta

SEQ ID NO: 6709901 - DNA, 18 bp, Homo sapiens
cataattattatttggcc

SEQ ID NO: 6709902 - DNA, 17 bp, Homo sapiens
cataattattttgttga

SEQ ID NO: 6709903 - DNA, 14 bp, Homo sapiens
cataattcactctg

SEQ ID NO: 6709904 - DNA, 17 bp, Homo sapiens
cataattcactctgagt

SEQ ID NO: 6709905 - DNA, 16 bp, Homo sapiens
cataattcagatttct

SEQ ID NO: 6709906 - DNA, 16 bp, Homo sapiens
cataattcatagtgat

SEQ ID NO: 6709907 - DNA, 14 bp, Homo sapiens
cataattcatttaa

SEQ ID NO: 6709908 - DNA, 22 bp, Homo sapiens
cataattccgaaacaaaactgt

SEQ ID NO: 6709909 - DNA, 21 bp, Homo sapiens
cataattctaatctaacaatg

SEQ ID NO: 6709910 - DNA, 19 bp, Homo sapiens
cataattcttccttccctc

SEQ ID NO: 6709911 - DNA, 14 bp, Homo sapiens
cataattgaagtgt

SEQ ID NO: 6709912 - DNA, 22 bp, Homo sapiens
cataattgattaaaatctcttg

SEQ ID NO: 6709913 - DNA, 19 bp, Homo sapiens
cataattgcaagggaagag

SEQ ID NO: 6709914 - DNA, 16 bp, Homo sapiens
cataattgcatgaaaa

SEQ ID NO: 6709915 - DNA, 16 bp, Homo sapiens
cataattgccaataat

SEQ ID NO: 6709916 - DNA, 16 bp, Homo sapiens
cataattgcctacatt

SEQ ID NO: 6709917 - DNA, 14 bp, Homo sapiens
cataattgtgacca

SEQ ID NO: 6709918 - DNA, 21 bp, Homo sapiens
cataattgtgaccaatacatt

SEQ ID NO: 6709919 - DNA, 22 bp, Homo sapiens
cataattgtgaccaatacattt

SEQ ID NO: 6709920 - DNA, 23 bp, Homo sapiens
cataattgttgtggtttaaatac

SEQ ID NO: 6709921 - DNA, 14 bp, Homo sapiens
cataatttaaaaat

SEQ ID NO: 6709922 - DNA, 15 bp, Homo sapiens
cataatttaaaaata

SEQ ID NO: 6709923 - DNA, 15 bp, Homo sapiens
cataatttaaaataa

SEQ ID NO: 6709924 - DNA, 17 bp, Homo sapiens
cataatttaaaataaat

SEQ ID NO: 6709925 - DNA, 23 bp, Homo sapiens
cataatttgctggagaagtgtgt

SEQ ID NO: 6709926 - DNA, 12 bp, Homo sapiens
cataatttggtc

SEQ ID NO: 6709927 - DNA, 15 bp, Homo sapiens
cataatttgtacata

SEQ ID NO: 6709928 - DNA, 23 bp, Homo sapiens
cataatttgtacatatgtaaaat

SEQ ID NO: 6709929 - DNA, 18 bp, Homo sapiens
cataatttgtttaaaatt

SEQ ID NO: 6709930 - DNA, 14 bp, Homo sapiens
cataatttgtttcc

SEQ ID NO: 6709931 - DNA, 12 bp, Homo sapiens
cataattttcaa

SEQ ID NO: 6709932 - DNA, 22 bp, Homo sapiens
cataattttcaagagaagaaaa

SEQ ID NO: 6709933 - DNA, 14 bp, Homo sapiens
cataattttgcata

SEQ ID NO: 6709934 - DNA, 13 bp, Homo sapiens
cataattttgtgt

SEQ ID NO: 6709935 - DNA, 17 bp, Homo sapiens
cataattttgtgttgta

SEQ ID NO: 6709936 - DNA, 22 bp, Homo sapiens
cataatttttatttttggcaaa

SEQ ID NO: 6709937 - DNA, 14 bp, Homo sapiens
cataatttttgtac

SEQ ID NO: 6709938 - DNA, 15 bp, Homo sapiens
cataatttttgtaca

SEQ ID NO: 6709939 - DNA, 18 bp, Homo sapiens
cataattttttttaaaga

SEQ ID NO: 6709940 - DNA, 19 bp, Homo sapiens
catacaaaaattagccggg

SEQ ID NO: 6709941 - DNA, 23 bp, Homo sapiens
catacaaaatatttaagtgaagg

SEQ ID NO: 6709942 - DNA, 16 bp, Homo sapiens
catacaaaccatgatt

SEQ ID NO: 6709943 - DNA, 20 bp, Homo sapiens
catacaaatatatgtatata

SEQ ID NO: 6709944 - DNA, 21 bp, Homo sapiens
catacaaatctcactgtatta

SEQ ID NO: 6709945 - DNA, 22 bp, Homo sapiens
catacaaatgcatctttgatgt

SEQ ID NO: 6709946 - DNA, 13 bp, Homo sapiens
catacaaatttat

SEQ ID NO: 6709947 - DNA, 17 bp, Homo sapiens
catacaacacaaagaga

SEQ ID NO: 6709948 - DNA, 14 bp, Homo sapiens
catacaacagaggg

SEQ ID NO: 6709949 - DNA, 20 bp, Homo sapiens
catacaaggacattcactgc

SEQ ID NO: 6709950 - DNA, 18 bp, Homo sapiens
catacaagggggtaactc

SEQ ID NO: 6709951 - DNA, 21 bp, Homo sapiens
catacaagtcatggtcacagt

SEQ ID NO: 6709952 - DNA, 12 bp, Homo sapiens
catacaataaaa

SEQ ID NO: 6709953 - DNA, 15 bp, Homo sapiens
catacaataaaagag

SEQ ID NO: 6709954 - DNA, 20 bp, Homo sapiens
catacaataaaagagcttta

SEQ ID NO: 6709955 - DNA, 21 bp, Homo sapiens
catacaatcgtcttaagtttt

SEQ ID NO: 6709956 - DNA, 14 bp, Homo sapiens
catacaatgtatgt

SEQ ID NO: 6709957 - DNA, 21 bp, Homo sapiens
catacacaacgtaatcaaata

SEQ ID NO: 6709958 - DNA, 22 bp, Homo sapiens
catacacaagcgtgtcaggctg

SEQ ID NO: 6709959 - DNA, 19 bp, Homo sapiens
catacacaaggccagaaaa

SEQ ID NO: 6709960 - DNA, 20 bp, Homo sapiens
catacacaaggccagaaaaa

SEQ ID NO: 6709961 - DNA, 22 bp, Homo sapiens
catacacaaggccagaaaaaga

SEQ ID NO: 6709962 - DNA, 12 bp, Homo sapiens
catacacacaca

SEQ ID NO: 6709963 - DNA, 14 bp, Homo sapiens
catacacacacaca

SEQ ID NO: 6709964 - DNA, 15 bp, Homo sapiens
catacacacacacac

SEQ ID NO: 6709965 - DNA, 20 bp, Homo sapiens
catacacacacacacacaaa

SEQ ID NO: 6709966 - DNA, 19 bp, Homo sapiens
catacacacacacacacag

SEQ ID NO: 6709967 - DNA, 14 bp, Homo sapiens
catacacacagcag

SEQ ID NO: 6709968 - DNA, 15 bp, Homo sapiens
catacacacagcagt

SEQ ID NO: 6709969 - DNA, 16 bp, Homo sapiens
catacacacgctgcct

SEQ ID NO: 6709970 - DNA, 20 bp, Homo sapiens
catacacagaaatcctaaca

SEQ ID NO: 6709971 - DNA, 16 bp, Homo sapiens
catacaccaaacattt

SEQ ID NO: 6709972 - DNA, 14 bp, Homo sapiens
catacaccagaaga

SEQ ID NO: 6709973 - DNA, 14 bp, Homo sapiens
catacaccagcatt

SEQ ID NO: 6709974 - DNA, 22 bp, Homo sapiens
catacacccccacctcctgcaa

SEQ ID NO: 6709975 - DNA, 23 bp, Homo sapiens
catacaccccctcttctgagcac

SEQ ID NO: 6709976 - DNA, 19 bp, Homo sapiens
catacacctcgtcaagagc

SEQ ID NO: 6709977 - DNA, 20 bp, Homo sapiens
catacaccttgctaacctaa

SEQ ID NO: 6709978 - DNA, 18 bp, Homo sapiens
catacacgttaactgcag

SEQ ID NO: 6709979 - DNA, 21 bp, Homo sapiens
catacactgtagtttttgaaa

SEQ ID NO: 6709980 - DNA, 14 bp, Homo sapiens
catacactgtgaac

SEQ ID NO: 6709981 - DNA, 23 bp, Homo sapiens
catacacttattggaactctgct

SEQ ID NO: 6709982 - DNA, 19 bp, Homo sapiens
catacacttgtataaatgt

SEQ ID NO: 6709983 - DNA, 20 bp, Homo sapiens
catacacttgtataaatgta

SEQ ID NO: 6709984 - DNA, 13 bp, Homo sapiens
catacagacagca

SEQ ID NO: 6709985 - DNA, 11 bp, Homo sapiens
catacagagaa

SEQ ID NO: 6709986 - DNA, 15 bp, Homo sapiens
catacagagaagtca

SEQ ID NO: 6709987 - DNA, 17 bp, Homo sapiens
catacagaggtaactat

SEQ ID NO: 6709988 - DNA, 14 bp, Homo sapiens
catacagatggtgt

SEQ ID NO: 6709989 - DNA, 23 bp, Homo sapiens
catacagcacaatgttattacct

SEQ ID NO: 6709990 - DNA, 18 bp, Homo sapiens
catacagcattacaaatt

SEQ ID NO: 6709991 - DNA, 12 bp, Homo sapiens
catacagctcta

SEQ ID NO: 6709992 - DNA, 14 bp, Homo sapiens
catacagctgccta

SEQ ID NO: 6709993 - DNA, 17 bp, Homo sapiens
catacagctgcctacct

SEQ ID NO: 6709994 - DNA, 23 bp, Homo sapiens
catacaggaaggtagaaatatct

SEQ ID NO: 6709995 - DNA, 22 bp, Homo sapiens
catacaggttaacctgcagaaa

SEQ ID NO: 6709996 - DNA, 19 bp, Homo sapiens
catacagtctctatttgat

SEQ ID NO: 6709997 - DNA, 11 bp, Homo sapiens
catacagtttt

SEQ ID NO: 6709998 - DNA, 16 bp, Homo sapiens
catacataatatatga

SEQ ID NO: 6709999 - DNA, 22 bp, Homo sapiens
catacataatgtttttcctttc

SEQ ID NO: 6710000 - DNA, 15 bp, Homo sapiens
catacatacatacaa

SEQ ID NO: 6710001 - DNA, 18 bp, Homo sapiens
catacatacatacataca

SEQ ID NO: 6710002 - DNA, 17 bp, Homo sapiens
catacatacatatatat

SEQ ID NO: 6710003 - DNA, 16 bp, Homo sapiens
catacatatatacatt

SEQ ID NO: 6710004 - DNA, 19 bp, Homo sapiens
catacatatatatatttgt

SEQ ID NO: 6710005 - DNA, 14 bp, Homo sapiens
catacatatatatc

SEQ ID NO: 6710006 - DNA, 15 bp, Homo sapiens
catacatatgtagaa

SEQ ID NO: 6710007 - DNA, 21 bp, Homo sapiens
catacatcagttattcattct

SEQ ID NO: 6710008 - DNA, 16 bp, Homo sapiens
catacatccctcagtt

SEQ ID NO: 6710009 - DNA, 22 bp, Homo sapiens
catacatcctgctttccctccc

SEQ ID NO: 6710010 - DNA, 16 bp, Homo sapiens
catacatgaataaaaa

SEQ ID NO: 6710011 - DNA, 18 bp, Homo sapiens
catacatgatacattttt

SEQ ID NO: 6710012 - DNA, 14 bp, Homo sapiens
catacatgctactt

SEQ ID NO: 6710013 - DNA, 15 bp, Homo sapiens
catacatgttattgt

SEQ ID NO: 6710014 - DNA, 17 bp, Homo sapiens
catacatgttattgttt

SEQ ID NO: 6710015 - DNA, 23 bp, Homo sapiens
catacattaaggagcagggtcct

SEQ ID NO: 6710016 - DNA, 11 bp, Homo sapiens
catacattata

SEQ ID NO: 6710017 - DNA, 13 bp, Homo sapiens
catacattatatt

SEQ ID NO: 6710018 - DNA, 21 bp, Homo sapiens
catacattccctctaatttga

SEQ ID NO: 6710019 - DNA, 23 bp, Homo sapiens
catacattgtataggccatctgt

SEQ ID NO: 6710020 - DNA, 21 bp, Homo sapiens
catacatttataatgtttgct

SEQ ID NO: 6710021 - DNA, 24 bp, Homo sapiens
catacatttataatgtttgctatt

SEQ ID NO: 6710022 - DNA, 16 bp, Homo sapiens
catacattttctaaga

SEQ ID NO: 6710023 - DNA, 15 bp, Homo sapiens
catacattttctggt

SEQ ID NO: 6710024 - DNA, 22 bp, Homo sapiens
cataccaaagctgctgcacagc

SEQ ID NO: 6710025 - DNA, 22 bp, Homo sapiens
cataccactttgacacgcttca

SEQ ID NO: 6710026 - DNA, 23 bp, Homo sapiens
cataccagaaagctctacatttg

SEQ ID NO: 6710027 - DNA, 13 bp, Homo sapiens
cataccaggcaac

SEQ ID NO: 6710028 - DNA, 18 bp, Homo sapiens
cataccaggcaacctccc

SEQ ID NO: 6710029 - DNA, 22 bp, Homo sapiens
cataccaggcaacctcccatcc

SEQ ID NO: 6710030 - DNA, 23 bp, Homo sapiens
cataccagggtgagttaaagaga

SEQ ID NO: 6710031 - DNA, 19 bp, Homo sapiens
cataccatctgctgccccg

SEQ ID NO: 6710032 - DNA, 18 bp, Homo sapiens
cataccatggaggaaggc

SEQ ID NO: 6710033 - DNA, 18 bp, Homo sapiens
catacccacaatctgagc

SEQ ID NO: 6710034 - DNA, 18 bp, Homo sapiens
catacccacacattccag

SEQ ID NO: 6710035 - DNA, 20 bp, Homo sapiens
catacccacacattccaggg

SEQ ID NO: 6710036 - DNA, 21 bp, Homo sapiens
catacccacccccacccaagg

SEQ ID NO: 6710037 - DNA, 15 bp, Homo sapiens
catacccatgcacag

SEQ ID NO: 6710038 - DNA, 14 bp, Homo sapiens
cataccccctgccc

SEQ ID NO: 6710039 - DNA, 14 bp, Homo sapiens
catacccctgcctg

SEQ ID NO: 6710040 - DNA, 16 bp, Homo sapiens
catacccctgcctggg

SEQ ID NO: 6710041 - DNA, 21 bp, Homo sapiens
cataccccttattgctgccaa

SEQ ID NO: 6710042 - DNA, 19 bp, Homo sapiens
catacccgcctagctgctg

SEQ ID NO: 6710043 - DNA, 22 bp, Homo sapiens
catacccgcctagctgctgtca

SEQ ID NO: 6710044 - DNA, 19 bp, Homo sapiens
catacccgtgacagtggct

SEQ ID NO: 6710045 - DNA, 18 bp, Homo sapiens
cataccctgacctggccc

SEQ ID NO: 6710046 - DNA, 19 bp, Homo sapiens
cataccctgacctggcccc

SEQ ID NO: 6710047 - DNA, 14 bp, Homo sapiens
catacccttcttta

SEQ ID NO: 6710048 - DNA, 20 bp, Homo sapiens
cataccgcctcgtgccagca

SEQ ID NO: 6710049 - DNA, 17 bp, Homo sapiens
catacctaagtactgta

SEQ ID NO: 6710050 - DNA, 14 bp, Homo sapiens
catacctaccagta

SEQ ID NO: 6710051 - DNA, 17 bp, Homo sapiens
catacctaccagtatta

SEQ ID NO: 6710052 - DNA, 22 bp, Homo sapiens
catacctcagaatgtaaaagaa

SEQ ID NO: 6710053 - DNA, 20 bp, Homo sapiens
catacctcagataatatgtt

SEQ ID NO: 6710054 - DNA, 15 bp, Homo sapiens
catacctggccctgt

SEQ ID NO: 6710055 - DNA, 19 bp, Homo sapiens
cataccttagactgaaaaa

SEQ ID NO: 6710056 - DNA, 18 bp, Homo sapiens
cataccttccttccctgg

SEQ ID NO: 6710057 - DNA, 21 bp, Homo sapiens
cataccttccttccctgggct

SEQ ID NO: 6710058 - DNA, 23 bp, Homo sapiens
cataccttccttccctgggctgt

SEQ ID NO: 6710059 - DNA, 20 bp, Homo sapiens
cataccttgagaccaagccg

SEQ ID NO: 6710060 - DNA, 15 bp, Homo sapiens
cataccttggactga

SEQ ID NO: 6710061 - DNA, 22 bp, Homo sapiens
cataccttggactgactaccag

SEQ ID NO: 6710062 - DNA, 22 bp, Homo sapiens
cataccttttattttttttaat

SEQ ID NO: 6710063 - DNA, 18 bp, Homo sapiens
catacgcaattgtatata

SEQ ID NO: 6710064 - DNA, 23 bp, Homo sapiens
catacgcaattgtatatatatgt

SEQ ID NO: 6710065 - DNA, 15 bp, Homo sapiens
catacgcactgggca

SEQ ID NO: 6710066 - DNA, 18 bp, Homo sapiens
catacgcatcccatctct

SEQ ID NO: 6710067 - DNA, 21 bp, Homo sapiens
catacgcattaagggcctgct

SEQ ID NO: 6710068 - DNA, 22 bp, Homo sapiens
catacgcattaagggcctgctg

SEQ ID NO: 6710069 - DNA, 17 bp, Homo sapiens
catacgctcagctcatc

SEQ ID NO: 6710070 - DNA, 19 bp, Homo sapiens
catacgctctcgtctctcg

SEQ ID NO: 6710071 - DNA, 19 bp, Homo sapiens
catacggtcaggtttaaca

SEQ ID NO: 6710072 - DNA, 14 bp, Homo sapiens
catacgtaaaaatc

SEQ ID NO: 6710073 - DNA, 17 bp, Homo sapiens
catacgtacacatttta

SEQ ID NO: 6710074 - DNA, 18 bp, Homo sapiens
catacgtacacattttat

SEQ ID NO: 6710075 - DNA, 16 bp, Homo sapiens
catacgtgcacagggt

SEQ ID NO: 6710076 - DNA, 19 bp, Homo sapiens
catacgtgcccatttcaca

SEQ ID NO: 6710077 - DNA, 22 bp, Homo sapiens
catacgtggaaacaatcctgtt

SEQ ID NO: 6710078 - DNA, 16 bp, Homo sapiens
catacgtgtgcatgtg

SEQ ID NO: 6710079 - DNA, 13 bp, Homo sapiens
catacgtttaaaa

SEQ ID NO: 6710080 - DNA, 14 bp, Homo sapiens
catactaaactgat

SEQ ID NO: 6710081 - DNA, 14 bp, Homo sapiens
catactaaccagca

SEQ ID NO: 6710082 - DNA, 21 bp, Homo sapiens
catactaaccagcagaaatgc

SEQ ID NO: 6710083 - DNA, 23 bp, Homo sapiens
catactaccctttgctggaagaa

SEQ ID NO: 6710084 - DNA, 13 bp, Homo sapiens
catactaggtgcc

SEQ ID NO: 6710085 - DNA, 15 bp, Homo sapiens
catactatagattct

SEQ ID NO: 6710086 - DNA, 18 bp, Homo sapiens
catactatctactctcct

SEQ ID NO: 6710087 - DNA, 14 bp, Homo sapiens
catactattaaaca

SEQ ID NO: 6710088 - DNA, 15 bp, Homo sapiens
catactcaaatggtg

SEQ ID NO: 6710089 - DNA, 23 bp, Homo sapiens
catactcaaggtgagaattaagt

SEQ ID NO: 6710090 - DNA, 14 bp, Homo sapiens
catactcagcctgc

SEQ ID NO: 6710091 - DNA, 17 bp, Homo sapiens
catactcagcctgctgc

SEQ ID NO: 6710092 - DNA, 19 bp, Homo sapiens
catactcagcctgctgccc

SEQ ID NO: 6710093 - DNA, 21 bp, Homo sapiens
catactcagcctgctgcccag

SEQ ID NO: 6710094 - DNA, 14 bp, Homo sapiens
catactcatgcatg

SEQ ID NO: 6710095 - DNA, 22 bp, Homo sapiens
catactcatttttcatgataat

SEQ ID NO: 6710096 - DNA, 15 bp, Homo sapiens
catactccactccaa

SEQ ID NO: 6710097 - DNA, 15 bp, Homo sapiens
catactcccatctgt

SEQ ID NO: 6710098 - DNA, 16 bp, Homo sapiens
catactcccatctgtg

SEQ ID NO: 6710099 - DNA, 23 bp, Homo sapiens
catactccgtgaggctgctgcca

SEQ ID NO: 6710100 - DNA, 18 bp, Homo sapiens
catactcctatgctttag

SEQ ID NO: 6710101 - DNA, 18 bp, Homo sapiens
catactcctgggctcaag

SEQ ID NO: 6710102 - DNA, 15 bp, Homo sapiens
catactcgagtctga

SEQ ID NO: 6710103 - DNA, 24 bp, Homo sapiens
catactctccaggattgtccacaa

SEQ ID NO: 6710104 - DNA, 14 bp, Homo sapiens
catactctcctttt

SEQ ID NO: 6710105 - DNA, 14 bp, Homo sapiens
catactctctgcct

SEQ ID NO: 6710106 - DNA, 19 bp, Homo sapiens
catactctctgcctggtgg

SEQ ID NO: 6710107 - DNA, 15 bp, Homo sapiens
catactctgtctccc

SEQ ID NO: 6710108 - DNA, 15 bp, Homo sapiens
catactcttaagtgt

SEQ ID NO: 6710109 - DNA, 17 bp, Homo sapiens
catactgaaaaaaaaag

SEQ ID NO: 6710110 - DNA, 16 bp, Homo sapiens
catactgaaaatccaa

SEQ ID NO: 6710111 - DNA, 17 bp, Homo sapiens
catactgaaaatccaat

SEQ ID NO: 6710112 - DNA, 18 bp, Homo sapiens
catactgagaatatacaa

SEQ ID NO: 6710113 - DNA, 12 bp, Homo sapiens
catactgagcct

SEQ ID NO: 6710114 - DNA, 19 bp, Homo sapiens
catactgagggaccaactg

SEQ ID NO: 6710115 - DNA, 18 bp, Homo sapiens
catactgatgagacaaca

SEQ ID NO: 6710116 - DNA, 23 bp, Homo sapiens
catactgatgccctgaggcactg

SEQ ID NO: 6710117 - DNA, 16 bp, Homo sapiens
catactgcatgtaagc

SEQ ID NO: 6710118 - DNA, 16 bp, Homo sapiens
catactgcctactgtt

SEQ ID NO: 6710119 - DNA, 16 bp, Homo sapiens
catactgccttgttta

SEQ ID NO: 6710120 - DNA, 16 bp, Homo sapiens
catactgcgtccaccc

SEQ ID NO: 6710121 - DNA, 16 bp, Homo sapiens
catactggcctcgcct

SEQ ID NO: 6710122 - DNA, 17 bp, Homo sapiens
catactggcctcgcctg

SEQ ID NO: 6710123 - DNA, 17 bp, Homo sapiens
catactggcttcaccat

SEQ ID NO: 6710124 - DNA, 17 bp, Homo sapiens
catactggtctcacagt

SEQ ID NO: 6710125 - DNA, 12 bp, Homo sapiens
catactgtacac

SEQ ID NO: 6710126 - DNA, 13 bp, Homo sapiens
catactgtacaca

SEQ ID NO: 6710127 - DNA, 16 bp, Homo sapiens
catactgtacacattt

SEQ ID NO: 6710128 - DNA, 18 bp, Homo sapiens
catactgtacacatttct

SEQ ID NO: 6710129 - DNA, 19 bp, Homo sapiens
catactgtacacatttctt

SEQ ID NO: 6710130 - DNA, 20 bp, Homo sapiens
catactgtacacatttctta

SEQ ID NO: 6710131 - DNA, 21 bp, Homo sapiens
catactgtacacatttcttaa

SEQ ID NO: 6710132 - DNA, 18 bp, Homo sapiens
catactgtagacactctg

SEQ ID NO: 6710133 - DNA, 19 bp, Homo sapiens
catactgtagacactctga

SEQ ID NO: 6710134 - DNA, 17 bp, Homo sapiens
catactgtgctggagcc

SEQ ID NO: 6710135 - DNA, 13 bp, Homo sapiens
catactgtgtatg

SEQ ID NO: 6710136 - DNA, 16 bp, Homo sapiens
catactgtgtatgttt

SEQ ID NO: 6710137 - DNA, 19 bp, Homo sapiens
catactgtgtatgttttat

SEQ ID NO: 6710138 - DNA, 12 bp, Homo sapiens
catactgttgat

SEQ ID NO: 6710139 - DNA, 17 bp, Homo sapiens
catactgttgatacaaa

SEQ ID NO: 6710140 - DNA, 19 bp, Homo sapiens
catactgttgatacaaacc

SEQ ID NO: 6710141 - DNA, 12 bp, Homo sapiens
catactgtttaa

SEQ ID NO: 6710142 - DNA, 23 bp, Homo sapiens
catactgtttaatatttatagag

SEQ ID NO: 6710143 - DNA, 19 bp, Homo sapiens
catacttaacatttcattg

SEQ ID NO: 6710144 - DNA, 13 bp, Homo sapiens
catacttaacttt

SEQ ID NO: 6710145 - DNA, 14 bp, Homo sapiens
catacttaacttta

SEQ ID NO: 6710146 - DNA, 14 bp, Homo sapiens
catacttacctagt

SEQ ID NO: 6710147 - DNA, 18 bp, Homo sapiens
catacttacctagtgaaa

SEQ ID NO: 6710148 - DNA, 16 bp, Homo sapiens
catacttatctctctg

SEQ ID NO: 6710149 - DNA, 16 bp, Homo sapiens
catacttcaaaagtat

SEQ ID NO: 6710150 - DNA, 18 bp, Homo sapiens
catacttcaaaagtattt

SEQ ID NO: 6710151 - DNA, 17 bp, Homo sapiens
catacttccagcgaaat

SEQ ID NO: 6710152 - DNA, 12 bp, Homo sapiens
catacttcctgg

SEQ ID NO: 6710153 - DNA, 17 bp, Homo sapiens
catacttgaagggccag

SEQ ID NO: 6710154 - DNA, 18 bp, Homo sapiens
catacttgaagggccaga

SEQ ID NO: 6710155 - DNA, 23 bp, Homo sapiens
catacttgaagggccagagccag

SEQ ID NO: 6710156 - DNA, 21 bp, Homo sapiens
catacttgctccttgaataag

SEQ ID NO: 6710157 - DNA, 14 bp, Homo sapiens
catacttgtgaaac

SEQ ID NO: 6710158 - DNA, 17 bp, Homo sapiens
catacttgtgaaacgtc

SEQ ID NO: 6710159 - DNA, 17 bp, Homo sapiens
catactttaagtaggga

SEQ ID NO: 6710160 - DNA, 23 bp, Homo sapiens
catactttatatatgtacataca

SEQ ID NO: 6710161 - DNA, 17 bp, Homo sapiens
catactttatcaatgtg

SEQ ID NO: 6710162 - DNA, 21 bp, Homo sapiens
catactttcatcctgactctg

SEQ ID NO: 6710163 - DNA, 22 bp, Homo sapiens
catactttcatcctgactctgc

SEQ ID NO: 6710164 - DNA, 12 bp, Homo sapiens
catactttctct

SEQ ID NO: 6710165 - DNA, 22 bp, Homo sapiens
catactttgacaaggaaaatct

SEQ ID NO: 6710166 - DNA, 16 bp, Homo sapiens
catactttgtattttg

SEQ ID NO: 6710167 - DNA, 19 bp, Homo sapiens
catactttgttaggaaggg

SEQ ID NO: 6710168 - DNA, 13 bp, Homo sapiens
catacttttcaaa

SEQ ID NO: 6710169 - DNA, 11 bp, Homo sapiens
catacttttct

SEQ ID NO: 6710170 - DNA, 12 bp, Homo sapiens
catacttttctt

SEQ ID NO: 6710171 - DNA, 23 bp, Homo sapiens
catagaaaaatgtataaaaatta

SEQ ID NO: 6710172 - DNA, 13 bp, Homo sapiens
catagaaaaggcg

SEQ ID NO: 6710173 - DNA, 14 bp, Homo sapiens
catagaaacatgac

SEQ ID NO: 6710174 - DNA, 18 bp, Homo sapiens
catagaaacatgacactg

SEQ ID NO: 6710175 - DNA, 18 bp, Homo sapiens
catagaaaccactagaaa

SEQ ID NO: 6710176 - DNA, 21 bp, Homo sapiens
catagaaacgacaaatcacca

SEQ ID NO: 6710177 - DNA, 23 bp, Homo sapiens
catagaaactgaggagtagctga

SEQ ID NO: 6710178 - DNA, 13 bp, Homo sapiens
catagaaagacat

SEQ ID NO: 6710179 - DNA, 20 bp, Homo sapiens
catagaaagagtctgaccct

SEQ ID NO: 6710180 - DNA, 23 bp, Homo sapiens
catagaaagtaaataaaaggact

SEQ ID NO: 6710181 - DNA, 22 bp, Homo sapiens
catagaaatgtaggtcctcaga

SEQ ID NO: 6710182 - DNA, 22 bp, Homo sapiens
catagaaattgcctccagtcca

SEQ ID NO: 6710183 - DNA, 14 bp, Homo sapiens
catagaaattgtgt

SEQ ID NO: 6710184 - DNA, 18 bp, Homo sapiens
catagaactgaactgtaa

SEQ ID NO: 6710185 - DNA, 14 bp, Homo sapiens
catagaactgggta

SEQ ID NO: 6710186 - DNA, 19 bp, Homo sapiens
catagaactgggtaaatgc

SEQ ID NO: 6710187 - DNA, 23 bp, Homo sapiens
catagaactgggtaaatgcaaag

SEQ ID NO: 6710188 - DNA, 23 bp, Homo sapiens
catagaactgtcccacaaaatat

SEQ ID NO: 6710189 - DNA, 15 bp, Homo sapiens
catagaagccacatc

SEQ ID NO: 6710190 - DNA, 22 bp, Homo sapiens
catagaaggaagtgtgtttgcc

SEQ ID NO: 6710191 - DNA, 23 bp, Homo sapiens
catagaaggaagtgtgtttgcct

SEQ ID NO: 6710192 - DNA, 21 bp, Homo sapiens
catagaaggagagcccaggcc

SEQ ID NO: 6710193 - DNA, 21 bp, Homo sapiens
catagaaggaggagagggaaa

SEQ ID NO: 6710194 - DNA, 20 bp, Homo sapiens
catagaagggagggaataaa

SEQ ID NO: 6710195 - DNA, 18 bp, Homo sapiens
catagaagttaaaggtta

SEQ ID NO: 6710196 - DNA, 14 bp, Homo sapiens
catagaataaaatt

SEQ ID NO: 6710197 - DNA, 20 bp, Homo sapiens
catagaataaaatttttaat

SEQ ID NO: 6710198 - DNA, 18 bp, Homo sapiens
catagaataacaactgct

SEQ ID NO: 6710199 - DNA, 16 bp, Homo sapiens
catagaatagcatgtt

SEQ ID NO: 6710200 - DNA, 21 bp, Homo sapiens
catagaatagcatgttgtaga

SEQ ID NO: 6710201 - DNA, 17 bp, Homo sapiens
catagaattaattttca

SEQ ID NO: 6710202 - DNA, 18 bp, Homo sapiens
catagaattctagctttt

SEQ ID NO: 6710203 - DNA, 13 bp, Homo sapiens
catagacaaaggc

SEQ ID NO: 6710204 - DNA, 20 bp, Homo sapiens
catagacaaaggccttaaca

SEQ ID NO: 6710205 - DNA, 15 bp, Homo sapiens
catagacaagtgttt

SEQ ID NO: 6710206 - DNA, 19 bp, Homo sapiens
catagacaattcctccaga

SEQ ID NO: 6710207 - DNA, 15 bp, Homo sapiens
catagacagaagaaa

SEQ ID NO: 6710208 - DNA, 20 bp, Homo sapiens
catagacagaagaaacaagg

SEQ ID NO: 6710209 - DNA, 21 bp, Homo sapiens
catagacatcagtattctgcc

SEQ ID NO: 6710210 - DNA, 13 bp, Homo sapiens
catagacatgaaa

SEQ ID NO: 6710211 - DNA, 15 bp, Homo sapiens
catagaccctctcaa

SEQ ID NO: 6710212 - DNA, 19 bp, Homo sapiens
catagacctacagacctgg

SEQ ID NO: 6710213 - DNA, 15 bp, Homo sapiens
catagactagagaaa

SEQ ID NO: 6710214 - DNA, 16 bp, Homo sapiens
catagactgaagattt

SEQ ID NO: 6710215 - DNA, 14 bp, Homo sapiens
catagactgcaaaa

SEQ ID NO: 6710216 - DNA, 20 bp, Homo sapiens
catagacttatattttataa

SEQ ID NO: 6710217 - DNA, 19 bp, Homo sapiens
catagactttatgcaataa

SEQ ID NO: 6710218 - DNA, 14 bp, Homo sapiens
catagagaaacctg

SEQ ID NO: 6710219 - DNA, 17 bp, Homo sapiens
catagagaacaaagtaa

SEQ ID NO: 6710220 - DNA, 16 bp, Homo sapiens
catagagaatacacat

SEQ ID NO: 6710221 - DNA, 18 bp, Homo sapiens
catagagacttgggaatg

SEQ ID NO: 6710222 - DNA, 19 bp, Homo sapiens
catagagagcaagacgctg

SEQ ID NO: 6710223 - DNA, 21 bp, Homo sapiens
catagagagcaagacgctgtg

SEQ ID NO: 6710224 - DNA, 23 bp, Homo sapiens
catagagagcaagacgctgtgct

SEQ ID NO: 6710225 - DNA, 17 bp, Homo sapiens
catagagatctattttt

SEQ ID NO: 6710226 - DNA, 13 bp, Homo sapiens
catagagatgagc

SEQ ID NO: 6710227 - DNA, 15 bp, Homo sapiens
catagagatgagccc

SEQ ID NO: 6710228 - DNA, 16 bp, Homo sapiens
catagagcaatgttgg

SEQ ID NO: 6710229 - DNA, 12 bp, Homo sapiens
catagagcaatt

SEQ ID NO: 6710230 - DNA, 14 bp, Homo sapiens
catagagcagcact

SEQ ID NO: 6710231 - DNA, 13 bp, Homo sapiens
catagagccctgg

SEQ ID NO: 6710232 - DNA, 19 bp, Homo sapiens
catagagccctggccagcc

SEQ ID NO: 6710233 - DNA, 21 bp, Homo sapiens
catagagccctggccagccct

SEQ ID NO: 6710234 - DNA, 13 bp, Homo sapiens
catagagcttttt

SEQ ID NO: 6710235 - DNA, 13 bp, Homo sapiens
catagaggcccag

SEQ ID NO: 6710236 - DNA, 15 bp, Homo sapiens
catagaggcccaggc

SEQ ID NO: 6710237 - DNA, 16 bp, Homo sapiens
catagaggcccaggca

SEQ ID NO: 6710238 - DNA, 17 bp, Homo sapiens
catagaggcccaggcac

SEQ ID NO: 6710239 - DNA, 12 bp, Homo sapiens
catagaggcttc

SEQ ID NO: 6710240 - DNA, 19 bp, Homo sapiens
catagagggagaggaagca

SEQ ID NO: 6710241 - DNA, 22 bp, Homo sapiens
catagagggagaggaagcacac

SEQ ID NO: 6710242 - DNA, 14 bp, Homo sapiens
catagagtacactg

SEQ ID NO: 6710243 - DNA, 15 bp, Homo sapiens
catagagtacactgc

SEQ ID NO: 6710244 - DNA, 18 bp, Homo sapiens
catagagtacactgcctg

SEQ ID NO: 6710245 - DNA, 19 bp, Homo sapiens
catagagtaggtactccat

SEQ ID NO: 6710246 - DNA, 21 bp, Homo sapiens
catagataaaacatctttgaa

SEQ ID NO: 6710247 - DNA, 22 bp, Homo sapiens
catagataatattgtttggtaa

SEQ ID NO: 6710248 - DNA, 18 bp, Homo sapiens
catagataccattttgaa

SEQ ID NO: 6710249 - DNA, 21 bp, Homo sapiens
catagataccattttgaaata

SEQ ID NO: 6710250 - DNA, 22 bp, Homo sapiens
catagataccattttgaaatat

SEQ ID NO: 6710251 - DNA, 15 bp, Homo sapiens
catagatcagccatt

SEQ ID NO: 6710252 - DNA, 21 bp, Homo sapiens
catagatcagccattaaaata

SEQ ID NO: 6710253 - DNA, 23 bp, Homo sapiens
catagatcagccattaaaataaa

SEQ ID NO: 6710254 - DNA, 14 bp, Homo sapiens
catagatgcctggg

SEQ ID NO: 6710255 - DNA, 18 bp, Homo sapiens
catagatgtatcattaat

SEQ ID NO: 6710256 - DNA, 23 bp, Homo sapiens
catagatgtccctttcttggcca

SEQ ID NO: 6710257 - DNA, 17 bp, Homo sapiens
catagattaatggcact

SEQ ID NO: 6710258 - DNA, 22 bp, Homo sapiens
catagattcacctgtaaaactt

SEQ ID NO: 6710259 - DNA, 23 bp, Homo sapiens
catagattcacctgtaaaacttt

SEQ ID NO: 6710260 - DNA, 21 bp, Homo sapiens
catagattcctggttatccta

SEQ ID NO: 6710261 - DNA, 18 bp, Homo sapiens
catagattgagaagtttt

SEQ ID NO: 6710262 - DNA, 17 bp, Homo sapiens
catagatttattttaca

SEQ ID NO: 6710263 - DNA, 18 bp, Homo sapiens
catagatttattttacat

SEQ ID NO: 6710264 - DNA, 21 bp, Homo sapiens
catagatttattttacattta

SEQ ID NO: 6710265 - DNA, 15 bp, Homo sapiens
catagatttctgatt

SEQ ID NO: 6710266 - DNA, 23 bp, Homo sapiens
catagatttgaagatctgattta

SEQ ID NO: 6710267 - DNA, 15 bp, Homo sapiens
catagcaacaggaaa

SEQ ID NO: 6710268 - DNA, 18 bp, Homo sapiens
catagcaaccagaggaag

SEQ ID NO: 6710269 - DNA, 17 bp, Homo sapiens
catagcaagcttttgct

SEQ ID NO: 6710270 - DNA, 22 bp, Homo sapiens
catagcacccgtggtgcatggt

SEQ ID NO: 6710271 - DNA, 14 bp, Homo sapiens
catagcacttcccc

SEQ ID NO: 6710272 - DNA, 16 bp, Homo sapiens
catagcagatctgttt

SEQ ID NO: 6710273 - DNA, 18 bp, Homo sapiens
catagcagattttaattt

SEQ ID NO: 6710274 - DNA, 17 bp, Homo sapiens
catagcaggaaatgtag

SEQ ID NO: 6710275 - DNA, 14 bp, Homo sapiens
catagcagtatatg

SEQ ID NO: 6710276 - DNA, 18 bp, Homo sapiens
catagcatagccagcatt

SEQ ID NO: 6710277 - DNA, 21 bp, Homo sapiens
catagcatagctagagattgg

SEQ ID NO: 6710278 - DNA, 14 bp, Homo sapiens
catagcataggaca

SEQ ID NO: 6710279 - DNA, 15 bp, Homo sapiens
catagcatcctgatt

SEQ ID NO: 6710280 - DNA, 17 bp, Homo sapiens
catagcatgacatttct

SEQ ID NO: 6710281 - DNA, 16 bp, Homo sapiens
catagcattaactaat

SEQ ID NO: 6710282 - DNA, 21 bp, Homo sapiens
catagcatttgtgtaaagact

SEQ ID NO: 6710283 - DNA, 17 bp, Homo sapiens
catagccaactctccca

SEQ ID NO: 6710284 - DNA, 18 bp, Homo sapiens
catagccaactctcccaa

SEQ ID NO: 6710285 - DNA, 22 bp, Homo sapiens
catagccaatggacaagcagtg

SEQ ID NO: 6710286 - DNA, 17 bp, Homo sapiens
catagccagttctgaca

SEQ ID NO: 6710287 - DNA, 13 bp, Homo sapiens
catagccataaat

SEQ ID NO: 6710288 - DNA, 21 bp, Homo sapiens
catagccattcatttacaact

SEQ ID NO: 6710289 - DNA, 16 bp, Homo sapiens
catagcccatccctgc

SEQ ID NO: 6710290 - DNA, 22 bp, Homo sapiens
catagccccaggcccgccctgc

SEQ ID NO: 6710291 - DNA, 15 bp, Homo sapiens
catagccctcaccct

SEQ ID NO: 6710292 - DNA, 19 bp, Homo sapiens
catagccctgttgacctgc

SEQ ID NO: 6710293 - DNA, 14 bp, Homo sapiens
catagcccttacct

SEQ ID NO: 6710294 - DNA, 14 bp, Homo sapiens
catagcctcatgtt

SEQ ID NO: 6710295 - DNA, 19 bp, Homo sapiens
catagcctcatgttctgtg

SEQ ID NO: 6710296 - DNA, 16 bp, Homo sapiens
catagcctgcctgatc

SEQ ID NO: 6710297 - DNA, 16 bp, Homo sapiens
catagccttatgagtt

SEQ ID NO: 6710298 - DNA, 22 bp, Homo sapiens
catagccttggggttggacatc

SEQ ID NO: 6710299 - DNA, 12 bp, Homo sapiens
catagcctttgt

SEQ ID NO: 6710300 - DNA, 17 bp, Homo sapiens
catagcgaaataaaaat

SEQ ID NO: 6710301 - DNA, 18 bp, Homo sapiens
catagcgctggctcagga

SEQ ID NO: 6710302 - DNA, 23 bp, Homo sapiens
catagcggactcctcctttctcc

SEQ ID NO: 6710303 - DNA, 18 bp, Homo sapiens
catagcgggggcctaaaa

SEQ ID NO: 6710304 - DNA, 15 bp, Homo sapiens
catagcgtcctgccc

SEQ ID NO: 6710305 - DNA, 15 bp, Homo sapiens
catagctaaaggcta

SEQ ID NO: 6710306 - DNA, 18 bp, Homo sapiens
catagctacaatttgttt

SEQ ID NO: 6710307 - DNA, 15 bp, Homo sapiens
catagctacatcagt

SEQ ID NO: 6710308 - DNA, 22 bp, Homo sapiens
catagctacccaaaagagaaaa

SEQ ID NO: 6710309 - DNA, 14 bp, Homo sapiens
catagctactatat

SEQ ID NO: 6710310 - DNA, 15 bp, Homo sapiens
catagctactatatg

SEQ ID NO: 6710311 - DNA, 22 bp, Homo sapiens
catagctattttccttgctttt

SEQ ID NO: 6710312 - DNA, 15 bp, Homo sapiens
catagctcaataaaa

SEQ ID NO: 6710313 - DNA, 18 bp, Homo sapiens
catagctcaataaaagaa

SEQ ID NO: 6710314 - DNA, 15 bp, Homo sapiens
catagctcactgcag

SEQ ID NO: 6710315 - DNA, 20 bp, Homo sapiens
catagctcctgctccacagc

SEQ ID NO: 6710316 - DNA, 21 bp, Homo sapiens
catagctctaatctaatatat

SEQ ID NO: 6710317 - DNA, 22 bp, Homo sapiens
catagctctgaagttaaaatga

SEQ ID NO: 6710318 - DNA, 17 bp, Homo sapiens
catagctcttcacttcc

SEQ ID NO: 6710319 - DNA, 22 bp, Homo sapiens
catagctcttcacttcctccag

SEQ ID NO: 6710320 - DNA, 15 bp, Homo sapiens
catagctgagctgga

SEQ ID NO: 6710321 - DNA, 13 bp, Homo sapiens
catagctgggaaa

SEQ ID NO: 6710322 - DNA, 16 bp, Homo sapiens
catagctgggatttga

SEQ ID NO: 6710323 - DNA, 23 bp, Homo sapiens
catagctggttatttctcccttg

SEQ ID NO: 6710324 - DNA, 19 bp, Homo sapiens
catagctggttcctgctag

SEQ ID NO: 6710325 - DNA, 16 bp, Homo sapiens
catagctgtacttctt

SEQ ID NO: 6710326 - DNA, 13 bp, Homo sapiens
catagctgtgatt

SEQ ID NO: 6710327 - DNA, 18 bp, Homo sapiens
catagctgtgatttttgg

SEQ ID NO: 6710328 - DNA, 21 bp, Homo sapiens
catagctgttttagctgaggg

SEQ ID NO: 6710329 - DNA, 20 bp, Homo sapiens
catagcttgataaagggcca

SEQ ID NO: 6710330 - DNA, 17 bp, Homo sapiens
catagctttccagttcc

SEQ ID NO: 6710331 - DNA, 23 bp, Homo sapiens
cataggaaaagtacatttaatac

SEQ ID NO: 6710332 - DNA, 15 bp, Homo sapiens
cataggaaggctgtg

SEQ ID NO: 6710333 - DNA, 19 bp, Homo sapiens
cataggaagggatctgaga

SEQ ID NO: 6710334 - DNA, 14 bp, Homo sapiens
cataggaagtggct

SEQ ID NO: 6710335 - DNA, 15 bp, Homo sapiens
cataggaagtggctg

SEQ ID NO: 6710336 - DNA, 19 bp, Homo sapiens
cataggaagtggctggtct

SEQ ID NO: 6710337 - DNA, 19 bp, Homo sapiens
cataggaagttaaaagcac

SEQ ID NO: 6710338 - DNA, 17 bp, Homo sapiens
cataggaagttagcctt

SEQ ID NO: 6710339 - DNA, 15 bp, Homo sapiens
cataggacctgcatc

SEQ ID NO: 6710340 - DNA, 17 bp, Homo sapiens
cataggactaccgcagg

SEQ ID NO: 6710341 - DNA, 19 bp, Homo sapiens
cataggactaccgcaggcc

SEQ ID NO: 6710342 - DNA, 21 bp, Homo sapiens
cataggactaccgcaggcccg

SEQ ID NO: 6710343 - DNA, 13 bp, Homo sapiens
cataggactgtgg

SEQ ID NO: 6710344 - DNA, 17 bp, Homo sapiens
cataggaggcttctgtt

SEQ ID NO: 6710345 - DNA, 14 bp, Homo sapiens
cataggagggaagg

SEQ ID NO: 6710346 - DNA, 18 bp, Homo sapiens
cataggaggggtctggac

SEQ ID NO: 6710347 - DNA, 19 bp, Homo sapiens
cataggaggggtctggaca

SEQ ID NO: 6710348 - DNA, 22 bp, Homo sapiens
cataggaggggtctggacatgt

SEQ ID NO: 6710349 - DNA, 15 bp, Homo sapiens
cataggagtgtgtta

SEQ ID NO: 6710350 - DNA, 15 bp, Homo sapiens
cataggcaagaggag

SEQ ID NO: 6710351 - DNA, 13 bp, Homo sapiens
cataggccaaggc

SEQ ID NO: 6710352 - DNA, 16 bp, Homo sapiens
cataggccaaggtgca

SEQ ID NO: 6710353 - DNA, 14 bp, Homo sapiens
cataggcccacaca

SEQ ID NO: 6710354 - DNA, 16 bp, Homo sapiens
cataggcccacacaca

SEQ ID NO: 6710355 - DNA, 13 bp, Homo sapiens
cataggcccagtg

SEQ ID NO: 6710356 - DNA, 19 bp, Homo sapiens
cataggccgagctgtggac

SEQ ID NO: 6710357 - DNA, 17 bp, Homo sapiens
cataggcctgggtgctg

SEQ ID NO: 6710358 - DNA, 21 bp, Homo sapiens
cataggcggtcatgtgtgcat

SEQ ID NO: 6710359 - DNA, 19 bp, Homo sapiens
cataggctatgccatgtgc

SEQ ID NO: 6710360 - DNA, 11 bp, Homo sapiens
cataggctcct

SEQ ID NO: 6710361 - DNA, 19 bp, Homo sapiens
cataggctcttaagcagca

SEQ ID NO: 6710362 - DNA, 19 bp, Homo sapiens
cataggctgtgtttacatg

SEQ ID NO: 6710363 - DNA, 14 bp, Homo sapiens
catagggctgggga

SEQ ID NO: 6710364 - DNA, 19 bp, Homo sapiens
catagggctggggactggg

SEQ ID NO: 6710365 - DNA, 11 bp, Homo sapiens
cataggggcag

SEQ ID NO: 6710366 - DNA, 18 bp, Homo sapiens
cataggggcatagccagt

SEQ ID NO: 6710367 - DNA, 14 bp, Homo sapiens
cataggggggaggg

SEQ ID NO: 6710368 - DNA, 17 bp, Homo sapiens
catagggtcactttgcc

SEQ ID NO: 6710369 - DNA, 19 bp, Homo sapiens
catagggtcactttgccat

SEQ ID NO: 6710370 - DNA, 19 bp, Homo sapiens
catagggtcggaggtgctg

SEQ ID NO: 6710371 - DNA, 13 bp, Homo sapiens
catagggtgctct

SEQ ID NO: 6710372 - DNA, 15 bp, Homo sapiens
catagggtttggaag

SEQ ID NO: 6710373 - DNA, 21 bp, Homo sapiens
cataggtaaggttttcaaggt

SEQ ID NO: 6710374 - DNA, 17 bp, Homo sapiens
cataggtagaatgtaaa

SEQ ID NO: 6710375 - DNA, 23 bp, Homo sapiens
cataggtagaatgtaaagcttgt

SEQ ID NO: 6710376 - DNA, 20 bp, Homo sapiens
cataggtaggtatctttata

SEQ ID NO: 6710377 - DNA, 23 bp, Homo sapiens
cataggtaggtatctttatagtt

SEQ ID NO: 6710378 - DNA, 14 bp, Homo sapiens
cataggtcactggc

SEQ ID NO: 6710379 - DNA, 16 bp, Homo sapiens
cataggtcactggctc

SEQ ID NO: 6710380 - DNA, 18 bp, Homo sapiens
cataggtcactggctctc

SEQ ID NO: 6710381 - DNA, 19 bp, Homo sapiens
cataggtcactggctctcc

SEQ ID NO: 6710382 - DNA, 19 bp, Homo sapiens
cataggtctctttgctttc

SEQ ID NO: 6710383 - DNA, 21 bp, Homo sapiens
cataggtctctttgctttctg

SEQ ID NO: 6710384 - DNA, 15 bp, Homo sapiens
cataggtgctcttcc

SEQ ID NO: 6710385 - DNA, 22 bp, Homo sapiens
cataggttaaaaaaaaaagtca

SEQ ID NO: 6710386 - DNA, 17 bp, Homo sapiens
cataggttactacctat

SEQ ID NO: 6710387 - DNA, 16 bp, Homo sapiens
cataggttagatatag

SEQ ID NO: 6710388 - DNA, 18 bp, Homo sapiens
cataggtttctctccctc

SEQ ID NO: 6710389 - DNA, 17 bp, Homo sapiens
cataggttttaaatctg

SEQ ID NO: 6710390 - DNA, 18 bp, Homo sapiens
cataggttttaaatctgc

SEQ ID NO: 6710391 - DNA, 13 bp, Homo sapiens
catagtaaaagaa

SEQ ID NO: 6710392 - DNA, 23 bp, Homo sapiens
catagtaaaatacctctaataaa

SEQ ID NO: 6710393 - DNA, 16 bp, Homo sapiens
catagtaaagtatttt

SEQ ID NO: 6710394 - DNA, 17 bp, Homo sapiens
catagtaaagtattttt

SEQ ID NO: 6710395 - DNA, 20 bp, Homo sapiens
catagtaaagtatttttgat

SEQ ID NO: 6710396 - DNA, 20 bp, Homo sapiens
catagtaagttcagcacttg

SEQ ID NO: 6710397 - DNA, 16 bp, Homo sapiens
catagtaccaatcatt

SEQ ID NO: 6710398 - DNA, 22 bp, Homo sapiens
catagtaccaatcattttaatt

SEQ ID NO: 6710399 - DNA, 16 bp, Homo sapiens
catagtagaacgctat

SEQ ID NO: 6710400 - DNA, 17 bp, Homo sapiens
catagtagtttttacag

SEQ ID NO: 6710401 - DNA, 17 bp, Homo sapiens
catagtataactttaaa

SEQ ID NO: 6710402 - DNA, 18 bp, Homo sapiens
catagtataactttaaat

SEQ ID NO: 6710403 - DNA, 20 bp, Homo sapiens
catagtatactgatttaatt

SEQ ID NO: 6710404 - DNA, 20 bp, Homo sapiens
catagtatccatattttatt

SEQ ID NO: 6710405 - DNA, 21 bp, Homo sapiens
catagtatcttcactgtgtta

SEQ ID NO: 6710406 - DNA, 17 bp, Homo sapiens
catagtatggtggctgg

SEQ ID NO: 6710407 - DNA, 19 bp, Homo sapiens
catagtatggtggctgggt

SEQ ID NO: 6710408 - DNA, 15 bp, Homo sapiens
catagtattggagca

SEQ ID NO: 6710409 - DNA, 22 bp, Homo sapiens
catagtcaatgatggtttaata

SEQ ID NO: 6710410 - DNA, 13 bp, Homo sapiens
catagtcacatgg

SEQ ID NO: 6710411 - DNA, 11 bp, Homo sapiens
catagtcagtg

SEQ ID NO: 6710412 - DNA, 16 bp, Homo sapiens
catagtcattctgcct

SEQ ID NO: 6710413 - DNA, 22 bp, Homo sapiens
catagtcattctgcctgccctg

SEQ ID NO: 6710414 - DNA, 13 bp, Homo sapiens
catagtccccaga

SEQ ID NO: 6710415 - DNA, 13 bp, Homo sapiens
catagtccctgcc

SEQ ID NO: 6710416 - DNA, 22 bp, Homo sapiens
catagtcgggatgtcagcagac

SEQ ID NO: 6710417 - DNA, 19 bp, Homo sapiens
catagtctggctgtaccca

SEQ ID NO: 6710418 - DNA, 23 bp, Homo sapiens
catagtctgtatccaaataatga

SEQ ID NO: 6710419 - DNA, 16 bp, Homo sapiens
catagtcttgaaatga

SEQ ID NO: 6710420 - DNA, 19 bp, Homo sapiens
catagtcttgaaatgaaag

SEQ ID NO: 6710421 - DNA, 14 bp, Homo sapiens
catagtctttgttt

SEQ ID NO: 6710422 - DNA, 15 bp, Homo sapiens
catagtgaacacact

SEQ ID NO: 6710423 - DNA, 17 bp, Homo sapiens
catagtgaacacagcag

SEQ ID NO: 6710424 - DNA, 21 bp, Homo sapiens
catagtgaattttaaaatgta

SEQ ID NO: 6710425 - DNA, 18 bp, Homo sapiens
catagtgaccggctgctt

SEQ ID NO: 6710426 - DNA, 21 bp, Homo sapiens
catagtgagaccctgtctcta

SEQ ID NO: 6710427 - DNA, 15 bp, Homo sapiens
catagtgagatccca

SEQ ID NO: 6710428 - DNA, 19 bp, Homo sapiens
catagtgatagagtgcagt

SEQ ID NO: 6710429 - DNA, 22 bp, Homo sapiens
catagtgatggttcccctgttc

SEQ ID NO: 6710430 - DNA, 18 bp, Homo sapiens
catagtgccttgatttta

SEQ ID NO: 6710431 - DNA, 13 bp, Homo sapiens
catagtgctggga

SEQ ID NO: 6710432 - DNA, 23 bp, Homo sapiens
catagtggacattgttggcagca

SEQ ID NO: 6710433 - DNA, 13 bp, Homo sapiens
catagtggatgga

SEQ ID NO: 6710434 - DNA, 16 bp, Homo sapiens
catagtggatggacag

SEQ ID NO: 6710435 - DNA, 19 bp, Homo sapiens
catagtggatggacagatg

SEQ ID NO: 6710436 - DNA, 23 bp, Homo sapiens
catagtggcacttgcctgtagtc

SEQ ID NO: 6710437 - DNA, 19 bp, Homo sapiens
catagtggggcctgggagg

SEQ ID NO: 6710438 - DNA, 15 bp, Homo sapiens
catagtggtatttta

SEQ ID NO: 6710439 - DNA, 17 bp, Homo sapiens
catagtgtcacagagag

SEQ ID NO: 6710440 - DNA, 14 bp, Homo sapiens
catagtgtcctgcc

SEQ ID NO: 6710441 - DNA, 15 bp, Homo sapiens
catagtgtcctgccc

SEQ ID NO: 6710442 - DNA, 17 bp, Homo sapiens
catagtgtcctgcccac

SEQ ID NO: 6710443 - DNA, 22 bp, Homo sapiens
catagtgtctgctgctgcctcc

SEQ ID NO: 6710444 - DNA, 21 bp, Homo sapiens
catagtgtgctcggacacagt

SEQ ID NO: 6710445 - DNA, 17 bp, Homo sapiens
catagttactgtaaaat

SEQ ID NO: 6710446 - DNA, 13 bp, Homo sapiens
catagttactgtg

SEQ ID NO: 6710447 - DNA, 19 bp, Homo sapiens
catagttactgtgtaaact

SEQ ID NO: 6710448 - DNA, 23 bp, Homo sapiens
catagttatttacttgaaagatg

SEQ ID NO: 6710449 - DNA, 13 bp, Homo sapiens
catagttcagaat

SEQ ID NO: 6710450 - DNA, 19 bp, Homo sapiens
catagttcccatgttaaat

SEQ ID NO: 6710451 - DNA, 22 bp, Homo sapiens
catagttctagtgcagctgaaa

SEQ ID NO: 6710452 - DNA, 13 bp, Homo sapiens
catagttctgtaa

SEQ ID NO: 6710453 - DNA, 13 bp, Homo sapiens
catagttctgtta

SEQ ID NO: 6710454 - DNA, 20 bp, Homo sapiens
catagttggtaatgcttgga

SEQ ID NO: 6710455 - DNA, 16 bp, Homo sapiens
catagttgtgttaagc

SEQ ID NO: 6710456 - DNA, 17 bp, Homo sapiens
catagtttcaaatctgt

SEQ ID NO: 6710457 - DNA, 22 bp, Homo sapiens
catagtttcaaatctgtaatca

SEQ ID NO: 6710458 - DNA, 20 bp, Homo sapiens
catagtttctgtaattggct

SEQ ID NO: 6710459 - DNA, 15 bp, Homo sapiens
catagtttcttggcc

SEQ ID NO: 6710460 - DNA, 15 bp, Homo sapiens
catagtttctttatt

SEQ ID NO: 6710461 - DNA, 22 bp, Homo sapiens
catagtttctttattttgtgta

SEQ ID NO: 6710462 - DNA, 23 bp, Homo sapiens
catagtttctttattttgtgtaa

SEQ ID NO: 6710463 - DNA, 15 bp, Homo sapiens
catagtttggcattt

SEQ ID NO: 6710464 - DNA, 18 bp, Homo sapiens
catagtttggcatttgca

SEQ ID NO: 6710465 - DNA, 21 bp, Homo sapiens
catagtttgggcttgtaccac

SEQ ID NO: 6710466 - DNA, 16 bp, Homo sapiens
catagtttgttcaaat

SEQ ID NO: 6710467 - DNA, 23 bp, Homo sapiens
catagttttctaaatgtacaaat

SEQ ID NO: 6710468 - DNA, 17 bp, Homo sapiens
catagtttttactgaac

SEQ ID NO: 6710469 - DNA, 12 bp, Homo sapiens
catagtttttcc

SEQ ID NO: 6710470 - DNA, 17 bp, Homo sapiens
catataaaaacatcagt

SEQ ID NO: 6710471 - DNA, 23 bp, Homo sapiens
catataaaaggtgagctcagctc

SEQ ID NO: 6710472 - DNA, 17 bp, Homo sapiens
catataaaagttgcgtt

SEQ ID NO: 6710473 - DNA, 14 bp, Homo sapiens
catataaaataatg

SEQ ID NO: 6710474 - DNA, 15 bp, Homo sapiens
catataaaataatgc

SEQ ID NO: 6710475 - DNA, 15 bp, Homo sapiens
catataaacacagta

SEQ ID NO: 6710476 - DNA, 19 bp, Homo sapiens
catataaacatcacacaca

SEQ ID NO: 6710477 - DNA, 20 bp, Homo sapiens
catataaacatcacacacac

SEQ ID NO: 6710478 - DNA, 16 bp, Homo sapiens
catataaagattaaca

SEQ ID NO: 6710479 - DNA, 22 bp, Homo sapiens
catataaaggttatgaaacata

SEQ ID NO: 6710480 - DNA, 15 bp, Homo sapiens
catataaagtgcaat

SEQ ID NO: 6710481 - DNA, 17 bp, Homo sapiens
catataaatgtttatat

SEQ ID NO: 6710482 - DNA, 22 bp, Homo sapiens
catataaattccccatatttgt

SEQ ID NO: 6710483 - DNA, 21 bp, Homo sapiens
catataaattgtcttaatgga

SEQ ID NO: 6710484 - DNA, 18 bp, Homo sapiens
catataaattttttgtga

SEQ ID NO: 6710485 - DNA, 13 bp, Homo sapiens
catataacactta

SEQ ID NO: 6710486 - DNA, 21 bp, Homo sapiens
catataacatgcaaacaggtt

SEQ ID NO: 6710487 - DNA, 19 bp, Homo sapiens
catataactgtgatgaaat

SEQ ID NO: 6710488 - DNA, 22 bp, Homo sapiens
catataacttatattgtaagaa

SEQ ID NO: 6710489 - DNA, 18 bp, Homo sapiens
catataagacaaatattc

SEQ ID NO: 6710490 - DNA, 18 bp, Homo sapiens
catataaggctaaatgta

SEQ ID NO: 6710491 - DNA, 19 bp, Homo sapiens
catataaggctaaatgtaa

SEQ ID NO: 6710492 - DNA, 16 bp, Homo sapiens
catataagtgattgct

SEQ ID NO: 6710493 - DNA, 17 bp, Homo sapiens
catataagttgagaagg

SEQ ID NO: 6710494 - DNA, 14 bp, Homo sapiens
catataagtttgaa

SEQ ID NO: 6710495 - DNA, 20 bp, Homo sapiens
catataagtttgaaggaaac

SEQ ID NO: 6710496 - DNA, 23 bp, Homo sapiens
catataagtttgaaggaaacagt

SEQ ID NO: 6710497 - DNA, 15 bp, Homo sapiens
catataatatatgtt

SEQ ID NO: 6710498 - DNA, 20 bp, Homo sapiens
catataatatatgttttaaa

SEQ ID NO: 6710499 - DNA, 22 bp, Homo sapiens
catataatatatgttttaaata

SEQ ID NO: 6710500 - DNA, 18 bp, Homo sapiens
catataatgttgttattt

SEQ ID NO: 6710501 - DNA, 22 bp, Homo sapiens
catataattatatgttgtaagc

SEQ ID NO: 6710502 - DNA, 20 bp, Homo sapiens
catataatttgccagacaga

SEQ ID NO: 6710503 - DNA, 23 bp, Homo sapiens
catataatttgccagacagagat

SEQ ID NO: 6710504 - DNA, 18 bp, Homo sapiens
catatacaacaccaaaaa

SEQ ID NO: 6710505 - DNA, 23 bp, Homo sapiens
catatacaataatgtaatttagt

SEQ ID NO: 6710506 - DNA, 14 bp, Homo sapiens
catatacacacaca

SEQ ID NO: 6710507 - DNA, 21 bp, Homo sapiens
catatacatattgtatatata

SEQ ID NO: 6710508 - DNA, 19 bp, Homo sapiens
catataccacccatagtgc

SEQ ID NO: 6710509 - DNA, 22 bp, Homo sapiens
catatacctataatgtgtgtat

SEQ ID NO: 6710510 - DNA, 23 bp, Homo sapiens
catatacctataatgtgtgtatg

SEQ ID NO: 6710511 - DNA, 12 bp, Homo sapiens
catatacctctt

SEQ ID NO: 6710512 - DNA, 16 bp, Homo sapiens
catatactataattgt

SEQ ID NO: 6710513 - DNA, 14 bp, Homo sapiens
catatactttgtct

SEQ ID NO: 6710514 - DNA, 13 bp, Homo sapiens
catatagaaaggc

SEQ ID NO: 6710515 - DNA, 23 bp, Homo sapiens
catatagacacacatacataatg

SEQ ID NO: 6710516 - DNA, 15 bp, Homo sapiens
catatagaccaattg

SEQ ID NO: 6710517 - DNA, 18 bp, Homo sapiens
catatagattttattatg

SEQ ID NO: 6710518 - DNA, 19 bp, Homo sapiens
catatagcaaaacttttaa

SEQ ID NO: 6710519 - DNA, 22 bp, Homo sapiens
catatagcattgataatcttca

SEQ ID NO: 6710520 - DNA, 13 bp, Homo sapiens
catatagccaggg

SEQ ID NO: 6710521 - DNA, 17 bp, Homo sapiens
catataggggcaaaaat

SEQ ID NO: 6710522 - DNA, 24 bp, Homo sapiens
catataggggcaaaaatttgacat

SEQ ID NO: 6710523 - DNA, 16 bp, Homo sapiens
catatagttaaactga

SEQ ID NO: 6710524 - DNA, 20 bp, Homo sapiens
catatagttgaggccgagga

SEQ ID NO: 6710525 - DNA, 13 bp, Homo sapiens
catatagtttgtt

SEQ ID NO: 6710526 - DNA, 17 bp, Homo sapiens
catatagtttgttttct

SEQ ID NO: 6710527 - DNA, 18 bp, Homo sapiens
catatagtttgttttctt

SEQ ID NO: 6710528 - DNA, 23 bp, Homo sapiens
catatataaaagtttaaagaaga

SEQ ID NO: 6710529 - DNA, 16 bp, Homo sapiens
catatataaattatta

SEQ ID NO: 6710530 - DNA, 15 bp, Homo sapiens
catatataacaatgc

SEQ ID NO: 6710531 - DNA, 20 bp, Homo sapiens
catatataacagatacattt

SEQ ID NO: 6710532 - DNA, 18 bp, Homo sapiens
catatataactagctaga

SEQ ID NO: 6710533 - DNA, 16 bp, Homo sapiens
catatataagactgct

SEQ ID NO: 6710534 - DNA, 13 bp, Homo sapiens
catatatacatac

SEQ ID NO: 6710535 - DNA, 13 bp, Homo sapiens
catatatacattt

SEQ ID NO: 6710536 - DNA, 22 bp, Homo sapiens
catatatacttgcaagataatt

SEQ ID NO: 6710537 - DNA, 19 bp, Homo sapiens
catatataggggttccagg

SEQ ID NO: 6710538 - DNA, 20 bp, Homo sapiens
catatatataaaatacacgt

SEQ ID NO: 6710539 - DNA, 14 bp, Homo sapiens
catatatatatgtg

SEQ ID NO: 6710540 - DNA, 15 bp, Homo sapiens
catatatatatgtgt

SEQ ID NO: 6710541 - DNA, 16 bp, Homo sapiens
catatatatatttgta

SEQ ID NO: 6710542 - DNA, 18 bp, Homo sapiens
catatatatatttgtaac

SEQ ID NO: 6710543 - DNA, 22 bp, Homo sapiens
catatatatatttgtaacattg

SEQ ID NO: 6710544 - DNA, 15 bp, Homo sapiens
catatatatcctatt

SEQ ID NO: 6710545 - DNA, 19 bp, Homo sapiens
catatatatgccttatgta

SEQ ID NO: 6710546 - DNA, 15 bp, Homo sapiens
catatatatgtatat

SEQ ID NO: 6710547 - DNA, 22 bp, Homo sapiens
catatatatgttttaagaggca

SEQ ID NO: 6710548 - DNA, 15 bp, Homo sapiens
catatatattaaaat

SEQ ID NO: 6710549 - DNA, 13 bp, Homo sapiens
catatatattaca

SEQ ID NO: 6710550 - DNA, 14 bp, Homo sapiens
catatatatttatt

SEQ ID NO: 6710551 - DNA, 12 bp, Homo sapiens
catatatcaaga

SEQ ID NO: 6710552 - DNA, 19 bp, Homo sapiens
catatatctacacatacag

SEQ ID NO: 6710553 - DNA, 14 bp, Homo sapiens
catatatctatatg

SEQ ID NO: 6710554 - DNA, 15 bp, Homo sapiens
catatatgctgtatt

SEQ ID NO: 6710555 - DNA, 16 bp, Homo sapiens
catatatgctgtattt

SEQ ID NO: 6710556 - DNA, 17 bp, Homo sapiens
catatatgctgtatttc

SEQ ID NO: 6710557 - DNA, 13 bp, Homo sapiens
catatatgtataa

SEQ ID NO: 6710558 - DNA, 21 bp, Homo sapiens
catatatgtataatatatatc

SEQ ID NO: 6710559 - DNA, 17 bp, Homo sapiens
catatattaccccttca

SEQ ID NO: 6710560 - DNA, 14 bp, Homo sapiens
catatattatatat

SEQ ID NO: 6710561 - DNA, 15 bp, Homo sapiens
catatattatatata

SEQ ID NO: 6710562 - DNA, 16 bp, Homo sapiens
catatattatatatag

SEQ ID NO: 6710563 - DNA, 12 bp, Homo sapiens
catatattcatg

SEQ ID NO: 6710564 - DNA, 19 bp, Homo sapiens
catatattcatgtaataaa

SEQ ID NO: 6710565 - DNA, 14 bp, Homo sapiens
catatattgcattt

SEQ ID NO: 6710566 - DNA, 17 bp, Homo sapiens
catatattgcatttctg

SEQ ID NO: 6710567 - DNA, 14 bp, Homo sapiens
catatattggcact

SEQ ID NO: 6710568 - DNA, 22 bp, Homo sapiens
catatattgggttccattctca

SEQ ID NO: 6710569 - DNA, 15 bp, Homo sapiens
catatattgtgtggt

SEQ ID NO: 6710570 - DNA, 21 bp, Homo sapiens
catatatttatgaatgtgcat

SEQ ID NO: 6710571 - DNA, 18 bp, Homo sapiens
catatatttttatattta

SEQ ID NO: 6710572 - DNA, 20 bp, Homo sapiens
catatatttttatatttact

SEQ ID NO: 6710573 - DNA, 21 bp, Homo sapiens
catatatttttatatttacta

SEQ ID NO: 6710574 - DNA, 16 bp, Homo sapiens
catatattttttaaaa

SEQ ID NO: 6710575 - DNA, 21 bp, Homo sapiens
catatattttttaaaataagt

SEQ ID NO: 6710576 - DNA, 16 bp, Homo sapiens
catatattttttacaa

SEQ ID NO: 6710577 - DNA, 23 bp, Homo sapiens
catatcaaaaagtattaaaacta

SEQ ID NO: 6710578 - DNA, 15 bp, Homo sapiens
catatcaaaatagga

SEQ ID NO: 6710579 - DNA, 14 bp, Homo sapiens
catatcaaatgaaa

SEQ ID NO: 6710580 - DNA, 23 bp, Homo sapiens
catatcaagaagtcagagaaaac

SEQ ID NO: 6710581 - DNA, 17 bp, Homo sapiens
catatcaagtcccgagg

SEQ ID NO: 6710582 - DNA, 22 bp, Homo sapiens
catatcaattggcagtgacttt

SEQ ID NO: 6710583 - DNA, 18 bp, Homo sapiens
catatcacacacattgct

SEQ ID NO: 6710584 - DNA, 13 bp, Homo sapiens
catatcacatgtc

SEQ ID NO: 6710585 - DNA, 14 bp, Homo sapiens
catatcactgaagg

SEQ ID NO: 6710586 - DNA, 14 bp, Homo sapiens
catatcagaaaagt

SEQ ID NO: 6710587 - DNA, 18 bp, Homo sapiens
catatcagaaaagtagaa

SEQ ID NO: 6710588 - DNA, 15 bp, Homo sapiens
catatcagacctctg

SEQ ID NO: 6710589 - DNA, 19 bp, Homo sapiens
catatcagacttcaccaaa

SEQ ID NO: 6710590 - DNA, 20 bp, Homo sapiens
catatcagacttcaccaaat

SEQ ID NO: 6710591 - DNA, 17 bp, Homo sapiens
catatcagctctctgca

SEQ ID NO: 6710592 - DNA, 17 bp, Homo sapiens
catatcagtcatgacta

SEQ ID NO: 6710593 - DNA, 18 bp, Homo sapiens
catatcataggtacaatc

SEQ ID NO: 6710594 - DNA, 23 bp, Homo sapiens
catatcataggtacaatctttca

SEQ ID NO: 6710595 - DNA, 18 bp, Homo sapiens
catatcatccacacatga

SEQ ID NO: 6710596 - DNA, 20 bp, Homo sapiens
catatcatggtaatgacaga

SEQ ID NO: 6710597 - DNA, 14 bp, Homo sapiens
catatcattaaaca

SEQ ID NO: 6710598 - DNA, 18 bp, Homo sapiens
catatcatttcactgtct

SEQ ID NO: 6710599 - DNA, 14 bp, Homo sapiens
catatcatttgagt

SEQ ID NO: 6710600 - DNA, 13 bp, Homo sapiens
catatcatttgtg

SEQ ID NO: 6710601 - DNA, 14 bp, Homo sapiens
catatcatttgtga

SEQ ID NO: 6710602 - DNA, 12 bp, Homo sapiens
catatcattttt

SEQ ID NO: 6710603 - DNA, 19 bp, Homo sapiens
catatccatagtgactttt

SEQ ID NO: 6710604 - DNA, 20 bp, Homo sapiens
catatccatgttgctgactt

SEQ ID NO: 6710605 - DNA, 17 bp, Homo sapiens
catatccattgtggaaa

SEQ ID NO: 6710606 - DNA, 23 bp, Homo sapiens
catatccattgtggaaactggat

SEQ ID NO: 6710607 - DNA, 20 bp, Homo sapiens
catatcccctgtgccctgca

SEQ ID NO: 6710608 - DNA, 19 bp, Homo sapiens
catatccctggttgcctca

SEQ ID NO: 6710609 - DNA, 13 bp, Homo sapiens
catatcccttcca

SEQ ID NO: 6710610 - DNA, 14 bp, Homo sapiens
catatccgggtgct

SEQ ID NO: 6710611 - DNA, 15 bp, Homo sapiens
catatccgggtgctc

SEQ ID NO: 6710612 - DNA, 17 bp, Homo sapiens
catatccgggtgctcaa

SEQ ID NO: 6710613 - DNA, 23 bp, Homo sapiens
catatccgggtgctcaataaact

SEQ ID NO: 6710614 - DNA, 17 bp, Homo sapiens
catatccgtatatatcc

SEQ ID NO: 6710615 - DNA, 11 bp, Homo sapiens
catatcctgcc

SEQ ID NO: 6710616 - DNA, 13 bp, Homo sapiens
catatcctgcctc

SEQ ID NO: 6710617 - DNA, 14 bp, Homo sapiens
catatcctgcctca

SEQ ID NO: 6710618 - DNA, 21 bp, Homo sapiens
catatcctttgccccaaggct

SEQ ID NO: 6710619 - DNA, 19 bp, Homo sapiens
catatcctttggtcctggt

SEQ ID NO: 6710620 - DNA, 14 bp, Homo sapiens
catatcggaggtgg

SEQ ID NO: 6710621 - DNA, 21 bp, Homo sapiens
catatcggaggtggtggagga

SEQ ID NO: 6710622 - DNA, 14 bp, Homo sapiens
catatctaaagtca

SEQ ID NO: 6710623 - DNA, 17 bp, Homo sapiens
catatctagtatgaaat

SEQ ID NO: 6710624 - DNA, 15 bp, Homo sapiens
catatctagtcaata

SEQ ID NO: 6710625 - DNA, 13 bp, Homo sapiens
catatctctaatt

SEQ ID NO: 6710626 - DNA, 20 bp, Homo sapiens
catatctctagtccctgtgt

SEQ ID NO: 6710627 - DNA, 24 bp, Homo sapiens
catatctctagtccctgtgttctg

SEQ ID NO: 6710628 - DNA, 20 bp, Homo sapiens
catatctcttatcttacgaa

SEQ ID NO: 6710629 - DNA, 23 bp, Homo sapiens
catatctcttatcttacgaaaaa

SEQ ID NO: 6710630 - DNA, 12 bp, Homo sapiens
catatctgactt

SEQ ID NO: 6710631 - DNA, 16 bp, Homo sapiens
catatctgcctcccct

SEQ ID NO: 6710632 - DNA, 24 bp, Homo sapiens
catatctggaagggcactatattt

SEQ ID NO: 6710633 - DNA, 19 bp, Homo sapiens
catatctggagcctgatgt

SEQ ID NO: 6710634 - DNA, 19 bp, Homo sapiens
catatctggtatatgtcat

SEQ ID NO: 6710635 - DNA, 22 bp, Homo sapiens
catatctggtatatgtcattat

SEQ ID NO: 6710636 - DNA, 18 bp, Homo sapiens
catatctgtcccctgcta

SEQ ID NO: 6710637 - DNA, 22 bp, Homo sapiens
catatctgtgtgccctagggct

SEQ ID NO: 6710638 - DNA, 23 bp, Homo sapiens
catatctgtgtgccctagggctc

SEQ ID NO: 6710639 - DNA, 18 bp, Homo sapiens
catatctgtttaggagtg

SEQ ID NO: 6710640 - DNA, 13 bp, Homo sapiens
catatctgtttat

SEQ ID NO: 6710641 - DNA, 20 bp, Homo sapiens
catatcttaaagaaacagct

SEQ ID NO: 6710642 - DNA, 20 bp, Homo sapiens
catatcttaatatatttcta

SEQ ID NO: 6710643 - DNA, 19 bp, Homo sapiens
catatcttctgtttcataa

SEQ ID NO: 6710644 - DNA, 14 bp, Homo sapiens
catatcttgccttc

SEQ ID NO: 6710645 - DNA, 21 bp, Homo sapiens
catatcttgcgaatccaagct

SEQ ID NO: 6710646 - DNA, 15 bp, Homo sapiens
catatcttgttagat

SEQ ID NO: 6710647 - DNA, 14 bp, Homo sapiens
catatctttattaa

SEQ ID NO: 6710648 - DNA, 17 bp, Homo sapiens
catatctttattaatca

SEQ ID NO: 6710649 - DNA, 14 bp, Homo sapiens
catatctttgagtt

SEQ ID NO: 6710650 - DNA, 22 bp, Homo sapiens
catatgaaaaaaatgcatttta

SEQ ID NO: 6710651 - DNA, 18 bp, Homo sapiens
catatgaaaatacaactt

SEQ ID NO: 6710652 - DNA, 19 bp, Homo sapiens
catatgaaaggtgccatgg

SEQ ID NO: 6710653 - DNA, 15 bp, Homo sapiens
catatgaacgcacaa

SEQ ID NO: 6710654 - DNA, 21 bp, Homo sapiens
catatgaacgcacaacatgca

SEQ ID NO: 6710655 - DNA, 18 bp, Homo sapiens
catatgaataccaggata

SEQ ID NO: 6710656 - DNA, 18 bp, Homo sapiens
catatgaatatatgtttt

SEQ ID NO: 6710657 - DNA, 12 bp, Homo sapiens
catatgaatgaa

SEQ ID NO: 6710658 - DNA, 17 bp, Homo sapiens
catatgacaaatgtttc

SEQ ID NO: 6710659 - DNA, 16 bp, Homo sapiens
catatgacaatttcaa

SEQ ID NO: 6710660 - DNA, 18 bp, Homo sapiens
catatgacaatttcaaaa

SEQ ID NO: 6710661 - DNA, 22 bp, Homo sapiens
catatgacaatttcaaaatgca

SEQ ID NO: 6710662 - DNA, 22 bp, Homo sapiens
catatgacattcatgcctggct

SEQ ID NO: 6710663 - DNA, 23 bp, Homo sapiens
catatgactgattactcagagca

SEQ ID NO: 6710664 - DNA, 23 bp, Homo sapiens
catatgagaatataccttattta

SEQ ID NO: 6710665 - DNA, 19 bp, Homo sapiens
catatgaggacctttatat

SEQ ID NO: 6710666 - DNA, 20 bp, Homo sapiens
catatgaggacctttatatc

SEQ ID NO: 6710667 - DNA, 23 bp, Homo sapiens
catatgaggacctttatatctgt

SEQ ID NO: 6710668 - DNA, 13 bp, Homo sapiens
catatgagtcttt

SEQ ID NO: 6710669 - DNA, 14 bp, Homo sapiens
catatgagtgtgga

SEQ ID NO: 6710670 - DNA, 17 bp, Homo sapiens
catatgatcaaatactc

SEQ ID NO: 6710671 - DNA, 15 bp, Homo sapiens
catatgatctgtctg

SEQ ID NO: 6710672 - DNA, 21 bp, Homo sapiens
catatgatgtacatgtactga

SEQ ID NO: 6710673 - DNA, 14 bp, Homo sapiens
catatgattctctt

SEQ ID NO: 6710674 - DNA, 15 bp, Homo sapiens
catatgattctgctt

SEQ ID NO: 6710675 - DNA, 14 bp, Homo sapiens
catatgattgaaaa

SEQ ID NO: 6710676 - DNA, 16 bp, Homo sapiens
catatgattgaaaaga

SEQ ID NO: 6710677 - DNA, 20 bp, Homo sapiens
catatgattgaaaagaagaa

SEQ ID NO: 6710678 - DNA, 21 bp, Homo sapiens
catatgattgaaaagaagaaa

SEQ ID NO: 6710679 - DNA, 18 bp, Homo sapiens
catatgattgtatttgtg

SEQ ID NO: 6710680 - DNA, 14 bp, Homo sapiens
catatgcaaacata

SEQ ID NO: 6710681 - DNA, 21 bp, Homo sapiens
catatgcaccttgtgtctgta

SEQ ID NO: 6710682 - DNA, 14 bp, Homo sapiens
catatgcagaaata

SEQ ID NO: 6710683 - DNA, 21 bp, Homo sapiens
catatgcagaacgtatttagc

SEQ ID NO: 6710684 - DNA, 16 bp, Homo sapiens
catatgcagatactta

SEQ ID NO: 6710685 - DNA, 16 bp, Homo sapiens
catatgcagccaacca

SEQ ID NO: 6710686 - DNA, 13 bp, Homo sapiens
catatgcatgcca

SEQ ID NO: 6710687 - DNA, 19 bp, Homo sapiens
catatgcatgcccttcctt

SEQ ID NO: 6710688 - DNA, 15 bp, Homo sapiens
catatgcctgggcag

SEQ ID NO: 6710689 - DNA, 22 bp, Homo sapiens
catatgccttggggaggacaaa

SEQ ID NO: 6710690 - DNA, 20 bp, Homo sapiens
catatgcgtcccaagcagcc

SEQ ID NO: 6710691 - DNA, 21 bp, Homo sapiens
catatgcgtcccaagcagccg

SEQ ID NO: 6710692 - DNA, 17 bp, Homo sapiens
catatgctaccaccagc

SEQ ID NO: 6710693 - DNA, 22 bp, Homo sapiens
catatgctaccaccagctgtgt

SEQ ID NO: 6710694 - DNA, 23 bp, Homo sapiens
catatgctaccaccagctgtgtc

SEQ ID NO: 6710695 - DNA, 19 bp, Homo sapiens
catatgctcctagagagga

SEQ ID NO: 6710696 - DNA, 23 bp, Homo sapiens
catatgctcctagagaggagaaa

SEQ ID NO: 6710697 - DNA, 23 bp, Homo sapiens
catatgctgtatatcctttctaa

SEQ ID NO: 6710698 - DNA, 17 bp, Homo sapiens
catatgcttactcttgc

SEQ ID NO: 6710699 - DNA, 17 bp, Homo sapiens
catatgcttcaaactaa

SEQ ID NO: 6710700 - DNA, 21 bp, Homo sapiens
catatgcttcaaactaacaca

SEQ ID NO: 6710701 - DNA, 15 bp, Homo sapiens
catatggaaatgtta

SEQ ID NO: 6710702 - DNA, 13 bp, Homo sapiens
catatggacactg

SEQ ID NO: 6710703 - DNA, 14 bp, Homo sapiens
catatggacactgt

SEQ ID NO: 6710704 - DNA, 17 bp, Homo sapiens
catatggacactgtgac

SEQ ID NO: 6710705 - DNA, 17 bp, Homo sapiens
catatggactctgcaca

SEQ ID NO: 6710706 - DNA, 19 bp, Homo sapiens
catatggagaacatgtttt

SEQ ID NO: 6710707 - DNA, 21 bp, Homo sapiens
catatggaggactgtgacaga

SEQ ID NO: 6710708 - DNA, 18 bp, Homo sapiens
catatggatccactggct

SEQ ID NO: 6710709 - DNA, 12 bp, Homo sapiens
catatggatgtt

SEQ ID NO: 6710710 - DNA, 16 bp, Homo sapiens
catatggatgttactc

SEQ ID NO: 6710711 - DNA, 20 bp, Homo sapiens
catatggcaacgttcatgtt

SEQ ID NO: 6710712 - DNA, 20 bp, Homo sapiens
catatggcccagtgtcaagt

SEQ ID NO: 6710713 - DNA, 14 bp, Homo sapiens
catatgggtgctgg

SEQ ID NO: 6710714 - DNA, 15 bp, Homo sapiens
catatgggtgctggc

SEQ ID NO: 6710715 - DNA, 16 bp, Homo sapiens
catatgggtgctggca

SEQ ID NO: 6710716 - DNA, 17 bp, Homo sapiens
catatgggttagatgtt

SEQ ID NO: 6710717 - DNA, 18 bp, Homo sapiens
catatgggttagatgttg

SEQ ID NO: 6710718 - DNA, 13 bp, Homo sapiens
catatgtaaaata

SEQ ID NO: 6710719 - DNA, 15 bp, Homo sapiens
catatgtaaacataa

SEQ ID NO: 6710720 - DNA, 21 bp, Homo sapiens
catatgtaacagtcaaatatc

SEQ ID NO: 6710721 - DNA, 15 bp, Homo sapiens
catatgtaacatcaa

SEQ ID NO: 6710722 - DNA, 20 bp, Homo sapiens
catatgtaacatcaagccat

SEQ ID NO: 6710723 - DNA, 21 bp, Homo sapiens
catatgtaccatgtacatgaa

SEQ ID NO: 6710724 - DNA, 17 bp, Homo sapiens
catatgtaccctaccct

SEQ ID NO: 6710725 - DNA, 13 bp, Homo sapiens
catatgtacttgt

SEQ ID NO: 6710726 - DNA, 15 bp, Homo sapiens
catatgtacttgttt

SEQ ID NO: 6710727 - DNA, 19 bp, Homo sapiens
catatgtacttgtttgcta

SEQ ID NO: 6710728 - DNA, 20 bp, Homo sapiens
catatgtagactatatacat

SEQ ID NO: 6710729 - DNA, 17 bp, Homo sapiens
catatgtagcattaaat

SEQ ID NO: 6710730 - DNA, 21 bp, Homo sapiens
catatgtagcattaaatataa

SEQ ID NO: 6710731 - DNA, 16 bp, Homo sapiens
catatgtatacatgtg

SEQ ID NO: 6710732 - DNA, 21 bp, Homo sapiens
catatgtatacttatcttgct

SEQ ID NO: 6710733 - DNA, 15 bp, Homo sapiens
catatgtatgtgtga

SEQ ID NO: 6710734 - DNA, 23 bp, Homo sapiens
catatgtcagtgtaaatccttgt

SEQ ID NO: 6710735 - DNA, 20 bp, Homo sapiens
catatgtctgcttctgtcca

SEQ ID NO: 6710736 - DNA, 21 bp, Homo sapiens
catatgtcttactactttaaa

SEQ ID NO: 6710737 - DNA, 14 bp, Homo sapiens
catatgtgaagaca

SEQ ID NO: 6710738 - DNA, 17 bp, Homo sapiens
catatgtgaatatggac

SEQ ID NO: 6710739 - DNA, 20 bp, Homo sapiens
catatgtgctatggagagga

SEQ ID NO: 6710740 - DNA, 14 bp, Homo sapiens
catatgtgtaaaga

SEQ ID NO: 6710741 - DNA, 19 bp, Homo sapiens
catatgtgtaaagatttat

SEQ ID NO: 6710742 - DNA, 18 bp, Homo sapiens
catatgttaaagcttatt

SEQ ID NO: 6710743 - DNA, 18 bp, Homo sapiens
catatgttaagcagctaa

SEQ ID NO: 6710744 - DNA, 18 bp, Homo sapiens
catatgttagatacacaa

SEQ ID NO: 6710745 - DNA, 19 bp, Homo sapiens
catatgttagatacacaaa

SEQ ID NO: 6710746 - DNA, 18 bp, Homo sapiens
catatgttccatgcctgg

SEQ ID NO: 6710747 - DNA, 17 bp, Homo sapiens
catatgttgaatacttt

SEQ ID NO: 6710748 - DNA, 19 bp, Homo sapiens
catatgttgaatacttttt

SEQ ID NO: 6710749 - DNA, 15 bp, Homo sapiens
catatgtttctgcta

SEQ ID NO: 6710750 - DNA, 20 bp, Homo sapiens
catatgttttccacataaat

SEQ ID NO: 6710751 - DNA, 23 bp, Homo sapiens
catatgttttccacataaatttt

SEQ ID NO: 6710752 - DNA, 11 bp, Homo sapiens
catattaaaat

SEQ ID NO: 6710753 - DNA, 12 bp, Homo sapiens
catattaaaatc

SEQ ID NO: 6710754 - DNA, 16 bp, Homo sapiens
catattaaaatcacaa

SEQ ID NO: 6710755 - DNA, 17 bp, Homo sapiens
catattaaaatcacaaa

SEQ ID NO: 6710756 - DNA, 23 bp, Homo sapiens
catattaaaatctgatgtaacaa

SEQ ID NO: 6710757 - DNA, 18 bp, Homo sapiens
catattaaagaaagtcat

SEQ ID NO: 6710758 - DNA, 16 bp, Homo sapiens
catattaaagataaga

SEQ ID NO: 6710759 - DNA, 17 bp, Homo sapiens
catattaacaaattgca

SEQ ID NO: 6710760 - DNA, 20 bp, Homo sapiens
catattaacaaattgcattt

SEQ ID NO: 6710761 - DNA, 21 bp, Homo sapiens
catattaacaaattgcatttg

SEQ ID NO: 6710762 - DNA, 20 bp, Homo sapiens
catattaagacagtgtacaa

SEQ ID NO: 6710763 - DNA, 23 bp, Homo sapiens
catattaagacagtgtacaaaac

SEQ ID NO: 6710764 - DNA, 14 bp, Homo sapiens
catattaatatatt

SEQ ID NO: 6710765 - DNA, 15 bp, Homo sapiens
catattaatgcgatt

SEQ ID NO: 6710766 - DNA, 14 bp, Homo sapiens
catattaattttct

SEQ ID NO: 6710767 - DNA, 15 bp, Homo sapiens
catattacaatattt

SEQ ID NO: 6710768 - DNA, 16 bp, Homo sapiens
catattacaatatttg

SEQ ID NO: 6710769 - DNA, 22 bp, Homo sapiens
catattacaatatttgtgtgct

SEQ ID NO: 6710770 - DNA, 16 bp, Homo sapiens
catattaccacagaca

SEQ ID NO: 6710771 - DNA, 13 bp, Homo sapiens
catattaccagaa

SEQ ID NO: 6710772 - DNA, 17 bp, Homo sapiens
catattaccagaaaatg

SEQ ID NO: 6710773 - DNA, 16 bp, Homo sapiens
catattacgttgtttc

SEQ ID NO: 6710774 - DNA, 18 bp, Homo sapiens
catattacgttgtttctt

SEQ ID NO: 6710775 - DNA, 21 bp, Homo sapiens
catattacgttgtttcttata

SEQ ID NO: 6710776 - DNA, 18 bp, Homo sapiens
catattactgttgcattt

SEQ ID NO: 6710777 - DNA, 19 bp, Homo sapiens
catattactgttgcattta

SEQ ID NO: 6710778 - DNA, 23 bp, Homo sapiens
catattactgttgcatttacttt

SEQ ID NO: 6710779 - DNA, 20 bp, Homo sapiens
catattagaaaactttgtta

SEQ ID NO: 6710780 - DNA, 21 bp, Homo sapiens
catattagacttctgttttca

SEQ ID NO: 6710781 - DNA, 20 bp, Homo sapiens
catattagcgacaacagatt

SEQ ID NO: 6710782 - DNA, 23 bp, Homo sapiens
catattagcgacaacagattgga

SEQ ID NO: 6710783 - DNA, 18 bp, Homo sapiens
catattataaataaatgc

SEQ ID NO: 6710784 - DNA, 19 bp, Homo sapiens
catattataaataaatgcc

SEQ ID NO: 6710785 - DNA, 23 bp, Homo sapiens
catattatagctcctattaaatt

SEQ ID NO: 6710786 - DNA, 14 bp, Homo sapiens
catattatgcctga

SEQ ID NO: 6710787 - DNA, 23 bp, Homo sapiens
catattatttcattggtcttctt

SEQ ID NO: 6710788 - DNA, 18 bp, Homo sapiens
catattattttagtgtgt

SEQ ID NO: 6710789 - DNA, 14 bp, Homo sapiens
catattcaaagcag

SEQ ID NO: 6710790 - DNA, 15 bp, Homo sapiens
catattcaaagtata

SEQ ID NO: 6710791 - DNA, 20 bp, Homo sapiens
catattcaagcaacagcact

SEQ ID NO: 6710792 - DNA, 16 bp, Homo sapiens
catattcacaatggaa

SEQ ID NO: 6710793 - DNA, 20 bp, Homo sapiens
catattcatgaaatgtggaa

SEQ ID NO: 6710794 - DNA, 14 bp, Homo sapiens
catattccagcagt

SEQ ID NO: 6710795 - DNA, 15 bp, Homo sapiens
catattctaaaacca

SEQ ID NO: 6710796 - DNA, 14 bp, Homo sapiens
catattctaaaagt

SEQ ID NO: 6710797 - DNA, 17 bp, Homo sapiens
catattctaaattcact

SEQ ID NO: 6710798 - DNA, 21 bp, Homo sapiens
catattctaagttagactctt

SEQ ID NO: 6710799 - DNA, 17 bp, Homo sapiens
catattctattgtttac

SEQ ID NO: 6710800 - DNA, 18 bp, Homo sapiens
catattctcatggctttg

SEQ ID NO: 6710801 - DNA, 21 bp, Homo sapiens
catattctcatggctttgtta

SEQ ID NO: 6710802 - DNA, 19 bp, Homo sapiens
catattctgatgtttctca

SEQ ID NO: 6710803 - DNA, 19 bp, Homo sapiens
catattctggttcttgaaa

SEQ ID NO: 6710804 - DNA, 17 bp, Homo sapiens
catattctgttggccag

SEQ ID NO: 6710805 - DNA, 18 bp, Homo sapiens
catattctgttggccagt

SEQ ID NO: 6710806 - DNA, 22 bp, Homo sapiens
catattctgttggccagtgtga

SEQ ID NO: 6710807 - DNA, 12 bp, Homo sapiens
catattcttgct

SEQ ID NO: 6710808 - DNA, 23 bp, Homo sapiens
catattcttgctttcacaaatat

SEQ ID NO: 6710809 - DNA, 12 bp, Homo sapiens
catattgacttt

SEQ ID NO: 6710810 - DNA, 17 bp, Homo sapiens
catattgataataaaat

SEQ ID NO: 6710811 - DNA, 19 bp, Homo sapiens
catattgataataaaattc

SEQ ID NO: 6710812 - DNA, 20 bp, Homo sapiens
catattgataataaaattca

SEQ ID NO: 6710813 - DNA, 17 bp, Homo sapiens
catattgatctttttat

SEQ ID NO: 6710814 - DNA, 14 bp, Homo sapiens
catattgatgaaaa

SEQ ID NO: 6710815 - DNA, 15 bp, Homo sapiens
catattgatgaaaag

SEQ ID NO: 6710816 - DNA, 16 bp, Homo sapiens
catattgatgaaaaga

SEQ ID NO: 6710817 - DNA, 23 bp, Homo sapiens
catattgcacaactctactgttg

SEQ ID NO: 6710818 - DNA, 15 bp, Homo sapiens
catattgcacatgtc

SEQ ID NO: 6710819 - DNA, 18 bp, Homo sapiens
catattgcacatgtctta

SEQ ID NO: 6710820 - DNA, 19 bp, Homo sapiens
catattgcacatgtcttaa

SEQ ID NO: 6710821 - DNA, 21 bp, Homo sapiens
catattgcacatgtcttaatg

SEQ ID NO: 6710822 - DNA, 19 bp, Homo sapiens
catattgcaggagacattt

SEQ ID NO: 6710823 - DNA, 21 bp, Homo sapiens
catattgcaggagacattttc

SEQ ID NO: 6710824 - DNA, 13 bp, Homo sapiens
catattgctctta

SEQ ID NO: 6710825 - DNA, 21 bp, Homo sapiens
catattgctgagagaaatatg

SEQ ID NO: 6710826 - DNA, 23 bp, Homo sapiens
catattgctgagagaaatatgga

SEQ ID NO: 6710827 - DNA, 19 bp, Homo sapiens
catattgctttttctaatg

SEQ ID NO: 6710828 - DNA, 16 bp, Homo sapiens
catattggaaaaatca

SEQ ID NO: 6710829 - DNA, 22 bp, Homo sapiens
catattggattgcgcctttgta

SEQ ID NO: 6710830 - DNA, 23 bp, Homo sapiens
catattggattgcgcctttgtat

SEQ ID NO: 6710831 - DNA, 20 bp, Homo sapiens
catattggtatatccttttc

SEQ ID NO: 6710832 - DNA, 13 bp, Homo sapiens
catattgtaaaac

SEQ ID NO: 6710833 - DNA, 19 bp, Homo sapiens
catattgtaaaacaggtag

SEQ ID NO: 6710834 - DNA, 13 bp, Homo sapiens
catattgtaatct

SEQ ID NO: 6710835 - DNA, 22 bp, Homo sapiens
catattgtaatctatgtttata

SEQ ID NO: 6710836 - DNA, 20 bp, Homo sapiens
catattgtgattctgccttt

SEQ ID NO: 6710837 - DNA, 13 bp, Homo sapiens
catattgtgccaa

SEQ ID NO: 6710838 - DNA, 20 bp, Homo sapiens
catattgtgccaatatgtat

SEQ ID NO: 6710839 - DNA, 18 bp, Homo sapiens
catattgtgtaatttaag

SEQ ID NO: 6710840 - DNA, 22 bp, Homo sapiens
catattgtgtaatttaagtgac

SEQ ID NO: 6710841 - DNA, 23 bp, Homo sapiens
catattgtgtaatttaagtgaca

SEQ ID NO: 6710842 - DNA, 14 bp, Homo sapiens
catattgtgtgtaa

SEQ ID NO: 6710843 - DNA, 21 bp, Homo sapiens
catattgttagggtcagccat

SEQ ID NO: 6710844 - DNA, 22 bp, Homo sapiens
catattgttagggtcagccatt

SEQ ID NO: 6710845 - DNA, 19 bp, Homo sapiens
catattgttgcattgcttt

SEQ ID NO: 6710846 - DNA, 22 bp, Homo sapiens
catattgttggcacagaacagg

SEQ ID NO: 6710847 - DNA, 12 bp, Homo sapiens
catattgtttga

SEQ ID NO: 6710848 - DNA, 14 bp, Homo sapiens
catatttaaagaca

SEQ ID NO: 6710849 - DNA, 17 bp, Homo sapiens
catatttaaagatcttt

SEQ ID NO: 6710850 - DNA, 14 bp, Homo sapiens
catatttaaagcca

SEQ ID NO: 6710851 - DNA, 22 bp, Homo sapiens
catatttaacaaaatttgaata

SEQ ID NO: 6710852 - DNA, 13 bp, Homo sapiens
catatttaactgg

SEQ ID NO: 6710853 - DNA, 13 bp, Homo sapiens
catatttaatgtt

SEQ ID NO: 6710854 - DNA, 22 bp, Homo sapiens
catatttaatgttttaaatgta

SEQ ID NO: 6710855 - DNA, 17 bp, Homo sapiens
catatttacattctagt

SEQ ID NO: 6710856 - DNA, 19 bp, Homo sapiens
catatttacctcagcctgg

SEQ ID NO: 6710857 - DNA, 17 bp, Homo sapiens
catatttacctgtattt

SEQ ID NO: 6710858 - DNA, 18 bp, Homo sapiens
catatttactctttctaa

SEQ ID NO: 6710859 - DNA, 17 bp, Homo sapiens
catatttacttactgct

SEQ ID NO: 6710860 - DNA, 20 bp, Homo sapiens
catatttacttcttatacat

SEQ ID NO: 6710861 - DNA, 14 bp, Homo sapiens
catatttagctgtt

SEQ ID NO: 6710862 - DNA, 21 bp, Homo sapiens
catatttagctgttttggaac

SEQ ID NO: 6710863 - DNA, 16 bp, Homo sapiens
catatttatactttgc

SEQ ID NO: 6710864 - DNA, 21 bp, Homo sapiens
catatttatccaaaatgtgta

SEQ ID NO: 6710865 - DNA, 18 bp, Homo sapiens
catatttatttttacctg

SEQ ID NO: 6710866 - DNA, 18 bp, Homo sapiens
catatttcagtgattttt

SEQ ID NO: 6710867 - DNA, 14 bp, Homo sapiens
catatttcatttta

SEQ ID NO: 6710868 - DNA, 17 bp, Homo sapiens
catatttccaataacta

SEQ ID NO: 6710869 - DNA, 21 bp, Homo sapiens
catatttcccttacaattaat

SEQ ID NO: 6710870 - DNA, 24 bp, Homo sapiens
catatttctaattggctttactat

SEQ ID NO: 6710871 - DNA, 13 bp, Homo sapiens
catatttctatgt

SEQ ID NO: 6710872 - DNA, 17 bp, Homo sapiens
catatttctatgttgta

SEQ ID NO: 6710873 - DNA, 11 bp, Homo sapiens
catatttctgt

SEQ ID NO: 6710874 - DNA, 14 bp, Homo sapiens
catatttctgtata

SEQ ID NO: 6710875 - DNA, 15 bp, Homo sapiens
catatttctgtatat

SEQ ID NO: 6710876 - DNA, 21 bp, Homo sapiens
catatttctgtatatttgtca

SEQ ID NO: 6710877 - DNA, 22 bp, Homo sapiens
catatttctgtatatttgtcat

SEQ ID NO: 6710878 - DNA, 13 bp, Homo sapiens
catatttctgtgg

SEQ ID NO: 6710879 - DNA, 15 bp, Homo sapiens
catatttctgtggag

SEQ ID NO: 6710880 - DNA, 20 bp, Homo sapiens
catatttcttgagtaattta

SEQ ID NO: 6710881 - DNA, 13 bp, Homo sapiens
catatttgaattg

SEQ ID NO: 6710882 - DNA, 15 bp, Homo sapiens
catatttgcatatgt

SEQ ID NO: 6710883 - DNA, 20 bp, Homo sapiens
catatttgccaataaagctt

SEQ ID NO: 6710884 - DNA, 18 bp, Homo sapiens
catatttgcttctaatgt

SEQ ID NO: 6710885 - DNA, 14 bp, Homo sapiens
catatttggatggt

SEQ ID NO: 6710886 - DNA, 14 bp, Homo sapiens
catatttgtaaaat

SEQ ID NO: 6710887 - DNA, 15 bp, Homo sapiens
catatttgtaaaatg

SEQ ID NO: 6710888 - DNA, 14 bp, Homo sapiens
catatttgtacttt

SEQ ID NO: 6710889 - DNA, 18 bp, Homo sapiens
catatttgtactttctgt

SEQ ID NO: 6710890 - DNA, 20 bp, Homo sapiens
catatttgtactttctgtta

SEQ ID NO: 6710891 - DNA, 18 bp, Homo sapiens
catatttgtatagttgct

SEQ ID NO: 6710892 - DNA, 22 bp, Homo sapiens
catatttgtatagttgcttgcc

SEQ ID NO: 6710893 - DNA, 23 bp, Homo sapiens
catatttgtatgtttttctgtat

SEQ ID NO: 6710894 - DNA, 12 bp, Homo sapiens
catatttgtgtt

SEQ ID NO: 6710895 - DNA, 14 bp, Homo sapiens
catatttgtgttca

SEQ ID NO: 6710896 - DNA, 19 bp, Homo sapiens
catatttgttaaatattta

SEQ ID NO: 6710897 - DNA, 17 bp, Homo sapiens
catattttaaaaaatca

SEQ ID NO: 6710898 - DNA, 18 bp, Homo sapiens
catattttaaaaaatcaa

SEQ ID NO: 6710899 - DNA, 19 bp, Homo sapiens
catattttaaaatttgttc

SEQ ID NO: 6710900 - DNA, 16 bp, Homo sapiens
catattttaaacagag

SEQ ID NO: 6710901 - DNA, 15 bp, Homo sapiens
catattttaaattct

SEQ ID NO: 6710902 - DNA, 19 bp, Homo sapiens
catattttaatcattattt

SEQ ID NO: 6710903 - DNA, 22 bp, Homo sapiens
catattttaatcattatttgag

SEQ ID NO: 6710904 - DNA, 23 bp, Homo sapiens
catattttaatcattatttgaga

SEQ ID NO: 6710905 - DNA, 15 bp, Homo sapiens
catattttaatttca

SEQ ID NO: 6710906 - DNA, 23 bp, Homo sapiens
catattttaatttcaagcttatt

SEQ ID NO: 6710907 - DNA, 13 bp, Homo sapiens
catattttagcta

SEQ ID NO: 6710908 - DNA, 17 bp, Homo sapiens
catattttagctgcacg

SEQ ID NO: 6710909 - DNA, 17 bp, Homo sapiens
catattttatagaactt

SEQ ID NO: 6710910 - DNA, 23 bp, Homo sapiens
catattttcacatgacgtaaaat

SEQ ID NO: 6710911 - DNA, 16 bp, Homo sapiens
catattttgagaaact

SEQ ID NO: 6710912 - DNA, 19 bp, Homo sapiens
catattttgattattgtat

SEQ ID NO: 6710913 - DNA, 14 bp, Homo sapiens
catattttgccact

SEQ ID NO: 6710914 - DNA, 20 bp, Homo sapiens
catatttttaaaacaaacca

SEQ ID NO: 6710915 - DNA, 21 bp, Homo sapiens
catatttttcacatatctagt

SEQ ID NO: 6710916 - DNA, 16 bp, Homo sapiens
catatttttctaaaga

SEQ ID NO: 6710917 - DNA, 17 bp, Homo sapiens
catatttttctaaagaa

SEQ ID NO: 6710918 - DNA, 20 bp, Homo sapiens
catatttttgatcatccctt

SEQ ID NO: 6710919 - DNA, 16 bp, Homo sapiens
catatttttgtaaata

SEQ ID NO: 6710920 - DNA, 18 bp, Homo sapiens
catattttttatgatgga

SEQ ID NO: 6710921 - DNA, 15 bp, Homo sapiens
catcaaaaaaggcag

SEQ ID NO: 6710922 - DNA, 16 bp, Homo sapiens
catcaaaaagaaaaat

SEQ ID NO: 6710923 - DNA, 14 bp, Homo sapiens
catcaaaaagagtc

SEQ ID NO: 6710924 - DNA, 19 bp, Homo sapiens
catcaaaaagagtcttaat

SEQ ID NO: 6710925 - DNA, 21 bp, Homo sapiens
catcaaaaagagtcttaattt

SEQ ID NO: 6710926 - DNA, 12 bp, Homo sapiens
catcaaaagaca

SEQ ID NO: 6710927 - DNA, 14 bp, Homo sapiens
catcaaaagacaat

SEQ ID NO: 6710928 - DNA, 15 bp, Homo sapiens
catcaaaagacaatt

SEQ ID NO: 6710929 - DNA, 18 bp, Homo sapiens
catcaaaagacaattctt

SEQ ID NO: 6710930 - DNA, 20 bp, Homo sapiens
catcaaaagacaattcttta

SEQ ID NO: 6710931 - DNA, 22 bp, Homo sapiens
catcaaaagacaattctttata

SEQ ID NO: 6710932 - DNA, 19 bp, Homo sapiens
catcaaaatatttcagtga

SEQ ID NO: 6710933 - DNA, 14 bp, Homo sapiens
catcaaacatgaaa

SEQ ID NO: 6710934 - DNA, 15 bp, Homo sapiens
catcaaacatgaaaa

SEQ ID NO: 6710935 - DNA, 18 bp, Homo sapiens
catcaaacatttgccaag

SEQ ID NO: 6710936 - DNA, 13 bp, Homo sapiens
catcaaacctcac

SEQ ID NO: 6710937 - DNA, 18 bp, Homo sapiens
catcaaacctttgagtag

SEQ ID NO: 6710938 - DNA, 14 bp, Homo sapiens
catcaaactgtaaa

SEQ ID NO: 6710939 - DNA, 11 bp, Homo sapiens
catcaaagagg

SEQ ID NO: 6710940 - DNA, 23 bp, Homo sapiens
catcaaagaggctgaggctggca

SEQ ID NO: 6710941 - DNA, 18 bp, Homo sapiens
catcaaagcagaagtctg

SEQ ID NO: 6710942 - DNA, 23 bp, Homo sapiens
catcaaagcagaagtctggcttt

SEQ ID NO: 6710943 - DNA, 21 bp, Homo sapiens
catcaaagctagaatgtgaat

SEQ ID NO: 6710944 - DNA, 14 bp, Homo sapiens
catcaaagcttctt

SEQ ID NO: 6710945 - DNA, 18 bp, Homo sapiens
catcaaaggaatataaga

SEQ ID NO: 6710946 - DNA, 17 bp, Homo sapiens
catcaaaggagattctt

SEQ ID NO: 6710947 - DNA, 22 bp, Homo sapiens
catcaaagtgtttaattgtata

SEQ ID NO: 6710948 - DNA, 14 bp, Homo sapiens
catcaaataaactg

SEQ ID NO: 6710949 - DNA, 21 bp, Homo sapiens
catcaaataaatttctgggat

SEQ ID NO: 6710950 - DNA, 16 bp, Homo sapiens
catcaaataatacatc

SEQ ID NO: 6710951 - DNA, 16 bp, Homo sapiens
catcaaatatttcttg

SEQ ID NO: 6710952 - DNA, 21 bp, Homo sapiens
catcaaatgaataatgccttt

SEQ ID NO: 6710953 - DNA, 15 bp, Homo sapiens
catcaaatgcatgcg

SEQ ID NO: 6710954 - DNA, 14 bp, Homo sapiens
catcaaatgctgta

SEQ ID NO: 6710955 - DNA, 15 bp, Homo sapiens
catcaaatggaagac

SEQ ID NO: 6710956 - DNA, 19 bp, Homo sapiens
catcaacaatgattaatca

SEQ ID NO: 6710957 - DNA, 24 bp, Homo sapiens
catcaacaatgattaatcagctgt

SEQ ID NO: 6710958 - DNA, 22 bp, Homo sapiens
catcaacatggcaattgcactc

SEQ ID NO: 6710959 - DNA, 14 bp, Homo sapiens
catcaacttaaaag

SEQ ID NO: 6710960 - DNA, 15 bp, Homo sapiens
catcaacttaaaagt

SEQ ID NO: 6710961 - DNA, 17 bp, Homo sapiens
catcaagaagggctgca

SEQ ID NO: 6710962 - DNA, 20 bp, Homo sapiens
catcaagaagggctgcatga

SEQ ID NO: 6710963 - DNA, 22 bp, Homo sapiens
catcaagaagggctgcatgatg

SEQ ID NO: 6710964 - DNA, 19 bp, Homo sapiens
catcaagactatctacaaa

SEQ ID NO: 6710965 - DNA, 17 bp, Homo sapiens
catcaagacttcaatcc

SEQ ID NO: 6710966 - DNA, 16 bp, Homo sapiens
catcaagactttgcta

SEQ ID NO: 6710967 - DNA, 17 bp, Homo sapiens
catcaagagactgagtc

SEQ ID NO: 6710968 - DNA, 23 bp, Homo sapiens
catcaagattaattaaaatttgg

SEQ ID NO: 6710969 - DNA, 18 bp, Homo sapiens
catcaagcacagaaggag

SEQ ID NO: 6710970 - DNA, 19 bp, Homo sapiens
catcaagcacttcccagga

SEQ ID NO: 6710971 - DNA, 15 bp, Homo sapiens
catcaagcttttctg

SEQ ID NO: 6710972 - DNA, 17 bp, Homo sapiens
catcaaggcactgcctg

SEQ ID NO: 6710973 - DNA, 17 bp, Homo sapiens
catcaaggggtcactta

SEQ ID NO: 6710974 - DNA, 13 bp, Homo sapiens
catcaagggtcat

SEQ ID NO: 6710975 - DNA, 16 bp, Homo sapiens
catcaaggtccagtgg

SEQ ID NO: 6710976 - DNA, 18 bp, Homo sapiens
catcaagtagtagtactt

SEQ ID NO: 6710977 - DNA, 18 bp, Homo sapiens
catcaagtctccacgtgt

SEQ ID NO: 6710978 - DNA, 22 bp, Homo sapiens
catcaagtctttcacatttaaa

SEQ ID NO: 6710979 - DNA, 15 bp, Homo sapiens
catcaagtgtaatta

SEQ ID NO: 6710980 - DNA, 23 bp, Homo sapiens
catcaagttattgacaaactctc

SEQ ID NO: 6710981 - DNA, 19 bp, Homo sapiens
catcaagttgtgccaaatt

SEQ ID NO: 6710982 - DNA, 23 bp, Homo sapiens
catcaataaaggggaattgtgtt

SEQ ID NO: 6710983 - DNA, 11 bp, Homo sapiens
catcaataaat

SEQ ID NO: 6710984 - DNA, 19 bp, Homo sapiens
catcaataaatactttaac

SEQ ID NO: 6710985 - DNA, 23 bp, Homo sapiens
catcaatacttttgtgtattctg

SEQ ID NO: 6710986 - DNA, 20 bp, Homo sapiens
catcaatatccctcttgtaa

SEQ ID NO: 6710987 - DNA, 24 bp, Homo sapiens
catcaatatccctcttgtaagtca

SEQ ID NO: 6710988 - DNA, 15 bp, Homo sapiens
catcaatatgtatat

SEQ ID NO: 6710989 - DNA, 21 bp, Homo sapiens
catcaatcaaatattttttga

SEQ ID NO: 6710990 - DNA, 22 bp, Homo sapiens
catcaatcaaatattttttgag

SEQ ID NO: 6710991 - DNA, 16 bp, Homo sapiens
catcaatcctgattcc

SEQ ID NO: 6710992 - DNA, 13 bp, Homo sapiens
catcaatcttgtt

SEQ ID NO: 6710993 - DNA, 16 bp, Homo sapiens
catcaatcttgttact

SEQ ID NO: 6710994 - DNA, 17 bp, Homo sapiens
catcaatcttgttactg

SEQ ID NO: 6710995 - DNA, 20 bp, Homo sapiens
catcaatggaaacagggcag

SEQ ID NO: 6710996 - DNA, 17 bp, Homo sapiens
catcaatgggattttct

SEQ ID NO: 6710997 - DNA, 19 bp, Homo sapiens
catcaatgggattttctag

SEQ ID NO: 6710998 - DNA, 19 bp, Homo sapiens
catcaatggggccagtcag

SEQ ID NO: 6710999 - DNA, 11 bp, Homo sapiens
catcaatgttc

SEQ ID NO: 6711000 - DNA, 11 bp, Homo sapiens
catcaattccc

SEQ ID NO: 6711001 - DNA, 21 bp, Homo sapiens
catcaattcttaaatttctta

SEQ ID NO: 6711002 - DNA, 11 bp, Homo sapiens
catcaatttgt

SEQ ID NO: 6711003 - DNA, 16 bp, Homo sapiens
catcaattttaacatt

SEQ ID NO: 6711004 - DNA, 20 bp, Homo sapiens
catcaattttaacatttgat

SEQ ID NO: 6711005 - DNA, 18 bp, Homo sapiens
catcaattttcacttgct

SEQ ID NO: 6711006 - DNA, 13 bp, Homo sapiens
catcaatttttat

SEQ ID NO: 6711007 - DNA, 15 bp, Homo sapiens
catcaatttttatac

SEQ ID NO: 6711008 - DNA, 16 bp, Homo sapiens
catcaatttttataca

SEQ ID NO: 6711009 - DNA, 18 bp, Homo sapiens
catcacaaccagatttga

SEQ ID NO: 6711010 - DNA, 15 bp, Homo sapiens
catcacaacctaaat

SEQ ID NO: 6711011 - DNA, 16 bp, Homo sapiens
catcacaacctaaatg

SEQ ID NO: 6711012 - DNA, 12 bp, Homo sapiens
catcacaataaa

SEQ ID NO: 6711013 - DNA, 18 bp, Homo sapiens
catcacaatattcagtgg

SEQ ID NO: 6711014 - DNA, 12 bp, Homo sapiens
catcacacacac

SEQ ID NO: 6711015 - DNA, 13 bp, Homo sapiens
catcacacacatg

SEQ ID NO: 6711016 - DNA, 15 bp, Homo sapiens
catcacactcaagga

SEQ ID NO: 6711017 - DNA, 14 bp, Homo sapiens
catcacactgggtg

SEQ ID NO: 6711018 - DNA, 20 bp, Homo sapiens
catcacagatcgcatttcct

SEQ ID NO: 6711019 - DNA, 19 bp, Homo sapiens
catcacagcaatatttaac

SEQ ID NO: 6711020 - DNA, 13 bp, Homo sapiens
catcacagcagcc

SEQ ID NO: 6711021 - DNA, 12 bp, Homo sapiens
catcacagccag

SEQ ID NO: 6711022 - DNA, 13 bp, Homo sapiens
catcacagccagc

SEQ ID NO: 6711023 - DNA, 14 bp, Homo sapiens
catcacagccagcc

SEQ ID NO: 6711024 - DNA, 18 bp, Homo sapiens
catcacagccagcccagc

SEQ ID NO: 6711025 - DNA, 16 bp, Homo sapiens
catcacagcccagccc

SEQ ID NO: 6711026 - DNA, 16 bp, Homo sapiens
catcacaggatgccag

SEQ ID NO: 6711027 - DNA, 23 bp, Homo sapiens
catcacaggatgccagcccctgc

SEQ ID NO: 6711028 - DNA, 13 bp, Homo sapiens
catcacaggctct

SEQ ID NO: 6711029 - DNA, 13 bp, Homo sapiens
catcacagggcag

SEQ ID NO: 6711030 - DNA, 15 bp, Homo sapiens
catcacagggcagag

SEQ ID NO: 6711031 - DNA, 19 bp, Homo sapiens
catcacagggcctcagttt

SEQ ID NO: 6711032 - DNA, 13 bp, Homo sapiens
catcacatagtat

SEQ ID NO: 6711033 - DNA, 15 bp, Homo sapiens
catcacatcatgctg

SEQ ID NO: 6711034 - DNA, 14 bp, Homo sapiens
catcacatctgcac

SEQ ID NO: 6711035 - DNA, 19 bp, Homo sapiens
catcacatctgcacactct

SEQ ID NO: 6711036 - DNA, 14 bp, Homo sapiens
catcacatcttatt

SEQ ID NO: 6711037 - DNA, 18 bp, Homo sapiens
catcacatcttatttatt

SEQ ID NO: 6711038 - DNA, 22 bp, Homo sapiens
catcacattcccatggtggcct

SEQ ID NO: 6711039 - DNA, 21 bp, Homo sapiens
catcacatttgtaaatgtctt

SEQ ID NO: 6711040 - DNA, 13 bp, Homo sapiens
catcacatttttg

SEQ ID NO: 6711041 - DNA, 15 bp, Homo sapiens
catcaccaacgtctg

SEQ ID NO: 6711042 - DNA, 15 bp, Homo sapiens
catcaccaccacacc

SEQ ID NO: 6711043 - DNA, 16 bp, Homo sapiens
catcaccacccttcca

SEQ ID NO: 6711044 - DNA, 15 bp, Homo sapiens
catcaccaggtgcat

SEQ ID NO: 6711045 - DNA, 22 bp, Homo sapiens
catcaccatcgtgtttgcaaag

SEQ ID NO: 6711046 - DNA, 18 bp, Homo sapiens
catcaccatttcctcctt

SEQ ID NO: 6711047 - DNA, 13 bp, Homo sapiens
catcacccaggct

SEQ ID NO: 6711048 - DNA, 13 bp, Homo sapiens
catcacccctggt

SEQ ID NO: 6711049 - DNA, 22 bp, Homo sapiens
catcacccctggtggctgcagg

SEQ ID NO: 6711050 - DNA, 24 bp, Homo sapiens
catcacccctggtggctgcaggca

SEQ ID NO: 6711051 - DNA, 13 bp, Homo sapiens
catcaccccttcc

SEQ ID NO: 6711052 - DNA, 14 bp, Homo sapiens
catcaccccttccc

SEQ ID NO: 6711053 - DNA, 16 bp, Homo sapiens
catcaccccttcccca

SEQ ID NO: 6711054 - DNA, 13 bp, Homo sapiens
catcaccctcacc

SEQ ID NO: 6711055 - DNA, 15 bp, Homo sapiens
catcaccctctgggc

SEQ ID NO: 6711056 - DNA, 17 bp, Homo sapiens
catcaccctctgggcag

SEQ ID NO: 6711057 - DNA, 22 bp, Homo sapiens
catcaccctgggagtttcctga

SEQ ID NO: 6711058 - DNA, 14 bp, Homo sapiens
catcacccttccga

SEQ ID NO: 6711059 - DNA, 23 bp, Homo sapiens
catcacccttccgacaggagcac

SEQ ID NO: 6711060 - DNA, 19 bp, Homo sapiens
catcaccctttgccttagc

SEQ ID NO: 6711061 - DNA, 14 bp, Homo sapiens
catcaccgctgggt

SEQ ID NO: 6711062 - DNA, 15 bp, Homo sapiens
catcaccgctgggtg

SEQ ID NO: 6711063 - DNA, 15 bp, Homo sapiens
catcaccggaggagc

SEQ ID NO: 6711064 - DNA, 23 bp, Homo sapiens
catcaccgtcattgatggagcct

SEQ ID NO: 6711065 - DNA, 23 bp, Homo sapiens
catcaccgtcccgcacagtggac

SEQ ID NO: 6711066 - DNA, 20 bp, Homo sapiens
catcacctactcacacaggc

SEQ ID NO: 6711067 - DNA, 14 bp, Homo sapiens
catcacctatttaa

SEQ ID NO: 6711068 - DNA, 17 bp, Homo sapiens
catcacctatttaatgt

SEQ ID NO: 6711069 - DNA, 16 bp, Homo sapiens
catcacctcagatggc

SEQ ID NO: 6711070 - DNA, 13 bp, Homo sapiens
catcacctcaggc

SEQ ID NO: 6711071 - DNA, 18 bp, Homo sapiens
catcacctcaggccaggt

SEQ ID NO: 6711072 - DNA, 14 bp, Homo sapiens
catcacctccacca

SEQ ID NO: 6711073 - DNA, 16 bp, Homo sapiens
catcacctctttgccc

SEQ ID NO: 6711074 - DNA, 14 bp, Homo sapiens
catcacctgaaaca

SEQ ID NO: 6711075 - DNA, 16 bp, Homo sapiens
catcacctgaaacact

SEQ ID NO: 6711076 - DNA, 20 bp, Homo sapiens
catcacctgaaacactggac

SEQ ID NO: 6711077 - DNA, 23 bp, Homo sapiens
catcacctgaaacactggacctg

SEQ ID NO: 6711078 - DNA, 14 bp, Homo sapiens
catcacctgggacc

SEQ ID NO: 6711079 - DNA, 17 bp, Homo sapiens
catcaccttaggcaggg

SEQ ID NO: 6711080 - DNA, 20 bp, Homo sapiens
catcaccttcctcctgtagt

SEQ ID NO: 6711081 - DNA, 13 bp, Homo sapiens
catcaccttcctg

SEQ ID NO: 6711082 - DNA, 16 bp, Homo sapiens
catcaccttcctgaat

SEQ ID NO: 6711083 - DNA, 21 bp, Homo sapiens
catcacggatggtgcatgggc

SEQ ID NO: 6711084 - DNA, 19 bp, Homo sapiens
catcacgtaccccactggg

SEQ ID NO: 6711085 - DNA, 16 bp, Homo sapiens
catcacgtcagtgctc

SEQ ID NO: 6711086 - DNA, 20 bp, Homo sapiens
catcacgtgtactggctcct

SEQ ID NO: 6711087 - DNA, 17 bp, Homo sapiens
catcactacaaaaagaa

SEQ ID NO: 6711088 - DNA, 17 bp, Homo sapiens
catcactagaagaaaag

SEQ ID NO: 6711089 - DNA, 18 bp, Homo sapiens
catcactagagtgctctg

SEQ ID NO: 6711090 - DNA, 16 bp, Homo sapiens
catcactagtggcaaa

SEQ ID NO: 6711091 - DNA, 17 bp, Homo sapiens
catcactatcaatttta

SEQ ID NO: 6711092 - DNA, 23 bp, Homo sapiens
catcactatcaattttaaggaaa

SEQ ID NO: 6711093 - DNA, 21 bp, Homo sapiens
catcactattgggcccccagg

SEQ ID NO: 6711094 - DNA, 14 bp, Homo sapiens
catcactccctgga

SEQ ID NO: 6711095 - DNA, 16 bp, Homo sapiens
catcactcggctgtgg

SEQ ID NO: 6711096 - DNA, 13 bp, Homo sapiens
catcactcttgta

SEQ ID NO: 6711097 - DNA, 19 bp, Homo sapiens
catcactgaaatccctcta

SEQ ID NO: 6711098 - DNA, 16 bp, Homo sapiens
catcactgagttttcc

SEQ ID NO: 6711099 - DNA, 11 bp, Homo sapiens
catcactgatg

SEQ ID NO: 6711100 - DNA, 16 bp, Homo sapiens
catcactgatgggaat

SEQ ID NO: 6711101 - DNA, 20 bp, Homo sapiens
catcactgatgggaataaaa

SEQ ID NO: 6711102 - DNA, 20 bp, Homo sapiens
catcactgctgtccctcctg

SEQ ID NO: 6711103 - DNA, 17 bp, Homo sapiens
catcactggactgcatg

SEQ ID NO: 6711104 - DNA, 19 bp, Homo sapiens
catcactggagcaccaggc

SEQ ID NO: 6711105 - DNA, 14 bp, Homo sapiens
catcactggcatgg

SEQ ID NO: 6711106 - DNA, 15 bp, Homo sapiens
catcactgtaaagac

SEQ ID NO: 6711107 - DNA, 20 bp, Homo sapiens
catcactgtaaagacaaata

SEQ ID NO: 6711108 - DNA, 14 bp, Homo sapiens
catcactgtatacc

SEQ ID NO: 6711109 - DNA, 14 bp, Homo sapiens
catcacttacagaa

SEQ ID NO: 6711110 - DNA, 14 bp, Homo sapiens
catcacttccctac

SEQ ID NO: 6711111 - DNA, 11 bp, Homo sapiens
catcacttcct

SEQ ID NO: 6711112 - DNA, 14 bp, Homo sapiens
catcacttctcccc

SEQ ID NO: 6711113 - DNA, 17 bp, Homo sapiens
catcacttcttccactg

SEQ ID NO: 6711114 - DNA, 20 bp, Homo sapiens
catcacttgaatcctagggc

SEQ ID NO: 6711115 - DNA, 14 bp, Homo sapiens
catcacttgtacaa

SEQ ID NO: 6711116 - DNA, 15 bp, Homo sapiens
catcacttgtacaaa

SEQ ID NO: 6711117 - DNA, 15 bp, Homo sapiens
catcactttcctgga

SEQ ID NO: 6711118 - DNA, 21 bp, Homo sapiens
catcactttcctggatccagg

SEQ ID NO: 6711119 - DNA, 17 bp, Homo sapiens
catcacttttcagtgat

SEQ ID NO: 6711120 - DNA, 15 bp, Homo sapiens
catcagaaaaccaaa

SEQ ID NO: 6711121 - DNA, 17 bp, Homo sapiens
catcagaaacaccctca

SEQ ID NO: 6711122 - DNA, 19 bp, Homo sapiens
catcagaaacaccctcaca

SEQ ID NO: 6711123 - DNA, 22 bp, Homo sapiens
catcagaaagctttattttgag

SEQ ID NO: 6711124 - DNA, 14 bp, Homo sapiens
catcagaaaggaat

SEQ ID NO: 6711125 - DNA, 12 bp, Homo sapiens
catcagaaaggg

SEQ ID NO: 6711126 - DNA, 16 bp, Homo sapiens
catcagaaagggaggg

SEQ ID NO: 6711127 - DNA, 18 bp, Homo sapiens
catcagaaagggagggct

SEQ ID NO: 6711128 - DNA, 23 bp, Homo sapiens
catcagaaagggagggctctgag

SEQ ID NO: 6711129 - DNA, 11 bp, Homo sapiens
catcagaaata

SEQ ID NO: 6711130 - DNA, 20 bp, Homo sapiens
catcagaaattttctacagt

SEQ ID NO: 6711131 - DNA, 17 bp, Homo sapiens
catcagaactcttcctc

SEQ ID NO: 6711132 - DNA, 13 bp, Homo sapiens
catcagaactgaa

SEQ ID NO: 6711133 - DNA, 11 bp, Homo sapiens
catcagaagga

SEQ ID NO: 6711134 - DNA, 14 bp, Homo sapiens
catcagaaggagaa

SEQ ID NO: 6711135 - DNA, 15 bp, Homo sapiens
catcagaaggtattt

SEQ ID NO: 6711136 - DNA, 23 bp, Homo sapiens
catcagaaggtattttttaactc

SEQ ID NO: 6711137 - DNA, 20 bp, Homo sapiens
catcagaagtaactcccact

SEQ ID NO: 6711138 - DNA, 14 bp, Homo sapiens
catcagaagtggta

SEQ ID NO: 6711139 - DNA, 17 bp, Homo sapiens
catcagaagttactttt

SEQ ID NO: 6711140 - DNA, 21 bp, Homo sapiens
catcagacaggtaaatgggca

SEQ ID NO: 6711141 - DNA, 12 bp, Homo sapiens
catcagacctgt

SEQ ID NO: 6711142 - DNA, 20 bp, Homo sapiens
catcagacctgtcttccaag

SEQ ID NO: 6711143 - DNA, 18 bp, Homo sapiens
catcagacttgcggccac

SEQ ID NO: 6711144 - DNA, 22 bp, Homo sapiens
catcagacttgcggccacagca

SEQ ID NO: 6711145 - DNA, 22 bp, Homo sapiens
catcagagaacagtcatgtatg

SEQ ID NO: 6711146 - DNA, 17 bp, Homo sapiens
catcagagcaaatttgg

SEQ ID NO: 6711147 - DNA, 11 bp, Homo sapiens
catcagatgcc

SEQ ID NO: 6711148 - DNA, 16 bp, Homo sapiens
catcagatgcctgctt

SEQ ID NO: 6711149 - DNA, 18 bp, Homo sapiens
catcagatgcctgcttga

SEQ ID NO: 6711150 - DNA, 13 bp, Homo sapiens
catcagattgtta

SEQ ID NO: 6711151 - DNA, 14 bp, Homo sapiens
catcagattgttaa

SEQ ID NO: 6711152 - DNA, 19 bp, Homo sapiens
catcagattgttaagggca

SEQ ID NO: 6711153 - DNA, 14 bp, Homo sapiens
catcagatttctta

SEQ ID NO: 6711154 - DNA, 23 bp, Homo sapiens
catcagcaaatgtgtacgtgcat

SEQ ID NO: 6711155 - DNA, 17 bp, Homo sapiens
catcagcaatgcttctc

SEQ ID NO: 6711156 - DNA, 16 bp, Homo sapiens
catcagcaccccagtg

SEQ ID NO: 6711157 - DNA, 19 bp, Homo sapiens
catcagcacgatttctgtt

SEQ ID NO: 6711158 - DNA, 21 bp, Homo sapiens
catcagcacgatttctgttta

SEQ ID NO: 6711159 - DNA, 12 bp, Homo sapiens
catcagcactct

SEQ ID NO: 6711160 - DNA, 13 bp, Homo sapiens
catcagcactctg

SEQ ID NO: 6711161 - DNA, 17 bp, Homo sapiens
catcagcactttaccag

SEQ ID NO: 6711162 - DNA, 21 bp, Homo sapiens
catcagcactttaccagaggc

SEQ ID NO: 6711163 - DNA, 12 bp, Homo sapiens
catcagcagcag

SEQ ID NO: 6711164 - DNA, 14 bp, Homo sapiens
catcagcaggagtg

SEQ ID NO: 6711165 - DNA, 14 bp, Homo sapiens
catcagcagtgatt

SEQ ID NO: 6711166 - DNA, 15 bp, Homo sapiens
catcagcatgttttc

SEQ ID NO: 6711167 - DNA, 14 bp, Homo sapiens
catcagccattttt

SEQ ID NO: 6711168 - DNA, 16 bp, Homo sapiens
catcagcccctgctgc

SEQ ID NO: 6711169 - DNA, 18 bp, Homo sapiens
catcagcccctgctgctc

SEQ ID NO: 6711170 - DNA, 14 bp, Homo sapiens
catcagcccctggg

SEQ ID NO: 6711171 - DNA, 15 bp, Homo sapiens
catcagcccctggga

SEQ ID NO: 6711172 - DNA, 18 bp, Homo sapiens
catcagcccctgggaaca

SEQ ID NO: 6711173 - DNA, 14 bp, Homo sapiens
catcagcctctggc

SEQ ID NO: 6711174 - DNA, 15 bp, Homo sapiens
catcagcctctggcc

SEQ ID NO: 6711175 - DNA, 17 bp, Homo sapiens
catcagcctctggccag

SEQ ID NO: 6711176 - DNA, 18 bp, Homo sapiens
catcagcctctggccaga

SEQ ID NO: 6711177 - DNA, 15 bp, Homo sapiens
catcagccttctcct

SEQ ID NO: 6711178 - DNA, 22 bp, Homo sapiens
catcagcggcgcgccctgcaga

SEQ ID NO: 6711179 - DNA, 16 bp, Homo sapiens
catcagcgggtctcct

SEQ ID NO: 6711180 - DNA, 18 bp, Homo sapiens
catcagcgggtctcctcc

SEQ ID NO: 6711181 - DNA, 22 bp, Homo sapiens
catcagcgggtctcctcccagc

SEQ ID NO: 6711182 - DNA, 17 bp, Homo sapiens
catcagcgtggcagtca

SEQ ID NO: 6711183 - DNA, 20 bp, Homo sapiens
catcagctaaacaccacgtc

SEQ ID NO: 6711184 - DNA, 22 bp, Homo sapiens
catcagctcccaacgagcctcc

SEQ ID NO: 6711185 - DNA, 13 bp, Homo sapiens
catcagctgaatt

SEQ ID NO: 6711186 - DNA, 17 bp, Homo sapiens
catcagctgctgaaaca

SEQ ID NO: 6711187 - DNA, 18 bp, Homo sapiens
catcagctgctgaaacaa

SEQ ID NO: 6711188 - DNA, 23 bp, Homo sapiens
catcagcttaggggctgctgacc

SEQ ID NO: 6711189 - DNA, 14 bp, Homo sapiens
catcagctttataa

SEQ ID NO: 6711190 - DNA, 16 bp, Homo sapiens
catcagctttccctgg

SEQ ID NO: 6711191 - DNA, 14 bp, Homo sapiens
catcagctttttgt

SEQ ID NO: 6711192 - DNA, 16 bp, Homo sapiens
catcaggaaagagagc

SEQ ID NO: 6711193 - DNA, 16 bp, Homo sapiens
catcaggaagcctgtg

SEQ ID NO: 6711194 - DNA, 15 bp, Homo sapiens
catcaggaccctgga

SEQ ID NO: 6711195 - DNA, 20 bp, Homo sapiens
catcaggagctgctcaggct

SEQ ID NO: 6711196 - DNA, 19 bp, Homo sapiens
catcaggagttccagtgct

SEQ ID NO: 6711197 - DNA, 22 bp, Homo sapiens
catcaggatactcaaagtggaa

SEQ ID NO: 6711198 - DNA, 23 bp, Homo sapiens
catcaggcactgcgccacctgct

SEQ ID NO: 6711199 - DNA, 13 bp, Homo sapiens
catcaggcactgg

SEQ ID NO: 6711200 - DNA, 22 bp, Homo sapiens
catcaggcagataactgctgta

SEQ ID NO: 6711201 - DNA, 13 bp, Homo sapiens
catcaggccaggc

SEQ ID NO: 6711202 - DNA, 23 bp, Homo sapiens
catcaggccaggccctctgccca

SEQ ID NO: 6711203 - DNA, 15 bp, Homo sapiens
catcaggctctgttc

SEQ ID NO: 6711204 - DNA, 18 bp, Homo sapiens
catcaggctgttattatg

SEQ ID NO: 6711205 - DNA, 11 bp, Homo sapiens
catcaggcttt

SEQ ID NO: 6711206 - DNA, 15 bp, Homo sapiens
catcaggctttctta

SEQ ID NO: 6711207 - DNA, 12 bp, Homo sapiens
catcagggacag

SEQ ID NO: 6711208 - DNA, 17 bp, Homo sapiens
catcagggatctcagag

SEQ ID NO: 6711209 - DNA, 20 bp, Homo sapiens
catcagggccctgccccagg

SEQ ID NO: 6711210 - DNA, 13 bp, Homo sapiens
catcagggcctgg

SEQ ID NO: 6711211 - DNA, 18 bp, Homo sapiens
catcagggcctggggcct

SEQ ID NO: 6711212 - DNA, 19 bp, Homo sapiens
catcagggcctttctcctc

SEQ ID NO: 6711213 - DNA, 20 bp, Homo sapiens
catcagggcctttctcctcc

SEQ ID NO: 6711214 - DNA, 21 bp, Homo sapiens
catcagggcctttctcctccc

SEQ ID NO: 6711215 - DNA, 21 bp, Homo sapiens
catcagggcggcctcccaggt

SEQ ID NO: 6711216 - DNA, 22 bp, Homo sapiens
catcagggcggcctcccaggtc

SEQ ID NO: 6711217 - DNA, 14 bp, Homo sapiens
catcagggcttgat

SEQ ID NO: 6711218 - DNA, 14 bp, Homo sapiens
catcaggggcagga

SEQ ID NO: 6711219 - DNA, 12 bp, Homo sapiens
catcagggtggg

SEQ ID NO: 6711220 - DNA, 20 bp, Homo sapiens
catcagggtgggccactctc

SEQ ID NO: 6711221 - DNA, 14 bp, Homo sapiens
catcaggtcaccgc

SEQ ID NO: 6711222 - DNA, 15 bp, Homo sapiens
catcaggtgaggtgt

SEQ ID NO: 6711223 - DNA, 17 bp, Homo sapiens
catcagtaagcagcctt

SEQ ID NO: 6711224 - DNA, 19 bp, Homo sapiens
catcagtagatttctggca

SEQ ID NO: 6711225 - DNA, 18 bp, Homo sapiens
catcagtagcatttttct

SEQ ID NO: 6711226 - DNA, 15 bp, Homo sapiens
catcagtattgtgta

SEQ ID NO: 6711227 - DNA, 16 bp, Homo sapiens
catcagtattgtgtaa

SEQ ID NO: 6711228 - DNA, 23 bp, Homo sapiens
catcagtattgtgtaaaggaaca

SEQ ID NO: 6711229 - DNA, 23 bp, Homo sapiens
catcagtcatcaggtgtgctcag

SEQ ID NO: 6711230 - DNA, 18 bp, Homo sapiens
catcagtccccctgtgca

SEQ ID NO: 6711231 - DNA, 14 bp, Homo sapiens
catcagtcctgcat

SEQ ID NO: 6711232 - DNA, 17 bp, Homo sapiens
catcagtcctgcatttc

SEQ ID NO: 6711233 - DNA, 17 bp, Homo sapiens
catcagtctccaacatg

SEQ ID NO: 6711234 - DNA, 17 bp, Homo sapiens
catcagtgacagactgg

SEQ ID NO: 6711235 - DNA, 15 bp, Homo sapiens
catcagtgaggaggg

SEQ ID NO: 6711236 - DNA, 16 bp, Homo sapiens
catcagtgaggaggga

SEQ ID NO: 6711237 - DNA, 17 bp, Homo sapiens
catcagtgccagcccct

SEQ ID NO: 6711238 - DNA, 19 bp, Homo sapiens
catcagtgccagcccctgc

SEQ ID NO: 6711239 - DNA, 15 bp, Homo sapiens
catcagtgctccctc

SEQ ID NO: 6711240 - DNA, 16 bp, Homo sapiens
catcagtgctccctca

SEQ ID NO: 6711241 - DNA, 24 bp, Homo sapiens
catcagtgctccctcacatgtcag

SEQ ID NO: 6711242 - DNA, 16 bp, Homo sapiens
catcagtgctctgtaa

SEQ ID NO: 6711243 - DNA, 14 bp, Homo sapiens
catcagtggagcca

SEQ ID NO: 6711244 - DNA, 20 bp, Homo sapiens
catcagtggagtccagatgg

SEQ ID NO: 6711245 - DNA, 16 bp, Homo sapiens
catcagtggcatggct

SEQ ID NO: 6711246 - DNA, 18 bp, Homo sapiens
catcagtggcatggctcc

SEQ ID NO: 6711247 - DNA, 21 bp, Homo sapiens
catcagtgtacccccgcccag

SEQ ID NO: 6711248 - DNA, 23 bp, Homo sapiens
catcagtgtacccccgcccaggc

SEQ ID NO: 6711249 - DNA, 14 bp, Homo sapiens
catcagtgtcattt

SEQ ID NO: 6711250 - DNA, 16 bp, Homo sapiens
catcagtgtgtaaata

SEQ ID NO: 6711251 - DNA, 15 bp, Homo sapiens
catcagtgttaaaaa

SEQ ID NO: 6711252 - DNA, 18 bp, Homo sapiens
catcagtgtttgttggat

SEQ ID NO: 6711253 - DNA, 13 bp, Homo sapiens
catcagttactgg

SEQ ID NO: 6711254 - DNA, 17 bp, Homo sapiens
catcagttactggtttc

SEQ ID NO: 6711255 - DNA, 17 bp, Homo sapiens
catcagttcccccagta

SEQ ID NO: 6711256 - DNA, 19 bp, Homo sapiens
catcagttcctttgtgtgt

SEQ ID NO: 6711257 - DNA, 20 bp, Homo sapiens
catcagtttaggccttggct

SEQ ID NO: 6711258 - DNA, 22 bp, Homo sapiens
catcataaaataaagtatatat

SEQ ID NO: 6711259 - DNA, 14 bp, Homo sapiens
catcataaaatttt

SEQ ID NO: 6711260 - DNA, 17 bp, Homo sapiens
catcataaaatttttat

SEQ ID NO: 6711261 - DNA, 19 bp, Homo sapiens
catcataaggaagttatta

SEQ ID NO: 6711262 - DNA, 13 bp, Homo sapiens
catcataattaca

SEQ ID NO: 6711263 - DNA, 17 bp, Homo sapiens
catcataattacattcc

SEQ ID NO: 6711264 - DNA, 17 bp, Homo sapiens
catcataggaagggacc

SEQ ID NO: 6711265 - DNA, 13 bp, Homo sapiens
catcataggtaac

SEQ ID NO: 6711266 - DNA, 19 bp, Homo sapiens
catcatagtttgctttgtt

SEQ ID NO: 6711267 - DNA, 15 bp, Homo sapiens
catcatatcccctgt

SEQ ID NO: 6711268 - DNA, 15 bp, Homo sapiens
catcatatgaatgtt

SEQ ID NO: 6711269 - DNA, 14 bp, Homo sapiens
catcatatgcctga

SEQ ID NO: 6711270 - DNA, 21 bp, Homo sapiens
catcatattctattgtttact

SEQ ID NO: 6711271 - DNA, 19 bp, Homo sapiens
catcatcaaggcactgcct

SEQ ID NO: 6711272 - DNA, 12 bp, Homo sapiens
catcatcactgt

SEQ ID NO: 6711273 - DNA, 15 bp, Homo sapiens
catcatcactgtaaa

SEQ ID NO: 6711274 - DNA, 13 bp, Homo sapiens
catcatcagagcc

SEQ ID NO: 6711275 - DNA, 13 bp, Homo sapiens
catcatcagggcc

SEQ ID NO: 6711276 - DNA, 14 bp, Homo sapiens
catcatcagggcct

SEQ ID NO: 6711277 - DNA, 16 bp, Homo sapiens
catcatcagggcctgg

SEQ ID NO: 6711278 - DNA, 13 bp, Homo sapiens
catcatccacccg

SEQ ID NO: 6711279 - DNA, 17 bp, Homo sapiens
catcatccagatgtggc

SEQ ID NO: 6711280 - DNA, 13 bp, Homo sapiens
catcatccctccc

SEQ ID NO: 6711281 - DNA, 17 bp, Homo sapiens
catcatccctccctgcc

SEQ ID NO: 6711282 - DNA, 17 bp, Homo sapiens
catcatcctcagcagca

SEQ ID NO: 6711283 - DNA, 19 bp, Homo sapiens
catcatcctcccgccagga

SEQ ID NO: 6711284 - DNA, 22 bp, Homo sapiens
catcatcctcccgccaggagct

SEQ ID NO: 6711285 - DNA, 13 bp, Homo sapiens
catcatcctcctt

SEQ ID NO: 6711286 - DNA, 14 bp, Homo sapiens
catcatctcagctc

SEQ ID NO: 6711287 - DNA, 15 bp, Homo sapiens
catcatctcagctca

SEQ ID NO: 6711288 - DNA, 20 bp, Homo sapiens
catcatctcctgccttcctc

SEQ ID NO: 6711289 - DNA, 21 bp, Homo sapiens
catcatctcctgccttcctcc

SEQ ID NO: 6711290 - DNA, 11 bp, Homo sapiens
catcatctctg

SEQ ID NO: 6711291 - DNA, 15 bp, Homo sapiens
catcatctctgaagg

SEQ ID NO: 6711292 - DNA, 16 bp, Homo sapiens
catcatctctgccttt

SEQ ID NO: 6711293 - DNA, 16 bp, Homo sapiens
catcatctcttcctca

SEQ ID NO: 6711294 - DNA, 16 bp, Homo sapiens
catcatctcttgataa

SEQ ID NO: 6711295 - DNA, 14 bp, Homo sapiens
catcatctcttttc

SEQ ID NO: 6711296 - DNA, 17 bp, Homo sapiens
catcatctgctgcacat

SEQ ID NO: 6711297 - DNA, 13 bp, Homo sapiens
catcatctgggaa

SEQ ID NO: 6711298 - DNA, 15 bp, Homo sapiens
catcatctgtttgta

SEQ ID NO: 6711299 - DNA, 18 bp, Homo sapiens
catcatctttatctcctg

SEQ ID NO: 6711300 - DNA, 14 bp, Homo sapiens
catcatgaactggc

SEQ ID NO: 6711301 - DNA, 15 bp, Homo sapiens
catcatgaactggct

SEQ ID NO: 6711302 - DNA, 16 bp, Homo sapiens
catcatgaattttaca

SEQ ID NO: 6711303 - DNA, 17 bp, Homo sapiens
catcatgaccagcaaat

SEQ ID NO: 6711304 - DNA, 19 bp, Homo sapiens
catcatgagccgttgctaa

SEQ ID NO: 6711305 - DNA, 16 bp, Homo sapiens
catcatgagttctgct

SEQ ID NO: 6711306 - DNA, 18 bp, Homo sapiens
catcatgagttctgctga

SEQ ID NO: 6711307 - DNA, 12 bp, Homo sapiens
catcatgcagct

SEQ ID NO: 6711308 - DNA, 14 bp, Homo sapiens
catcatgcattcac

SEQ ID NO: 6711309 - DNA, 15 bp, Homo sapiens
catcatgccacaccg

SEQ ID NO: 6711310 - DNA, 14 bp, Homo sapiens
catcatgcctctga

SEQ ID NO: 6711311 - DNA, 22 bp, Homo sapiens
catcatgcctctgaggccagcc

SEQ ID NO: 6711312 - DNA, 23 bp, Homo sapiens
catcatgcctctgaggccagcct

SEQ ID NO: 6711313 - DNA, 21 bp, Homo sapiens
catcatgccttgataaatata

SEQ ID NO: 6711314 - DNA, 20 bp, Homo sapiens
catcatgcggtgggtgctgc

SEQ ID NO: 6711315 - DNA, 21 bp, Homo sapiens
catcatgcttacaaaaaagaa

SEQ ID NO: 6711316 - DNA, 16 bp, Homo sapiens
catcatgcttatgtta

SEQ ID NO: 6711317 - DNA, 21 bp, Homo sapiens
catcatggaaagactgggaca

SEQ ID NO: 6711318 - DNA, 23 bp, Homo sapiens
catcatggatcaaccaagttaca

SEQ ID NO: 6711319 - DNA, 15 bp, Homo sapiens
catcatggccagctg

SEQ ID NO: 6711320 - DNA, 15 bp, Homo sapiens
catcatggctatctg

SEQ ID NO: 6711321 - DNA, 14 bp, Homo sapiens
catcatggctgctt

SEQ ID NO: 6711322 - DNA, 19 bp, Homo sapiens
catcatggtggatatggtg

SEQ ID NO: 6711323 - DNA, 15 bp, Homo sapiens
catcatgtaagatgg

SEQ ID NO: 6711324 - DNA, 22 bp, Homo sapiens
catcatgtccccaaacctgcaa

SEQ ID NO: 6711325 - DNA, 14 bp, Homo sapiens
catcatgtctcttt

SEQ ID NO: 6711326 - DNA, 21 bp, Homo sapiens
catcatgtctctttgccaagg

SEQ ID NO: 6711327 - DNA, 14 bp, Homo sapiens
catcatgtctggct

SEQ ID NO: 6711328 - DNA, 12 bp, Homo sapiens
catcatgtctgt

SEQ ID NO: 6711329 - DNA, 16 bp, Homo sapiens
catcatgtctgtatac

SEQ ID NO: 6711330 - DNA, 13 bp, Homo sapiens
catcatgttactt

SEQ ID NO: 6711331 - DNA, 19 bp, Homo sapiens
catcatgtttacagaggac

SEQ ID NO: 6711332 - DNA, 18 bp, Homo sapiens
catcattaagaataattg

SEQ ID NO: 6711333 - DNA, 22 bp, Homo sapiens
catcattaataagtgaagaata

SEQ ID NO: 6711334 - DNA, 22 bp, Homo sapiens
catcattaatgactttatgtat

SEQ ID NO: 6711335 - DNA, 21 bp, Homo sapiens
catcattacttgggaaatttt

SEQ ID NO: 6711336 - DNA, 16 bp, Homo sapiens
catcattcacttcact

SEQ ID NO: 6711337 - DNA, 19 bp, Homo sapiens
catcattcacttcactgtg

SEQ ID NO: 6711338 - DNA, 20 bp, Homo sapiens
catcattcacttcactgtgc

SEQ ID NO: 6711339 - DNA, 23 bp, Homo sapiens
catcattcataaaagtttgcatg

SEQ ID NO: 6711340 - DNA, 17 bp, Homo sapiens
catcattcattcactgt

SEQ ID NO: 6711341 - DNA, 21 bp, Homo sapiens
catcattccaaaaagaacaat

SEQ ID NO: 6711342 - DNA, 16 bp, Homo sapiens
catcattccctctcat

SEQ ID NO: 6711343 - DNA, 20 bp, Homo sapiens
catcattccctctcatctca

SEQ ID NO: 6711344 - DNA, 22 bp, Homo sapiens
catcattcttgtgggagacagc

SEQ ID NO: 6711345 - DNA, 13 bp, Homo sapiens
catcattgaaatc

SEQ ID NO: 6711346 - DNA, 21 bp, Homo sapiens
catcattgaaatctttttgct

SEQ ID NO: 6711347 - DNA, 16 bp, Homo sapiens
catcattgcacctgca

SEQ ID NO: 6711348 - DNA, 21 bp, Homo sapiens
catcattgcacctgcaggctt

SEQ ID NO: 6711349 - DNA, 18 bp, Homo sapiens
catcattgctgtctgcag

SEQ ID NO: 6711350 - DNA, 22 bp, Homo sapiens
catcattggaatacaggaagta

SEQ ID NO: 6711351 - DNA, 22 bp, Homo sapiens
catcattggccctcattccaag

SEQ ID NO: 6711352 - DNA, 14 bp, Homo sapiens
catcattgtaaatt

SEQ ID NO: 6711353 - DNA, 14 bp, Homo sapiens
catcattgtatata

SEQ ID NO: 6711354 - DNA, 15 bp, Homo sapiens
catcattgtatatat

SEQ ID NO: 6711355 - DNA, 16 bp, Homo sapiens
catcattgtcagcctt

SEQ ID NO: 6711356 - DNA, 20 bp, Homo sapiens
catcattgtcagccttgcta

SEQ ID NO: 6711357 - DNA, 16 bp, Homo sapiens
catcattgtccccatg

SEQ ID NO: 6711358 - DNA, 22 bp, Homo sapiens
catcattgtccccatgcaacaa

SEQ ID NO: 6711359 - DNA, 17 bp, Homo sapiens
catcattgttgtgtata

SEQ ID NO: 6711360 - DNA, 20 bp, Homo sapiens
catcattgtttagatgaggc

SEQ ID NO: 6711361 - DNA, 17 bp, Homo sapiens
catcattgtttctgcat

SEQ ID NO: 6711362 - DNA, 12 bp, Homo sapiens
catcatttatca

SEQ ID NO: 6711363 - DNA, 21 bp, Homo sapiens
catcatttatcatcacaaatg

SEQ ID NO: 6711364 - DNA, 15 bp, Homo sapiens
catcatttcacttgt

SEQ ID NO: 6711365 - DNA, 13 bp, Homo sapiens
catcatttcagcc

SEQ ID NO: 6711366 - DNA, 16 bp, Homo sapiens
catcatttcattcgtg

SEQ ID NO: 6711367 - DNA, 14 bp, Homo sapiens
catcatttcccagg

SEQ ID NO: 6711368 - DNA, 16 bp, Homo sapiens
catcatttcccctccc

SEQ ID NO: 6711369 - DNA, 19 bp, Homo sapiens
catcatttcccctcccgct

SEQ ID NO: 6711370 - DNA, 22 bp, Homo sapiens
catcatttcccctcccgcttcc

SEQ ID NO: 6711371 - DNA, 20 bp, Homo sapiens
catcatttctgtctttaaga

SEQ ID NO: 6711372 - DNA, 15 bp, Homo sapiens
catcattttattata

SEQ ID NO: 6711373 - DNA, 16 bp, Homo sapiens
catcattttattataa

SEQ ID NO: 6711374 - DNA, 21 bp, Homo sapiens
catcattttcacctccatttc

SEQ ID NO: 6711375 - DNA, 22 bp, Homo sapiens
catcattttccatatcctggtg

SEQ ID NO: 6711376 - DNA, 17 bp, Homo sapiens
catcattttctccacct

SEQ ID NO: 6711377 - DNA, 22 bp, Homo sapiens
catcattttgcattcaaattaa

SEQ ID NO: 6711378 - DNA, 17 bp, Homo sapiens
catcatttttgtatcta

SEQ ID NO: 6711379 - DNA, 14 bp, Homo sapiens
catcattttttact

SEQ ID NO: 6711380 - DNA, 16 bp, Homo sapiens
catcattttttgtttc

SEQ ID NO: 6711381 - DNA, 17 bp, Homo sapiens
catcattttttgtttct

SEQ ID NO: 6711382 - DNA, 18 bp, Homo sapiens
catcattttttgtttctt

SEQ ID NO: 6711383 - DNA, 16 bp, Homo sapiens
catccaaaagtgacca

SEQ ID NO: 6711384 - DNA, 17 bp, Homo sapiens
catccaaaatatttttt

SEQ ID NO: 6711385 - DNA, 17 bp, Homo sapiens
catccaaaatcttgatc

SEQ ID NO: 6711386 - DNA, 15 bp, Homo sapiens
catccaaacatgtat

SEQ ID NO: 6711387 - DNA, 13 bp, Homo sapiens
catccaaacctac

SEQ ID NO: 6711388 - DNA, 15 bp, Homo sapiens
catccaaactcagaa

SEQ ID NO: 6711389 - DNA, 14 bp, Homo sapiens
catccaaagattgc

SEQ ID NO: 6711390 - DNA, 21 bp, Homo sapiens
catccaaagcagacagctcca

SEQ ID NO: 6711391 - DNA, 21 bp, Homo sapiens
catccaaaggctcctgagaca

SEQ ID NO: 6711392 - DNA, 16 bp, Homo sapiens
catccaaataggagtc

SEQ ID NO: 6711393 - DNA, 16 bp, Homo sapiens
catccaaatggctgct

SEQ ID NO: 6711394 - DNA, 16 bp, Homo sapiens
catccaaattaagttt

SEQ ID NO: 6711395 - DNA, 19 bp, Homo sapiens
catccaaccccccacctgc

SEQ ID NO: 6711396 - DNA, 16 bp, Homo sapiens
catccaaccttcccaa

SEQ ID NO: 6711397 - DNA, 20 bp, Homo sapiens
catccaactggaaattccag

SEQ ID NO: 6711398 - DNA, 23 bp, Homo sapiens
catccaactggaaggctttattc

SEQ ID NO: 6711399 - DNA, 14 bp, Homo sapiens
catccaacttatgt

SEQ ID NO: 6711400 - DNA, 16 bp, Homo sapiens
catccaacttccaaga

SEQ ID NO: 6711401 - DNA, 17 bp, Homo sapiens
catccaagagtgcgccg

SEQ ID NO: 6711402 - DNA, 21 bp, Homo sapiens
catccaaggaacctaattgaa

SEQ ID NO: 6711403 - DNA, 22 bp, Homo sapiens
catccaaggaagggatgtattt

SEQ ID NO: 6711404 - DNA, 22 bp, Homo sapiens
catccaaggagaaacagagaca

SEQ ID NO: 6711405 - DNA, 23 bp, Homo sapiens
catccaaggagaaacagagacag

SEQ ID NO: 6711406 - DNA, 17 bp, Homo sapiens
catccaaggcaaacaat

SEQ ID NO: 6711407 - DNA, 22 bp, Homo sapiens
catccaagtctttcttcttttt

SEQ ID NO: 6711408 - DNA, 23 bp, Homo sapiens
catccaataaaaatcaggagcct

SEQ ID NO: 6711409 - DNA, 16 bp, Homo sapiens
catccaatcctcactg

SEQ ID NO: 6711410 - DNA, 20 bp, Homo sapiens
catccaatctattatttctc

SEQ ID NO: 6711411 - DNA, 15 bp, Homo sapiens
catccaatgcatagt

SEQ ID NO: 6711412 - DNA, 23 bp, Homo sapiens
catccaatgctcaagaaacaact

SEQ ID NO: 6711413 - DNA, 20 bp, Homo sapiens
catccacaactaatgaggga

SEQ ID NO: 6711414 - DNA, 14 bp, Homo sapiens
catccacacacagc

SEQ ID NO: 6711415 - DNA, 16 bp, Homo sapiens
catccacacacagcag

SEQ ID NO: 6711416 - DNA, 17 bp, Homo sapiens
catccacacacagcagc

SEQ ID NO: 6711417 - DNA, 14 bp, Homo sapiens
catccacaccctct

SEQ ID NO: 6711418 - DNA, 15 bp, Homo sapiens
catccacaggattcc

SEQ ID NO: 6711419 - DNA, 15 bp, Homo sapiens
catccacagttgtca

SEQ ID NO: 6711420 - DNA, 16 bp, Homo sapiens
catccacataaccctg

SEQ ID NO: 6711421 - DNA, 21 bp, Homo sapiens
catccacataaccctgtcacc

SEQ ID NO: 6711422 - DNA, 15 bp, Homo sapiens
catccacatgcacat

SEQ ID NO: 6711423 - DNA, 18 bp, Homo sapiens
catccacatgcacatgta

SEQ ID NO: 6711424 - DNA, 17 bp, Homo sapiens
catccacatgggagccg

SEQ ID NO: 6711425 - DNA, 17 bp, Homo sapiens
catccacattgttttaa

SEQ ID NO: 6711426 - DNA, 21 bp, Homo sapiens
catccacattgttttaaaaag

SEQ ID NO: 6711427 - DNA, 16 bp, Homo sapiens
catccaccaaactcct

SEQ ID NO: 6711428 - DNA, 18 bp, Homo sapiens
catccaccaaactcctgc

SEQ ID NO: 6711429 - DNA, 13 bp, Homo sapiens
catccaccacctt

SEQ ID NO: 6711430 - DNA, 15 bp, Homo sapiens
catccaccagtgtgt

SEQ ID NO: 6711431 - DNA, 14 bp, Homo sapiens
catccacccagtgc

SEQ ID NO: 6711432 - DNA, 15 bp, Homo sapiens
catccacccagtgct

SEQ ID NO: 6711433 - DNA, 23 bp, Homo sapiens
catccacccatgtttattaagaa

SEQ ID NO: 6711434 - DNA, 14 bp, Homo sapiens
catccaccccactg

SEQ ID NO: 6711435 - DNA, 15 bp, Homo sapiens
catccaccccagccc

SEQ ID NO: 6711436 - DNA, 20 bp, Homo sapiens
catccacccgctgcccctcc

SEQ ID NO: 6711437 - DNA, 22 bp, Homo sapiens
catccacccgctgcccctcccc

SEQ ID NO: 6711438 - DNA, 22 bp, Homo sapiens
catccacccgggggagcccagt

SEQ ID NO: 6711439 - DNA, 14 bp, Homo sapiens
catccaccctgcag

SEQ ID NO: 6711440 - DNA, 17 bp, Homo sapiens
catccaccgccacccca

SEQ ID NO: 6711441 - DNA, 23 bp, Homo sapiens
catccacctatccaccaccccac

SEQ ID NO: 6711442 - DNA, 20 bp, Homo sapiens
catccacctcatcactggac

SEQ ID NO: 6711443 - DNA, 12 bp, Homo sapiens
catccacctcct

SEQ ID NO: 6711444 - DNA, 14 bp, Homo sapiens
catccacctccttc

SEQ ID NO: 6711445 - DNA, 14 bp, Homo sapiens
catccaccttccct

SEQ ID NO: 6711446 - DNA, 16 bp, Homo sapiens
catccaccttcccttc

SEQ ID NO: 6711447 - DNA, 14 bp, Homo sapiens
catccaccttcctg

SEQ ID NO: 6711448 - DNA, 18 bp, Homo sapiens
catccaccttcctgccca

SEQ ID NO: 6711449 - DNA, 23 bp, Homo sapiens
catccaccttcctgcccagggga

SEQ ID NO: 6711450 - DNA, 15 bp, Homo sapiens
catccacgtggcctc

SEQ ID NO: 6711451 - DNA, 21 bp, Homo sapiens
catccacgtggcctctctctc

SEQ ID NO: 6711452 - DNA, 21 bp, Homo sapiens
catccactagtgcaaatcata

SEQ ID NO: 6711453 - DNA, 15 bp, Homo sapiens
catccactctaccct

SEQ ID NO: 6711454 - DNA, 22 bp, Homo sapiens
catccactctaccctcccaccc

SEQ ID NO: 6711455 - DNA, 16 bp, Homo sapiens
catccacttcaggagc

SEQ ID NO: 6711456 - DNA, 19 bp, Homo sapiens
catccacttcaggagccct

SEQ ID NO: 6711457 - DNA, 20 bp, Homo sapiens
catccacttcaggagcccta

SEQ ID NO: 6711458 - DNA, 15 bp, Homo sapiens
catccagaaagctga

SEQ ID NO: 6711459 - DNA, 16 bp, Homo sapiens
catccagaaataaaga

SEQ ID NO: 6711460 - DNA, 15 bp, Homo sapiens
catccagaactgtct

SEQ ID NO: 6711461 - DNA, 17 bp, Homo sapiens
catccagactcagagct

SEQ ID NO: 6711462 - DNA, 20 bp, Homo sapiens
catccagagattcattttct

SEQ ID NO: 6711463 - DNA, 17 bp, Homo sapiens
catccagaggaataaaa

SEQ ID NO: 6711464 - DNA, 15 bp, Homo sapiens
catccagaggagctg

SEQ ID NO: 6711465 - DNA, 13 bp, Homo sapiens
catccagagtccc

SEQ ID NO: 6711466 - DNA, 17 bp, Homo sapiens
catccagagtccctgcc

SEQ ID NO: 6711467 - DNA, 18 bp, Homo sapiens
catccagagtccctgcct

SEQ ID NO: 6711468 - DNA, 13 bp, Homo sapiens
catccagatgtgg

SEQ ID NO: 6711469 - DNA, 23 bp, Homo sapiens
catccagcagatttccagccttc

SEQ ID NO: 6711470 - DNA, 12 bp, Homo sapiens
catccagcagca

SEQ ID NO: 6711471 - DNA, 18 bp, Homo sapiens
catccagcagcagcactt

SEQ ID NO: 6711472 - DNA, 16 bp, Homo sapiens
catccagcagtctctg

SEQ ID NO: 6711473 - DNA, 17 bp, Homo sapiens
catccagcagtctctgc

SEQ ID NO: 6711474 - DNA, 20 bp, Homo sapiens
catccagcagtctctgcctt

SEQ ID NO: 6711475 - DNA, 13 bp, Homo sapiens
catccagcagtgt

SEQ ID NO: 6711476 - DNA, 21 bp, Homo sapiens
catccagcagtgttgctcagc

SEQ ID NO: 6711477 - DNA, 15 bp, Homo sapiens
catccagcatgtgtg

SEQ ID NO: 6711478 - DNA, 17 bp, Homo sapiens
catccagccacggaggg

SEQ ID NO: 6711479 - DNA, 22 bp, Homo sapiens
catccagccacggagggaggca

SEQ ID NO: 6711480 - DNA, 23 bp, Homo sapiens
catccagccacggagggaggcac

SEQ ID NO: 6711481 - DNA, 13 bp, Homo sapiens
catccagcctcag

SEQ ID NO: 6711482 - DNA, 16 bp, Homo sapiens
catccagcctccaggg

SEQ ID NO: 6711483 - DNA, 22 bp, Homo sapiens
catccagcgagagagtttcaaa

SEQ ID NO: 6711484 - DNA, 23 bp, Homo sapiens
catccagcgagagagtttcaaaa

SEQ ID NO: 6711485 - DNA, 18 bp, Homo sapiens
catccagctaccaccacg

SEQ ID NO: 6711486 - DNA, 21 bp, Homo sapiens
catccagctacttagctggcc

SEQ ID NO: 6711487 - DNA, 21 bp, Homo sapiens
catccagctcctctaggggca

SEQ ID NO: 6711488 - DNA, 14 bp, Homo sapiens
catccagcttgcca

SEQ ID NO: 6711489 - DNA, 15 bp, Homo sapiens
catccagcttgccag

SEQ ID NO: 6711490 - DNA, 15 bp, Homo sapiens
catccaggactgaga

SEQ ID NO: 6711491 - DNA, 22 bp, Homo sapiens
catccaggaggaataagctccc

SEQ ID NO: 6711492 - DNA, 17 bp, Homo sapiens
catccaggatggctgca

SEQ ID NO: 6711493 - DNA, 12 bp, Homo sapiens
catccaggctgg

SEQ ID NO: 6711494 - DNA, 20 bp, Homo sapiens
catccaggctggccagtgct

SEQ ID NO: 6711495 - DNA, 19 bp, Homo sapiens
catccagggaaatgcctcg

SEQ ID NO: 6711496 - DNA, 11 bp, Homo sapiens
catccagggcc

SEQ ID NO: 6711497 - DNA, 21 bp, Homo sapiens
catccagggcccccatctcat

SEQ ID NO: 6711498 - DNA, 14 bp, Homo sapiens
catccagggtctgg

SEQ ID NO: 6711499 - DNA, 21 bp, Homo sapiens
catccagggtctggcagagcc

SEQ ID NO: 6711500 - DNA, 22 bp, Homo sapiens
catccagggtctggcagagcct

SEQ ID NO: 6711501 - DNA, 23 bp, Homo sapiens
catccagggtctggcagagcctc

SEQ ID NO: 6711502 - DNA, 15 bp, Homo sapiens
catccaggtcctttc

SEQ ID NO: 6711503 - DNA, 17 bp, Homo sapiens
catccaggtcctttcct

SEQ ID NO: 6711504 - DNA, 17 bp, Homo sapiens
catccaggttcagcttg

SEQ ID NO: 6711505 - DNA, 15 bp, Homo sapiens
catccagtggggtct

SEQ ID NO: 6711506 - DNA, 22 bp, Homo sapiens
catccagtgtctcacagccctg

SEQ ID NO: 6711507 - DNA, 16 bp, Homo sapiens
catccagttgcaataa

SEQ ID NO: 6711508 - DNA, 18 bp, Homo sapiens
catccagttggcttttta

SEQ ID NO: 6711509 - DNA, 14 bp, Homo sapiens
catccagtttgttc

SEQ ID NO: 6711510 - DNA, 14 bp, Homo sapiens
catccataaagaag

SEQ ID NO: 6711511 - DNA, 18 bp, Homo sapiens
catccataaagcaagctc

SEQ ID NO: 6711512 - DNA, 19 bp, Homo sapiens
catccataaagcaagctca

SEQ ID NO: 6711513 - DNA, 12 bp, Homo sapiens
catccataaatc

SEQ ID NO: 6711514 - DNA, 18 bp, Homo sapiens
catccataagtgtgcctc

SEQ ID NO: 6711515 - DNA, 23 bp, Homo sapiens
catccataatttggggccctgag

SEQ ID NO: 6711516 - DNA, 17 bp, Homo sapiens
catccataccagctcgc

SEQ ID NO: 6711517 - DNA, 18 bp, Homo sapiens
catccatagacacagtat

SEQ ID NO: 6711518 - DNA, 15 bp, Homo sapiens
catccatagtgcact

SEQ ID NO: 6711519 - DNA, 14 bp, Homo sapiens
catccatatttctt

SEQ ID NO: 6711520 - DNA, 16 bp, Homo sapiens
catccatcagctccct

SEQ ID NO: 6711521 - DNA, 13 bp, Homo sapiens
catccatcatcat

SEQ ID NO: 6711522 - DNA, 15 bp, Homo sapiens
catccatccctagaa

SEQ ID NO: 6711523 - DNA, 17 bp, Homo sapiens
catccatcgtaattgtt

SEQ ID NO: 6711524 - DNA, 13 bp, Homo sapiens
catccatctccag

SEQ ID NO: 6711525 - DNA, 19 bp, Homo sapiens
catccatctctctcttgcc

SEQ ID NO: 6711526 - DNA, 16 bp, Homo sapiens
catccatctgtccgtc

SEQ ID NO: 6711527 - DNA, 17 bp, Homo sapiens
catccatcttccctacc

SEQ ID NO: 6711528 - DNA, 15 bp, Homo sapiens
catccatgcacttta

SEQ ID NO: 6711529 - DNA, 22 bp, Homo sapiens
catccatgccctcccaggaccc

SEQ ID NO: 6711530 - DNA, 15 bp, Homo sapiens
catccatgcctcaga

SEQ ID NO: 6711531 - DNA, 17 bp, Homo sapiens
catccatgcctcagaag

SEQ ID NO: 6711532 - DNA, 22 bp, Homo sapiens
catccatgcggagtccattatt

SEQ ID NO: 6711533 - DNA, 18 bp, Homo sapiens
catccatggccagcagca

SEQ ID NO: 6711534 - DNA, 22 bp, Homo sapiens
catccatggccagcagcacctg

SEQ ID NO: 6711535 - DNA, 11 bp, Homo sapiens
catccatgggg

SEQ ID NO: 6711536 - DNA, 18 bp, Homo sapiens
catccatgtcctatgtgt

SEQ ID NO: 6711537 - DNA, 17 bp, Homo sapiens
catccatgtgtggactc

SEQ ID NO: 6711538 - DNA, 18 bp, Homo sapiens
catccatgttccgagaag

SEQ ID NO: 6711539 - DNA, 19 bp, Homo sapiens
catccatgttccgagaaga

SEQ ID NO: 6711540 - DNA, 18 bp, Homo sapiens
catccatgtttgtaaaac

SEQ ID NO: 6711541 - DNA, 15 bp, Homo sapiens
catccattacctcca

SEQ ID NO: 6711542 - DNA, 14 bp, Homo sapiens
catccattcccaag

SEQ ID NO: 6711543 - DNA, 12 bp, Homo sapiens
catccattccta

SEQ ID NO: 6711544 - DNA, 14 bp, Homo sapiens
catccattcctcag

SEQ ID NO: 6711545 - DNA, 15 bp, Homo sapiens
catccattcctcagg

SEQ ID NO: 6711546 - DNA, 19 bp, Homo sapiens
catccattctcctcagtgg

SEQ ID NO: 6711547 - DNA, 19 bp, Homo sapiens
catccattgtctcttcatg

SEQ ID NO: 6711548 - DNA, 13 bp, Homo sapiens
catccattgttgt

SEQ ID NO: 6711549 - DNA, 22 bp, Homo sapiens
catccatttatttggcatctgt

SEQ ID NO: 6711550 - DNA, 13 bp, Homo sapiens
catccatttcttt

SEQ ID NO: 6711551 - DNA, 16 bp, Homo sapiens
catccatttgaacaca

SEQ ID NO: 6711552 - DNA, 19 bp, Homo sapiens
catcccaaacccttcagtg

SEQ ID NO: 6711553 - DNA, 12 bp, Homo sapiens
catcccaaactt

SEQ ID NO: 6711554 - DNA, 21 bp, Homo sapiens
catcccaaactttaaaatgcg

SEQ ID NO: 6711555 - DNA, 20 bp, Homo sapiens
catcccaaagtgctgggatt

SEQ ID NO: 6711556 - DNA, 18 bp, Homo sapiens
catcccaacagcccagca

SEQ ID NO: 6711557 - DNA, 18 bp, Homo sapiens
catcccaaccaggcacct

SEQ ID NO: 6711558 - DNA, 20 bp, Homo sapiens
catcccaaccaggcacctct

SEQ ID NO: 6711559 - DNA, 17 bp, Homo sapiens
catcccaaccagtgcca

SEQ ID NO: 6711560 - DNA, 22 bp, Homo sapiens
catcccaacctggctccctccc

SEQ ID NO: 6711561 - DNA, 23 bp, Homo sapiens
catcccaacctggctccctccca

SEQ ID NO: 6711562 - DNA, 13 bp, Homo sapiens
catcccaactgtc

SEQ ID NO: 6711563 - DNA, 18 bp, Homo sapiens
catcccaagacctcatct

SEQ ID NO: 6711564 - DNA, 21 bp, Homo sapiens
catcccaaggcaagcatgaat

SEQ ID NO: 6711565 - DNA, 21 bp, Homo sapiens
catcccaataaagtcctcttc

SEQ ID NO: 6711566 - DNA, 16 bp, Homo sapiens
catcccacccctccat

SEQ ID NO: 6711567 - DNA, 18 bp, Homo sapiens
catcccacgatcggcctt

SEQ ID NO: 6711568 - DNA, 14 bp, Homo sapiens
catcccactccact

SEQ ID NO: 6711569 - DNA, 17 bp, Homo sapiens
catcccactccctttcc

SEQ ID NO: 6711570 - DNA, 18 bp, Homo sapiens
catcccactgatatcacg

SEQ ID NO: 6711571 - DNA, 22 bp, Homo sapiens
catcccactgatatcacgggcc

SEQ ID NO: 6711572 - DNA, 22 bp, Homo sapiens
catcccacttagccgcaccctg

SEQ ID NO: 6711573 - DNA, 11 bp, Homo sapiens
catcccagccc

SEQ ID NO: 6711574 - DNA, 13 bp, Homo sapiens
catcccagcccaa

SEQ ID NO: 6711575 - DNA, 19 bp, Homo sapiens
catcccagcccaatccagg

SEQ ID NO: 6711576 - DNA, 13 bp, Homo sapiens
catcccagcccca

SEQ ID NO: 6711577 - DNA, 11 bp, Homo sapiens
catcccagcct

SEQ ID NO: 6711578 - DNA, 15 bp, Homo sapiens
catcccagcctcaga

SEQ ID NO: 6711579 - DNA, 16 bp, Homo sapiens
catcccagcctcagaa

SEQ ID NO: 6711580 - DNA, 20 bp, Homo sapiens
catcccagcctcagaagcct

SEQ ID NO: 6711581 - DNA, 12 bp, Homo sapiens
catcccagcctg

SEQ ID NO: 6711582 - DNA, 13 bp, Homo sapiens
catcccagcctgg

SEQ ID NO: 6711583 - DNA, 22 bp, Homo sapiens
catcccagcctgggggccagtg

SEQ ID NO: 6711584 - DNA, 15 bp, Homo sapiens
catcccagcctgtgg

SEQ ID NO: 6711585 - DNA, 16 bp, Homo sapiens
catcccagcctgtggt

SEQ ID NO: 6711586 - DNA, 18 bp, Homo sapiens
catcccagcctgtggtta

SEQ ID NO: 6711587 - DNA, 14 bp, Homo sapiens
catcccagccttgg

SEQ ID NO: 6711588 - DNA, 15 bp, Homo sapiens
catcccagctgctga

SEQ ID NO: 6711589 - DNA, 16 bp, Homo sapiens
catcccagctgctgag

SEQ ID NO: 6711590 - DNA, 22 bp, Homo sapiens
catcccaggacaccacacccag

SEQ ID NO: 6711591 - DNA, 19 bp, Homo sapiens
catcccaggaggggcctct

SEQ ID NO: 6711592 - DNA, 13 bp, Homo sapiens
catcccagggtcc

SEQ ID NO: 6711593 - DNA, 23 bp, Homo sapiens
catcccagtccctcgccgtccct

SEQ ID NO: 6711594 - DNA, 22 bp, Homo sapiens
catcccagtcctgatggccgct

SEQ ID NO: 6711595 - DNA, 18 bp, Homo sapiens
catcccagtctgatattc

SEQ ID NO: 6711596 - DNA, 13 bp, Homo sapiens
catcccagtggcc

SEQ ID NO: 6711597 - DNA, 23 bp, Homo sapiens
catcccagtggcctcaaccctcc

SEQ ID NO: 6711598 - DNA, 15 bp, Homo sapiens
catcccagtgtccta

SEQ ID NO: 6711599 - DNA, 18 bp, Homo sapiens
catcccagtttctcagaa

SEQ ID NO: 6711600 - DNA, 19 bp, Homo sapiens
catcccatatgcctgggca

SEQ ID NO: 6711601 - DNA, 16 bp, Homo sapiens
catcccatcatggctg

SEQ ID NO: 6711602 - DNA, 17 bp, Homo sapiens
catcccatcccatccca

SEQ ID NO: 6711603 - DNA, 18 bp, Homo sapiens
catcccatcccatcccgc

SEQ ID NO: 6711604 - DNA, 12 bp, Homo sapiens
catcccatcccg

SEQ ID NO: 6711605 - DNA, 13 bp, Homo sapiens
catcccatccctt

SEQ ID NO: 6711606 - DNA, 14 bp, Homo sapiens
catcccatctctcc

SEQ ID NO: 6711607 - DNA, 19 bp, Homo sapiens
catcccatctctcccactt

SEQ ID NO: 6711608 - DNA, 17 bp, Homo sapiens
catcccatgaacacact

SEQ ID NO: 6711609 - DNA, 16 bp, Homo sapiens
catcccatgtaacaga

SEQ ID NO: 6711610 - DNA, 19 bp, Homo sapiens
catcccatgtaacagaaag

SEQ ID NO: 6711611 - DNA, 15 bp, Homo sapiens
catcccatgtattta

SEQ ID NO: 6711612 - DNA, 20 bp, Homo sapiens
catcccattcacttctgcat

SEQ ID NO: 6711613 - DNA, 21 bp, Homo sapiens
catcccattcacttctgcatt

SEQ ID NO: 6711614 - DNA, 12 bp, Homo sapiens
catcccattgcc

SEQ ID NO: 6711615 - DNA, 13 bp, Homo sapiens
catcccattgccc

SEQ ID NO: 6711616 - DNA, 21 bp, Homo sapiens
catccccaaaacaaagtcttt

SEQ ID NO: 6711617 - DNA, 23 bp, Homo sapiens
catccccaaactgtgccctgcct

SEQ ID NO: 6711618 - DNA, 12 bp, Homo sapiens
catccccaagcc

SEQ ID NO: 6711619 - DNA, 12 bp, Homo sapiens
catccccaccag

SEQ ID NO: 6711620 - DNA, 12 bp, Homo sapiens
catccccacctt

SEQ ID NO: 6711621 - DNA, 21 bp, Homo sapiens
catccccacgacccctgcctc

SEQ ID NO: 6711622 - DNA, 14 bp, Homo sapiens
catccccagagccc

SEQ ID NO: 6711623 - DNA, 19 bp, Homo sapiens
catccccagaggtgaccca

SEQ ID NO: 6711624 - DNA, 14 bp, Homo sapiens
catccccagccagg

SEQ ID NO: 6711625 - DNA, 12 bp, Homo sapiens
catccccagccc

SEQ ID NO: 6711626 - DNA, 15 bp, Homo sapiens
catccccagccccct

SEQ ID NO: 6711627 - DNA, 11 bp, Homo sapiens
catccccaggg

SEQ ID NO: 6711628 - DNA, 12 bp, Homo sapiens
catccccagggg

SEQ ID NO: 6711629 - DNA, 21 bp, Homo sapiens
catccccaggggtcccagcca

SEQ ID NO: 6711630 - DNA, 14 bp, Homo sapiens
catccccagtttat

SEQ ID NO: 6711631 - DNA, 15 bp, Homo sapiens
catccccatcctcca

SEQ ID NO: 6711632 - DNA, 21 bp, Homo sapiens
catccccatcctccagcttct

SEQ ID NO: 6711633 - DNA, 21 bp, Homo sapiens
catccccatcggccctgtccc

SEQ ID NO: 6711634 - DNA, 17 bp, Homo sapiens
catcccccacctactct

SEQ ID NO: 6711635 - DNA, 23 bp, Homo sapiens
catcccccactgccacaccctcc

SEQ ID NO: 6711636 - DNA, 16 bp, Homo sapiens
catcccccagcactga

SEQ ID NO: 6711637 - DNA, 20 bp, Homo sapiens
catccccccacccgacttct

SEQ ID NO: 6711638 - DNA, 20 bp, Homo sapiens
catcccccctgctgcccagt

SEQ ID NO: 6711639 - DNA, 13 bp, Homo sapiens
catccccctcctt

SEQ ID NO: 6711640 - DNA, 18 bp, Homo sapiens
catccccctctcacgcca

SEQ ID NO: 6711641 - DNA, 23 bp, Homo sapiens
catccccctctcctctcccccag

SEQ ID NO: 6711642 - DNA, 14 bp, Homo sapiens
catccccctgtgga

SEQ ID NO: 6711643 - DNA, 18 bp, Homo sapiens
catccccgtccatgctca

SEQ ID NO: 6711644 - DNA, 14 bp, Homo sapiens
catcccctccctgc

SEQ ID NO: 6711645 - DNA, 18 bp, Homo sapiens
catcccctcgtcctgtcc

SEQ ID NO: 6711646 - DNA, 21 bp, Homo sapiens
catcccctcgtcctgtcccag

SEQ ID NO: 6711647 - DNA, 22 bp, Homo sapiens
catcccctcgtcctgtcccaga

SEQ ID NO: 6711648 - DNA, 13 bp, Homo sapiens
catcccctctcag

SEQ ID NO: 6711649 - DNA, 13 bp, Homo sapiens
catcccctgcctc

SEQ ID NO: 6711650 - DNA, 16 bp, Homo sapiens
catcccctgcctccat

SEQ ID NO: 6711651 - DNA, 21 bp, Homo sapiens
catcccctgtagagtgggagc

SEQ ID NO: 6711652 - DNA, 22 bp, Homo sapiens
catccccttacccttagaatcc

SEQ ID NO: 6711653 - DNA, 14 bp, Homo sapiens
catccccttccagc

SEQ ID NO: 6711654 - DNA, 21 bp, Homo sapiens
catccccttgtgtcagagaca

SEQ ID NO: 6711655 - DNA, 13 bp, Homo sapiens
catcccctttcct

SEQ ID NO: 6711656 - DNA, 16 bp, Homo sapiens
catcccctttcctccc

SEQ ID NO: 6711657 - DNA, 17 bp, Homo sapiens
catcccctttcctcccc

SEQ ID NO: 6711658 - DNA, 21 bp, Homo sapiens
catcccgaagccatcacttct

SEQ ID NO: 6711659 - DNA, 17 bp, Homo sapiens
catcccgagcacctcca

SEQ ID NO: 6711660 - DNA, 17 bp, Homo sapiens
catcccgccttctccag

SEQ ID NO: 6711661 - DNA, 18 bp, Homo sapiens
catcccgctcttttccta

SEQ ID NO: 6711662 - DNA, 19 bp, Homo sapiens
catcccgcttagcctgcct

SEQ ID NO: 6711663 - DNA, 19 bp, Homo sapiens
catcccggagcgcacctgc

SEQ ID NO: 6711664 - DNA, 13 bp, Homo sapiens
catcccggcagcg

SEQ ID NO: 6711665 - DNA, 23 bp, Homo sapiens
catcccggcagcgaggctgggct

SEQ ID NO: 6711666 - DNA, 12 bp, Homo sapiens
catcccggcctc

SEQ ID NO: 6711667 - DNA, 14 bp, Homo sapiens
catcccggcctctt

SEQ ID NO: 6711668 - DNA, 18 bp, Homo sapiens
catcccggcctcttccac

SEQ ID NO: 6711669 - DNA, 20 bp, Homo sapiens
catcccggctgaccctgtgc

SEQ ID NO: 6711670 - DNA, 21 bp, Homo sapiens
catcccggctgaccctgtgcc

SEQ ID NO: 6711671 - DNA, 16 bp, Homo sapiens
catcccgggcctcagt

SEQ ID NO: 6711672 - DNA, 16 bp, Homo sapiens
catcccggtgcatgca

SEQ ID NO: 6711673 - DNA, 18 bp, Homo sapiens
catcccgtaagaccacct

SEQ ID NO: 6711674 - DNA, 20 bp, Homo sapiens
catcccgtaagaccaccttc

SEQ ID NO: 6711675 - DNA, 22 bp, Homo sapiens
catcccgtaagaccaccttccc

SEQ ID NO: 6711676 - DNA, 17 bp, Homo sapiens
catcccgtatcacagtg

SEQ ID NO: 6711677 - DNA, 18 bp, Homo sapiens
catcccgtcttctccaac

SEQ ID NO: 6711678 - DNA, 16 bp, Homo sapiens
catcccgtgttctcct

SEQ ID NO: 6711679 - DNA, 15 bp, Homo sapiens
catcccgtttccctc

SEQ ID NO: 6711680 - DNA, 18 bp, Homo sapiens
catccctaatgctgcaga

SEQ ID NO: 6711681 - DNA, 20 bp, Homo sapiens
catccctaattcttcatagg

SEQ ID NO: 6711682 - DNA, 16 bp, Homo sapiens
catccctagaagagca

SEQ ID NO: 6711683 - DNA, 22 bp, Homo sapiens
catccctagaagagcacagagc

SEQ ID NO: 6711684 - DNA, 21 bp, Homo sapiens
catccctatagaccactgggt

SEQ ID NO: 6711685 - DNA, 14 bp, Homo sapiens
catccctcacccat

SEQ ID NO: 6711686 - DNA, 20 bp, Homo sapiens
catccctcacccatcctaga

SEQ ID NO: 6711687 - DNA, 13 bp, Homo sapiens
catccctccaccc

SEQ ID NO: 6711688 - DNA, 16 bp, Homo sapiens
catccctccaccccag

SEQ ID NO: 6711689 - DNA, 20 bp, Homo sapiens
catccctccattcatccttc

SEQ ID NO: 6711690 - DNA, 14 bp, Homo sapiens
catccctccccagt

SEQ ID NO: 6711691 - DNA, 16 bp, Homo sapiens
catccctcccccagca

SEQ ID NO: 6711692 - DNA, 12 bp, Homo sapiens
catccctccctc

SEQ ID NO: 6711693 - DNA, 20 bp, Homo sapiens
catccctccctccacctccc

SEQ ID NO: 6711694 - DNA, 13 bp, Homo sapiens
catccctccctgc

SEQ ID NO: 6711695 - DNA, 13 bp, Homo sapiens
catccctcctggg

SEQ ID NO: 6711696 - DNA, 16 bp, Homo sapiens
catccctccttgccta

SEQ ID NO: 6711697 - DNA, 19 bp, Homo sapiens
catccctccttgcctagca

SEQ ID NO: 6711698 - DNA, 19 bp, Homo sapiens
catccctcggaagccgtct

SEQ ID NO: 6711699 - DNA, 16 bp, Homo sapiens
catccctctcctctgc

SEQ ID NO: 6711700 - DNA, 19 bp, Homo sapiens
catccctctggggctgttc

SEQ ID NO: 6711701 - DNA, 18 bp, Homo sapiens
catccctgaaggccccgc

SEQ ID NO: 6711702 - DNA, 17 bp, Homo sapiens
catccctgactggccaa

SEQ ID NO: 6711703 - DNA, 24 bp, Homo sapiens
catccctgagcaggaaagtttacc

SEQ ID NO: 6711704 - DNA, 18 bp, Homo sapiens
catccctgaggagccagg

SEQ ID NO: 6711705 - DNA, 19 bp, Homo sapiens
catccctgaggctggactc

SEQ ID NO: 6711706 - DNA, 22 bp, Homo sapiens
catccctgaggctggactccag

SEQ ID NO: 6711707 - DNA, 21 bp, Homo sapiens
catccctgccagctcttctgc

SEQ ID NO: 6711708 - DNA, 14 bp, Homo sapiens
catccctgcctgga

SEQ ID NO: 6711709 - DNA, 15 bp, Homo sapiens
catccctgcctggtc

SEQ ID NO: 6711710 - DNA, 16 bp, Homo sapiens
catccctgcctggtca

SEQ ID NO: 6711711 - DNA, 13 bp, Homo sapiens
catccctgcttct

SEQ ID NO: 6711712 - DNA, 14 bp, Homo sapiens
catccctgcttctg

SEQ ID NO: 6711713 - DNA, 20 bp, Homo sapiens
catccctggagcaggagccc

SEQ ID NO: 6711714 - DNA, 13 bp, Homo sapiens
catccctggctga

SEQ ID NO: 6711715 - DNA, 11 bp, Homo sapiens
catccctgggc

SEQ ID NO: 6711716 - DNA, 13 bp, Homo sapiens
catccctgggcaa

SEQ ID NO: 6711717 - DNA, 13 bp, Homo sapiens
catccctgggccc

SEQ ID NO: 6711718 - DNA, 13 bp, Homo sapiens
catccctgggcct

SEQ ID NO: 6711719 - DNA, 20 bp, Homo sapiens
catccctgggcctgctgctg

SEQ ID NO: 6711720 - DNA, 21 bp, Homo sapiens
catccctgggcctgctgctga

SEQ ID NO: 6711721 - DNA, 23 bp, Homo sapiens
catccctgggcctgctgctgaga

SEQ ID NO: 6711722 - DNA, 21 bp, Homo sapiens
catccctgggccttgggctcc

SEQ ID NO: 6711723 - DNA, 13 bp, Homo sapiens
catccctggtgaa

SEQ ID NO: 6711724 - DNA, 16 bp, Homo sapiens
catccctgtcctcatg

SEQ ID NO: 6711725 - DNA, 13 bp, Homo sapiens
catccctgtgagg

SEQ ID NO: 6711726 - DNA, 21 bp, Homo sapiens
catccctgtgtccactgagac

SEQ ID NO: 6711727 - DNA, 18 bp, Homo sapiens
catcccttacctgggaaa

SEQ ID NO: 6711728 - DNA, 17 bp, Homo sapiens
catcccttcccacatgc

SEQ ID NO: 6711729 - DNA, 17 bp, Homo sapiens
catcccttcctccccag

SEQ ID NO: 6711730 - DNA, 20 bp, Homo sapiens
catcccttcctcctctcctg

SEQ ID NO: 6711731 - DNA, 18 bp, Homo sapiens
catcccttctcttccagg

SEQ ID NO: 6711732 - DNA, 23 bp, Homo sapiens
catcccttctcttccaggcagcc

SEQ ID NO: 6711733 - DNA, 19 bp, Homo sapiens
catcccttgaccaggcctg

SEQ ID NO: 6711734 - DNA, 17 bp, Homo sapiens
catccctttcccttggt

SEQ ID NO: 6711735 - DNA, 14 bp, Homo sapiens
catccctttctccc

SEQ ID NO: 6711736 - DNA, 16 bp, Homo sapiens
catccctttgcccaga

SEQ ID NO: 6711737 - DNA, 17 bp, Homo sapiens
catcccttttcctgtca

SEQ ID NO: 6711738 - DNA, 21 bp, Homo sapiens
catccctttttttacatttca

SEQ ID NO: 6711739 - DNA, 16 bp, Homo sapiens
catccgaccaggttgt

SEQ ID NO: 6711740 - DNA, 13 bp, Homo sapiens
catccgagcccct

SEQ ID NO: 6711741 - DNA, 14 bp, Homo sapiens
catccgagcccctg

SEQ ID NO: 6711742 - DNA, 16 bp, Homo sapiens
catccgagcccctgtt

SEQ ID NO: 6711743 - DNA, 14 bp, Homo sapiens
catccgcagactgc

SEQ ID NO: 6711744 - DNA, 18 bp, Homo sapiens
catccgcctctgagccag

SEQ ID NO: 6711745 - DNA, 19 bp, Homo sapiens
catccgcctctgagccagg

SEQ ID NO: 6711746 - DNA, 13 bp, Homo sapiens
catccgcctggcc

SEQ ID NO: 6711747 - DNA, 20 bp, Homo sapiens
catccgcgtgtgcctgtgtg

SEQ ID NO: 6711748 - DNA, 18 bp, Homo sapiens
catccgctgcgctcccac

SEQ ID NO: 6711749 - DNA, 20 bp, Homo sapiens
catccggaacagccaaagaa

SEQ ID NO: 6711750 - DNA, 19 bp, Homo sapiens
catccggagaattgcctct

SEQ ID NO: 6711751 - DNA, 23 bp, Homo sapiens
catccggaggagaagaaggaaat

SEQ ID NO: 6711752 - DNA, 17 bp, Homo sapiens
catccgggacgcttcca

SEQ ID NO: 6711753 - DNA, 18 bp, Homo sapiens
catccggtggcctattcc

SEQ ID NO: 6711754 - DNA, 18 bp, Homo sapiens
catccgtagttccctgaa

SEQ ID NO: 6711755 - DNA, 18 bp, Homo sapiens
catccgtcattgctgctg

SEQ ID NO: 6711756 - DNA, 15 bp, Homo sapiens
catccgtcctgggcg

SEQ ID NO: 6711757 - DNA, 18 bp, Homo sapiens
catccgtctgtctgtcgc

SEQ ID NO: 6711758 - DNA, 22 bp, Homo sapiens
catccgtctgtctgtcgccctt

SEQ ID NO: 6711759 - DNA, 17 bp, Homo sapiens
catccgtgagcagtgtg

SEQ ID NO: 6711760 - DNA, 20 bp, Homo sapiens
catccgtgctatgacatgga

SEQ ID NO: 6711761 - DNA, 23 bp, Homo sapiens
catccgtgtatttggctgggcta

SEQ ID NO: 6711762 - DNA, 15 bp, Homo sapiens
catccgttgtgactc

SEQ ID NO: 6711763 - DNA, 19 bp, Homo sapiens
catcctaaaagccacccca

SEQ ID NO: 6711764 - DNA, 18 bp, Homo sapiens
catcctaaagaacaaagt

SEQ ID NO: 6711765 - DNA, 14 bp, Homo sapiens
catcctaaatattg

SEQ ID NO: 6711766 - DNA, 23 bp, Homo sapiens
catcctaaggttcttgctttctc

SEQ ID NO: 6711767 - DNA, 18 bp, Homo sapiens
catcctacaagacacagt

SEQ ID NO: 6711768 - DNA, 19 bp, Homo sapiens
catcctacccagcgtggcc

SEQ ID NO: 6711769 - DNA, 19 bp, Homo sapiens
catcctaccctcgggccca

SEQ ID NO: 6711770 - DNA, 21 bp, Homo sapiens
catcctaccctcgggcccacc

SEQ ID NO: 6711771 - DNA, 23 bp, Homo sapiens
catcctaccctcgggcccacctg

SEQ ID NO: 6711772 - DNA, 14 bp, Homo sapiens
catcctaccctttt

SEQ ID NO: 6711773 - DNA, 23 bp, Homo sapiens
catcctacctaactccctaggcc

SEQ ID NO: 6711774 - DNA, 14 bp, Homo sapiens
catcctagccccac

SEQ ID NO: 6711775 - DNA, 22 bp, Homo sapiens
catcctagccccacccagaggt

SEQ ID NO: 6711776 - DNA, 22 bp, Homo sapiens
catcctaggaaccagccaacca

SEQ ID NO: 6711777 - DNA, 18 bp, Homo sapiens
catcctagggtgttttaa

SEQ ID NO: 6711778 - DNA, 17 bp, Homo sapiens
catcctatgcttaataa

SEQ ID NO: 6711779 - DNA, 13 bp, Homo sapiens
catcctattttgt

SEQ ID NO: 6711780 - DNA, 22 bp, Homo sapiens
catcctcaaacgacagaggagc

SEQ ID NO: 6711781 - DNA, 22 bp, Homo sapiens
catcctcaaagaaagtgtattg

SEQ ID NO: 6711782 - DNA, 17 bp, Homo sapiens
catcctcacacagattc

SEQ ID NO: 6711783 - DNA, 14 bp, Homo sapiens
catcctcacatgtg

SEQ ID NO: 6711784 - DNA, 17 bp, Homo sapiens
catcctcacatgtggca

SEQ ID NO: 6711785 - DNA, 14 bp, Homo sapiens
catcctcacccaga

SEQ ID NO: 6711786 - DNA, 19 bp, Homo sapiens
catcctcacccagatcagg

SEQ ID NO: 6711787 - DNA, 23 bp, Homo sapiens
catcctcagaaagtgcagcatgg

SEQ ID NO: 6711788 - DNA, 14 bp, Homo sapiens
catcctcagaacca

SEQ ID NO: 6711789 - DNA, 22 bp, Homo sapiens
catcctcagaggctgagccctg

SEQ ID NO: 6711790 - DNA, 23 bp, Homo sapiens
catcctcagaggctgagccctgt

SEQ ID NO: 6711791 - DNA, 19 bp, Homo sapiens
catcctcagatgctcaaag

SEQ ID NO: 6711792 - DNA, 13 bp, Homo sapiens
catcctcagcaag

SEQ ID NO: 6711793 - DNA, 16 bp, Homo sapiens
catcctcagccccagg

SEQ ID NO: 6711794 - DNA, 19 bp, Homo sapiens
catcctcagccccagggcc

SEQ ID NO: 6711795 - DNA, 21 bp, Homo sapiens
catcctcatacccacccccac

SEQ ID NO: 6711796 - DNA, 22 bp, Homo sapiens
catcctcatacccacccccacc

SEQ ID NO: 6711797 - DNA, 13 bp, Homo sapiens
catcctcatctct

SEQ ID NO: 6711798 - DNA, 16 bp, Homo sapiens
catcctcattcactaa

SEQ ID NO: 6711799 - DNA, 18 bp, Homo sapiens
catcctcattgcctcctg

SEQ ID NO: 6711800 - DNA, 23 bp, Homo sapiens
catcctcattgcctcctgttctg

SEQ ID NO: 6711801 - DNA, 19 bp, Homo sapiens
catcctccaaacctggcct

SEQ ID NO: 6711802 - DNA, 21 bp, Homo sapiens
catcctccacgttctgctcat

SEQ ID NO: 6711803 - DNA, 21 bp, Homo sapiens
catcctccagagaaacccagg

SEQ ID NO: 6711804 - DNA, 15 bp, Homo sapiens
catcctccagcccct

SEQ ID NO: 6711805 - DNA, 17 bp, Homo sapiens
catcctccagccctgcc

SEQ ID NO: 6711806 - DNA, 14 bp, Homo sapiens
catcctccagcttc

SEQ ID NO: 6711807 - DNA, 17 bp, Homo sapiens
catcctccagcttctgg

SEQ ID NO: 6711808 - DNA, 17 bp, Homo sapiens
catcctcccattgccca

SEQ ID NO: 6711809 - DNA, 19 bp, Homo sapiens
catcctcccattgcccagt

SEQ ID NO: 6711810 - DNA, 23 bp, Homo sapiens
catcctcccattgcccagtgagc

SEQ ID NO: 6711811 - DNA, 24 bp, Homo sapiens
catcctcccattgcccagtgagcc

SEQ ID NO: 6711812 - DNA, 20 bp, Homo sapiens
catcctccccaccagagctg

SEQ ID NO: 6711813 - DNA, 21 bp, Homo sapiens
catcctccccaccagagctgc

SEQ ID NO: 6711814 - DNA, 22 bp, Homo sapiens
catcctccccaccagagctgcc

SEQ ID NO: 6711815 - DNA, 23 bp, Homo sapiens
catcctccccaccagagctgcct

SEQ ID NO: 6711816 - DNA, 16 bp, Homo sapiens
catcctccccaggacc

SEQ ID NO: 6711817 - DNA, 17 bp, Homo sapiens
catcctcccctctcctg

SEQ ID NO: 6711818 - DNA, 16 bp, Homo sapiens
catcctccccttccct

SEQ ID NO: 6711819 - DNA, 16 bp, Homo sapiens
catcctcccgccagga

SEQ ID NO: 6711820 - DNA, 11 bp, Homo sapiens
catcctccctc

SEQ ID NO: 6711821 - DNA, 13 bp, Homo sapiens
catcctccctcca

SEQ ID NO: 6711822 - DNA, 19 bp, Homo sapiens
catcctccctccacctcaa

SEQ ID NO: 6711823 - DNA, 21 bp, Homo sapiens
catcctccctgttccccacag

SEQ ID NO: 6711824 - DNA, 24 bp, Homo sapiens
catcctcccttgccccaggccagg

SEQ ID NO: 6711825 - DNA, 13 bp, Homo sapiens
catcctccggaga

SEQ ID NO: 6711826 - DNA, 20 bp, Homo sapiens
catcctccgtccagccgcca

SEQ ID NO: 6711827 - DNA, 15 bp, Homo sapiens
catcctcctcagatc

SEQ ID NO: 6711828 - DNA, 17 bp, Homo sapiens
catcctcctcagccccc

SEQ ID NO: 6711829 - DNA, 12 bp, Homo sapiens
catcctcctccc

SEQ ID NO: 6711830 - DNA, 14 bp, Homo sapiens
catcctcctcccca

SEQ ID NO: 6711831 - DNA, 15 bp, Homo sapiens
catcctcctccccag

SEQ ID NO: 6711832 - DNA, 18 bp, Homo sapiens
catcctcctccccagctc

SEQ ID NO: 6711833 - DNA, 19 bp, Homo sapiens
catcctcctccccagctct

SEQ ID NO: 6711834 - DNA, 15 bp, Homo sapiens
catcctcctccttcc

SEQ ID NO: 6711835 - DNA, 16 bp, Homo sapiens
catcctcctccttcct

SEQ ID NO: 6711836 - DNA, 17 bp, Homo sapiens
catcctcctccttccta

SEQ ID NO: 6711837 - DNA, 13 bp, Homo sapiens
catcctcctctcc

SEQ ID NO: 6711838 - DNA, 21 bp, Homo sapiens
catcctcctctccatgcaagt

SEQ ID NO: 6711839 - DNA, 16 bp, Homo sapiens
catcctcctggaacct

SEQ ID NO: 6711840 - DNA, 11 bp, Homo sapiens
catcctctcca

SEQ ID NO: 6711841 - DNA, 13 bp, Homo sapiens
catcctctccagg

SEQ ID NO: 6711842 - DNA, 18 bp, Homo sapiens
catcctctcccttcttac

SEQ ID NO: 6711843 - DNA, 15 bp, Homo sapiens
catcctctgactcca

SEQ ID NO: 6711844 - DNA, 15 bp, Homo sapiens
catcctctgccctta

SEQ ID NO: 6711845 - DNA, 21 bp, Homo sapiens
catcctctgctggttcctgac

SEQ ID NO: 6711846 - DNA, 18 bp, Homo sapiens
catcctctggagccagcc

SEQ ID NO: 6711847 - DNA, 20 bp, Homo sapiens
catcctcttccatatggatc

SEQ ID NO: 6711848 - DNA, 15 bp, Homo sapiens
catcctcttctgctt

SEQ ID NO: 6711849 - DNA, 11 bp, Homo sapiens
catcctctttc

SEQ ID NO: 6711850 - DNA, 20 bp, Homo sapiens
catcctgaaagccagcaaag

SEQ ID NO: 6711851 - DNA, 17 bp, Homo sapiens
catcctgaatctgatct

SEQ ID NO: 6711852 - DNA, 19 bp, Homo sapiens
catcctgaatctgatcttt

SEQ ID NO: 6711853 - DNA, 19 bp, Homo sapiens
catcctgaccagctgctcc

SEQ ID NO: 6711854 - DNA, 17 bp, Homo sapiens
catcctgacctcctgga

SEQ ID NO: 6711855 - DNA, 16 bp, Homo sapiens
catcctgactctgccc

SEQ ID NO: 6711856 - DNA, 17 bp, Homo sapiens
catcctgactctgcccc

SEQ ID NO: 6711857 - DNA, 21 bp, Homo sapiens
catcctgagagacctgccctc

SEQ ID NO: 6711858 - DNA, 12 bp, Homo sapiens
catcctgagcca

SEQ ID NO: 6711859 - DNA, 14 bp, Homo sapiens
catcctgagccagg

SEQ ID NO: 6711860 - DNA, 16 bp, Homo sapiens
catcctgagccaggga

SEQ ID NO: 6711861 - DNA, 22 bp, Homo sapiens
catcctgagcccaaccaggccc

SEQ ID NO: 6711862 - DNA, 16 bp, Homo sapiens
catcctgagccccgcc

SEQ ID NO: 6711863 - DNA, 22 bp, Homo sapiens
catcctgagccccgccctcttc

SEQ ID NO: 6711864 - DNA, 12 bp, Homo sapiens
catcctgaggac

SEQ ID NO: 6711865 - DNA, 14 bp, Homo sapiens
catcctgaggaccg

SEQ ID NO: 6711866 - DNA, 17 bp, Homo sapiens
catcctgaggccagtgg

SEQ ID NO: 6711867 - DNA, 20 bp, Homo sapiens
catcctgaggccagtggccc

SEQ ID NO: 6711868 - DNA, 21 bp, Homo sapiens
catcctgaggccagtggcccc

SEQ ID NO: 6711869 - DNA, 18 bp, Homo sapiens
catcctgaggctccactt

SEQ ID NO: 6711870 - DNA, 21 bp, Homo sapiens
catcctgaggtgcctcccagt

SEQ ID NO: 6711871 - DNA, 17 bp, Homo sapiens
catcctgataccattct

SEQ ID NO: 6711872 - DNA, 17 bp, Homo sapiens
catcctgatcccagacc

SEQ ID NO: 6711873 - DNA, 20 bp, Homo sapiens
catcctgattattgaatgtt

SEQ ID NO: 6711874 - DNA, 19 bp, Homo sapiens
catcctgatttttactatc

SEQ ID NO: 6711875 - DNA, 15 bp, Homo sapiens
catcctgcaaaggcc

SEQ ID NO: 6711876 - DNA, 18 bp, Homo sapiens
catcctgcaaaggccctt

SEQ ID NO: 6711877 - DNA, 11 bp, Homo sapiens
catcctgcaag

SEQ ID NO: 6711878 - DNA, 16 bp, Homo sapiens
catcctgcaaggtgaa

SEQ ID NO: 6711879 - DNA, 12 bp, Homo sapiens
catcctgcagcc

SEQ ID NO: 6711880 - DNA, 21 bp, Homo sapiens
catcctgcagggcttctcctc

SEQ ID NO: 6711881 - DNA, 14 bp, Homo sapiens
catcctgccagccc

SEQ ID NO: 6711882 - DNA, 17 bp, Homo sapiens
catcctgccagccccac

SEQ ID NO: 6711883 - DNA, 15 bp, Homo sapiens
catcctgccaggagc

SEQ ID NO: 6711884 - DNA, 21 bp, Homo sapiens
catcctgccaggagcagcctc

SEQ ID NO: 6711885 - DNA, 13 bp, Homo sapiens
catcctgcccgag

SEQ ID NO: 6711886 - DNA, 14 bp, Homo sapiens
catcctgccctgca

SEQ ID NO: 6711887 - DNA, 16 bp, Homo sapiens
catcctgccctgcagc

SEQ ID NO: 6711888 - DNA, 13 bp, Homo sapiens
catcctgcctggg

SEQ ID NO: 6711889 - DNA, 14 bp, Homo sapiens
catcctgcctgggt

SEQ ID NO: 6711890 - DNA, 15 bp, Homo sapiens
catcctgcctgggtg

SEQ ID NO: 6711891 - DNA, 23 bp, Homo sapiens
catcctgccttagagccaggcac

SEQ ID NO: 6711892 - DNA, 11 bp, Homo sapiens
catcctgcttc

SEQ ID NO: 6711893 - DNA, 15 bp, Homo sapiens
catcctgcttcctga

SEQ ID NO: 6711894 - DNA, 17 bp, Homo sapiens
catcctgcttcctgaaa

SEQ ID NO: 6711895 - DNA, 18 bp, Homo sapiens
catcctgcttcctgaaag

SEQ ID NO: 6711896 - DNA, 22 bp, Homo sapiens
catcctgcttcctgaaagctgt

SEQ ID NO: 6711897 - DNA, 23 bp, Homo sapiens
catcctgcttcctgaaagctgtt

SEQ ID NO: 6711898 - DNA, 14 bp, Homo sapiens
catcctgcttctct

SEQ ID NO: 6711899 - DNA, 18 bp, Homo sapiens
catcctgcttctcttttc

SEQ ID NO: 6711900 - DNA, 16 bp, Homo sapiens
catcctggaaatttgt

SEQ ID NO: 6711901 - DNA, 21 bp, Homo sapiens
catcctggaggggtgttgtat

SEQ ID NO: 6711902 - DNA, 15 bp, Homo sapiens
catcctggcacccgg

SEQ ID NO: 6711903 - DNA, 23 bp, Homo sapiens
catcctggcacccggcccctgct

SEQ ID NO: 6711904 - DNA, 12 bp, Homo sapiens
catcctggcagg

SEQ ID NO: 6711905 - DNA, 12 bp, Homo sapiens
catcctggccaa

SEQ ID NO: 6711906 - DNA, 12 bp, Homo sapiens
catcctggccca

SEQ ID NO: 6711907 - DNA, 14 bp, Homo sapiens
catcctggcccagc

SEQ ID NO: 6711908 - DNA, 18 bp, Homo sapiens
catcctggcccagcctct

SEQ ID NO: 6711909 - DNA, 18 bp, Homo sapiens
catcctggcccagggcat

SEQ ID NO: 6711910 - DNA, 19 bp, Homo sapiens
catcctggcccagggcatc

SEQ ID NO: 6711911 - DNA, 13 bp, Homo sapiens
catcctggcccat

SEQ ID NO: 6711912 - DNA, 15 bp, Homo sapiens
catcctggcccatca

SEQ ID NO: 6711913 - DNA, 16 bp, Homo sapiens
catcctggcccatcag

SEQ ID NO: 6711914 - DNA, 19 bp, Homo sapiens
catcctggcccatcagtgt

SEQ ID NO: 6711915 - DNA, 12 bp, Homo sapiens
catcctggcccc

SEQ ID NO: 6711916 - DNA, 15 bp, Homo sapiens
catcctggcccctcc

SEQ ID NO: 6711917 - DNA, 11 bp, Homo sapiens
catcctggctg

SEQ ID NO: 6711918 - DNA, 15 bp, Homo sapiens
catcctggctggctg

SEQ ID NO: 6711919 - DNA, 19 bp, Homo sapiens
catcctggctggctgtgtc

SEQ ID NO: 6711920 - DNA, 18 bp, Homo sapiens
catcctgggatgtaaacc

SEQ ID NO: 6711921 - DNA, 18 bp, Homo sapiens
catcctgggccttacctc

SEQ ID NO: 6711922 - DNA, 23 bp, Homo sapiens
catcctgggccttacctcccctg

SEQ ID NO: 6711923 - DNA, 19 bp, Homo sapiens
catcctggggcagcactcc

SEQ ID NO: 6711924 - DNA, 15 bp, Homo sapiens
catcctgtataagca

SEQ ID NO: 6711925 - DNA, 11 bp, Homo sapiens
catcctgtgaa

SEQ ID NO: 6711926 - DNA, 23 bp, Homo sapiens
catcctgtgccactaaactacat

SEQ ID NO: 6711927 - DNA, 19 bp, Homo sapiens
catcctgtgcctccatcag

SEQ ID NO: 6711928 - DNA, 19 bp, Homo sapiens
catcctgtgggacctgggc

SEQ ID NO: 6711929 - DNA, 23 bp, Homo sapiens
catcctgtgtcagaaaccctggt

SEQ ID NO: 6711930 - DNA, 15 bp, Homo sapiens
catcctgtgtcccct

SEQ ID NO: 6711931 - DNA, 16 bp, Homo sapiens
catcctgtgtggggag

SEQ ID NO: 6711932 - DNA, 16 bp, Homo sapiens
catcctgttggctgct

SEQ ID NO: 6711933 - DNA, 12 bp, Homo sapiens
catcctgtttga

SEQ ID NO: 6711934 - DNA, 20 bp, Homo sapiens
catcctgtttgtatgaaatt

SEQ ID NO: 6711935 - DNA, 14 bp, Homo sapiens
catcctgttttctc

SEQ ID NO: 6711936 - DNA, 12 bp, Homo sapiens
catccttaaatg

SEQ ID NO: 6711937 - DNA, 21 bp, Homo sapiens
catccttaagagaagaaatgt

SEQ ID NO: 6711938 - DNA, 17 bp, Homo sapiens
catccttacaatgtaaa

SEQ ID NO: 6711939 - DNA, 21 bp, Homo sapiens
catccttcaagaactctgggc

SEQ ID NO: 6711940 - DNA, 23 bp, Homo sapiens
catccttcaagaactctgggctg

SEQ ID NO: 6711941 - DNA, 13 bp, Homo sapiens
catccttcaccag

SEQ ID NO: 6711942 - DNA, 14 bp, Homo sapiens
catccttcaccaga

SEQ ID NO: 6711943 - DNA, 16 bp, Homo sapiens
catccttcaccagagc

SEQ ID NO: 6711944 - DNA, 16 bp, Homo sapiens
catccttcccactctg

SEQ ID NO: 6711945 - DNA, 21 bp, Homo sapiens
catccttccccaacttcccta

SEQ ID NO: 6711946 - DNA, 13 bp, Homo sapiens
catccttcccgca

SEQ ID NO: 6711947 - DNA, 17 bp, Homo sapiens
catccttcccgcagcac

SEQ ID NO: 6711948 - DNA, 20 bp, Homo sapiens
catccttcccgcagcaccag

SEQ ID NO: 6711949 - DNA, 23 bp, Homo sapiens
catccttcccgcagcaccagcct

SEQ ID NO: 6711950 - DNA, 21 bp, Homo sapiens
catccttccctgtctgccagg

SEQ ID NO: 6711951 - DNA, 13 bp, Homo sapiens
catccttcccttt

SEQ ID NO: 6711952 - DNA, 21 bp, Homo sapiens
catccttccgccaatctggcc

SEQ ID NO: 6711953 - DNA, 18 bp, Homo sapiens
catccttctaaagtgctg

SEQ ID NO: 6711954 - DNA, 20 bp, Homo sapiens
catccttctccccaaggtct

SEQ ID NO: 6711955 - DNA, 23 bp, Homo sapiens
catccttctgtgtaccacttcct

SEQ ID NO: 6711956 - DNA, 21 bp, Homo sapiens
catccttcttggcttcctggc

SEQ ID NO: 6711957 - DNA, 21 bp, Homo sapiens
catccttgattacttccactg

SEQ ID NO: 6711958 - DNA, 22 bp, Homo sapiens
catccttgattacttccactga

SEQ ID NO: 6711959 - DNA, 13 bp, Homo sapiens
catccttgcagtt

SEQ ID NO: 6711960 - DNA, 16 bp, Homo sapiens
catccttgcagtttaa

SEQ ID NO: 6711961 - DNA, 16 bp, Homo sapiens
catccttgcccaggtg

SEQ ID NO: 6711962 - DNA, 19 bp, Homo sapiens
catccttggtctttgtatc

SEQ ID NO: 6711963 - DNA, 21 bp, Homo sapiens
catccttggtctttgtatctt

SEQ ID NO: 6711964 - DNA, 20 bp, Homo sapiens
catccttggtgctcttgctt

SEQ ID NO: 6711965 - DNA, 21 bp, Homo sapiens
catccttggtgctcttgcttt

SEQ ID NO: 6711966 - DNA, 15 bp, Homo sapiens
catccttgtaatacc

SEQ ID NO: 6711967 - DNA, 14 bp, Homo sapiens
catccttgtctttt

SEQ ID NO: 6711968 - DNA, 19 bp, Homo sapiens
catcctttcacttctttcc

SEQ ID NO: 6711969 - DNA, 20 bp, Homo sapiens
catcctttcacttctttccc

SEQ ID NO: 6711970 - DNA, 14 bp, Homo sapiens
catcctttccctct

SEQ ID NO: 6711971 - DNA, 15 bp, Homo sapiens
catcctttccctctc

SEQ ID NO: 6711972 - DNA, 16 bp, Homo sapiens
catcctttccctctcc

SEQ ID NO: 6711973 - DNA, 22 bp, Homo sapiens
catcctttcctctagcttttct

SEQ ID NO: 6711974 - DNA, 23 bp, Homo sapiens
catccttttgctctgtcctcccc

SEQ ID NO: 6711975 - DNA, 16 bp, Homo sapiens
catccttttgcttcat

SEQ ID NO: 6711976 - DNA, 17 bp, Homo sapiens
catccttttgcttcatc

SEQ ID NO: 6711977 - DNA, 14 bp, Homo sapiens
catcctttttctgc

SEQ ID NO: 6711978 - DNA, 18 bp, Homo sapiens
catccttttttaaaaaaa

SEQ ID NO: 6711979 - DNA, 20 bp, Homo sapiens
catccttttttctcttctgt

SEQ ID NO: 6711980 - DNA, 20 bp, Homo sapiens
catcgaaaattcatttcaca

SEQ ID NO: 6711981 - DNA, 13 bp, Homo sapiens
catcgaatgtgta

SEQ ID NO: 6711982 - DNA, 21 bp, Homo sapiens
catcgaccacaccagcctcct

SEQ ID NO: 6711983 - DNA, 17 bp, Homo sapiens
catcgacttagcctgag

SEQ ID NO: 6711984 - DNA, 19 bp, Homo sapiens
catcgacttagcctgagtc

SEQ ID NO: 6711985 - DNA, 13 bp, Homo sapiens
catcgatatgaaa

SEQ ID NO: 6711986 - DNA, 14 bp, Homo sapiens
catcgatatgaaaa

SEQ ID NO: 6711987 - DNA, 20 bp, Homo sapiens
catcgcaatagttttttact

SEQ ID NO: 6711988 - DNA, 15 bp, Homo sapiens
catcgcagcttcctg

SEQ ID NO: 6711989 - DNA, 20 bp, Homo sapiens
catcgcaggagtctctgcca

SEQ ID NO: 6711990 - DNA, 23 bp, Homo sapiens
catcgcaggagtctctgccaccc

SEQ ID NO: 6711991 - DNA, 18 bp, Homo sapiens
catcgcatccgtcctggg

SEQ ID NO: 6711992 - DNA, 16 bp, Homo sapiens
catcgccaacttgtct

SEQ ID NO: 6711993 - DNA, 16 bp, Homo sapiens
catcgccaaggactga

SEQ ID NO: 6711994 - DNA, 21 bp, Homo sapiens
catcgccaaggactgactgag

SEQ ID NO: 6711995 - DNA, 23 bp, Homo sapiens
catcgccaaggactgactgagac

SEQ ID NO: 6711996 - DNA, 20 bp, Homo sapiens
catcgccagaggtgcttcac

SEQ ID NO: 6711997 - DNA, 15 bp, Homo sapiens
catcgccagccctgg

SEQ ID NO: 6711998 - DNA, 20 bp, Homo sapiens
catcgccagccctgggcctg

SEQ ID NO: 6711999 - DNA, 21 bp, Homo sapiens
catcgccagctgatgactcaa

SEQ ID NO: 6712000 - DNA, 19 bp, Homo sapiens
catcgccatcttcttccct

SEQ ID NO: 6712001 - DNA, 20 bp, Homo sapiens
catcgccatcttcttccctt

SEQ ID NO: 6712002 - DNA, 15 bp, Homo sapiens
catcgccccaactcc

SEQ ID NO: 6712003 - DNA, 12 bp, Homo sapiens
catcgcctggga

SEQ ID NO: 6712004 - DNA, 12 bp, Homo sapiens
catcgccttctg

SEQ ID NO: 6712005 - DNA, 15 bp, Homo sapiens
catcgcgctccttgc

SEQ ID NO: 6712006 - DNA, 23 bp, Homo sapiens
catcgcgggatggtgcagacgcg

SEQ ID NO: 6712007 - DNA, 19 bp, Homo sapiens
catcgctcccaaaggaaag

SEQ ID NO: 6712008 - DNA, 16 bp, Homo sapiens
catcgctggaaaacag

SEQ ID NO: 6712009 - DNA, 18 bp, Homo sapiens
catcgctgttctgggcat

SEQ ID NO: 6712010 - DNA, 19 bp, Homo sapiens
catcgctgttctgggcatg

SEQ ID NO: 6712011 - DNA, 23 bp, Homo sapiens
catcgcttctttttcaaaactag

SEQ ID NO: 6712012 - DNA, 16 bp, Homo sapiens
catcggaaaaataatc

SEQ ID NO: 6712013 - DNA, 13 bp, Homo sapiens
catcggaagagag

SEQ ID NO: 6712014 - DNA, 17 bp, Homo sapiens
catcggaagagagggct

SEQ ID NO: 6712015 - DNA, 16 bp, Homo sapiens
catcggacaggaggat

SEQ ID NO: 6712016 - DNA, 22 bp, Homo sapiens
catcggactaaactatctgtat

SEQ ID NO: 6712017 - DNA, 20 bp, Homo sapiens
catcggaggctgggcccctg

SEQ ID NO: 6712018 - DNA, 20 bp, Homo sapiens
catcggagggagtcccagag

SEQ ID NO: 6712019 - DNA, 20 bp, Homo sapiens
catcggccaagaatacttga

SEQ ID NO: 6712020 - DNA, 21 bp, Homo sapiens
catcggccaagaatacttgaa

SEQ ID NO: 6712021 - DNA, 15 bp, Homo sapiens
catcggccctgtccc

SEQ ID NO: 6712022 - DNA, 16 bp, Homo sapiens
catcggcctagggccc

SEQ ID NO: 6712023 - DNA, 17 bp, Homo sapiens
catcggcctagggcccc

SEQ ID NO: 6712024 - DNA, 15 bp, Homo sapiens
catcggcgtggccca

SEQ ID NO: 6712025 - DNA, 17 bp, Homo sapiens
catcgggaaagaagaaa

SEQ ID NO: 6712026 - DNA, 15 bp, Homo sapiens
catcgggcccaggga

SEQ ID NO: 6712027 - DNA, 17 bp, Homo sapiens
catcgggcccagggaca

SEQ ID NO: 6712028 - DNA, 14 bp, Homo sapiens
catcggggccattt

SEQ ID NO: 6712029 - DNA, 20 bp, Homo sapiens
catcggggctaacagagact

SEQ ID NO: 6712030 - DNA, 15 bp, Homo sapiens
catcgggggcctgca

SEQ ID NO: 6712031 - DNA, 14 bp, Homo sapiens
catcggtcagcagg

SEQ ID NO: 6712032 - DNA, 16 bp, Homo sapiens
catcggtcatgtgtgt

SEQ ID NO: 6712033 - DNA, 22 bp, Homo sapiens
catcggtgtggactacaggaca

SEQ ID NO: 6712034 - DNA, 23 bp, Homo sapiens
catcggtgtggactacaggacaa

SEQ ID NO: 6712035 - DNA, 14 bp, Homo sapiens
catcgtagaagaga

SEQ ID NO: 6712036 - DNA, 21 bp, Homo sapiens
catcgtagaagagatgtggca

SEQ ID NO: 6712037 - DNA, 16 bp, Homo sapiens
catcgtaggcagccac

SEQ ID NO: 6712038 - DNA, 14 bp, Homo sapiens
catcgtataaggaa

SEQ ID NO: 6712039 - DNA, 15 bp, Homo sapiens
catcgtcctgggact

SEQ ID NO: 6712040 - DNA, 19 bp, Homo sapiens
catcgtctcatcctccttt

SEQ ID NO: 6712041 - DNA, 21 bp, Homo sapiens
catcgtctcatcctcctttca

SEQ ID NO: 6712042 - DNA, 16 bp, Homo sapiens
catcgtcttttagttc

SEQ ID NO: 6712043 - DNA, 18 bp, Homo sapiens
catcgtgaagaagcctgt

SEQ ID NO: 6712044 - DNA, 15 bp, Homo sapiens
catcgtgacccttca

SEQ ID NO: 6712045 - DNA, 16 bp, Homo sapiens
catcgtgacccttcag

SEQ ID NO: 6712046 - DNA, 16 bp, Homo sapiens
catcgtggtatgtgaa

SEQ ID NO: 6712047 - DNA, 16 bp, Homo sapiens
catcgttccccacccc

SEQ ID NO: 6712048 - DNA, 16 bp, Homo sapiens
catcgttgagacatca

SEQ ID NO: 6712049 - DNA, 23 bp, Homo sapiens
catcgttgagacatcaggaaggt

SEQ ID NO: 6712050 - DNA, 23 bp, Homo sapiens
catcgttgcaaccactgcaatat

SEQ ID NO: 6712051 - DNA, 17 bp, Homo sapiens
catcgttgcattttaca

SEQ ID NO: 6712052 - DNA, 17 bp, Homo sapiens
catcgttttctttgctg

SEQ ID NO: 6712053 - DNA, 13 bp, Homo sapiens
catctaaaaatat

SEQ ID NO: 6712054 - DNA, 14 bp, Homo sapiens
catctaaaaatata

SEQ ID NO: 6712055 - DNA, 17 bp, Homo sapiens
catctaaaaatatacat

SEQ ID NO: 6712056 - DNA, 23 bp, Homo sapiens
catctaaaaatatacatgtttat

SEQ ID NO: 6712057 - DNA, 22 bp, Homo sapiens
catctaaacacaacaataactt

SEQ ID NO: 6712058 - DNA, 15 bp, Homo sapiens
catctaaaccagaag

SEQ ID NO: 6712059 - DNA, 22 bp, Homo sapiens
catctaaaccagaaggaagccc

SEQ ID NO: 6712060 - DNA, 15 bp, Homo sapiens
catctaaactgcccc

SEQ ID NO: 6712061 - DNA, 21 bp, Homo sapiens
catctaaactggagtgatgtt

SEQ ID NO: 6712062 - DNA, 15 bp, Homo sapiens
catctaaactttaat

SEQ ID NO: 6712063 - DNA, 23 bp, Homo sapiens
catctaaactttaatatgtattt

SEQ ID NO: 6712064 - DNA, 18 bp, Homo sapiens
catctaaatacctgccct

SEQ ID NO: 6712065 - DNA, 16 bp, Homo sapiens
catctaaatattatgc

SEQ ID NO: 6712066 - DNA, 22 bp, Homo sapiens
catctaacaggaaaagagggag

SEQ ID NO: 6712067 - DNA, 20 bp, Homo sapiens
catctaacttcttaaagtta

SEQ ID NO: 6712068 - DNA, 16 bp, Homo sapiens
catctaagcctgaagg

SEQ ID NO: 6712069 - DNA, 14 bp, Homo sapiens
catctaagctgcag

SEQ ID NO: 6712070 - DNA, 17 bp, Homo sapiens
catctaagctgcagctt

SEQ ID NO: 6712071 - DNA, 16 bp, Homo sapiens
catctaataaatcagt

SEQ ID NO: 6712072 - DNA, 17 bp, Homo sapiens
catctaatgaaaaacaa

SEQ ID NO: 6712073 - DNA, 13 bp, Homo sapiens
catctaatgaatg

SEQ ID NO: 6712074 - DNA, 19 bp, Homo sapiens
catctaatgcttgtttatg

SEQ ID NO: 6712075 - DNA, 21 bp, Homo sapiens
catctaatgtattatgagcca

SEQ ID NO: 6712076 - DNA, 18 bp, Homo sapiens
catctaatgtctcttcct

SEQ ID NO: 6712077 - DNA, 22 bp, Homo sapiens
catctaatgtctcttcctctgt

SEQ ID NO: 6712078 - DNA, 16 bp, Homo sapiens
catctaattctgattc

SEQ ID NO: 6712079 - DNA, 14 bp, Homo sapiens
catctacaaaacat

SEQ ID NO: 6712080 - DNA, 22 bp, Homo sapiens
catctacacagcagtatgaatg

SEQ ID NO: 6712081 - DNA, 20 bp, Homo sapiens
catctacacatataaacaca

SEQ ID NO: 6712082 - DNA, 16 bp, Homo sapiens
catctacccctggatg

SEQ ID NO: 6712083 - DNA, 18 bp, Homo sapiens
catctaccttttctcttc

SEQ ID NO: 6712084 - DNA, 19 bp, Homo sapiens
catctaccttttctcttca

SEQ ID NO: 6712085 - DNA, 21 bp, Homo sapiens
catctacgaagccacaggcct

SEQ ID NO: 6712086 - DNA, 23 bp, Homo sapiens
catctacgaagccacaggcctgg

SEQ ID NO: 6712087 - DNA, 23 bp, Homo sapiens
catctactcattgtctcagtgct

SEQ ID NO: 6712088 - DNA, 19 bp, Homo sapiens
catctactgaatgacctct

SEQ ID NO: 6712089 - DNA, 13 bp, Homo sapiens
catctactggata

SEQ ID NO: 6712090 - DNA, 16 bp, Homo sapiens
catctacttaataaat

SEQ ID NO: 6712091 - DNA, 23 bp, Homo sapiens
catctagaggcttccttcatttc

SEQ ID NO: 6712092 - DNA, 13 bp, Homo sapiens
catctagcacagc

SEQ ID NO: 6712093 - DNA, 19 bp, Homo sapiens
catctagccagaggctgga

SEQ ID NO: 6712094 - DNA, 12 bp, Homo sapiens
catctagccagc

SEQ ID NO: 6712095 - DNA, 17 bp, Homo sapiens
catctagccagcccctc

SEQ ID NO: 6712096 - DNA, 12 bp, Homo sapiens
catctaggattt

SEQ ID NO: 6712097 - DNA, 19 bp, Homo sapiens
catctagggaatgggactg

SEQ ID NO: 6712098 - DNA, 18 bp, Homo sapiens
catctaggggagccttga

SEQ ID NO: 6712099 - DNA, 17 bp, Homo sapiens
catctaggtaattttta

SEQ ID NO: 6712100 - DNA, 18 bp, Homo sapiens
catctagtacttgaaaaa

SEQ ID NO: 6712101 - DNA, 20 bp, Homo sapiens
catctagtcttgacctctcc

SEQ ID NO: 6712102 - DNA, 22 bp, Homo sapiens
catctagtgagcagtcaggaaa

SEQ ID NO: 6712103 - DNA, 20 bp, Homo sapiens
catctagttcccctgtttat

SEQ ID NO: 6712104 - DNA, 14 bp, Homo sapiens
catctataaagaag

SEQ ID NO: 6712105 - DNA, 20 bp, Homo sapiens
catctataatgtcagcttat

SEQ ID NO: 6712106 - DNA, 17 bp, Homo sapiens
catctatagaaagctat

SEQ ID NO: 6712107 - DNA, 19 bp, Homo sapiens
catctatcgagtttgcaat

SEQ ID NO: 6712108 - DNA, 17 bp, Homo sapiens
catctatggagggcaga

SEQ ID NO: 6712109 - DNA, 20 bp, Homo sapiens
catctatggcagtccagcca

SEQ ID NO: 6712110 - DNA, 15 bp, Homo sapiens
catctatggttctaa

SEQ ID NO: 6712111 - DNA, 13 bp, Homo sapiens
catctatgtattc

SEQ ID NO: 6712112 - DNA, 20 bp, Homo sapiens
catctattataaaaccatgt

SEQ ID NO: 6712113 - DNA, 18 bp, Homo sapiens
catctattcccaaagaac

SEQ ID NO: 6712114 - DNA, 21 bp, Homo sapiens
catctattctttgtaccatct

SEQ ID NO: 6712115 - DNA, 17 bp, Homo sapiens
catctatttcgagtgtt

SEQ ID NO: 6712116 - DNA, 16 bp, Homo sapiens
catctatttctgagaa

SEQ ID NO: 6712117 - DNA, 11 bp, Homo sapiens
catctatttta

SEQ ID NO: 6712118 - DNA, 23 bp, Homo sapiens
catctattttaccatatgtttat

SEQ ID NO: 6712119 - DNA, 22 bp, Homo sapiens
catctattttattttattgaat

SEQ ID NO: 6712120 - DNA, 23 bp, Homo sapiens
catctattttctcagaatctatt

SEQ ID NO: 6712121 - DNA, 21 bp, Homo sapiens
catctattttgatgcagcatt

SEQ ID NO: 6712122 - DNA, 14 bp, Homo sapiens
catctattttggat

SEQ ID NO: 6712123 - DNA, 16 bp, Homo sapiens
catctcaaaacagagg

SEQ ID NO: 6712124 - DNA, 20 bp, Homo sapiens
catctcaaaacagagggctg

SEQ ID NO: 6712125 - DNA, 21 bp, Homo sapiens
catctcaaaacagagggctgc

SEQ ID NO: 6712126 - DNA, 22 bp, Homo sapiens
catctcaaaacagagggctgca

SEQ ID NO: 6712127 - DNA, 21 bp, Homo sapiens
catctcaaatccttgagcact

SEQ ID NO: 6712128 - DNA, 13 bp, Homo sapiens
catctcaaatgtt

SEQ ID NO: 6712129 - DNA, 16 bp, Homo sapiens
catctcaaccatcccc

SEQ ID NO: 6712130 - DNA, 21 bp, Homo sapiens
catctcaagcaagtttaatca

SEQ ID NO: 6712131 - DNA, 22 bp, Homo sapiens
catctcaaggaataatgggctt

SEQ ID NO: 6712132 - DNA, 20 bp, Homo sapiens
catctcaattgtgctttgta

SEQ ID NO: 6712133 - DNA, 22 bp, Homo sapiens
catctcaattgtgctttgtatc

SEQ ID NO: 6712134 - DNA, 19 bp, Homo sapiens
catctcaattttttcaaat

SEQ ID NO: 6712135 - DNA, 20 bp, Homo sapiens
catctcaattttttcaaatg

SEQ ID NO: 6712136 - DNA, 20 bp, Homo sapiens
catctcacacatgagcatca

SEQ ID NO: 6712137 - DNA, 12 bp, Homo sapiens
catctcacctcc

SEQ ID NO: 6712138 - DNA, 16 bp, Homo sapiens
catctcacctcctgct

SEQ ID NO: 6712139 - DNA, 17 bp, Homo sapiens
catctcacctcctgctg

SEQ ID NO: 6712140 - DNA, 13 bp, Homo sapiens
catctcacctctc

SEQ ID NO: 6712141 - DNA, 13 bp, Homo sapiens
catctcactgccc

SEQ ID NO: 6712142 - DNA, 16 bp, Homo sapiens
catctcactgcccagt

SEQ ID NO: 6712143 - DNA, 19 bp, Homo sapiens
catctcactggatgcaaag

SEQ ID NO: 6712144 - DNA, 15 bp, Homo sapiens
catctcacttcagtt

SEQ ID NO: 6712145 - DNA, 16 bp, Homo sapiens
catctcagaccctgct

SEQ ID NO: 6712146 - DNA, 14 bp, Homo sapiens
catctcagattctg

SEQ ID NO: 6712147 - DNA, 13 bp, Homo sapiens
catctcagcccac

SEQ ID NO: 6712148 - DNA, 20 bp, Homo sapiens
catctcagcctaccatgaga

SEQ ID NO: 6712149 - DNA, 16 bp, Homo sapiens
catctcagcctcctga

SEQ ID NO: 6712150 - DNA, 18 bp, Homo sapiens
catctcagcctcctgagc

SEQ ID NO: 6712151 - DNA, 20 bp, Homo sapiens
catctcagcctcctgagcct

SEQ ID NO: 6712152 - DNA, 16 bp, Homo sapiens
catctcagcttttgat

SEQ ID NO: 6712153 - DNA, 17 bp, Homo sapiens
catctcaggagatggag

SEQ ID NO: 6712154 - DNA, 23 bp, Homo sapiens
catctcaggaggggcagcgcatg

SEQ ID NO: 6712155 - DNA, 15 bp, Homo sapiens
catctcaggccacct

SEQ ID NO: 6712156 - DNA, 17 bp, Homo sapiens
catctcaggccacctgc

SEQ ID NO: 6712157 - DNA, 18 bp, Homo sapiens
catctcaggcctccctca

SEQ ID NO: 6712158 - DNA, 16 bp, Homo sapiens
catctcaggggccaga

SEQ ID NO: 6712159 - DNA, 21 bp, Homo sapiens
catctcagggtccagaccctg

SEQ ID NO: 6712160 - DNA, 13 bp, Homo sapiens
catctcaggtgcc

SEQ ID NO: 6712161 - DNA, 19 bp, Homo sapiens
catctcaggtgccactccc

SEQ ID NO: 6712162 - DNA, 21 bp, Homo sapiens
catctcaggtgccactccctg

SEQ ID NO: 6712163 - DNA, 22 bp, Homo sapiens
catctcaggtgccactccctga

SEQ ID NO: 6712164 - DNA, 22 bp, Homo sapiens
catctcaggttaagtgtgagta

SEQ ID NO: 6712165 - DNA, 21 bp, Homo sapiens
catctcaggttggcggcagac

SEQ ID NO: 6712166 - DNA, 17 bp, Homo sapiens
catctcagtatgaatta

SEQ ID NO: 6712167 - DNA, 22 bp, Homo sapiens
catctcagtcctcaaagctttt

SEQ ID NO: 6712168 - DNA, 18 bp, Homo sapiens
catctcatcatgtctatt

SEQ ID NO: 6712169 - DNA, 11 bp, Homo sapiens
catctcatcct

SEQ ID NO: 6712170 - DNA, 12 bp, Homo sapiens
catctcatccta

SEQ ID NO: 6712171 - DNA, 14 bp, Homo sapiens
catctcatcctggc

SEQ ID NO: 6712172 - DNA, 19 bp, Homo sapiens
catctcatgaggggagagg

SEQ ID NO: 6712173 - DNA, 20 bp, Homo sapiens
catctcatgtatcatctgga

SEQ ID NO: 6712174 - DNA, 23 bp, Homo sapiens
catctcatgtatcatctggatag

SEQ ID NO: 6712175 - DNA, 16 bp, Homo sapiens
catctcattacagctc

SEQ ID NO: 6712176 - DNA, 19 bp, Homo sapiens
catctcattacccttttct

SEQ ID NO: 6712177 - DNA, 17 bp, Homo sapiens
catctcattccaacttc

SEQ ID NO: 6712178 - DNA, 18 bp, Homo sapiens
catctcattgcggcctgt

SEQ ID NO: 6712179 - DNA, 23 bp, Homo sapiens
catctcatttaagggaaaaatat

SEQ ID NO: 6712180 - DNA, 19 bp, Homo sapiens
catctcatttaatcctccc

SEQ ID NO: 6712181 - DNA, 14 bp, Homo sapiens
catctcatttgtat

SEQ ID NO: 6712182 - DNA, 19 bp, Homo sapiens
catctccaagaatgctgaa

SEQ ID NO: 6712183 - DNA, 23 bp, Homo sapiens
catctccaagaatgctgaaacca

SEQ ID NO: 6712184 - DNA, 22 bp, Homo sapiens
catctccaagataagcctgagc

SEQ ID NO: 6712185 - DNA, 13 bp, Homo sapiens
catctccaagcag

SEQ ID NO: 6712186 - DNA, 21 bp, Homo sapiens
catctccaatggaaagctttt

SEQ ID NO: 6712187 - DNA, 17 bp, Homo sapiens
catctccaccctgagcc

SEQ ID NO: 6712188 - DNA, 20 bp, Homo sapiens
catctccaccctgagcctga

SEQ ID NO: 6712189 - DNA, 14 bp, Homo sapiens
catctccactccag

SEQ ID NO: 6712190 - DNA, 19 bp, Homo sapiens
catctccagaaaaatgaaa

SEQ ID NO: 6712191 - DNA, 13 bp, Homo sapiens
catctccagggaa

SEQ ID NO: 6712192 - DNA, 16 bp, Homo sapiens
catctccagggagcaa

SEQ ID NO: 6712193 - DNA, 22 bp, Homo sapiens
catctccagggagcaagacaga

SEQ ID NO: 6712194 - DNA, 14 bp, Homo sapiens
catctccagggagt

SEQ ID NO: 6712195 - DNA, 19 bp, Homo sapiens
catctccagggagtcccct

SEQ ID NO: 6712196 - DNA, 16 bp, Homo sapiens
catctccatcagctgt

SEQ ID NO: 6712197 - DNA, 21 bp, Homo sapiens
catctccatggggaggcctca

SEQ ID NO: 6712198 - DNA, 16 bp, Homo sapiens
catctccatgtagaat

SEQ ID NO: 6712199 - DNA, 14 bp, Homo sapiens
catctccattgcat

SEQ ID NO: 6712200 - DNA, 18 bp, Homo sapiens
catctccatttcacgggc

SEQ ID NO: 6712201 - DNA, 13 bp, Homo sapiens
catctcccaaggc

SEQ ID NO: 6712202 - DNA, 19 bp, Homo sapiens
catctcccaaggctgccag

SEQ ID NO: 6712203 - DNA, 20 bp, Homo sapiens
catctcccaaggctgccaga

SEQ ID NO: 6712204 - DNA, 14 bp, Homo sapiens
catctcccaccctg

SEQ ID NO: 6712205 - DNA, 17 bp, Homo sapiens
catctcccagataatgt

SEQ ID NO: 6712206 - DNA, 17 bp, Homo sapiens
catctcccagatcctgg

SEQ ID NO: 6712207 - DNA, 12 bp, Homo sapiens
catctcccaggc

SEQ ID NO: 6712208 - DNA, 13 bp, Homo sapiens
catctcccaggcc

SEQ ID NO: 6712209 - DNA, 11 bp, Homo sapiens
catctccccac

SEQ ID NO: 6712210 - DNA, 14 bp, Homo sapiens
catctccccaggcc

SEQ ID NO: 6712211 - DNA, 16 bp, Homo sapiens
catctccccaggcctc

SEQ ID NO: 6712212 - DNA, 17 bp, Homo sapiens
catctccccaggcctcc

SEQ ID NO: 6712213 - DNA, 20 bp, Homo sapiens
catctccccaggcctccagc

SEQ ID NO: 6712214 - DNA, 21 bp, Homo sapiens
catctccccaggcctccagcc

SEQ ID NO: 6712215 - DNA, 13 bp, Homo sapiens
catctcccccacc

SEQ ID NO: 6712216 - DNA, 19 bp, Homo sapiens
catctcccccaccctgtgc

SEQ ID NO: 6712217 - DNA, 14 bp, Homo sapiens
catctcccctagct

SEQ ID NO: 6712218 - DNA, 15 bp, Homo sapiens
catctcccctcagct

SEQ ID NO: 6712219 - DNA, 15 bp, Homo sapiens
catctcccctcctgg

SEQ ID NO: 6712220 - DNA, 16 bp, Homo sapiens
catctcccctcctggc

SEQ ID NO: 6712221 - DNA, 17 bp, Homo sapiens
catctcccctcctggcg

SEQ ID NO: 6712222 - DNA, 21 bp, Homo sapiens
catctccctccccagaaacag

SEQ ID NO: 6712223 - DNA, 22 bp, Homo sapiens
catctccctcgaacccacactg

SEQ ID NO: 6712224 - DNA, 11 bp, Homo sapiens
catctccctgc

SEQ ID NO: 6712225 - DNA, 23 bp, Homo sapiens
catctccctgccatccccctctc

SEQ ID NO: 6712226 - DNA, 14 bp, Homo sapiens
catctccctgcctg

SEQ ID NO: 6712227 - DNA, 21 bp, Homo sapiens
catctccctgcctggccccca

SEQ ID NO: 6712228 - DNA, 14 bp, Homo sapiens
catctccctgcttt

SEQ ID NO: 6712229 - DNA, 20 bp, Homo sapiens
catctccctggtgcttatgc

SEQ ID NO: 6712230 - DNA, 19 bp, Homo sapiens
catctcccttccacctcac

SEQ ID NO: 6712231 - DNA, 20 bp, Homo sapiens
catctcccttccacctcaca

SEQ ID NO: 6712232 - DNA, 13 bp, Homo sapiens
catctcccttcct

SEQ ID NO: 6712233 - DNA, 16 bp, Homo sapiens
catctccggggctttg

SEQ ID NO: 6712234 - DNA, 22 bp, Homo sapiens
catctcctaatttgtttcttct

SEQ ID NO: 6712235 - DNA, 16 bp, Homo sapiens
catctcctcaccccag

SEQ ID NO: 6712236 - DNA, 18 bp, Homo sapiens
catctcctcccaccagtg

SEQ ID NO: 6712237 - DNA, 19 bp, Homo sapiens
catctcctcccgcccttcc

SEQ ID NO: 6712238 - DNA, 14 bp, Homo sapiens
catctcctgagtat

SEQ ID NO: 6712239 - DNA, 19 bp, Homo sapiens
catctcctgccttcctcct

SEQ ID NO: 6712240 - DNA, 22 bp, Homo sapiens
catctcctgccttcctcctggg

SEQ ID NO: 6712241 - DNA, 12 bp, Homo sapiens
catctcctgctc

SEQ ID NO: 6712242 - DNA, 22 bp, Homo sapiens
catctcctggctaagcctctgc

SEQ ID NO: 6712243 - DNA, 11 bp, Homo sapiens
catctcctgtc

SEQ ID NO: 6712244 - DNA, 17 bp, Homo sapiens
catctcctgtcctgggc

SEQ ID NO: 6712245 - DNA, 19 bp, Homo sapiens
catctcctgtgcatgggtg

SEQ ID NO: 6712246 - DNA, 19 bp, Homo sapiens
catctccttacctctggaa

SEQ ID NO: 6712247 - DNA, 20 bp, Homo sapiens
catctccttacctctggaac

SEQ ID NO: 6712248 - DNA, 16 bp, Homo sapiens
catctccttcccccag

SEQ ID NO: 6712249 - DNA, 16 bp, Homo sapiens
catctccttgatcatg

SEQ ID NO: 6712250 - DNA, 18 bp, Homo sapiens
catctccttgatcatgtc

SEQ ID NO: 6712251 - DNA, 14 bp, Homo sapiens
catctcctttgcta

SEQ ID NO: 6712252 - DNA, 21 bp, Homo sapiens
catctcctttgctagtgtctt

SEQ ID NO: 6712253 - DNA, 19 bp, Homo sapiens
catctcgagccccctggat

SEQ ID NO: 6712254 - DNA, 17 bp, Homo sapiens
catctcgctccctccca

SEQ ID NO: 6712255 - DNA, 21 bp, Homo sapiens
catctcgctccctcccaggac

SEQ ID NO: 6712256 - DNA, 22 bp, Homo sapiens
catctcgctccctcccaggact

SEQ ID NO: 6712257 - DNA, 14 bp, Homo sapiens
catctcggagcatc

SEQ ID NO: 6712258 - DNA, 21 bp, Homo sapiens
catctcggagcatcccggagg

SEQ ID NO: 6712259 - DNA, 22 bp, Homo sapiens
catctctaaaaaaatacaaaaa

SEQ ID NO: 6712260 - DNA, 20 bp, Homo sapiens
catctctaacagctcaggat

SEQ ID NO: 6712261 - DNA, 15 bp, Homo sapiens
catctctaattttgg

SEQ ID NO: 6712262 - DNA, 23 bp, Homo sapiens
catctctacaggcacccatcaga

SEQ ID NO: 6712263 - DNA, 15 bp, Homo sapiens
catctctactaaaaa

SEQ ID NO: 6712264 - DNA, 22 bp, Homo sapiens
catctctactaaaaatacaaac

SEQ ID NO: 6712265 - DNA, 22 bp, Homo sapiens
catctctagtgtagctgccaca

SEQ ID NO: 6712266 - DNA, 14 bp, Homo sapiens
catctctcaaactt

SEQ ID NO: 6712267 - DNA, 19 bp, Homo sapiens
catctctcaaacttagttt

SEQ ID NO: 6712268 - DNA, 18 bp, Homo sapiens
catctctcagaagggagg

SEQ ID NO: 6712269 - DNA, 19 bp, Homo sapiens
catctctcaggaatcatct

SEQ ID NO: 6712270 - DNA, 17 bp, Homo sapiens
catctctcatcctccag

SEQ ID NO: 6712271 - DNA, 12 bp, Homo sapiens
catctctcccac

SEQ ID NO: 6712272 - DNA, 16 bp, Homo sapiens
catctctcccacttcc

SEQ ID NO: 6712273 - DNA, 17 bp, Homo sapiens
catctctcccacttcct

SEQ ID NO: 6712274 - DNA, 13 bp, Homo sapiens
catctctccctcc

SEQ ID NO: 6712275 - DNA, 14 bp, Homo sapiens
catctctccctcct

SEQ ID NO: 6712276 - DNA, 14 bp, Homo sapiens
catctctcctgctc

SEQ ID NO: 6712277 - DNA, 14 bp, Homo sapiens
catctctctacctc

SEQ ID NO: 6712278 - DNA, 21 bp, Homo sapiens
catctctctacctccaccctg

SEQ ID NO: 6712279 - DNA, 22 bp, Homo sapiens
catctctctacctccaccctgc

SEQ ID NO: 6712280 - DNA, 21 bp, Homo sapiens
catctctctactcctacctca

SEQ ID NO: 6712281 - DNA, 16 bp, Homo sapiens
catctctctgcccaac

SEQ ID NO: 6712282 - DNA, 14 bp, Homo sapiens
catctctctgcccc

SEQ ID NO: 6712283 - DNA, 22 bp, Homo sapiens
catctctctgccccacataatt

SEQ ID NO: 6712284 - DNA, 15 bp, Homo sapiens
catctctctgccctc

SEQ ID NO: 6712285 - DNA, 23 bp, Homo sapiens
catctctctgccctctccctgtg

SEQ ID NO: 6712286 - DNA, 11 bp, Homo sapiens
catctctctgg

SEQ ID NO: 6712287 - DNA, 21 bp, Homo sapiens
catctctctggccctctaccc

SEQ ID NO: 6712288 - DNA, 16 bp, Homo sapiens
catctctctggcttct

SEQ ID NO: 6712289 - DNA, 20 bp, Homo sapiens
catctctctggggccctggg

SEQ ID NO: 6712290 - DNA, 12 bp, Homo sapiens
catctctcttcc

SEQ ID NO: 6712291 - DNA, 23 bp, Homo sapiens
catctctcttgggccaagccagc

SEQ ID NO: 6712292 - DNA, 18 bp, Homo sapiens
catctctgaacttcagct

SEQ ID NO: 6712293 - DNA, 19 bp, Homo sapiens
catctctgagtgtctctgc

SEQ ID NO: 6712294 - DNA, 20 bp, Homo sapiens
catctctgagtgtctctgcc

SEQ ID NO: 6712295 - DNA, 22 bp, Homo sapiens
catctctgagtgtctctgcctg

SEQ ID NO: 6712296 - DNA, 12 bp, Homo sapiens
catctctgcaaa

SEQ ID NO: 6712297 - DNA, 15 bp, Homo sapiens
catctctgcaatctt

SEQ ID NO: 6712298 - DNA, 22 bp, Homo sapiens
catctctgcaatcttctcagaa

SEQ ID NO: 6712299 - DNA, 12 bp, Homo sapiens
catctctgcagt

SEQ ID NO: 6712300 - DNA, 12 bp, Homo sapiens
catctctgcctg

SEQ ID NO: 6712301 - DNA, 21 bp, Homo sapiens
catctctgcctgacaaggcca

SEQ ID NO: 6712302 - DNA, 13 bp, Homo sapiens
catctctgctcca

SEQ ID NO: 6712303 - DNA, 14 bp, Homo sapiens
catctctgctgctt

SEQ ID NO: 6712304 - DNA, 13 bp, Homo sapiens
catctctgcttgg

SEQ ID NO: 6712305 - DNA, 19 bp, Homo sapiens
catctctggaaggggcagc

SEQ ID NO: 6712306 - DNA, 22 bp, Homo sapiens
catctctggaaggggcagccct

SEQ ID NO: 6712307 - DNA, 23 bp, Homo sapiens
catctctggaaggggcagccctg

SEQ ID NO: 6712308 - DNA, 13 bp, Homo sapiens
catctctggagtg

SEQ ID NO: 6712309 - DNA, 19 bp, Homo sapiens
catctctggagtgtgtggg

SEQ ID NO: 6712310 - DNA, 22 bp, Homo sapiens
catctctgggctggatgagctc

SEQ ID NO: 6712311 - DNA, 20 bp, Homo sapiens
catctctggttgacgggctg

SEQ ID NO: 6712312 - DNA, 18 bp, Homo sapiens
catctctgtactttgctt

SEQ ID NO: 6712313 - DNA, 20 bp, Homo sapiens
catctctgtaggatcgtaaa

SEQ ID NO: 6712314 - DNA, 14 bp, Homo sapiens
catctctgtcagtg

SEQ ID NO: 6712315 - DNA, 12 bp, Homo sapiens
catctctgtctg

SEQ ID NO: 6712316 - DNA, 11 bp, Homo sapiens
catctctgtga

SEQ ID NO: 6712317 - DNA, 19 bp, Homo sapiens
catctctgtgaagcctctc

SEQ ID NO: 6712318 - DNA, 14 bp, Homo sapiens
catctcttaaattt

SEQ ID NO: 6712319 - DNA, 19 bp, Homo sapiens
catctcttagctcccctcc

SEQ ID NO: 6712320 - DNA, 22 bp, Homo sapiens
catctcttcaatcactagtcaa

SEQ ID NO: 6712321 - DNA, 14 bp, Homo sapiens
catctcttcaggtt

SEQ ID NO: 6712322 - DNA, 15 bp, Homo sapiens
catctcttccccaga

SEQ ID NO: 6712323 - DNA, 17 bp, Homo sapiens
catctcttccccagaga

SEQ ID NO: 6712324 - DNA, 18 bp, Homo sapiens
catctcttccccagagag

SEQ ID NO: 6712325 - DNA, 12 bp, Homo sapiens
catctcttcctc

SEQ ID NO: 6712326 - DNA, 12 bp, Homo sapiens
catctcttcctt

SEQ ID NO: 6712327 - DNA, 13 bp, Homo sapiens
catctcttccttt

SEQ ID NO: 6712328 - DNA, 14 bp, Homo sapiens
catctcttgaaacc

SEQ ID NO: 6712329 - DNA, 15 bp, Homo sapiens
catctcttgaggcca

SEQ ID NO: 6712330 - DNA, 17 bp, Homo sapiens
catctcttgtaaaagtt

SEQ ID NO: 6712331 - DNA, 23 bp, Homo sapiens
catctcttgtaccagcccaggca

SEQ ID NO: 6712332 - DNA, 13 bp, Homo sapiens
catctcttttccc

SEQ ID NO: 6712333 - DNA, 17 bp, Homo sapiens
catctcttttcccactc

SEQ ID NO: 6712334 - DNA, 13 bp, Homo sapiens
catctgaaaagaa

SEQ ID NO: 6712335 - DNA, 12 bp, Homo sapiens
catctgaaagcc

SEQ ID NO: 6712336 - DNA, 14 bp, Homo sapiens
catctgaaagtaga

SEQ ID NO: 6712337 - DNA, 23 bp, Homo sapiens
catctgaaagttttgatacttgt

SEQ ID NO: 6712338 - DNA, 21 bp, Homo sapiens
catctgaacacaaccagaggt

SEQ ID NO: 6712339 - DNA, 11 bp, Homo sapiens
catctgaagag

SEQ ID NO: 6712340 - DNA, 13 bp, Homo sapiens
catctgaagccac

SEQ ID NO: 6712341 - DNA, 17 bp, Homo sapiens
catctgaatctccttgt

SEQ ID NO: 6712342 - DNA, 18 bp, Homo sapiens
catctgaatctccttgtt

SEQ ID NO: 6712343 - DNA, 20 bp, Homo sapiens
catctgaatgaaaataactg

SEQ ID NO: 6712344 - DNA, 23 bp, Homo sapiens
catctgaatgaaaataactgaac

SEQ ID NO: 6712345 - DNA, 15 bp, Homo sapiens
catctgacaaattca

SEQ ID NO: 6712346 - DNA, 16 bp, Homo sapiens
catctgacacaaaaaa

SEQ ID NO: 6712347 - DNA, 19 bp, Homo sapiens
catctgaccagcagcgcct

SEQ ID NO: 6712348 - DNA, 15 bp, Homo sapiens
catctgaccatctgt

SEQ ID NO: 6712349 - DNA, 17 bp, Homo sapiens
catctgaccatctgtga

SEQ ID NO: 6712350 - DNA, 14 bp, Homo sapiens
catctgacccagag

SEQ ID NO: 6712351 - DNA, 21 bp, Homo sapiens
catctgaccccggggggctgg

SEQ ID NO: 6712352 - DNA, 17 bp, Homo sapiens
catctgactatgacata

SEQ ID NO: 6712353 - DNA, 16 bp, Homo sapiens
catctgactctctttt

SEQ ID NO: 6712354 - DNA, 13 bp, Homo sapiens
catctgactgcca

SEQ ID NO: 6712355 - DNA, 19 bp, Homo sapiens
catctgactgccaagccag

SEQ ID NO: 6712356 - DNA, 21 bp, Homo sapiens
catctgactgccaagccagat

SEQ ID NO: 6712357 - DNA, 22 bp, Homo sapiens
catctgagagaggctaaaatgt

SEQ ID NO: 6712358 - DNA, 23 bp, Homo sapiens
catctgagagaggctaaaatgtt

SEQ ID NO: 6712359 - DNA, 21 bp, Homo sapiens
catctgagaggctctccgtgc

SEQ ID NO: 6712360 - DNA, 16 bp, Homo sapiens
catctgagccagcacc

SEQ ID NO: 6712361 - DNA, 14 bp, Homo sapiens
catctgagctttta

SEQ ID NO: 6712362 - DNA, 13 bp, Homo sapiens
catctgaggagtc

SEQ ID NO: 6712363 - DNA, 16 bp, Homo sapiens
catctgaggcatccag

SEQ ID NO: 6712364 - DNA, 18 bp, Homo sapiens
catctgaggcatccagca

SEQ ID NO: 6712365 - DNA, 19 bp, Homo sapiens
catctgataatttcacaga

SEQ ID NO: 6712366 - DNA, 22 bp, Homo sapiens
catctgatattcaaacacacag

SEQ ID NO: 6712367 - DNA, 14 bp, Homo sapiens
catctgattccagc

SEQ ID NO: 6712368 - DNA, 21 bp, Homo sapiens
catctgatttacttaattcag

SEQ ID NO: 6712369 - DNA, 22 bp, Homo sapiens
catctgcaaaaggcctcttgta

SEQ ID NO: 6712370 - DNA, 21 bp, Homo sapiens
catctgcacacacctccgaga

SEQ ID NO: 6712371 - DNA, 23 bp, Homo sapiens
catctgcacacacctccgagaca

SEQ ID NO: 6712372 - DNA, 15 bp, Homo sapiens
catctgcacactctc

SEQ ID NO: 6712373 - DNA, 22 bp, Homo sapiens
catctgcacactctcttctcca

SEQ ID NO: 6712374 - DNA, 16 bp, Homo sapiens
catctgcaccccttct

SEQ ID NO: 6712375 - DNA, 23 bp, Homo sapiens
catctgcaccctcgatgaagccc

SEQ ID NO: 6712376 - DNA, 13 bp, Homo sapiens
catctgcaccctt

SEQ ID NO: 6712377 - DNA, 15 bp, Homo sapiens
catctgcacccttct

SEQ ID NO: 6712378 - DNA, 16 bp, Homo sapiens
catctgcacccttctt

SEQ ID NO: 6712379 - DNA, 17 bp, Homo sapiens
catctgcacccttcttt

SEQ ID NO: 6712380 - DNA, 19 bp, Homo sapiens
catctgcacccttcttttc

SEQ ID NO: 6712381 - DNA, 18 bp, Homo sapiens
catctgcagcctcctctg

SEQ ID NO: 6712382 - DNA, 13 bp, Homo sapiens
catctgcaggcac

SEQ ID NO: 6712383 - DNA, 11 bp, Homo sapiens
catctgcatca

SEQ ID NO: 6712384 - DNA, 16 bp, Homo sapiens
catctgcattgcccag

SEQ ID NO: 6712385 - DNA, 18 bp, Homo sapiens
catctgcattgcccagtc

SEQ ID NO: 6712386 - DNA, 19 bp, Homo sapiens
catctgcattttcacccca

SEQ ID NO: 6712387 - DNA, 17 bp, Homo sapiens
catctgccaaaatgtag

SEQ ID NO: 6712388 - DNA, 14 bp, Homo sapiens
catctgccaatgcc

SEQ ID NO: 6712389 - DNA, 22 bp, Homo sapiens
catctgccaatgccatgactgc

SEQ ID NO: 6712390 - DNA, 14 bp, Homo sapiens
catctgccacaggc

SEQ ID NO: 6712391 - DNA, 17 bp, Homo sapiens
catctgccatttatttc

SEQ ID NO: 6712392 - DNA, 19 bp, Homo sapiens
catctgcccaactgtgtag

SEQ ID NO: 6712393 - DNA, 11 bp, Homo sapiens
catctgcccag

SEQ ID NO: 6712394 - DNA, 13 bp, Homo sapiens
catctgcccaggg

SEQ ID NO: 6712395 - DNA, 21 bp, Homo sapiens
catctgcccaggggtgccccc

SEQ ID NO: 6712396 - DNA, 16 bp, Homo sapiens
catctgccccaggtac

SEQ ID NO: 6712397 - DNA, 14 bp, Homo sapiens
catctgcccctccc

SEQ ID NO: 6712398 - DNA, 15 bp, Homo sapiens
catctgcccctcccc

SEQ ID NO: 6712399 - DNA, 14 bp, Homo sapiens
catctgcccgcctg

SEQ ID NO: 6712400 - DNA, 20 bp, Homo sapiens
catctgcccgcctgcccacc

SEQ ID NO: 6712401 - DNA, 11 bp, Homo sapiens
catctgccctc

SEQ ID NO: 6712402 - DNA, 19 bp, Homo sapiens
catctgccggcccccagga

SEQ ID NO: 6712403 - DNA, 21 bp, Homo sapiens
catctgccggcccccaggaca

SEQ ID NO: 6712404 - DNA, 20 bp, Homo sapiens
catctgccgtgcctggatcc

SEQ ID NO: 6712405 - DNA, 18 bp, Homo sapiens
catctgcctctggaaaac

SEQ ID NO: 6712406 - DNA, 15 bp, Homo sapiens
catctgcctgcagtg

SEQ ID NO: 6712407 - DNA, 11 bp, Homo sapiens
catctgcctgg

SEQ ID NO: 6712408 - DNA, 15 bp, Homo sapiens
catctgcctggagcc

SEQ ID NO: 6712409 - DNA, 18 bp, Homo sapiens
catctgcctggagcctgg

SEQ ID NO: 6712410 - DNA, 21 bp, Homo sapiens
catctgcctggagcctgggca

SEQ ID NO: 6712411 - DNA, 22 bp, Homo sapiens
catctgcctggagcctgggcag

SEQ ID NO: 6712412 - DNA, 15 bp, Homo sapiens
catctgcctgtaatt

SEQ ID NO: 6712413 - DNA, 16 bp, Homo sapiens
catctgcctgtaatta

SEQ ID NO: 6712414 - DNA, 20 bp, Homo sapiens
catctgcctgttctgaggat

SEQ ID NO: 6712415 - DNA, 20 bp, Homo sapiens
catctgccttaaaaccaaag

SEQ ID NO: 6712416 - DNA, 15 bp, Homo sapiens
catctgccttgctgc

SEQ ID NO: 6712417 - DNA, 16 bp, Homo sapiens
catctgccttgctgca

SEQ ID NO: 6712418 - DNA, 17 bp, Homo sapiens
catctgccttgctgcac

SEQ ID NO: 6712419 - DNA, 16 bp, Homo sapiens
catctgcggggcttct

SEQ ID NO: 6712420 - DNA, 20 bp, Homo sapiens
catctgcggggcttctgggt

SEQ ID NO: 6712421 - DNA, 17 bp, Homo sapiens
catctgcgggggcagtg

SEQ ID NO: 6712422 - DNA, 19 bp, Homo sapiens
catctgcgggggcagtgct

SEQ ID NO: 6712423 - DNA, 21 bp, Homo sapiens
catctgcgggggcagtgctca

SEQ ID NO: 6712424 - DNA, 18 bp, Homo sapiens
catctgcgtgacaataaa

SEQ ID NO: 6712425 - DNA, 22 bp, Homo sapiens
catctgcgtgacaataaaacat

SEQ ID NO: 6712426 - DNA, 17 bp, Homo sapiens
catctgctactgtgtca

SEQ ID NO: 6712427 - DNA, 18 bp, Homo sapiens
catctgctactgtgtcag

SEQ ID NO: 6712428 - DNA, 11 bp, Homo sapiens
catctgctcct

SEQ ID NO: 6712429 - DNA, 22 bp, Homo sapiens
catctgctcctagcccagcaga

SEQ ID NO: 6712430 - DNA, 17 bp, Homo sapiens
catctgctccttcctgt

SEQ ID NO: 6712431 - DNA, 13 bp, Homo sapiens
catctgctctaga

SEQ ID NO: 6712432 - DNA, 14 bp, Homo sapiens
catctgctctaggg

SEQ ID NO: 6712433 - DNA, 16 bp, Homo sapiens
catctgctctagggaa

SEQ ID NO: 6712434 - DNA, 22 bp, Homo sapiens
catctgctctagggaatctgga

SEQ ID NO: 6712435 - DNA, 16 bp, Homo sapiens
catctgctctgagacg

SEQ ID NO: 6712436 - DNA, 17 bp, Homo sapiens
catctgctcttctctta

SEQ ID NO: 6712437 - DNA, 20 bp, Homo sapiens
catctgctgcacatagcaga

SEQ ID NO: 6712438 - DNA, 20 bp, Homo sapiens
catctgctgctgaaactgtg

SEQ ID NO: 6712439 - DNA, 14 bp, Homo sapiens
catctgctggtccg

SEQ ID NO: 6712440 - DNA, 21 bp, Homo sapiens
catctgctgtcttttctttgc

SEQ ID NO: 6712441 - DNA, 11 bp, Homo sapiens
catctgctgtg

SEQ ID NO: 6712442 - DNA, 13 bp, Homo sapiens
catctgctgtgtg

SEQ ID NO: 6712443 - DNA, 22 bp, Homo sapiens
catctgcttggttggctggcag

SEQ ID NO: 6712444 - DNA, 16 bp, Homo sapiens
catctgctttattgcc

SEQ ID NO: 6712445 - DNA, 17 bp, Homo sapiens
catctggaaaataaaag

SEQ ID NO: 6712446 - DNA, 19 bp, Homo sapiens
catctggaaagttttctcc

SEQ ID NO: 6712447 - DNA, 18 bp, Homo sapiens
catctggaaatccagctg

SEQ ID NO: 6712448 - DNA, 12 bp, Homo sapiens
catctggaacca

SEQ ID NO: 6712449 - DNA, 22 bp, Homo sapiens
catctggaatctgaggcatcct

SEQ ID NO: 6712450 - DNA, 12 bp, Homo sapiens
catctggagtcc

SEQ ID NO: 6712451 - DNA, 19 bp, Homo sapiens
catctggagtccctcctcc

SEQ ID NO: 6712452 - DNA, 17 bp, Homo sapiens
catctggagtcttcctg

SEQ ID NO: 6712453 - DNA, 16 bp, Homo sapiens
catctggagttctcaa

SEQ ID NO: 6712454 - DNA, 20 bp, Homo sapiens
catctggataggagcctgct

SEQ ID NO: 6712455 - DNA, 15 bp, Homo sapiens
catctggatatcaag

SEQ ID NO: 6712456 - DNA, 16 bp, Homo sapiens
catctggatgtaaatc

SEQ ID NO: 6712457 - DNA, 14 bp, Homo sapiens
catctggcacgtgg

SEQ ID NO: 6712458 - DNA, 20 bp, Homo sapiens
catctggcccaagtgaagca

SEQ ID NO: 6712459 - DNA, 15 bp, Homo sapiens
catctggcccaggct

SEQ ID NO: 6712460 - DNA, 16 bp, Homo sapiens
catctggccctgctgc

SEQ ID NO: 6712461 - DNA, 21 bp, Homo sapiens
catctggccctgctgccccct

SEQ ID NO: 6712462 - DNA, 16 bp, Homo sapiens
catctggcctatgacc

SEQ ID NO: 6712463 - DNA, 19 bp, Homo sapiens
catctggcctatgaccctg

SEQ ID NO: 6712464 - DNA, 17 bp, Homo sapiens
catctggcctggcctgg

SEQ ID NO: 6712465 - DNA, 20 bp, Homo sapiens
catctggcctggcctggccc

SEQ ID NO: 6712466 - DNA, 21 bp, Homo sapiens
catctggcctggcctggccct

SEQ ID NO: 6712467 - DNA, 20 bp, Homo sapiens
catctggccttacacctcgt

SEQ ID NO: 6712468 - DNA, 19 bp, Homo sapiens
catctggctgcacaggctg

SEQ ID NO: 6712469 - DNA, 20 bp, Homo sapiens
catctggctgtctagaatgt

SEQ ID NO: 6712470 - DNA, 22 bp, Homo sapiens
catctggcttattttaatgtga

SEQ ID NO: 6712471 - DNA, 23 bp, Homo sapiens
catctggcttattttaatgtgat

SEQ ID NO: 6712472 - DNA, 21 bp, Homo sapiens
catctggctttttctgccact

SEQ ID NO: 6712473 - DNA, 14 bp, Homo sapiens
catctgggaggctg

SEQ ID NO: 6712474 - DNA, 19 bp, Homo sapiens
catctgggagtcccctttt

SEQ ID NO: 6712475 - DNA, 15 bp, Homo sapiens
catctgggattccca

SEQ ID NO: 6712476 - DNA, 23 bp, Homo sapiens
catctgggccttggcctggagca

SEQ ID NO: 6712477 - DNA, 13 bp, Homo sapiens
catctgggctcct

SEQ ID NO: 6712478 - DNA, 13 bp, Homo sapiens
catctgggctggc

SEQ ID NO: 6712479 - DNA, 16 bp, Homo sapiens
catctgggctggcaga

SEQ ID NO: 6712480 - DNA, 17 bp, Homo sapiens
catctgggctggcagag

SEQ ID NO: 6712481 - DNA, 19 bp, Homo sapiens
catctgggctggcagaggg

SEQ ID NO: 6712482 - DNA, 11 bp, Homo sapiens
catctggggat

SEQ ID NO: 6712483 - DNA, 21 bp, Homo sapiens
catctggggcccatactggtt

SEQ ID NO: 6712484 - DNA, 15 bp, Homo sapiens
catctgggggagtgg

SEQ ID NO: 6712485 - DNA, 17 bp, Homo sapiens
catctgggggagtggaa

SEQ ID NO: 6712486 - DNA, 18 bp, Homo sapiens
catctgggggagtggaat

SEQ ID NO: 6712487 - DNA, 20 bp, Homo sapiens
catctgggtagctgtaaggc

SEQ ID NO: 6712488 - DNA, 15 bp, Homo sapiens
catctgggtgccctg

SEQ ID NO: 6712489 - DNA, 16 bp, Homo sapiens
catctgggtgccctga

SEQ ID NO: 6712490 - DNA, 15 bp, Homo sapiens
catctgggtggtctg

SEQ ID NO: 6712491 - DNA, 23 bp, Homo sapiens
catctggtagaagggaaagccca

SEQ ID NO: 6712492 - DNA, 15 bp, Homo sapiens
catctggtcttgttt

SEQ ID NO: 6712493 - DNA, 23 bp, Homo sapiens
catctggtgtaggaagttttttc

SEQ ID NO: 6712494 - DNA, 22 bp, Homo sapiens
catctggttgaatggcttttct

SEQ ID NO: 6712495 - DNA, 18 bp, Homo sapiens
catctgtaaaaccaggct

SEQ ID NO: 6712496 - DNA, 16 bp, Homo sapiens
catctgtaaaatggag

SEQ ID NO: 6712497 - DNA, 14 bp, Homo sapiens
catctgtaaagaaa

SEQ ID NO: 6712498 - DNA, 16 bp, Homo sapiens
catctgtaaagaaaac

SEQ ID NO: 6712499 - DNA, 22 bp, Homo sapiens
catctgtaaatatcccagagaa

SEQ ID NO: 6712500 - DNA, 22 bp, Homo sapiens
catctgtaaatctacacacggt

SEQ ID NO: 6712501 - DNA, 19 bp, Homo sapiens
catctgtaactctaaaaga

SEQ ID NO: 6712502 - DNA, 17 bp, Homo sapiens
catctgtagtcagccga

SEQ ID NO: 6712503 - DNA, 20 bp, Homo sapiens
catctgtataccctctgttt

SEQ ID NO: 6712504 - DNA, 18 bp, Homo sapiens
catctgtatatcagctct

SEQ ID NO: 6712505 - DNA, 14 bp, Homo sapiens
catctgtcaacagg

SEQ ID NO: 6712506 - DNA, 20 bp, Homo sapiens
catctgtcaccaattggtta

SEQ ID NO: 6712507 - DNA, 12 bp, Homo sapiens
catctgtcactt

SEQ ID NO: 6712508 - DNA, 11 bp, Homo sapiens
catctgtcagc

SEQ ID NO: 6712509 - DNA, 13 bp, Homo sapiens
catctgtcagctt

SEQ ID NO: 6712510 - DNA, 19 bp, Homo sapiens
catctgtcagcttcccaac

SEQ ID NO: 6712511 - DNA, 19 bp, Homo sapiens
catctgtcattatattcta

SEQ ID NO: 6712512 - DNA, 21 bp, Homo sapiens
catctgtccacatccccagag

SEQ ID NO: 6712513 - DNA, 12 bp, Homo sapiens
catctgtccatc

SEQ ID NO: 6712514 - DNA, 19 bp, Homo sapiens
catctgtccatcctcctct

SEQ ID NO: 6712515 - DNA, 22 bp, Homo sapiens
catctgtccatggcctttctaa

SEQ ID NO: 6712516 - DNA, 17 bp, Homo sapiens
catctgtcccactggga

SEQ ID NO: 6712517 - DNA, 12 bp, Homo sapiens
catctgtccccc

SEQ ID NO: 6712518 - DNA, 20 bp, Homo sapiens
catctgtccctccgggacct

SEQ ID NO: 6712519 - DNA, 17 bp, Homo sapiens
catctgtccctgcctca

SEQ ID NO: 6712520 - DNA, 17 bp, Homo sapiens
catctgtccgtccagag

SEQ ID NO: 6712521 - DNA, 13 bp, Homo sapiens
catctgtcctcac

SEQ ID NO: 6712522 - DNA, 22 bp, Homo sapiens
catctgtcctcaccctgtggga

SEQ ID NO: 6712523 - DNA, 16 bp, Homo sapiens
catctgtcctgacaga

SEQ ID NO: 6712524 - DNA, 14 bp, Homo sapiens
catctgtctaaaga

SEQ ID NO: 6712525 - DNA, 16 bp, Homo sapiens
catctgtctcaacctg

SEQ ID NO: 6712526 - DNA, 23 bp, Homo sapiens
catctgtctccctccccaaatgg

SEQ ID NO: 6712527 - DNA, 21 bp, Homo sapiens
catctgtctcggctctgcatg

SEQ ID NO: 6712528 - DNA, 22 bp, Homo sapiens
catctgtctcggctctgcatgt

SEQ ID NO: 6712529 - DNA, 14 bp, Homo sapiens
catctgtctgctct

SEQ ID NO: 6712530 - DNA, 17 bp, Homo sapiens
catctgtctgctctgca

SEQ ID NO: 6712531 - DNA, 21 bp, Homo sapiens
catctgtctgtctgtgggctt

SEQ ID NO: 6712532 - DNA, 23 bp, Homo sapiens
catctgtcttcagcacattccac

SEQ ID NO: 6712533 - DNA, 19 bp, Homo sapiens
catctgtgaatctgcttta

SEQ ID NO: 6712534 - DNA, 23 bp, Homo sapiens
catctgtgaatctgctttaatta

SEQ ID NO: 6712535 - DNA, 16 bp, Homo sapiens
catctgtgactataaa

SEQ ID NO: 6712536 - DNA, 22 bp, Homo sapiens
catctgtgactataaagctgtt

SEQ ID NO: 6712537 - DNA, 23 bp, Homo sapiens
catctgtgactataaagctgtta

SEQ ID NO: 6712538 - DNA, 23 bp, Homo sapiens
catctgtgaggtgataggcaagg

SEQ ID NO: 6712539 - DNA, 17 bp, Homo sapiens
catctgtgcactgccca

SEQ ID NO: 6712540 - DNA, 18 bp, Homo sapiens
catctgtgcactgcccat

SEQ ID NO: 6712541 - DNA, 13 bp, Homo sapiens
catctgtgcaggg

SEQ ID NO: 6712542 - DNA, 11 bp, Homo sapiens
catctgtgcat

SEQ ID NO: 6712543 - DNA, 20 bp, Homo sapiens
catctgtgcctgtctgtcca

SEQ ID NO: 6712544 - DNA, 19 bp, Homo sapiens
catctgtggaaatgacagc

SEQ ID NO: 6712545 - DNA, 14 bp, Homo sapiens
catctgtggagctg

SEQ ID NO: 6712546 - DNA, 13 bp, Homo sapiens
catctgtgtattt

SEQ ID NO: 6712547 - DNA, 14 bp, Homo sapiens
catctgtgtctctg

SEQ ID NO: 6712548 - DNA, 15 bp, Homo sapiens
catctgtgtctgtgt

SEQ ID NO: 6712549 - DNA, 13 bp, Homo sapiens
catctgtgtcttg

SEQ ID NO: 6712550 - DNA, 14 bp, Homo sapiens
catctgtgtcttgt

SEQ ID NO: 6712551 - DNA, 23 bp, Homo sapiens
catctgtgtgcgtggtgtggccc

SEQ ID NO: 6712552 - DNA, 21 bp, Homo sapiens
catctgtgtgtgaattccttt

SEQ ID NO: 6712553 - DNA, 21 bp, Homo sapiens
catctgtgtgtgtccccctat

SEQ ID NO: 6712554 - DNA, 19 bp, Homo sapiens
catctgtgtttcaagtggg

SEQ ID NO: 6712555 - DNA, 22 bp, Homo sapiens
catctgttaaatgagagaatag

SEQ ID NO: 6712556 - DNA, 19 bp, Homo sapiens
catctgttagcagagtctg

SEQ ID NO: 6712557 - DNA, 16 bp, Homo sapiens
catctgttagggcctt

SEQ ID NO: 6712558 - DNA, 19 bp, Homo sapiens
catctgttctatgcttcct

SEQ ID NO: 6712559 - DNA, 16 bp, Homo sapiens
catctgttgttctgtg

SEQ ID NO: 6712560 - DNA, 12 bp, Homo sapiens
catctgttgttt

SEQ ID NO: 6712561 - DNA, 23 bp, Homo sapiens
catctgtttacctggcagtggct

SEQ ID NO: 6712562 - DNA, 15 bp, Homo sapiens
catctgtttgataca

SEQ ID NO: 6712563 - DNA, 14 bp, Homo sapiens
catctgtttgtaat

SEQ ID NO: 6712564 - DNA, 16 bp, Homo sapiens
catctgtttgtaatca

SEQ ID NO: 6712565 - DNA, 15 bp, Homo sapiens
catcttaaaaacaac

SEQ ID NO: 6712566 - DNA, 15 bp, Homo sapiens
catcttaaatgacag

SEQ ID NO: 6712567 - DNA, 15 bp, Homo sapiens
catcttaactctttg

SEQ ID NO: 6712568 - DNA, 12 bp, Homo sapiens
catcttaatctt

SEQ ID NO: 6712569 - DNA, 16 bp, Homo sapiens
catcttaatctttatt

SEQ ID NO: 6712570 - DNA, 15 bp, Homo sapiens
catcttaatgttact

SEQ ID NO: 6712571 - DNA, 14 bp, Homo sapiens
catcttactgaagg

SEQ ID NO: 6712572 - DNA, 15 bp, Homo sapiens
catcttacttgtcct

SEQ ID NO: 6712573 - DNA, 17 bp, Homo sapiens
catcttacttgtccttt

SEQ ID NO: 6712574 - DNA, 17 bp, Homo sapiens
catcttagactttgcaa

SEQ ID NO: 6712575 - DNA, 23 bp, Homo sapiens
catcttagagcaaagagccagca

SEQ ID NO: 6712576 - DNA, 14 bp, Homo sapiens
catcttagcaagca

SEQ ID NO: 6712577 - DNA, 18 bp, Homo sapiens
catcttaggggattatct

SEQ ID NO: 6712578 - DNA, 23 bp, Homo sapiens
catcttatagatgcaaagtattt

SEQ ID NO: 6712579 - DNA, 15 bp, Homo sapiens
catcttatagcactt

SEQ ID NO: 6712580 - DNA, 18 bp, Homo sapiens
catcttatcaaggactct

SEQ ID NO: 6712581 - DNA, 20 bp, Homo sapiens
catcttatgctaactgtaga

SEQ ID NO: 6712582 - DNA, 15 bp, Homo sapiens
catcttattcagcac

SEQ ID NO: 6712583 - DNA, 19 bp, Homo sapiens
catcttattcccaattaaa

SEQ ID NO: 6712584 - DNA, 20 bp, Homo sapiens
catcttattttcatgtatat

SEQ ID NO: 6712585 - DNA, 13 bp, Homo sapiens
catcttcaatatg

SEQ ID NO: 6712586 - DNA, 16 bp, Homo sapiens
catcttcaatatgaat

SEQ ID NO: 6712587 - DNA, 12 bp, Homo sapiens
catcttcactct

SEQ ID NO: 6712588 - DNA, 18 bp, Homo sapiens
catcttcactcttcactt

SEQ ID NO: 6712589 - DNA, 16 bp, Homo sapiens
catcttcactgcaatt

SEQ ID NO: 6712590 - DNA, 21 bp, Homo sapiens
catcttcacttctaaatgcat

SEQ ID NO: 6712591 - DNA, 13 bp, Homo sapiens
catcttcagctcc

SEQ ID NO: 6712592 - DNA, 13 bp, Homo sapiens
catcttcagcttc

SEQ ID NO: 6712593 - DNA, 11 bp, Homo sapiens
catcttcagga

SEQ ID NO: 6712594 - DNA, 23 bp, Homo sapiens
catcttcagttgtctctgatgca

SEQ ID NO: 6712595 - DNA, 15 bp, Homo sapiens
catcttcagtttctg

SEQ ID NO: 6712596 - DNA, 15 bp, Homo sapiens
catcttcataatttg

SEQ ID NO: 6712597 - DNA, 11 bp, Homo sapiens
catcttcatat

SEQ ID NO: 6712598 - DNA, 13 bp, Homo sapiens
catcttcatccca

SEQ ID NO: 6712599 - DNA, 12 bp, Homo sapiens
catcttcattaa

SEQ ID NO: 6712600 - DNA, 13 bp, Homo sapiens
catcttcattaat

SEQ ID NO: 6712601 - DNA, 21 bp, Homo sapiens
catcttccacaggtctcagaa

SEQ ID NO: 6712602 - DNA, 12 bp, Homo sapiens
catcttccagaa

SEQ ID NO: 6712603 - DNA, 13 bp, Homo sapiens
catcttccagaag

SEQ ID NO: 6712604 - DNA, 18 bp, Homo sapiens
catcttccagaagtgtga

SEQ ID NO: 6712605 - DNA, 13 bp, Homo sapiens
catcttccagcca

SEQ ID NO: 6712606 - DNA, 21 bp, Homo sapiens
catcttccaggtggggtgagg

SEQ ID NO: 6712607 - DNA, 13 bp, Homo sapiens
catcttccatatc

SEQ ID NO: 6712608 - DNA, 23 bp, Homo sapiens
catcttccatatccgggtgctca

SEQ ID NO: 6712609 - DNA, 10 bp, Homo sapiens
catcttccca

SEQ ID NO: 6712610 - DNA, 16 bp, Homo sapiens
catcttccctgcccct

SEQ ID NO: 6712611 - DNA, 17 bp, Homo sapiens
catcttccctgcccctg

SEQ ID NO: 6712612 - DNA, 16 bp, Homo sapiens
catcttcctgctgctg

SEQ ID NO: 6712613 - DNA, 17 bp, Homo sapiens
catcttcctgctgctgt

SEQ ID NO: 6712614 - DNA, 18 bp, Homo sapiens
catcttcgggaccaggat

SEQ ID NO: 6712615 - DNA, 23 bp, Homo sapiens
catcttcgtcttcactcttaggc

SEQ ID NO: 6712616 - DNA, 19 bp, Homo sapiens
catcttctatcttctttcc

SEQ ID NO: 6712617 - DNA, 16 bp, Homo sapiens
catcttctcactccct

SEQ ID NO: 6712618 - DNA, 12 bp, Homo sapiens
catcttctcagc

SEQ ID NO: 6712619 - DNA, 13 bp, Homo sapiens
catcttctcagtg

SEQ ID NO: 6712620 - DNA, 18 bp, Homo sapiens
catcttctcattcccatg

SEQ ID NO: 6712621 - DNA, 19 bp, Homo sapiens
catcttctccccacagcct

SEQ ID NO: 6712622 - DNA, 12 bp, Homo sapiens
catcttctcttt

SEQ ID NO: 6712623 - DNA, 15 bp, Homo sapiens
catcttctctttttc

SEQ ID NO: 6712624 - DNA, 17 bp, Homo sapiens
catcttctgccttagtc

SEQ ID NO: 6712625 - DNA, 13 bp, Homo sapiens
catcttctggagt

SEQ ID NO: 6712626 - DNA, 22 bp, Homo sapiens
catcttctggagtctccagtgg

SEQ ID NO: 6712627 - DNA, 13 bp, Homo sapiens
catcttctggctt

SEQ ID NO: 6712628 - DNA, 17 bp, Homo sapiens
catcttctggcttgact

SEQ ID NO: 6712629 - DNA, 16 bp, Homo sapiens
catcttctgtgaaata

SEQ ID NO: 6712630 - DNA, 20 bp, Homo sapiens
catcttctgttgctctctgt

SEQ ID NO: 6712631 - DNA, 19 bp, Homo sapiens
catcttcttcaccatttgg

SEQ ID NO: 6712632 - DNA, 13 bp, Homo sapiens
catcttcttccca

SEQ ID NO: 6712633 - DNA, 14 bp, Homo sapiens
catcttcttcccag

SEQ ID NO: 6712634 - DNA, 22 bp, Homo sapiens
catcttcttcccttaactccaa

SEQ ID NO: 6712635 - DNA, 22 bp, Homo sapiens
catcttgaaaatattgaagaat

SEQ ID NO: 6712636 - DNA, 20 bp, Homo sapiens
catcttgaagggcccaggag

SEQ ID NO: 6712637 - DNA, 15 bp, Homo sapiens
catcttgaagtcatt

SEQ ID NO: 6712638 - DNA, 20 bp, Homo sapiens
catcttgaagttacacataa

SEQ ID NO: 6712639 - DNA, 17 bp, Homo sapiens
catcttgaatccttcca

SEQ ID NO: 6712640 - DNA, 16 bp, Homo sapiens
catcttgaattgtaag

SEQ ID NO: 6712641 - DNA, 13 bp, Homo sapiens
catcttgacatgt

SEQ ID NO: 6712642 - DNA, 18 bp, Homo sapiens
catcttgaccaagcagga

SEQ ID NO: 6712643 - DNA, 23 bp, Homo sapiens
catcttgaccaagcaggaagctc

SEQ ID NO: 6712644 - DNA, 18 bp, Homo sapiens
catcttgagcctgagcct

SEQ ID NO: 6712645 - DNA, 24 bp, Homo sapiens
catcttgcaagcaaatcccatttc

SEQ ID NO: 6712646 - DNA, 15 bp, Homo sapiens
catcttgcacacact

SEQ ID NO: 6712647 - DNA, 17 bp, Homo sapiens
catcttgcacacacttt

SEQ ID NO: 6712648 - DNA, 14 bp, Homo sapiens
catcttgcagcatt

SEQ ID NO: 6712649 - DNA, 15 bp, Homo sapiens
catcttgcagcattt

SEQ ID NO: 6712650 - DNA, 17 bp, Homo sapiens
catcttgcattatgcaa

SEQ ID NO: 6712651 - DNA, 19 bp, Homo sapiens
catcttgccaagggtccct

SEQ ID NO: 6712652 - DNA, 12 bp, Homo sapiens
catcttgcctca

SEQ ID NO: 6712653 - DNA, 20 bp, Homo sapiens
catcttgcctccatggtgcc

SEQ ID NO: 6712654 - DNA, 19 bp, Homo sapiens
catcttgctaataaacact

SEQ ID NO: 6712655 - DNA, 14 bp, Homo sapiens
catcttgctaccag

SEQ ID NO: 6712656 - DNA, 20 bp, Homo sapiens
catcttgctaccagtattta

SEQ ID NO: 6712657 - DNA, 13 bp, Homo sapiens
catcttgctctgc

SEQ ID NO: 6712658 - DNA, 14 bp, Homo sapiens
catcttgctctgct

SEQ ID NO: 6712659 - DNA, 13 bp, Homo sapiens
catcttgctctgt

SEQ ID NO: 6712660 - DNA, 14 bp, Homo sapiens
catcttgctggcta

SEQ ID NO: 6712661 - DNA, 13 bp, Homo sapiens
catcttgcttcca

SEQ ID NO: 6712662 - DNA, 16 bp, Homo sapiens
catcttggaactgcat

SEQ ID NO: 6712663 - DNA, 16 bp, Homo sapiens
catcttggagggacca

SEQ ID NO: 6712664 - DNA, 19 bp, Homo sapiens
catcttggccctcctcagc

SEQ ID NO: 6712665 - DNA, 21 bp, Homo sapiens
catcttggccctcctcagctc

SEQ ID NO: 6712666 - DNA, 15 bp, Homo sapiens
catcttggggacatc

SEQ ID NO: 6712667 - DNA, 20 bp, Homo sapiens
catcttgggggtcacccatg

SEQ ID NO: 6712668 - DNA, 21 bp, Homo sapiens
catcttgggggtcacccatgg

SEQ ID NO: 6712669 - DNA, 24 bp, Homo sapiens
catcttgggggtcacccatggcct

SEQ ID NO: 6712670 - DNA, 13 bp, Homo sapiens
catcttggtaaat

SEQ ID NO: 6712671 - DNA, 19 bp, Homo sapiens
catcttggtagttctgtgc

SEQ ID NO: 6712672 - DNA, 21 bp, Homo sapiens
catcttggtcctgtcaccctg

SEQ ID NO: 6712673 - DNA, 23 bp, Homo sapiens
catcttggtcctgtcaccctggc

SEQ ID NO: 6712674 - DNA, 23 bp, Homo sapiens
catcttgtaatttccagctttct

SEQ ID NO: 6712675 - DNA, 14 bp, Homo sapiens
catcttgtcttttc

SEQ ID NO: 6712676 - DNA, 13 bp, Homo sapiens
catcttgtggggc

SEQ ID NO: 6712677 - DNA, 13 bp, Homo sapiens
catcttgtttctg

SEQ ID NO: 6712678 - DNA, 15 bp, Homo sapiens
catcttgtttctgag

SEQ ID NO: 6712679 - DNA, 12 bp, Homo sapiens
catctttaacat

SEQ ID NO: 6712680 - DNA, 21 bp, Homo sapiens
catctttaatcaatgtgacat

SEQ ID NO: 6712681 - DNA, 16 bp, Homo sapiens
catctttaattcctta

SEQ ID NO: 6712682 - DNA, 15 bp, Homo sapiens
catctttacgtactg

SEQ ID NO: 6712683 - DNA, 20 bp, Homo sapiens
catctttacgtactgtaact

SEQ ID NO: 6712684 - DNA, 12 bp, Homo sapiens
catctttagaaa

SEQ ID NO: 6712685 - DNA, 16 bp, Homo sapiens
catctttatctgttct

SEQ ID NO: 6712686 - DNA, 17 bp, Homo sapiens
catctttattgaaattc

SEQ ID NO: 6712687 - DNA, 14 bp, Homo sapiens
catctttcacactt

SEQ ID NO: 6712688 - DNA, 13 bp, Homo sapiens
catctttcacatt

SEQ ID NO: 6712689 - DNA, 21 bp, Homo sapiens
catctttcatcaatcattgta

SEQ ID NO: 6712690 - DNA, 18 bp, Homo sapiens
catctttcatttcgtatt

SEQ ID NO: 6712691 - DNA, 12 bp, Homo sapiens
catctttccaaa

SEQ ID NO: 6712692 - DNA, 13 bp, Homo sapiens
catctttccctcc

SEQ ID NO: 6712693 - DNA, 14 bp, Homo sapiens
catctttccctcct

SEQ ID NO: 6712694 - DNA, 15 bp, Homo sapiens
catctttccctcctt

SEQ ID NO: 6712695 - DNA, 16 bp, Homo sapiens
catctttccctccttg

SEQ ID NO: 6712696 - DNA, 18 bp, Homo sapiens
catctttccctccttggt

SEQ ID NO: 6712697 - DNA, 20 bp, Homo sapiens
catctttcctccaaactcct

SEQ ID NO: 6712698 - DNA, 13 bp, Homo sapiens
catctttcctgtc

SEQ ID NO: 6712699 - DNA, 15 bp, Homo sapiens
catctttcctttgct

SEQ ID NO: 6712700 - DNA, 17 bp, Homo sapiens
catctttcctttgctct

SEQ ID NO: 6712701 - DNA, 18 bp, Homo sapiens
catctttgatccttctga

SEQ ID NO: 6712702 - DNA, 12 bp, Homo sapiens
catctttgatgt

SEQ ID NO: 6712703 - DNA, 16 bp, Homo sapiens
catctttgatgtgttg

SEQ ID NO: 6712704 - DNA, 17 bp, Homo sapiens
catctttgccaagtaag

SEQ ID NO: 6712705 - DNA, 15 bp, Homo sapiens
catctttgccatatg

SEQ ID NO: 6712706 - DNA, 17 bp, Homo sapiens
catctttgcccttctgg

SEQ ID NO: 6712707 - DNA, 22 bp, Homo sapiens
catctttgccttgggctgctcc

SEQ ID NO: 6712708 - DNA, 23 bp, Homo sapiens
catctttgctgaatgtcattatt

SEQ ID NO: 6712709 - DNA, 14 bp, Homo sapiens
catctttgtcaaac

SEQ ID NO: 6712710 - DNA, 22 bp, Homo sapiens
catctttgttggctcagaaaat

SEQ ID NO: 6712711 - DNA, 19 bp, Homo sapiens
catctttgtttttaaaata

SEQ ID NO: 6712712 - DNA, 13 bp, Homo sapiens
catcttttaaaga

SEQ ID NO: 6712713 - DNA, 16 bp, Homo sapiens
catcttttaagacaaa

SEQ ID NO: 6712714 - DNA, 12 bp, Homo sapiens
catcttttaatc

SEQ ID NO: 6712715 - DNA, 19 bp, Homo sapiens
catcttttaatcatgagcc

SEQ ID NO: 6712716 - DNA, 19 bp, Homo sapiens
catcttttaattcacctct

SEQ ID NO: 6712717 - DNA, 21 bp, Homo sapiens
catcttttatagacgctcttt

SEQ ID NO: 6712718 - DNA, 15 bp, Homo sapiens
catcttttattcttt

SEQ ID NO: 6712719 - DNA, 17 bp, Homo sapiens
catcttttattcttttt

SEQ ID NO: 6712720 - DNA, 18 bp, Homo sapiens
catcttttattttggaac

SEQ ID NO: 6712721 - DNA, 18 bp, Homo sapiens
catcttttccatcctgag

SEQ ID NO: 6712722 - DNA, 21 bp, Homo sapiens
catcttttctaatcacagtgt

SEQ ID NO: 6712723 - DNA, 22 bp, Homo sapiens
catcttttctaatcacagtgtt

SEQ ID NO: 6712724 - DNA, 21 bp, Homo sapiens
catcttttcttgcctctgtcc

SEQ ID NO: 6712725 - DNA, 15 bp, Homo sapiens
catcttttgggaagc

SEQ ID NO: 6712726 - DNA, 14 bp, Homo sapiens
catcttttgtatta

SEQ ID NO: 6712727 - DNA, 18 bp, Homo sapiens
catcttttgtattaagaa

SEQ ID NO: 6712728 - DNA, 16 bp, Homo sapiens
catcttttgtgagatg

SEQ ID NO: 6712729 - DNA, 21 bp, Homo sapiens
catcttttgttactcttggga

SEQ ID NO: 6712730 - DNA, 23 bp, Homo sapiens
catcttttgttactcttgggaca

SEQ ID NO: 6712731 - DNA, 16 bp, Homo sapiens
catctttttaaagctt

SEQ ID NO: 6712732 - DNA, 13 bp, Homo sapiens
catctttttcccc

SEQ ID NO: 6712733 - DNA, 20 bp, Homo sapiens
catctttttcccctatcctg

SEQ ID NO: 6712734 - DNA, 13 bp, Homo sapiens
catctttttcttg

SEQ ID NO: 6712735 - DNA, 22 bp, Homo sapiens
catctttttctttttaacccta

SEQ ID NO: 6712736 - DNA, 22 bp, Homo sapiens
catgaaaaacacggcagctgta

SEQ ID NO: 6712737 - DNA, 16 bp, Homo sapiens
catgaaaaacagcaga

SEQ ID NO: 6712738 - DNA, 17 bp, Homo sapiens
catgaaaaaccattttt

SEQ ID NO: 6712739 - DNA, 12 bp, Homo sapiens
catgaaaaagca

SEQ ID NO: 6712740 - DNA, 15 bp, Homo sapiens
catgaaaaagctgct

SEQ ID NO: 6712741 - DNA, 15 bp, Homo sapiens
catgaaaacacattt

SEQ ID NO: 6712742 - DNA, 21 bp, Homo sapiens
catgaaaacacatttttctta

SEQ ID NO: 6712743 - DNA, 13 bp, Homo sapiens
catgaaaacattg

SEQ ID NO: 6712744 - DNA, 22 bp, Homo sapiens
catgaaaaccattacctgactt

SEQ ID NO: 6712745 - DNA, 22 bp, Homo sapiens
catgaaaacgttttattgtgtt

SEQ ID NO: 6712746 - DNA, 20 bp, Homo sapiens
catgaaaactattttaaagc

SEQ ID NO: 6712747 - DNA, 14 bp, Homo sapiens
catgaaaacttttt

SEQ ID NO: 6712748 - DNA, 14 bp, Homo sapiens
catgaaaagtgcat

SEQ ID NO: 6712749 - DNA, 22 bp, Homo sapiens
catgaaaagttatttatgctat

SEQ ID NO: 6712750 - DNA, 24 bp, Homo sapiens
catgaaaataccatttagtaagaa

SEQ ID NO: 6712751 - DNA, 18 bp, Homo sapiens
catgaaaatagctatttt

SEQ ID NO: 6712752 - DNA, 13 bp, Homo sapiens
catgaaaatgcaa

SEQ ID NO: 6712753 - DNA, 15 bp, Homo sapiens
catgaaaatgtgtgt

SEQ ID NO: 6712754 - DNA, 17 bp, Homo sapiens
catgaaaatgtgtgttt

SEQ ID NO: 6712755 - DNA, 19 bp, Homo sapiens
catgaaaattatctccctt

SEQ ID NO: 6712756 - DNA, 14 bp, Homo sapiens
catgaaaatttgtt

SEQ ID NO: 6712757 - DNA, 16 bp, Homo sapiens
catgaaacagcagctg

SEQ ID NO: 6712758 - DNA, 17 bp, Homo sapiens
catgaaacagcagctga

SEQ ID NO: 6712759 - DNA, 13 bp, Homo sapiens
catgaaacattat

SEQ ID NO: 6712760 - DNA, 23 bp, Homo sapiens
catgaaacggaggcagatggaga

SEQ ID NO: 6712761 - DNA, 21 bp, Homo sapiens
catgaaactaggcttctgtaa

SEQ ID NO: 6712762 - DNA, 23 bp, Homo sapiens
catgaaagaacccaagacatcat

SEQ ID NO: 6712763 - DNA, 14 bp, Homo sapiens
catgaaagattcaa

SEQ ID NO: 6712764 - DNA, 23 bp, Homo sapiens
catgaaagccctggaattttagg

SEQ ID NO: 6712765 - DNA, 13 bp, Homo sapiens
catgaaaggcatc

SEQ ID NO: 6712766 - DNA, 19 bp, Homo sapiens
catgaaaggtaatctgaaa

SEQ ID NO: 6712767 - DNA, 15 bp, Homo sapiens
catgaaagtcttact

SEQ ID NO: 6712768 - DNA, 20 bp, Homo sapiens
catgaaataaagaatttaaa

SEQ ID NO: 6712769 - DNA, 19 bp, Homo sapiens
catgaaatgaacacaaatt

SEQ ID NO: 6712770 - DNA, 16 bp, Homo sapiens
catgaaatgtgaattt

SEQ ID NO: 6712771 - DNA, 17 bp, Homo sapiens
catgaaatgtggaagtc

SEQ ID NO: 6712772 - DNA, 13 bp, Homo sapiens
catgaaatgtgtt

SEQ ID NO: 6712773 - DNA, 14 bp, Homo sapiens
catgaaattactta

SEQ ID NO: 6712774 - DNA, 12 bp, Homo sapiens
catgaaattttg

SEQ ID NO: 6712775 - DNA, 14 bp, Homo sapiens
catgaaatttttaa

SEQ ID NO: 6712776 - DNA, 18 bp, Homo sapiens
catgaaatttttgtaaat

SEQ ID NO: 6712777 - DNA, 17 bp, Homo sapiens
catgaacaaaatgaagt

SEQ ID NO: 6712778 - DNA, 14 bp, Homo sapiens
catgaacaaattct

SEQ ID NO: 6712779 - DNA, 15 bp, Homo sapiens
catgaacaaattctt

SEQ ID NO: 6712780 - DNA, 19 bp, Homo sapiens
catgaacaagttagtttct

SEQ ID NO: 6712781 - DNA, 23 bp, Homo sapiens
catgaacacaaatgtgtattttt

SEQ ID NO: 6712782 - DNA, 20 bp, Homo sapiens
catgaacacactgtgtcctg

SEQ ID NO: 6712783 - DNA, 15 bp, Homo sapiens
catgaacactggctg

SEQ ID NO: 6712784 - DNA, 20 bp, Homo sapiens
catgaacactggctgcaagt

SEQ ID NO: 6712785 - DNA, 13 bp, Homo sapiens
catgaacagctct

SEQ ID NO: 6712786 - DNA, 20 bp, Homo sapiens
catgaacagctctgagatcc

SEQ ID NO: 6712787 - DNA, 23 bp, Homo sapiens
catgaaccaaatggttcttactt

SEQ ID NO: 6712788 - DNA, 19 bp, Homo sapiens
catgaaccatccttcccat

SEQ ID NO: 6712789 - DNA, 15 bp, Homo sapiens
catgaaccctcttgc

SEQ ID NO: 6712790 - DNA, 22 bp, Homo sapiens
catgaaccctcttgccatcctg

SEQ ID NO: 6712791 - DNA, 15 bp, Homo sapiens
catgaaccctgccct

SEQ ID NO: 6712792 - DNA, 16 bp, Homo sapiens
catgaaccctgccctg

SEQ ID NO: 6712793 - DNA, 17 bp, Homo sapiens
catgaacgccaaggaat

SEQ ID NO: 6712794 - DNA, 16 bp, Homo sapiens
catgaacgtggattgt

SEQ ID NO: 6712795 - DNA, 22 bp, Homo sapiens
catgaacgtggattgtatttaa

SEQ ID NO: 6712796 - DNA, 18 bp, Homo sapiens
catgaactacgtgacctc

SEQ ID NO: 6712797 - DNA, 23 bp, Homo sapiens
catgaactacgtgacctctgcaa

SEQ ID NO: 6712798 - DNA, 19 bp, Homo sapiens
catgaactggcttgtacat

SEQ ID NO: 6712799 - DNA, 21 bp, Homo sapiens
catgaactggcttgtacattt

SEQ ID NO: 6712800 - DNA, 14 bp, Homo sapiens
catgaactgtgttt

SEQ ID NO: 6712801 - DNA, 21 bp, Homo sapiens
catgaacttcgcatcaaaaga

SEQ ID NO: 6712802 - DNA, 19 bp, Homo sapiens
catgaagaaaaaattttaa

SEQ ID NO: 6712803 - DNA, 15 bp, Homo sapiens
catgaagaatagaaa

SEQ ID NO: 6712804 - DNA, 18 bp, Homo sapiens
catgaagaatagaaacaa

SEQ ID NO: 6712805 - DNA, 14 bp, Homo sapiens
catgaagaatgcat

SEQ ID NO: 6712806 - DNA, 18 bp, Homo sapiens
catgaagaatgcattcaa

SEQ ID NO: 6712807 - DNA, 15 bp, Homo sapiens
catgaagacaggaca

SEQ ID NO: 6712808 - DNA, 22 bp, Homo sapiens
catgaagacctttttctgcact

SEQ ID NO: 6712809 - DNA, 16 bp, Homo sapiens
catgaagagaagcaat

SEQ ID NO: 6712810 - DNA, 18 bp, Homo sapiens
catgaagagaagcaattt

SEQ ID NO: 6712811 - DNA, 18 bp, Homo sapiens
catgaagagatttttcat

SEQ ID NO: 6712812 - DNA, 14 bp, Homo sapiens
catgaagagcttgt

SEQ ID NO: 6712813 - DNA, 20 bp, Homo sapiens
catgaagagcttgtgtcctg

SEQ ID NO: 6712814 - DNA, 20 bp, Homo sapiens
catgaagaggagattggcca

SEQ ID NO: 6712815 - DNA, 21 bp, Homo sapiens
catgaagaggatgctgtgaaa

SEQ ID NO: 6712816 - DNA, 18 bp, Homo sapiens
catgaagatgtagaggag

SEQ ID NO: 6712817 - DNA, 18 bp, Homo sapiens
catgaagatgttaaaatc

SEQ ID NO: 6712818 - DNA, 17 bp, Homo sapiens
catgaagcaaactaact

SEQ ID NO: 6712819 - DNA, 13 bp, Homo sapiens
catgaagcagaac

SEQ ID NO: 6712820 - DNA, 14 bp, Homo sapiens
catgaagcagaacc

SEQ ID NO: 6712821 - DNA, 18 bp, Homo sapiens
catgaagcagaaccttct

SEQ ID NO: 6712822 - DNA, 17 bp, Homo sapiens
catgaagcataatttgt

SEQ ID NO: 6712823 - DNA, 24 bp, Homo sapiens
catgaagccacagcccaggcctcc

SEQ ID NO: 6712824 - DNA, 16 bp, Homo sapiens
catgaagccaggtgtg

SEQ ID NO: 6712825 - DNA, 13 bp, Homo sapiens
catgaagccctta

SEQ ID NO: 6712826 - DNA, 20 bp, Homo sapiens
catgaagcccttagggagag

SEQ ID NO: 6712827 - DNA, 12 bp, Homo sapiens
catgaagcctgt

SEQ ID NO: 6712828 - DNA, 12 bp, Homo sapiens
catgaagccttt

SEQ ID NO: 6712829 - DNA, 16 bp, Homo sapiens
catgaagccttttgaa

SEQ ID NO: 6712830 - DNA, 13 bp, Homo sapiens
catgaagctggcc

SEQ ID NO: 6712831 - DNA, 20 bp, Homo sapiens
catgaagctggccctcagct

SEQ ID NO: 6712832 - DNA, 23 bp, Homo sapiens
catgaagctggccctcagctccc

SEQ ID NO: 6712833 - DNA, 12 bp, Homo sapiens
catgaaggaaag

SEQ ID NO: 6712834 - DNA, 21 bp, Homo sapiens
catgaaggacactctgcaggg

SEQ ID NO: 6712835 - DNA, 20 bp, Homo sapiens
catgaaggagacagcagcac

SEQ ID NO: 6712836 - DNA, 13 bp, Homo sapiens
catgaaggagagg

SEQ ID NO: 6712837 - DNA, 14 bp, Homo sapiens
catgaaggagtgaa

SEQ ID NO: 6712838 - DNA, 14 bp, Homo sapiens
catgaaggcacctg

SEQ ID NO: 6712839 - DNA, 15 bp, Homo sapiens
catgaaggcacctgc

SEQ ID NO: 6712840 - DNA, 22 bp, Homo sapiens
catgaaggcacctgcccccaca

SEQ ID NO: 6712841 - DNA, 22 bp, Homo sapiens
catgaagggaccctttgggggt

SEQ ID NO: 6712842 - DNA, 13 bp, Homo sapiens
catgaagggctgg

SEQ ID NO: 6712843 - DNA, 21 bp, Homo sapiens
catgaaggtaaataaaaagaa

SEQ ID NO: 6712844 - DNA, 19 bp, Homo sapiens
catgaaggtcctagcttta

SEQ ID NO: 6712845 - DNA, 15 bp, Homo sapiens
catgaaggtttctga

SEQ ID NO: 6712846 - DNA, 16 bp, Homo sapiens
catgaagtaaattatg

SEQ ID NO: 6712847 - DNA, 17 bp, Homo sapiens
catgaagtaaattatgt

SEQ ID NO: 6712848 - DNA, 18 bp, Homo sapiens
catgaagtaaattatgta

SEQ ID NO: 6712849 - DNA, 22 bp, Homo sapiens
catgaagtaatatgcacacatt

SEQ ID NO: 6712850 - DNA, 24 bp, Homo sapiens
catgaagtcttaaggacaaagtgc

SEQ ID NO: 6712851 - DNA, 14 bp, Homo sapiens
catgaagtgaaaat

SEQ ID NO: 6712852 - DNA, 16 bp, Homo sapiens
catgaagtgcacagga

SEQ ID NO: 6712853 - DNA, 19 bp, Homo sapiens
catgaagtgcacaggagcc

SEQ ID NO: 6712854 - DNA, 20 bp, Homo sapiens
catgaagtgtgtttccttca

SEQ ID NO: 6712855 - DNA, 19 bp, Homo sapiens
catgaataaagcctttgta

SEQ ID NO: 6712856 - DNA, 22 bp, Homo sapiens
catgaataaagcctttgtatct

SEQ ID NO: 6712857 - DNA, 23 bp, Homo sapiens
catgaataaagcctttgtatctt

SEQ ID NO: 6712858 - DNA, 20 bp, Homo sapiens
catgaataacatttaaattc

SEQ ID NO: 6712859 - DNA, 21 bp, Homo sapiens
catgaatacgtaaactgcgta

SEQ ID NO: 6712860 - DNA, 23 bp, Homo sapiens
catgaatactatccatgtaataa

SEQ ID NO: 6712861 - DNA, 16 bp, Homo sapiens
catgaatatcaagaat

SEQ ID NO: 6712862 - DNA, 14 bp, Homo sapiens
catgaatatggtgt

SEQ ID NO: 6712863 - DNA, 24 bp, Homo sapiens
catgaatatggtgtctattatagt

SEQ ID NO: 6712864 - DNA, 23 bp, Homo sapiens
catgaatatggttggagagccct

SEQ ID NO: 6712865 - DNA, 11 bp, Homo sapiens
catgaatattt

SEQ ID NO: 6712866 - DNA, 12 bp, Homo sapiens
catgaatattta

SEQ ID NO: 6712867 - DNA, 20 bp, Homo sapiens
catgaatatttcaaaataaa

SEQ ID NO: 6712868 - DNA, 13 bp, Homo sapiens
catgaatattttc

SEQ ID NO: 6712869 - DNA, 17 bp, Homo sapiens
catgaatattttcaagt

SEQ ID NO: 6712870 - DNA, 21 bp, Homo sapiens
catgaatattttcaagttttt

SEQ ID NO: 6712871 - DNA, 16 bp, Homo sapiens
catgaatcaaaagtgc

SEQ ID NO: 6712872 - DNA, 13 bp, Homo sapiens
catgaatcaagca

SEQ ID NO: 6712873 - DNA, 21 bp, Homo sapiens
catgaatcgggctaaggtccc

SEQ ID NO: 6712874 - DNA, 19 bp, Homo sapiens
catgaatctctgcctctcc

SEQ ID NO: 6712875 - DNA, 15 bp, Homo sapiens
catgaatctgcaatg

SEQ ID NO: 6712876 - DNA, 14 bp, Homo sapiens
catgaatcttgaga

SEQ ID NO: 6712877 - DNA, 22 bp, Homo sapiens
catgaatcttgagagtgttcct

SEQ ID NO: 6712878 - DNA, 17 bp, Homo sapiens
catgaatctttcataca

SEQ ID NO: 6712879 - DNA, 21 bp, Homo sapiens
catgaatgaacccctggctcc

SEQ ID NO: 6712880 - DNA, 20 bp, Homo sapiens
catgaatgcagtcatgcaaa

SEQ ID NO: 6712881 - DNA, 13 bp, Homo sapiens
catgaatgctttt

SEQ ID NO: 6712882 - DNA, 18 bp, Homo sapiens
catgaatgggcatttcta

SEQ ID NO: 6712883 - DNA, 19 bp, Homo sapiens
catgaatgtaaatttgtac

SEQ ID NO: 6712884 - DNA, 13 bp, Homo sapiens
catgaatgtatca

SEQ ID NO: 6712885 - DNA, 19 bp, Homo sapiens
catgaatgtgagtcattat

SEQ ID NO: 6712886 - DNA, 22 bp, Homo sapiens
catgaatgttcatatagccagg

SEQ ID NO: 6712887 - DNA, 15 bp, Homo sapiens
catgaattaagaact

SEQ ID NO: 6712888 - DNA, 21 bp, Homo sapiens
catgaattaagggccagaaaa

SEQ ID NO: 6712889 - DNA, 20 bp, Homo sapiens
catgaattactgtatataaa

SEQ ID NO: 6712890 - DNA, 20 bp, Homo sapiens
catgaattattacagtgttt

SEQ ID NO: 6712891 - DNA, 14 bp, Homo sapiens
catgaattcatact

SEQ ID NO: 6712892 - DNA, 23 bp, Homo sapiens
catgaattcatactctgttgcct

SEQ ID NO: 6712893 - DNA, 18 bp, Homo sapiens
catgaattccaactcact

SEQ ID NO: 6712894 - DNA, 16 bp, Homo sapiens
catgaattcttgagtt

SEQ ID NO: 6712895 - DNA, 12 bp, Homo sapiens
catgaattggaa

SEQ ID NO: 6712896 - DNA, 14 bp, Homo sapiens
catgaattggaact

SEQ ID NO: 6712897 - DNA, 18 bp, Homo sapiens
catgaattggaactgcaa

SEQ ID NO: 6712898 - DNA, 16 bp, Homo sapiens
catgaatttaatgtct

SEQ ID NO: 6712899 - DNA, 22 bp, Homo sapiens
catgaatttattgcacattgtt

SEQ ID NO: 6712900 - DNA, 22 bp, Homo sapiens
catgaattttaaataatgtatt

SEQ ID NO: 6712901 - DNA, 15 bp, Homo sapiens
catgaattttacatg

SEQ ID NO: 6712902 - DNA, 20 bp, Homo sapiens
catgaattttagcttttgtg

SEQ ID NO: 6712903 - DNA, 23 bp, Homo sapiens
catgacaaaaataacactgttgg

SEQ ID NO: 6712904 - DNA, 21 bp, Homo sapiens
catgacaaaagtgacagatgt

SEQ ID NO: 6712905 - DNA, 20 bp, Homo sapiens
catgacaaaatagcccagcc

SEQ ID NO: 6712906 - DNA, 16 bp, Homo sapiens
catgacaacatgaaac

SEQ ID NO: 6712907 - DNA, 13 bp, Homo sapiens
catgacaactttt

SEQ ID NO: 6712908 - DNA, 19 bp, Homo sapiens
catgacaacttttaaagaa

SEQ ID NO: 6712909 - DNA, 21 bp, Homo sapiens
catgacacccgtgagcgcctg

SEQ ID NO: 6712910 - DNA, 14 bp, Homo sapiens
catgacactgaaat

SEQ ID NO: 6712911 - DNA, 16 bp, Homo sapiens
catgacactgaaatgc

SEQ ID NO: 6712912 - DNA, 14 bp, Homo sapiens
catgacagaaaata

SEQ ID NO: 6712913 - DNA, 16 bp, Homo sapiens
catgacagaaaatatg

SEQ ID NO: 6712914 - DNA, 21 bp, Homo sapiens
catgacagaaaatatgtatta

SEQ ID NO: 6712915 - DNA, 14 bp, Homo sapiens
catgacagaatata

SEQ ID NO: 6712916 - DNA, 15 bp, Homo sapiens
catgacagaatatac

SEQ ID NO: 6712917 - DNA, 16 bp, Homo sapiens
catgacagaatataca

SEQ ID NO: 6712918 - DNA, 13 bp, Homo sapiens
catgacagaggct

SEQ ID NO: 6712919 - DNA, 12 bp, Homo sapiens
catgacagccag

SEQ ID NO: 6712920 - DNA, 14 bp, Homo sapiens
catgacagcctgca

SEQ ID NO: 6712921 - DNA, 20 bp, Homo sapiens
catgacagcctgcagcagga

SEQ ID NO: 6712922 - DNA, 14 bp, Homo sapiens
catgacagctgttc

SEQ ID NO: 6712923 - DNA, 24 bp, Homo sapiens
catgacagtgcttgcatcctattt

SEQ ID NO: 6712924 - DNA, 15 bp, Homo sapiens
catgacataacagtg

SEQ ID NO: 6712925 - DNA, 13 bp, Homo sapiens
catgacatcaaaa

SEQ ID NO: 6712926 - DNA, 16 bp, Homo sapiens
catgacatcaaaatga

SEQ ID NO: 6712927 - DNA, 13 bp, Homo sapiens
catgacatccaca

SEQ ID NO: 6712928 - DNA, 12 bp, Homo sapiens
catgacatgtta

SEQ ID NO: 6712929 - DNA, 19 bp, Homo sapiens
catgacatttcatctgggt

SEQ ID NO: 6712930 - DNA, 20 bp, Homo sapiens
catgacatttcatctgggtg

SEQ ID NO: 6712931 - DNA, 14 bp, Homo sapiens
catgaccaaaaacc

SEQ ID NO: 6712932 - DNA, 18 bp, Homo sapiens
catgaccagaagggaaac

SEQ ID NO: 6712933 - DNA, 16 bp, Homo sapiens
catgaccaggccacca

SEQ ID NO: 6712934 - DNA, 18 bp, Homo sapiens
catgaccatactgaggga

SEQ ID NO: 6712935 - DNA, 13 bp, Homo sapiens
catgacccacccc

SEQ ID NO: 6712936 - DNA, 15 bp, Homo sapiens
catgacccagcctga

SEQ ID NO: 6712937 - DNA, 15 bp, Homo sapiens
catgacccaggctgg

SEQ ID NO: 6712938 - DNA, 16 bp, Homo sapiens
catgacccaggctggg

SEQ ID NO: 6712939 - DNA, 17 bp, Homo sapiens
catgacccaggctgggc

SEQ ID NO: 6712940 - DNA, 11 bp, Homo sapiens
catgacccagt

SEQ ID NO: 6712941 - DNA, 22 bp, Homo sapiens
catgacccccacccctctgcca

SEQ ID NO: 6712942 - DNA, 22 bp, Homo sapiens
catgacccctcgtccacccccc

SEQ ID NO: 6712943 - DNA, 15 bp, Homo sapiens
catgaccccttctct

SEQ ID NO: 6712944 - DNA, 17 bp, Homo sapiens
catgaccctcctgtcca

SEQ ID NO: 6712945 - DNA, 16 bp, Homo sapiens
catgaccctctgtccc

SEQ ID NO: 6712946 - DNA, 23 bp, Homo sapiens
catgaccctctgtccccaggcct

SEQ ID NO: 6712947 - DNA, 14 bp, Homo sapiens
catgaccctgcctc

SEQ ID NO: 6712948 - DNA, 14 bp, Homo sapiens
catgaccctggagc

SEQ ID NO: 6712949 - DNA, 20 bp, Homo sapiens
catgacctaccaggacagaa

SEQ ID NO: 6712950 - DNA, 23 bp, Homo sapiens
catgacctaccaggacagaactt

SEQ ID NO: 6712951 - DNA, 17 bp, Homo sapiens
catgacctcagtcaggc

SEQ ID NO: 6712952 - DNA, 15 bp, Homo sapiens
catgacctccagctt

SEQ ID NO: 6712953 - DNA, 17 bp, Homo sapiens
catgacctccagctttc

SEQ ID NO: 6712954 - DNA, 12 bp, Homo sapiens
catgacctccat

SEQ ID NO: 6712955 - DNA, 16 bp, Homo sapiens
catgacctgtgaccag

SEQ ID NO: 6712956 - DNA, 18 bp, Homo sapiens
catgacctgtgaccagca

SEQ ID NO: 6712957 - DNA, 16 bp, Homo sapiens
catgaccttacatagc

SEQ ID NO: 6712958 - DNA, 21 bp, Homo sapiens
catgaccttacatttcctggg

SEQ ID NO: 6712959 - DNA, 18 bp, Homo sapiens
catgaccttatccttcct

SEQ ID NO: 6712960 - DNA, 19 bp, Homo sapiens
catgaccttgacgtgtgtg

SEQ ID NO: 6712961 - DNA, 21 bp, Homo sapiens
catgaccttttggcctttgta

SEQ ID NO: 6712962 - DNA, 17 bp, Homo sapiens
catgacctttttcactg

SEQ ID NO: 6712963 - DNA, 23 bp, Homo sapiens
catgacgacaaagctgctaaatc

SEQ ID NO: 6712964 - DNA, 19 bp, Homo sapiens
catgacgccagataaaatg

SEQ ID NO: 6712965 - DNA, 16 bp, Homo sapiens
catgacggcctgcctg

SEQ ID NO: 6712966 - DNA, 19 bp, Homo sapiens
catgacggcctgcctgcaa

SEQ ID NO: 6712967 - DNA, 20 bp, Homo sapiens
catgacgggttgtgagactt

SEQ ID NO: 6712968 - DNA, 20 bp, Homo sapiens
catgacgtggtaaaatgtga

SEQ ID NO: 6712969 - DNA, 14 bp, Homo sapiens
catgactaatgctt

SEQ ID NO: 6712970 - DNA, 16 bp, Homo sapiens
catgactaatgctttt

SEQ ID NO: 6712971 - DNA, 21 bp, Homo sapiens
catgactagggtcctcaggca

SEQ ID NO: 6712972 - DNA, 14 bp, Homo sapiens
catgactatttcca

SEQ ID NO: 6712973 - DNA, 14 bp, Homo sapiens
catgactctgccta

SEQ ID NO: 6712974 - DNA, 23 bp, Homo sapiens
catgactctgcctaaccatgggc

SEQ ID NO: 6712975 - DNA, 19 bp, Homo sapiens
catgactctttattgtctg

SEQ ID NO: 6712976 - DNA, 16 bp, Homo sapiens
catgactgcacccagc

SEQ ID NO: 6712977 - DNA, 17 bp, Homo sapiens
catgactgcacccagct

SEQ ID NO: 6712978 - DNA, 23 bp, Homo sapiens
catgactgcacccagctccaggg

SEQ ID NO: 6712979 - DNA, 18 bp, Homo sapiens
catgactgcccagctctg

SEQ ID NO: 6712980 - DNA, 22 bp, Homo sapiens
catgactgccccttgcttctca

SEQ ID NO: 6712981 - DNA, 12 bp, Homo sapiens
catgactgctca

SEQ ID NO: 6712982 - DNA, 13 bp, Homo sapiens
catgactgctcag

SEQ ID NO: 6712983 - DNA, 14 bp, Homo sapiens
catgactgctcagg

SEQ ID NO: 6712984 - DNA, 17 bp, Homo sapiens
catgactgctcaggcct

SEQ ID NO: 6712985 - DNA, 18 bp, Homo sapiens
catgactgctcaggcctc

SEQ ID NO: 6712986 - DNA, 13 bp, Homo sapiens
catgactgcttgc

SEQ ID NO: 6712987 - DNA, 19 bp, Homo sapiens
catgactggctaattttct

SEQ ID NO: 6712988 - DNA, 13 bp, Homo sapiens
catgactggctgt

SEQ ID NO: 6712989 - DNA, 17 bp, Homo sapiens
catgactgggcctccct

SEQ ID NO: 6712990 - DNA, 16 bp, Homo sapiens
catgactggtgcgttc

SEQ ID NO: 6712991 - DNA, 15 bp, Homo sapiens
catgactgtcgccac

SEQ ID NO: 6712992 - DNA, 17 bp, Homo sapiens
catgactgtcgccacac

SEQ ID NO: 6712993 - DNA, 19 bp, Homo sapiens
catgactgtgaccaccttc

SEQ ID NO: 6712994 - DNA, 20 bp, Homo sapiens
catgactgtttcttttgtaa

SEQ ID NO: 6712995 - DNA, 22 bp, Homo sapiens
catgactgtttcttttgtaaag

SEQ ID NO: 6712996 - DNA, 20 bp, Homo sapiens
catgacttattatgcataaa

SEQ ID NO: 6712997 - DNA, 16 bp, Homo sapiens
catgacttatttagta

SEQ ID NO: 6712998 - DNA, 20 bp, Homo sapiens
catgacttccctccacccct

SEQ ID NO: 6712999 - DNA, 21 bp, Homo sapiens
catgacttccttatttctgaa

SEQ ID NO: 6713000 - DNA, 19 bp, Homo sapiens
catgacttgaggcacaaat

SEQ ID NO: 6713001 - DNA, 23 bp, Homo sapiens
catgacttgaggcacaaatcact

SEQ ID NO: 6713002 - DNA, 14 bp, Homo sapiens
catgactttcctta

SEQ ID NO: 6713003 - DNA, 21 bp, Homo sapiens
catgacttttccatgtatcta

SEQ ID NO: 6713004 - DNA, 20 bp, Homo sapiens
catgacttttctgccctgcc

SEQ ID NO: 6713005 - DNA, 13 bp, Homo sapiens
catgagaaagaat

SEQ ID NO: 6713006 - DNA, 13 bp, Homo sapiens
catgagaaataca

SEQ ID NO: 6713007 - DNA, 18 bp, Homo sapiens
catgagaaatacaaaaat

SEQ ID NO: 6713008 - DNA, 15 bp, Homo sapiens
catgagaaatgtgaa

SEQ ID NO: 6713009 - DNA, 12 bp, Homo sapiens
catgagaacaga

SEQ ID NO: 6713010 - DNA, 20 bp, Homo sapiens
catgagaacagactggcctg

SEQ ID NO: 6713011 - DNA, 23 bp, Homo sapiens
catgagaacagactggcctgagg

SEQ ID NO: 6713012 - DNA, 18 bp, Homo sapiens
catgagaagagggcctgt

SEQ ID NO: 6713013 - DNA, 11 bp, Homo sapiens
catgagaagcc

SEQ ID NO: 6713014 - DNA, 14 bp, Homo sapiens
catgagaagccaag

SEQ ID NO: 6713015 - DNA, 18 bp, Homo sapiens
catgagaattttacttcc

SEQ ID NO: 6713016 - DNA, 19 bp, Homo sapiens
catgagaccactgttatca

SEQ ID NO: 6713017 - DNA, 23 bp, Homo sapiens
catgagaccctggtgcctggctc

SEQ ID NO: 6713018 - DNA, 18 bp, Homo sapiens
catgagactcagtgcaga

SEQ ID NO: 6713019 - DNA, 18 bp, Homo sapiens
catgagactgatccctgg

SEQ ID NO: 6713020 - DNA, 17 bp, Homo sapiens
catgagactgccctgcc

SEQ ID NO: 6713021 - DNA, 21 bp, Homo sapiens
catgagactgccctgcccagg

SEQ ID NO: 6713022 - DNA, 14 bp, Homo sapiens
catgagactttctg

SEQ ID NO: 6713023 - DNA, 15 bp, Homo sapiens
catgagaggaggcag

SEQ ID NO: 6713024 - DNA, 21 bp, Homo sapiens
catgagaggaggcagcaggac

SEQ ID NO: 6713025 - DNA, 16 bp, Homo sapiens
catgagataaataaaa

SEQ ID NO: 6713026 - DNA, 21 bp, Homo sapiens
catgagatcagggcctgcccc

SEQ ID NO: 6713027 - DNA, 22 bp, Homo sapiens
catgagatcagggcctgccccc

SEQ ID NO: 6713028 - DNA, 22 bp, Homo sapiens
catgagatggagaggctgaggg

SEQ ID NO: 6713029 - DNA, 19 bp, Homo sapiens
catgagattggtcattaaa

SEQ ID NO: 6713030 - DNA, 22 bp, Homo sapiens
catgagattggtcattaaatac

SEQ ID NO: 6713031 - DNA, 18 bp, Homo sapiens
catgagcacctccagctg

SEQ ID NO: 6713032 - DNA, 22 bp, Homo sapiens
catgagcactactctaccatgg

SEQ ID NO: 6713033 - DNA, 15 bp, Homo sapiens
catgagcatcaggcc

SEQ ID NO: 6713034 - DNA, 16 bp, Homo sapiens
catgagcatcaggcca

SEQ ID NO: 6713035 - DNA, 18 bp, Homo sapiens
catgagcatcaggccagg

SEQ ID NO: 6713036 - DNA, 20 bp, Homo sapiens
catgagcatcaggccaggcc

SEQ ID NO: 6713037 - DNA, 23 bp, Homo sapiens
catgagcatcaggccaggccctc

SEQ ID NO: 6713038 - DNA, 18 bp, Homo sapiens
catgagcattcataatta

SEQ ID NO: 6713039 - DNA, 17 bp, Homo sapiens
catgagccactgcacct

SEQ ID NO: 6713040 - DNA, 16 bp, Homo sapiens
catgagccactgtgcc

SEQ ID NO: 6713041 - DNA, 21 bp, Homo sapiens
catgagccagctctgtcccag

SEQ ID NO: 6713042 - DNA, 17 bp, Homo sapiens
catgagccgcccaaggc

SEQ ID NO: 6713043 - DNA, 22 bp, Homo sapiens
catgagccgcccaaggccttcc

SEQ ID NO: 6713044 - DNA, 18 bp, Homo sapiens
catgagcctcagcatcct

SEQ ID NO: 6713045 - DNA, 12 bp, Homo sapiens
catgagcctgcc

SEQ ID NO: 6713046 - DNA, 19 bp, Homo sapiens
catgagcctgcccgctgca

SEQ ID NO: 6713047 - DNA, 12 bp, Homo sapiens
catgagcctgct

SEQ ID NO: 6713048 - DNA, 15 bp, Homo sapiens
catgagcctgctgga

SEQ ID NO: 6713049 - DNA, 13 bp, Homo sapiens
catgagcctgttt

SEQ ID NO: 6713050 - DNA, 16 bp, Homo sapiens
catgagccttcagtca

SEQ ID NO: 6713051 - DNA, 16 bp, Homo sapiens
catgagctatttccat

SEQ ID NO: 6713052 - DNA, 22 bp, Homo sapiens
catgagctccctcgctgtatga

SEQ ID NO: 6713053 - DNA, 17 bp, Homo sapiens
catgagctcctgatcag

SEQ ID NO: 6713054 - DNA, 20 bp, Homo sapiens
catgagctcggggtccacca

SEQ ID NO: 6713055 - DNA, 14 bp, Homo sapiens
catgagctctgtgt

SEQ ID NO: 6713056 - DNA, 21 bp, Homo sapiens
catgagctgctgtgcccagcc

SEQ ID NO: 6713057 - DNA, 13 bp, Homo sapiens
catgagctggcaa

SEQ ID NO: 6713058 - DNA, 14 bp, Homo sapiens
catgagctggcaac

SEQ ID NO: 6713059 - DNA, 17 bp, Homo sapiens
catgagctggcaaccag

SEQ ID NO: 6713060 - DNA, 20 bp, Homo sapiens
catgagctggcaaccagcca

SEQ ID NO: 6713061 - DNA, 23 bp, Homo sapiens
catgagctggcaaccagccagcg

SEQ ID NO: 6713062 - DNA, 14 bp, Homo sapiens
catgagctgggtac

SEQ ID NO: 6713063 - DNA, 18 bp, Homo sapiens
catgagctgtgttcacag

SEQ ID NO: 6713064 - DNA, 15 bp, Homo sapiens
catgagctttccagt

SEQ ID NO: 6713065 - DNA, 23 bp, Homo sapiens
catgaggaacaaggcaaggctgt

SEQ ID NO: 6713066 - DNA, 22 bp, Homo sapiens
catgaggaactgtagatgatgt

SEQ ID NO: 6713067 - DNA, 15 bp, Homo sapiens
catgaggacagaagg

SEQ ID NO: 6713068 - DNA, 16 bp, Homo sapiens
catgaggacagaagga

SEQ ID NO: 6713069 - DNA, 19 bp, Homo sapiens
catgaggacagaaggactg

SEQ ID NO: 6713070 - DNA, 20 bp, Homo sapiens
catgaggacatgatggagcg

SEQ ID NO: 6713071 - DNA, 22 bp, Homo sapiens
catgaggacatgatggagcgca

SEQ ID NO: 6713072 - DNA, 20 bp, Homo sapiens
catgaggactctattcttta

SEQ ID NO: 6713073 - DNA, 20 bp, Homo sapiens
catgaggagattctgccttt

SEQ ID NO: 6713074 - DNA, 15 bp, Homo sapiens
catgaggagcgtgga

SEQ ID NO: 6713075 - DNA, 13 bp, Homo sapiens
catgaggaggcag

SEQ ID NO: 6713076 - DNA, 15 bp, Homo sapiens
catgaggaggcagag

SEQ ID NO: 6713077 - DNA, 12 bp, Homo sapiens
catgaggagggt

SEQ ID NO: 6713078 - DNA, 15 bp, Homo sapiens
catgaggagggtgcc

SEQ ID NO: 6713079 - DNA, 18 bp, Homo sapiens
catgaggatttctttatg

SEQ ID NO: 6713080 - DNA, 24 bp, Homo sapiens
catgaggcaatgtcaggaacagaa

SEQ ID NO: 6713081 - DNA, 14 bp, Homo sapiens
catgaggccatctc

SEQ ID NO: 6713082 - DNA, 15 bp, Homo sapiens
catgaggccatctca

SEQ ID NO: 6713083 - DNA, 21 bp, Homo sapiens
catgaggccccgaggctcgag

SEQ ID NO: 6713084 - DNA, 15 bp, Homo sapiens
catgaggcctttccc

SEQ ID NO: 6713085 - DNA, 20 bp, Homo sapiens
catgaggcctttccccagtg

SEQ ID NO: 6713086 - DNA, 14 bp, Homo sapiens
catgaggctgaggc

SEQ ID NO: 6713087 - DNA, 17 bp, Homo sapiens
catgaggcttgtggcca

SEQ ID NO: 6713088 - DNA, 14 bp, Homo sapiens
catgagggacaggg

SEQ ID NO: 6713089 - DNA, 19 bp, Homo sapiens
catgagggacagggtcttt

SEQ ID NO: 6713090 - DNA, 19 bp, Homo sapiens
catgagggatcacagggcc

SEQ ID NO: 6713091 - DNA, 23 bp, Homo sapiens
catgaggggattcccttccttct

SEQ ID NO: 6713092 - DNA, 16 bp, Homo sapiens
catgaggggcccgagc

SEQ ID NO: 6713093 - DNA, 15 bp, Homo sapiens
catgaggggttcctc

SEQ ID NO: 6713094 - DNA, 15 bp, Homo sapiens
catgaggtaaaagag

SEQ ID NO: 6713095 - DNA, 16 bp, Homo sapiens
catgaggtactgagag

SEQ ID NO: 6713096 - DNA, 22 bp, Homo sapiens
catgaggtactggtcccttcct

SEQ ID NO: 6713097 - DNA, 14 bp, Homo sapiens
catgaggtatctaa

SEQ ID NO: 6713098 - DNA, 15 bp, Homo sapiens
catgaggttctctct

SEQ ID NO: 6713099 - DNA, 21 bp, Homo sapiens
catgagtaaaatagattttat

SEQ ID NO: 6713100 - DNA, 19 bp, Homo sapiens
catgagtatctgtgggagt

SEQ ID NO: 6713101 - DNA, 15 bp, Homo sapiens
catgagtcaaaacaa

SEQ ID NO: 6713102 - DNA, 18 bp, Homo sapiens
catgagtcagatacacaa

SEQ ID NO: 6713103 - DNA, 16 bp, Homo sapiens
catgagtccatgtcct

SEQ ID NO: 6713104 - DNA, 15 bp, Homo sapiens
catgagtcccagtgg

SEQ ID NO: 6713105 - DNA, 17 bp, Homo sapiens
catgagtcccagtggga

SEQ ID NO: 6713106 - DNA, 18 bp, Homo sapiens
catgagtcccagtgggag

SEQ ID NO: 6713107 - DNA, 14 bp, Homo sapiens
catgagtcccctgt

SEQ ID NO: 6713108 - DNA, 15 bp, Homo sapiens
catgagtcccctgtt

SEQ ID NO: 6713109 - DNA, 17 bp, Homo sapiens
catgagtccttgaaaat

SEQ ID NO: 6713110 - DNA, 18 bp, Homo sapiens
catgagtccttgaaaata

SEQ ID NO: 6713111 - DNA, 19 bp, Homo sapiens
catgagtccttgaaaatat

SEQ ID NO: 6713112 - DNA, 21 bp, Homo sapiens
catgagtccttgaaaatattt

SEQ ID NO: 6713113 - DNA, 17 bp, Homo sapiens
catgagtctccagatag

SEQ ID NO: 6713114 - DNA, 18 bp, Homo sapiens
catgagtgcgtgctcagt

SEQ ID NO: 6713115 - DNA, 13 bp, Homo sapiens
catgagtggaaat

SEQ ID NO: 6713116 - DNA, 20 bp, Homo sapiens
catgagtggaaatacactca

SEQ ID NO: 6713117 - DNA, 21 bp, Homo sapiens
catgagtggccttaataaata

SEQ ID NO: 6713118 - DNA, 16 bp, Homo sapiens
catgagttatcatgaa

SEQ ID NO: 6713119 - DNA, 19 bp, Homo sapiens
catgagttatcatgaattt

SEQ ID NO: 6713120 - DNA, 23 bp, Homo sapiens
catgagttatcatgaattttaaa

SEQ ID NO: 6713121 - DNA, 14 bp, Homo sapiens
catgagttattcat

SEQ ID NO: 6713122 - DNA, 17 bp, Homo sapiens
catgagttattcataaa

SEQ ID NO: 6713123 - DNA, 15 bp, Homo sapiens
catgagttctgcaca

SEQ ID NO: 6713124 - DNA, 17 bp, Homo sapiens
catgagttctgcacata

SEQ ID NO: 6713125 - DNA, 16 bp, Homo sapiens
catgagttctgctgaa

SEQ ID NO: 6713126 - DNA, 17 bp, Homo sapiens
catgagttgtcagcttt

SEQ ID NO: 6713127 - DNA, 13 bp, Homo sapiens
catgagtttaaag

SEQ ID NO: 6713128 - DNA, 15 bp, Homo sapiens
catgagtttgccctg

SEQ ID NO: 6713129 - DNA, 15 bp, Homo sapiens
catgataaaataagt

SEQ ID NO: 6713130 - DNA, 16 bp, Homo sapiens
catgataagacatttt

SEQ ID NO: 6713131 - DNA, 17 bp, Homo sapiens
catgataagacattttg

SEQ ID NO: 6713132 - DNA, 15 bp, Homo sapiens
catgataataggtca

SEQ ID NO: 6713133 - DNA, 13 bp, Homo sapiens
catgatacaaaga

SEQ ID NO: 6713134 - DNA, 16 bp, Homo sapiens
catgatacatttttat

SEQ ID NO: 6713135 - DNA, 20 bp, Homo sapiens
catgataccacctttactgt

SEQ ID NO: 6713136 - DNA, 21 bp, Homo sapiens
catgataccacctttactgtg

SEQ ID NO: 6713137 - DNA, 22 bp, Homo sapiens
catgataccagcagcaactgaa

SEQ ID NO: 6713138 - DNA, 20 bp, Homo sapiens
catgataccaggcccaggag

SEQ ID NO: 6713139 - DNA, 20 bp, Homo sapiens
catgatacctattaaaggaa

SEQ ID NO: 6713140 - DNA, 21 bp, Homo sapiens
catgatacctattaaaggaaa

SEQ ID NO: 6713141 - DNA, 19 bp, Homo sapiens
catgatacttattcaaaaa

SEQ ID NO: 6713142 - DNA, 14 bp, Homo sapiens
catgatactttaat

SEQ ID NO: 6713143 - DNA, 20 bp, Homo sapiens
catgatactttaatttttat

SEQ ID NO: 6713144 - DNA, 17 bp, Homo sapiens
catgatagaaagaataa

SEQ ID NO: 6713145 - DNA, 16 bp, Homo sapiens
catgatagtgtgattt

SEQ ID NO: 6713146 - DNA, 12 bp, Homo sapiens
catgatagttaa

SEQ ID NO: 6713147 - DNA, 15 bp, Homo sapiens
catgatataacttta

SEQ ID NO: 6713148 - DNA, 18 bp, Homo sapiens
catgatataactttagaa

SEQ ID NO: 6713149 - DNA, 19 bp, Homo sapiens
catgatataactttagaaa

SEQ ID NO: 6713150 - DNA, 15 bp, Homo sapiens
catgatattttcaga

SEQ ID NO: 6713151 - DNA, 13 bp, Homo sapiens
catgatattttgt

SEQ ID NO: 6713152 - DNA, 21 bp, Homo sapiens
catgatattttgtttttcccc

SEQ ID NO: 6713153 - DNA, 14 bp, Homo sapiens
catgatcaagatat

SEQ ID NO: 6713154 - DNA, 20 bp, Homo sapiens
catgatcacaactgagatca

SEQ ID NO: 6713155 - DNA, 14 bp, Homo sapiens
catgatcacacagc

SEQ ID NO: 6713156 - DNA, 20 bp, Homo sapiens
catgatcagacatacagctg

SEQ ID NO: 6713157 - DNA, 22 bp, Homo sapiens
catgatcagacatacagctgcc

SEQ ID NO: 6713158 - DNA, 23 bp, Homo sapiens
catgatccccgtctctgccctgg

SEQ ID NO: 6713159 - DNA, 13 bp, Homo sapiens
catgatctccctg

SEQ ID NO: 6713160 - DNA, 15 bp, Homo sapiens
catgatctccctgcc

SEQ ID NO: 6713161 - DNA, 23 bp, Homo sapiens
catgatctgactttaattgtgtg

SEQ ID NO: 6713162 - DNA, 17 bp, Homo sapiens
catgatctgcaggggtc

SEQ ID NO: 6713163 - DNA, 12 bp, Homo sapiens
catgatctgtat

SEQ ID NO: 6713164 - DNA, 20 bp, Homo sapiens
catgatcttgttaatgcatt

SEQ ID NO: 6713165 - DNA, 21 bp, Homo sapiens
catgatgacaactacagaaaa

SEQ ID NO: 6713166 - DNA, 22 bp, Homo sapiens
catgatgactcttcttatcaca

SEQ ID NO: 6713167 - DNA, 23 bp, Homo sapiens
catgatgactcttcttatcacac

SEQ ID NO: 6713168 - DNA, 15 bp, Homo sapiens
catgatgagctcctc

SEQ ID NO: 6713169 - DNA, 15 bp, Homo sapiens
catgatgatctgcct

SEQ ID NO: 6713170 - DNA, 21 bp, Homo sapiens
catgatgatgatgattttaac

SEQ ID NO: 6713171 - DNA, 22 bp, Homo sapiens
catgatgatgatgattttaaca

SEQ ID NO: 6713172 - DNA, 18 bp, Homo sapiens
catgatgcaagccagctt

SEQ ID NO: 6713173 - DNA, 17 bp, Homo sapiens
catgatgcacagtatct

SEQ ID NO: 6713174 - DNA, 21 bp, Homo sapiens
catgatgccctcccctcagcg

SEQ ID NO: 6713175 - DNA, 20 bp, Homo sapiens
catgatgccgctcttctgtc

SEQ ID NO: 6713176 - DNA, 23 bp, Homo sapiens
catgatgcctctgtcttctggac

SEQ ID NO: 6713177 - DNA, 14 bp, Homo sapiens
catgatgcgggcca

SEQ ID NO: 6713178 - DNA, 14 bp, Homo sapiens
catgatgctagcca

SEQ ID NO: 6713179 - DNA, 15 bp, Homo sapiens
catgatgctagttct

SEQ ID NO: 6713180 - DNA, 17 bp, Homo sapiens
catgatgctagttctta

SEQ ID NO: 6713181 - DNA, 17 bp, Homo sapiens
catgatgctctttccca

SEQ ID NO: 6713182 - DNA, 13 bp, Homo sapiens
catgatgctgagc

SEQ ID NO: 6713183 - DNA, 15 bp, Homo sapiens
catgatgctgagccc

SEQ ID NO: 6713184 - DNA, 16 bp, Homo sapiens
catgatgcttttactg

SEQ ID NO: 6713185 - DNA, 14 bp, Homo sapiens
catgatggaatttc

SEQ ID NO: 6713186 - DNA, 19 bp, Homo sapiens
catgatggagcgcacctgc

SEQ ID NO: 6713187 - DNA, 14 bp, Homo sapiens
catgatggcaacag

SEQ ID NO: 6713188 - DNA, 17 bp, Homo sapiens
catgatggcaacagaaa

SEQ ID NO: 6713189 - DNA, 20 bp, Homo sapiens
catgatggcaacagaaacca

SEQ ID NO: 6713190 - DNA, 20 bp, Homo sapiens
catgatggcaacagatctgg

SEQ ID NO: 6713191 - DNA, 21 bp, Homo sapiens
catgatggccaggctgatctc

SEQ ID NO: 6713192 - DNA, 12 bp, Homo sapiens
catgatgggaaa

SEQ ID NO: 6713193 - DNA, 20 bp, Homo sapiens
catgatgggaggtgtgccag

SEQ ID NO: 6713194 - DNA, 18 bp, Homo sapiens
catgatggtcacttaaaa

SEQ ID NO: 6713195 - DNA, 19 bp, Homo sapiens
catgatgtaaaaaatacaa

SEQ ID NO: 6713196 - DNA, 19 bp, Homo sapiens
catgatgtaaaaaatatta

SEQ ID NO: 6713197 - DNA, 22 bp, Homo sapiens
catgatgtaaaaaatattaaag

SEQ ID NO: 6713198 - DNA, 15 bp, Homo sapiens
catgatgtccttgga

SEQ ID NO: 6713199 - DNA, 21 bp, Homo sapiens
catgatgtcgttcattttctg

SEQ ID NO: 6713200 - DNA, 14 bp, Homo sapiens
catgatgtctgcaa

SEQ ID NO: 6713201 - DNA, 20 bp, Homo sapiens
catgatgtgacttccggaga

SEQ ID NO: 6713202 - DNA, 13 bp, Homo sapiens
catgatgtttaca

SEQ ID NO: 6713203 - DNA, 15 bp, Homo sapiens
catgatgtttccctc

SEQ ID NO: 6713204 - DNA, 13 bp, Homo sapiens
catgatgttttcc

SEQ ID NO: 6713205 - DNA, 23 bp, Homo sapiens
catgattaaccacttcagctgac

SEQ ID NO: 6713206 - DNA, 24 bp, Homo sapiens
catgattaaccacttcagctgact

SEQ ID NO: 6713207 - DNA, 16 bp, Homo sapiens
catgattagacaatgt

SEQ ID NO: 6713208 - DNA, 21 bp, Homo sapiens
catgattagacaatgtggaat

SEQ ID NO: 6713209 - DNA, 15 bp, Homo sapiens
catgattagtgcaat

SEQ ID NO: 6713210 - DNA, 19 bp, Homo sapiens
catgattatagaaggctgt

SEQ ID NO: 6713211 - DNA, 14 bp, Homo sapiens
catgattatagcaa

SEQ ID NO: 6713212 - DNA, 15 bp, Homo sapiens
catgattatcttgat

SEQ ID NO: 6713213 - DNA, 16 bp, Homo sapiens
catgattatcttgatt

SEQ ID NO: 6713214 - DNA, 16 bp, Homo sapiens
catgattcatgccaat

SEQ ID NO: 6713215 - DNA, 21 bp, Homo sapiens
catgattcatgccaattagca

SEQ ID NO: 6713216 - DNA, 14 bp, Homo sapiens
catgattcatttta

SEQ ID NO: 6713217 - DNA, 21 bp, Homo sapiens
catgattccaagggcccagag

SEQ ID NO: 6713218 - DNA, 14 bp, Homo sapiens
catgattccagcca

SEQ ID NO: 6713219 - DNA, 15 bp, Homo sapiens
catgattccagccat

SEQ ID NO: 6713220 - DNA, 16 bp, Homo sapiens
catgattccagccatc

SEQ ID NO: 6713221 - DNA, 21 bp, Homo sapiens
catgattccatgcccgagtcc

SEQ ID NO: 6713222 - DNA, 14 bp, Homo sapiens
catgattccctcct

SEQ ID NO: 6713223 - DNA, 16 bp, Homo sapiens
catgattcctttaaca

SEQ ID NO: 6713224 - DNA, 14 bp, Homo sapiens
catgattctctgag

SEQ ID NO: 6713225 - DNA, 16 bp, Homo sapiens
catgattctctgagtg

SEQ ID NO: 6713226 - DNA, 17 bp, Homo sapiens
catgattctctgagtgg

SEQ ID NO: 6713227 - DNA, 20 bp, Homo sapiens
catgattcttccaaggaaat

SEQ ID NO: 6713228 - DNA, 16 bp, Homo sapiens
catgattcttctcttg

SEQ ID NO: 6713229 - DNA, 16 bp, Homo sapiens
catgattgtataagca

SEQ ID NO: 6713230 - DNA, 13 bp, Homo sapiens
catgatttaatcc

SEQ ID NO: 6713231 - DNA, 16 bp, Homo sapiens
catgatttacagagaa

SEQ ID NO: 6713232 - DNA, 12 bp, Homo sapiens
catgatttagca

SEQ ID NO: 6713233 - DNA, 14 bp, Homo sapiens
catgatttagcaag

SEQ ID NO: 6713234 - DNA, 16 bp, Homo sapiens
catgatttagcaagca

SEQ ID NO: 6713235 - DNA, 18 bp, Homo sapiens
catgatttagggaagcag

SEQ ID NO: 6713236 - DNA, 15 bp, Homo sapiens
catgatttatatatg

SEQ ID NO: 6713237 - DNA, 20 bp, Homo sapiens
catgatttatatatggcata

SEQ ID NO: 6713238 - DNA, 16 bp, Homo sapiens
catgatttcacaaata

SEQ ID NO: 6713239 - DNA, 17 bp, Homo sapiens
catgatttcacaaatat

SEQ ID NO: 6713240 - DNA, 18 bp, Homo sapiens
catgatttcacaaatatt

SEQ ID NO: 6713241 - DNA, 13 bp, Homo sapiens
catgatttcatgt

SEQ ID NO: 6713242 - DNA, 14 bp, Homo sapiens
catgatttcatgta

SEQ ID NO: 6713243 - DNA, 17 bp, Homo sapiens
catgatttcatgtactg

SEQ ID NO: 6713244 - DNA, 23 bp, Homo sapiens
catgatttccctccagagaaagc

SEQ ID NO: 6713245 - DNA, 19 bp, Homo sapiens
catgatttctgtgaagcaa

SEQ ID NO: 6713246 - DNA, 19 bp, Homo sapiens
catgatttgaaaaaaagca

SEQ ID NO: 6713247 - DNA, 13 bp, Homo sapiens
catgatttgcaac

SEQ ID NO: 6713248 - DNA, 23 bp, Homo sapiens
catgatttgcaactttagaaaga

SEQ ID NO: 6713249 - DNA, 21 bp, Homo sapiens
catgatttgtcccagcctggg

SEQ ID NO: 6713250 - DNA, 22 bp, Homo sapiens
catgatttgtcccagcctgggg

SEQ ID NO: 6713251 - DNA, 23 bp, Homo sapiens
catgatttgtcccagcctggggc

SEQ ID NO: 6713252 - DNA, 19 bp, Homo sapiens
catgattttaagaggcttt

SEQ ID NO: 6713253 - DNA, 11 bp, Homo sapiens
catgattttac

SEQ ID NO: 6713254 - DNA, 16 bp, Homo sapiens
catgattttggccact

SEQ ID NO: 6713255 - DNA, 15 bp, Homo sapiens
catgatttttgccct

SEQ ID NO: 6713256 - DNA, 16 bp, Homo sapiens
catgatttttgccctg

SEQ ID NO: 6713257 - DNA, 17 bp, Homo sapiens
catgatttttgccctgc

SEQ ID NO: 6713258 - DNA, 13 bp, Homo sapiens
catgcaaaaatga

SEQ ID NO: 6713259 - DNA, 21 bp, Homo sapiens
catgcaaaagaaagcaaatta

SEQ ID NO: 6713260 - DNA, 16 bp, Homo sapiens
catgcaaactgcttta

SEQ ID NO: 6713261 - DNA, 22 bp, Homo sapiens
catgcaaactgctttattttcc

SEQ ID NO: 6713262 - DNA, 23 bp, Homo sapiens
catgcaaactgctttattttccc

SEQ ID NO: 6713263 - DNA, 15 bp, Homo sapiens
catgcaaaggctggg

SEQ ID NO: 6713264 - DNA, 16 bp, Homo sapiens
catgcaaaggctggga

SEQ ID NO: 6713265 - DNA, 16 bp, Homo sapiens
catgcaaatgagctct

SEQ ID NO: 6713266 - DNA, 20 bp, Homo sapiens
catgcaaatgagctctgaaa

SEQ ID NO: 6713267 - DNA, 15 bp, Homo sapiens
catgcaaattgtgaa

SEQ ID NO: 6713268 - DNA, 16 bp, Homo sapiens
catgcaaattgtgaaa

SEQ ID NO: 6713269 - DNA, 17 bp, Homo sapiens
catgcaaattgtgaaat

SEQ ID NO: 6713270 - DNA, 14 bp, Homo sapiens
catgcaacaaaaat

SEQ ID NO: 6713271 - DNA, 16 bp, Homo sapiens
catgcaactccatgcc

SEQ ID NO: 6713272 - DNA, 19 bp, Homo sapiens
catgcaactccatgcctat

SEQ ID NO: 6713273 - DNA, 22 bp, Homo sapiens
catgcaagaatttctggaagaa

SEQ ID NO: 6713274 - DNA, 18 bp, Homo sapiens
catgcaagacttcactgc

SEQ ID NO: 6713275 - DNA, 22 bp, Homo sapiens
catgcaagacttcactgcagcc

SEQ ID NO: 6713276 - DNA, 13 bp, Homo sapiens
catgcaagagttt

SEQ ID NO: 6713277 - DNA, 15 bp, Homo sapiens
catgcaagagtttct

SEQ ID NO: 6713278 - DNA, 14 bp, Homo sapiens
catgcaagcagagg

SEQ ID NO: 6713279 - DNA, 17 bp, Homo sapiens
catgcaagcagaggacc

SEQ ID NO: 6713280 - DNA, 21 bp, Homo sapiens
catgcaagcttggtcaaactt

SEQ ID NO: 6713281 - DNA, 18 bp, Homo sapiens
catgcaagtgctatgcca

SEQ ID NO: 6713282 - DNA, 17 bp, Homo sapiens
catgcaagtgctgtttg

SEQ ID NO: 6713283 - DNA, 14 bp, Homo sapiens
catgcaataaaatt

SEQ ID NO: 6713284 - DNA, 15 bp, Homo sapiens
catgcaataaaattt

SEQ ID NO: 6713285 - DNA, 12 bp, Homo sapiens
catgcaataatg

SEQ ID NO: 6713286 - DNA, 17 bp, Homo sapiens
catgcaattcatcccag

SEQ ID NO: 6713287 - DNA, 19 bp, Homo sapiens
catgcaattggggaagaaa

SEQ ID NO: 6713288 - DNA, 18 bp, Homo sapiens
catgcaatttattaaaat

SEQ ID NO: 6713289 - DNA, 15 bp, Homo sapiens
catgcaatttgaagt

SEQ ID NO: 6713290 - DNA, 17 bp, Homo sapiens
catgcacacaaacacct

SEQ ID NO: 6713291 - DNA, 20 bp, Homo sapiens
catgcacacaaacacctcct

SEQ ID NO: 6713292 - DNA, 11 bp, Homo sapiens
catgcacacac

SEQ ID NO: 6713293 - DNA, 13 bp, Homo sapiens
catgcacacacac

SEQ ID NO: 6713294 - DNA, 14 bp, Homo sapiens
catgcacacacaca

SEQ ID NO: 6713295 - DNA, 19 bp, Homo sapiens
catgcacacggctggtcac

SEQ ID NO: 6713296 - DNA, 21 bp, Homo sapiens
catgcacacggctggtcactc

SEQ ID NO: 6713297 - DNA, 19 bp, Homo sapiens
catgcacactcatgtgcaa

SEQ ID NO: 6713298 - DNA, 15 bp, Homo sapiens
catgcacactgagaa

SEQ ID NO: 6713299 - DNA, 18 bp, Homo sapiens
catgcacagaacaagcca

SEQ ID NO: 6713300 - DNA, 12 bp, Homo sapiens
catgcacagctg

SEQ ID NO: 6713301 - DNA, 15 bp, Homo sapiens
catgcacagctgctt

SEQ ID NO: 6713302 - DNA, 21 bp, Homo sapiens
catgcacagctgcttgtcctg

SEQ ID NO: 6713303 - DNA, 15 bp, Homo sapiens
catgcacaggaaaag

SEQ ID NO: 6713304 - DNA, 10 bp, Homo sapiens
catgcacagt

SEQ ID NO: 6713305 - DNA, 17 bp, Homo sapiens
catgcacagtatttgta

SEQ ID NO: 6713306 - DNA, 18 bp, Homo sapiens
catgcacagtatttgtaa

SEQ ID NO: 6713307 - DNA, 20 bp, Homo sapiens
catgcacagtatttgtaatt

SEQ ID NO: 6713308 - DNA, 13 bp, Homo sapiens
catgcacagtcat

SEQ ID NO: 6713309 - DNA, 15 bp, Homo sapiens
catgcacagtcatac

SEQ ID NO: 6713310 - DNA, 18 bp, Homo sapiens
catgcacattcatcctca

SEQ ID NO: 6713311 - DNA, 19 bp, Homo sapiens
catgcacattcatcctcac

SEQ ID NO: 6713312 - DNA, 15 bp, Homo sapiens
catgcacatttatat

SEQ ID NO: 6713313 - DNA, 14 bp, Homo sapiens
catgcacattttgt

SEQ ID NO: 6713314 - DNA, 17 bp, Homo sapiens
catgcacattttgtaca

SEQ ID NO: 6713315 - DNA, 18 bp, Homo sapiens
catgcaccacgcccggct

SEQ ID NO: 6713316 - DNA, 14 bp, Homo sapiens
catgcaccacgggc

SEQ ID NO: 6713317 - DNA, 20 bp, Homo sapiens
catgcaccaggactggctgt

SEQ ID NO: 6713318 - DNA, 18 bp, Homo sapiens
catgcacccctgatgttc

SEQ ID NO: 6713319 - DNA, 23 bp, Homo sapiens
catgcacccgcatgtacaaaaac

SEQ ID NO: 6713320 - DNA, 19 bp, Homo sapiens
catgcaccctggacttctc

SEQ ID NO: 6713321 - DNA, 13 bp, Homo sapiens
catgcaccttcca

SEQ ID NO: 6713322 - DNA, 14 bp, Homo sapiens
catgcaccttccag

SEQ ID NO: 6713323 - DNA, 15 bp, Homo sapiens
catgcaccttgctcc

SEQ ID NO: 6713324 - DNA, 22 bp, Homo sapiens
catgcacgcaccccgcccctgc

SEQ ID NO: 6713325 - DNA, 14 bp, Homo sapiens
catgcacgccggga

SEQ ID NO: 6713326 - DNA, 17 bp, Homo sapiens
catgcactatatttgta

SEQ ID NO: 6713327 - DNA, 16 bp, Homo sapiens
catgcactcagctctt

SEQ ID NO: 6713328 - DNA, 12 bp, Homo sapiens
catgcactgacc

SEQ ID NO: 6713329 - DNA, 15 bp, Homo sapiens
catgcactgatgttg

SEQ ID NO: 6713330 - DNA, 10 bp, Homo sapiens
catgcactgt

SEQ ID NO: 6713331 - DNA, 16 bp, Homo sapiens
catgcactgtgaagga

SEQ ID NO: 6713332 - DNA, 22 bp, Homo sapiens
catgcactgtgaaggacccttg

SEQ ID NO: 6713333 - DNA, 17 bp, Homo sapiens
catgcacttaaagaagt

SEQ ID NO: 6713334 - DNA, 23 bp, Homo sapiens
catgcactttaattgaagaactg

SEQ ID NO: 6713335 - DNA, 20 bp, Homo sapiens
catgcagaacaaatgaagac

SEQ ID NO: 6713336 - DNA, 14 bp, Homo sapiens
catgcagaataatc

SEQ ID NO: 6713337 - DNA, 19 bp, Homo sapiens
catgcagaataatcctgtt

SEQ ID NO: 6713338 - DNA, 20 bp, Homo sapiens
catgcagacaaagccctgtc

SEQ ID NO: 6713339 - DNA, 21 bp, Homo sapiens
catgcagacaaagccctgtcc

SEQ ID NO: 6713340 - DNA, 21 bp, Homo sapiens
catgcagacctcatgcccagc

SEQ ID NO: 6713341 - DNA, 17 bp, Homo sapiens
catgcagactcctcaga

SEQ ID NO: 6713342 - DNA, 20 bp, Homo sapiens
catgcagactgttagctttt

SEQ ID NO: 6713343 - DNA, 17 bp, Homo sapiens
catgcagagtatttcta

SEQ ID NO: 6713344 - DNA, 18 bp, Homo sapiens
catgcagagttgaagttt

SEQ ID NO: 6713345 - DNA, 17 bp, Homo sapiens
catgcagataacagctg

SEQ ID NO: 6713346 - DNA, 21 bp, Homo sapiens
catgcagatagtatacacatc

SEQ ID NO: 6713347 - DNA, 18 bp, Homo sapiens
catgcagatctagccagg

SEQ ID NO: 6713348 - DNA, 23 bp, Homo sapiens
catgcagatctagccaggcctcc

SEQ ID NO: 6713349 - DNA, 14 bp, Homo sapiens
catgcagcatctaa

SEQ ID NO: 6713350 - DNA, 14 bp, Homo sapiens
catgcagccttggg

SEQ ID NO: 6713351 - DNA, 19 bp, Homo sapiens
catgcagccttggggcatt

SEQ ID NO: 6713352 - DNA, 19 bp, Homo sapiens
catgcagcgaattcagaaa

SEQ ID NO: 6713353 - DNA, 12 bp, Homo sapiens
catgcagctctg

SEQ ID NO: 6713354 - DNA, 21 bp, Homo sapiens
catgcagctgcaccctccctc

SEQ ID NO: 6713355 - DNA, 19 bp, Homo sapiens
catgcagctgcctggggcc

SEQ ID NO: 6713356 - DNA, 16 bp, Homo sapiens
catgcagctgctcccc

SEQ ID NO: 6713357 - DNA, 24 bp, Homo sapiens
catgcagctgctccccaggccacc

SEQ ID NO: 6713358 - DNA, 13 bp, Homo sapiens
catgcagcttcat

SEQ ID NO: 6713359 - DNA, 17 bp, Homo sapiens
catgcagcttcatcaat

SEQ ID NO: 6713360 - DNA, 19 bp, Homo sapiens
catgcagcttcatcaattt

SEQ ID NO: 6713361 - DNA, 21 bp, Homo sapiens
catgcagcttcatcaattttt

SEQ ID NO: 6713362 - DNA, 23 bp, Homo sapiens
catgcagcttcatcaatttttat

SEQ ID NO: 6713363 - DNA, 12 bp, Homo sapiens
catgcaggaaga

SEQ ID NO: 6713364 - DNA, 17 bp, Homo sapiens
catgcaggaagaggccc

SEQ ID NO: 6713365 - DNA, 18 bp, Homo sapiens
catgcaggaagaggccca

SEQ ID NO: 6713366 - DNA, 19 bp, Homo sapiens
catgcaggaagaggcccac

SEQ ID NO: 6713367 - DNA, 11 bp, Homo sapiens
catgcaggagg

SEQ ID NO: 6713368 - DNA, 13 bp, Homo sapiens
catgcaggccctt

SEQ ID NO: 6713369 - DNA, 22 bp, Homo sapiens
catgcaggccttaactttccca

SEQ ID NO: 6713370 - DNA, 22 bp, Homo sapiens
catgcagggcccccacaggagc

SEQ ID NO: 6713371 - DNA, 19 bp, Homo sapiens
catgcagggcccccatgca

SEQ ID NO: 6713372 - DNA, 18 bp, Homo sapiens
catgcagggggctcctgg

SEQ ID NO: 6713373 - DNA, 19 bp, Homo sapiens
catgcaggggtcagtgcag

SEQ ID NO: 6713374 - DNA, 22 bp, Homo sapiens
catgcagtctgggagtggggaa

SEQ ID NO: 6713375 - DNA, 22 bp, Homo sapiens
catgcagtgctctttgtagcta

SEQ ID NO: 6713376 - DNA, 21 bp, Homo sapiens
catgcagttatatattttgtt

SEQ ID NO: 6713377 - DNA, 20 bp, Homo sapiens
catgcagttcattattttgt

SEQ ID NO: 6713378 - DNA, 14 bp, Homo sapiens
catgcagttcctgg

SEQ ID NO: 6713379 - DNA, 12 bp, Homo sapiens
catgcagtttga

SEQ ID NO: 6713380 - DNA, 13 bp, Homo sapiens
catgcagtttgaa

SEQ ID NO: 6713381 - DNA, 17 bp, Homo sapiens
catgcagtttgaaattc

SEQ ID NO: 6713382 - DNA, 22 bp, Homo sapiens
catgcagtttgaaattctgaat

SEQ ID NO: 6713383 - DNA, 15 bp, Homo sapiens
catgcataaaaatta

SEQ ID NO: 6713384 - DNA, 21 bp, Homo sapiens
catgcataaaaattaaatgga

SEQ ID NO: 6713385 - DNA, 15 bp, Homo sapiens
catgcataaatatgc

SEQ ID NO: 6713386 - DNA, 19 bp, Homo sapiens
catgcataaatatgcagtg

SEQ ID NO: 6713387 - DNA, 18 bp, Homo sapiens
catgcataacaaaccctg

SEQ ID NO: 6713388 - DNA, 11 bp, Homo sapiens
catgcatacac

SEQ ID NO: 6713389 - DNA, 12 bp, Homo sapiens
catgcatacaca

SEQ ID NO: 6713390 - DNA, 14 bp, Homo sapiens
catgcatacacaca

SEQ ID NO: 6713391 - DNA, 15 bp, Homo sapiens
catgcatacactctc

SEQ ID NO: 6713392 - DNA, 17 bp, Homo sapiens
catgcatacttacagac

SEQ ID NO: 6713393 - DNA, 20 bp, Homo sapiens
catgcatacttcaaaagtat

SEQ ID NO: 6713394 - DNA, 16 bp, Homo sapiens
catgcatactttattg

SEQ ID NO: 6713395 - DNA, 21 bp, Homo sapiens
catgcatataatgaataaatc

SEQ ID NO: 6713396 - DNA, 20 bp, Homo sapiens
catgcatatgatatatagtt

SEQ ID NO: 6713397 - DNA, 23 bp, Homo sapiens
catgcatatgatatatagttaca

SEQ ID NO: 6713398 - DNA, 21 bp, Homo sapiens
catgcatcacggatcaataga

SEQ ID NO: 6713399 - DNA, 15 bp, Homo sapiens
catgcatcatcagcc

SEQ ID NO: 6713400 - DNA, 14 bp, Homo sapiens
catgcatcatctca

SEQ ID NO: 6713401 - DNA, 22 bp, Homo sapiens
catgcatccatttactgacact

SEQ ID NO: 6713402 - DNA, 15 bp, Homo sapiens
catgcatcctcccct

SEQ ID NO: 6713403 - DNA, 15 bp, Homo sapiens
catgcatctccacct

SEQ ID NO: 6713404 - DNA, 18 bp, Homo sapiens
catgcatctccacctgct

SEQ ID NO: 6713405 - DNA, 15 bp, Homo sapiens
catgcatctgtttat

SEQ ID NO: 6713406 - DNA, 17 bp, Homo sapiens
catgcatcttactgaag

SEQ ID NO: 6713407 - DNA, 14 bp, Homo sapiens
catgcatgacactt

SEQ ID NO: 6713408 - DNA, 14 bp, Homo sapiens
catgcatgcaaatg

SEQ ID NO: 6713409 - DNA, 19 bp, Homo sapiens
catgcatgcaaatgagctc

SEQ ID NO: 6713410 - DNA, 14 bp, Homo sapiens
catgcatgcagcgc

SEQ ID NO: 6713411 - DNA, 17 bp, Homo sapiens
catgcatggaaattccc

SEQ ID NO: 6713412 - DNA, 21 bp, Homo sapiens
catgcatggcctcccagccac

SEQ ID NO: 6713413 - DNA, 17 bp, Homo sapiens
catgcatgtcctgtaaa

SEQ ID NO: 6713414 - DNA, 12 bp, Homo sapiens
catgcatgtctg

SEQ ID NO: 6713415 - DNA, 13 bp, Homo sapiens
catgcatgtctgc

SEQ ID NO: 6713416 - DNA, 19 bp, Homo sapiens
catgcatgttctcctctat

SEQ ID NO: 6713417 - DNA, 23 bp, Homo sapiens
catgcatgttggggtttccttta

SEQ ID NO: 6713418 - DNA, 22 bp, Homo sapiens
catgcatgttttatgtgcactc

SEQ ID NO: 6713419 - DNA, 23 bp, Homo sapiens
catgcatgttttatgtgcactca

SEQ ID NO: 6713420 - DNA, 17 bp, Homo sapiens
catgcattactgcatgc

SEQ ID NO: 6713421 - DNA, 15 bp, Homo sapiens
catgcattatatacc

SEQ ID NO: 6713422 - DNA, 17 bp, Homo sapiens
catgcattcagatctga

SEQ ID NO: 6713423 - DNA, 19 bp, Homo sapiens
catgcattctagtgcagaa

SEQ ID NO: 6713424 - DNA, 13 bp, Homo sapiens
catgcattgagct

SEQ ID NO: 6713425 - DNA, 14 bp, Homo sapiens
catgcattgagctg

SEQ ID NO: 6713426 - DNA, 16 bp, Homo sapiens
catgcattgagctgcc

SEQ ID NO: 6713427 - DNA, 15 bp, Homo sapiens
catgcattgtaatca

SEQ ID NO: 6713428 - DNA, 15 bp, Homo sapiens
catgcattgtcctct

SEQ ID NO: 6713429 - DNA, 11 bp, Homo sapiens
catgcattgtt

SEQ ID NO: 6713430 - DNA, 12 bp, Homo sapiens
catgcattgttg

SEQ ID NO: 6713431 - DNA, 22 bp, Homo sapiens
catgcattgttgaggtggtctg

SEQ ID NO: 6713432 - DNA, 14 bp, Homo sapiens
catgcatttcaagc

SEQ ID NO: 6713433 - DNA, 21 bp, Homo sapiens
catgcattttatcagacaatt

SEQ ID NO: 6713434 - DNA, 16 bp, Homo sapiens
catgcattttcttgta

SEQ ID NO: 6713435 - DNA, 19 bp, Homo sapiens
catgcattttgcagcagtg

SEQ ID NO: 6713436 - DNA, 19 bp, Homo sapiens
catgccaaagcaaaagaag

SEQ ID NO: 6713437 - DNA, 16 bp, Homo sapiens
catgccaacaagaatg

SEQ ID NO: 6713438 - DNA, 17 bp, Homo sapiens
catgccaacaagaatgc

SEQ ID NO: 6713439 - DNA, 21 bp, Homo sapiens
catgccaacaagaatgcattg

SEQ ID NO: 6713440 - DNA, 20 bp, Homo sapiens
catgccaatagttgctgtcc

SEQ ID NO: 6713441 - DNA, 16 bp, Homo sapiens
catgccaatgtccagg

SEQ ID NO: 6713442 - DNA, 18 bp, Homo sapiens
catgccaatgtccaggtc

SEQ ID NO: 6713443 - DNA, 21 bp, Homo sapiens
catgccacaaggacttcctgt

SEQ ID NO: 6713444 - DNA, 15 bp, Homo sapiens
catgccacagtggta

SEQ ID NO: 6713445 - DNA, 13 bp, Homo sapiens
catgccaccctca

SEQ ID NO: 6713446 - DNA, 16 bp, Homo sapiens
catgccaccctctcca

SEQ ID NO: 6713447 - DNA, 20 bp, Homo sapiens
catgccacgccccgtgtctg

SEQ ID NO: 6713448 - DNA, 22 bp, Homo sapiens
catgccacgccccgtgtctgga

SEQ ID NO: 6713449 - DNA, 19 bp, Homo sapiens
catgccacgttccacagtt

SEQ ID NO: 6713450 - DNA, 12 bp, Homo sapiens
catgccactgcc

SEQ ID NO: 6713451 - DNA, 16 bp, Homo sapiens
catgccactgccaggc

SEQ ID NO: 6713452 - DNA, 23 bp, Homo sapiens
catgccactgccaggcacctggc

SEQ ID NO: 6713453 - DNA, 22 bp, Homo sapiens
catgccagaaggaatcttctca

SEQ ID NO: 6713454 - DNA, 19 bp, Homo sapiens
catgccagattctgcctct

SEQ ID NO: 6713455 - DNA, 21 bp, Homo sapiens
catgccagattctgcctctct

SEQ ID NO: 6713456 - DNA, 20 bp, Homo sapiens
catgccagcgcagcgccagg

SEQ ID NO: 6713457 - DNA, 21 bp, Homo sapiens
catgccagctacttcctcctc

SEQ ID NO: 6713458 - DNA, 16 bp, Homo sapiens
catgccagctggcctt

SEQ ID NO: 6713459 - DNA, 22 bp, Homo sapiens
catgccagctggcctttgtaag

SEQ ID NO: 6713460 - DNA, 19 bp, Homo sapiens
catgccagcttatctcagg

SEQ ID NO: 6713461 - DNA, 20 bp, Homo sapiens
catgccagcttatctcaggg

SEQ ID NO: 6713462 - DNA, 21 bp, Homo sapiens
catgccaggacccgccagccc

SEQ ID NO: 6713463 - DNA, 16 bp, Homo sapiens
catgccaggctaattt

SEQ ID NO: 6713464 - DNA, 14 bp, Homo sapiens
catgccaggctggg

SEQ ID NO: 6713465 - DNA, 19 bp, Homo sapiens
catgccagtaacaggctca

SEQ ID NO: 6713466 - DNA, 14 bp, Homo sapiens
catgccagtatttt

SEQ ID NO: 6713467 - DNA, 17 bp, Homo sapiens
catgccagtgacacttc

SEQ ID NO: 6713468 - DNA, 12 bp, Homo sapiens
catgccagtgca

SEQ ID NO: 6713469 - DNA, 16 bp, Homo sapiens
catgccagtgccttat

SEQ ID NO: 6713470 - DNA, 19 bp, Homo sapiens
catgccataagcaggagtt

SEQ ID NO: 6713471 - DNA, 18 bp, Homo sapiens
catgccatctccaccctg

SEQ ID NO: 6713472 - DNA, 14 bp, Homo sapiens
catgccatctgttt

SEQ ID NO: 6713473 - DNA, 15 bp, Homo sapiens
catgccatgtctgag

SEQ ID NO: 6713474 - DNA, 17 bp, Homo sapiens
catgccatttgtactga

SEQ ID NO: 6713475 - DNA, 17 bp, Homo sapiens
catgcccaaatataaca

SEQ ID NO: 6713476 - DNA, 13 bp, Homo sapiens
catgcccaaccta

SEQ ID NO: 6713477 - DNA, 18 bp, Homo sapiens
catgcccaccgcccctgg

SEQ ID NO: 6713478 - DNA, 13 bp, Homo sapiens
catgcccacgccc

SEQ ID NO: 6713479 - DNA, 20 bp, Homo sapiens
catgcccacgcccctcccca

SEQ ID NO: 6713480 - DNA, 19 bp, Homo sapiens
catgcccacgttctttccc

SEQ ID NO: 6713481 - DNA, 13 bp, Homo sapiens
catgcccactgcc

SEQ ID NO: 6713482 - DNA, 18 bp, Homo sapiens
catgcccactgctggtgc

SEQ ID NO: 6713483 - DNA, 21 bp, Homo sapiens
catgcccactgctggtgccag

SEQ ID NO: 6713484 - DNA, 22 bp, Homo sapiens
catgcccactgctggtgccagg

SEQ ID NO: 6713485 - DNA, 11 bp, Homo sapiens
catgcccagag

SEQ ID NO: 6713486 - DNA, 14 bp, Homo sapiens
catgcccagagacc

SEQ ID NO: 6713487 - DNA, 12 bp, Homo sapiens
catgcccagcta

SEQ ID NO: 6713488 - DNA, 20 bp, Homo sapiens
catgcccagctaatttttgt

SEQ ID NO: 6713489 - DNA, 14 bp, Homo sapiens
catgcccagctctc

SEQ ID NO: 6713490 - DNA, 17 bp, Homo sapiens
catgcccagctctctga

SEQ ID NO: 6713491 - DNA, 21 bp, Homo sapiens
catgcccatcccagtgtccta

SEQ ID NO: 6713492 - DNA, 13 bp, Homo sapiens
catgccccaccca

SEQ ID NO: 6713493 - DNA, 17 bp, Homo sapiens
catgccccacccacccc

SEQ ID NO: 6713494 - DNA, 19 bp, Homo sapiens
catgccccacccacccctc

SEQ ID NO: 6713495 - DNA, 15 bp, Homo sapiens
catgccccacccccc

SEQ ID NO: 6713496 - DNA, 16 bp, Homo sapiens
catgccccacccccct

SEQ ID NO: 6713497 - DNA, 20 bp, Homo sapiens
catgccccacccccctcctc

SEQ ID NO: 6713498 - DNA, 21 bp, Homo sapiens
catgccccacccccctcctcc

SEQ ID NO: 6713499 - DNA, 15 bp, Homo sapiens
catgccccagctctg

SEQ ID NO: 6713500 - DNA, 18 bp, Homo sapiens
catgccccagctctggat

SEQ ID NO: 6713501 - DNA, 13 bp, Homo sapiens
catgccccaggct

SEQ ID NO: 6713502 - DNA, 18 bp, Homo sapiens
catgccccaggctctcgc

SEQ ID NO: 6713503 - DNA, 21 bp, Homo sapiens
catgcccccaccctcccctca

SEQ ID NO: 6713504 - DNA, 15 bp, Homo sapiens
catgcccccgccacc

SEQ ID NO: 6713505 - DNA, 18 bp, Homo sapiens
catgcccccgccacctcc

SEQ ID NO: 6713506 - DNA, 15 bp, Homo sapiens
catgccccctccctt

SEQ ID NO: 6713507 - DNA, 21 bp, Homo sapiens
catgccccctcccttcacagg

SEQ ID NO: 6713508 - DNA, 17 bp, Homo sapiens
catgccccctcgtgcca

SEQ ID NO: 6713509 - DNA, 19 bp, Homo sapiens
catgccccctcgtgccagt

SEQ ID NO: 6713510 - DNA, 14 bp, Homo sapiens
catgccccctgcag

SEQ ID NO: 6713511 - DNA, 11 bp, Homo sapiens
catgccccctt

SEQ ID NO: 6713512 - DNA, 17 bp, Homo sapiens
catgcccccttcgctcc

SEQ ID NO: 6713513 - DNA, 16 bp, Homo sapiens
catgccccgccatggt

SEQ ID NO: 6713514 - DNA, 17 bp, Homo sapiens
catgccccggccacctc

SEQ ID NO: 6713515 - DNA, 18 bp, Homo sapiens
catgccccggctgcacac

SEQ ID NO: 6713516 - DNA, 21 bp, Homo sapiens
catgccccgtttttgagactg

SEQ ID NO: 6713517 - DNA, 15 bp, Homo sapiens
catgcccctccccca

SEQ ID NO: 6713518 - DNA, 18 bp, Homo sapiens
catgcccctcccccagct

SEQ ID NO: 6713519 - DNA, 22 bp, Homo sapiens
catgcccctcccccagctgcgt

SEQ ID NO: 6713520 - DNA, 15 bp, Homo sapiens
catgcccctcccctc

SEQ ID NO: 6713521 - DNA, 16 bp, Homo sapiens
catgcccctcccctcc

SEQ ID NO: 6713522 - DNA, 17 bp, Homo sapiens
catgcccctcttagaag

SEQ ID NO: 6713523 - DNA, 19 bp, Homo sapiens
catgcccctcttagaagaa

SEQ ID NO: 6713524 - DNA, 15 bp, Homo sapiens
catgcccctgacaga

SEQ ID NO: 6713525 - DNA, 18 bp, Homo sapiens
catgcccgagtccgccca

SEQ ID NO: 6713526 - DNA, 19 bp, Homo sapiens
catgcccgctgtcccaggg

SEQ ID NO: 6713527 - DNA, 17 bp, Homo sapiens
catgcccggctaatttt

SEQ ID NO: 6713528 - DNA, 21 bp, Homo sapiens
catgccctaagagtgtcactg

SEQ ID NO: 6713529 - DNA, 12 bp, Homo sapiens
catgccctagac

SEQ ID NO: 6713530 - DNA, 21 bp, Homo sapiens
catgccctccctgctgccagg

SEQ ID NO: 6713531 - DNA, 22 bp, Homo sapiens
catgccctcccttctccctgga

SEQ ID NO: 6713532 - DNA, 13 bp, Homo sapiens
catgccctctcag

SEQ ID NO: 6713533 - DNA, 23 bp, Homo sapiens
catgccctctctcgggagcccta

SEQ ID NO: 6713534 - DNA, 13 bp, Homo sapiens
catgccctctctg

SEQ ID NO: 6713535 - DNA, 22 bp, Homo sapiens
catgccctctctgagtctggac

SEQ ID NO: 6713536 - DNA, 23 bp, Homo sapiens
catgccctctctgagtctggact

SEQ ID NO: 6713537 - DNA, 20 bp, Homo sapiens
catgccctgccttgtccctc

SEQ ID NO: 6713538 - DNA, 19 bp, Homo sapiens
catgccctggaccagccgc

SEQ ID NO: 6713539 - DNA, 13 bp, Homo sapiens
catgccctgggat

SEQ ID NO: 6713540 - DNA, 22 bp, Homo sapiens
catgccctgggatgcctcacca

SEQ ID NO: 6713541 - DNA, 22 bp, Homo sapiens
catgccgagtgccccagaaatg

SEQ ID NO: 6713542 - DNA, 15 bp, Homo sapiens
catgccgccgcagct

SEQ ID NO: 6713543 - DNA, 20 bp, Homo sapiens
catgccgcgggcggccaggc

SEQ ID NO: 6713544 - DNA, 21 bp, Homo sapiens
catgccgcgggcggccaggca

SEQ ID NO: 6713545 - DNA, 22 bp, Homo sapiens
catgccgcgggcggccaggcaa

SEQ ID NO: 6713546 - DNA, 14 bp, Homo sapiens
catgccgggcgcag

SEQ ID NO: 6713547 - DNA, 18 bp, Homo sapiens
catgccggtacacagcca

SEQ ID NO: 6713548 - DNA, 19 bp, Homo sapiens
catgccggtacacagccag

SEQ ID NO: 6713549 - DNA, 20 bp, Homo sapiens
catgccggtacacagccagt

SEQ ID NO: 6713550 - DNA, 17 bp, Homo sapiens
catgcctaaagcccatt

SEQ ID NO: 6713551 - DNA, 19 bp, Homo sapiens
catgcctaaagcccattgc

SEQ ID NO: 6713552 - DNA, 22 bp, Homo sapiens
catgcctaaagcccattgctgc

SEQ ID NO: 6713553 - DNA, 22 bp, Homo sapiens
catgcctacattagtgagattt

SEQ ID NO: 6713554 - DNA, 12 bp, Homo sapiens
catgcctagtta

SEQ ID NO: 6713555 - DNA, 16 bp, Homo sapiens
catgcctcagaagtgc

SEQ ID NO: 6713556 - DNA, 18 bp, Homo sapiens
catgcctcagaagtgcat

SEQ ID NO: 6713557 - DNA, 21 bp, Homo sapiens
catgcctcagccagccctgga

SEQ ID NO: 6713558 - DNA, 19 bp, Homo sapiens
catgcctcagccctgaccc

SEQ ID NO: 6713559 - DNA, 13 bp, Homo sapiens
catgcctcagttt

SEQ ID NO: 6713560 - DNA, 14 bp, Homo sapiens
catgcctcagtttc

SEQ ID NO: 6713561 - DNA, 19 bp, Homo sapiens
catgcctcatgccacacct

SEQ ID NO: 6713562 - DNA, 15 bp, Homo sapiens
catgcctcccaggcc

SEQ ID NO: 6713563 - DNA, 12 bp, Homo sapiens
catgcctccctg

SEQ ID NO: 6713564 - DNA, 23 bp, Homo sapiens
catgcctccctgggccacctcct

SEQ ID NO: 6713565 - DNA, 14 bp, Homo sapiens
catgcctcctcctg

SEQ ID NO: 6713566 - DNA, 16 bp, Homo sapiens
catgcctcctcctgcc

SEQ ID NO: 6713567 - DNA, 19 bp, Homo sapiens
catgcctcctcctgccctc

SEQ ID NO: 6713568 - DNA, 22 bp, Homo sapiens
catgcctcgctcagtcagtgca

SEQ ID NO: 6713569 - DNA, 24 bp, Homo sapiens
catgcctcgctcagtcagtgcact

SEQ ID NO: 6713570 - DNA, 14 bp, Homo sapiens
catgcctctctcag

SEQ ID NO: 6713571 - DNA, 18 bp, Homo sapiens
catgcctctctcaggcca

SEQ ID NO: 6713572 - DNA, 21 bp, Homo sapiens
catgcctctgaggccagcctg

SEQ ID NO: 6713573 - DNA, 22 bp, Homo sapiens
catgcctctgaggccagcctgg

SEQ ID NO: 6713574 - DNA, 23 bp, Homo sapiens
catgcctctgatatgggactgag

SEQ ID NO: 6713575 - DNA, 20 bp, Homo sapiens
catgcctctgtagagagcag

SEQ ID NO: 6713576 - DNA, 21 bp, Homo sapiens
catgcctgagaatgcctaggc

SEQ ID NO: 6713577 - DNA, 21 bp, Homo sapiens
catgcctgagagacatggctt

SEQ ID NO: 6713578 - DNA, 16 bp, Homo sapiens
catgcctgagggtgga

SEQ ID NO: 6713579 - DNA, 20 bp, Homo sapiens
catgcctgagggtggagact

SEQ ID NO: 6713580 - DNA, 15 bp, Homo sapiens
catgcctgattttaa

SEQ ID NO: 6713581 - DNA, 12 bp, Homo sapiens
catgcctgccaa

SEQ ID NO: 6713582 - DNA, 14 bp, Homo sapiens
catgcctgccaaag

SEQ ID NO: 6713583 - DNA, 20 bp, Homo sapiens
catgcctgccaaagacgtgt

SEQ ID NO: 6713584 - DNA, 20 bp, Homo sapiens
catgcctgccccaaacaaat

SEQ ID NO: 6713585 - DNA, 20 bp, Homo sapiens
catgcctgcccccctcatct

SEQ ID NO: 6713586 - DNA, 14 bp, Homo sapiens
catgcctgctccct

SEQ ID NO: 6713587 - DNA, 17 bp, Homo sapiens
catgcctgctccctgtc

SEQ ID NO: 6713588 - DNA, 19 bp, Homo sapiens
catgcctgctccctgtctg

SEQ ID NO: 6713589 - DNA, 23 bp, Homo sapiens
catgcctgctccctgtctgtgtc

SEQ ID NO: 6713590 - DNA, 13 bp, Homo sapiens
catgcctggatgg

SEQ ID NO: 6713591 - DNA, 21 bp, Homo sapiens
catgcctggatggggctgcac

SEQ ID NO: 6713592 - DNA, 11 bp, Homo sapiens
catgcctggcc

SEQ ID NO: 6713593 - DNA, 18 bp, Homo sapiens
catgcctggcccccctcc

SEQ ID NO: 6713594 - DNA, 23 bp, Homo sapiens
catgcctggcccccctccaggca

SEQ ID NO: 6713595 - DNA, 14 bp, Homo sapiens
catgcctggcccgg

SEQ ID NO: 6713596 - DNA, 13 bp, Homo sapiens
catgcctggccct

SEQ ID NO: 6713597 - DNA, 22 bp, Homo sapiens
catgcctggcccttgccggggc

SEQ ID NO: 6713598 - DNA, 13 bp, Homo sapiens
catgcctggcttc

SEQ ID NO: 6713599 - DNA, 14 bp, Homo sapiens
catgcctggcttcg

SEQ ID NO: 6713600 - DNA, 20 bp, Homo sapiens
catgcctgggaatcctgctg

SEQ ID NO: 6713601 - DNA, 19 bp, Homo sapiens
catgcctggggtggaggct

SEQ ID NO: 6713602 - DNA, 16 bp, Homo sapiens
catgcctggtattttc

SEQ ID NO: 6713603 - DNA, 17 bp, Homo sapiens
catgcctgtaatcccag

SEQ ID NO: 6713604 - DNA, 18 bp, Homo sapiens
catgcctgtaatcccaga

SEQ ID NO: 6713605 - DNA, 21 bp, Homo sapiens
catgcctgtagctttcctggt

SEQ ID NO: 6713606 - DNA, 16 bp, Homo sapiens
catgcctgtccagcct

SEQ ID NO: 6713607 - DNA, 20 bp, Homo sapiens
catgcctgtccagcctgggc

SEQ ID NO: 6713608 - DNA, 23 bp, Homo sapiens
catgcctgtccagcctgggcagc

SEQ ID NO: 6713609 - DNA, 14 bp, Homo sapiens
catgcctgtcctga

SEQ ID NO: 6713610 - DNA, 16 bp, Homo sapiens
catgcctgtcctgaaa

SEQ ID NO: 6713611 - DNA, 17 bp, Homo sapiens
catgcctgtcctgaaag

SEQ ID NO: 6713612 - DNA, 14 bp, Homo sapiens
catgcctgtggctg

SEQ ID NO: 6713613 - DNA, 19 bp, Homo sapiens
catgcctgtggctgcgctt

SEQ ID NO: 6713614 - DNA, 23 bp, Homo sapiens
catgcctgtgtgacatcagtggc

SEQ ID NO: 6713615 - DNA, 16 bp, Homo sapiens
catgccttaaatttgt

SEQ ID NO: 6713616 - DNA, 17 bp, Homo sapiens
catgccttcataaatta

SEQ ID NO: 6713617 - DNA, 10 bp, Homo sapiens
catgccttgg

SEQ ID NO: 6713618 - DNA, 19 bp, Homo sapiens
catgcctttaatgttgccc

SEQ ID NO: 6713619 - DNA, 15 bp, Homo sapiens
catgcgaggggccag

SEQ ID NO: 6713620 - DNA, 21 bp, Homo sapiens
catgcgatgacacttgtacaa

SEQ ID NO: 6713621 - DNA, 18 bp, Homo sapiens
catgcgatgttagtttta

SEQ ID NO: 6713622 - DNA, 13 bp, Homo sapiens
catgcgcacaagg

SEQ ID NO: 6713623 - DNA, 16 bp, Homo sapiens
catgcgcagaggccag

SEQ ID NO: 6713624 - DNA, 17 bp, Homo sapiens
catgcgcagaggccagt

SEQ ID NO: 6713625 - DNA, 13 bp, Homo sapiens
catgcgcaggctc

SEQ ID NO: 6713626 - DNA, 19 bp, Homo sapiens
catgcgcgcgctctctctc

SEQ ID NO: 6713627 - DNA, 14 bp, Homo sapiens
catgcgctcagggc

SEQ ID NO: 6713628 - DNA, 14 bp, Homo sapiens
catgcgctcctggc

SEQ ID NO: 6713629 - DNA, 17 bp, Homo sapiens
catgcggcccagccatg

SEQ ID NO: 6713630 - DNA, 15 bp, Homo sapiens
catgcggcccagccc

SEQ ID NO: 6713631 - DNA, 22 bp, Homo sapiens
catgcggcccagcccggctccc

SEQ ID NO: 6713632 - DNA, 21 bp, Homo sapiens
catgcggccggcctggggccg

SEQ ID NO: 6713633 - DNA, 23 bp, Homo sapiens
catgcggctgcccacgctcctgc

SEQ ID NO: 6713634 - DNA, 14 bp, Homo sapiens
catgcggtagccag

SEQ ID NO: 6713635 - DNA, 23 bp, Homo sapiens
catgcggtttccaaggtgcacat

SEQ ID NO: 6713636 - DNA, 23 bp, Homo sapiens
catgcgtccactttcccttcccc

SEQ ID NO: 6713637 - DNA, 17 bp, Homo sapiens
catgcgtctctggccct

SEQ ID NO: 6713638 - DNA, 17 bp, Homo sapiens
catgcgtgtgtcaggga

SEQ ID NO: 6713639 - DNA, 16 bp, Homo sapiens
catgctaaaattctat

SEQ ID NO: 6713640 - DNA, 16 bp, Homo sapiens
catgctaaattattat

SEQ ID NO: 6713641 - DNA, 17 bp, Homo sapiens
catgctaacctctctga

SEQ ID NO: 6713642 - DNA, 16 bp, Homo sapiens
catgctaagcaagcta

SEQ ID NO: 6713643 - DNA, 22 bp, Homo sapiens
catgctaagcaagctaacctta

SEQ ID NO: 6713644 - DNA, 14 bp, Homo sapiens
catgctaattatat

SEQ ID NO: 6713645 - DNA, 20 bp, Homo sapiens
catgctacacactgcatgtt

SEQ ID NO: 6713646 - DNA, 22 bp, Homo sapiens
catgctacctgatcccactcct

SEQ ID NO: 6713647 - DNA, 22 bp, Homo sapiens
catgctacttggggacataatt

SEQ ID NO: 6713648 - DNA, 22 bp, Homo sapiens
catgctagcatgggtattttta

SEQ ID NO: 6713649 - DNA, 23 bp, Homo sapiens
catgctagcatgggtatttttat

SEQ ID NO: 6713650 - DNA, 17 bp, Homo sapiens
catgctatgagttttct

SEQ ID NO: 6713651 - DNA, 20 bp, Homo sapiens
catgctatgagttttctcct

SEQ ID NO: 6713652 - DNA, 23 bp, Homo sapiens
catgctatgctgaagacattcaa

SEQ ID NO: 6713653 - DNA, 16 bp, Homo sapiens
catgctcaaccactgt

SEQ ID NO: 6713654 - DNA, 19 bp, Homo sapiens
catgctcaacccccctccc

SEQ ID NO: 6713655 - DNA, 23 bp, Homo sapiens
catgctcaacccccctcccagac

SEQ ID NO: 6713656 - DNA, 15 bp, Homo sapiens
catgctcagccctga

SEQ ID NO: 6713657 - DNA, 20 bp, Homo sapiens
catgctcagccctgactggt

SEQ ID NO: 6713658 - DNA, 17 bp, Homo sapiens
catgctcagcccttcct

SEQ ID NO: 6713659 - DNA, 21 bp, Homo sapiens
catgctcagcccttcctagaa

SEQ ID NO: 6713660 - DNA, 15 bp, Homo sapiens
catgctcagctcagc

SEQ ID NO: 6713661 - DNA, 14 bp, Homo sapiens
catgctcagtgcct

SEQ ID NO: 6713662 - DNA, 15 bp, Homo sapiens
catgctcagtgcctt

SEQ ID NO: 6713663 - DNA, 16 bp, Homo sapiens
catgctcagtgccttt

SEQ ID NO: 6713664 - DNA, 19 bp, Homo sapiens
catgctcatctgctggtcc

SEQ ID NO: 6713665 - DNA, 20 bp, Homo sapiens
catgctcatgtatatttagt

SEQ ID NO: 6713666 - DNA, 13 bp, Homo sapiens
catgctcccaact

SEQ ID NO: 6713667 - DNA, 15 bp, Homo sapiens
catgctcctcactgc

SEQ ID NO: 6713668 - DNA, 19 bp, Homo sapiens
catgctcctcactgcccgc

SEQ ID NO: 6713669 - DNA, 20 bp, Homo sapiens
catgctcctcactgcccgca

SEQ ID NO: 6713670 - DNA, 13 bp, Homo sapiens
catgctcctctgc

SEQ ID NO: 6713671 - DNA, 16 bp, Homo sapiens
catgctcctctgcctg

SEQ ID NO: 6713672 - DNA, 17 bp, Homo sapiens
catgctcctctgcctgt

SEQ ID NO: 6713673 - DNA, 20 bp, Homo sapiens
catgctcctctgcctgtgcc

SEQ ID NO: 6713674 - DNA, 16 bp, Homo sapiens
catgctcctcttcccc

SEQ ID NO: 6713675 - DNA, 17 bp, Homo sapiens
catgctcctcttcccca

SEQ ID NO: 6713676 - DNA, 13 bp, Homo sapiens
catgctcctggcc

SEQ ID NO: 6713677 - DNA, 12 bp, Homo sapiens
catgctccttac

SEQ ID NO: 6713678 - DNA, 14 bp, Homo sapiens
catgctccttgcct

SEQ ID NO: 6713679 - DNA, 22 bp, Homo sapiens
catgctccttgcctctgctctg

SEQ ID NO: 6713680 - DNA, 22 bp, Homo sapiens
catgctctcatatatattttaa

SEQ ID NO: 6713681 - DNA, 13 bp, Homo sapiens
catgctctctcac

SEQ ID NO: 6713682 - DNA, 14 bp, Homo sapiens
catgctctctgcag

SEQ ID NO: 6713683 - DNA, 16 bp, Homo sapiens
catgctctctgcagcc

SEQ ID NO: 6713684 - DNA, 19 bp, Homo sapiens
catgctctctgcagccagc

SEQ ID NO: 6713685 - DNA, 20 bp, Homo sapiens
catgctctctgcagccagcc

SEQ ID NO: 6713686 - DNA, 21 bp, Homo sapiens
catgctctctgcagccagccc

SEQ ID NO: 6713687 - DNA, 23 bp, Homo sapiens
catgctctctgcagccagcccag

SEQ ID NO: 6713688 - DNA, 22 bp, Homo sapiens
catgctctgcagcattgaagta

SEQ ID NO: 6713689 - DNA, 20 bp, Homo sapiens
catgctctgcagtcctggcc

SEQ ID NO: 6713690 - DNA, 12 bp, Homo sapiens
catgctctgccc

SEQ ID NO: 6713691 - DNA, 13 bp, Homo sapiens
catgctctgcccc

SEQ ID NO: 6713692 - DNA, 17 bp, Homo sapiens
catgctctggaagcctg

SEQ ID NO: 6713693 - DNA, 19 bp, Homo sapiens
catgctctggaagcctgga

SEQ ID NO: 6713694 - DNA, 10 bp, Homo sapiens
catgctcttt

SEQ ID NO: 6713695 - DNA, 13 bp, Homo sapiens
catgctctttttc

SEQ ID NO: 6713696 - DNA, 13 bp, Homo sapiens
catgctctttttt

SEQ ID NO: 6713697 - DNA, 16 bp, Homo sapiens
catgctgaagccaaag

SEQ ID NO: 6713698 - DNA, 20 bp, Homo sapiens
catgctgaagccaaagccaa

SEQ ID NO: 6713699 - DNA, 19 bp, Homo sapiens
catgctgaaggctgaaaga

SEQ ID NO: 6713700 - DNA, 13 bp, Homo sapiens
catgctgaaggga

SEQ ID NO: 6713701 - DNA, 12 bp, Homo sapiens
catgctgaatgc

SEQ ID NO: 6713702 - DNA, 18 bp, Homo sapiens
catgctgaatgccccctg

SEQ ID NO: 6713703 - DNA, 18 bp, Homo sapiens
catgctgaattattttgt

SEQ ID NO: 6713704 - DNA, 19 bp, Homo sapiens
catgctgactgtcctctcc

SEQ ID NO: 6713705 - DNA, 15 bp, Homo sapiens
catgctgacttgcag

SEQ ID NO: 6713706 - DNA, 17 bp, Homo sapiens
catgctgagacatccct

SEQ ID NO: 6713707 - DNA, 19 bp, Homo sapiens
catgctgagacatccctca

SEQ ID NO: 6713708 - DNA, 18 bp, Homo sapiens
catgctgaggttttgaat

SEQ ID NO: 6713709 - DNA, 21 bp, Homo sapiens
catgctgaggttttgaataaa

SEQ ID NO: 6713710 - DNA, 14 bp, Homo sapiens
catgctgagtctcc

SEQ ID NO: 6713711 - DNA, 20 bp, Homo sapiens
catgctgagtctcccaaggc

SEQ ID NO: 6713712 - DNA, 15 bp, Homo sapiens
catgctgcagtgggt

SEQ ID NO: 6713713 - DNA, 15 bp, Homo sapiens
catgctgccaatatc

SEQ ID NO: 6713714 - DNA, 21 bp, Homo sapiens
catgctgccaatatcctaata

SEQ ID NO: 6713715 - DNA, 22 bp, Homo sapiens
catgctgccaatatcctaataa

SEQ ID NO: 6713716 - DNA, 22 bp, Homo sapiens
catgctgccaggaaacaaggga

SEQ ID NO: 6713717 - DNA, 19 bp, Homo sapiens
catgctgccattcttgatt

SEQ ID NO: 6713718 - DNA, 12 bp, Homo sapiens
catgctgcccac

SEQ ID NO: 6713719 - DNA, 16 bp, Homo sapiens
catgctgcccaccccc

SEQ ID NO: 6713720 - DNA, 19 bp, Homo sapiens
catgctgcccaccccctgc

SEQ ID NO: 6713721 - DNA, 20 bp, Homo sapiens
catgctgcccaccccctgct

SEQ ID NO: 6713722 - DNA, 21 bp, Homo sapiens
catgctgcccaccccctgctg

SEQ ID NO: 6713723 - DNA, 12 bp, Homo sapiens
catgctgccctg

SEQ ID NO: 6713724 - DNA, 13 bp, Homo sapiens
catgctgccctgt

SEQ ID NO: 6713725 - DNA, 14 bp, Homo sapiens
catgctgccctgtg

SEQ ID NO: 6713726 - DNA, 16 bp, Homo sapiens
catgctgccctgtgag

SEQ ID NO: 6713727 - DNA, 15 bp, Homo sapiens
catgctgcctgccat

SEQ ID NO: 6713728 - DNA, 16 bp, Homo sapiens
catgctgcctgccatg

SEQ ID NO: 6713729 - DNA, 14 bp, Homo sapiens
catgctgcctgcct

SEQ ID NO: 6713730 - DNA, 15 bp, Homo sapiens
catgctgcctgcctc

SEQ ID NO: 6713731 - DNA, 16 bp, Homo sapiens
catgctgcctgcctcc

SEQ ID NO: 6713732 - DNA, 20 bp, Homo sapiens
catgctgcctgcctccggcc

SEQ ID NO: 6713733 - DNA, 23 bp, Homo sapiens
catgctgcctgcctccggccctg

SEQ ID NO: 6713734 - DNA, 13 bp, Homo sapiens
catgctgcctggc

SEQ ID NO: 6713735 - DNA, 16 bp, Homo sapiens
catgctgcctggcaca

SEQ ID NO: 6713736 - DNA, 22 bp, Homo sapiens
catgctgcctggcacagaccag

SEQ ID NO: 6713737 - DNA, 17 bp, Homo sapiens
catgctgccttcaggga

SEQ ID NO: 6713738 - DNA, 22 bp, Homo sapiens
catgctgcgcatgttttcttca

SEQ ID NO: 6713739 - DNA, 18 bp, Homo sapiens
catgctgctagatcttta

SEQ ID NO: 6713740 - DNA, 13 bp, Homo sapiens
catgctgctatga

SEQ ID NO: 6713741 - DNA, 22 bp, Homo sapiens
catgctgctctggtgcacgcct

SEQ ID NO: 6713742 - DNA, 14 bp, Homo sapiens
catgctgctgggga

SEQ ID NO: 6713743 - DNA, 16 bp, Homo sapiens
catgctgctggggaag

SEQ ID NO: 6713744 - DNA, 22 bp, Homo sapiens
catgctgctggggaagacagtg

SEQ ID NO: 6713745 - DNA, 18 bp, Homo sapiens
catgctgctttgcacaca

SEQ ID NO: 6713746 - DNA, 22 bp, Homo sapiens
catgctggaaaataatactgct

SEQ ID NO: 6713747 - DNA, 23 bp, Homo sapiens
catgctggaaaataatactgctg

SEQ ID NO: 6713748 - DNA, 13 bp, Homo sapiens
catgctggaaata

SEQ ID NO: 6713749 - DNA, 19 bp, Homo sapiens
catgctggaaataaaacag

SEQ ID NO: 6713750 - DNA, 23 bp, Homo sapiens
catgctggaacctgcaaaaaata

SEQ ID NO: 6713751 - DNA, 20 bp, Homo sapiens
catgctggacaggtctggga

SEQ ID NO: 6713752 - DNA, 14 bp, Homo sapiens
catgctggagcctg

SEQ ID NO: 6713753 - DNA, 16 bp, Homo sapiens
catgctggagcctgtg

SEQ ID NO: 6713754 - DNA, 18 bp, Homo sapiens
catgctggagggaggctg

SEQ ID NO: 6713755 - DNA, 20 bp, Homo sapiens
catgctggagtacccagcct

SEQ ID NO: 6713756 - DNA, 23 bp, Homo sapiens
catgctggcggcgcagagggaag

SEQ ID NO: 6713757 - DNA, 19 bp, Homo sapiens
catgctggctcccagggcc

SEQ ID NO: 6713758 - DNA, 14 bp, Homo sapiens
catgctggctcctg

SEQ ID NO: 6713759 - DNA, 20 bp, Homo sapiens
catgctggctgaagaggacc

SEQ ID NO: 6713760 - DNA, 14 bp, Homo sapiens
catgctggctgggg

SEQ ID NO: 6713761 - DNA, 23 bp, Homo sapiens
catgctgggaagacgcctgagct

SEQ ID NO: 6713762 - DNA, 19 bp, Homo sapiens
catgctgggatttccaact

SEQ ID NO: 6713763 - DNA, 20 bp, Homo sapiens
catgctggggcaagtccctg

SEQ ID NO: 6713764 - DNA, 23 bp, Homo sapiens
catgctgggtctgaggcccctgc

SEQ ID NO: 6713765 - DNA, 19 bp, Homo sapiens
catgctgggttctgcacag

SEQ ID NO: 6713766 - DNA, 13 bp, Homo sapiens
catgctggtcaga

SEQ ID NO: 6713767 - DNA, 20 bp, Homo sapiens
catgctggtgagtgccacgt

SEQ ID NO: 6713768 - DNA, 20 bp, Homo sapiens
catgctggtgtggccaaggc

SEQ ID NO: 6713769 - DNA, 21 bp, Homo sapiens
catgctggttacctgttccat

SEQ ID NO: 6713770 - DNA, 13 bp, Homo sapiens
catgctgtacata

SEQ ID NO: 6713771 - DNA, 16 bp, Homo sapiens
catgctgtacatactt

SEQ ID NO: 6713772 - DNA, 15 bp, Homo sapiens
catgctgtccctgca

SEQ ID NO: 6713773 - DNA, 19 bp, Homo sapiens
catgctgtccctgcactgt

SEQ ID NO: 6713774 - DNA, 20 bp, Homo sapiens
catgctgtccctgcactgtg

SEQ ID NO: 6713775 - DNA, 21 bp, Homo sapiens
catgctgtccctgcactgtgc

SEQ ID NO: 6713776 - DNA, 20 bp, Homo sapiens
catgctgtccctgtgggctc

SEQ ID NO: 6713777 - DNA, 22 bp, Homo sapiens
catgctgtccctgtgggctcac

SEQ ID NO: 6713778 - DNA, 13 bp, Homo sapiens
catgctgtccctt

SEQ ID NO: 6713779 - DNA, 15 bp, Homo sapiens
catgctgtcccttac

SEQ ID NO: 6713780 - DNA, 19 bp, Homo sapiens
catgctgtctggcacagcc

SEQ ID NO: 6713781 - DNA, 23 bp, Homo sapiens
catgctgtctggcacagcctgca

SEQ ID NO: 6713782 - DNA, 20 bp, Homo sapiens
catgctgtcttagatcagga

SEQ ID NO: 6713783 - DNA, 16 bp, Homo sapiens
catgctgtgcattttt

SEQ ID NO: 6713784 - DNA, 17 bp, Homo sapiens
catgctgtgtgactcaa

SEQ ID NO: 6713785 - DNA, 22 bp, Homo sapiens
catgctgtgtgactcaaaccaa

SEQ ID NO: 6713786 - DNA, 14 bp, Homo sapiens
catgctgttattta

SEQ ID NO: 6713787 - DNA, 13 bp, Homo sapiens
catgctgttctct

SEQ ID NO: 6713788 - DNA, 22 bp, Homo sapiens
catgctgttctctttgctgaca

SEQ ID NO: 6713789 - DNA, 18 bp, Homo sapiens
catgctgttggcctcaag

SEQ ID NO: 6713790 - DNA, 22 bp, Homo sapiens
catgcttaaataaaaattatgt

SEQ ID NO: 6713791 - DNA, 13 bp, Homo sapiens
catgcttaaattt

SEQ ID NO: 6713792 - DNA, 14 bp, Homo sapiens
catgcttaaatttt

SEQ ID NO: 6713793 - DNA, 15 bp, Homo sapiens
catgcttacaaagaa

SEQ ID NO: 6713794 - DNA, 17 bp, Homo sapiens
catgcttacaaagaaag

SEQ ID NO: 6713795 - DNA, 17 bp, Homo sapiens
catgcttagcagtcccc

SEQ ID NO: 6713796 - DNA, 12 bp, Homo sapiens
catgcttagctt

SEQ ID NO: 6713797 - DNA, 19 bp, Homo sapiens
catgcttagtcactgcctg

SEQ ID NO: 6713798 - DNA, 21 bp, Homo sapiens
catgcttagtcactgcctgca

SEQ ID NO: 6713799 - DNA, 15 bp, Homo sapiens
catgcttatgacaat

SEQ ID NO: 6713800 - DNA, 17 bp, Homo sapiens
catgcttatgttaaact

SEQ ID NO: 6713801 - DNA, 20 bp, Homo sapiens
catgcttatgttaaactctg

SEQ ID NO: 6713802 - DNA, 19 bp, Homo sapiens
catgcttattccatgactg

SEQ ID NO: 6713803 - DNA, 12 bp, Homo sapiens
catgcttcactc

SEQ ID NO: 6713804 - DNA, 14 bp, Homo sapiens
catgcttcatcatt

SEQ ID NO: 6713805 - DNA, 19 bp, Homo sapiens
catgcttcatgaaaatcct

SEQ ID NO: 6713806 - DNA, 15 bp, Homo sapiens
catgcttcccagagg

SEQ ID NO: 6713807 - DNA, 19 bp, Homo sapiens
catgcttcccagagggagc

SEQ ID NO: 6713808 - DNA, 20 bp, Homo sapiens
catgcttccctttcctgagt

SEQ ID NO: 6713809 - DNA, 16 bp, Homo sapiens
catgcttcctttctct

SEQ ID NO: 6713810 - DNA, 19 bp, Homo sapiens
catgcttcctttctctcct

SEQ ID NO: 6713811 - DNA, 20 bp, Homo sapiens
catgcttcctttctctcctg

SEQ ID NO: 6713812 - DNA, 19 bp, Homo sapiens
catgcttctactgtgacac

SEQ ID NO: 6713813 - DNA, 15 bp, Homo sapiens
catgcttctgtgccg

SEQ ID NO: 6713814 - DNA, 14 bp, Homo sapiens
catgcttcttctca

SEQ ID NO: 6713815 - DNA, 17 bp, Homo sapiens
catgcttcttgcccctt

SEQ ID NO: 6713816 - DNA, 19 bp, Homo sapiens
catgcttcttgccccttgg

SEQ ID NO: 6713817 - DNA, 15 bp, Homo sapiens
catgcttgcaccgag

SEQ ID NO: 6713818 - DNA, 19 bp, Homo sapiens
catgcttgtgaaaatgtgt

SEQ ID NO: 6713819 - DNA, 15 bp, Homo sapiens
catgctttcacctac

SEQ ID NO: 6713820 - DNA, 12 bp, Homo sapiens
catgctttccat

SEQ ID NO: 6713821 - DNA, 14 bp, Homo sapiens
catgctttccattt

SEQ ID NO: 6713822 - DNA, 21 bp, Homo sapiens
catgctttcccaccagcatgt

SEQ ID NO: 6713823 - DNA, 20 bp, Homo sapiens
catgctttcctaaagtctct

SEQ ID NO: 6713824 - DNA, 18 bp, Homo sapiens
catgctttctttgagttt

SEQ ID NO: 6713825 - DNA, 15 bp, Homo sapiens
catgctttgagtcca

SEQ ID NO: 6713826 - DNA, 19 bp, Homo sapiens
catgctttgagtccacgcc

SEQ ID NO: 6713827 - DNA, 22 bp, Homo sapiens
catgctttgctgctatgaaaat

SEQ ID NO: 6713828 - DNA, 15 bp, Homo sapiens
catgcttttccaaac

SEQ ID NO: 6713829 - DNA, 14 bp, Homo sapiens
catgcttttctcat

SEQ ID NO: 6713830 - DNA, 19 bp, Homo sapiens
catgcttttgccactttgg

SEQ ID NO: 6713831 - DNA, 12 bp, Homo sapiens
catggaaaaaaa

SEQ ID NO: 6713832 - DNA, 19 bp, Homo sapiens
catggaaaaatcctgtcat

SEQ ID NO: 6713833 - DNA, 23 bp, Homo sapiens
catggaaaaatggttgatggaaa

SEQ ID NO: 6713834 - DNA, 13 bp, Homo sapiens
catggaaaacaga

SEQ ID NO: 6713835 - DNA, 16 bp, Homo sapiens
catggaaaagcccagt

SEQ ID NO: 6713836 - DNA, 16 bp, Homo sapiens
catggaaaatgtcctg

SEQ ID NO: 6713837 - DNA, 18 bp, Homo sapiens
catggaaaatgtcctgtg

SEQ ID NO: 6713838 - DNA, 16 bp, Homo sapiens
catggaaactggccag

SEQ ID NO: 6713839 - DNA, 18 bp, Homo sapiens
catggaaagggtcttcct

SEQ ID NO: 6713840 - DNA, 22 bp, Homo sapiens
catggaaagggtcttccttctc

SEQ ID NO: 6713841 - DNA, 16 bp, Homo sapiens
catggaaatagaatga

SEQ ID NO: 6713842 - DNA, 14 bp, Homo sapiens
catggaaatattat

SEQ ID NO: 6713843 - DNA, 15 bp, Homo sapiens
catggaaatcagcca

SEQ ID NO: 6713844 - DNA, 21 bp, Homo sapiens
catggaaattcccttcatctg

SEQ ID NO: 6713845 - DNA, 17 bp, Homo sapiens
catggaacagccctgca

SEQ ID NO: 6713846 - DNA, 20 bp, Homo sapiens
catggaaccatggaggagga

SEQ ID NO: 6713847 - DNA, 16 bp, Homo sapiens
catggaactcattcct

SEQ ID NO: 6713848 - DNA, 15 bp, Homo sapiens
catggaactttcata

SEQ ID NO: 6713849 - DNA, 19 bp, Homo sapiens
catggaacttttctgtaat

SEQ ID NO: 6713850 - DNA, 14 bp, Homo sapiens
catggaagaaaagg

SEQ ID NO: 6713851 - DNA, 18 bp, Homo sapiens
catggaagagagagccat

SEQ ID NO: 6713852 - DNA, 20 bp, Homo sapiens
catggaagattagaggtttg

SEQ ID NO: 6713853 - DNA, 14 bp, Homo sapiens
catggaagctggca

SEQ ID NO: 6713854 - DNA, 14 bp, Homo sapiens
catggaagggaaga

SEQ ID NO: 6713855 - DNA, 14 bp, Homo sapiens
catggaaggtgcca

SEQ ID NO: 6713856 - DNA, 16 bp, Homo sapiens
catggaaggtgccaga

SEQ ID NO: 6713857 - DNA, 20 bp, Homo sapiens
catggaaggtgccagaagga

SEQ ID NO: 6713858 - DNA, 22 bp, Homo sapiens
catggaaggtgccagaaggaag

SEQ ID NO: 6713859 - DNA, 20 bp, Homo sapiens
catggaaggttagaggtttg

SEQ ID NO: 6713860 - DNA, 21 bp, Homo sapiens
catggaaggttagaggtttgt

SEQ ID NO: 6713861 - DNA, 16 bp, Homo sapiens
catggaatgactgaag

SEQ ID NO: 6713862 - DNA, 21 bp, Homo sapiens
catggaatgactgaagacagg

SEQ ID NO: 6713863 - DNA, 22 bp, Homo sapiens
catggaatgactgaagacaggc

SEQ ID NO: 6713864 - DNA, 15 bp, Homo sapiens
catggaatgcttgaa

SEQ ID NO: 6713865 - DNA, 23 bp, Homo sapiens
catggaatgtaactatatcatcc

SEQ ID NO: 6713866 - DNA, 15 bp, Homo sapiens
catggaattccctcc

SEQ ID NO: 6713867 - DNA, 20 bp, Homo sapiens
catggaattggagctcgtgg

SEQ ID NO: 6713868 - DNA, 13 bp, Homo sapiens
catggaatttaat

SEQ ID NO: 6713869 - DNA, 19 bp, Homo sapiens
catggaatttaatgctgaa

SEQ ID NO: 6713870 - DNA, 16 bp, Homo sapiens
catggaatttgtaagt

SEQ ID NO: 6713871 - DNA, 22 bp, Homo sapiens
catggacaatataaactgaaaa

SEQ ID NO: 6713872 - DNA, 17 bp, Homo sapiens
catggacaatggaccgg

SEQ ID NO: 6713873 - DNA, 15 bp, Homo sapiens
catggacagaagaag

SEQ ID NO: 6713874 - DNA, 21 bp, Homo sapiens
catggacagaagaaggcagca

SEQ ID NO: 6713875 - DNA, 15 bp, Homo sapiens
catggacagctgagc

SEQ ID NO: 6713876 - DNA, 17 bp, Homo sapiens
catggacagggccaggg

SEQ ID NO: 6713877 - DNA, 21 bp, Homo sapiens
catggacagggccagggttgc

SEQ ID NO: 6713878 - DNA, 16 bp, Homo sapiens
catggacatgggcagc

SEQ ID NO: 6713879 - DNA, 17 bp, Homo sapiens
catggacatgggcagca

SEQ ID NO: 6713880 - DNA, 21 bp, Homo sapiens
catggacatgtgtcccagcca

SEQ ID NO: 6713881 - DNA, 14 bp, Homo sapiens
catggaccaagaat

SEQ ID NO: 6713882 - DNA, 13 bp, Homo sapiens
catggaccagcat

SEQ ID NO: 6713883 - DNA, 22 bp, Homo sapiens
catggaccagcatctggtcttg

SEQ ID NO: 6713884 - DNA, 14 bp, Homo sapiens
catggaccatgctg

SEQ ID NO: 6713885 - DNA, 21 bp, Homo sapiens
catggacccaagataaaagaa

SEQ ID NO: 6713886 - DNA, 19 bp, Homo sapiens
catggacctggtgcccctg

SEQ ID NO: 6713887 - DNA, 19 bp, Homo sapiens
catggacgcaccggcctgg

SEQ ID NO: 6713888 - DNA, 24 bp, Homo sapiens
catggacgcaccggcctggctgca

SEQ ID NO: 6713889 - DNA, 14 bp, Homo sapiens
catggacgcctggc

SEQ ID NO: 6713890 - DNA, 16 bp, Homo sapiens
catggacgcctggctc

SEQ ID NO: 6713891 - DNA, 17 bp, Homo sapiens
catggacgcctggctcc

SEQ ID NO: 6713892 - DNA, 19 bp, Homo sapiens
catggacgcctggctccag

SEQ ID NO: 6713893 - DNA, 21 bp, Homo sapiens
catggacgcctggctccaggc

SEQ ID NO: 6713894 - DNA, 20 bp, Homo sapiens
catggactcgtaaagctgct

SEQ ID NO: 6713895 - DNA, 21 bp, Homo sapiens
catggactctacactgtgaac

SEQ ID NO: 6713896 - DNA, 15 bp, Homo sapiens
catggacttccactg

SEQ ID NO: 6713897 - DNA, 22 bp, Homo sapiens
catggacttctgccagcataat

SEQ ID NO: 6713898 - DNA, 17 bp, Homo sapiens
catggacttctggatgc

SEQ ID NO: 6713899 - DNA, 13 bp, Homo sapiens
catggacttgtat

SEQ ID NO: 6713900 - DNA, 17 bp, Homo sapiens
catggactttataagcc

SEQ ID NO: 6713901 - DNA, 13 bp, Homo sapiens
catggactttgtt

SEQ ID NO: 6713902 - DNA, 18 bp, Homo sapiens
catggagaaaatgggcgg

SEQ ID NO: 6713903 - DNA, 12 bp, Homo sapiens
catggagaaaca

SEQ ID NO: 6713904 - DNA, 21 bp, Homo sapiens
catggagaaaccctgtctcta

SEQ ID NO: 6713905 - DNA, 18 bp, Homo sapiens
catggagaaagctgactt

SEQ ID NO: 6713906 - DNA, 19 bp, Homo sapiens
catggagaacagtgatttt

SEQ ID NO: 6713907 - DNA, 20 bp, Homo sapiens
catggagaagggttctgccc

SEQ ID NO: 6713908 - DNA, 21 bp, Homo sapiens
catggagaagggttctgccct

SEQ ID NO: 6713909 - DNA, 17 bp, Homo sapiens
catggagaagttatcag

SEQ ID NO: 6713910 - DNA, 16 bp, Homo sapiens
catggagacaataaac

SEQ ID NO: 6713911 - DNA, 12 bp, Homo sapiens
catggagacagc

SEQ ID NO: 6713912 - DNA, 19 bp, Homo sapiens
catggagactcctgccctg

SEQ ID NO: 6713913 - DNA, 20 bp, Homo sapiens
catggagactcctgccctgt

SEQ ID NO: 6713914 - DNA, 21 bp, Homo sapiens
catggagactcctgccctgtt

SEQ ID NO: 6713915 - DNA, 16 bp, Homo sapiens
catggagactctgaga

SEQ ID NO: 6713916 - DNA, 14 bp, Homo sapiens
catggagagctgga

SEQ ID NO: 6713917 - DNA, 17 bp, Homo sapiens
catggagagctggagcc

SEQ ID NO: 6713918 - DNA, 14 bp, Homo sapiens
catggagaggtttg

SEQ ID NO: 6713919 - DNA, 15 bp, Homo sapiens
catggagaggtttgt

SEQ ID NO: 6713920 - DNA, 21 bp, Homo sapiens
catggagatagccccacagga

SEQ ID NO: 6713921 - DNA, 10 bp, Homo sapiens
catggagcca

SEQ ID NO: 6713922 - DNA, 14 bp, Homo sapiens
catggagccagctc

SEQ ID NO: 6713923 - DNA, 17 bp, Homo sapiens
catggagccccagcccc

SEQ ID NO: 6713924 - DNA, 18 bp, Homo sapiens
catggagccccctctgcc

SEQ ID NO: 6713925 - DNA, 19 bp, Homo sapiens
catggagccccctctgccg

SEQ ID NO: 6713926 - DNA, 14 bp, Homo sapiens
catggagcccctcc

SEQ ID NO: 6713927 - DNA, 11 bp, Homo sapiens
catggagccta

SEQ ID NO: 6713928 - DNA, 14 bp, Homo sapiens
catggagcctacct

SEQ ID NO: 6713929 - DNA, 21 bp, Homo sapiens
catggagcctacctctgtctg

SEQ ID NO: 6713930 - DNA, 22 bp, Homo sapiens
catggagcctggaactgcatca

SEQ ID NO: 6713931 - DNA, 14 bp, Homo sapiens
catggagctcaggt

SEQ ID NO: 6713932 - DNA, 18 bp, Homo sapiens
catggagctcttgttgca

SEQ ID NO: 6713933 - DNA, 14 bp, Homo sapiens
catggagctggccg

SEQ ID NO: 6713934 - DNA, 17 bp, Homo sapiens
catggaggactctcctc

SEQ ID NO: 6713935 - DNA, 12 bp, Homo sapiens
catggaggagac

SEQ ID NO: 6713936 - DNA, 22 bp, Homo sapiens
catggaggagcttgggggatga

SEQ ID NO: 6713937 - DNA, 22 bp, Homo sapiens
catggaggatggtgtcctgagg

SEQ ID NO: 6713938 - DNA, 16 bp, Homo sapiens
catggaggcacacagc

SEQ ID NO: 6713939 - DNA, 19 bp, Homo sapiens
catggaggcacacagctgc

SEQ ID NO: 6713940 - DNA, 13 bp, Homo sapiens
catggaggttcta

SEQ ID NO: 6713941 - DNA, 17 bp, Homo sapiens
catggaggttctaaggc

SEQ ID NO: 6713942 - DNA, 21 bp, Homo sapiens
catggagtagagtcaggagaa

SEQ ID NO: 6713943 - DNA, 23 bp, Homo sapiens
catggagtcatcttgcacacact

SEQ ID NO: 6713944 - DNA, 22 bp, Homo sapiens
catggagtgagacccaggagcc

SEQ ID NO: 6713945 - DNA, 21 bp, Homo sapiens
catggagtggcagcccagcca

SEQ ID NO: 6713946 - DNA, 14 bp, Homo sapiens
catggagtgtttga

SEQ ID NO: 6713947 - DNA, 14 bp, Homo sapiens
catggatacatatt

SEQ ID NO: 6713948 - DNA, 15 bp, Homo sapiens
catggatacttcctg

SEQ ID NO: 6713949 - DNA, 16 bp, Homo sapiens
catggatacttcctgg

SEQ ID NO: 6713950 - DNA, 17 bp, Homo sapiens
catggatacttcctggg

SEQ ID NO: 6713951 - DNA, 18 bp, Homo sapiens
catggatacttcctgggt

SEQ ID NO: 6713952 - DNA, 22 bp, Homo sapiens
catggatatgttgtattaactg

SEQ ID NO: 6713953 - DNA, 13 bp, Homo sapiens
catggatcttgct

SEQ ID NO: 6713954 - DNA, 14 bp, Homo sapiens
catggatgaaacct

SEQ ID NO: 6713955 - DNA, 19 bp, Homo sapiens
catggatgcagaaatgagt

SEQ ID NO: 6713956 - DNA, 20 bp, Homo sapiens
catggatgcatttcaaatgt

SEQ ID NO: 6713957 - DNA, 14 bp, Homo sapiens
catggatggaaaac

SEQ ID NO: 6713958 - DNA, 16 bp, Homo sapiens
catggatgtttcttct

SEQ ID NO: 6713959 - DNA, 22 bp, Homo sapiens
catggatgttttagccattgtt

SEQ ID NO: 6713960 - DNA, 14 bp, Homo sapiens
catggattgattaa

SEQ ID NO: 6713961 - DNA, 19 bp, Homo sapiens
catggattgattaaaagca

SEQ ID NO: 6713962 - DNA, 14 bp, Homo sapiens
catggattgccaca

SEQ ID NO: 6713963 - DNA, 20 bp, Homo sapiens
catggatttattttttgtaa

SEQ ID NO: 6713964 - DNA, 16 bp, Homo sapiens
catggatttcctttga

SEQ ID NO: 6713965 - DNA, 19 bp, Homo sapiens
catggatttcctttgacct

SEQ ID NO: 6713966 - DNA, 21 bp, Homo sapiens
catggatttctctgctcacag

SEQ ID NO: 6713967 - DNA, 21 bp, Homo sapiens
catggatttctgtcttctcta

SEQ ID NO: 6713968 - DNA, 13 bp, Homo sapiens
catggatttcttt

SEQ ID NO: 6713969 - DNA, 19 bp, Homo sapiens
catggcaaatcaggggcca

SEQ ID NO: 6713970 - DNA, 16 bp, Homo sapiens
catggcaaatgggcag

SEQ ID NO: 6713971 - DNA, 22 bp, Homo sapiens
catggcaataaatggctcgtgg

SEQ ID NO: 6713972 - DNA, 17 bp, Homo sapiens
catggcaatgaaaattt

SEQ ID NO: 6713973 - DNA, 16 bp, Homo sapiens
catggcaattgcactc

SEQ ID NO: 6713974 - DNA, 21 bp, Homo sapiens
catggcaattttgtaaattga

SEQ ID NO: 6713975 - DNA, 22 bp, Homo sapiens
catggcacagagattctgaact

SEQ ID NO: 6713976 - DNA, 13 bp, Homo sapiens
catggcacaggcc

SEQ ID NO: 6713977 - DNA, 15 bp, Homo sapiens
catggcacaggcccg

SEQ ID NO: 6713978 - DNA, 19 bp, Homo sapiens
catggcacataccaaagct

SEQ ID NO: 6713979 - DNA, 12 bp, Homo sapiens
catggcaccagc

SEQ ID NO: 6713980 - DNA, 21 bp, Homo sapiens
catggcacctgtcgcccagtg

SEQ ID NO: 6713981 - DNA, 22 bp, Homo sapiens
catggcaccttcagactttgct

SEQ ID NO: 6713982 - DNA, 23 bp, Homo sapiens
catggcaccttcagactttgctt

SEQ ID NO: 6713983 - DNA, 18 bp, Homo sapiens
catggcactaaaccactt

SEQ ID NO: 6713984 - DNA, 22 bp, Homo sapiens
catggcactaaaccacttctct

SEQ ID NO: 6713985 - DNA, 16 bp, Homo sapiens
catggcagaagcgtct

SEQ ID NO: 6713986 - DNA, 19 bp, Homo sapiens
catggcagaagcgtctccc

SEQ ID NO: 6713987 - DNA, 23 bp, Homo sapiens
catggcagaagcgtctcccttgg

SEQ ID NO: 6713988 - DNA, 17 bp, Homo sapiens
catggcagagtttgtgt

SEQ ID NO: 6713989 - DNA, 13 bp, Homo sapiens
catggcagatgat

SEQ ID NO: 6713990 - DNA, 23 bp, Homo sapiens
catggcagatgatttgggcagag

SEQ ID NO: 6713991 - DNA, 20 bp, Homo sapiens
catggcagatgtaggaggga

SEQ ID NO: 6713992 - DNA, 23 bp, Homo sapiens
catggcagatgtaggagggactg

SEQ ID NO: 6713993 - DNA, 19 bp, Homo sapiens
catggcagcagccagggac

SEQ ID NO: 6713994 - DNA, 22 bp, Homo sapiens
catggcagcagccagggacccc

SEQ ID NO: 6713995 - DNA, 20 bp, Homo sapiens
catggcagcctactctcctt

SEQ ID NO: 6713996 - DNA, 14 bp, Homo sapiens
catggcagctcctg

SEQ ID NO: 6713997 - DNA, 15 bp, Homo sapiens
catggcagctcctga

SEQ ID NO: 6713998 - DNA, 14 bp, Homo sapiens
catggcagctgttt

SEQ ID NO: 6713999 - DNA, 17 bp, Homo sapiens
catggcagctgtttctc

SEQ ID NO: 6714000 - DNA, 17 bp, Homo sapiens
catggcaggacagctcc

SEQ ID NO: 6714001 - DNA, 13 bp, Homo sapiens
catggcaggagtc

SEQ ID NO: 6714002 - DNA, 21 bp, Homo sapiens
catggcaggagtctctgccag

SEQ ID NO: 6714003 - DNA, 17 bp, Homo sapiens
catggcagggccaggcc

SEQ ID NO: 6714004 - DNA, 18 bp, Homo sapiens
catggcagggccaggcct

SEQ ID NO: 6714005 - DNA, 19 bp, Homo sapiens
catggcagggccaggcctc

SEQ ID NO: 6714006 - DNA, 20 bp, Homo sapiens
catggcagggccaggcctct

SEQ ID NO: 6714007 - DNA, 19 bp, Homo sapiens
catggcagggggctgctgc

SEQ ID NO: 6714008 - DNA, 18 bp, Homo sapiens
catggcatcatccattct

SEQ ID NO: 6714009 - DNA, 20 bp, Homo sapiens
catggcatcatccattctct

SEQ ID NO: 6714010 - DNA, 23 bp, Homo sapiens
catggcatcatccattctctctg

SEQ ID NO: 6714011 - DNA, 14 bp, Homo sapiens
catggcatcctcca

SEQ ID NO: 6714012 - DNA, 15 bp, Homo sapiens
catggcatcctccag

SEQ ID NO: 6714013 - DNA, 16 bp, Homo sapiens
catggcatcctccagc

SEQ ID NO: 6714014 - DNA, 18 bp, Homo sapiens
catggcatcctccagccc

SEQ ID NO: 6714015 - DNA, 22 bp, Homo sapiens
catggcatcctccagcccctgt

SEQ ID NO: 6714016 - DNA, 22 bp, Homo sapiens
catggcatgggggcctcagggc

SEQ ID NO: 6714017 - DNA, 21 bp, Homo sapiens
catggcatggttttgtgccat

SEQ ID NO: 6714018 - DNA, 14 bp, Homo sapiens
catggcatgtcttt

SEQ ID NO: 6714019 - DNA, 20 bp, Homo sapiens
catggccaaatcgcagtgat

SEQ ID NO: 6714020 - DNA, 19 bp, Homo sapiens
catggccaaggggccagct

SEQ ID NO: 6714021 - DNA, 15 bp, Homo sapiens
catggccaatagtca

SEQ ID NO: 6714022 - DNA, 18 bp, Homo sapiens
catggccacaaagggaca

SEQ ID NO: 6714023 - DNA, 15 bp, Homo sapiens
catggccacactgtg

SEQ ID NO: 6714024 - DNA, 15 bp, Homo sapiens
catggccacagccac

SEQ ID NO: 6714025 - DNA, 21 bp, Homo sapiens
catggccacatcctcatggcc

SEQ ID NO: 6714026 - DNA, 19 bp, Homo sapiens
catggccaccccgtgccac

SEQ ID NO: 6714027 - DNA, 14 bp, Homo sapiens
catggccagactcc

SEQ ID NO: 6714028 - DNA, 16 bp, Homo sapiens
catggccagactccct

SEQ ID NO: 6714029 - DNA, 18 bp, Homo sapiens
catggccagactcccttg

SEQ ID NO: 6714030 - DNA, 14 bp, Homo sapiens
catggccagcagca

SEQ ID NO: 6714031 - DNA, 22 bp, Homo sapiens
catggccagcgcccctcagcct

SEQ ID NO: 6714032 - DNA, 12 bp, Homo sapiens
catggccaggag

SEQ ID NO: 6714033 - DNA, 17 bp, Homo sapiens
catggccaggagtgggt

SEQ ID NO: 6714034 - DNA, 18 bp, Homo sapiens
catggccatagaggccca

SEQ ID NO: 6714035 - DNA, 20 bp, Homo sapiens
catggccatagaggcccagg

SEQ ID NO: 6714036 - DNA, 21 bp, Homo sapiens
catggccatagaggcccaggc

SEQ ID NO: 6714037 - DNA, 16 bp, Homo sapiens
catggcccagcagctt

SEQ ID NO: 6714038 - DNA, 19 bp, Homo sapiens
catggcccagcagcttggc

SEQ ID NO: 6714039 - DNA, 20 bp, Homo sapiens
catggcccagcagcttggct

SEQ ID NO: 6714040 - DNA, 23 bp, Homo sapiens
catggcccagcagcttggctgag

SEQ ID NO: 6714041 - DNA, 13 bp, Homo sapiens
catggcccagcct

SEQ ID NO: 6714042 - DNA, 19 bp, Homo sapiens
catggcccatcactcggct

SEQ ID NO: 6714043 - DNA, 16 bp, Homo sapiens
catggcccatcagggg

SEQ ID NO: 6714044 - DNA, 21 bp, Homo sapiens
catggcccatcaggggcagga

SEQ ID NO: 6714045 - DNA, 14 bp, Homo sapiens
catggcccattgga

SEQ ID NO: 6714046 - DNA, 22 bp, Homo sapiens
catggcccattggagcacctgg

SEQ ID NO: 6714047 - DNA, 21 bp, Homo sapiens
catggcccccaataaaggcag

SEQ ID NO: 6714048 - DNA, 23 bp, Homo sapiens
catggcccccaataaaggcagct

SEQ ID NO: 6714049 - DNA, 24 bp, Homo sapiens
catggcccccaataaaggcagctg

SEQ ID NO: 6714050 - DNA, 15 bp, Homo sapiens
catggcccccagggg

SEQ ID NO: 6714051 - DNA, 19 bp, Homo sapiens
catggcccccaggggcagg

SEQ ID NO: 6714052 - DNA, 20 bp, Homo sapiens
catggcccccaggggcagga

SEQ ID NO: 6714053 - DNA, 16 bp, Homo sapiens
catggccccccactcc

SEQ ID NO: 6714054 - DNA, 19 bp, Homo sapiens
catggcccctccaggaaca

SEQ ID NO: 6714055 - DNA, 16 bp, Homo sapiens
catggcccctgtgagt

SEQ ID NO: 6714056 - DNA, 15 bp, Homo sapiens
catggccctcattaa

SEQ ID NO: 6714057 - DNA, 15 bp, Homo sapiens
catggccctgctgcc

SEQ ID NO: 6714058 - DNA, 21 bp, Homo sapiens
catggccctgctgcccctccc

SEQ ID NO: 6714059 - DNA, 13 bp, Homo sapiens
catggccctgggc

SEQ ID NO: 6714060 - DNA, 14 bp, Homo sapiens
catggccctggggt

SEQ ID NO: 6714061 - DNA, 22 bp, Homo sapiens
catggccctgtagttaggcctg

SEQ ID NO: 6714062 - DNA, 23 bp, Homo sapiens
catggccgaagccccttggagag

SEQ ID NO: 6714063 - DNA, 14 bp, Homo sapiens
catggccgctgccc

SEQ ID NO: 6714064 - DNA, 15 bp, Homo sapiens
catggccgctgccca

SEQ ID NO: 6714065 - DNA, 21 bp, Homo sapiens
catggccgctgcccacgtccc

SEQ ID NO: 6714066 - DNA, 19 bp, Homo sapiens
catggccggctttcaggag

SEQ ID NO: 6714067 - DNA, 22 bp, Homo sapiens
catggccgggccctctgtagct

SEQ ID NO: 6714068 - DNA, 23 bp, Homo sapiens
catggccgttgcctctctgccag

SEQ ID NO: 6714069 - DNA, 16 bp, Homo sapiens
catggcctatgcacat

SEQ ID NO: 6714070 - DNA, 18 bp, Homo sapiens
catggcctcagatgatgg

SEQ ID NO: 6714071 - DNA, 17 bp, Homo sapiens
catggcctcagccctgc

SEQ ID NO: 6714072 - DNA, 15 bp, Homo sapiens
catggcctcccagcc

SEQ ID NO: 6714073 - DNA, 16 bp, Homo sapiens
catggcctcccagcca

SEQ ID NO: 6714074 - DNA, 23 bp, Homo sapiens
catggcctcttgaagagaaaaaa

SEQ ID NO: 6714075 - DNA, 20 bp, Homo sapiens
catggcctgcaaactgggaa

SEQ ID NO: 6714076 - DNA, 12 bp, Homo sapiens
catggcctgctg

SEQ ID NO: 6714077 - DNA, 17 bp, Homo sapiens
catggcctgctgggctt

SEQ ID NO: 6714078 - DNA, 17 bp, Homo sapiens
catggcctgtgctgggc

SEQ ID NO: 6714079 - DNA, 22 bp, Homo sapiens
catggcctgtgctgggccagtg

SEQ ID NO: 6714080 - DNA, 13 bp, Homo sapiens
catggccttccct

SEQ ID NO: 6714081 - DNA, 18 bp, Homo sapiens
catggccttgaaacagtt

SEQ ID NO: 6714082 - DNA, 13 bp, Homo sapiens
catggcctttcta

SEQ ID NO: 6714083 - DNA, 19 bp, Homo sapiens
catggcctttgcttgaaag

SEQ ID NO: 6714084 - DNA, 19 bp, Homo sapiens
catggcgaaaacatctcct

SEQ ID NO: 6714085 - DNA, 13 bp, Homo sapiens
catggcgaggctg

SEQ ID NO: 6714086 - DNA, 18 bp, Homo sapiens
catggcgccctgcctcct

SEQ ID NO: 6714087 - DNA, 18 bp, Homo sapiens
catggcgtaatgggcctg

SEQ ID NO: 6714088 - DNA, 19 bp, Homo sapiens
catggcgtaatgggcctgc

SEQ ID NO: 6714089 - DNA, 20 bp, Homo sapiens
catggcgtaatgggcctgcc

SEQ ID NO: 6714090 - DNA, 22 bp, Homo sapiens
catggcgtaatgggcctgccca

SEQ ID NO: 6714091 - DNA, 22 bp, Homo sapiens
catggcgtagagggtgctgccc

SEQ ID NO: 6714092 - DNA, 20 bp, Homo sapiens
catggcgtggaggaggaggg

SEQ ID NO: 6714093 - DNA, 14 bp, Homo sapiens
catggcgtgtccct

SEQ ID NO: 6714094 - DNA, 20 bp, Homo sapiens
catggctaagcttaaaaaaa

SEQ ID NO: 6714095 - DNA, 19 bp, Homo sapiens
catggctaaggcaccagcc

SEQ ID NO: 6714096 - DNA, 18 bp, Homo sapiens
catggctaatttaacacc

SEQ ID NO: 6714097 - DNA, 20 bp, Homo sapiens
catggctatcctagagaggc

SEQ ID NO: 6714098 - DNA, 16 bp, Homo sapiens
catggctcaaggattc

SEQ ID NO: 6714099 - DNA, 18 bp, Homo sapiens
catggctcaggcaagccc

SEQ ID NO: 6714100 - DNA, 16 bp, Homo sapiens
catggctcctcaccac

SEQ ID NO: 6714101 - DNA, 12 bp, Homo sapiens
catggctctatt

SEQ ID NO: 6714102 - DNA, 21 bp, Homo sapiens
catggctctggactctaaaga

SEQ ID NO: 6714103 - DNA, 21 bp, Homo sapiens
catggctctgttatgcaagca

SEQ ID NO: 6714104 - DNA, 20 bp, Homo sapiens
catggctgaagctggagcag

SEQ ID NO: 6714105 - DNA, 22 bp, Homo sapiens
catggctgaagctggagcagcg

SEQ ID NO: 6714106 - DNA, 16 bp, Homo sapiens
catggctgcacagttg

SEQ ID NO: 6714107 - DNA, 22 bp, Homo sapiens
catggctgccaatgggagctca

SEQ ID NO: 6714108 - DNA, 20 bp, Homo sapiens
catggctgcttgattttgta

SEQ ID NO: 6714109 - DNA, 17 bp, Homo sapiens
catggctggatgtgcat

SEQ ID NO: 6714110 - DNA, 19 bp, Homo sapiens
catggctggatgtgcatct

SEQ ID NO: 6714111 - DNA, 23 bp, Homo sapiens
catggctggatgtgcatctggcc

SEQ ID NO: 6714112 - DNA, 12 bp, Homo sapiens
catggctgggga

SEQ ID NO: 6714113 - DNA, 13 bp, Homo sapiens
catggctggggga

SEQ ID NO: 6714114 - DNA, 21 bp, Homo sapiens
catggctgggggagggactgc

SEQ ID NO: 6714115 - DNA, 13 bp, Homo sapiens
catggctggtgcc

SEQ ID NO: 6714116 - DNA, 16 bp, Homo sapiens
catggctggtgcctga

SEQ ID NO: 6714117 - DNA, 13 bp, Homo sapiens
catggctgtcccc

SEQ ID NO: 6714118 - DNA, 13 bp, Homo sapiens
catggctgtctgc

SEQ ID NO: 6714119 - DNA, 20 bp, Homo sapiens
catggctgtctgcacagagg

SEQ ID NO: 6714120 - DNA, 21 bp, Homo sapiens
catggctgtctgcacagaggg

SEQ ID NO: 6714121 - DNA, 17 bp, Homo sapiens
catggctgtgtttgcag

SEQ ID NO: 6714122 - DNA, 18 bp, Homo sapiens
catggctgttatctgtct

SEQ ID NO: 6714123 - DNA, 15 bp, Homo sapiens
catggcttagaaatc

SEQ ID NO: 6714124 - DNA, 10 bp, Homo sapiens
catggcttcc

SEQ ID NO: 6714125 - DNA, 15 bp, Homo sapiens
catggcttcctcctc

SEQ ID NO: 6714126 - DNA, 15 bp, Homo sapiens
catggcttcctcctg

SEQ ID NO: 6714127 - DNA, 17 bp, Homo sapiens
catggcttcctcctgcg

SEQ ID NO: 6714128 - DNA, 15 bp, Homo sapiens
catggcttcctgaga

SEQ ID NO: 6714129 - DNA, 18 bp, Homo sapiens
catggcttctcctttggc

SEQ ID NO: 6714130 - DNA, 17 bp, Homo sapiens
catggcttctggtcatg

SEQ ID NO: 6714131 - DNA, 19 bp, Homo sapiens
catggcttgccacagctct

SEQ ID NO: 6714132 - DNA, 18 bp, Homo sapiens
catggcttgcccctgtgg

SEQ ID NO: 6714133 - DNA, 15 bp, Homo sapiens
catggcttgggctgg

SEQ ID NO: 6714134 - DNA, 14 bp, Homo sapiens
catggcttggggag

SEQ ID NO: 6714135 - DNA, 18 bp, Homo sapiens
catggctttcagaaaacg

SEQ ID NO: 6714136 - DNA, 22 bp, Homo sapiens
catggctttcagaaaacgggaa

SEQ ID NO: 6714137 - DNA, 15 bp, Homo sapiens
catggctttgtatcc

SEQ ID NO: 6714138 - DNA, 18 bp, Homo sapiens
catggctttgtgctgctg

SEQ ID NO: 6714139 - DNA, 13 bp, Homo sapiens
catggctttttct

SEQ ID NO: 6714140 - DNA, 23 bp, Homo sapiens
catggctttttctttttttgcat

SEQ ID NO: 6714141 - DNA, 13 bp, Homo sapiens
catgggaaaggag

SEQ ID NO: 6714142 - DNA, 21 bp, Homo sapiens
catgggaaagtattctctttt

SEQ ID NO: 6714143 - DNA, 22 bp, Homo sapiens
catgggaaatagcggccctgga

SEQ ID NO: 6714144 - DNA, 23 bp, Homo sapiens
catgggaaatagcggccctggag

SEQ ID NO: 6714145 - DNA, 14 bp, Homo sapiens
catgggaacctcat

SEQ ID NO: 6714146 - DNA, 17 bp, Homo sapiens
catgggaacctcatatg

SEQ ID NO: 6714147 - DNA, 16 bp, Homo sapiens
catgggaacgcagcct

SEQ ID NO: 6714148 - DNA, 12 bp, Homo sapiens
catgggaagaac

SEQ ID NO: 6714149 - DNA, 17 bp, Homo sapiens
catgggaagcatgtgga

SEQ ID NO: 6714150 - DNA, 16 bp, Homo sapiens
catgggaaggtgggcg

SEQ ID NO: 6714151 - DNA, 23 bp, Homo sapiens
catgggaatgtgcctcggcctcc

SEQ ID NO: 6714152 - DNA, 18 bp, Homo sapiens
catgggacctataactgc

SEQ ID NO: 6714153 - DNA, 16 bp, Homo sapiens
catgggacctcctccc

SEQ ID NO: 6714154 - DNA, 17 bp, Homo sapiens
catgggacctcctccct

SEQ ID NO: 6714155 - DNA, 14 bp, Homo sapiens
catgggacctggcc

SEQ ID NO: 6714156 - DNA, 21 bp, Homo sapiens
catgggactgattctgttgtg

SEQ ID NO: 6714157 - DNA, 14 bp, Homo sapiens
catgggagagtcca

SEQ ID NO: 6714158 - DNA, 21 bp, Homo sapiens
catgggagagtccaggcctgg

SEQ ID NO: 6714159 - DNA, 22 bp, Homo sapiens
catgggagagtccaggcctggg

SEQ ID NO: 6714160 - DNA, 12 bp, Homo sapiens
catgggagccag

SEQ ID NO: 6714161 - DNA, 22 bp, Homo sapiens
catgggagccagctgctttttg

SEQ ID NO: 6714162 - DNA, 12 bp, Homo sapiens
catgggagggag

SEQ ID NO: 6714163 - DNA, 14 bp, Homo sapiens
catgggagggagct

SEQ ID NO: 6714164 - DNA, 14 bp, Homo sapiens
catgggagggaggg

SEQ ID NO: 6714165 - DNA, 17 bp, Homo sapiens
catgggagggatcagcc

SEQ ID NO: 6714166 - DNA, 21 bp, Homo sapiens
catgggaggtgaaaggggcac

SEQ ID NO: 6714167 - DNA, 19 bp, Homo sapiens
catgggagtaagttcttca

SEQ ID NO: 6714168 - DNA, 19 bp, Homo sapiens
catgggagtcagggagccc

SEQ ID NO: 6714169 - DNA, 16 bp, Homo sapiens
catgggataaatgcca

SEQ ID NO: 6714170 - DNA, 18 bp, Homo sapiens
catgggatacaacctccc

SEQ ID NO: 6714171 - DNA, 20 bp, Homo sapiens
catgggatccaattttaata

SEQ ID NO: 6714172 - DNA, 16 bp, Homo sapiens
catgggattattagaa

SEQ ID NO: 6714173 - DNA, 23 bp, Homo sapiens
catgggcaactcgtgacagcctc

SEQ ID NO: 6714174 - DNA, 21 bp, Homo sapiens
catgggcacaaagggcccaga

SEQ ID NO: 6714175 - DNA, 14 bp, Homo sapiens
catgggcactgctg

SEQ ID NO: 6714176 - DNA, 15 bp, Homo sapiens
catgggcactgctgg

SEQ ID NO: 6714177 - DNA, 16 bp, Homo sapiens
catgggcactgctggg

SEQ ID NO: 6714178 - DNA, 18 bp, Homo sapiens
catgggcactgctgggtg

SEQ ID NO: 6714179 - DNA, 19 bp, Homo sapiens
catgggcagaagatagaga

SEQ ID NO: 6714180 - DNA, 15 bp, Homo sapiens
catgggcagagccca

SEQ ID NO: 6714181 - DNA, 14 bp, Homo sapiens
catgggcaggagac

SEQ ID NO: 6714182 - DNA, 22 bp, Homo sapiens
catgggcattgctggactgatg

SEQ ID NO: 6714183 - DNA, 21 bp, Homo sapiens
catgggccagcccctccatct

SEQ ID NO: 6714184 - DNA, 13 bp, Homo sapiens
catgggccagcct

SEQ ID NO: 6714185 - DNA, 14 bp, Homo sapiens
catgggccagccta

SEQ ID NO: 6714186 - DNA, 18 bp, Homo sapiens
catgggccagcctagccc

SEQ ID NO: 6714187 - DNA, 21 bp, Homo sapiens
catgggccagcctagcccttg

SEQ ID NO: 6714188 - DNA, 20 bp, Homo sapiens
catgggccccaggggaacac

SEQ ID NO: 6714189 - DNA, 18 bp, Homo sapiens
catgggcccgctgcctct

SEQ ID NO: 6714190 - DNA, 23 bp, Homo sapiens
catgggcccttggaaaaacagga

SEQ ID NO: 6714191 - DNA, 17 bp, Homo sapiens
catgggcctcctgtgtg

SEQ ID NO: 6714192 - DNA, 15 bp, Homo sapiens
catgggcctctctgg

SEQ ID NO: 6714193 - DNA, 22 bp, Homo sapiens
catgggcctctctgggggaggc

SEQ ID NO: 6714194 - DNA, 15 bp, Homo sapiens
catgggcctgctgcg

SEQ ID NO: 6714195 - DNA, 13 bp, Homo sapiens
catgggcctggcc

SEQ ID NO: 6714196 - DNA, 16 bp, Homo sapiens
catgggcctgggcctg

SEQ ID NO: 6714197 - DNA, 17 bp, Homo sapiens
catgggcctgtggggac

SEQ ID NO: 6714198 - DNA, 22 bp, Homo sapiens
catgggcctttaagaaccttaa

SEQ ID NO: 6714199 - DNA, 19 bp, Homo sapiens
catgggctagtgtgagtgg

SEQ ID NO: 6714200 - DNA, 12 bp, Homo sapiens
catgggctcagg

SEQ ID NO: 6714201 - DNA, 18 bp, Homo sapiens
catgggctcagggccagg

SEQ ID NO: 6714202 - DNA, 14 bp, Homo sapiens
catgggctcctgcc

SEQ ID NO: 6714203 - DNA, 18 bp, Homo sapiens
catgggctcctgcccctt

SEQ ID NO: 6714204 - DNA, 16 bp, Homo sapiens
catgggctctggcccc

SEQ ID NO: 6714205 - DNA, 13 bp, Homo sapiens
catgggctggggg

SEQ ID NO: 6714206 - DNA, 13 bp, Homo sapiens
catgggctgtgtc

SEQ ID NO: 6714207 - DNA, 12 bp, Homo sapiens
catgggcttcac

SEQ ID NO: 6714208 - DNA, 16 bp, Homo sapiens
catgggcttcactgta

SEQ ID NO: 6714209 - DNA, 21 bp, Homo sapiens
catgggcttcactgtataaat

SEQ ID NO: 6714210 - DNA, 12 bp, Homo sapiens
catgggcttgga

SEQ ID NO: 6714211 - DNA, 17 bp, Homo sapiens
catggggaaggcagagg

SEQ ID NO: 6714212 - DNA, 18 bp, Homo sapiens
catggggaaggcagaggc

SEQ ID NO: 6714213 - DNA, 19 bp, Homo sapiens
catggggaaggcagaggct

SEQ ID NO: 6714214 - DNA, 16 bp, Homo sapiens
catggggaagggatat

SEQ ID NO: 6714215 - DNA, 10 bp, Homo sapiens
catggggagg

SEQ ID NO: 6714216 - DNA, 21 bp, Homo sapiens
catggggaggcagcagagcgg

SEQ ID NO: 6714217 - DNA, 21 bp, Homo sapiens
catggggatcaattttcatta

SEQ ID NO: 6714218 - DNA, 18 bp, Homo sapiens
catggggatctggggggt

SEQ ID NO: 6714219 - DNA, 14 bp, Homo sapiens
catggggcaagcca

SEQ ID NO: 6714220 - DNA, 15 bp, Homo sapiens
catggggcaagccag

SEQ ID NO: 6714221 - DNA, 17 bp, Homo sapiens
catggggcaagccaggg

SEQ ID NO: 6714222 - DNA, 22 bp, Homo sapiens
catggggcaagccagggcccag

SEQ ID NO: 6714223 - DNA, 23 bp, Homo sapiens
catggggcagaggcttccgtgtc

SEQ ID NO: 6714224 - DNA, 21 bp, Homo sapiens
catggggcccctggcccagag

SEQ ID NO: 6714225 - DNA, 17 bp, Homo sapiens
catggggccctcccaga

SEQ ID NO: 6714226 - DNA, 21 bp, Homo sapiens
catggggcgctcccactcaga

SEQ ID NO: 6714227 - DNA, 16 bp, Homo sapiens
catgggggaacaatga

SEQ ID NO: 6714228 - DNA, 17 bp, Homo sapiens
catgggggaccccttcc

SEQ ID NO: 6714229 - DNA, 17 bp, Homo sapiens
catgggggaggctctga

SEQ ID NO: 6714230 - DNA, 21 bp, Homo sapiens
catgggggagggggcagaagt

SEQ ID NO: 6714231 - DNA, 23 bp, Homo sapiens
catgggggcaccgggctccatgc

SEQ ID NO: 6714232 - DNA, 19 bp, Homo sapiens
catgggggcacttgagttt

SEQ ID NO: 6714233 - DNA, 15 bp, Homo sapiens
catgggggcccctcg

SEQ ID NO: 6714234 - DNA, 17 bp, Homo sapiens
catgggggcctcagggc

SEQ ID NO: 6714235 - DNA, 15 bp, Homo sapiens
catgggggctgccag

SEQ ID NO: 6714236 - DNA, 16 bp, Homo sapiens
catgggggctgccagc

SEQ ID NO: 6714237 - DNA, 11 bp, Homo sapiens
catggggggag

SEQ ID NO: 6714238 - DNA, 21 bp, Homo sapiens
catggggggagcaccctgagg

SEQ ID NO: 6714239 - DNA, 23 bp, Homo sapiens
catggggggagcaccctgagggc

SEQ ID NO: 6714240 - DNA, 14 bp, Homo sapiens
catgggggtgagac

SEQ ID NO: 6714241 - DNA, 16 bp, Homo sapiens
catgggggtgagaccc

SEQ ID NO: 6714242 - DNA, 21 bp, Homo sapiens
catggggtcagccccaagggc

SEQ ID NO: 6714243 - DNA, 21 bp, Homo sapiens
catggggtccatccccttccc

SEQ ID NO: 6714244 - DNA, 19 bp, Homo sapiens
catggggtccttggagtga

SEQ ID NO: 6714245 - DNA, 15 bp, Homo sapiens
catggggtctctcac

SEQ ID NO: 6714246 - DNA, 23 bp, Homo sapiens
catggggtctctcacagacagga

SEQ ID NO: 6714247 - DNA, 13 bp, Homo sapiens
catggggtctctg

SEQ ID NO: 6714248 - DNA, 22 bp, Homo sapiens
catggggtctctgcatcttcag

SEQ ID NO: 6714249 - DNA, 17 bp, Homo sapiens
catggggtgggcctctg

SEQ ID NO: 6714250 - DNA, 23 bp, Homo sapiens
catggggtggggttggggcaaag

SEQ ID NO: 6714251 - DNA, 15 bp, Homo sapiens
catggggttcctggt

SEQ ID NO: 6714252 - DNA, 14 bp, Homo sapiens
catggggttcgaga

SEQ ID NO: 6714253 - DNA, 21 bp, Homo sapiens
catggggttcgagactccatc

SEQ ID NO: 6714254 - DNA, 22 bp, Homo sapiens
catggggtttggttgtgctgat

SEQ ID NO: 6714255 - DNA, 15 bp, Homo sapiens
catgggtagcctggg

SEQ ID NO: 6714256 - DNA, 19 bp, Homo sapiens
catgggtagcttctgacct

SEQ ID NO: 6714257 - DNA, 20 bp, Homo sapiens
catgggtatagttcatgtct

SEQ ID NO: 6714258 - DNA, 22 bp, Homo sapiens
catgggtatttttataacaata

SEQ ID NO: 6714259 - DNA, 14 bp, Homo sapiens
catgggtcaagaga

SEQ ID NO: 6714260 - DNA, 19 bp, Homo sapiens
catgggtcagggtgtgagg

SEQ ID NO: 6714261 - DNA, 18 bp, Homo sapiens
catgggtccaagagacat

SEQ ID NO: 6714262 - DNA, 15 bp, Homo sapiens
catgggtccagaaga

SEQ ID NO: 6714263 - DNA, 14 bp, Homo sapiens
catgggtcccttcc

SEQ ID NO: 6714264 - DNA, 22 bp, Homo sapiens
catgggtcccttgaaggaagag

SEQ ID NO: 6714265 - DNA, 21 bp, Homo sapiens
catgggtccttgatgccagag

SEQ ID NO: 6714266 - DNA, 23 bp, Homo sapiens
catgggtccttgatgccagaggg

SEQ ID NO: 6714267 - DNA, 17 bp, Homo sapiens
catgggtcgcccatgag

SEQ ID NO: 6714268 - DNA, 19 bp, Homo sapiens
catgggtcgcccatgagag

SEQ ID NO: 6714269 - DNA, 21 bp, Homo sapiens
catgggtcgcccatgagagcg

SEQ ID NO: 6714270 - DNA, 23 bp, Homo sapiens
catgggtcgggagaggggacgca

SEQ ID NO: 6714271 - DNA, 22 bp, Homo sapiens
catgggtgaagggagagccagc

SEQ ID NO: 6714272 - DNA, 18 bp, Homo sapiens
catgggtggtaacaagag

SEQ ID NO: 6714273 - DNA, 17 bp, Homo sapiens
catgggtgtgccaggct

SEQ ID NO: 6714274 - DNA, 18 bp, Homo sapiens
catgggtgtgcccttggg

SEQ ID NO: 6714275 - DNA, 16 bp, Homo sapiens
catgggtgtggatggc

SEQ ID NO: 6714276 - DNA, 18 bp, Homo sapiens
catgggtgtggatggcag

SEQ ID NO: 6714277 - DNA, 22 bp, Homo sapiens
catgggtgtggatggcagtgtg

SEQ ID NO: 6714278 - DNA, 19 bp, Homo sapiens
catgggttaattgagaata

SEQ ID NO: 6714279 - DNA, 17 bp, Homo sapiens
catggtaacgaacccct

SEQ ID NO: 6714280 - DNA, 20 bp, Homo sapiens
catggtaatgacagatgcaa

SEQ ID NO: 6714281 - DNA, 22 bp, Homo sapiens
catggtaatgacagatgcaagt

SEQ ID NO: 6714282 - DNA, 16 bp, Homo sapiens
catggtaccagccctg

SEQ ID NO: 6714283 - DNA, 21 bp, Homo sapiens
catggtacccccttctgggca

SEQ ID NO: 6714284 - DNA, 14 bp, Homo sapiens
catggtactacccc

SEQ ID NO: 6714285 - DNA, 18 bp, Homo sapiens
catggtacttcctctgtg

SEQ ID NO: 6714286 - DNA, 21 bp, Homo sapiens
catggtagactctttttgtaa

SEQ ID NO: 6714287 - DNA, 15 bp, Homo sapiens
catggtagtttaaaa

SEQ ID NO: 6714288 - DNA, 17 bp, Homo sapiens
catggtagtttaaaaca

SEQ ID NO: 6714289 - DNA, 18 bp, Homo sapiens
catggtagtttaaaacat

SEQ ID NO: 6714290 - DNA, 20 bp, Homo sapiens
catggtagtttaaaacatca

SEQ ID NO: 6714291 - DNA, 15 bp, Homo sapiens
catggtataattgaa

SEQ ID NO: 6714292 - DNA, 15 bp, Homo sapiens
catggtattcttctg

SEQ ID NO: 6714293 - DNA, 14 bp, Homo sapiens
catggtattgtaat

SEQ ID NO: 6714294 - DNA, 19 bp, Homo sapiens
catggtattgtaatgaata

SEQ ID NO: 6714295 - DNA, 17 bp, Homo sapiens
catggtcaaccctcagg

SEQ ID NO: 6714296 - DNA, 13 bp, Homo sapiens
catggtcaagcct

SEQ ID NO: 6714297 - DNA, 16 bp, Homo sapiens
catggtcaagcctctt

SEQ ID NO: 6714298 - DNA, 18 bp, Homo sapiens
catggtcaagttcccaac

SEQ ID NO: 6714299 - DNA, 14 bp, Homo sapiens
catggtcacacact

SEQ ID NO: 6714300 - DNA, 15 bp, Homo sapiens
catggtcacacactg

SEQ ID NO: 6714301 - DNA, 17 bp, Homo sapiens
catggtcacacactgat

SEQ ID NO: 6714302 - DNA, 21 bp, Homo sapiens
catggtcacacactgatgctt

SEQ ID NO: 6714303 - DNA, 14 bp, Homo sapiens
catggtcacagacc

SEQ ID NO: 6714304 - DNA, 22 bp, Homo sapiens
catggtcacagacccctggggg

SEQ ID NO: 6714305 - DNA, 12 bp, Homo sapiens
catggtcacagt

SEQ ID NO: 6714306 - DNA, 22 bp, Homo sapiens
catggtcacccccactctgcat

SEQ ID NO: 6714307 - DNA, 21 bp, Homo sapiens
catggtcagaacctttggaca

SEQ ID NO: 6714308 - DNA, 16 bp, Homo sapiens
catggtcagccctagg

SEQ ID NO: 6714309 - DNA, 16 bp, Homo sapiens
catggtcatcaccacc

SEQ ID NO: 6714310 - DNA, 17 bp, Homo sapiens
catggtcatcaccaccc

SEQ ID NO: 6714311 - DNA, 18 bp, Homo sapiens
catggtcatcaccaccct

SEQ ID NO: 6714312 - DNA, 14 bp, Homo sapiens
catggtccatcccc

SEQ ID NO: 6714313 - DNA, 15 bp, Homo sapiens
catggtccatcccct

SEQ ID NO: 6714314 - DNA, 14 bp, Homo sapiens
catggtccattctc

SEQ ID NO: 6714315 - DNA, 20 bp, Homo sapiens
catggtcccacatccctggg

SEQ ID NO: 6714316 - DNA, 22 bp, Homo sapiens
catggtcccacatccctgggcc

SEQ ID NO: 6714317 - DNA, 16 bp, Homo sapiens
catggtcccacttccc

SEQ ID NO: 6714318 - DNA, 15 bp, Homo sapiens
catggtccccatggc

SEQ ID NO: 6714319 - DNA, 17 bp, Homo sapiens
catggtccctgccttag

SEQ ID NO: 6714320 - DNA, 17 bp, Homo sapiens
catggtcccttaaggca

SEQ ID NO: 6714321 - DNA, 11 bp, Homo sapiens
catggtcctag

SEQ ID NO: 6714322 - DNA, 12 bp, Homo sapiens
catggtcctggc

SEQ ID NO: 6714323 - DNA, 13 bp, Homo sapiens
catggtcctggct

SEQ ID NO: 6714324 - DNA, 18 bp, Homo sapiens
catggtcctggctggaag

SEQ ID NO: 6714325 - DNA, 18 bp, Homo sapiens
catggtcctgtgccccga

SEQ ID NO: 6714326 - DNA, 18 bp, Homo sapiens
catggtcctttctggaag

SEQ ID NO: 6714327 - DNA, 17 bp, Homo sapiens
catggtcggaaaacatg

SEQ ID NO: 6714328 - DNA, 17 bp, Homo sapiens
catggtctagaaatgcg

SEQ ID NO: 6714329 - DNA, 13 bp, Homo sapiens
catggtctgccct

SEQ ID NO: 6714330 - DNA, 15 bp, Homo sapiens
catggtctgtcctga

SEQ ID NO: 6714331 - DNA, 14 bp, Homo sapiens
catggtctttgcta

SEQ ID NO: 6714332 - DNA, 11 bp, Homo sapiens
catggtgaaaa

SEQ ID NO: 6714333 - DNA, 21 bp, Homo sapiens
catggtgaaaatgtactgaga

SEQ ID NO: 6714334 - DNA, 21 bp, Homo sapiens
catggtgaaacccccatctct

SEQ ID NO: 6714335 - DNA, 16 bp, Homo sapiens
catggtgaaagggttt

SEQ ID NO: 6714336 - DNA, 14 bp, Homo sapiens
catggtgaagtgct

SEQ ID NO: 6714337 - DNA, 19 bp, Homo sapiens
catggtgacacacagcagc

SEQ ID NO: 6714338 - DNA, 21 bp, Homo sapiens
catggtgacacacagcagcac

SEQ ID NO: 6714339 - DNA, 16 bp, Homo sapiens
catggtgactaacagt

SEQ ID NO: 6714340 - DNA, 20 bp, Homo sapiens
catggtgagaccctgtctct

SEQ ID NO: 6714341 - DNA, 19 bp, Homo sapiens
catggtgagtctattttta

SEQ ID NO: 6714342 - DNA, 19 bp, Homo sapiens
catggtgatgcaagtcact

SEQ ID NO: 6714343 - DNA, 15 bp, Homo sapiens
catggtgattaaaat

SEQ ID NO: 6714344 - DNA, 13 bp, Homo sapiens
catggtgcaattt

SEQ ID NO: 6714345 - DNA, 15 bp, Homo sapiens
catggtgcagggaga

SEQ ID NO: 6714346 - DNA, 18 bp, Homo sapiens
catggtgccccaggacca

SEQ ID NO: 6714347 - DNA, 20 bp, Homo sapiens
catggtgccccaggaccagc

SEQ ID NO: 6714348 - DNA, 18 bp, Homo sapiens
catggtgcccctagcttt

SEQ ID NO: 6714349 - DNA, 22 bp, Homo sapiens
catggtgcctatatctgagaga

SEQ ID NO: 6714350 - DNA, 15 bp, Homo sapiens
catggtgcctctgga

SEQ ID NO: 6714351 - DNA, 15 bp, Homo sapiens
catggtgcctgagag

SEQ ID NO: 6714352 - DNA, 21 bp, Homo sapiens
catggtgcctgagaggcaggc

SEQ ID NO: 6714353 - DNA, 14 bp, Homo sapiens
catggtgctagtgg

SEQ ID NO: 6714354 - DNA, 16 bp, Homo sapiens
catggtgctgcattga

SEQ ID NO: 6714355 - DNA, 21 bp, Homo sapiens
catggtgctgtgtgtgagcga

SEQ ID NO: 6714356 - DNA, 19 bp, Homo sapiens
catggtgctttcaggtctg

SEQ ID NO: 6714357 - DNA, 20 bp, Homo sapiens
catggtggaaaacgaagctc

SEQ ID NO: 6714358 - DNA, 11 bp, Homo sapiens
catggtggcac

SEQ ID NO: 6714359 - DNA, 16 bp, Homo sapiens
catggtggcacgtgcc

SEQ ID NO: 6714360 - DNA, 20 bp, Homo sapiens
catggtggcacgtgcctgta

SEQ ID NO: 6714361 - DNA, 18 bp, Homo sapiens
catggtggcatgcacctg

SEQ ID NO: 6714362 - DNA, 16 bp, Homo sapiens
catggtggcatgtgcc

SEQ ID NO: 6714363 - DNA, 18 bp, Homo sapiens
catggtggcatgtgcctg

SEQ ID NO: 6714364 - DNA, 17 bp, Homo sapiens
catggtggcgcaagcct

SEQ ID NO: 6714365 - DNA, 17 bp, Homo sapiens
catggtggctcccgcct

SEQ ID NO: 6714366 - DNA, 16 bp, Homo sapiens
catggtgggagagact

SEQ ID NO: 6714367 - DNA, 19 bp, Homo sapiens
catggtggggcatgcctgt

SEQ ID NO: 6714368 - DNA, 15 bp, Homo sapiens
catggtggggtctcc

SEQ ID NO: 6714369 - DNA, 18 bp, Homo sapiens
catggtggggtctcctca

SEQ ID NO: 6714370 - DNA, 17 bp, Homo sapiens
catggtgtctcacacgt

SEQ ID NO: 6714371 - DNA, 18 bp, Homo sapiens
catggtgtctcccaacat

SEQ ID NO: 6714372 - DNA, 19 bp, Homo sapiens
catggtgtctcccaacatg

SEQ ID NO: 6714373 - DNA, 12 bp, Homo sapiens
catggtgtctgg

SEQ ID NO: 6714374 - DNA, 22 bp, Homo sapiens
catggtgtgaaagtcagatgcc

SEQ ID NO: 6714375 - DNA, 15 bp, Homo sapiens
catggtgtgaactaa

SEQ ID NO: 6714376 - DNA, 14 bp, Homo sapiens
catggtgtggccat

SEQ ID NO: 6714377 - DNA, 15 bp, Homo sapiens
catggtgtggccatc

SEQ ID NO: 6714378 - DNA, 21 bp, Homo sapiens
catggtgtggggggctggggg

SEQ ID NO: 6714379 - DNA, 22 bp, Homo sapiens
catggtgtggggggctggggga

SEQ ID NO: 6714380 - DNA, 14 bp, Homo sapiens
catggtgtgttaca

SEQ ID NO: 6714381 - DNA, 17 bp, Homo sapiens
catggtgtgtttgtaat

SEQ ID NO: 6714382 - DNA, 22 bp, Homo sapiens
catggtgttggaggggcaggcc

SEQ ID NO: 6714383 - DNA, 15 bp, Homo sapiens
catggtgtttatgca

SEQ ID NO: 6714384 - DNA, 16 bp, Homo sapiens
catggtgttttcattc

SEQ ID NO: 6714385 - DNA, 16 bp, Homo sapiens
catggtgtttttataa

SEQ ID NO: 6714386 - DNA, 16 bp, Homo sapiens
catggttaacaccaga

SEQ ID NO: 6714387 - DNA, 21 bp, Homo sapiens
catggttacaatcattgctga

SEQ ID NO: 6714388 - DNA, 22 bp, Homo sapiens
catggttacatatcaaaacatc

SEQ ID NO: 6714389 - DNA, 18 bp, Homo sapiens
catggttaccatgtcttt

SEQ ID NO: 6714390 - DNA, 23 bp, Homo sapiens
catggttccaattttttttaagt

SEQ ID NO: 6714391 - DNA, 20 bp, Homo sapiens
catggttccttccctgggaa

SEQ ID NO: 6714392 - DNA, 14 bp, Homo sapiens
catggttctcaatt

SEQ ID NO: 6714393 - DNA, 15 bp, Homo sapiens
catggttctcaattt

SEQ ID NO: 6714394 - DNA, 14 bp, Homo sapiens
catggttctgcctc

SEQ ID NO: 6714395 - DNA, 18 bp, Homo sapiens
catggttctgcctcctgg

SEQ ID NO: 6714396 - DNA, 19 bp, Homo sapiens
catggttctgcctcctggc

SEQ ID NO: 6714397 - DNA, 20 bp, Homo sapiens
catggttctgcctcctggcc

SEQ ID NO: 6714398 - DNA, 14 bp, Homo sapiens
catggttgggggaa

SEQ ID NO: 6714399 - DNA, 22 bp, Homo sapiens
catggttgttgcatatagttaa

SEQ ID NO: 6714400 - DNA, 19 bp, Homo sapiens
catggtttaaaagaaaaaa

SEQ ID NO: 6714401 - DNA, 16 bp, Homo sapiens
catggtttcagcacta

SEQ ID NO: 6714402 - DNA, 17 bp, Homo sapiens
catggtttccatttact

SEQ ID NO: 6714403 - DNA, 16 bp, Homo sapiens
catggtttggagctga

SEQ ID NO: 6714404 - DNA, 16 bp, Homo sapiens
catggttttaaagcta

SEQ ID NO: 6714405 - DNA, 22 bp, Homo sapiens
catggttttggctctcccaccc

SEQ ID NO: 6714406 - DNA, 19 bp, Homo sapiens
catggttttgtgccatctg

SEQ ID NO: 6714407 - DNA, 20 bp, Homo sapiens
catggttttgtgccatctgt

SEQ ID NO: 6714408 - DNA, 17 bp, Homo sapiens
catggtttttataatat

SEQ ID NO: 6714409 - DNA, 18 bp, Homo sapiens
catggtttttgctctact

SEQ ID NO: 6714410 - DNA, 23 bp, Homo sapiens
catgtaaaaaatgtaaaatggag

SEQ ID NO: 6714411 - DNA, 18 bp, Homo sapiens
catgtaaaaagacaaaaa

SEQ ID NO: 6714412 - DNA, 22 bp, Homo sapiens
catgtaaaaagacaaaaaccaa

SEQ ID NO: 6714413 - DNA, 18 bp, Homo sapiens
catgtaaaaagtgcagta

SEQ ID NO: 6714414 - DNA, 15 bp, Homo sapiens
catgtaaaacaaaaa

SEQ ID NO: 6714415 - DNA, 19 bp, Homo sapiens
catgtaaaacaaaaaacaa

SEQ ID NO: 6714416 - DNA, 15 bp, Homo sapiens
catgtaaaacagaaa

SEQ ID NO: 6714417 - DNA, 16 bp, Homo sapiens
catgtaaaagcggaaa

SEQ ID NO: 6714418 - DNA, 13 bp, Homo sapiens
catgtaaaataag

SEQ ID NO: 6714419 - DNA, 13 bp, Homo sapiens
catgtaaaatctt

SEQ ID NO: 6714420 - DNA, 17 bp, Homo sapiens
catgtaaaatcttcagc

SEQ ID NO: 6714421 - DNA, 14 bp, Homo sapiens
catgtaaaatgcag

SEQ ID NO: 6714422 - DNA, 17 bp, Homo sapiens
catgtaaacaaatattt

SEQ ID NO: 6714423 - DNA, 18 bp, Homo sapiens
catgtaaacaaatatttt

SEQ ID NO: 6714424 - DNA, 16 bp, Homo sapiens
catgtaaactatttgt

SEQ ID NO: 6714425 - DNA, 15 bp, Homo sapiens
catgtaaactgtgca

SEQ ID NO: 6714426 - DNA, 18 bp, Homo sapiens
catgtaaagaaatgtctt

SEQ ID NO: 6714427 - DNA, 21 bp, Homo sapiens
catgtaaagcagtattaaaat

SEQ ID NO: 6714428 - DNA, 22 bp, Homo sapiens
catgtaaagctgttaaaataca

SEQ ID NO: 6714429 - DNA, 14 bp, Homo sapiens
catgtaaataaata

SEQ ID NO: 6714430 - DNA, 21 bp, Homo sapiens
catgtaaataccagactgcag

SEQ ID NO: 6714431 - DNA, 22 bp, Homo sapiens
catgtaaataccagactgcagg

SEQ ID NO: 6714432 - DNA, 23 bp, Homo sapiens
catgtaaatactttccatgtttt

SEQ ID NO: 6714433 - DNA, 21 bp, Homo sapiens
catgtaaatccccactgggac

SEQ ID NO: 6714434 - DNA, 12 bp, Homo sapiens
catgtaaatgct

SEQ ID NO: 6714435 - DNA, 18 bp, Homo sapiens
catgtaaatgtaaactca

SEQ ID NO: 6714436 - DNA, 17 bp, Homo sapiens
catgtaaattaagtgtg

SEQ ID NO: 6714437 - DNA, 19 bp, Homo sapiens
catgtaaattaagtgtgtg

SEQ ID NO: 6714438 - DNA, 18 bp, Homo sapiens
catgtaacacataaacaa

SEQ ID NO: 6714439 - DNA, 14 bp, Homo sapiens
catgtaacagaaag

SEQ ID NO: 6714440 - DNA, 16 bp, Homo sapiens
catgtaacagttgtgt

SEQ ID NO: 6714441 - DNA, 16 bp, Homo sapiens
catgtaaccactgcac

SEQ ID NO: 6714442 - DNA, 18 bp, Homo sapiens
catgtaaccggcatgttt

SEQ ID NO: 6714443 - DNA, 19 bp, Homo sapiens
catgtaacgcaagttccca

SEQ ID NO: 6714444 - DNA, 17 bp, Homo sapiens
catgtaactatgtatca

SEQ ID NO: 6714445 - DNA, 15 bp, Homo sapiens
catgtaactatttct

SEQ ID NO: 6714446 - DNA, 21 bp, Homo sapiens
catgtaactctccagccattg

SEQ ID NO: 6714447 - DNA, 19 bp, Homo sapiens
catgtaactgcctagaaac

SEQ ID NO: 6714448 - DNA, 17 bp, Homo sapiens
catgtaacttttttatt

SEQ ID NO: 6714449 - DNA, 14 bp, Homo sapiens
catgtaagaagccc

SEQ ID NO: 6714450 - DNA, 15 bp, Homo sapiens
catgtaagatggcaa

SEQ ID NO: 6714451 - DNA, 23 bp, Homo sapiens
catgtaagctgaaaatatggcaa

SEQ ID NO: 6714452 - DNA, 20 bp, Homo sapiens
catgtaaggtcttcttgtgt

SEQ ID NO: 6714453 - DNA, 20 bp, Homo sapiens
catgtaaggttgtgcagggt

SEQ ID NO: 6714454 - DNA, 21 bp, Homo sapiens
catgtaaggttgtgcagggtg

SEQ ID NO: 6714455 - DNA, 13 bp, Homo sapiens
catgtaatactga

SEQ ID NO: 6714456 - DNA, 15 bp, Homo sapiens
catgtaatgatcttg

SEQ ID NO: 6714457 - DNA, 19 bp, Homo sapiens
catgtaatgttaatgttat

SEQ ID NO: 6714458 - DNA, 16 bp, Homo sapiens
catgtaattatctagt

SEQ ID NO: 6714459 - DNA, 14 bp, Homo sapiens
catgtaatttgtgt

SEQ ID NO: 6714460 - DNA, 18 bp, Homo sapiens
catgtaatttgtgtaaat

SEQ ID NO: 6714461 - DNA, 19 bp, Homo sapiens
catgtaattttattttaaa

SEQ ID NO: 6714462 - DNA, 16 bp, Homo sapiens
catgtacaaaaacaca

SEQ ID NO: 6714463 - DNA, 19 bp, Homo sapiens
catgtacaaaaattatgca

SEQ ID NO: 6714464 - DNA, 21 bp, Homo sapiens
catgtacaaaatcgattggct

SEQ ID NO: 6714465 - DNA, 14 bp, Homo sapiens
catgtacagacaga

SEQ ID NO: 6714466 - DNA, 15 bp, Homo sapiens
catgtacagcatgca

SEQ ID NO: 6714467 - DNA, 11 bp, Homo sapiens
catgtacagtg

SEQ ID NO: 6714468 - DNA, 19 bp, Homo sapiens
catgtacagtgttctgttt

SEQ ID NO: 6714469 - DNA, 21 bp, Homo sapiens
catgtacagtgttctgtttaa

SEQ ID NO: 6714470 - DNA, 22 bp, Homo sapiens
catgtacagtgttctgtttaat

SEQ ID NO: 6714471 - DNA, 19 bp, Homo sapiens
catgtacataaactgtcac

SEQ ID NO: 6714472 - DNA, 20 bp, Homo sapiens
catgtacatagtaaagtatt

SEQ ID NO: 6714473 - DNA, 22 bp, Homo sapiens
catgtaccagtgtactgctttc

SEQ ID NO: 6714474 - DNA, 19 bp, Homo sapiens
catgtaccatttgcatggc

SEQ ID NO: 6714475 - DNA, 21 bp, Homo sapiens
catgtacccattgcagaccct

SEQ ID NO: 6714476 - DNA, 18 bp, Homo sapiens
catgtaccccctttccct

SEQ ID NO: 6714477 - DNA, 19 bp, Homo sapiens
catgtaccctaaggtcatt

SEQ ID NO: 6714478 - DNA, 19 bp, Homo sapiens
catgtacctaatccaaata

SEQ ID NO: 6714479 - DNA, 22 bp, Homo sapiens
catgtacctaatccaaatatca

SEQ ID NO: 6714480 - DNA, 13 bp, Homo sapiens
catgtacctcccc

SEQ ID NO: 6714481 - DNA, 22 bp, Homo sapiens
catgtacctcccctgccttgct

SEQ ID NO: 6714482 - DNA, 18 bp, Homo sapiens
catgtaccttgtgtactt

SEQ ID NO: 6714483 - DNA, 22 bp, Homo sapiens
catgtactacagctatatttga

SEQ ID NO: 6714484 - DNA, 21 bp, Homo sapiens
catgtactagtcctctagaaa

SEQ ID NO: 6714485 - DNA, 21 bp, Homo sapiens
catgtactatcttatctcaga

SEQ ID NO: 6714486 - DNA, 17 bp, Homo sapiens
catgtactcaagtacca

SEQ ID NO: 6714487 - DNA, 19 bp, Homo sapiens
catgtactgagacaaaaag

SEQ ID NO: 6714488 - DNA, 23 bp, Homo sapiens
catgtactgagccttgtaattct

SEQ ID NO: 6714489 - DNA, 17 bp, Homo sapiens
catgtactgcattattt

SEQ ID NO: 6714490 - DNA, 24 bp, Homo sapiens
catgtactgctagtacctgtaagc

SEQ ID NO: 6714491 - DNA, 13 bp, Homo sapiens
catgtactgtagt

SEQ ID NO: 6714492 - DNA, 17 bp, Homo sapiens
catgtacttcctgtgta

SEQ ID NO: 6714493 - DNA, 14 bp, Homo sapiens
catgtacttcttta

SEQ ID NO: 6714494 - DNA, 12 bp, Homo sapiens
catgtacttgaa

SEQ ID NO: 6714495 - DNA, 13 bp, Homo sapiens
catgtacttgaag

SEQ ID NO: 6714496 - DNA, 20 bp, Homo sapiens
catgtagaaaatttgttatt

SEQ ID NO: 6714497 - DNA, 16 bp, Homo sapiens
catgtagaacaagaaa

SEQ ID NO: 6714498 - DNA, 21 bp, Homo sapiens
catgtagaacaagaaatcttt

SEQ ID NO: 6714499 - DNA, 21 bp, Homo sapiens
catgtagaactcagcagttga

SEQ ID NO: 6714500 - DNA, 23 bp, Homo sapiens
catgtagaagagggagaaggaga

SEQ ID NO: 6714501 - DNA, 19 bp, Homo sapiens
catgtagaagctgcatctt

SEQ ID NO: 6714502 - DNA, 13 bp, Homo sapiens
catgtagagaaaa

SEQ ID NO: 6714503 - DNA, 23 bp, Homo sapiens
catgtagcaatcagattttcctg

SEQ ID NO: 6714504 - DNA, 15 bp, Homo sapiens
catgtagcatataaa

SEQ ID NO: 6714505 - DNA, 19 bp, Homo sapiens
catgtagccccagtcagaa

SEQ ID NO: 6714506 - DNA, 23 bp, Homo sapiens
catgtagctctatggggggaggg

SEQ ID NO: 6714507 - DNA, 13 bp, Homo sapiens
catgtagctggca

SEQ ID NO: 6714508 - DNA, 15 bp, Homo sapiens
catgtagctggcaag

SEQ ID NO: 6714509 - DNA, 20 bp, Homo sapiens
catgtagctggcaagctgca

SEQ ID NO: 6714510 - DNA, 19 bp, Homo sapiens
catgtagcttcttctgaaa

SEQ ID NO: 6714511 - DNA, 18 bp, Homo sapiens
catgtaggctaagaaaga

SEQ ID NO: 6714512 - DNA, 14 bp, Homo sapiens
catgtagggcaaga

SEQ ID NO: 6714513 - DNA, 17 bp, Homo sapiens
catgtagggcaagagga

SEQ ID NO: 6714514 - DNA, 20 bp, Homo sapiens
catgtaggttgtctaaaaat

SEQ ID NO: 6714515 - DNA, 22 bp, Homo sapiens
catgtaggttgtctaaaaataa

SEQ ID NO: 6714516 - DNA, 17 bp, Homo sapiens
catgtagtaacactaat

SEQ ID NO: 6714517 - DNA, 19 bp, Homo sapiens
catgtagtaacactaatat

SEQ ID NO: 6714518 - DNA, 19 bp, Homo sapiens
catgtagtagcctttcctg

SEQ ID NO: 6714519 - DNA, 21 bp, Homo sapiens
catgtagtatcaaatattaga

SEQ ID NO: 6714520 - DNA, 15 bp, Homo sapiens
catgtagtgctctca

SEQ ID NO: 6714521 - DNA, 14 bp, Homo sapiens
catgtagttttaac

SEQ ID NO: 6714522 - DNA, 15 bp, Homo sapiens
catgtataaagtgat

SEQ ID NO: 6714523 - DNA, 18 bp, Homo sapiens
catgtataaagtgattga

SEQ ID NO: 6714524 - DNA, 14 bp, Homo sapiens
catgtataaatgaa

SEQ ID NO: 6714525 - DNA, 20 bp, Homo sapiens
catgtataaccaagtgtgct

SEQ ID NO: 6714526 - DNA, 20 bp, Homo sapiens
catgtataatatttttaatt

SEQ ID NO: 6714527 - DNA, 21 bp, Homo sapiens
catgtataatttttttcttgt

SEQ ID NO: 6714528 - DNA, 15 bp, Homo sapiens
catgtatagtgagtg

SEQ ID NO: 6714529 - DNA, 17 bp, Homo sapiens
catgtatattttctcta

SEQ ID NO: 6714530 - DNA, 16 bp, Homo sapiens
catgtatcactcactg

SEQ ID NO: 6714531 - DNA, 18 bp, Homo sapiens
catgtatcataattacca

SEQ ID NO: 6714532 - DNA, 21 bp, Homo sapiens
catgtatcccaactcctataa

SEQ ID NO: 6714533 - DNA, 20 bp, Homo sapiens
catgtatctatgcattttct

SEQ ID NO: 6714534 - DNA, 23 bp, Homo sapiens
catgtatctatgcattttctgga

SEQ ID NO: 6714535 - DNA, 18 bp, Homo sapiens
catgtatctgtctacttt

SEQ ID NO: 6714536 - DNA, 14 bp, Homo sapiens
catgtatgaatgta

SEQ ID NO: 6714537 - DNA, 15 bp, Homo sapiens
catgtatgaatgtaa

SEQ ID NO: 6714538 - DNA, 18 bp, Homo sapiens
catgtatgaatgtaagga

SEQ ID NO: 6714539 - DNA, 17 bp, Homo sapiens
catgtatgccatgtatg

SEQ ID NO: 6714540 - DNA, 14 bp, Homo sapiens
catgtatgcctgcc

SEQ ID NO: 6714541 - DNA, 15 bp, Homo sapiens
catgtatgcttccag

SEQ ID NO: 6714542 - DNA, 21 bp, Homo sapiens
catgtatggacgtgtgtgaat

SEQ ID NO: 6714543 - DNA, 20 bp, Homo sapiens
catgtatggttactaaaaag

SEQ ID NO: 6714544 - DNA, 13 bp, Homo sapiens
catgtatgtcttg

SEQ ID NO: 6714545 - DNA, 18 bp, Homo sapiens
catgtatgtcttggacac

SEQ ID NO: 6714546 - DNA, 22 bp, Homo sapiens
catgtatgtcttggacactgta

SEQ ID NO: 6714547 - DNA, 10 bp, Homo sapiens
catgtatgtg

SEQ ID NO: 6714548 - DNA, 16 bp, Homo sapiens
catgtatgtgcacatg

SEQ ID NO: 6714549 - DNA, 20 bp, Homo sapiens
catgtatgtgcacatgtgtc

SEQ ID NO: 6714550 - DNA, 21 bp, Homo sapiens
catgtatgtgcacatgtgtct

SEQ ID NO: 6714551 - DNA, 19 bp, Homo sapiens
catgtatgtggtatgtata

SEQ ID NO: 6714552 - DNA, 14 bp, Homo sapiens
catgtatgtgtgct

SEQ ID NO: 6714553 - DNA, 15 bp, Homo sapiens
catgtatgtgtgtgt

SEQ ID NO: 6714554 - DNA, 18 bp, Homo sapiens
catgtatgttatgatatt

SEQ ID NO: 6714555 - DNA, 23 bp, Homo sapiens
catgtatgttatgatattgttta

SEQ ID NO: 6714556 - DNA, 16 bp, Homo sapiens
catgtatgttgcatga

SEQ ID NO: 6714557 - DNA, 18 bp, Homo sapiens
catgtatgttgcatgaat

SEQ ID NO: 6714558 - DNA, 13 bp, Homo sapiens
catgtatgtttct

SEQ ID NO: 6714559 - DNA, 13 bp, Homo sapiens
catgtattatgaa

SEQ ID NO: 6714560 - DNA, 15 bp, Homo sapiens
catgtattatttcat

SEQ ID NO: 6714561 - DNA, 15 bp, Homo sapiens
catgtattcatccag

SEQ ID NO: 6714562 - DNA, 16 bp, Homo sapiens
catgtattcatccaga

SEQ ID NO: 6714563 - DNA, 18 bp, Homo sapiens
catgtattcatccagagt

SEQ ID NO: 6714564 - DNA, 21 bp, Homo sapiens
catgtattgtgtcttttgcat

SEQ ID NO: 6714565 - DNA, 23 bp, Homo sapiens
catgtatttattcctctgtccta

SEQ ID NO: 6714566 - DNA, 16 bp, Homo sapiens
catgtatttcagggac

SEQ ID NO: 6714567 - DNA, 18 bp, Homo sapiens
catgtatttcagggacct

SEQ ID NO: 6714568 - DNA, 23 bp, Homo sapiens
catgtatttcagggacctcaggg

SEQ ID NO: 6714569 - DNA, 20 bp, Homo sapiens
catgtatttggtgattacat

SEQ ID NO: 6714570 - DNA, 14 bp, Homo sapiens
catgtatttgttat

SEQ ID NO: 6714571 - DNA, 20 bp, Homo sapiens
catgtatttgttatatataa

SEQ ID NO: 6714572 - DNA, 22 bp, Homo sapiens
catgtatttgttatatataata

SEQ ID NO: 6714573 - DNA, 12 bp, Homo sapiens
catgtattttat

SEQ ID NO: 6714574 - DNA, 15 bp, Homo sapiens
catgtcaaacaaata

SEQ ID NO: 6714575 - DNA, 13 bp, Homo sapiens
catgtcaaacatg

SEQ ID NO: 6714576 - DNA, 20 bp, Homo sapiens
catgtcaaagctgcatgtgt

SEQ ID NO: 6714577 - DNA, 15 bp, Homo sapiens
catgtcaacagcgtt

SEQ ID NO: 6714578 - DNA, 15 bp, Homo sapiens
catgtcacatgacat

SEQ ID NO: 6714579 - DNA, 16 bp, Homo sapiens
catgtcacatgacatc

SEQ ID NO: 6714580 - DNA, 22 bp, Homo sapiens
catgtcacatgacatccacatg

SEQ ID NO: 6714581 - DNA, 15 bp, Homo sapiens
catgtcacatgccac

SEQ ID NO: 6714582 - DNA, 19 bp, Homo sapiens
catgtcaccggtcagtgcc

SEQ ID NO: 6714583 - DNA, 16 bp, Homo sapiens
catgtcacctcagctg

SEQ ID NO: 6714584 - DNA, 20 bp, Homo sapiens
catgtcacctggctgctagg

SEQ ID NO: 6714585 - DNA, 22 bp, Homo sapiens
catgtcacctggctgctaggcc

SEQ ID NO: 6714586 - DNA, 15 bp, Homo sapiens
catgtcactcccaga

SEQ ID NO: 6714587 - DNA, 13 bp, Homo sapiens
catgtcactgtgg

SEQ ID NO: 6714588 - DNA, 15 bp, Homo sapiens
catgtcactgtggtc

SEQ ID NO: 6714589 - DNA, 16 bp, Homo sapiens
catgtcactgtggtcc

SEQ ID NO: 6714590 - DNA, 15 bp, Homo sapiens
catgtcagagccagg

SEQ ID NO: 6714591 - DNA, 21 bp, Homo sapiens
catgtcagagccaggctctgc

SEQ ID NO: 6714592 - DNA, 19 bp, Homo sapiens
catgtcagaggaccccagg

SEQ ID NO: 6714593 - DNA, 20 bp, Homo sapiens
catgtcagaggaccccaggg

SEQ ID NO: 6714594 - DNA, 23 bp, Homo sapiens
catgtcagaggaccccagggtgg

SEQ ID NO: 6714595 - DNA, 22 bp, Homo sapiens
catgtcagataagtgtaaatag

SEQ ID NO: 6714596 - DNA, 16 bp, Homo sapiens
catgtcagcaaaaagc

SEQ ID NO: 6714597 - DNA, 18 bp, Homo sapiens
catgtcagcaaaaagcaa

SEQ ID NO: 6714598 - DNA, 18 bp, Homo sapiens
catgtcagcatcagctca

SEQ ID NO: 6714599 - DNA, 13 bp, Homo sapiens
catgtcaggccag

SEQ ID NO: 6714600 - DNA, 21 bp, Homo sapiens
catgtcatgtaggttgtctaa

SEQ ID NO: 6714601 - DNA, 15 bp, Homo sapiens
catgtcatgtgccac

SEQ ID NO: 6714602 - DNA, 20 bp, Homo sapiens
catgtcattgcccacttctg

SEQ ID NO: 6714603 - DNA, 15 bp, Homo sapiens
catgtcatttctcat

SEQ ID NO: 6714604 - DNA, 19 bp, Homo sapiens
catgtccaaacgtcctctt

SEQ ID NO: 6714605 - DNA, 19 bp, Homo sapiens
catgtccaaagaggctgcc

SEQ ID NO: 6714606 - DNA, 18 bp, Homo sapiens
catgtccaagaagcccag

SEQ ID NO: 6714607 - DNA, 20 bp, Homo sapiens
catgtccaagaagcccagga

SEQ ID NO: 6714608 - DNA, 24 bp, Homo sapiens
catgtccaagtccaacctgcctgt

SEQ ID NO: 6714609 - DNA, 17 bp, Homo sapiens
catgtccaagttcttca

SEQ ID NO: 6714610 - DNA, 22 bp, Homo sapiens
catgtccaagttcttcacctct

SEQ ID NO: 6714611 - DNA, 19 bp, Homo sapiens
catgtccagcaccttgtgc

SEQ ID NO: 6714612 - DNA, 22 bp, Homo sapiens
catgtccatacactttgttgca

SEQ ID NO: 6714613 - DNA, 22 bp, Homo sapiens
catgtccatcccttttcctgtc

SEQ ID NO: 6714614 - DNA, 20 bp, Homo sapiens
catgtcccagatcgtctcca

SEQ ID NO: 6714615 - DNA, 17 bp, Homo sapiens
catgtcccccgtgcacg

SEQ ID NO: 6714616 - DNA, 13 bp, Homo sapiens
catgtccccctta

SEQ ID NO: 6714617 - DNA, 15 bp, Homo sapiens
catgtcccctcccag

SEQ ID NO: 6714618 - DNA, 20 bp, Homo sapiens
catgtccccttcctgttctt

SEQ ID NO: 6714619 - DNA, 13 bp, Homo sapiens
catgtccctccaa

SEQ ID NO: 6714620 - DNA, 21 bp, Homo sapiens
catgtccctccaaggctgtct

SEQ ID NO: 6714621 - DNA, 14 bp, Homo sapiens
catgtccctccagg

SEQ ID NO: 6714622 - DNA, 15 bp, Homo sapiens
catgtcctatccaaa

SEQ ID NO: 6714623 - DNA, 11 bp, Homo sapiens
catgtcctctc

SEQ ID NO: 6714624 - DNA, 12 bp, Homo sapiens
catgtcctgctg

SEQ ID NO: 6714625 - DNA, 13 bp, Homo sapiens
catgtcctgtcct

SEQ ID NO: 6714626 - DNA, 21 bp, Homo sapiens
catgtcctgtcctggtcctga

SEQ ID NO: 6714627 - DNA, 15 bp, Homo sapiens
catgtcctgtgtcag

SEQ ID NO: 6714628 - DNA, 21 bp, Homo sapiens
catgtccttagcacagggggg

SEQ ID NO: 6714629 - DNA, 17 bp, Homo sapiens
catgtcctttccatctg

SEQ ID NO: 6714630 - DNA, 19 bp, Homo sapiens
catgtcctttccatctgtc

SEQ ID NO: 6714631 - DNA, 20 bp, Homo sapiens
catgtcgaggctagaggcat

SEQ ID NO: 6714632 - DNA, 16 bp, Homo sapiens
catgtcgcacaatgtt

SEQ ID NO: 6714633 - DNA, 15 bp, Homo sapiens
catgtcgcctctgca

SEQ ID NO: 6714634 - DNA, 18 bp, Homo sapiens
catgtcgcctgcccccag

SEQ ID NO: 6714635 - DNA, 22 bp, Homo sapiens
catgtcgcgctcagcatgcatc

SEQ ID NO: 6714636 - DNA, 13 bp, Homo sapiens
catgtcgcttttg

SEQ ID NO: 6714637 - DNA, 20 bp, Homo sapiens
catgtcggagtagaaattgt

SEQ ID NO: 6714638 - DNA, 16 bp, Homo sapiens
catgtctaattcattt

SEQ ID NO: 6714639 - DNA, 18 bp, Homo sapiens
catgtctacaaaagcaaa

SEQ ID NO: 6714640 - DNA, 18 bp, Homo sapiens
catgtctactttttaatt

SEQ ID NO: 6714641 - DNA, 17 bp, Homo sapiens
catgtctattcagcttc

SEQ ID NO: 6714642 - DNA, 18 bp, Homo sapiens
catgtctattccattccc

SEQ ID NO: 6714643 - DNA, 15 bp, Homo sapiens
catgtctcacagacg

SEQ ID NO: 6714644 - DNA, 17 bp, Homo sapiens
catgtctcagcctcctc

SEQ ID NO: 6714645 - DNA, 18 bp, Homo sapiens
catgtctcagcctcctca

SEQ ID NO: 6714646 - DNA, 18 bp, Homo sapiens
catgtctcctactgagga

SEQ ID NO: 6714647 - DNA, 20 bp, Homo sapiens
catgtctcctactgaggata

SEQ ID NO: 6714648 - DNA, 14 bp, Homo sapiens
catgtctcgactca

SEQ ID NO: 6714649 - DNA, 21 bp, Homo sapiens
catgtctctacccactatgca

SEQ ID NO: 6714650 - DNA, 17 bp, Homo sapiens
catgtctctcagaattc

SEQ ID NO: 6714651 - DNA, 15 bp, Homo sapiens
catgtctctctgcca

SEQ ID NO: 6714652 - DNA, 15 bp, Homo sapiens
catgtctctttgcca

SEQ ID NO: 6714653 - DNA, 18 bp, Homo sapiens
catgtctctttggggaga

SEQ ID NO: 6714654 - DNA, 23 bp, Homo sapiens
catgtctctttggggagagctgg

SEQ ID NO: 6714655 - DNA, 16 bp, Homo sapiens
catgtctgcacctccg

SEQ ID NO: 6714656 - DNA, 17 bp, Homo sapiens
catgtctgcacctccgc

SEQ ID NO: 6714657 - DNA, 15 bp, Homo sapiens
catgtctgcatttcg

SEQ ID NO: 6714658 - DNA, 17 bp, Homo sapiens
catgtctgcctatgcac

SEQ ID NO: 6714659 - DNA, 21 bp, Homo sapiens
catgtctggagtcccctcctc

SEQ ID NO: 6714660 - DNA, 18 bp, Homo sapiens
catgtctgtaatcccagc

SEQ ID NO: 6714661 - DNA, 22 bp, Homo sapiens
catgtctgtatactcctgtcac

SEQ ID NO: 6714662 - DNA, 20 bp, Homo sapiens
catgtctgtatccccagtgc

SEQ ID NO: 6714663 - DNA, 21 bp, Homo sapiens
catgtctgtatccccagtgcc

SEQ ID NO: 6714664 - DNA, 17 bp, Homo sapiens
catgtctgtcctcagag

SEQ ID NO: 6714665 - DNA, 14 bp, Homo sapiens
catgtctgttgttg

SEQ ID NO: 6714666 - DNA, 23 bp, Homo sapiens
catgtctgttgttggtcatctct

SEQ ID NO: 6714667 - DNA, 18 bp, Homo sapiens
catgtcttaatgaagttt

SEQ ID NO: 6714668 - DNA, 23 bp, Homo sapiens
catgtcttaatgaagtttgaatg

SEQ ID NO: 6714669 - DNA, 14 bp, Homo sapiens
catgtcttatttaa

SEQ ID NO: 6714670 - DNA, 23 bp, Homo sapiens
catgtcttctcacaagccagcca

SEQ ID NO: 6714671 - DNA, 14 bp, Homo sapiens
catgtcttgtacat

SEQ ID NO: 6714672 - DNA, 15 bp, Homo sapiens
catgtcttgtacatg

SEQ ID NO: 6714673 - DNA, 21 bp, Homo sapiens
catgtcttgtcatacaaattt

SEQ ID NO: 6714674 - DNA, 14 bp, Homo sapiens
catgtctttactag

SEQ ID NO: 6714675 - DNA, 13 bp, Homo sapiens
catgtctttactg

SEQ ID NO: 6714676 - DNA, 14 bp, Homo sapiens
catgtctttactgg

SEQ ID NO: 6714677 - DNA, 21 bp, Homo sapiens
catgtctttccacttctctgg

SEQ ID NO: 6714678 - DNA, 20 bp, Homo sapiens
catgtctttctccaaagtta

SEQ ID NO: 6714679 - DNA, 20 bp, Homo sapiens
catgtctttggcttcagaat

SEQ ID NO: 6714680 - DNA, 23 bp, Homo sapiens
catgtcttttcttgcatgaggct

SEQ ID NO: 6714681 - DNA, 17 bp, Homo sapiens
catgtgaaaatcaaata

SEQ ID NO: 6714682 - DNA, 13 bp, Homo sapiens
catgtgaaacctt

SEQ ID NO: 6714683 - DNA, 21 bp, Homo sapiens
catgtgaaaccttttttaaga

SEQ ID NO: 6714684 - DNA, 17 bp, Homo sapiens
catgtgaaactcatctc

SEQ ID NO: 6714685 - DNA, 15 bp, Homo sapiens
catgtgaaatcattc

SEQ ID NO: 6714686 - DNA, 17 bp, Homo sapiens
catgtgaaatcattcat

SEQ ID NO: 6714687 - DNA, 15 bp, Homo sapiens
catgtgaacctcaaa

SEQ ID NO: 6714688 - DNA, 13 bp, Homo sapiens
catgtgaagaggg

SEQ ID NO: 6714689 - DNA, 16 bp, Homo sapiens
catgtgaagtgtatat

SEQ ID NO: 6714690 - DNA, 20 bp, Homo sapiens
catgtgaagtgttgtggaga

SEQ ID NO: 6714691 - DNA, 20 bp, Homo sapiens
catgtgaattctgtgaagaa

SEQ ID NO: 6714692 - DNA, 13 bp, Homo sapiens
catgtgacacata

SEQ ID NO: 6714693 - DNA, 18 bp, Homo sapiens
catgtgacacccacaatc

SEQ ID NO: 6714694 - DNA, 21 bp, Homo sapiens
catgtgaccacatacgtgtta

SEQ ID NO: 6714695 - DNA, 15 bp, Homo sapiens
catgtgaccattctg

SEQ ID NO: 6714696 - DNA, 19 bp, Homo sapiens
catgtgaccgaacactgca

SEQ ID NO: 6714697 - DNA, 19 bp, Homo sapiens
catgtgactagcgcctggc

SEQ ID NO: 6714698 - DNA, 16 bp, Homo sapiens
catgtgactctgaagc

SEQ ID NO: 6714699 - DNA, 14 bp, Homo sapiens
catgtgactctttc

SEQ ID NO: 6714700 - DNA, 16 bp, Homo sapiens
catgtgactctttcca

SEQ ID NO: 6714701 - DNA, 22 bp, Homo sapiens
catgtgacttctcccctgccct

SEQ ID NO: 6714702 - DNA, 18 bp, Homo sapiens
catgtgagaaagctaaaa

SEQ ID NO: 6714703 - DNA, 16 bp, Homo sapiens
catgtgagaatatttt

SEQ ID NO: 6714704 - DNA, 19 bp, Homo sapiens
catgtgagaatatttttcc

SEQ ID NO: 6714705 - DNA, 22 bp, Homo sapiens
catgtgagatagttttcatttt

SEQ ID NO: 6714706 - DNA, 23 bp, Homo sapiens
catgtgagatagttttcatttta

SEQ ID NO: 6714707 - DNA, 22 bp, Homo sapiens
catgtgagcatggtcacaagca

SEQ ID NO: 6714708 - DNA, 17 bp, Homo sapiens
catgtgagccaccgctg

SEQ ID NO: 6714709 - DNA, 20 bp, Homo sapiens
catgtgagccaccgctgcca

SEQ ID NO: 6714710 - DNA, 13 bp, Homo sapiens
catgtgagcctcg

SEQ ID NO: 6714711 - DNA, 15 bp, Homo sapiens
catgtgaggaggaaa

SEQ ID NO: 6714712 - DNA, 17 bp, Homo sapiens
catgtgagtattaataa

SEQ ID NO: 6714713 - DNA, 21 bp, Homo sapiens
catgtgagtgacgatgatgta

SEQ ID NO: 6714714 - DNA, 22 bp, Homo sapiens
catgtgataactgattattact

SEQ ID NO: 6714715 - DNA, 22 bp, Homo sapiens
catgtgatacattttttaagct

SEQ ID NO: 6714716 - DNA, 18 bp, Homo sapiens
catgtgatccttttatgt

SEQ ID NO: 6714717 - DNA, 14 bp, Homo sapiens
catgtgatctatta

SEQ ID NO: 6714718 - DNA, 15 bp, Homo sapiens
catgtgatctattac

SEQ ID NO: 6714719 - DNA, 17 bp, Homo sapiens
catgtgatctcattgtt

SEQ ID NO: 6714720 - DNA, 18 bp, Homo sapiens
catgtgatctcattgttc

SEQ ID NO: 6714721 - DNA, 16 bp, Homo sapiens
catgtgatgagaggaa

SEQ ID NO: 6714722 - DNA, 20 bp, Homo sapiens
catgtgatgagaggaaatca

SEQ ID NO: 6714723 - DNA, 20 bp, Homo sapiens
catgtgatggacactccagg

SEQ ID NO: 6714724 - DNA, 21 bp, Homo sapiens
catgtgatgttgtcttagcat

SEQ ID NO: 6714725 - DNA, 12 bp, Homo sapiens
catgtgattaat

SEQ ID NO: 6714726 - DNA, 17 bp, Homo sapiens
catgtgattatggacat

SEQ ID NO: 6714727 - DNA, 21 bp, Homo sapiens
catgtgattggcagcttcaaa

SEQ ID NO: 6714728 - DNA, 15 bp, Homo sapiens
catgtgcaaacgctg

SEQ ID NO: 6714729 - DNA, 14 bp, Homo sapiens
catgtgcaaagtga

SEQ ID NO: 6714730 - DNA, 15 bp, Homo sapiens
catgtgcaactcttg

SEQ ID NO: 6714731 - DNA, 18 bp, Homo sapiens
catgtgcaactcttgtat

SEQ ID NO: 6714732 - DNA, 20 bp, Homo sapiens
catgtgcaactcttgtattg

SEQ ID NO: 6714733 - DNA, 11 bp, Homo sapiens
catgtgcaata

SEQ ID NO: 6714734 - DNA, 15 bp, Homo sapiens
catgtgcacatgcac

SEQ ID NO: 6714735 - DNA, 14 bp, Homo sapiens
catgtgcacccggc

SEQ ID NO: 6714736 - DNA, 19 bp, Homo sapiens
catgtgcacccggcctgga

SEQ ID NO: 6714737 - DNA, 16 bp, Homo sapiens
catgtgcagacactca

SEQ ID NO: 6714738 - DNA, 18 bp, Homo sapiens
catgtgcatagtttcttt

SEQ ID NO: 6714739 - DNA, 24 bp, Homo sapiens
catgtgccaagattctactcttgt

SEQ ID NO: 6714740 - DNA, 20 bp, Homo sapiens
catgtgccacaacgcctggc

SEQ ID NO: 6714741 - DNA, 22 bp, Homo sapiens
catgtgccacaacgcctggcta

SEQ ID NO: 6714742 - DNA, 15 bp, Homo sapiens
catgtgccacacagt

SEQ ID NO: 6714743 - DNA, 22 bp, Homo sapiens
catgtgccactgttcagcggag

SEQ ID NO: 6714744 - DNA, 22 bp, Homo sapiens
catgtgccagggcaatgatgaa

SEQ ID NO: 6714745 - DNA, 14 bp, Homo sapiens
catgtgccatctgt

SEQ ID NO: 6714746 - DNA, 18 bp, Homo sapiens
catgtgccatctgtacat

SEQ ID NO: 6714747 - DNA, 19 bp, Homo sapiens
catgtgccatctgtacata

SEQ ID NO: 6714748 - DNA, 13 bp, Homo sapiens
catgtgccatttt

SEQ ID NO: 6714749 - DNA, 14 bp, Homo sapiens
catgtgcccctgcc

SEQ ID NO: 6714750 - DNA, 12 bp, Homo sapiens
catgtgccctcc

SEQ ID NO: 6714751 - DNA, 14 bp, Homo sapiens
catgtgccctgcct

SEQ ID NO: 6714752 - DNA, 22 bp, Homo sapiens
catgtgcctctgcggggcaggg

SEQ ID NO: 6714753 - DNA, 16 bp, Homo sapiens
catgtgcctctgtcct

SEQ ID NO: 6714754 - DNA, 20 bp, Homo sapiens
catgtgcctgatccagcctc

SEQ ID NO: 6714755 - DNA, 17 bp, Homo sapiens
catgtgcctgcaccagg

SEQ ID NO: 6714756 - DNA, 18 bp, Homo sapiens
catgtgcctgcaccagga

SEQ ID NO: 6714757 - DNA, 21 bp, Homo sapiens
catgtgcctgcaccaggagac

SEQ ID NO: 6714758 - DNA, 22 bp, Homo sapiens
catgtgcctgtattcccagcta

SEQ ID NO: 6714759 - DNA, 17 bp, Homo sapiens
catgtgccttgtccagg

SEQ ID NO: 6714760 - DNA, 21 bp, Homo sapiens
catgtgcctttctttgcctct

SEQ ID NO: 6714761 - DNA, 15 bp, Homo sapiens
catgtgcggctgaac

SEQ ID NO: 6714762 - DNA, 21 bp, Homo sapiens
catgtgcggctgaactgagaa

SEQ ID NO: 6714763 - DNA, 24 bp, Homo sapiens
catgtgcggctgaactgagaaggc

SEQ ID NO: 6714764 - DNA, 22 bp, Homo sapiens
catgtgcgtggaagtgttcctg

SEQ ID NO: 6714765 - DNA, 23 bp, Homo sapiens
catgtgcgtggaagtgttcctgt

SEQ ID NO: 6714766 - DNA, 22 bp, Homo sapiens
catgtgctaataagtttgaaat

SEQ ID NO: 6714767 - DNA, 20 bp, Homo sapiens
catgtgctattgaactgagc

SEQ ID NO: 6714768 - DNA, 18 bp, Homo sapiens
catgtgctcagaagagga

SEQ ID NO: 6714769 - DNA, 22 bp, Homo sapiens
catgtgctcagccccagacctg

SEQ ID NO: 6714770 - DNA, 23 bp, Homo sapiens
catgtgctcagccccagacctgc

SEQ ID NO: 6714771 - DNA, 21 bp, Homo sapiens
catgtgctctgttttgacata

SEQ ID NO: 6714772 - DNA, 12 bp, Homo sapiens
catgtgctgccc

SEQ ID NO: 6714773 - DNA, 18 bp, Homo sapiens
catgtgctgccctacagc

SEQ ID NO: 6714774 - DNA, 15 bp, Homo sapiens
catgtgctgccctgt

SEQ ID NO: 6714775 - DNA, 17 bp, Homo sapiens
catgtgctgccctgttg

SEQ ID NO: 6714776 - DNA, 20 bp, Homo sapiens
catgtgctgggaaatgcaga

SEQ ID NO: 6714777 - DNA, 21 bp, Homo sapiens
catgtgctgtgcacccgtgcc

SEQ ID NO: 6714778 - DNA, 16 bp, Homo sapiens
catgtgcttcatctgt

SEQ ID NO: 6714779 - DNA, 14 bp, Homo sapiens
catgtgctttgtag

SEQ ID NO: 6714780 - DNA, 15 bp, Homo sapiens
catgtgctttgtagc

SEQ ID NO: 6714781 - DNA, 21 bp, Homo sapiens
catgtggaaagtgaatttgaa

SEQ ID NO: 6714782 - DNA, 20 bp, Homo sapiens
catgtggaaggcaagccagg

SEQ ID NO: 6714783 - DNA, 15 bp, Homo sapiens
catgtggactgtgcc

SEQ ID NO: 6714784 - DNA, 15 bp, Homo sapiens
catgtggagaaagga

SEQ ID NO: 6714785 - DNA, 19 bp, Homo sapiens
catgtggagaaaggagtga

SEQ ID NO: 6714786 - DNA, 14 bp, Homo sapiens
catgtggagtggac

SEQ ID NO: 6714787 - DNA, 14 bp, Homo sapiens
catgtggcagcagg

SEQ ID NO: 6714788 - DNA, 21 bp, Homo sapiens
catgtggcagcaggcatggct

SEQ ID NO: 6714789 - DNA, 23 bp, Homo sapiens
catgtggcagcaggcatggcttc

SEQ ID NO: 6714790 - DNA, 12 bp, Homo sapiens
catgtggcagcc

SEQ ID NO: 6714791 - DNA, 13 bp, Homo sapiens
catgtggcagccc

SEQ ID NO: 6714792 - DNA, 16 bp, Homo sapiens
catgtggcagcccatg

SEQ ID NO: 6714793 - DNA, 15 bp, Homo sapiens
catgtggccatggcc

SEQ ID NO: 6714794 - DNA, 20 bp, Homo sapiens
catgtggccatggcctctgc

SEQ ID NO: 6714795 - DNA, 21 bp, Homo sapiens
catgtggccatggcctctgca

SEQ ID NO: 6714796 - DNA, 20 bp, Homo sapiens
catgtggcccaactctcctg

SEQ ID NO: 6714797 - DNA, 19 bp, Homo sapiens
catgtggccccaggtgcca

SEQ ID NO: 6714798 - DNA, 22 bp, Homo sapiens
catgtggccctccagtgtatga

SEQ ID NO: 6714799 - DNA, 21 bp, Homo sapiens
catgtggcctaatattgaaaa

SEQ ID NO: 6714800 - DNA, 20 bp, Homo sapiens
catgtggcctgcccagcctc

SEQ ID NO: 6714801 - DNA, 17 bp, Homo sapiens
catgtggctccccctga

SEQ ID NO: 6714802 - DNA, 15 bp, Homo sapiens
catgtggctgaagac

SEQ ID NO: 6714803 - DNA, 20 bp, Homo sapiens
catgtggcttgaattaagaa

SEQ ID NO: 6714804 - DNA, 19 bp, Homo sapiens
catgtgggcgcccaccctg

SEQ ID NO: 6714805 - DNA, 22 bp, Homo sapiens
catgtgggcgcccaccctgggc

SEQ ID NO: 6714806 - DNA, 14 bp, Homo sapiens
catgtggggaagca

SEQ ID NO: 6714807 - DNA, 17 bp, Homo sapiens
catgtggggacagggct

SEQ ID NO: 6714808 - DNA, 19 bp, Homo sapiens
catgtggggacagggctgg

SEQ ID NO: 6714809 - DNA, 14 bp, Homo sapiens
catgtggggccagg

SEQ ID NO: 6714810 - DNA, 15 bp, Homo sapiens
catgtgggggaaggc

SEQ ID NO: 6714811 - DNA, 22 bp, Homo sapiens
catgtgggggaaggccttgctg

SEQ ID NO: 6714812 - DNA, 17 bp, Homo sapiens
catgtgggtgaccaggt

SEQ ID NO: 6714813 - DNA, 23 bp, Homo sapiens
catgtgggtgagccagtggaaca

SEQ ID NO: 6714814 - DNA, 15 bp, Homo sapiens
catgtgggtgagtta

SEQ ID NO: 6714815 - DNA, 16 bp, Homo sapiens
catgtgggtggagaag

SEQ ID NO: 6714816 - DNA, 21 bp, Homo sapiens
catgtgggtggagaagggagg

SEQ ID NO: 6714817 - DNA, 23 bp, Homo sapiens
catgtgggtggagaagggagggt

SEQ ID NO: 6714818 - DNA, 20 bp, Homo sapiens
catgtggtaaggtgtgtact

SEQ ID NO: 6714819 - DNA, 23 bp, Homo sapiens
catgtggtatgtagcccggccag

SEQ ID NO: 6714820 - DNA, 21 bp, Homo sapiens
catgtggtgggacagggaccc

SEQ ID NO: 6714821 - DNA, 20 bp, Homo sapiens
catgtggttactagtacagg

SEQ ID NO: 6714822 - DNA, 15 bp, Homo sapiens
catgtggtttataga

SEQ ID NO: 6714823 - DNA, 14 bp, Homo sapiens
catgtggtttgaaa

SEQ ID NO: 6714824 - DNA, 20 bp, Homo sapiens
catgtggtttggttcctctc

SEQ ID NO: 6714825 - DNA, 13 bp, Homo sapiens
catgtgtaagaca

SEQ ID NO: 6714826 - DNA, 17 bp, Homo sapiens
catgtgtaatcaataaa

SEQ ID NO: 6714827 - DNA, 23 bp, Homo sapiens
catgtgtaatcaataaacgattt

SEQ ID NO: 6714828 - DNA, 17 bp, Homo sapiens
catgtgtacatatatgt

SEQ ID NO: 6714829 - DNA, 18 bp, Homo sapiens
catgtgtacatatatgta

SEQ ID NO: 6714830 - DNA, 23 bp, Homo sapiens
catgtgtagagcccctactgtgg

SEQ ID NO: 6714831 - DNA, 24 bp, Homo sapiens
catgtgtagatattatgtatagaa

SEQ ID NO: 6714832 - DNA, 16 bp, Homo sapiens
catgtgtagcctatgt

SEQ ID NO: 6714833 - DNA, 18 bp, Homo sapiens
catgtgtagcctgtgcat

SEQ ID NO: 6714834 - DNA, 20 bp, Homo sapiens
catgtgtaggaagaggccgc

SEQ ID NO: 6714835 - DNA, 16 bp, Homo sapiens
catgtgtaggatgtat

SEQ ID NO: 6714836 - DNA, 15 bp, Homo sapiens
catgtgtatatatgt

SEQ ID NO: 6714837 - DNA, 23 bp, Homo sapiens
catgtgtatattccttttaaaga

SEQ ID NO: 6714838 - DNA, 13 bp, Homo sapiens
catgtgtatgaga

SEQ ID NO: 6714839 - DNA, 14 bp, Homo sapiens
catgtgtatgagaa

SEQ ID NO: 6714840 - DNA, 22 bp, Homo sapiens
catgtgtatgagaagtactttg

SEQ ID NO: 6714841 - DNA, 11 bp, Homo sapiens
catgtgtatgt

SEQ ID NO: 6714842 - DNA, 19 bp, Homo sapiens
catgtgtcagctgtagaaa

SEQ ID NO: 6714843 - DNA, 21 bp, Homo sapiens
catgtgtccatcccagcggct

SEQ ID NO: 6714844 - DNA, 14 bp, Homo sapiens
catgtgtcccagaa

SEQ ID NO: 6714845 - DNA, 15 bp, Homo sapiens
catgtgtcccccctg

SEQ ID NO: 6714846 - DNA, 20 bp, Homo sapiens
catgtgtcccccctgtggtc

SEQ ID NO: 6714847 - DNA, 24 bp, Homo sapiens
catgtgtcccctcactctgtcagc

SEQ ID NO: 6714848 - DNA, 13 bp, Homo sapiens
catgtgtcctggt

SEQ ID NO: 6714849 - DNA, 15 bp, Homo sapiens
catgtgtcctggttc

SEQ ID NO: 6714850 - DNA, 16 bp, Homo sapiens
catgtgtcgcctctca

SEQ ID NO: 6714851 - DNA, 13 bp, Homo sapiens
catgtgtctgtat

SEQ ID NO: 6714852 - DNA, 23 bp, Homo sapiens
catgtgtctgtattcatacagca

SEQ ID NO: 6714853 - DNA, 15 bp, Homo sapiens
catgtgtctgtgtgg

SEQ ID NO: 6714854 - DNA, 16 bp, Homo sapiens
catgtgtgaacacata

SEQ ID NO: 6714855 - DNA, 21 bp, Homo sapiens
catgtgtgacccttgtcatct

SEQ ID NO: 6714856 - DNA, 13 bp, Homo sapiens
catgtgtgactcc

SEQ ID NO: 6714857 - DNA, 18 bp, Homo sapiens
catgtgtgactccagcct

SEQ ID NO: 6714858 - DNA, 15 bp, Homo sapiens
catgtgtgagtgtgt

SEQ ID NO: 6714859 - DNA, 20 bp, Homo sapiens
catgtgtgatgctgacacca

SEQ ID NO: 6714860 - DNA, 19 bp, Homo sapiens
catgtgtgcagagcagaca

SEQ ID NO: 6714861 - DNA, 15 bp, Homo sapiens
catgtgtgcatgtga

SEQ ID NO: 6714862 - DNA, 18 bp, Homo sapiens
catgtgtgcatgtgagca

SEQ ID NO: 6714863 - DNA, 22 bp, Homo sapiens
catgtgtgcatgtgctgtgtga

SEQ ID NO: 6714864 - DNA, 12 bp, Homo sapiens
catgtgtgcctg

SEQ ID NO: 6714865 - DNA, 13 bp, Homo sapiens
catgtgtgcctgt

SEQ ID NO: 6714866 - DNA, 17 bp, Homo sapiens
catgtgtgcctgtggca

SEQ ID NO: 6714867 - DNA, 17 bp, Homo sapiens
catgtgtgcgagtgtgt

SEQ ID NO: 6714868 - DNA, 19 bp, Homo sapiens
catgtgtgcgagtgtgtgc

SEQ ID NO: 6714869 - DNA, 20 bp, Homo sapiens
catgtgtgcgtgtctccatg

SEQ ID NO: 6714870 - DNA, 14 bp, Homo sapiens
catgtgtggactca

SEQ ID NO: 6714871 - DNA, 18 bp, Homo sapiens
catgtgtggatgtgtaaa

SEQ ID NO: 6714872 - DNA, 12 bp, Homo sapiens
catgtgtgtata

SEQ ID NO: 6714873 - DNA, 13 bp, Homo sapiens
catgtgtgtataa

SEQ ID NO: 6714874 - DNA, 13 bp, Homo sapiens
catgtgtgtatat

SEQ ID NO: 6714875 - DNA, 18 bp, Homo sapiens
catgtgtgtatatatgtg

SEQ ID NO: 6714876 - DNA, 20 bp, Homo sapiens
catgtgtgtatatatgtgta

SEQ ID NO: 6714877 - DNA, 21 bp, Homo sapiens
catgtgtgtattttttcatag

SEQ ID NO: 6714878 - DNA, 19 bp, Homo sapiens
catgtgtgtgagtttgctg

SEQ ID NO: 6714879 - DNA, 17 bp, Homo sapiens
catgtgtgtgccaagcc

SEQ ID NO: 6714880 - DNA, 20 bp, Homo sapiens
catgtgtgtgccaagccctg

SEQ ID NO: 6714881 - DNA, 21 bp, Homo sapiens
catgtgtgtgccaagccctgg

SEQ ID NO: 6714882 - DNA, 22 bp, Homo sapiens
catgtgtgtgccaagccctggc

SEQ ID NO: 6714883 - DNA, 15 bp, Homo sapiens
catgtgtgtgctcag

SEQ ID NO: 6714884 - DNA, 11 bp, Homo sapiens
catgtgtgtgt

SEQ ID NO: 6714885 - DNA, 14 bp, Homo sapiens
catgtgtgtgtctc

SEQ ID NO: 6714886 - DNA, 16 bp, Homo sapiens
catgtgttaagtattt

SEQ ID NO: 6714887 - DNA, 15 bp, Homo sapiens
catgtgttaatctta

SEQ ID NO: 6714888 - DNA, 15 bp, Homo sapiens
catgtgttatgtttt

SEQ ID NO: 6714889 - DNA, 13 bp, Homo sapiens
catgtgttccaaa

SEQ ID NO: 6714890 - DNA, 23 bp, Homo sapiens
catgtgttccaaatttgctttac

SEQ ID NO: 6714891 - DNA, 14 bp, Homo sapiens
catgtgttccaagg

SEQ ID NO: 6714892 - DNA, 22 bp, Homo sapiens
catgtgttccctttgtctttca

SEQ ID NO: 6714893 - DNA, 21 bp, Homo sapiens
catgtgttgcaaattattcta

SEQ ID NO: 6714894 - DNA, 17 bp, Homo sapiens
catgtgttgcagctgtc

SEQ ID NO: 6714895 - DNA, 20 bp, Homo sapiens
catgtgttggggagacatca

SEQ ID NO: 6714896 - DNA, 15 bp, Homo sapiens
catgtgttgtacaat

SEQ ID NO: 6714897 - DNA, 14 bp, Homo sapiens
catgtgttgttgtt

SEQ ID NO: 6714898 - DNA, 20 bp, Homo sapiens
catgtgtttattcatccagc

SEQ ID NO: 6714899 - DNA, 16 bp, Homo sapiens
catgtgttttcatcat

SEQ ID NO: 6714900 - DNA, 16 bp, Homo sapiens
catgtgttttgctttt

SEQ ID NO: 6714901 - DNA, 19 bp, Homo sapiens
catgttaaaaatagcagta

SEQ ID NO: 6714902 - DNA, 12 bp, Homo sapiens
catgttaaaata

SEQ ID NO: 6714903 - DNA, 18 bp, Homo sapiens
catgttaaaataattata

SEQ ID NO: 6714904 - DNA, 21 bp, Homo sapiens
catgttaaaataattatatga

SEQ ID NO: 6714905 - DNA, 22 bp, Homo sapiens
catgttaaagaggcgtcttgta

SEQ ID NO: 6714906 - DNA, 13 bp, Homo sapiens
catgttaaatgac

SEQ ID NO: 6714907 - DNA, 14 bp, Homo sapiens
catgttaaatgact

SEQ ID NO: 6714908 - DNA, 18 bp, Homo sapiens
catgttaaatgacttgat

SEQ ID NO: 6714909 - DNA, 21 bp, Homo sapiens
catgttaaatgacttgattgt

SEQ ID NO: 6714910 - DNA, 14 bp, Homo sapiens
catgttaactttat

SEQ ID NO: 6714911 - DNA, 17 bp, Homo sapiens
catgttaactttattac

SEQ ID NO: 6714912 - DNA, 14 bp, Homo sapiens
catgttaagtgcca

SEQ ID NO: 6714913 - DNA, 15 bp, Homo sapiens
catgttaatatttga

SEQ ID NO: 6714914 - DNA, 16 bp, Homo sapiens
catgttaatcctagct

SEQ ID NO: 6714915 - DNA, 13 bp, Homo sapiens
catgttaatttca

SEQ ID NO: 6714916 - DNA, 12 bp, Homo sapiens
catgttaccatc

SEQ ID NO: 6714917 - DNA, 23 bp, Homo sapiens
catgttactaaatggtgttacat

SEQ ID NO: 6714918 - DNA, 17 bp, Homo sapiens
catgttactgcttcatt

SEQ ID NO: 6714919 - DNA, 18 bp, Homo sapiens
catgttacttctctgagt

SEQ ID NO: 6714920 - DNA, 15 bp, Homo sapiens
catgttacttgagaa

SEQ ID NO: 6714921 - DNA, 18 bp, Homo sapiens
catgttagcaaacgcagc

SEQ ID NO: 6714922 - DNA, 13 bp, Homo sapiens
catgttagcctta

SEQ ID NO: 6714923 - DNA, 19 bp, Homo sapiens
catgttagggttatgtttt

SEQ ID NO: 6714924 - DNA, 17 bp, Homo sapiens
catgttagtaatacctc

SEQ ID NO: 6714925 - DNA, 13 bp, Homo sapiens
catgttatatatt

SEQ ID NO: 6714926 - DNA, 20 bp, Homo sapiens
catgttatgataaaaaattt

SEQ ID NO: 6714927 - DNA, 21 bp, Homo sapiens
catgttatgataaaaaatttt

SEQ ID NO: 6714928 - DNA, 16 bp, Homo sapiens
catgttatgcagtgaa

SEQ ID NO: 6714929 - DNA, 12 bp, Homo sapiens
catgttatgttt

SEQ ID NO: 6714930 - DNA, 15 bp, Homo sapiens
catgttatgtttcta

SEQ ID NO: 6714931 - DNA, 14 bp, Homo sapiens
catgttatttgtaa

SEQ ID NO: 6714932 - DNA, 17 bp, Homo sapiens
catgttattttattatt

SEQ ID NO: 6714933 - DNA, 13 bp, Homo sapiens
catgttcaaaaga

SEQ ID NO: 6714934 - DNA, 14 bp, Homo sapiens
catgttcaaaagaa

SEQ ID NO: 6714935 - DNA, 22 bp, Homo sapiens
catgttcaaagccacattattt

SEQ ID NO: 6714936 - DNA, 13 bp, Homo sapiens
catgttcaattat

SEQ ID NO: 6714937 - DNA, 20 bp, Homo sapiens
catgttcacaccgctgcact

SEQ ID NO: 6714938 - DNA, 17 bp, Homo sapiens
catgttcatatgtactt

SEQ ID NO: 6714939 - DNA, 13 bp, Homo sapiens
catgttcatcaat

SEQ ID NO: 6714940 - DNA, 22 bp, Homo sapiens
catgttcatgtgattaactctt

SEQ ID NO: 6714941 - DNA, 17 bp, Homo sapiens
catgttccaataaacag

SEQ ID NO: 6714942 - DNA, 13 bp, Homo sapiens
catgttcccagct

SEQ ID NO: 6714943 - DNA, 14 bp, Homo sapiens
catgttcctgttcc

SEQ ID NO: 6714944 - DNA, 14 bp, Homo sapiens
catgttccttttga

SEQ ID NO: 6714945 - DNA, 23 bp, Homo sapiens
catgttcgagcttacctactctt

SEQ ID NO: 6714946 - DNA, 22 bp, Homo sapiens
catgttcgggagcgaactcccc

SEQ ID NO: 6714947 - DNA, 18 bp, Homo sapiens
catgttctaatactttgt

SEQ ID NO: 6714948 - DNA, 19 bp, Homo sapiens
catgttctaccgtggattt

SEQ ID NO: 6714949 - DNA, 22 bp, Homo sapiens
catgttctaccgtggatttgta

SEQ ID NO: 6714950 - DNA, 23 bp, Homo sapiens
catgttctaccgtggatttgtac

SEQ ID NO: 6714951 - DNA, 15 bp, Homo sapiens
catgttctatgtgtt

SEQ ID NO: 6714952 - DNA, 17 bp, Homo sapiens
catgttctcaataccca

SEQ ID NO: 6714953 - DNA, 22 bp, Homo sapiens
catgttctccattttcaagctg

SEQ ID NO: 6714954 - DNA, 15 bp, Homo sapiens
catgttctctgagga

SEQ ID NO: 6714955 - DNA, 20 bp, Homo sapiens
catgttctgagctataacat

SEQ ID NO: 6714956 - DNA, 22 bp, Homo sapiens
catgttctgagctataacattt

SEQ ID NO: 6714957 - DNA, 17 bp, Homo sapiens
catgttctgcccccagc

SEQ ID NO: 6714958 - DNA, 18 bp, Homo sapiens
catgttctgcccccagcc

SEQ ID NO: 6714959 - DNA, 22 bp, Homo sapiens
catgttctggtggtttgattgt

SEQ ID NO: 6714960 - DNA, 18 bp, Homo sapiens
catgttctgtcccttgcc

SEQ ID NO: 6714961 - DNA, 14 bp, Homo sapiens
catgttctgtgtca

SEQ ID NO: 6714962 - DNA, 13 bp, Homo sapiens
catgttcttaatt

SEQ ID NO: 6714963 - DNA, 20 bp, Homo sapiens
catgttcttgtcataaaatg

SEQ ID NO: 6714964 - DNA, 16 bp, Homo sapiens
catgttcttgttttgt

SEQ ID NO: 6714965 - DNA, 20 bp, Homo sapiens
catgttcttgttttgttata

SEQ ID NO: 6714966 - DNA, 14 bp, Homo sapiens
catgttctttgtac

SEQ ID NO: 6714967 - DNA, 22 bp, Homo sapiens
catgttgaatgtatctagtggt

SEQ ID NO: 6714968 - DNA, 20 bp, Homo sapiens
catgttgagacctcagcttg

SEQ ID NO: 6714969 - DNA, 14 bp, Homo sapiens
catgttgagaggct

SEQ ID NO: 6714970 - DNA, 19 bp, Homo sapiens
catgttgagccaggcctgg

SEQ ID NO: 6714971 - DNA, 15 bp, Homo sapiens
catgttgagccagtg

SEQ ID NO: 6714972 - DNA, 17 bp, Homo sapiens
catgttgatcatgtact

SEQ ID NO: 6714973 - DNA, 20 bp, Homo sapiens
catgttgatgactcgaaact

SEQ ID NO: 6714974 - DNA, 15 bp, Homo sapiens
catgttgatttccta

SEQ ID NO: 6714975 - DNA, 22 bp, Homo sapiens
catgttgcaaagaactccagag

SEQ ID NO: 6714976 - DNA, 23 bp, Homo sapiens
catgttgcaaagaactccagagt

SEQ ID NO: 6714977 - DNA, 22 bp, Homo sapiens
catgttgcacacccactcagct

SEQ ID NO: 6714978 - DNA, 17 bp, Homo sapiens
catgttgcatgcctatg

SEQ ID NO: 6714979 - DNA, 15 bp, Homo sapiens
catgttgcccagaat

SEQ ID NO: 6714980 - DNA, 22 bp, Homo sapiens
catgttgcccccgtgagccaat

SEQ ID NO: 6714981 - DNA, 18 bp, Homo sapiens
catgttgcgttcaaagag

SEQ ID NO: 6714982 - DNA, 15 bp, Homo sapiens
catgttgctgaattt

SEQ ID NO: 6714983 - DNA, 18 bp, Homo sapiens
catgttgctgtttccagt

SEQ ID NO: 6714984 - DNA, 16 bp, Homo sapiens
catgttgcttcactct

SEQ ID NO: 6714985 - DNA, 16 bp, Homo sapiens
catgttggaaatgtgt

SEQ ID NO: 6714986 - DNA, 12 bp, Homo sapiens
catgttggacat

SEQ ID NO: 6714987 - DNA, 12 bp, Homo sapiens
catgttggccag

SEQ ID NO: 6714988 - DNA, 17 bp, Homo sapiens
catgttggccaggctgg

SEQ ID NO: 6714989 - DNA, 17 bp, Homo sapiens
catgttggcctcttcag

SEQ ID NO: 6714990 - DNA, 20 bp, Homo sapiens
catgttgggaaacttggctc

SEQ ID NO: 6714991 - DNA, 18 bp, Homo sapiens
catgttgggtttgagaca

SEQ ID NO: 6714992 - DNA, 17 bp, Homo sapiens
catgttggtcaggctgg

SEQ ID NO: 6714993 - DNA, 18 bp, Homo sapiens
catgttggtcaggctggt

SEQ ID NO: 6714994 - DNA, 20 bp, Homo sapiens
catgttggtcaggctggtct

SEQ ID NO: 6714995 - DNA, 15 bp, Homo sapiens
catgttgtaatgctg

SEQ ID NO: 6714996 - DNA, 16 bp, Homo sapiens
catgttgtaatgctgc

SEQ ID NO: 6714997 - DNA, 17 bp, Homo sapiens
catgttgtaatgctgca

SEQ ID NO: 6714998 - DNA, 20 bp, Homo sapiens
catgttgtatttatggaaga

SEQ ID NO: 6714999 - DNA, 23 bp, Homo sapiens
catgttgtcttataaacaaatga

SEQ ID NO: 6715000 - DNA, 18 bp, Homo sapiens
catgttgtgcctccctgg

SEQ ID NO: 6715001 - DNA, 19 bp, Homo sapiens
catgttgtgcctccctggt

SEQ ID NO: 6715002 - DNA, 20 bp, Homo sapiens
catgttgtgcctccctggtg

SEQ ID NO: 6715003 - DNA, 14 bp, Homo sapiens
catgttgttaaaat

SEQ ID NO: 6715004 - DNA, 18 bp, Homo sapiens
catgttgttaaaattatg

SEQ ID NO: 6715005 - DNA, 19 bp, Homo sapiens
catgttgttgtgtgtatat

SEQ ID NO: 6715006 - DNA, 16 bp, Homo sapiens
catgttgttttttcat

SEQ ID NO: 6715007 - DNA, 14 bp, Homo sapiens
catgtttaaaacaa

SEQ ID NO: 6715008 - DNA, 23 bp, Homo sapiens
catgtttaaactttgtgcctttg

SEQ ID NO: 6715009 - DNA, 12 bp, Homo sapiens
catgtttaagaa

SEQ ID NO: 6715010 - DNA, 21 bp, Homo sapiens
catgtttaagaaatgagaaat

SEQ ID NO: 6715011 - DNA, 13 bp, Homo sapiens
catgtttaagatt

SEQ ID NO: 6715012 - DNA, 21 bp, Homo sapiens
catgtttaataatatgtacaa

SEQ ID NO: 6715013 - DNA, 12 bp, Homo sapiens
catgtttaatgg

SEQ ID NO: 6715014 - DNA, 14 bp, Homo sapiens
catgtttaatgtga

SEQ ID NO: 6715015 - DNA, 15 bp, Homo sapiens
catgtttaatgttat

SEQ ID NO: 6715016 - DNA, 19 bp, Homo sapiens
catgtttacaggtttgaat

SEQ ID NO: 6715017 - DNA, 13 bp, Homo sapiens
catgtttacttta

SEQ ID NO: 6715018 - DNA, 15 bp, Homo sapiens
catgtttagacttta

SEQ ID NO: 6715019 - DNA, 18 bp, Homo sapiens
catgtttagattccagga

SEQ ID NO: 6715020 - DNA, 12 bp, Homo sapiens
catgtttataaa

SEQ ID NO: 6715021 - DNA, 23 bp, Homo sapiens
catgtttataaatcttatgctct

SEQ ID NO: 6715022 - DNA, 19 bp, Homo sapiens
catgtttatccatgtactt

SEQ ID NO: 6715023 - DNA, 15 bp, Homo sapiens
catgtttatctgctt

SEQ ID NO: 6715024 - DNA, 13 bp, Homo sapiens
catgtttatgaaa

SEQ ID NO: 6715025 - DNA, 20 bp, Homo sapiens
catgtttatgaaaataaata

SEQ ID NO: 6715026 - DNA, 15 bp, Homo sapiens
catgtttatgagaaa

SEQ ID NO: 6715027 - DNA, 14 bp, Homo sapiens
catgtttatgtaaa

SEQ ID NO: 6715028 - DNA, 15 bp, Homo sapiens
catgtttattaagaa

SEQ ID NO: 6715029 - DNA, 18 bp, Homo sapiens
catgtttattaagaatca

SEQ ID NO: 6715030 - DNA, 13 bp, Homo sapiens
catgtttattaca

SEQ ID NO: 6715031 - DNA, 23 bp, Homo sapiens
catgtttattacagtataattaa

SEQ ID NO: 6715032 - DNA, 15 bp, Homo sapiens
catgtttattctaat

SEQ ID NO: 6715033 - DNA, 17 bp, Homo sapiens
catgtttattctgttcc

SEQ ID NO: 6715034 - DNA, 16 bp, Homo sapiens
catgtttattgagctg

SEQ ID NO: 6715035 - DNA, 22 bp, Homo sapiens
catgtttatttatttccagtgg

SEQ ID NO: 6715036 - DNA, 15 bp, Homo sapiens
catgtttatttttct

SEQ ID NO: 6715037 - DNA, 22 bp, Homo sapiens
catgtttcatgttttgtgacta

SEQ ID NO: 6715038 - DNA, 14 bp, Homo sapiens
catgtttccagcag

SEQ ID NO: 6715039 - DNA, 23 bp, Homo sapiens
catgtttccctactaacatccca

SEQ ID NO: 6715040 - DNA, 21 bp, Homo sapiens
catgtttcctctagttctttg

SEQ ID NO: 6715041 - DNA, 22 bp, Homo sapiens
catgtttctgcagtattctgta

SEQ ID NO: 6715042 - DNA, 21 bp, Homo sapiens
catgtttctttgtaatgaaaa

SEQ ID NO: 6715043 - DNA, 22 bp, Homo sapiens
catgtttctttgtaatgaaaac

SEQ ID NO: 6715044 - DNA, 18 bp, Homo sapiens
catgtttgcctagacagc

SEQ ID NO: 6715045 - DNA, 16 bp, Homo sapiens
catgtttgctgaacac

SEQ ID NO: 6715046 - DNA, 14 bp, Homo sapiens
catgtttgcttcat

SEQ ID NO: 6715047 - DNA, 23 bp, Homo sapiens
catgtttggtgtttgtctgtgtt

SEQ ID NO: 6715048 - DNA, 13 bp, Homo sapiens
catgtttgtaaat

SEQ ID NO: 6715049 - DNA, 23 bp, Homo sapiens
catgtttgtctgtgtgctgtaac

SEQ ID NO: 6715050 - DNA, 21 bp, Homo sapiens
catgttttaaaagtttgtcct

SEQ ID NO: 6715051 - DNA, 22 bp, Homo sapiens
catgttttaaaatctataacat

SEQ ID NO: 6715052 - DNA, 18 bp, Homo sapiens
catgttttaaagcttgct

SEQ ID NO: 6715053 - DNA, 15 bp, Homo sapiens
catgttttaaatgta

SEQ ID NO: 6715054 - DNA, 17 bp, Homo sapiens
catgttttaacaaaaac

SEQ ID NO: 6715055 - DNA, 16 bp, Homo sapiens
catgttttaacttatt

SEQ ID NO: 6715056 - DNA, 14 bp, Homo sapiens
catgttttataatt

SEQ ID NO: 6715057 - DNA, 15 bp, Homo sapiens
catgttttataattt

SEQ ID NO: 6715058 - DNA, 16 bp, Homo sapiens
catgttttataatttg

SEQ ID NO: 6715059 - DNA, 22 bp, Homo sapiens
catgttttcaaatggagttgga

SEQ ID NO: 6715060 - DNA, 16 bp, Homo sapiens
catgttttcaactgcc

SEQ ID NO: 6715061 - DNA, 17 bp, Homo sapiens
catgttttcaactgcca

SEQ ID NO: 6715062 - DNA, 14 bp, Homo sapiens
catgttttctgctt

SEQ ID NO: 6715063 - DNA, 16 bp, Homo sapiens
catgttttctgcttta

SEQ ID NO: 6715064 - DNA, 17 bp, Homo sapiens
catgttttgataaagta

SEQ ID NO: 6715065 - DNA, 16 bp, Homo sapiens
catgttttgctaatgc

SEQ ID NO: 6715066 - DNA, 13 bp, Homo sapiens
catgttttgtata

SEQ ID NO: 6715067 - DNA, 14 bp, Homo sapiens
catgttttgtatac

SEQ ID NO: 6715068 - DNA, 20 bp, Homo sapiens
catgttttgtatacaaatat

SEQ ID NO: 6715069 - DNA, 14 bp, Homo sapiens
catgttttgtgact

SEQ ID NO: 6715070 - DNA, 18 bp, Homo sapiens
catgtttttaaagggcta

SEQ ID NO: 6715071 - DNA, 14 bp, Homo sapiens
catgtttttaactt

SEQ ID NO: 6715072 - DNA, 21 bp, Homo sapiens
catgtttttctattaaaaata

SEQ ID NO: 6715073 - DNA, 19 bp, Homo sapiens
catgtttttcttctccctc

SEQ ID NO: 6715074 - DNA, 13 bp, Homo sapiens
catgtttttgaaa

SEQ ID NO: 6715075 - DNA, 13 bp, Homo sapiens
catgtttttgcca

SEQ ID NO: 6715076 - DNA, 20 bp, Homo sapiens
catgtttttgttttaaaacg

SEQ ID NO: 6715077 - DNA, 22 bp, Homo sapiens
cattaaaaaaaaaaaaaaaagt

SEQ ID NO: 6715078 - DNA, 22 bp, Homo sapiens
cattaaaaaaaaaaaaaaactc

SEQ ID NO: 6715079 - DNA, 23 bp, Homo sapiens
cattaaaaaaatgtgcctagttt

SEQ ID NO: 6715080 - DNA, 13 bp, Homo sapiens
cattaaaaaatga

SEQ ID NO: 6715081 - DNA, 21 bp, Homo sapiens
cattaaaaaatgaaatatttt

SEQ ID NO: 6715082 - DNA, 16 bp, Homo sapiens
cattaaaaagaataga

SEQ ID NO: 6715083 - DNA, 20 bp, Homo sapiens
cattaaaaagccttacagtt

SEQ ID NO: 6715084 - DNA, 15 bp, Homo sapiens
cattaaaaagttgtt

SEQ ID NO: 6715085 - DNA, 23 bp, Homo sapiens
cattaaaaagttgttctttgttt

SEQ ID NO: 6715086 - DNA, 13 bp, Homo sapiens
cattaaaaataaa

SEQ ID NO: 6715087 - DNA, 14 bp, Homo sapiens
cattaaaaataaaa

SEQ ID NO: 6715088 - DNA, 19 bp, Homo sapiens
cattaaaaataaaagttgt

SEQ ID NO: 6715089 - DNA, 15 bp, Homo sapiens
cattaaaaatggaac

SEQ ID NO: 6715090 - DNA, 19 bp, Homo sapiens
cattaaaaatgttagtatt

SEQ ID NO: 6715091 - DNA, 16 bp, Homo sapiens
cattaaaacaagagac

SEQ ID NO: 6715092 - DNA, 12 bp, Homo sapiens
cattaaaacaat

SEQ ID NO: 6715093 - DNA, 23 bp, Homo sapiens
cattaaaacttaaccgcatcaga

SEQ ID NO: 6715094 - DNA, 13 bp, Homo sapiens
cattaaaagaaaa

SEQ ID NO: 6715095 - DNA, 18 bp, Homo sapiens
cattaaaagaagactgga

SEQ ID NO: 6715096 - DNA, 17 bp, Homo sapiens
cattaaaagacaaatat

SEQ ID NO: 6715097 - DNA, 20 bp, Homo sapiens
cattaaaagacaaatatgta

SEQ ID NO: 6715098 - DNA, 20 bp, Homo sapiens
cattaaaaggaaaaaagaaa

SEQ ID NO: 6715099 - DNA, 15 bp, Homo sapiens
cattaaaataaaaca

SEQ ID NO: 6715100 - DNA, 19 bp, Homo sapiens
cattaaaataaaacaagcc

SEQ ID NO: 6715101 - DNA, 22 bp, Homo sapiens
cattaaaataaaacaagcctta

SEQ ID NO: 6715102 - DNA, 14 bp, Homo sapiens
cattaaaataacta

SEQ ID NO: 6715103 - DNA, 16 bp, Homo sapiens
cattaaaataactatc

SEQ ID NO: 6715104 - DNA, 21 bp, Homo sapiens
cattaaaatagattatcccac

SEQ ID NO: 6715105 - DNA, 16 bp, Homo sapiens
cattaaaatagttaca

SEQ ID NO: 6715106 - DNA, 21 bp, Homo sapiens
cattaaaatatatgttctgca

SEQ ID NO: 6715107 - DNA, 16 bp, Homo sapiens
cattaaaatatgcact

SEQ ID NO: 6715108 - DNA, 13 bp, Homo sapiens
cattaaaatgaca

SEQ ID NO: 6715109 - DNA, 20 bp, Homo sapiens
cattaaaatgacaaacatga

SEQ ID NO: 6715110 - DNA, 19 bp, Homo sapiens
cattaaaatggaagtggat

SEQ ID NO: 6715111 - DNA, 14 bp, Homo sapiens
cattaaacaaataa

SEQ ID NO: 6715112 - DNA, 16 bp, Homo sapiens
cattaaacactgtaat

SEQ ID NO: 6715113 - DNA, 17 bp, Homo sapiens
cattaaacactgtaatc

SEQ ID NO: 6715114 - DNA, 18 bp, Homo sapiens
cattaaacactgtaatct

SEQ ID NO: 6715115 - DNA, 17 bp, Homo sapiens
cattaaacatgaattta

SEQ ID NO: 6715116 - DNA, 20 bp, Homo sapiens
cattaaaccacatcatggac

SEQ ID NO: 6715117 - DNA, 19 bp, Homo sapiens
cattaaaccatctccctgg

SEQ ID NO: 6715118 - DNA, 20 bp, Homo sapiens
cattaaactcatattttgaa

SEQ ID NO: 6715119 - DNA, 20 bp, Homo sapiens
cattaaacttctactgagca

SEQ ID NO: 6715120 - DNA, 15 bp, Homo sapiens
cattaaacttgaagc

SEQ ID NO: 6715121 - DNA, 17 bp, Homo sapiens
cattaaagcaatctgtt

SEQ ID NO: 6715122 - DNA, 22 bp, Homo sapiens
cattaaagcatttactttgaat

SEQ ID NO: 6715123 - DNA, 15 bp, Homo sapiens
cattaaagtcagaag

SEQ ID NO: 6715124 - DNA, 17 bp, Homo sapiens
cattaaagtcagaagtt

SEQ ID NO: 6715125 - DNA, 18 bp, Homo sapiens
cattaaagtcagaagttt

SEQ ID NO: 6715126 - DNA, 13 bp, Homo sapiens
cattaaagtctga

SEQ ID NO: 6715127 - DNA, 12 bp, Homo sapiens
cattaaagtgca

SEQ ID NO: 6715128 - DNA, 17 bp, Homo sapiens
cattaaagtgcactgtg

SEQ ID NO: 6715129 - DNA, 19 bp, Homo sapiens
cattaaagtgctttcagaa

SEQ ID NO: 6715130 - DNA, 20 bp, Homo sapiens
cattaaagttaatagaactt

SEQ ID NO: 6715131 - DNA, 15 bp, Homo sapiens
cattaaatactattt

SEQ ID NO: 6715132 - DNA, 14 bp, Homo sapiens
cattaaatataaaa

SEQ ID NO: 6715133 - DNA, 19 bp, Homo sapiens
cattaaatataaaatacat

SEQ ID NO: 6715134 - DNA, 20 bp, Homo sapiens
cattaaatataaaatacata

SEQ ID NO: 6715135 - DNA, 23 bp, Homo sapiens
cattaaatattctgtacattttt

SEQ ID NO: 6715136 - DNA, 14 bp, Homo sapiens
cattaaatgaatat

SEQ ID NO: 6715137 - DNA, 15 bp, Homo sapiens
cattaaatgaatatt

SEQ ID NO: 6715138 - DNA, 12 bp, Homo sapiens
cattaaatgttt

SEQ ID NO: 6715139 - DNA, 14 bp, Homo sapiens
cattaaatgtttga

SEQ ID NO: 6715140 - DNA, 22 bp, Homo sapiens
cattaaattactatagcaaagt

SEQ ID NO: 6715141 - DNA, 13 bp, Homo sapiens
cattaaattcact

SEQ ID NO: 6715142 - DNA, 12 bp, Homo sapiens
cattaaatttct

SEQ ID NO: 6715143 - DNA, 20 bp, Homo sapiens
cattaaattttctatgctta

SEQ ID NO: 6715144 - DNA, 23 bp, Homo sapiens
cattaacagttttccatgaaaac

SEQ ID NO: 6715145 - DNA, 15 bp, Homo sapiens
cattaacattttgag

SEQ ID NO: 6715146 - DNA, 16 bp, Homo sapiens
cattaaccaaagaaag

SEQ ID NO: 6715147 - DNA, 22 bp, Homo sapiens
cattaaccgatgctttaccaaa

SEQ ID NO: 6715148 - DNA, 15 bp, Homo sapiens
cattaacggtgctaa

SEQ ID NO: 6715149 - DNA, 18 bp, Homo sapiens
cattaactaaatgctcat

SEQ ID NO: 6715150 - DNA, 18 bp, Homo sapiens
cattaactaatctattgg

SEQ ID NO: 6715151 - DNA, 16 bp, Homo sapiens
cattaactcaggcatt

SEQ ID NO: 6715152 - DNA, 17 bp, Homo sapiens
cattaactcaggcattt

SEQ ID NO: 6715153 - DNA, 17 bp, Homo sapiens
cattaactctaactgtg

SEQ ID NO: 6715154 - DNA, 15 bp, Homo sapiens
cattaactgcttcct

SEQ ID NO: 6715155 - DNA, 13 bp, Homo sapiens
cattaactgttgc

SEQ ID NO: 6715156 - DNA, 14 bp, Homo sapiens
cattaactgttgca

SEQ ID NO: 6715157 - DNA, 22 bp, Homo sapiens
cattaactgttgcacttttgaa

SEQ ID NO: 6715158 - DNA, 16 bp, Homo sapiens
cattaagaaaatattt

SEQ ID NO: 6715159 - DNA, 14 bp, Homo sapiens
cattaagaaaatca

SEQ ID NO: 6715160 - DNA, 15 bp, Homo sapiens
cattaagaaaatcat

SEQ ID NO: 6715161 - DNA, 21 bp, Homo sapiens
cattaagaatgttggtttact

SEQ ID NO: 6715162 - DNA, 18 bp, Homo sapiens
cattaagacacacctctg

SEQ ID NO: 6715163 - DNA, 20 bp, Homo sapiens
cattaagacacacctctgga

SEQ ID NO: 6715164 - DNA, 17 bp, Homo sapiens
cattaagagaacaaaga

SEQ ID NO: 6715165 - DNA, 13 bp, Homo sapiens
cattaagaggttt

SEQ ID NO: 6715166 - DNA, 17 bp, Homo sapiens
cattaagagtgaatgtg

SEQ ID NO: 6715167 - DNA, 17 bp, Homo sapiens
cattaagagttactcag

SEQ ID NO: 6715168 - DNA, 23 bp, Homo sapiens
cattaagcacacacatctggccc

SEQ ID NO: 6715169 - DNA, 16 bp, Homo sapiens
cattaagccctcttcc

SEQ ID NO: 6715170 - DNA, 16 bp, Homo sapiens
cattaagccttccaca

SEQ ID NO: 6715171 - DNA, 16 bp, Homo sapiens
cattaagggcctgctg

SEQ ID NO: 6715172 - DNA, 20 bp, Homo sapiens
cattaaggtatttcgaaact

SEQ ID NO: 6715173 - DNA, 23 bp, Homo sapiens
cattaaggtatttcgaaactgcc

SEQ ID NO: 6715174 - DNA, 16 bp, Homo sapiens
cattaagtaaatgctg

SEQ ID NO: 6715175 - DNA, 14 bp, Homo sapiens
cattaagtaatcaa

SEQ ID NO: 6715176 - DNA, 20 bp, Homo sapiens
cattaagtaatcaataaaga

SEQ ID NO: 6715177 - DNA, 21 bp, Homo sapiens
cattaagtaatcaataaagaa

SEQ ID NO: 6715178 - DNA, 17 bp, Homo sapiens
cattaagtcatgtgtga

SEQ ID NO: 6715179 - DNA, 16 bp, Homo sapiens
cattaataaagttgct

SEQ ID NO: 6715180 - DNA, 18 bp, Homo sapiens
cattaataaagttgcttt

SEQ ID NO: 6715181 - DNA, 14 bp, Homo sapiens
cattaataataaat

SEQ ID NO: 6715182 - DNA, 12 bp, Homo sapiens
cattaataatag

SEQ ID NO: 6715183 - DNA, 16 bp, Homo sapiens
cattaataatagctaa

SEQ ID NO: 6715184 - DNA, 21 bp, Homo sapiens
cattaataatagctaataata

SEQ ID NO: 6715185 - DNA, 13 bp, Homo sapiens
cattaatactgtg

SEQ ID NO: 6715186 - DNA, 17 bp, Homo sapiens
cattaatagcagccttt

SEQ ID NO: 6715187 - DNA, 20 bp, Homo sapiens
cattaatagcagcctttctc

SEQ ID NO: 6715188 - DNA, 15 bp, Homo sapiens
cattaataggaaaga

SEQ ID NO: 6715189 - DNA, 19 bp, Homo sapiens
cattaataggaaagattta

SEQ ID NO: 6715190 - DNA, 21 bp, Homo sapiens
cattaataggaaagatttaat

SEQ ID NO: 6715191 - DNA, 16 bp, Homo sapiens
cattaatatatggaat

SEQ ID NO: 6715192 - DNA, 16 bp, Homo sapiens
cattaatattcttttg

SEQ ID NO: 6715193 - DNA, 14 bp, Homo sapiens
cattaatatttacc

SEQ ID NO: 6715194 - DNA, 17 bp, Homo sapiens
cattaatatttaccaaa

SEQ ID NO: 6715195 - DNA, 17 bp, Homo sapiens
cattaatatttgctgac

SEQ ID NO: 6715196 - DNA, 17 bp, Homo sapiens
cattaatcaatttctca

SEQ ID NO: 6715197 - DNA, 17 bp, Homo sapiens
cattaatcaccaaagta

SEQ ID NO: 6715198 - DNA, 12 bp, Homo sapiens
cattaatcttga

SEQ ID NO: 6715199 - DNA, 13 bp, Homo sapiens
cattaatcttgat

SEQ ID NO: 6715200 - DNA, 15 bp, Homo sapiens
cattaatgaaaactt

SEQ ID NO: 6715201 - DNA, 20 bp, Homo sapiens
cattaatgaaaactttttca

SEQ ID NO: 6715202 - DNA, 22 bp, Homo sapiens
cattaatgataaactcagatct

SEQ ID NO: 6715203 - DNA, 23 bp, Homo sapiens
cattaatgcctgctttttggaaa

SEQ ID NO: 6715204 - DNA, 22 bp, Homo sapiens
cattaatggcatatggtcctag

SEQ ID NO: 6715205 - DNA, 19 bp, Homo sapiens
cattaatgtaggtttagat

SEQ ID NO: 6715206 - DNA, 22 bp, Homo sapiens
cattaatgtgaagcaaaacaca

SEQ ID NO: 6715207 - DNA, 14 bp, Homo sapiens
cattaatgttgaaa

SEQ ID NO: 6715208 - DNA, 19 bp, Homo sapiens
cattaatgttgaaaaagaa

SEQ ID NO: 6715209 - DNA, 16 bp, Homo sapiens
cattaatgttgatttc

SEQ ID NO: 6715210 - DNA, 17 bp, Homo sapiens
cattaatgttgatttct

SEQ ID NO: 6715211 - DNA, 22 bp, Homo sapiens
cattaatgtttatttagctctg

SEQ ID NO: 6715212 - DNA, 12 bp, Homo sapiens
cattaatgtttc

SEQ ID NO: 6715213 - DNA, 15 bp, Homo sapiens
cattaatgtttctat

SEQ ID NO: 6715214 - DNA, 12 bp, Homo sapiens
cattaattaatt

SEQ ID NO: 6715215 - DNA, 13 bp, Homo sapiens
cattaattaatta

SEQ ID NO: 6715216 - DNA, 17 bp, Homo sapiens
cattaattaattaaagc

SEQ ID NO: 6715217 - DNA, 22 bp, Homo sapiens
cattaattagttccagtttctc

SEQ ID NO: 6715218 - DNA, 17 bp, Homo sapiens
cattaattctactaaat

SEQ ID NO: 6715219 - DNA, 17 bp, Homo sapiens
cattaattgctaacaat

SEQ ID NO: 6715220 - DNA, 22 bp, Homo sapiens
cattaattgctaacaattgtta

SEQ ID NO: 6715221 - DNA, 18 bp, Homo sapiens
cattaatttaaatgattt

SEQ ID NO: 6715222 - DNA, 15 bp, Homo sapiens
cattaatttaattac

SEQ ID NO: 6715223 - DNA, 19 bp, Homo sapiens
cattaatttaattactact

SEQ ID NO: 6715224 - DNA, 17 bp, Homo sapiens
cattaatttcaaaattt

SEQ ID NO: 6715225 - DNA, 15 bp, Homo sapiens
cattaatttctctca

SEQ ID NO: 6715226 - DNA, 21 bp, Homo sapiens
cattaatttctctcaatttgg

SEQ ID NO: 6715227 - DNA, 16 bp, Homo sapiens
cattaattttgtgcat

SEQ ID NO: 6715228 - DNA, 16 bp, Homo sapiens
cattacaaacaaagga

SEQ ID NO: 6715229 - DNA, 15 bp, Homo sapiens
cattacaacctggaa

SEQ ID NO: 6715230 - DNA, 17 bp, Homo sapiens
cattacaagtattttta

SEQ ID NO: 6715231 - DNA, 20 bp, Homo sapiens
cattacacgatcacctgcat

SEQ ID NO: 6715232 - DNA, 23 bp, Homo sapiens
cattacactccagcctgggcgaa

SEQ ID NO: 6715233 - DNA, 16 bp, Homo sapiens
cattacagaccatgga

SEQ ID NO: 6715234 - DNA, 22 bp, Homo sapiens
cattacagaccatggatatgtt

SEQ ID NO: 6715235 - DNA, 13 bp, Homo sapiens
cattacagagagg

SEQ ID NO: 6715236 - DNA, 13 bp, Homo sapiens
cattacagccagg

SEQ ID NO: 6715237 - DNA, 12 bp, Homo sapiens
cattacagccat

SEQ ID NO: 6715238 - DNA, 17 bp, Homo sapiens
cattacagccatatgta

SEQ ID NO: 6715239 - DNA, 16 bp, Homo sapiens
cattacagcttaatca

SEQ ID NO: 6715240 - DNA, 19 bp, Homo sapiens
cattacaggggcagtgcct

SEQ ID NO: 6715241 - DNA, 22 bp, Homo sapiens
cattacagttctttcctctttc

SEQ ID NO: 6715242 - DNA, 18 bp, Homo sapiens
cattacatcatcctcctt

SEQ ID NO: 6715243 - DNA, 12 bp, Homo sapiens
cattacatgtaa

SEQ ID NO: 6715244 - DNA, 14 bp, Homo sapiens
cattacatgtttaa

SEQ ID NO: 6715245 - DNA, 16 bp, Homo sapiens
cattacattaacattt

SEQ ID NO: 6715246 - DNA, 16 bp, Homo sapiens
cattacattattaaac

SEQ ID NO: 6715247 - DNA, 22 bp, Homo sapiens
cattacattccttgataatgtt

SEQ ID NO: 6715248 - DNA, 23 bp, Homo sapiens
cattaccaaaataataaaaatca

SEQ ID NO: 6715249 - DNA, 15 bp, Homo sapiens
cattaccactcaggc

SEQ ID NO: 6715250 - DNA, 17 bp, Homo sapiens
cattaccacttccctgc

SEQ ID NO: 6715251 - DNA, 16 bp, Homo sapiens
cattaccagcttaaaa

SEQ ID NO: 6715252 - DNA, 15 bp, Homo sapiens
cattaccatgtaatg

SEQ ID NO: 6715253 - DNA, 18 bp, Homo sapiens
cattacccacccgacctg

SEQ ID NO: 6715254 - DNA, 22 bp, Homo sapiens
cattacccacccgacctggctg

SEQ ID NO: 6715255 - DNA, 23 bp, Homo sapiens
cattacccacccgacctggctgc

SEQ ID NO: 6715256 - DNA, 19 bp, Homo sapiens
cattacccacgtgacacca

SEQ ID NO: 6715257 - DNA, 15 bp, Homo sapiens
cattacccttttctg

SEQ ID NO: 6715258 - DNA, 17 bp, Homo sapiens
cattacccttttctggg

SEQ ID NO: 6715259 - DNA, 18 bp, Homo sapiens
cattaccgcgttgtaaaa

SEQ ID NO: 6715260 - DNA, 15 bp, Homo sapiens
cattacctccatcca

SEQ ID NO: 6715261 - DNA, 23 bp, Homo sapiens
cattacctctttggaaaaggaag

SEQ ID NO: 6715262 - DNA, 16 bp, Homo sapiens
cattaccttgtctttc

SEQ ID NO: 6715263 - DNA, 21 bp, Homo sapiens
cattacgtgcatttaaactct

SEQ ID NO: 6715264 - DNA, 22 bp, Homo sapiens
cattacgtgcatttaaactctg

SEQ ID NO: 6715265 - DNA, 18 bp, Homo sapiens
cattactaaggcaggtgg

SEQ ID NO: 6715266 - DNA, 17 bp, Homo sapiens
cattactacactggtgt

SEQ ID NO: 6715267 - DNA, 12 bp, Homo sapiens
cattactactgt

SEQ ID NO: 6715268 - DNA, 14 bp, Homo sapiens
cattactactgtac

SEQ ID NO: 6715269 - DNA, 15 bp, Homo sapiens
cattactataagaac

SEQ ID NO: 6715270 - DNA, 23 bp, Homo sapiens
cattactcaattgataaacattt

SEQ ID NO: 6715271 - DNA, 13 bp, Homo sapiens
cattactctgcac

SEQ ID NO: 6715272 - DNA, 23 bp, Homo sapiens
cattactctgcactatagccatt

SEQ ID NO: 6715273 - DNA, 16 bp, Homo sapiens
cattactcttaaggaa

SEQ ID NO: 6715274 - DNA, 20 bp, Homo sapiens
cattactcttgtaagatttt

SEQ ID NO: 6715275 - DNA, 23 bp, Homo sapiens
cattactcttgtaagattttgaa

SEQ ID NO: 6715276 - DNA, 21 bp, Homo sapiens
cattactgaatttttaaaatg

SEQ ID NO: 6715277 - DNA, 21 bp, Homo sapiens
cattactgaggggattctcta

SEQ ID NO: 6715278 - DNA, 19 bp, Homo sapiens
cattactgcccagatgttt

SEQ ID NO: 6715279 - DNA, 12 bp, Homo sapiens
cattactgcctt

SEQ ID NO: 6715280 - DNA, 21 bp, Homo sapiens
cattactgcctttggaagaaa

SEQ ID NO: 6715281 - DNA, 13 bp, Homo sapiens
cattactggtaaa

SEQ ID NO: 6715282 - DNA, 14 bp, Homo sapiens
cattactgtccttt

SEQ ID NO: 6715283 - DNA, 16 bp, Homo sapiens
cattactgtgatttct

SEQ ID NO: 6715284 - DNA, 16 bp, Homo sapiens
cattactgttaactgt

SEQ ID NO: 6715285 - DNA, 16 bp, Homo sapiens
cattactgttccagat

SEQ ID NO: 6715286 - DNA, 20 bp, Homo sapiens
cattactgttccagattcct

SEQ ID NO: 6715287 - DNA, 12 bp, Homo sapiens
cattacttgaat

SEQ ID NO: 6715288 - DNA, 14 bp, Homo sapiens
cattacttgaatgt

SEQ ID NO: 6715289 - DNA, 23 bp, Homo sapiens
cattacttgattaagattttaca

SEQ ID NO: 6715290 - DNA, 15 bp, Homo sapiens
cattacttgcacaag

SEQ ID NO: 6715291 - DNA, 15 bp, Homo sapiens
cattacttgctttca

SEQ ID NO: 6715292 - DNA, 15 bp, Homo sapiens
cattacttgtataaa

SEQ ID NO: 6715293 - DNA, 23 bp, Homo sapiens
cattactttaccacccccacacc

SEQ ID NO: 6715294 - DNA, 12 bp, Homo sapiens
cattactttata

SEQ ID NO: 6715295 - DNA, 14 bp, Homo sapiens
cattactttctgct

SEQ ID NO: 6715296 - DNA, 16 bp, Homo sapiens
cattacttttaaaaat

SEQ ID NO: 6715297 - DNA, 12 bp, Homo sapiens
cattacttttta

SEQ ID NO: 6715298 - DNA, 19 bp, Homo sapiens
cattagaaaattttgtaaa

SEQ ID NO: 6715299 - DNA, 21 bp, Homo sapiens
cattagaaaattttgtaaaac

SEQ ID NO: 6715300 - DNA, 23 bp, Homo sapiens
cattagaaaattttgtaaaacaa

SEQ ID NO: 6715301 - DNA, 23 bp, Homo sapiens
cattagaaactgaaaactgtaaa

SEQ ID NO: 6715302 - DNA, 15 bp, Homo sapiens
cattagaaatatttt

SEQ ID NO: 6715303 - DNA, 12 bp, Homo sapiens
cattagaagaaa

SEQ ID NO: 6715304 - DNA, 17 bp, Homo sapiens
cattagaagttaccaaa

SEQ ID NO: 6715305 - DNA, 19 bp, Homo sapiens
cattagaagttaccaaatt

SEQ ID NO: 6715306 - DNA, 13 bp, Homo sapiens
cattagaatgtga

SEQ ID NO: 6715307 - DNA, 15 bp, Homo sapiens
cattagaatgtgatt

SEQ ID NO: 6715308 - DNA, 17 bp, Homo sapiens
cattagaatgtgatttt

SEQ ID NO: 6715309 - DNA, 14 bp, Homo sapiens
cattagaattattt

SEQ ID NO: 6715310 - DNA, 20 bp, Homo sapiens
cattagaattgaattattgg

SEQ ID NO: 6715311 - DNA, 15 bp, Homo sapiens
cattagactcctcct

SEQ ID NO: 6715312 - DNA, 20 bp, Homo sapiens
cattagactggaacttgaac

SEQ ID NO: 6715313 - DNA, 21 bp, Homo sapiens
cattagagagatttttcattt

SEQ ID NO: 6715314 - DNA, 19 bp, Homo sapiens
cattagagatgttgagtct

SEQ ID NO: 6715315 - DNA, 16 bp, Homo sapiens
cattagagcacagctt

SEQ ID NO: 6715316 - DNA, 19 bp, Homo sapiens
cattagataaacacaggca

SEQ ID NO: 6715317 - DNA, 19 bp, Homo sapiens
cattagcaaaaaaagttgt

SEQ ID NO: 6715318 - DNA, 20 bp, Homo sapiens
cattagcaaaaaaagttgta

SEQ ID NO: 6715319 - DNA, 18 bp, Homo sapiens
cattagcaacgcctgcct

SEQ ID NO: 6715320 - DNA, 15 bp, Homo sapiens
cattagcaaggcaga

SEQ ID NO: 6715321 - DNA, 20 bp, Homo sapiens
cattagcacagattttaatt

SEQ ID NO: 6715322 - DNA, 17 bp, Homo sapiens
cattagcagctatgtaa

SEQ ID NO: 6715323 - DNA, 18 bp, Homo sapiens
cattagcagtttgctttg

SEQ ID NO: 6715324 - DNA, 17 bp, Homo sapiens
cattagcataattttgt

SEQ ID NO: 6715325 - DNA, 14 bp, Homo sapiens
cattagccaaggat

SEQ ID NO: 6715326 - DNA, 17 bp, Homo sapiens
cattagcctgagtagaa

SEQ ID NO: 6715327 - DNA, 19 bp, Homo sapiens
cattagcctgagtagaaag

SEQ ID NO: 6715328 - DNA, 20 bp, Homo sapiens
cattagcgacagtaggattt

SEQ ID NO: 6715329 - DNA, 15 bp, Homo sapiens
cattagctttaatta

SEQ ID NO: 6715330 - DNA, 19 bp, Homo sapiens
cattaggaaaagttgctat

SEQ ID NO: 6715331 - DNA, 15 bp, Homo sapiens
cattaggaagctgaa

SEQ ID NO: 6715332 - DNA, 21 bp, Homo sapiens
cattaggaattaagttatctt

SEQ ID NO: 6715333 - DNA, 12 bp, Homo sapiens
cattaggaattg

SEQ ID NO: 6715334 - DNA, 20 bp, Homo sapiens
cattaggaattgtttataca

SEQ ID NO: 6715335 - DNA, 19 bp, Homo sapiens
cattaggacaatcagtccc

SEQ ID NO: 6715336 - DNA, 14 bp, Homo sapiens
cattaggcaaagta

SEQ ID NO: 6715337 - DNA, 16 bp, Homo sapiens
cattaggccagcaacg

SEQ ID NO: 6715338 - DNA, 20 bp, Homo sapiens
cattaggccagcaacgcttg

SEQ ID NO: 6715339 - DNA, 13 bp, Homo sapiens
cattaggccccag

SEQ ID NO: 6715340 - DNA, 19 bp, Homo sapiens
cattaggctgttggttcaa

SEQ ID NO: 6715341 - DNA, 20 bp, Homo sapiens
cattagggatgcctcctttc

SEQ ID NO: 6715342 - DNA, 14 bp, Homo sapiens
cattagggcttttt

SEQ ID NO: 6715343 - DNA, 15 bp, Homo sapiens
cattaggttgtgaat

SEQ ID NO: 6715344 - DNA, 16 bp, Homo sapiens
cattaggttgtgaatg

SEQ ID NO: 6715345 - DNA, 14 bp, Homo sapiens
cattagtaaatgtc

SEQ ID NO: 6715346 - DNA, 17 bp, Homo sapiens
cattagtaaatgtcttt

SEQ ID NO: 6715347 - DNA, 16 bp, Homo sapiens
cattagtaactttgaa

SEQ ID NO: 6715348 - DNA, 20 bp, Homo sapiens
cattagtactttatagaaga

SEQ ID NO: 6715349 - DNA, 22 bp, Homo sapiens
cattagtactttatagaagaat

SEQ ID NO: 6715350 - DNA, 15 bp, Homo sapiens
cattagtactttgtg

SEQ ID NO: 6715351 - DNA, 18 bp, Homo sapiens
cattagtatagtctccct

SEQ ID NO: 6715352 - DNA, 19 bp, Homo sapiens
cattagtatagtctccctt

SEQ ID NO: 6715353 - DNA, 23 bp, Homo sapiens
cattagtgtccccccttgaagca

SEQ ID NO: 6715354 - DNA, 17 bp, Homo sapiens
cattagtgttctttata

SEQ ID NO: 6715355 - DNA, 23 bp, Homo sapiens
cattagtgttctttatatacctt

SEQ ID NO: 6715356 - DNA, 21 bp, Homo sapiens
cattagttggagctagaaaat

SEQ ID NO: 6715357 - DNA, 23 bp, Homo sapiens
cattagttggagctagaaaatga

SEQ ID NO: 6715358 - DNA, 16 bp, Homo sapiens
cattagtttgaggtac

SEQ ID NO: 6715359 - DNA, 12 bp, Homo sapiens
cattagttttaa

SEQ ID NO: 6715360 - DNA, 14 bp, Homo sapiens
cattagttttgaag

SEQ ID NO: 6715361 - DNA, 15 bp, Homo sapiens
cattagttttgaaga

SEQ ID NO: 6715362 - DNA, 16 bp, Homo sapiens
cattataaaaacactt

SEQ ID NO: 6715363 - DNA, 19 bp, Homo sapiens
cattataaaaacacttata

SEQ ID NO: 6715364 - DNA, 19 bp, Homo sapiens
cattataaaataagaaaaa

SEQ ID NO: 6715365 - DNA, 20 bp, Homo sapiens
cattataaaatctttccatc

SEQ ID NO: 6715366 - DNA, 19 bp, Homo sapiens
cattataaagttcagatgt

SEQ ID NO: 6715367 - DNA, 12 bp, Homo sapiens
cattataaatga

SEQ ID NO: 6715368 - DNA, 20 bp, Homo sapiens
cattataacaactatttact

SEQ ID NO: 6715369 - DNA, 18 bp, Homo sapiens
cattataactgaaggaga

SEQ ID NO: 6715370 - DNA, 20 bp, Homo sapiens
cattataatctcaaaggaga

SEQ ID NO: 6715371 - DNA, 22 bp, Homo sapiens
cattataatctcaaaggagaaa

SEQ ID NO: 6715372 - DNA, 13 bp, Homo sapiens
cattataatgaat

SEQ ID NO: 6715373 - DNA, 14 bp, Homo sapiens
cattataattttga

SEQ ID NO: 6715374 - DNA, 20 bp, Homo sapiens
cattatacatcaattggaaa

SEQ ID NO: 6715375 - DNA, 19 bp, Homo sapiens
cattatactctctgaaata

SEQ ID NO: 6715376 - DNA, 15 bp, Homo sapiens
cattatactttatat

SEQ ID NO: 6715377 - DNA, 17 bp, Homo sapiens
cattatagatcccccag

SEQ ID NO: 6715378 - DNA, 19 bp, Homo sapiens
cattatagcacgaagctat

SEQ ID NO: 6715379 - DNA, 17 bp, Homo sapiens
cattatagcatgtaata

SEQ ID NO: 6715380 - DNA, 18 bp, Homo sapiens
cattatagcatgtaatat

SEQ ID NO: 6715381 - DNA, 20 bp, Homo sapiens
cattatagcgcctgtataag

SEQ ID NO: 6715382 - DNA, 17 bp, Homo sapiens
cattatatagcagtaaa

SEQ ID NO: 6715383 - DNA, 13 bp, Homo sapiens
cattatattctaa

SEQ ID NO: 6715384 - DNA, 15 bp, Homo sapiens
cattatattctctta

SEQ ID NO: 6715385 - DNA, 13 bp, Homo sapiens
cattatattgcaa

SEQ ID NO: 6715386 - DNA, 15 bp, Homo sapiens
cattatattgcaatg

SEQ ID NO: 6715387 - DNA, 14 bp, Homo sapiens
cattatatttattg

SEQ ID NO: 6715388 - DNA, 19 bp, Homo sapiens
cattatatttattgtttat

SEQ ID NO: 6715389 - DNA, 23 bp, Homo sapiens
cattatatttattgtttatttta

SEQ ID NO: 6715390 - DNA, 13 bp, Homo sapiens
cattatattttga

SEQ ID NO: 6715391 - DNA, 22 bp, Homo sapiens
cattatcaaaagtgatcagcaa

SEQ ID NO: 6715392 - DNA, 13 bp, Homo sapiens
cattatcatgtgt

SEQ ID NO: 6715393 - DNA, 14 bp, Homo sapiens
cattatcatgtgta

SEQ ID NO: 6715394 - DNA, 15 bp, Homo sapiens
cattatcatgtgtaa

SEQ ID NO: 6715395 - DNA, 18 bp, Homo sapiens
cattatcatgtgtaatca

SEQ ID NO: 6715396 - DNA, 22 bp, Homo sapiens
cattatcatgtgtaatcaataa

SEQ ID NO: 6715397 - DNA, 15 bp, Homo sapiens
cattatccattccca

SEQ ID NO: 6715398 - DNA, 23 bp, Homo sapiens
cattatccattcccaagatgcct

SEQ ID NO: 6715399 - DNA, 14 bp, Homo sapiens
cattatcctttatt

SEQ ID NO: 6715400 - DNA, 16 bp, Homo sapiens
cattatcgggagcagt

SEQ ID NO: 6715401 - DNA, 13 bp, Homo sapiens
cattatctatgca

SEQ ID NO: 6715402 - DNA, 19 bp, Homo sapiens
cattatctcacttagtcct

SEQ ID NO: 6715403 - DNA, 15 bp, Homo sapiens
cattatctgctgttc

SEQ ID NO: 6715404 - DNA, 14 bp, Homo sapiens
cattatctgtactg

SEQ ID NO: 6715405 - DNA, 16 bp, Homo sapiens
cattatctgtactgaa

SEQ ID NO: 6715406 - DNA, 18 bp, Homo sapiens
cattatctgtactgaaag

SEQ ID NO: 6715407 - DNA, 21 bp, Homo sapiens
cattatctgtactgaaagcaa

SEQ ID NO: 6715408 - DNA, 18 bp, Homo sapiens
cattatcttatcatttat

SEQ ID NO: 6715409 - DNA, 15 bp, Homo sapiens
cattatcttatgaat

SEQ ID NO: 6715410 - DNA, 14 bp, Homo sapiens
cattatcttgctca

SEQ ID NO: 6715411 - DNA, 23 bp, Homo sapiens
cattatcttttggctctgaagaa

SEQ ID NO: 6715412 - DNA, 13 bp, Homo sapiens
cattatgaagaat

SEQ ID NO: 6715413 - DNA, 21 bp, Homo sapiens
cattatgaagaatacccagga

SEQ ID NO: 6715414 - DNA, 13 bp, Homo sapiens
cattatgaagatg

SEQ ID NO: 6715415 - DNA, 14 bp, Homo sapiens
cattatgacatttc

SEQ ID NO: 6715416 - DNA, 23 bp, Homo sapiens
cattatgaggaaacttggacatt

SEQ ID NO: 6715417 - DNA, 18 bp, Homo sapiens
cattatgagtaaaagcag

SEQ ID NO: 6715418 - DNA, 11 bp, Homo sapiens
cattatgatct

SEQ ID NO: 6715419 - DNA, 14 bp, Homo sapiens
cattatgatctaat

SEQ ID NO: 6715420 - DNA, 16 bp, Homo sapiens
cattatgatctaataa

SEQ ID NO: 6715421 - DNA, 18 bp, Homo sapiens
cattatgatctaataaac

SEQ ID NO: 6715422 - DNA, 20 bp, Homo sapiens
cattatgatctaataaactt

SEQ ID NO: 6715423 - DNA, 22 bp, Homo sapiens
cattatgatctaataaacttta

SEQ ID NO: 6715424 - DNA, 15 bp, Homo sapiens
cattatgatttcatt

SEQ ID NO: 6715425 - DNA, 20 bp, Homo sapiens
cattatgcaacgtttaacat

SEQ ID NO: 6715426 - DNA, 21 bp, Homo sapiens
cattatgcacttttagaaatg

SEQ ID NO: 6715427 - DNA, 18 bp, Homo sapiens
cattatgccacttccttt

SEQ ID NO: 6715428 - DNA, 12 bp, Homo sapiens
cattatgccctt

SEQ ID NO: 6715429 - DNA, 12 bp, Homo sapiens
cattatgctttg

SEQ ID NO: 6715430 - DNA, 21 bp, Homo sapiens
cattatgggttaggcattaat

SEQ ID NO: 6715431 - DNA, 20 bp, Homo sapiens
cattatgtaaaatgttttag

SEQ ID NO: 6715432 - DNA, 21 bp, Homo sapiens
cattatgtaacactagccgaa

SEQ ID NO: 6715433 - DNA, 12 bp, Homo sapiens
cattatgtagaa

SEQ ID NO: 6715434 - DNA, 14 bp, Homo sapiens
cattatgtagctgt

SEQ ID NO: 6715435 - DNA, 15 bp, Homo sapiens
cattatgtagctgtc

SEQ ID NO: 6715436 - DNA, 22 bp, Homo sapiens
cattatgtatttataatttaaa

SEQ ID NO: 6715437 - DNA, 12 bp, Homo sapiens
cattatgtcaat

SEQ ID NO: 6715438 - DNA, 21 bp, Homo sapiens
cattatgtcaattcattaata

SEQ ID NO: 6715439 - DNA, 19 bp, Homo sapiens
cattatgtccactgtgtat

SEQ ID NO: 6715440 - DNA, 21 bp, Homo sapiens
cattatgtccactgtgtatag

SEQ ID NO: 6715441 - DNA, 11 bp, Homo sapiens
cattatgtgtg

SEQ ID NO: 6715442 - DNA, 18 bp, Homo sapiens
cattatgtgtgcatgtgt

SEQ ID NO: 6715443 - DNA, 16 bp, Homo sapiens
cattatgttaatattt

SEQ ID NO: 6715444 - DNA, 20 bp, Homo sapiens
cattatgttagagaggtagc

SEQ ID NO: 6715445 - DNA, 19 bp, Homo sapiens
cattatgttattggaattt

SEQ ID NO: 6715446 - DNA, 15 bp, Homo sapiens
cattatgttcatgta

SEQ ID NO: 6715447 - DNA, 15 bp, Homo sapiens
cattatgtttaagat

SEQ ID NO: 6715448 - DNA, 18 bp, Homo sapiens
cattattaaatcagaatc

SEQ ID NO: 6715449 - DNA, 14 bp, Homo sapiens
cattattaatcatt

SEQ ID NO: 6715450 - DNA, 18 bp, Homo sapiens
cattattaatcattccat

SEQ ID NO: 6715451 - DNA, 23 bp, Homo sapiens
cattattacgtggcaaaatccct

SEQ ID NO: 6715452 - DNA, 23 bp, Homo sapiens
cattattacttttcctcttagaa

SEQ ID NO: 6715453 - DNA, 18 bp, Homo sapiens
cattattatctagctaag

SEQ ID NO: 6715454 - DNA, 21 bp, Homo sapiens
cattattattactttttaaaa

SEQ ID NO: 6715455 - DNA, 16 bp, Homo sapiens
cattattcaaagttgc

SEQ ID NO: 6715456 - DNA, 15 bp, Homo sapiens
cattattcaagaaag

SEQ ID NO: 6715457 - DNA, 14 bp, Homo sapiens
cattattcataaaa

SEQ ID NO: 6715458 - DNA, 14 bp, Homo sapiens
cattattcatatgc

SEQ ID NO: 6715459 - DNA, 13 bp, Homo sapiens
cattattcctcag

SEQ ID NO: 6715460 - DNA, 22 bp, Homo sapiens
cattattcctcagattgctgaa

SEQ ID NO: 6715461 - DNA, 12 bp, Homo sapiens
cattattctcat

SEQ ID NO: 6715462 - DNA, 14 bp, Homo sapiens
cattattctcataa

SEQ ID NO: 6715463 - DNA, 19 bp, Homo sapiens
cattattctcataatcctt

SEQ ID NO: 6715464 - DNA, 11 bp, Homo sapiens
cattattcttc

SEQ ID NO: 6715465 - DNA, 19 bp, Homo sapiens
cattattgacgaactggct

SEQ ID NO: 6715466 - DNA, 18 bp, Homo sapiens
cattattgccaaataaga

SEQ ID NO: 6715467 - DNA, 18 bp, Homo sapiens
cattattggaatataatt

SEQ ID NO: 6715468 - DNA, 18 bp, Homo sapiens
cattattggaattaacct

SEQ ID NO: 6715469 - DNA, 23 bp, Homo sapiens
cattattggaattaacctggtgc

SEQ ID NO: 6715470 - DNA, 16 bp, Homo sapiens
cattattggatgtcaa

SEQ ID NO: 6715471 - DNA, 20 bp, Homo sapiens
cattattgtagtttgaaagt

SEQ ID NO: 6715472 - DNA, 14 bp, Homo sapiens
cattatttaataag

SEQ ID NO: 6715473 - DNA, 16 bp, Homo sapiens
cattatttaataagag

SEQ ID NO: 6715474 - DNA, 19 bp, Homo sapiens
cattatttaataagagtaa

SEQ ID NO: 6715475 - DNA, 13 bp, Homo sapiens
cattatttaatgt

SEQ ID NO: 6715476 - DNA, 15 bp, Homo sapiens
cattatttaatgttt

SEQ ID NO: 6715477 - DNA, 21 bp, Homo sapiens
cattatttaatgtttgattta

SEQ ID NO: 6715478 - DNA, 16 bp, Homo sapiens
cattatttaatttgta

SEQ ID NO: 6715479 - DNA, 20 bp, Homo sapiens
cattatttaatttgtatgct

SEQ ID NO: 6715480 - DNA, 23 bp, Homo sapiens
cattatttaatttgtatgctaaa

SEQ ID NO: 6715481 - DNA, 22 bp, Homo sapiens
cattatttatgtattgtgcaat

SEQ ID NO: 6715482 - DNA, 17 bp, Homo sapiens
cattatttattaaaaat

SEQ ID NO: 6715483 - DNA, 15 bp, Homo sapiens
cattatttattgtta

SEQ ID NO: 6715484 - DNA, 16 bp, Homo sapiens
cattatttattgttaa

SEQ ID NO: 6715485 - DNA, 13 bp, Homo sapiens
cattatttcaaaa

SEQ ID NO: 6715486 - DNA, 23 bp, Homo sapiens
cattatttcaaccgcttgccata

SEQ ID NO: 6715487 - DNA, 22 bp, Homo sapiens
cattatttcgtgttgtgttctt

SEQ ID NO: 6715488 - DNA, 20 bp, Homo sapiens
cattatttctaccattaaaa

SEQ ID NO: 6715489 - DNA, 21 bp, Homo sapiens
cattatttctaccattaaaat

SEQ ID NO: 6715490 - DNA, 22 bp, Homo sapiens
cattatttctgcttcctggggg

SEQ ID NO: 6715491 - DNA, 15 bp, Homo sapiens
cattatttctgtata

SEQ ID NO: 6715492 - DNA, 17 bp, Homo sapiens
cattatttctgtatata

SEQ ID NO: 6715493 - DNA, 21 bp, Homo sapiens
cattatttctgtatatagatg

SEQ ID NO: 6715494 - DNA, 16 bp, Homo sapiens
cattatttcttcccag

SEQ ID NO: 6715495 - DNA, 16 bp, Homo sapiens
cattatttgagactgt

SEQ ID NO: 6715496 - DNA, 21 bp, Homo sapiens
cattatttgagtttgacattt

SEQ ID NO: 6715497 - DNA, 13 bp, Homo sapiens
cattatttgataa

SEQ ID NO: 6715498 - DNA, 21 bp, Homo sapiens
cattatttgataacattttgt

SEQ ID NO: 6715499 - DNA, 19 bp, Homo sapiens
cattatttgcatgttacct

SEQ ID NO: 6715500 - DNA, 12 bp, Homo sapiens
cattatttggaa

SEQ ID NO: 6715501 - DNA, 13 bp, Homo sapiens
cattatttgtcaa

SEQ ID NO: 6715502 - DNA, 15 bp, Homo sapiens
cattatttgtcaaat

SEQ ID NO: 6715503 - DNA, 19 bp, Homo sapiens
cattattttaaaatcaaag

SEQ ID NO: 6715504 - DNA, 13 bp, Homo sapiens
cattattttacag

SEQ ID NO: 6715505 - DNA, 15 bp, Homo sapiens
cattattttacagtc

SEQ ID NO: 6715506 - DNA, 23 bp, Homo sapiens
cattattttacagtctctgttgt

SEQ ID NO: 6715507 - DNA, 11 bp, Homo sapiens
cattattttat

SEQ ID NO: 6715508 - DNA, 12 bp, Homo sapiens
cattattttatt

SEQ ID NO: 6715509 - DNA, 19 bp, Homo sapiens
cattattttattttatagt

SEQ ID NO: 6715510 - DNA, 12 bp, Homo sapiens
cattattttccc

SEQ ID NO: 6715511 - DNA, 22 bp, Homo sapiens
cattattttcccacaattcttt

SEQ ID NO: 6715512 - DNA, 14 bp, Homo sapiens
cattattttctgtc

SEQ ID NO: 6715513 - DNA, 15 bp, Homo sapiens
cattattttctgtca

SEQ ID NO: 6715514 - DNA, 20 bp, Homo sapiens
cattattttgaggtagagga

SEQ ID NO: 6715515 - DNA, 20 bp, Homo sapiens
cattattttgggaagaaaac

SEQ ID NO: 6715516 - DNA, 15 bp, Homo sapiens
cattattttgtcata

SEQ ID NO: 6715517 - DNA, 22 bp, Homo sapiens
cattattttgtcataaaatgct

SEQ ID NO: 6715518 - DNA, 15 bp, Homo sapiens
cattattttgtggtt

SEQ ID NO: 6715519 - DNA, 21 bp, Homo sapiens
cattattttgtggttctattt

SEQ ID NO: 6715520 - DNA, 13 bp, Homo sapiens
cattatttttcaa

SEQ ID NO: 6715521 - DNA, 15 bp, Homo sapiens
cattatttttcaatt

SEQ ID NO: 6715522 - DNA, 20 bp, Homo sapiens
cattatttttccactttgtt

SEQ ID NO: 6715523 - DNA, 22 bp, Homo sapiens
cattatttttccactttgttct

SEQ ID NO: 6715524 - DNA, 19 bp, Homo sapiens
cattcaaaaaactctctcc

SEQ ID NO: 6715525 - DNA, 16 bp, Homo sapiens
cattcaaaagttgaaa

SEQ ID NO: 6715526 - DNA, 18 bp, Homo sapiens
cattcaaaatagttctat

SEQ ID NO: 6715527 - DNA, 20 bp, Homo sapiens
cattcaaaatagttctattt

SEQ ID NO: 6715528 - DNA, 22 bp, Homo sapiens
cattcaaaatagttctatttct

SEQ ID NO: 6715529 - DNA, 21 bp, Homo sapiens
cattcaaaatgtccagcttct

SEQ ID NO: 6715530 - DNA, 14 bp, Homo sapiens
cattcaaatcagtg

SEQ ID NO: 6715531 - DNA, 16 bp, Homo sapiens
cattcaaatcagtgat

SEQ ID NO: 6715532 - DNA, 17 bp, Homo sapiens
cattcaaatcagtgatc

SEQ ID NO: 6715533 - DNA, 15 bp, Homo sapiens
cattcaaatgaagat

SEQ ID NO: 6715534 - DNA, 23 bp, Homo sapiens
cattcaaatgggtgatatcctga

SEQ ID NO: 6715535 - DNA, 14 bp, Homo sapiens
cattcaaatttgtc

SEQ ID NO: 6715536 - DNA, 18 bp, Homo sapiens
cattcaaccttaccaaaa

SEQ ID NO: 6715537 - DNA, 14 bp, Homo sapiens
cattcaagattccc

SEQ ID NO: 6715538 - DNA, 15 bp, Homo sapiens
cattcaagcctgtga

SEQ ID NO: 6715539 - DNA, 16 bp, Homo sapiens
cattcaagcttcatat

SEQ ID NO: 6715540 - DNA, 22 bp, Homo sapiens
cattcaataagcatcaaactct

SEQ ID NO: 6715541 - DNA, 20 bp, Homo sapiens
cattcaatcaacctgcactt

SEQ ID NO: 6715542 - DNA, 21 bp, Homo sapiens
cattcaatcaacctgcacttc

SEQ ID NO: 6715543 - DNA, 18 bp, Homo sapiens
cattcaattccagagaac

SEQ ID NO: 6715544 - DNA, 21 bp, Homo sapiens
cattcaatttgctatttacaa

SEQ ID NO: 6715545 - DNA, 24 bp, Homo sapiens
cattcacaaagtataacaattaaa

SEQ ID NO: 6715546 - DNA, 17 bp, Homo sapiens
cattcacaagcctcctg

SEQ ID NO: 6715547 - DNA, 21 bp, Homo sapiens
cattcacaagcctcctgtacc

SEQ ID NO: 6715548 - DNA, 13 bp, Homo sapiens
cattcacacacag

SEQ ID NO: 6715549 - DNA, 19 bp, Homo sapiens
cattcacacacagcctggc

SEQ ID NO: 6715550 - DNA, 22 bp, Homo sapiens
cattcacacacagcctggcctc

SEQ ID NO: 6715551 - DNA, 14 bp, Homo sapiens
cattcacagagcct

SEQ ID NO: 6715552 - DNA, 11 bp, Homo sapiens
cattcacagca

SEQ ID NO: 6715553 - DNA, 18 bp, Homo sapiens
cattcacagcgcctcctg

SEQ ID NO: 6715554 - DNA, 17 bp, Homo sapiens
cattcacatcgcagatt

SEQ ID NO: 6715555 - DNA, 19 bp, Homo sapiens
cattcacatttgatgtaca

SEQ ID NO: 6715556 - DNA, 16 bp, Homo sapiens
cattcacctgccccaa

SEQ ID NO: 6715557 - DNA, 19 bp, Homo sapiens
cattcacctgtatatttct

SEQ ID NO: 6715558 - DNA, 22 bp, Homo sapiens
cattcacgcatacttggatatc

SEQ ID NO: 6715559 - DNA, 18 bp, Homo sapiens
cattcacggcctggcatg

SEQ ID NO: 6715560 - DNA, 19 bp, Homo sapiens
cattcactaagccatgcca

SEQ ID NO: 6715561 - DNA, 14 bp, Homo sapiens
cattcactcttcca

SEQ ID NO: 6715562 - DNA, 18 bp, Homo sapiens
cattcactgctgattttt

SEQ ID NO: 6715563 - DNA, 13 bp, Homo sapiens
cattcactgtgca

SEQ ID NO: 6715564 - DNA, 19 bp, Homo sapiens
cattcacttcactgtgctg

SEQ ID NO: 6715565 - DNA, 13 bp, Homo sapiens
cattcacttctct

SEQ ID NO: 6715566 - DNA, 14 bp, Homo sapiens
cattcacttctgca

SEQ ID NO: 6715567 - DNA, 22 bp, Homo sapiens
cattcacttctgcattcctgta

SEQ ID NO: 6715568 - DNA, 13 bp, Homo sapiens
cattcagaaagct

SEQ ID NO: 6715569 - DNA, 14 bp, Homo sapiens
cattcagaaatgtt

SEQ ID NO: 6715570 - DNA, 13 bp, Homo sapiens
cattcagaacacc

SEQ ID NO: 6715571 - DNA, 11 bp, Homo sapiens
cattcagaact

SEQ ID NO: 6715572 - DNA, 15 bp, Homo sapiens
cattcagaactctca

SEQ ID NO: 6715573 - DNA, 16 bp, Homo sapiens
cattcagaactctcag

SEQ ID NO: 6715574 - DNA, 15 bp, Homo sapiens
cattcagactaaaaa

SEQ ID NO: 6715575 - DNA, 21 bp, Homo sapiens
cattcagactaaaaatacacc

SEQ ID NO: 6715576 - DNA, 21 bp, Homo sapiens
cattcagagactgcccttctc

SEQ ID NO: 6715577 - DNA, 16 bp, Homo sapiens
cattcagatcactgaa

SEQ ID NO: 6715578 - DNA, 17 bp, Homo sapiens
cattcagatcactgaat

SEQ ID NO: 6715579 - DNA, 21 bp, Homo sapiens
cattcagatcactgaatttat

SEQ ID NO: 6715580 - DNA, 23 bp, Homo sapiens
cattcagatcactgaatttataa

SEQ ID NO: 6715581 - DNA, 13 bp, Homo sapiens
cattcagatctga

SEQ ID NO: 6715582 - DNA, 17 bp, Homo sapiens
cattcagatctgaagta

SEQ ID NO: 6715583 - DNA, 21 bp, Homo sapiens
cattcagcacaccccaaggga

SEQ ID NO: 6715584 - DNA, 12 bp, Homo sapiens
cattcagcagaa

SEQ ID NO: 6715585 - DNA, 20 bp, Homo sapiens
cattcagcagaatgactctg

SEQ ID NO: 6715586 - DNA, 19 bp, Homo sapiens
cattcagcagcaaattttc

SEQ ID NO: 6715587 - DNA, 17 bp, Homo sapiens
cattcagccttcaatca

SEQ ID NO: 6715588 - DNA, 20 bp, Homo sapiens
cattcagctaacaaactaga

SEQ ID NO: 6715589 - DNA, 21 bp, Homo sapiens
cattcagctaacaaactagaa

SEQ ID NO: 6715590 - DNA, 17 bp, Homo sapiens
cattcagctctggagaa

SEQ ID NO: 6715591 - DNA, 21 bp, Homo sapiens
cattcagctctggagaacagt

SEQ ID NO: 6715592 - DNA, 21 bp, Homo sapiens
cattcagctgaggttcattac

SEQ ID NO: 6715593 - DNA, 14 bp, Homo sapiens
cattcagcttcctg

SEQ ID NO: 6715594 - DNA, 16 bp, Homo sapiens
cattcaggagcttcct

SEQ ID NO: 6715595 - DNA, 19 bp, Homo sapiens
cattcaggtgacctcctgc

SEQ ID NO: 6715596 - DNA, 22 bp, Homo sapiens
cattcagtactttatgaaaaaa

SEQ ID NO: 6715597 - DNA, 16 bp, Homo sapiens
cattcagtctgcagct

SEQ ID NO: 6715598 - DNA, 12 bp, Homo sapiens
cattcagtgaca

SEQ ID NO: 6715599 - DNA, 16 bp, Homo sapiens
cattcagtgagacaca

SEQ ID NO: 6715600 - DNA, 22 bp, Homo sapiens
cattcagtgcagcatatacaat

SEQ ID NO: 6715601 - DNA, 13 bp, Homo sapiens
cattcagtggcaa

SEQ ID NO: 6715602 - DNA, 22 bp, Homo sapiens
cattcagtgtaaattaattaca

SEQ ID NO: 6715603 - DNA, 14 bp, Homo sapiens
cattcataaggaaa

SEQ ID NO: 6715604 - DNA, 19 bp, Homo sapiens
cattcatactcaaagaggc

SEQ ID NO: 6715605 - DNA, 22 bp, Homo sapiens
cattcatatcactatgaacttg

SEQ ID NO: 6715606 - DNA, 16 bp, Homo sapiens
cattcatattaagaca

SEQ ID NO: 6715607 - DNA, 19 bp, Homo sapiens
cattcatattaagacagtg

SEQ ID NO: 6715608 - DNA, 15 bp, Homo sapiens
cattcatatttgcaa

SEQ ID NO: 6715609 - DNA, 17 bp, Homo sapiens
cattcatatttgcaata

SEQ ID NO: 6715610 - DNA, 16 bp, Homo sapiens
cattcatccagttgca

SEQ ID NO: 6715611 - DNA, 23 bp, Homo sapiens
cattcatccagttgcaataaaat

SEQ ID NO: 6715612 - DNA, 15 bp, Homo sapiens
cattcatcctcacat

SEQ ID NO: 6715613 - DNA, 18 bp, Homo sapiens
cattcatcctcacatgtg

SEQ ID NO: 6715614 - DNA, 18 bp, Homo sapiens
cattcatctcatgctctc

SEQ ID NO: 6715615 - DNA, 15 bp, Homo sapiens
cattcatctggaggc

SEQ ID NO: 6715616 - DNA, 15 bp, Homo sapiens
cattcatctgggctg

SEQ ID NO: 6715617 - DNA, 17 bp, Homo sapiens
cattcatctgggctggc

SEQ ID NO: 6715618 - DNA, 22 bp, Homo sapiens
cattcatctttcctttgctctg

SEQ ID NO: 6715619 - DNA, 23 bp, Homo sapiens
cattcatctttcctttgctctgg

SEQ ID NO: 6715620 - DNA, 18 bp, Homo sapiens
cattcatgaatattttca

SEQ ID NO: 6715621 - DNA, 19 bp, Homo sapiens
cattcatgaatattttcaa

SEQ ID NO: 6715622 - DNA, 21 bp, Homo sapiens
cattcatgcaacttgattctt

SEQ ID NO: 6715623 - DNA, 20 bp, Homo sapiens
cattcatgcaagagtttctt

SEQ ID NO: 6715624 - DNA, 16 bp, Homo sapiens
cattcatgcctggctt

SEQ ID NO: 6715625 - DNA, 14 bp, Homo sapiens
cattcatgtaactc

SEQ ID NO: 6715626 - DNA, 14 bp, Homo sapiens
cattcattcactgt

SEQ ID NO: 6715627 - DNA, 16 bp, Homo sapiens
cattcattccattctg

SEQ ID NO: 6715628 - DNA, 17 bp, Homo sapiens
cattcattccattctgg

SEQ ID NO: 6715629 - DNA, 16 bp, Homo sapiens
cattcattctgagccc

SEQ ID NO: 6715630 - DNA, 18 bp, Homo sapiens
cattcattttatattgaa

SEQ ID NO: 6715631 - DNA, 20 bp, Homo sapiens
cattcattttatattgaaaa

SEQ ID NO: 6715632 - DNA, 21 bp, Homo sapiens
cattcattttctgacatgcat

SEQ ID NO: 6715633 - DNA, 19 bp, Homo sapiens
cattcattttctgggtgtt

SEQ ID NO: 6715634 - DNA, 20 bp, Homo sapiens
cattccaaaaagaacaataa

SEQ ID NO: 6715635 - DNA, 15 bp, Homo sapiens
cattccaaaatacaa

SEQ ID NO: 6715636 - DNA, 16 bp, Homo sapiens
cattccaaagaacagc

SEQ ID NO: 6715637 - DNA, 19 bp, Homo sapiens
cattccaaagttcttatct

SEQ ID NO: 6715638 - DNA, 21 bp, Homo sapiens
cattccaaagttcttatctct

SEQ ID NO: 6715639 - DNA, 18 bp, Homo sapiens
cattccaacaaagggttt

SEQ ID NO: 6715640 - DNA, 18 bp, Homo sapiens
cattccaacaatggggtg

SEQ ID NO: 6715641 - DNA, 17 bp, Homo sapiens
cattccaacacctgcca

SEQ ID NO: 6715642 - DNA, 16 bp, Homo sapiens
cattccaacagtgagt

SEQ ID NO: 6715643 - DNA, 21 bp, Homo sapiens
cattccaagaatagcatctgt

SEQ ID NO: 6715644 - DNA, 22 bp, Homo sapiens
cattccaaggagttggaagtga

SEQ ID NO: 6715645 - DNA, 23 bp, Homo sapiens
cattccaagggtatgggaagcca

SEQ ID NO: 6715646 - DNA, 13 bp, Homo sapiens
cattccacacaga

SEQ ID NO: 6715647 - DNA, 16 bp, Homo sapiens
cattccacacatttcc

SEQ ID NO: 6715648 - DNA, 18 bp, Homo sapiens
cattccacactgcaggga

SEQ ID NO: 6715649 - DNA, 21 bp, Homo sapiens
cattccacagctgccctggct

SEQ ID NO: 6715650 - DNA, 11 bp, Homo sapiens
cattccacagg

SEQ ID NO: 6715651 - DNA, 13 bp, Homo sapiens
cattccacaggac

SEQ ID NO: 6715652 - DNA, 13 bp, Homo sapiens
cattccacaggat

SEQ ID NO: 6715653 - DNA, 16 bp, Homo sapiens
cattccacatctgttt

SEQ ID NO: 6715654 - DNA, 17 bp, Homo sapiens
cattccaccctgttact

SEQ ID NO: 6715655 - DNA, 14 bp, Homo sapiens
cattccacgtgccc

SEQ ID NO: 6715656 - DNA, 15 bp, Homo sapiens
cattccacgtgcccc

SEQ ID NO: 6715657 - DNA, 14 bp, Homo sapiens
cattccagaatctt

SEQ ID NO: 6715658 - DNA, 16 bp, Homo sapiens
cattccagacttcaaa

SEQ ID NO: 6715659 - DNA, 19 bp, Homo sapiens
cattccagacttcaaaaat

SEQ ID NO: 6715660 - DNA, 18 bp, Homo sapiens
cattccagagctgcagaa

SEQ ID NO: 6715661 - DNA, 18 bp, Homo sapiens
cattccagcagctgcacc

SEQ ID NO: 6715662 - DNA, 14 bp, Homo sapiens
cattccagccaggc

SEQ ID NO: 6715663 - DNA, 16 bp, Homo sapiens
cattccagccaggccc

SEQ ID NO: 6715664 - DNA, 17 bp, Homo sapiens
cattccagccaggccca

SEQ ID NO: 6715665 - DNA, 18 bp, Homo sapiens
cattccagccaggcccag

SEQ ID NO: 6715666 - DNA, 18 bp, Homo sapiens
cattccagcccctctggt

SEQ ID NO: 6715667 - DNA, 19 bp, Homo sapiens
cattccagcccctctggtc

SEQ ID NO: 6715668 - DNA, 14 bp, Homo sapiens
cattccagcgtctg

SEQ ID NO: 6715669 - DNA, 16 bp, Homo sapiens
cattccagcgtctgct

SEQ ID NO: 6715670 - DNA, 19 bp, Homo sapiens
cattccagcgtctgctgtt

SEQ ID NO: 6715671 - DNA, 21 bp, Homo sapiens
cattccagcgtctgctgttga

SEQ ID NO: 6715672 - DNA, 23 bp, Homo sapiens
cattccagcgtctgctgttgatt

SEQ ID NO: 6715673 - DNA, 19 bp, Homo sapiens
cattccagctctcccatgg

SEQ ID NO: 6715674 - DNA, 18 bp, Homo sapiens
cattccagctctgccccc

SEQ ID NO: 6715675 - DNA, 19 bp, Homo sapiens
cattccagctctgcccccg

SEQ ID NO: 6715676 - DNA, 17 bp, Homo sapiens
cattccaggcagcctct

SEQ ID NO: 6715677 - DNA, 12 bp, Homo sapiens
cattccaggctc

SEQ ID NO: 6715678 - DNA, 21 bp, Homo sapiens
cattccagggctggggtgagc

SEQ ID NO: 6715679 - DNA, 19 bp, Homo sapiens
cattccaggtagctcggca

SEQ ID NO: 6715680 - DNA, 21 bp, Homo sapiens
cattccagtacagtattcttt

SEQ ID NO: 6715681 - DNA, 19 bp, Homo sapiens
cattccagtgctagaaaat

SEQ ID NO: 6715682 - DNA, 18 bp, Homo sapiens
cattccatcacagccagc

SEQ ID NO: 6715683 - DNA, 20 bp, Homo sapiens
cattccatcacagccagccc

SEQ ID NO: 6715684 - DNA, 22 bp, Homo sapiens
cattccatcacagccagcccag

SEQ ID NO: 6715685 - DNA, 17 bp, Homo sapiens
cattccatgacgcagga

SEQ ID NO: 6715686 - DNA, 14 bp, Homo sapiens
cattccatgatttt

SEQ ID NO: 6715687 - DNA, 19 bp, Homo sapiens
cattccatgattttacaga

SEQ ID NO: 6715688 - DNA, 18 bp, Homo sapiens
cattccatggaaataaaa

SEQ ID NO: 6715689 - DNA, 15 bp, Homo sapiens
cattccatgtgccca

SEQ ID NO: 6715690 - DNA, 18 bp, Homo sapiens
cattccatgtgcccagtt

SEQ ID NO: 6715691 - DNA, 21 bp, Homo sapiens
cattccatgtgcccagttaat

SEQ ID NO: 6715692 - DNA, 14 bp, Homo sapiens
cattccattgccta

SEQ ID NO: 6715693 - DNA, 16 bp, Homo sapiens
cattccattgcctagc

SEQ ID NO: 6715694 - DNA, 14 bp, Homo sapiens
cattccatttctct

SEQ ID NO: 6715695 - DNA, 13 bp, Homo sapiens
cattccatttgct

SEQ ID NO: 6715696 - DNA, 21 bp, Homo sapiens
cattcccaacgtgcaaagcca

SEQ ID NO: 6715697 - DNA, 17 bp, Homo sapiens
cattcccaagatgcctg

SEQ ID NO: 6715698 - DNA, 21 bp, Homo sapiens
cattcccaagatgcctgatca

SEQ ID NO: 6715699 - DNA, 22 bp, Homo sapiens
cattcccacataatacattcca

SEQ ID NO: 6715700 - DNA, 17 bp, Homo sapiens
cattcccagagtcagag

SEQ ID NO: 6715701 - DNA, 22 bp, Homo sapiens
cattcccagcctgactagaact

SEQ ID NO: 6715702 - DNA, 12 bp, Homo sapiens
cattcccagcgt

SEQ ID NO: 6715703 - DNA, 13 bp, Homo sapiens
cattcccagggac

SEQ ID NO: 6715704 - DNA, 15 bp, Homo sapiens
cattcccagggacct

SEQ ID NO: 6715705 - DNA, 11 bp, Homo sapiens
cattcccaggt

SEQ ID NO: 6715706 - DNA, 21 bp, Homo sapiens
cattcccatggtggcctcaag

SEQ ID NO: 6715707 - DNA, 23 bp, Homo sapiens
cattccccaacggggtggggagg

SEQ ID NO: 6715708 - DNA, 14 bp, Homo sapiens
cattccccagagtg

SEQ ID NO: 6715709 - DNA, 21 bp, Homo sapiens
cattccccagagtgggatcca

SEQ ID NO: 6715710 - DNA, 18 bp, Homo sapiens
cattccccaggaggccag

SEQ ID NO: 6715711 - DNA, 19 bp, Homo sapiens
cattccccaggaggccagc

SEQ ID NO: 6715712 - DNA, 22 bp, Homo sapiens
cattcccccaccagctgcagcc

SEQ ID NO: 6715713 - DNA, 13 bp, Homo sapiens
cattcccccagtg

SEQ ID NO: 6715714 - DNA, 15 bp, Homo sapiens
cattcccccagtgcg

SEQ ID NO: 6715715 - DNA, 18 bp, Homo sapiens
cattcccccatgtggctg

SEQ ID NO: 6715716 - DNA, 20 bp, Homo sapiens
cattcccccttcctagtgaa

SEQ ID NO: 6715717 - DNA, 16 bp, Homo sapiens
cattccccgctgccca

SEQ ID NO: 6715718 - DNA, 17 bp, Homo sapiens
cattccccgctgcccaa

SEQ ID NO: 6715719 - DNA, 16 bp, Homo sapiens
cattcccctcccacct

SEQ ID NO: 6715720 - DNA, 20 bp, Homo sapiens
cattcccctccccactcctc

SEQ ID NO: 6715721 - DNA, 11 bp, Homo sapiens
cattcccctcg

SEQ ID NO: 6715722 - DNA, 19 bp, Homo sapiens
cattcccgcagtgggagca

SEQ ID NO: 6715723 - DNA, 22 bp, Homo sapiens
cattcccgcagtgggagcaaac

SEQ ID NO: 6715724 - DNA, 23 bp, Homo sapiens
cattcccgtggtctccttgcact

SEQ ID NO: 6715725 - DNA, 16 bp, Homo sapiens
cattccctatcaaaac

SEQ ID NO: 6715726 - DNA, 17 bp, Homo sapiens
cattccctatcaaaaca

SEQ ID NO: 6715727 - DNA, 14 bp, Homo sapiens
cattccctgaatct

SEQ ID NO: 6715728 - DNA, 16 bp, Homo sapiens
cattccctgaatctgt

SEQ ID NO: 6715729 - DNA, 11 bp, Homo sapiens
cattccctgag

SEQ ID NO: 6715730 - DNA, 20 bp, Homo sapiens
cattcccttcgacagcattt

SEQ ID NO: 6715731 - DNA, 15 bp, Homo sapiens
cattcccttcggcca

SEQ ID NO: 6715732 - DNA, 22 bp, Homo sapiens
cattccgacaaccgatgctcca

SEQ ID NO: 6715733 - DNA, 17 bp, Homo sapiens
cattccggactggcaga

SEQ ID NO: 6715734 - DNA, 20 bp, Homo sapiens
cattccggccacatcattct

SEQ ID NO: 6715735 - DNA, 13 bp, Homo sapiens
cattccgttagga

SEQ ID NO: 6715736 - DNA, 19 bp, Homo sapiens
cattcctaactagaattag

SEQ ID NO: 6715737 - DNA, 21 bp, Homo sapiens
cattcctaactagaattagta

SEQ ID NO: 6715738 - DNA, 19 bp, Homo sapiens
cattcctaagagtggagga

SEQ ID NO: 6715739 - DNA, 16 bp, Homo sapiens
cattcctacaatttct

SEQ ID NO: 6715740 - DNA, 17 bp, Homo sapiens
cattcctagagagcaga

SEQ ID NO: 6715741 - DNA, 23 bp, Homo sapiens
cattcctaggtcacttgaagcca

SEQ ID NO: 6715742 - DNA, 13 bp, Homo sapiens
cattcctatttct

SEQ ID NO: 6715743 - DNA, 15 bp, Homo sapiens
cattcctcacaatga

SEQ ID NO: 6715744 - DNA, 12 bp, Homo sapiens
cattcctcagct

SEQ ID NO: 6715745 - DNA, 19 bp, Homo sapiens
cattcctcaggaaggacat

SEQ ID NO: 6715746 - DNA, 15 bp, Homo sapiens
cattcctctaatgtt

SEQ ID NO: 6715747 - DNA, 20 bp, Homo sapiens
cattcctctcctagccctcc

SEQ ID NO: 6715748 - DNA, 19 bp, Homo sapiens
cattcctgaaagaaacagt

SEQ ID NO: 6715749 - DNA, 16 bp, Homo sapiens
cattcctgaagaacca

SEQ ID NO: 6715750 - DNA, 16 bp, Homo sapiens
cattcctgaccctcac

SEQ ID NO: 6715751 - DNA, 19 bp, Homo sapiens
cattcctgaccctcacttt

SEQ ID NO: 6715752 - DNA, 14 bp, Homo sapiens
cattcctgcctggt

SEQ ID NO: 6715753 - DNA, 21 bp, Homo sapiens
cattcctgcctttaagccaaa

SEQ ID NO: 6715754 - DNA, 22 bp, Homo sapiens
cattcctgcctttaagccaaag

SEQ ID NO: 6715755 - DNA, 13 bp, Homo sapiens
cattcctgcttct

SEQ ID NO: 6715756 - DNA, 21 bp, Homo sapiens
cattcctggaaaccacagtcc

SEQ ID NO: 6715757 - DNA, 19 bp, Homo sapiens
cattcctggtacccagcca

SEQ ID NO: 6715758 - DNA, 19 bp, Homo sapiens
cattcctgtaacttttaat

SEQ ID NO: 6715759 - DNA, 13 bp, Homo sapiens
cattcctgtattc

SEQ ID NO: 6715760 - DNA, 11 bp, Homo sapiens
cattcctgtcc

SEQ ID NO: 6715761 - DNA, 13 bp, Homo sapiens
cattcctgtgccc

SEQ ID NO: 6715762 - DNA, 17 bp, Homo sapiens
cattcctgtgccctaga

SEQ ID NO: 6715763 - DNA, 12 bp, Homo sapiens
cattcctgttcc

SEQ ID NO: 6715764 - DNA, 16 bp, Homo sapiens
cattcctgttctttct

SEQ ID NO: 6715765 - DNA, 17 bp, Homo sapiens
cattccttagcagctca

SEQ ID NO: 6715766 - DNA, 15 bp, Homo sapiens
cattccttcccagag

SEQ ID NO: 6715767 - DNA, 21 bp, Homo sapiens
cattccttctacatgtaatga

SEQ ID NO: 6715768 - DNA, 17 bp, Homo sapiens
cattccttgcgcctcag

SEQ ID NO: 6715769 - DNA, 19 bp, Homo sapiens
cattccttgcgcctcagcc

SEQ ID NO: 6715770 - DNA, 15 bp, Homo sapiens
cattccttgctgaaa

SEQ ID NO: 6715771 - DNA, 17 bp, Homo sapiens
cattccttgtcaccagc

SEQ ID NO: 6715772 - DNA, 21 bp, Homo sapiens
cattcctttaaattctccaac

SEQ ID NO: 6715773 - DNA, 14 bp, Homo sapiens
cattcctttgggta

SEQ ID NO: 6715774 - DNA, 18 bp, Homo sapiens
cattccttttcgtttaga

SEQ ID NO: 6715775 - DNA, 20 bp, Homo sapiens
cattcgaaggaacctgtgtt

SEQ ID NO: 6715776 - DNA, 15 bp, Homo sapiens
cattcgaatctctgc

SEQ ID NO: 6715777 - DNA, 17 bp, Homo sapiens
cattcgaatctctgccc

SEQ ID NO: 6715778 - DNA, 18 bp, Homo sapiens
cattcgacataccccact

SEQ ID NO: 6715779 - DNA, 20 bp, Homo sapiens
cattcgacataccccactgg

SEQ ID NO: 6715780 - DNA, 23 bp, Homo sapiens
cattcgcagcagctccgcctggc

SEQ ID NO: 6715781 - DNA, 21 bp, Homo sapiens
cattcgcagtgcccagtgatg

SEQ ID NO: 6715782 - DNA, 17 bp, Homo sapiens
cattcgcctttgtcttg

SEQ ID NO: 6715783 - DNA, 19 bp, Homo sapiens
cattcgcgtggctcgggac

SEQ ID NO: 6715784 - DNA, 14 bp, Homo sapiens
cattcggactgctg

SEQ ID NO: 6715785 - DNA, 23 bp, Homo sapiens
cattcggccttggtgaacacaca

SEQ ID NO: 6715786 - DNA, 14 bp, Homo sapiens
cattcgggccacag

SEQ ID NO: 6715787 - DNA, 16 bp, Homo sapiens
cattcgggccacaggg

SEQ ID NO: 6715788 - DNA, 23 bp, Homo sapiens
cattcggtacttacccggagaag

SEQ ID NO: 6715789 - DNA, 16 bp, Homo sapiens
cattcggtgtggtgca

SEQ ID NO: 6715790 - DNA, 19 bp, Homo sapiens
cattcgtggcatgttttga

SEQ ID NO: 6715791 - DNA, 15 bp, Homo sapiens
cattctaaaccaaaa

SEQ ID NO: 6715792 - DNA, 17 bp, Homo sapiens
cattctaaaccaaaaca

SEQ ID NO: 6715793 - DNA, 16 bp, Homo sapiens
cattctaacctggagg

SEQ ID NO: 6715794 - DNA, 11 bp, Homo sapiens
cattctaatgc

SEQ ID NO: 6715795 - DNA, 14 bp, Homo sapiens
cattctaatgcata

SEQ ID NO: 6715796 - DNA, 16 bp, Homo sapiens
cattctaatgcatatt

SEQ ID NO: 6715797 - DNA, 15 bp, Homo sapiens
cattctaattacaaa

SEQ ID NO: 6715798 - DNA, 16 bp, Homo sapiens
cattctacacagagca

SEQ ID NO: 6715799 - DNA, 15 bp, Homo sapiens
cattctacagaataa

SEQ ID NO: 6715800 - DNA, 20 bp, Homo sapiens
cattctacagaataatccag

SEQ ID NO: 6715801 - DNA, 17 bp, Homo sapiens
cattctacataatggaa

SEQ ID NO: 6715802 - DNA, 20 bp, Homo sapiens
cattctaccaagctgtcaca

SEQ ID NO: 6715803 - DNA, 14 bp, Homo sapiens
cattctacctgagg

SEQ ID NO: 6715804 - DNA, 16 bp, Homo sapiens
cattctacttcagctt

SEQ ID NO: 6715805 - DNA, 13 bp, Homo sapiens
cattctacttgct

SEQ ID NO: 6715806 - DNA, 15 bp, Homo sapiens
cattctacttgctct

SEQ ID NO: 6715807 - DNA, 17 bp, Homo sapiens
cattctacttgctctgg

SEQ ID NO: 6715808 - DNA, 20 bp, Homo sapiens
cattctacttgctctggacc

SEQ ID NO: 6715809 - DNA, 22 bp, Homo sapiens
cattctacttgctctggacctg

SEQ ID NO: 6715810 - DNA, 15 bp, Homo sapiens
cattctacttgctta

SEQ ID NO: 6715811 - DNA, 21 bp, Homo sapiens
cattctagagtgcatatattt

SEQ ID NO: 6715812 - DNA, 18 bp, Homo sapiens
cattctagatcctgcacc

SEQ ID NO: 6715813 - DNA, 21 bp, Homo sapiens
cattctagatgcaagtctctt

SEQ ID NO: 6715814 - DNA, 16 bp, Homo sapiens
cattctagattacttt

SEQ ID NO: 6715815 - DNA, 13 bp, Homo sapiens
cattctagcacct

SEQ ID NO: 6715816 - DNA, 16 bp, Homo sapiens
cattctaggatgtgga

SEQ ID NO: 6715817 - DNA, 17 bp, Homo sapiens
cattctagtattcttta

SEQ ID NO: 6715818 - DNA, 14 bp, Homo sapiens
cattctagtgcaga

SEQ ID NO: 6715819 - DNA, 15 bp, Homo sapiens
cattctatcaagccc

SEQ ID NO: 6715820 - DNA, 21 bp, Homo sapiens
cattctatccccaatcagctc

SEQ ID NO: 6715821 - DNA, 15 bp, Homo sapiens
cattctatcgttatt

SEQ ID NO: 6715822 - DNA, 18 bp, Homo sapiens
cattctattctccagaca

SEQ ID NO: 6715823 - DNA, 14 bp, Homo sapiens
cattctattgcctt

SEQ ID NO: 6715824 - DNA, 22 bp, Homo sapiens
cattctattgccttctttgaag

SEQ ID NO: 6715825 - DNA, 16 bp, Homo sapiens
cattctattttagaat

SEQ ID NO: 6715826 - DNA, 17 bp, Homo sapiens
cattctcaagccctgca

SEQ ID NO: 6715827 - DNA, 12 bp, Homo sapiens
cattctcacaat

SEQ ID NO: 6715828 - DNA, 19 bp, Homo sapiens
cattctcacaattgtaaag

SEQ ID NO: 6715829 - DNA, 11 bp, Homo sapiens
cattctcacat

SEQ ID NO: 6715830 - DNA, 19 bp, Homo sapiens
cattctcaccctgtgaaac

SEQ ID NO: 6715831 - DNA, 16 bp, Homo sapiens
cattctcactctgctt

SEQ ID NO: 6715832 - DNA, 23 bp, Homo sapiens
cattctcagaattcggtgtgctg

SEQ ID NO: 6715833 - DNA, 13 bp, Homo sapiens
cattctcaggcac

SEQ ID NO: 6715834 - DNA, 17 bp, Homo sapiens
cattctcaggcaccagt

SEQ ID NO: 6715835 - DNA, 16 bp, Homo sapiens
cattctcatctactca

SEQ ID NO: 6715836 - DNA, 15 bp, Homo sapiens
cattctcatctgcac

SEQ ID NO: 6715837 - DNA, 15 bp, Homo sapiens
cattctcatggagaa

SEQ ID NO: 6715838 - DNA, 16 bp, Homo sapiens
cattctcatggagaag

SEQ ID NO: 6715839 - DNA, 17 bp, Homo sapiens
cattctcattggaaatt

SEQ ID NO: 6715840 - DNA, 13 bp, Homo sapiens
cattctccacctg

SEQ ID NO: 6715841 - DNA, 12 bp, Homo sapiens
cattctccattt

SEQ ID NO: 6715842 - DNA, 17 bp, Homo sapiens
cattctccatttgttat

SEQ ID NO: 6715843 - DNA, 22 bp, Homo sapiens
cattctccccagtgtatgtctt

SEQ ID NO: 6715844 - DNA, 15 bp, Homo sapiens
cattctcccgcttcc

SEQ ID NO: 6715845 - DNA, 18 bp, Homo sapiens
cattctcccgcttcctgg

SEQ ID NO: 6715846 - DNA, 23 bp, Homo sapiens
cattctcccgcttcctggcctcc

SEQ ID NO: 6715847 - DNA, 19 bp, Homo sapiens
cattctcctcagtggcttc

SEQ ID NO: 6715848 - DNA, 21 bp, Homo sapiens
cattctcctcagtggcttctc

SEQ ID NO: 6715849 - DNA, 13 bp, Homo sapiens
cattctcctgcct

SEQ ID NO: 6715850 - DNA, 18 bp, Homo sapiens
cattctcctgcctcagcc

SEQ ID NO: 6715851 - DNA, 20 bp, Homo sapiens
cattctcctgcctcagcctc

SEQ ID NO: 6715852 - DNA, 21 bp, Homo sapiens
cattctcctgcctcagccttc

SEQ ID NO: 6715853 - DNA, 15 bp, Homo sapiens
cattctcctgcctgt

SEQ ID NO: 6715854 - DNA, 22 bp, Homo sapiens
cattctcctgcctgtagcagtg

SEQ ID NO: 6715855 - DNA, 12 bp, Homo sapiens
cattctccttcc

SEQ ID NO: 6715856 - DNA, 22 bp, Homo sapiens
cattctcctttgcagttcctct

SEQ ID NO: 6715857 - DNA, 15 bp, Homo sapiens
cattctctcatagaa

SEQ ID NO: 6715858 - DNA, 22 bp, Homo sapiens
cattctctcatagaacattgat

SEQ ID NO: 6715859 - DNA, 16 bp, Homo sapiens
cattctctctcctgtc

SEQ ID NO: 6715860 - DNA, 12 bp, Homo sapiens
cattctctctgc

SEQ ID NO: 6715861 - DNA, 14 bp, Homo sapiens
cattctctctgccc

SEQ ID NO: 6715862 - DNA, 21 bp, Homo sapiens
cattctctcttcctgcagtgt

SEQ ID NO: 6715863 - DNA, 12 bp, Homo sapiens
cattctctgaag

SEQ ID NO: 6715864 - DNA, 13 bp, Homo sapiens
cattctctgccca

SEQ ID NO: 6715865 - DNA, 22 bp, Homo sapiens
cattctcttgaaggtgctgcca

SEQ ID NO: 6715866 - DNA, 14 bp, Homo sapiens
cattctctttgata

SEQ ID NO: 6715867 - DNA, 13 bp, Homo sapiens
cattctcttttaa

SEQ ID NO: 6715868 - DNA, 14 bp, Homo sapiens
cattctcttttaat

SEQ ID NO: 6715869 - DNA, 19 bp, Homo sapiens
cattctgaaccctccaaag

SEQ ID NO: 6715870 - DNA, 13 bp, Homo sapiens
cattctgaatcaa

SEQ ID NO: 6715871 - DNA, 13 bp, Homo sapiens
cattctgaatgct

SEQ ID NO: 6715872 - DNA, 16 bp, Homo sapiens
cattctgaatgcttct

SEQ ID NO: 6715873 - DNA, 19 bp, Homo sapiens
cattctgacacatatcatt

SEQ ID NO: 6715874 - DNA, 18 bp, Homo sapiens
cattctgacccagggcct

SEQ ID NO: 6715875 - DNA, 16 bp, Homo sapiens
cattctgactcggttt

SEQ ID NO: 6715876 - DNA, 19 bp, Homo sapiens
cattctgactcggtttctc

SEQ ID NO: 6715877 - DNA, 21 bp, Homo sapiens
cattctgactcggtttctcca

SEQ ID NO: 6715878 - DNA, 12 bp, Homo sapiens
cattctgagccc

SEQ ID NO: 6715879 - DNA, 20 bp, Homo sapiens
cattctgagcccccttcctg

SEQ ID NO: 6715880 - DNA, 21 bp, Homo sapiens
cattctgagcccccttcctgt

SEQ ID NO: 6715881 - DNA, 18 bp, Homo sapiens
cattctgagctccccatc

SEQ ID NO: 6715882 - DNA, 16 bp, Homo sapiens
cattctgataggaggg

SEQ ID NO: 6715883 - DNA, 18 bp, Homo sapiens
cattctgcaccttgccag

SEQ ID NO: 6715884 - DNA, 21 bp, Homo sapiens
cattctgcaccttgccaggga

SEQ ID NO: 6715885 - DNA, 18 bp, Homo sapiens
cattctgcacgctgccca

SEQ ID NO: 6715886 - DNA, 16 bp, Homo sapiens
cattctgcatgagctg

SEQ ID NO: 6715887 - DNA, 15 bp, Homo sapiens
cattctgcattgcta

SEQ ID NO: 6715888 - DNA, 15 bp, Homo sapiens
cattctgcatttagc

SEQ ID NO: 6715889 - DNA, 22 bp, Homo sapiens
cattctgcatttagctgtattc

SEQ ID NO: 6715890 - DNA, 17 bp, Homo sapiens
cattctgccaaagtaaa

SEQ ID NO: 6715891 - DNA, 21 bp, Homo sapiens
cattctgccaaagtaaaacaa

SEQ ID NO: 6715892 - DNA, 15 bp, Homo sapiens
cattctgccccagag

SEQ ID NO: 6715893 - DNA, 18 bp, Homo sapiens
cattctgccccagagtgg

SEQ ID NO: 6715894 - DNA, 20 bp, Homo sapiens
cattctgccctgtgggaccc

SEQ ID NO: 6715895 - DNA, 15 bp, Homo sapiens
cattctgcctctcct

SEQ ID NO: 6715896 - DNA, 12 bp, Homo sapiens
cattctgcctgc

SEQ ID NO: 6715897 - DNA, 14 bp, Homo sapiens
cattctgcctgccc

SEQ ID NO: 6715898 - DNA, 16 bp, Homo sapiens
cattctgcctgccctg

SEQ ID NO: 6715899 - DNA, 18 bp, Homo sapiens
cattctgcctgccctgaa

SEQ ID NO: 6715900 - DNA, 15 bp, Homo sapiens
cattctgcctgcctg

SEQ ID NO: 6715901 - DNA, 17 bp, Homo sapiens
cattctgcctgcctggg

SEQ ID NO: 6715902 - DNA, 19 bp, Homo sapiens
cattctgcctgcctgggaa

SEQ ID NO: 6715903 - DNA, 13 bp, Homo sapiens
cattctgctctgc

SEQ ID NO: 6715904 - DNA, 17 bp, Homo sapiens
cattctgctctgcccat

SEQ ID NO: 6715905 - DNA, 22 bp, Homo sapiens
cattctgctctgcccatgccta

SEQ ID NO: 6715906 - DNA, 20 bp, Homo sapiens
cattctgctttcatcttggt

SEQ ID NO: 6715907 - DNA, 18 bp, Homo sapiens
cattctggaaacttttgt

SEQ ID NO: 6715908 - DNA, 21 bp, Homo sapiens
cattctggatgggcttggcca

SEQ ID NO: 6715909 - DNA, 11 bp, Homo sapiens
cattctggctt

SEQ ID NO: 6715910 - DNA, 18 bp, Homo sapiens
cattctggggtggggctt

SEQ ID NO: 6715911 - DNA, 16 bp, Homo sapiens
cattctgggtgttttc

SEQ ID NO: 6715912 - DNA, 15 bp, Homo sapiens
cattctggtattcct

SEQ ID NO: 6715913 - DNA, 21 bp, Homo sapiens
cattctggtccttagtaaatt

SEQ ID NO: 6715914 - DNA, 19 bp, Homo sapiens
cattctggttccctgctgc

SEQ ID NO: 6715915 - DNA, 22 bp, Homo sapiens
cattctggttccctgctgcgct

SEQ ID NO: 6715916 - DNA, 17 bp, Homo sapiens
cattctgtataaatgca

SEQ ID NO: 6715917 - DNA, 11 bp, Homo sapiens
cattctgtcct

SEQ ID NO: 6715918 - DNA, 21 bp, Homo sapiens
cattctgtcgccttagcatgt

SEQ ID NO: 6715919 - DNA, 22 bp, Homo sapiens
cattctgtcgccttagcatgtt

SEQ ID NO: 6715920 - DNA, 16 bp, Homo sapiens
cattctgtctctgctt

SEQ ID NO: 6715921 - DNA, 17 bp, Homo sapiens
cattctgtctctgcttg

SEQ ID NO: 6715922 - DNA, 21 bp, Homo sapiens
cattctgtctttcaaaaggta

SEQ ID NO: 6715923 - DNA, 17 bp, Homo sapiens
cattctgtgatcattta

SEQ ID NO: 6715924 - DNA, 17 bp, Homo sapiens
cattctgtgcaggctgc

SEQ ID NO: 6715925 - DNA, 15 bp, Homo sapiens
cattctgttgcccag

SEQ ID NO: 6715926 - DNA, 17 bp, Homo sapiens
cattctgttgcccaggc

SEQ ID NO: 6715927 - DNA, 19 bp, Homo sapiens
cattctgttgcccaggctg

SEQ ID NO: 6715928 - DNA, 22 bp, Homo sapiens
cattctgttgttcagtcctctg

SEQ ID NO: 6715929 - DNA, 18 bp, Homo sapiens
cattctgtttcctcttga

SEQ ID NO: 6715930 - DNA, 22 bp, Homo sapiens
cattctgtttcctcttgatctc

SEQ ID NO: 6715931 - DNA, 14 bp, Homo sapiens
cattcttaaaggaa

SEQ ID NO: 6715932 - DNA, 21 bp, Homo sapiens
cattcttaagatttctcctga

SEQ ID NO: 6715933 - DNA, 21 bp, Homo sapiens
cattcttaatttatgtaaggt

SEQ ID NO: 6715934 - DNA, 16 bp, Homo sapiens
cattcttacaaaacat

SEQ ID NO: 6715935 - DNA, 17 bp, Homo sapiens
cattcttagctcttaat

SEQ ID NO: 6715936 - DNA, 16 bp, Homo sapiens
cattcttataaatatg

SEQ ID NO: 6715937 - DNA, 22 bp, Homo sapiens
cattcttataaatatgaagctc

SEQ ID NO: 6715938 - DNA, 15 bp, Homo sapiens
cattcttataacata

SEQ ID NO: 6715939 - DNA, 13 bp, Homo sapiens
cattcttcaagat

SEQ ID NO: 6715940 - DNA, 19 bp, Homo sapiens
cattcttcactgtctgttg

SEQ ID NO: 6715941 - DNA, 14 bp, Homo sapiens
cattcttcagtgtc

SEQ ID NO: 6715942 - DNA, 22 bp, Homo sapiens
cattcttcagtgtctctgtttt

SEQ ID NO: 6715943 - DNA, 14 bp, Homo sapiens
cattcttcagttct

SEQ ID NO: 6715944 - DNA, 17 bp, Homo sapiens
cattcttcagtttttca

SEQ ID NO: 6715945 - DNA, 21 bp, Homo sapiens
cattcttcagtttttcacttc

SEQ ID NO: 6715946 - DNA, 18 bp, Homo sapiens
cattcttccatcatcact

SEQ ID NO: 6715947 - DNA, 19 bp, Homo sapiens
cattcttccatcatcactg

SEQ ID NO: 6715948 - DNA, 21 bp, Homo sapiens
cattcttcccaacttgccttt

SEQ ID NO: 6715949 - DNA, 13 bp, Homo sapiens
cattcttcctagt

SEQ ID NO: 6715950 - DNA, 19 bp, Homo sapiens
cattcttcggtctgaattt

SEQ ID NO: 6715951 - DNA, 20 bp, Homo sapiens
cattcttctctagctggtgg

SEQ ID NO: 6715952 - DNA, 21 bp, Homo sapiens
cattcttctctgttgtcgtaa

SEQ ID NO: 6715953 - DNA, 19 bp, Homo sapiens
cattcttctgatcactgaa

SEQ ID NO: 6715954 - DNA, 14 bp, Homo sapiens
cattcttgagtttt

SEQ ID NO: 6715955 - DNA, 12 bp, Homo sapiens
cattcttgctct

SEQ ID NO: 6715956 - DNA, 12 bp, Homo sapiens
cattcttgcttg

SEQ ID NO: 6715957 - DNA, 12 bp, Homo sapiens
cattcttggctt

SEQ ID NO: 6715958 - DNA, 21 bp, Homo sapiens
cattcttggttggctggcctt

SEQ ID NO: 6715959 - DNA, 21 bp, Homo sapiens
cattcttgtaaggctttgatt

SEQ ID NO: 6715960 - DNA, 18 bp, Homo sapiens
cattcttgtcacaataaa

SEQ ID NO: 6715961 - DNA, 13 bp, Homo sapiens
cattctttactgc

SEQ ID NO: 6715962 - DNA, 14 bp, Homo sapiens
cattctttactgca

SEQ ID NO: 6715963 - DNA, 17 bp, Homo sapiens
cattctttactgcactc

SEQ ID NO: 6715964 - DNA, 17 bp, Homo sapiens
cattctttataaaatgt

SEQ ID NO: 6715965 - DNA, 21 bp, Homo sapiens
cattctttataaaccataaaa

SEQ ID NO: 6715966 - DNA, 24 bp, Homo sapiens
cattctttataatcctctgtaaaa

SEQ ID NO: 6715967 - DNA, 20 bp, Homo sapiens
cattctttatagtgaagtgt

SEQ ID NO: 6715968 - DNA, 10 bp, Homo sapiens
cattctttcc

SEQ ID NO: 6715969 - DNA, 19 bp, Homo sapiens
cattctttcccctcagagc

SEQ ID NO: 6715970 - DNA, 21 bp, Homo sapiens
cattctttcccctcagagctc

SEQ ID NO: 6715971 - DNA, 15 bp, Homo sapiens
cattctttcttcctc

SEQ ID NO: 6715972 - DNA, 18 bp, Homo sapiens
cattctttcttctcttta

SEQ ID NO: 6715973 - DNA, 18 bp, Homo sapiens
cattctttgcaatactgc

SEQ ID NO: 6715974 - DNA, 19 bp, Homo sapiens
cattctttgcttgaacaca

SEQ ID NO: 6715975 - DNA, 13 bp, Homo sapiens
cattctttggtaa

SEQ ID NO: 6715976 - DNA, 17 bp, Homo sapiens
cattcttttatagagca

SEQ ID NO: 6715977 - DNA, 17 bp, Homo sapiens
cattcttttcacttcct

SEQ ID NO: 6715978 - DNA, 18 bp, Homo sapiens
cattcttttgtaatttaa

SEQ ID NO: 6715979 - DNA, 19 bp, Homo sapiens
cattcttttgtaatttaaa

SEQ ID NO: 6715980 - DNA, 13 bp, Homo sapiens
cattctttttgaa

SEQ ID NO: 6715981 - DNA, 16 bp, Homo sapiens
cattctttttgaaatg

SEQ ID NO: 6715982 - DNA, 18 bp, Homo sapiens
cattctttttttcttggc

SEQ ID NO: 6715983 - DNA, 14 bp, Homo sapiens
cattgaaaaaggaa

SEQ ID NO: 6715984 - DNA, 16 bp, Homo sapiens
cattgaaaaaggaaaa

SEQ ID NO: 6715985 - DNA, 18 bp, Homo sapiens
cattgaaaatgtaagtaa

SEQ ID NO: 6715986 - DNA, 15 bp, Homo sapiens
cattgaaacatttat

SEQ ID NO: 6715987 - DNA, 16 bp, Homo sapiens
cattgaaactgtattt

SEQ ID NO: 6715988 - DNA, 19 bp, Homo sapiens
cattgaaacttgagtttgt

SEQ ID NO: 6715989 - DNA, 21 bp, Homo sapiens
cattgaaacttgagtttgttt

SEQ ID NO: 6715990 - DNA, 22 bp, Homo sapiens
cattgaaacttgagtttgtttc

SEQ ID NO: 6715991 - DNA, 11 bp, Homo sapiens
cattgaaagag

SEQ ID NO: 6715992 - DNA, 14 bp, Homo sapiens
cattgaaataataa

SEQ ID NO: 6715993 - DNA, 11 bp, Homo sapiens
cattgaaatgt

SEQ ID NO: 6715994 - DNA, 13 bp, Homo sapiens
cattgaaatgtaa

SEQ ID NO: 6715995 - DNA, 13 bp, Homo sapiens
cattgaaatgtca

SEQ ID NO: 6715996 - DNA, 18 bp, Homo sapiens
cattgaaattctgagaaa

SEQ ID NO: 6715997 - DNA, 22 bp, Homo sapiens
cattgaacacaaactgtaaata

SEQ ID NO: 6715998 - DNA, 18 bp, Homo sapiens
cattgaacactgcaccct

SEQ ID NO: 6715999 - DNA, 14 bp, Homo sapiens
cattgaacagcaaa

SEQ ID NO: 6716000 - DNA, 15 bp, Homo sapiens
cattgaacagcaaag

SEQ ID NO: 6716001 - DNA, 13 bp, Homo sapiens
cattgaacagctg

SEQ ID NO: 6716002 - DNA, 17 bp, Homo sapiens
cattgaacagctgtgag

SEQ ID NO: 6716003 - DNA, 21 bp, Homo sapiens
cattgaacatttcttatgatt

SEQ ID NO: 6716004 - DNA, 23 bp, Homo sapiens
cattgaagaagaaccagcccagc

SEQ ID NO: 6716005 - DNA, 20 bp, Homo sapiens
cattgaagagaactgcaact

SEQ ID NO: 6716006 - DNA, 14 bp, Homo sapiens
cattgaagagagag

SEQ ID NO: 6716007 - DNA, 18 bp, Homo sapiens
cattgaagccgactctgg

SEQ ID NO: 6716008 - DNA, 20 bp, Homo sapiens
cattgaagtatggtgtgttc

SEQ ID NO: 6716009 - DNA, 21 bp, Homo sapiens
cattgaagtatggtgtgttca

SEQ ID NO: 6716010 - DNA, 19 bp, Homo sapiens
cattgaagtgtttgctgca

SEQ ID NO: 6716011 - DNA, 21 bp, Homo sapiens
cattgaatagtggaacatttt

SEQ ID NO: 6716012 - DNA, 22 bp, Homo sapiens
cattgacaccagaaagccctct

SEQ ID NO: 6716013 - DNA, 13 bp, Homo sapiens
cattgacagcaat

SEQ ID NO: 6716014 - DNA, 15 bp, Homo sapiens
cattgacagcaattc

SEQ ID NO: 6716015 - DNA, 11 bp, Homo sapiens
cattgacatag

SEQ ID NO: 6716016 - DNA, 21 bp, Homo sapiens
cattgacataggtcataaagc

SEQ ID NO: 6716017 - DNA, 14 bp, Homo sapiens
cattgacatgtaca

SEQ ID NO: 6716018 - DNA, 16 bp, Homo sapiens
cattgacatgtacaga

SEQ ID NO: 6716019 - DNA, 17 bp, Homo sapiens
cattgacatgtacagag

SEQ ID NO: 6716020 - DNA, 15 bp, Homo sapiens
cattgacattataga

SEQ ID NO: 6716021 - DNA, 17 bp, Homo sapiens
cattgacatttgaattt

SEQ ID NO: 6716022 - DNA, 17 bp, Homo sapiens
cattgaccaagaactgc

SEQ ID NO: 6716023 - DNA, 21 bp, Homo sapiens
cattgaccaagatgatcacat

SEQ ID NO: 6716024 - DNA, 14 bp, Homo sapiens
cattgaccagctct

SEQ ID NO: 6716025 - DNA, 22 bp, Homo sapiens
cattgaccagctctcttcctgt

SEQ ID NO: 6716026 - DNA, 17 bp, Homo sapiens
cattgacccatagcaca

SEQ ID NO: 6716027 - DNA, 16 bp, Homo sapiens
cattgaccgcaactca

SEQ ID NO: 6716028 - DNA, 21 bp, Homo sapiens
cattgacctatttccagaaat

SEQ ID NO: 6716029 - DNA, 14 bp, Homo sapiens
cattgacctcagct

SEQ ID NO: 6716030 - DNA, 15 bp, Homo sapiens
cattgacctctcagg

SEQ ID NO: 6716031 - DNA, 19 bp, Homo sapiens
cattgacctctcagggcct

SEQ ID NO: 6716032 - DNA, 13 bp, Homo sapiens
cattgacctgagg

SEQ ID NO: 6716033 - DNA, 22 bp, Homo sapiens
cattgacctgaggcccttctct

SEQ ID NO: 6716034 - DNA, 15 bp, Homo sapiens
cattgacctggaggg

SEQ ID NO: 6716035 - DNA, 22 bp, Homo sapiens
cattgacctggaggggagaggt

SEQ ID NO: 6716036 - DNA, 12 bp, Homo sapiens
cattgactaaga

SEQ ID NO: 6716037 - DNA, 22 bp, Homo sapiens
cattgactatcaaactgaagcc

SEQ ID NO: 6716038 - DNA, 23 bp, Homo sapiens
cattgactggtttacaggccctg

SEQ ID NO: 6716039 - DNA, 13 bp, Homo sapiens
cattgacttcatt

SEQ ID NO: 6716040 - DNA, 14 bp, Homo sapiens
cattgacttcattt

SEQ ID NO: 6716041 - DNA, 18 bp, Homo sapiens
cattgacttcattttata

SEQ ID NO: 6716042 - DNA, 16 bp, Homo sapiens
cattgactttccccac

SEQ ID NO: 6716043 - DNA, 18 bp, Homo sapiens
cattgagaccgtgaagat

SEQ ID NO: 6716044 - DNA, 11 bp, Homo sapiens
cattgagactt

SEQ ID NO: 6716045 - DNA, 17 bp, Homo sapiens
cattgagagtaagcacg

SEQ ID NO: 6716046 - DNA, 22 bp, Homo sapiens
cattgagattcacatgctggct

SEQ ID NO: 6716047 - DNA, 21 bp, Homo sapiens
cattgagctagcgatttcaga

SEQ ID NO: 6716048 - DNA, 21 bp, Homo sapiens
cattgagctgatataaattct

SEQ ID NO: 6716049 - DNA, 19 bp, Homo sapiens
cattgagctgcctccagcc

SEQ ID NO: 6716050 - DNA, 21 bp, Homo sapiens
cattgagctgcctccagcctg

SEQ ID NO: 6716051 - DNA, 14 bp, Homo sapiens
cattgagctgtgca

SEQ ID NO: 6716052 - DNA, 19 bp, Homo sapiens
cattgaggaaatattaatt

SEQ ID NO: 6716053 - DNA, 16 bp, Homo sapiens
cattgaggaaggaaat

SEQ ID NO: 6716054 - DNA, 15 bp, Homo sapiens
cattgaggataaatt

SEQ ID NO: 6716055 - DNA, 19 bp, Homo sapiens
cattgaggataaattgcca

SEQ ID NO: 6716056 - DNA, 21 bp, Homo sapiens
cattgaggataaattgccata

SEQ ID NO: 6716057 - DNA, 19 bp, Homo sapiens
cattgagtttaagtctctg

SEQ ID NO: 6716058 - DNA, 17 bp, Homo sapiens
cattgataagatggttt

SEQ ID NO: 6716059 - DNA, 15 bp, Homo sapiens
cattgatagaactac

SEQ ID NO: 6716060 - DNA, 18 bp, Homo sapiens
cattgatagaactacttt

SEQ ID NO: 6716061 - DNA, 19 bp, Homo sapiens
cattgatattgtgaacatt

SEQ ID NO: 6716062 - DNA, 21 bp, Homo sapiens
cattgatcacagatgtgccca

SEQ ID NO: 6716063 - DNA, 17 bp, Homo sapiens
cattgatcataaactga

SEQ ID NO: 6716064 - DNA, 22 bp, Homo sapiens
cattgatgaatgaggaacaatc

SEQ ID NO: 6716065 - DNA, 19 bp, Homo sapiens
cattgatgatcactgtgaa

SEQ ID NO: 6716066 - DNA, 20 bp, Homo sapiens
cattgatgatcactgtgaaa

SEQ ID NO: 6716067 - DNA, 12 bp, Homo sapiens
cattgatgctga

SEQ ID NO: 6716068 - DNA, 14 bp, Homo sapiens
cattgatggggaag

SEQ ID NO: 6716069 - DNA, 16 bp, Homo sapiens
cattgatggggaagga

SEQ ID NO: 6716070 - DNA, 19 bp, Homo sapiens
cattgatggggaaggaggc

SEQ ID NO: 6716071 - DNA, 21 bp, Homo sapiens
cattgatgtaatttaaaactt

SEQ ID NO: 6716072 - DNA, 15 bp, Homo sapiens
cattgattgctgtgt

SEQ ID NO: 6716073 - DNA, 16 bp, Homo sapiens
cattgattgctgtgtc

SEQ ID NO: 6716074 - DNA, 20 bp, Homo sapiens
cattgattggataaatgctt

SEQ ID NO: 6716075 - DNA, 16 bp, Homo sapiens
cattgatttgattttt

SEQ ID NO: 6716076 - DNA, 20 bp, Homo sapiens
cattgattttaaaaatacat

SEQ ID NO: 6716077 - DNA, 23 bp, Homo sapiens
cattgattttaaaaatacatttt

SEQ ID NO: 6716078 - DNA, 13 bp, Homo sapiens
cattgcaaaaggt

SEQ ID NO: 6716079 - DNA, 19 bp, Homo sapiens
cattgcaaaaggttaagcc

SEQ ID NO: 6716080 - DNA, 15 bp, Homo sapiens
cattgcaaaatagaa

SEQ ID NO: 6716081 - DNA, 22 bp, Homo sapiens
cattgcaaaatagaagaagagg

SEQ ID NO: 6716082 - DNA, 16 bp, Homo sapiens
cattgcaaacaactga

SEQ ID NO: 6716083 - DNA, 21 bp, Homo sapiens
cattgcaaacaactgaaatgt

SEQ ID NO: 6716084 - DNA, 14 bp, Homo sapiens
cattgcaacaaaat

SEQ ID NO: 6716085 - DNA, 13 bp, Homo sapiens
cattgcaatagaa

SEQ ID NO: 6716086 - DNA, 15 bp, Homo sapiens
cattgcaatagaaat

SEQ ID NO: 6716087 - DNA, 14 bp, Homo sapiens
cattgcacccagcc

SEQ ID NO: 6716088 - DNA, 14 bp, Homo sapiens
cattgcacctatct

SEQ ID NO: 6716089 - DNA, 13 bp, Homo sapiens
cattgcacctgca

SEQ ID NO: 6716090 - DNA, 12 bp, Homo sapiens
cattgcactaaa

SEQ ID NO: 6716091 - DNA, 14 bp, Homo sapiens
cattgcactaaaag

SEQ ID NO: 6716092 - DNA, 12 bp, Homo sapiens
cattgcactcca

SEQ ID NO: 6716093 - DNA, 17 bp, Homo sapiens
cattgcactccagcctg

SEQ ID NO: 6716094 - DNA, 21 bp, Homo sapiens
cattgcactccagcctgggca

SEQ ID NO: 6716095 - DNA, 15 bp, Homo sapiens
cattgcactgcagtt

SEQ ID NO: 6716096 - DNA, 16 bp, Homo sapiens
cattgcactgcagtta

SEQ ID NO: 6716097 - DNA, 23 bp, Homo sapiens
cattgcacttcggataattttca

SEQ ID NO: 6716098 - DNA, 11 bp, Homo sapiens
cattgcacttt

SEQ ID NO: 6716099 - DNA, 12 bp, Homo sapiens
cattgcactttc

SEQ ID NO: 6716100 - DNA, 23 bp, Homo sapiens
cattgcagaacatgagtgctgat

SEQ ID NO: 6716101 - DNA, 16 bp, Homo sapiens
cattgcagaataatgt

SEQ ID NO: 6716102 - DNA, 13 bp, Homo sapiens
cattgcagaccct

SEQ ID NO: 6716103 - DNA, 16 bp, Homo sapiens
cattgcagcctaagaa

SEQ ID NO: 6716104 - DNA, 17 bp, Homo sapiens
cattgcagcctaagaag

SEQ ID NO: 6716105 - DNA, 18 bp, Homo sapiens
cattgcagcctaagaaga

SEQ ID NO: 6716106 - DNA, 23 bp, Homo sapiens
cattgcagcctaagaagaaggcc

SEQ ID NO: 6716107 - DNA, 24 bp, Homo sapiens
cattgcagccttgcgctgtcccag

SEQ ID NO: 6716108 - DNA, 21 bp, Homo sapiens
cattgcaggccagtggacaga

SEQ ID NO: 6716109 - DNA, 18 bp, Homo sapiens
cattgcagtatcagaggg

SEQ ID NO: 6716110 - DNA, 18 bp, Homo sapiens
cattgcagtcactttgac

SEQ ID NO: 6716111 - DNA, 18 bp, Homo sapiens
cattgcagttagccccag

SEQ ID NO: 6716112 - DNA, 18 bp, Homo sapiens
cattgcatgtattgtaaa

SEQ ID NO: 6716113 - DNA, 17 bp, Homo sapiens
cattgcattcaaaatct

SEQ ID NO: 6716114 - DNA, 16 bp, Homo sapiens
cattgcattctattgc

SEQ ID NO: 6716115 - DNA, 10 bp, Homo sapiens
cattgcattt

SEQ ID NO: 6716116 - DNA, 15 bp, Homo sapiens
cattgccaagtcaga

SEQ ID NO: 6716117 - DNA, 14 bp, Homo sapiens
cattgccaccagga

SEQ ID NO: 6716118 - DNA, 16 bp, Homo sapiens
cattgccaccaggaga

SEQ ID NO: 6716119 - DNA, 17 bp, Homo sapiens
cattgccaccaggagaa

SEQ ID NO: 6716120 - DNA, 13 bp, Homo sapiens
cattgccagtggt

SEQ ID NO: 6716121 - DNA, 15 bp, Homo sapiens
cattgccagtgtctt

SEQ ID NO: 6716122 - DNA, 18 bp, Homo sapiens
cattgccattccctgcct

SEQ ID NO: 6716123 - DNA, 19 bp, Homo sapiens
cattgccattccctgcctg

SEQ ID NO: 6716124 - DNA, 16 bp, Homo sapiens
cattgcccacacctgc

SEQ ID NO: 6716125 - DNA, 15 bp, Homo sapiens
cattgcccacttctg

SEQ ID NO: 6716126 - DNA, 23 bp, Homo sapiens
cattgcccacttctgtgtagaca

SEQ ID NO: 6716127 - DNA, 19 bp, Homo sapiens
cattgcccagtgagccctg

SEQ ID NO: 6716128 - DNA, 22 bp, Homo sapiens
cattgccccaaatggattcctg

SEQ ID NO: 6716129 - DNA, 14 bp, Homo sapiens
cattgccccaagat

SEQ ID NO: 6716130 - DNA, 14 bp, Homo sapiens
cattgcccccacct

SEQ ID NO: 6716131 - DNA, 16 bp, Homo sapiens
cattgcccccacctct

SEQ ID NO: 6716132 - DNA, 19 bp, Homo sapiens
cattgcccccacctctggt

SEQ ID NO: 6716133 - DNA, 17 bp, Homo sapiens
cattgcccccagggcac

SEQ ID NO: 6716134 - DNA, 21 bp, Homo sapiens
cattgcccctccgatgctgag

SEQ ID NO: 6716135 - DNA, 24 bp, Homo sapiens
cattgcccctccgatgctgaggcc

SEQ ID NO: 6716136 - DNA, 16 bp, Homo sapiens
cattgcccctctgcct

SEQ ID NO: 6716137 - DNA, 19 bp, Homo sapiens
cattgcccctctgccttgc

SEQ ID NO: 6716138 - DNA, 16 bp, Homo sapiens
cattgccctgaggggc

SEQ ID NO: 6716139 - DNA, 21 bp, Homo sapiens
cattgccctgaggggcctgcc

SEQ ID NO: 6716140 - DNA, 21 bp, Homo sapiens
cattgccgtggcatcttaaaa

SEQ ID NO: 6716141 - DNA, 13 bp, Homo sapiens
cattgcctccacc

SEQ ID NO: 6716142 - DNA, 13 bp, Homo sapiens
cattgcctcctgt

SEQ ID NO: 6716143 - DNA, 22 bp, Homo sapiens
cattgcctcctgttctgcccac

SEQ ID NO: 6716144 - DNA, 21 bp, Homo sapiens
cattgcctgactaaaatgttt

SEQ ID NO: 6716145 - DNA, 21 bp, Homo sapiens
cattgcctgatttgttccttc

SEQ ID NO: 6716146 - DNA, 13 bp, Homo sapiens
cattgcctggact

SEQ ID NO: 6716147 - DNA, 14 bp, Homo sapiens
cattgcctggactg

SEQ ID NO: 6716148 - DNA, 16 bp, Homo sapiens
cattgcctggactgac

SEQ ID NO: 6716149 - DNA, 18 bp, Homo sapiens
cattgcctggactgacca

SEQ ID NO: 6716150 - DNA, 11 bp, Homo sapiens
cattgcctggc

SEQ ID NO: 6716151 - DNA, 12 bp, Homo sapiens
cattgcctgtga

SEQ ID NO: 6716152 - DNA, 14 bp, Homo sapiens
cattgcctgttctg

SEQ ID NO: 6716153 - DNA, 17 bp, Homo sapiens
cattgcctgttctgctt

SEQ ID NO: 6716154 - DNA, 18 bp, Homo sapiens
cattgccttcgctccatg

SEQ ID NO: 6716155 - DNA, 12 bp, Homo sapiens
cattgccttctg

SEQ ID NO: 6716156 - DNA, 17 bp, Homo sapiens
cattgccttctggagct

SEQ ID NO: 6716157 - DNA, 22 bp, Homo sapiens
cattgccttctggggagggaca

SEQ ID NO: 6716158 - DNA, 14 bp, Homo sapiens
cattgccttgcatt

SEQ ID NO: 6716159 - DNA, 16 bp, Homo sapiens
cattgcctttccaggg

SEQ ID NO: 6716160 - DNA, 13 bp, Homo sapiens
cattgccttttct

SEQ ID NO: 6716161 - DNA, 19 bp, Homo sapiens
cattgcggccccaggaggg

SEQ ID NO: 6716162 - DNA, 23 bp, Homo sapiens
cattgcgtttgaccttttatgta

SEQ ID NO: 6716163 - DNA, 14 bp, Homo sapiens
cattgctaaaaaat

SEQ ID NO: 6716164 - DNA, 16 bp, Homo sapiens
cattgctaagatgctc

SEQ ID NO: 6716165 - DNA, 20 bp, Homo sapiens
cattgctacacttacaagta

SEQ ID NO: 6716166 - DNA, 16 bp, Homo sapiens
cattgctaccaagttt

SEQ ID NO: 6716167 - DNA, 13 bp, Homo sapiens
cattgctacctca

SEQ ID NO: 6716168 - DNA, 17 bp, Homo sapiens
cattgctagataaaagc

SEQ ID NO: 6716169 - DNA, 18 bp, Homo sapiens
cattgctagcgagccgcc

SEQ ID NO: 6716170 - DNA, 17 bp, Homo sapiens
cattgctcaagaggaaa

SEQ ID NO: 6716171 - DNA, 13 bp, Homo sapiens
cattgctcagccc

SEQ ID NO: 6716172 - DNA, 14 bp, Homo sapiens
cattgctcagcccg

SEQ ID NO: 6716173 - DNA, 21 bp, Homo sapiens
cattgctcagcccgcttggcc

SEQ ID NO: 6716174 - DNA, 20 bp, Homo sapiens
cattgctcccctgatagaag

SEQ ID NO: 6716175 - DNA, 20 bp, Homo sapiens
cattgctctatgtctgcctt

SEQ ID NO: 6716176 - DNA, 13 bp, Homo sapiens
cattgctctctgg

SEQ ID NO: 6716177 - DNA, 14 bp, Homo sapiens
cattgctctctggg

SEQ ID NO: 6716178 - DNA, 18 bp, Homo sapiens
cattgctgacagagccct

SEQ ID NO: 6716179 - DNA, 21 bp, Homo sapiens
cattgctgagcctctgctccc

SEQ ID NO: 6716180 - DNA, 18 bp, Homo sapiens
cattgctgattttgtctg

SEQ ID NO: 6716181 - DNA, 13 bp, Homo sapiens
cattgctgcaaat

SEQ ID NO: 6716182 - DNA, 23 bp, Homo sapiens
cattgctgccaaggtggagggaa

SEQ ID NO: 6716183 - DNA, 21 bp, Homo sapiens
cattgctgcctttgtccccac

SEQ ID NO: 6716184 - DNA, 22 bp, Homo sapiens
cattgctgctccttagctgcca

SEQ ID NO: 6716185 - DNA, 13 bp, Homo sapiens
cattgctgctgct

SEQ ID NO: 6716186 - DNA, 19 bp, Homo sapiens
cattgctggcaatgagtgt

SEQ ID NO: 6716187 - DNA, 17 bp, Homo sapiens
cattgctggtagagacc

SEQ ID NO: 6716188 - DNA, 22 bp, Homo sapiens
cattgctggtagagacccccag

SEQ ID NO: 6716189 - DNA, 17 bp, Homo sapiens
cattgctggtcttgtaa

SEQ ID NO: 6716190 - DNA, 20 bp, Homo sapiens
cattgctggtcttgtaagag

SEQ ID NO: 6716191 - DNA, 16 bp, Homo sapiens
cattgctgtctgcagc

SEQ ID NO: 6716192 - DNA, 14 bp, Homo sapiens
cattgctgtcttgc

SEQ ID NO: 6716193 - DNA, 18 bp, Homo sapiens
cattgctgtcttgcccca

SEQ ID NO: 6716194 - DNA, 19 bp, Homo sapiens
cattgctgtcttgccccag

SEQ ID NO: 6716195 - DNA, 20 bp, Homo sapiens
cattgctgtcttgccccagt

SEQ ID NO: 6716196 - DNA, 14 bp, Homo sapiens
cattgctgtgaaca

SEQ ID NO: 6716197 - DNA, 13 bp, Homo sapiens
cattgctgtgtca

SEQ ID NO: 6716198 - DNA, 23 bp, Homo sapiens
cattgctgtgtgaatccaggagg

SEQ ID NO: 6716199 - DNA, 18 bp, Homo sapiens
cattgctgttagagaaat

SEQ ID NO: 6716200 - DNA, 17 bp, Homo sapiens
cattgctgttctacttt

SEQ ID NO: 6716201 - DNA, 22 bp, Homo sapiens
cattgctgttgtccaactattt

SEQ ID NO: 6716202 - DNA, 21 bp, Homo sapiens
cattgctgttgtccctctgct

SEQ ID NO: 6716203 - DNA, 21 bp, Homo sapiens
cattgctgttttaatttgtat

SEQ ID NO: 6716204 - DNA, 18 bp, Homo sapiens
cattgcttattcttgagc

SEQ ID NO: 6716205 - DNA, 15 bp, Homo sapiens
cattgcttcacaacc

SEQ ID NO: 6716206 - DNA, 15 bp, Homo sapiens
cattgcttcactacc

SEQ ID NO: 6716207 - DNA, 16 bp, Homo sapiens
cattgcttcattaaaa

SEQ ID NO: 6716208 - DNA, 19 bp, Homo sapiens
cattgcttcattaaaacaa

SEQ ID NO: 6716209 - DNA, 16 bp, Homo sapiens
cattgcttcttctgag

SEQ ID NO: 6716210 - DNA, 22 bp, Homo sapiens
cattgcttgtgccacaccctcc

SEQ ID NO: 6716211 - DNA, 17 bp, Homo sapiens
cattgctttagacaaat

SEQ ID NO: 6716212 - DNA, 15 bp, Homo sapiens
cattgctttctgaaa

SEQ ID NO: 6716213 - DNA, 23 bp, Homo sapiens
cattgctttgaagcagttgtgtc

SEQ ID NO: 6716214 - DNA, 21 bp, Homo sapiens
cattgcttttaaaactactta

SEQ ID NO: 6716215 - DNA, 21 bp, Homo sapiens
cattgcttttattttgaaaag

SEQ ID NO: 6716216 - DNA, 11 bp, Homo sapiens
cattgcttttg

SEQ ID NO: 6716217 - DNA, 21 bp, Homo sapiens
cattgcttttggacaaggaag

SEQ ID NO: 6716218 - DNA, 18 bp, Homo sapiens
cattggaaatttagcatt

SEQ ID NO: 6716219 - DNA, 19 bp, Homo sapiens
cattggaaatttagcattg

SEQ ID NO: 6716220 - DNA, 15 bp, Homo sapiens
cattggaactggagg

SEQ ID NO: 6716221 - DNA, 17 bp, Homo sapiens
cattggaagaccccacc

SEQ ID NO: 6716222 - DNA, 19 bp, Homo sapiens
cattggaagagcagcacct

SEQ ID NO: 6716223 - DNA, 15 bp, Homo sapiens
cattggaagagcccg

SEQ ID NO: 6716224 - DNA, 15 bp, Homo sapiens
cattggaagctccca

SEQ ID NO: 6716225 - DNA, 22 bp, Homo sapiens
cattggaataaggcatggctca

SEQ ID NO: 6716226 - DNA, 16 bp, Homo sapiens
cattggaatgttctca

SEQ ID NO: 6716227 - DNA, 11 bp, Homo sapiens
cattggacaga

SEQ ID NO: 6716228 - DNA, 14 bp, Homo sapiens
cattggacagaaaa

SEQ ID NO: 6716229 - DNA, 17 bp, Homo sapiens
cattggacagaaaatgc

SEQ ID NO: 6716230 - DNA, 20 bp, Homo sapiens
cattggacagaaaatgcaat

SEQ ID NO: 6716231 - DNA, 17 bp, Homo sapiens
cattggacagtctccct

SEQ ID NO: 6716232 - DNA, 22 bp, Homo sapiens
cattggacagtctccctgatgg

SEQ ID NO: 6716233 - DNA, 23 bp, Homo sapiens
cattggacagtctccctgatgga

SEQ ID NO: 6716234 - DNA, 14 bp, Homo sapiens
cattggagagctgt

SEQ ID NO: 6716235 - DNA, 15 bp, Homo sapiens
cattggagagctgtc

SEQ ID NO: 6716236 - DNA, 23 bp, Homo sapiens
cattggagagctgtcttcctgtg

SEQ ID NO: 6716237 - DNA, 16 bp, Homo sapiens
cattggagcacctggg

SEQ ID NO: 6716238 - DNA, 19 bp, Homo sapiens
cattggagcacctgggccc

SEQ ID NO: 6716239 - DNA, 17 bp, Homo sapiens
cattggagtttcaaatc

SEQ ID NO: 6716240 - DNA, 14 bp, Homo sapiens
cattggatacagca

SEQ ID NO: 6716241 - DNA, 11 bp, Homo sapiens
cattggatatt

SEQ ID NO: 6716242 - DNA, 18 bp, Homo sapiens
cattggatattttttact

SEQ ID NO: 6716243 - DNA, 16 bp, Homo sapiens
cattggatcttttact

SEQ ID NO: 6716244 - DNA, 12 bp, Homo sapiens
cattggatgcag

SEQ ID NO: 6716245 - DNA, 22 bp, Homo sapiens
cattggatgtggagctcctgct

SEQ ID NO: 6716246 - DNA, 20 bp, Homo sapiens
cattggatttttgttaattt

SEQ ID NO: 6716247 - DNA, 22 bp, Homo sapiens
cattggatttttgttaattttc

SEQ ID NO: 6716248 - DNA, 15 bp, Homo sapiens
cattggcacaatgta

SEQ ID NO: 6716249 - DNA, 21 bp, Homo sapiens
cattggcagcaggtgctgcta

SEQ ID NO: 6716250 - DNA, 18 bp, Homo sapiens
cattggccctcattccaa

SEQ ID NO: 6716251 - DNA, 21 bp, Homo sapiens
cattggccctcattccaagca

SEQ ID NO: 6716252 - DNA, 13 bp, Homo sapiens
cattggccgagct

SEQ ID NO: 6716253 - DNA, 17 bp, Homo sapiens
cattggccgagctcctg

SEQ ID NO: 6716254 - DNA, 21 bp, Homo sapiens
cattggccgagctcctgggga

SEQ ID NO: 6716255 - DNA, 15 bp, Homo sapiens
cattggcctctgtac

SEQ ID NO: 6716256 - DNA, 11 bp, Homo sapiens
cattggcctgg

SEQ ID NO: 6716257 - DNA, 19 bp, Homo sapiens
cattggcctggccagacca

SEQ ID NO: 6716258 - DNA, 16 bp, Homo sapiens
cattggcctggcctcc

SEQ ID NO: 6716259 - DNA, 22 bp, Homo sapiens
cattggctatataaaatgtggc

SEQ ID NO: 6716260 - DNA, 14 bp, Homo sapiens
cattggctatttaa

SEQ ID NO: 6716261 - DNA, 11 bp, Homo sapiens
cattggctcct

SEQ ID NO: 6716262 - DNA, 11 bp, Homo sapiens
cattggcttcc

SEQ ID NO: 6716263 - DNA, 13 bp, Homo sapiens
cattggctttatc

SEQ ID NO: 6716264 - DNA, 22 bp, Homo sapiens
cattggctttatcctctttaga

SEQ ID NO: 6716265 - DNA, 11 bp, Homo sapiens
cattggctttc

SEQ ID NO: 6716266 - DNA, 23 bp, Homo sapiens
cattgggaccctccagtgctgga

SEQ ID NO: 6716267 - DNA, 18 bp, Homo sapiens
cattgggaggggcttctg

SEQ ID NO: 6716268 - DNA, 21 bp, Homo sapiens
cattgggaggggcttctgaat

SEQ ID NO: 6716269 - DNA, 17 bp, Homo sapiens
cattgggcacagtccag

SEQ ID NO: 6716270 - DNA, 19 bp, Homo sapiens
cattgggcacagtccagac

SEQ ID NO: 6716271 - DNA, 17 bp, Homo sapiens
cattgggccatgtttaa

SEQ ID NO: 6716272 - DNA, 22 bp, Homo sapiens
cattgggctgacacctaccatg

SEQ ID NO: 6716273 - DNA, 18 bp, Homo sapiens
cattggggctcccagcca

SEQ ID NO: 6716274 - DNA, 23 bp, Homo sapiens
cattggggtagttgtgtttcaac

SEQ ID NO: 6716275 - DNA, 21 bp, Homo sapiens
cattggggttccgcactttcc

SEQ ID NO: 6716276 - DNA, 16 bp, Homo sapiens
cattggggttgcaaca

SEQ ID NO: 6716277 - DNA, 18 bp, Homo sapiens
cattggggttgcaacaat

SEQ ID NO: 6716278 - DNA, 20 bp, Homo sapiens
cattgggtcctgggtctttc

SEQ ID NO: 6716279 - DNA, 20 bp, Homo sapiens
cattgggtggggctcctggg

SEQ ID NO: 6716280 - DNA, 17 bp, Homo sapiens
cattggtctgcatgtct

SEQ ID NO: 6716281 - DNA, 14 bp, Homo sapiens
cattggtggcttgg

SEQ ID NO: 6716282 - DNA, 14 bp, Homo sapiens
cattggttaatttt

SEQ ID NO: 6716283 - DNA, 17 bp, Homo sapiens
cattggttccctttgct

SEQ ID NO: 6716284 - DNA, 18 bp, Homo sapiens
cattggttccctttgctc

SEQ ID NO: 6716285 - DNA, 15 bp, Homo sapiens
cattggttcttcctt

SEQ ID NO: 6716286 - DNA, 17 bp, Homo sapiens
cattggttggaagctac

SEQ ID NO: 6716287 - DNA, 16 bp, Homo sapiens
cattggttttccatga

SEQ ID NO: 6716288 - DNA, 15 bp, Homo sapiens
cattgtaaaagcatt

SEQ ID NO: 6716289 - DNA, 23 bp, Homo sapiens
cattgtaaaagcattttgtaata

SEQ ID NO: 6716290 - DNA, 16 bp, Homo sapiens
cattgtaaaataaagt

SEQ ID NO: 6716291 - DNA, 13 bp, Homo sapiens
cattgtaaacaaa

SEQ ID NO: 6716292 - DNA, 18 bp, Homo sapiens
cattgtaaacaaactctt

SEQ ID NO: 6716293 - DNA, 10 bp, Homo sapiens
cattgtaaag

SEQ ID NO: 6716294 - DNA, 22 bp, Homo sapiens
cattgtaaataaattttgtgca

SEQ ID NO: 6716295 - DNA, 19 bp, Homo sapiens
cattgtaaatagtatttga

SEQ ID NO: 6716296 - DNA, 21 bp, Homo sapiens
cattgtaaatatttactcttt

SEQ ID NO: 6716297 - DNA, 15 bp, Homo sapiens
cattgtaaatcactt

SEQ ID NO: 6716298 - DNA, 20 bp, Homo sapiens
cattgtaaatctgaagaaag

SEQ ID NO: 6716299 - DNA, 23 bp, Homo sapiens
cattgtaaatgaacataatgaac

SEQ ID NO: 6716300 - DNA, 21 bp, Homo sapiens
cattgtaaatgtgcttttaaa

SEQ ID NO: 6716301 - DNA, 19 bp, Homo sapiens
cattgtaaattatttcata

SEQ ID NO: 6716302 - DNA, 20 bp, Homo sapiens
cattgtaaccatttctcact

SEQ ID NO: 6716303 - DNA, 13 bp, Homo sapiens
cattgtaactatt

SEQ ID NO: 6716304 - DNA, 17 bp, Homo sapiens
cattgtaactattaacc

SEQ ID NO: 6716305 - DNA, 20 bp, Homo sapiens
cattgtaactattaaccttt

SEQ ID NO: 6716306 - DNA, 13 bp, Homo sapiens
cattgtaatgttg

SEQ ID NO: 6716307 - DNA, 23 bp, Homo sapiens
cattgtaatgttgtgaataatta

SEQ ID NO: 6716308 - DNA, 15 bp, Homo sapiens
cattgtaattatgta

SEQ ID NO: 6716309 - DNA, 22 bp, Homo sapiens
cattgtaattatgtaaataact

SEQ ID NO: 6716310 - DNA, 23 bp, Homo sapiens
cattgtaattatgtaaataactc

SEQ ID NO: 6716311 - DNA, 14 bp, Homo sapiens
cattgtaatttgaa

SEQ ID NO: 6716312 - DNA, 14 bp, Homo sapiens
cattgtacagtttg

SEQ ID NO: 6716313 - DNA, 22 bp, Homo sapiens
cattgtacagtttgtttacaca

SEQ ID NO: 6716314 - DNA, 16 bp, Homo sapiens
cattgtactacctgtg

SEQ ID NO: 6716315 - DNA, 17 bp, Homo sapiens
cattgtactccagcctg

SEQ ID NO: 6716316 - DNA, 19 bp, Homo sapiens
cattgtactccagcctggg

SEQ ID NO: 6716317 - DNA, 21 bp, Homo sapiens
cattgtactgttgctttaata

SEQ ID NO: 6716318 - DNA, 19 bp, Homo sapiens
cattgtacttaaacctcct

SEQ ID NO: 6716319 - DNA, 18 bp, Homo sapiens
cattgtagcgtctttctt

SEQ ID NO: 6716320 - DNA, 24 bp, Homo sapiens
cattgtagtgctttgagagagaaa

SEQ ID NO: 6716321 - DNA, 15 bp, Homo sapiens
cattgtataaaaata

SEQ ID NO: 6716322 - DNA, 14 bp, Homo sapiens
cattgtataagccc

SEQ ID NO: 6716323 - DNA, 19 bp, Homo sapiens
cattgtataggccatctgt

SEQ ID NO: 6716324 - DNA, 20 bp, Homo sapiens
cattgtataggccatctgta

SEQ ID NO: 6716325 - DNA, 17 bp, Homo sapiens
cattgtatatatgtgtg

SEQ ID NO: 6716326 - DNA, 14 bp, Homo sapiens
cattgtatatgtga

SEQ ID NO: 6716327 - DNA, 16 bp, Homo sapiens
cattgtatcgatgtta

SEQ ID NO: 6716328 - DNA, 22 bp, Homo sapiens
cattgtatcgatgttatgtaaa

SEQ ID NO: 6716329 - DNA, 16 bp, Homo sapiens
cattgtatctgtcttt

SEQ ID NO: 6716330 - DNA, 17 bp, Homo sapiens
cattgtatctgtctttc

SEQ ID NO: 6716331 - DNA, 15 bp, Homo sapiens
cattgtatgcaggga

SEQ ID NO: 6716332 - DNA, 17 bp, Homo sapiens
cattgtatgtatctatt

SEQ ID NO: 6716333 - DNA, 11 bp, Homo sapiens
cattgtatgtt

SEQ ID NO: 6716334 - DNA, 13 bp, Homo sapiens
cattgtatttaaa

SEQ ID NO: 6716335 - DNA, 19 bp, Homo sapiens
cattgtattttactttgtg

SEQ ID NO: 6716336 - DNA, 16 bp, Homo sapiens
cattgtcaaaattaat

SEQ ID NO: 6716337 - DNA, 21 bp, Homo sapiens
cattgtcaaaattaatatgat

SEQ ID NO: 6716338 - DNA, 15 bp, Homo sapiens
cattgtcagccttgc

SEQ ID NO: 6716339 - DNA, 21 bp, Homo sapiens
cattgtccaatcctatgtttt

SEQ ID NO: 6716340 - DNA, 19 bp, Homo sapiens
cattgtccatgcctacaga

SEQ ID NO: 6716341 - DNA, 21 bp, Homo sapiens
cattgtccctctgccccatcc

SEQ ID NO: 6716342 - DNA, 20 bp, Homo sapiens
cattgtccctctttggaaca

SEQ ID NO: 6716343 - DNA, 14 bp, Homo sapiens
cattgtcctccttt

SEQ ID NO: 6716344 - DNA, 13 bp, Homo sapiens
cattgtcctcttt

SEQ ID NO: 6716345 - DNA, 18 bp, Homo sapiens
cattgtcgtttcattcat

SEQ ID NO: 6716346 - DNA, 20 bp, Homo sapiens
cattgtcgtttcattcattt

SEQ ID NO: 6716347 - DNA, 15 bp, Homo sapiens
cattgtctcagtgaa

SEQ ID NO: 6716348 - DNA, 16 bp, Homo sapiens
cattgtctcattgcca

SEQ ID NO: 6716349 - DNA, 17 bp, Homo sapiens
cattgtctccttccaca

SEQ ID NO: 6716350 - DNA, 22 bp, Homo sapiens
cattgtctcttcatgtctattc

SEQ ID NO: 6716351 - DNA, 17 bp, Homo sapiens
cattgtcttccaacccc

SEQ ID NO: 6716352 - DNA, 22 bp, Homo sapiens
cattgtcttccaaccccagctg

SEQ ID NO: 6716353 - DNA, 21 bp, Homo sapiens
cattgtcttgttatgtacaaa

SEQ ID NO: 6716354 - DNA, 13 bp, Homo sapiens
cattgtcttgttc

SEQ ID NO: 6716355 - DNA, 16 bp, Homo sapiens
cattgtcttgttctgt

SEQ ID NO: 6716356 - DNA, 18 bp, Homo sapiens
cattgtcttgttctgtcc

SEQ ID NO: 6716357 - DNA, 19 bp, Homo sapiens
cattgtcttgttctgtccc

SEQ ID NO: 6716358 - DNA, 21 bp, Homo sapiens
cattgtcttgttctgtccctt

SEQ ID NO: 6716359 - DNA, 22 bp, Homo sapiens
cattgtcttgttctgtcccttc

SEQ ID NO: 6716360 - DNA, 11 bp, Homo sapiens
cattgtcttta

SEQ ID NO: 6716361 - DNA, 17 bp, Homo sapiens
cattgtctttatatgaa

SEQ ID NO: 6716362 - DNA, 22 bp, Homo sapiens
cattgtctttcctcccttcttt

SEQ ID NO: 6716363 - DNA, 14 bp, Homo sapiens
cattgtctttttag

SEQ ID NO: 6716364 - DNA, 15 bp, Homo sapiens
cattgtgaaccaatg

SEQ ID NO: 6716365 - DNA, 17 bp, Homo sapiens
cattgtgaattgcctgc

SEQ ID NO: 6716366 - DNA, 21 bp, Homo sapiens
cattgtgaattgcctgccatg

SEQ ID NO: 6716367 - DNA, 24 bp, Homo sapiens
cattgtgaattgcctgccatggct

SEQ ID NO: 6716368 - DNA, 13 bp, Homo sapiens
cattgtgacttgg

SEQ ID NO: 6716369 - DNA, 16 bp, Homo sapiens
cattgtgattggcctg

SEQ ID NO: 6716370 - DNA, 23 bp, Homo sapiens
cattgtgatttgttcctgcccca

SEQ ID NO: 6716371 - DNA, 16 bp, Homo sapiens
cattgtgcattctaga

SEQ ID NO: 6716372 - DNA, 17 bp, Homo sapiens
cattgtgccaagccttc

SEQ ID NO: 6716373 - DNA, 22 bp, Homo sapiens
cattgtgccctgtagctcctta

SEQ ID NO: 6716374 - DNA, 15 bp, Homo sapiens
cattgtggaagacag

SEQ ID NO: 6716375 - DNA, 21 bp, Homo sapiens
cattgtggccagtttagagtt

SEQ ID NO: 6716376 - DNA, 21 bp, Homo sapiens
cattgtggtgtgagcttcaga

SEQ ID NO: 6716377 - DNA, 23 bp, Homo sapiens
cattgtggttatttttatacagt

SEQ ID NO: 6716378 - DNA, 12 bp, Homo sapiens
cattgtgtatga

SEQ ID NO: 6716379 - DNA, 18 bp, Homo sapiens
cattgtgtcctgcttata

SEQ ID NO: 6716380 - DNA, 19 bp, Homo sapiens
cattgtgtgagcttctaca

SEQ ID NO: 6716381 - DNA, 19 bp, Homo sapiens
cattgtgtgatccagccct

SEQ ID NO: 6716382 - DNA, 17 bp, Homo sapiens
cattgtgtggcctggtg

SEQ ID NO: 6716383 - DNA, 18 bp, Homo sapiens
cattgtgtggcctggtgg

SEQ ID NO: 6716384 - DNA, 14 bp, Homo sapiens
cattgtgttacctg

SEQ ID NO: 6716385 - DNA, 14 bp, Homo sapiens
cattgtgttcactg

SEQ ID NO: 6716386 - DNA, 15 bp, Homo sapiens
cattgtgttgacatt

SEQ ID NO: 6716387 - DNA, 16 bp, Homo sapiens
cattgtgttgacatta

SEQ ID NO: 6716388 - DNA, 10 bp, Homo sapiens
cattgtgttt

SEQ ID NO: 6716389 - DNA, 20 bp, Homo sapiens
cattgtgttttcttcgtgga

SEQ ID NO: 6716390 - DNA, 17 bp, Homo sapiens
cattgttaaaaaacaac

SEQ ID NO: 6716391 - DNA, 22 bp, Homo sapiens
cattgttaatataatttaacag

SEQ ID NO: 6716392 - DNA, 19 bp, Homo sapiens
cattgttacaggtgtacta

SEQ ID NO: 6716393 - DNA, 14 bp, Homo sapiens
cattgttagcacta

SEQ ID NO: 6716394 - DNA, 15 bp, Homo sapiens
cattgttatttatac

SEQ ID NO: 6716395 - DNA, 16 bp, Homo sapiens
cattgttatttataca

SEQ ID NO: 6716396 - DNA, 16 bp, Homo sapiens
cattgttatttctgta

SEQ ID NO: 6716397 - DNA, 14 bp, Homo sapiens
cattgttattttca

SEQ ID NO: 6716398 - DNA, 17 bp, Homo sapiens
cattgttcaaaaggaac

SEQ ID NO: 6716399 - DNA, 15 bp, Homo sapiens
cattgttcaactccc

SEQ ID NO: 6716400 - DNA, 15 bp, Homo sapiens
cattgttcagaaaag

SEQ ID NO: 6716401 - DNA, 22 bp, Homo sapiens
cattgttcagaaaagcacctct

SEQ ID NO: 6716402 - DNA, 16 bp, Homo sapiens
cattgttcattcttgt

SEQ ID NO: 6716403 - DNA, 14 bp, Homo sapiens
cattgttcccttcc

SEQ ID NO: 6716404 - DNA, 23 bp, Homo sapiens
cattgttcccttcctcttcctgc

SEQ ID NO: 6716405 - DNA, 18 bp, Homo sapiens
cattgttggcgctgaggt

SEQ ID NO: 6716406 - DNA, 19 bp, Homo sapiens
cattgttggcgctgaggtg

SEQ ID NO: 6716407 - DNA, 18 bp, Homo sapiens
cattgttggctatttgaa

SEQ ID NO: 6716408 - DNA, 21 bp, Homo sapiens
cattgttggctatttgaaata

SEQ ID NO: 6716409 - DNA, 19 bp, Homo sapiens
cattgttggtgttaattga

SEQ ID NO: 6716410 - DNA, 13 bp, Homo sapiens
cattgttgtcaag

SEQ ID NO: 6716411 - DNA, 14 bp, Homo sapiens
cattgttgtgtata

SEQ ID NO: 6716412 - DNA, 16 bp, Homo sapiens
cattgttgtgtataat

SEQ ID NO: 6716413 - DNA, 16 bp, Homo sapiens
cattgttgtgtctgtg

SEQ ID NO: 6716414 - DNA, 21 bp, Homo sapiens
cattgttgttttaacctcccc

SEQ ID NO: 6716415 - DNA, 14 bp, Homo sapiens
cattgtttaaaaat

SEQ ID NO: 6716416 - DNA, 19 bp, Homo sapiens
cattgtttaaaaatacaca

SEQ ID NO: 6716417 - DNA, 17 bp, Homo sapiens
cattgtttattaacaaa

SEQ ID NO: 6716418 - DNA, 22 bp, Homo sapiens
cattgtttcccatcactgtatc

SEQ ID NO: 6716419 - DNA, 14 bp, Homo sapiens
cattgtttgaaaca

SEQ ID NO: 6716420 - DNA, 14 bp, Homo sapiens
cattgtttgctgct

SEQ ID NO: 6716421 - DNA, 19 bp, Homo sapiens
cattgtttgcttattgttc

SEQ ID NO: 6716422 - DNA, 15 bp, Homo sapiens
cattgtttggagaca

SEQ ID NO: 6716423 - DNA, 15 bp, Homo sapiens
cattgtttgtccttt

SEQ ID NO: 6716424 - DNA, 18 bp, Homo sapiens
cattgtttgtctgtcttc

SEQ ID NO: 6716425 - DNA, 13 bp, Homo sapiens
cattgttttaaaa

SEQ ID NO: 6716426 - DNA, 22 bp, Homo sapiens
cattgttttcaggtactgagtt

SEQ ID NO: 6716427 - DNA, 14 bp, Homo sapiens
cattgttttgaaac

SEQ ID NO: 6716428 - DNA, 16 bp, Homo sapiens
cattgttttgaatatt

SEQ ID NO: 6716429 - DNA, 18 bp, Homo sapiens
cattgttttgaatattac

SEQ ID NO: 6716430 - DNA, 22 bp, Homo sapiens
cattgttttgaatattactcct

SEQ ID NO: 6716431 - DNA, 14 bp, Homo sapiens
cattgttttgcaaa

SEQ ID NO: 6716432 - DNA, 13 bp, Homo sapiens
cattgttttgcat

SEQ ID NO: 6716433 - DNA, 14 bp, Homo sapiens
cattgttttgcatc

SEQ ID NO: 6716434 - DNA, 20 bp, Homo sapiens
cattgttttgccaacattgc

SEQ ID NO: 6716435 - DNA, 21 bp, Homo sapiens
cattgtttttcaaaggcctca

SEQ ID NO: 6716436 - DNA, 17 bp, Homo sapiens
cattgtttttctgatat

SEQ ID NO: 6716437 - DNA, 14 bp, Homo sapiens
cattgtttttgtat

SEQ ID NO: 6716438 - DNA, 21 bp, Homo sapiens
catttaaaaaaaaaatttgtt

SEQ ID NO: 6716439 - DNA, 15 bp, Homo sapiens
catttaaaaaaaaag

SEQ ID NO: 6716440 - DNA, 15 bp, Homo sapiens
catttaaaaaaaatc

SEQ ID NO: 6716441 - DNA, 15 bp, Homo sapiens
catttaaaaaacatt

SEQ ID NO: 6716442 - DNA, 22 bp, Homo sapiens
catttaaaaaggtttaaaacta

SEQ ID NO: 6716443 - DNA, 22 bp, Homo sapiens
catttaaaaataaatgtaaagt

SEQ ID NO: 6716444 - DNA, 13 bp, Homo sapiens
catttaaaacaga

SEQ ID NO: 6716445 - DNA, 13 bp, Homo sapiens
catttaaaagaca

SEQ ID NO: 6716446 - DNA, 12 bp, Homo sapiens
catttaaaagat

SEQ ID NO: 6716447 - DNA, 21 bp, Homo sapiens
catttaaaagatacagttact

SEQ ID NO: 6716448 - DNA, 21 bp, Homo sapiens
catttaaaataccactgtaat

SEQ ID NO: 6716449 - DNA, 23 bp, Homo sapiens
catttaaaatagttttctaaatg

SEQ ID NO: 6716450 - DNA, 12 bp, Homo sapiens
catttaaaatga

SEQ ID NO: 6716451 - DNA, 13 bp, Homo sapiens
catttaaaatgat

SEQ ID NO: 6716452 - DNA, 14 bp, Homo sapiens
catttaaaatgatt

SEQ ID NO: 6716453 - DNA, 16 bp, Homo sapiens
catttaaaatgattag

SEQ ID NO: 6716454 - DNA, 13 bp, Homo sapiens
catttaaaatgga

SEQ ID NO: 6716455 - DNA, 17 bp, Homo sapiens
catttaaaatggaaaat

SEQ ID NO: 6716456 - DNA, 23 bp, Homo sapiens
catttaaaatgtaaactcttcac

SEQ ID NO: 6716457 - DNA, 20 bp, Homo sapiens
catttaaaattgctatgtta

SEQ ID NO: 6716458 - DNA, 14 bp, Homo sapiens
catttaaacccaat

SEQ ID NO: 6716459 - DNA, 14 bp, Homo sapiens
catttaaactaaat

SEQ ID NO: 6716460 - DNA, 18 bp, Homo sapiens
catttaaactcatttgag

SEQ ID NO: 6716461 - DNA, 13 bp, Homo sapiens
catttaaactctg

SEQ ID NO: 6716462 - DNA, 14 bp, Homo sapiens
catttaaacttttt

SEQ ID NO: 6716463 - DNA, 15 bp, Homo sapiens
catttaaacttttta

SEQ ID NO: 6716464 - DNA, 19 bp, Homo sapiens
catttaaactttttaaaat

SEQ ID NO: 6716465 - DNA, 20 bp, Homo sapiens
catttaaactttttaaaata

SEQ ID NO: 6716466 - DNA, 21 bp, Homo sapiens
catttaaactttttaaaatac

SEQ ID NO: 6716467 - DNA, 19 bp, Homo sapiens
catttaaagacaaagacat

SEQ ID NO: 6716468 - DNA, 21 bp, Homo sapiens
catttaaagaccaataaactt

SEQ ID NO: 6716469 - DNA, 12 bp, Homo sapiens
catttaaagcat

SEQ ID NO: 6716470 - DNA, 15 bp, Homo sapiens
catttaaagcattgc

SEQ ID NO: 6716471 - DNA, 18 bp, Homo sapiens
catttaaagctaaatttt

SEQ ID NO: 6716472 - DNA, 19 bp, Homo sapiens
catttaaagcttattaaaa

SEQ ID NO: 6716473 - DNA, 22 bp, Homo sapiens
catttaaataaaactttccaaa

SEQ ID NO: 6716474 - DNA, 17 bp, Homo sapiens
catttaaatacagtctt

SEQ ID NO: 6716475 - DNA, 20 bp, Homo sapiens
catttaaatacagtcttcca

SEQ ID NO: 6716476 - DNA, 16 bp, Homo sapiens
catttaaatatctgtt

SEQ ID NO: 6716477 - DNA, 13 bp, Homo sapiens
catttaaatcctt

SEQ ID NO: 6716478 - DNA, 16 bp, Homo sapiens
catttaaatggttctg

SEQ ID NO: 6716479 - DNA, 18 bp, Homo sapiens
catttaaatggttctgtg

SEQ ID NO: 6716480 - DNA, 12 bp, Homo sapiens
catttaaattcc

SEQ ID NO: 6716481 - DNA, 15 bp, Homo sapiens
catttaaattccaca

SEQ ID NO: 6716482 - DNA, 12 bp, Homo sapiens
catttaaatttt

SEQ ID NO: 6716483 - DNA, 17 bp, Homo sapiens
catttaacactgagtga

SEQ ID NO: 6716484 - DNA, 10 bp, Homo sapiens
catttaacat

SEQ ID NO: 6716485 - DNA, 22 bp, Homo sapiens
catttaacataatggttgtgaa

SEQ ID NO: 6716486 - DNA, 20 bp, Homo sapiens
catttaacccccctgtacac

SEQ ID NO: 6716487 - DNA, 19 bp, Homo sapiens
catttaactagcactttat

SEQ ID NO: 6716488 - DNA, 16 bp, Homo sapiens
catttaactgaactgt

SEQ ID NO: 6716489 - DNA, 13 bp, Homo sapiens
catttaagaacag

SEQ ID NO: 6716490 - DNA, 15 bp, Homo sapiens
catttaagagactct

SEQ ID NO: 6716491 - DNA, 20 bp, Homo sapiens
catttaagctgtggtcaagg

SEQ ID NO: 6716492 - DNA, 13 bp, Homo sapiens
catttaaggagat

SEQ ID NO: 6716493 - DNA, 22 bp, Homo sapiens
catttaaggatggggttatgaa

SEQ ID NO: 6716494 - DNA, 15 bp, Homo sapiens
catttaagggaaaaa

SEQ ID NO: 6716495 - DNA, 18 bp, Homo sapiens
catttaagggaaaaatat

SEQ ID NO: 6716496 - DNA, 22 bp, Homo sapiens
catttaagggaaaaatatatat

SEQ ID NO: 6716497 - DNA, 20 bp, Homo sapiens
catttaagggaaagaaaatg

SEQ ID NO: 6716498 - DNA, 15 bp, Homo sapiens
catttaagtatcttg

SEQ ID NO: 6716499 - DNA, 18 bp, Homo sapiens
catttaagttgtaaacgt

SEQ ID NO: 6716500 - DNA, 13 bp, Homo sapiens
catttaataaaga

SEQ ID NO: 6716501 - DNA, 19 bp, Homo sapiens
catttaataaagaaatatt

SEQ ID NO: 6716502 - DNA, 12 bp, Homo sapiens
catttaataatc

SEQ ID NO: 6716503 - DNA, 12 bp, Homo sapiens
catttaataatt

SEQ ID NO: 6716504 - DNA, 15 bp, Homo sapiens
catttaataattata

SEQ ID NO: 6716505 - DNA, 23 bp, Homo sapiens
catttaataattatatgctattt

SEQ ID NO: 6716506 - DNA, 19 bp, Homo sapiens
catttaatatttttcaaaa

SEQ ID NO: 6716507 - DNA, 23 bp, Homo sapiens
catttaatatttttcaaaatcaa

SEQ ID NO: 6716508 - DNA, 22 bp, Homo sapiens
catttaatgagttttatcttga

SEQ ID NO: 6716509 - DNA, 22 bp, Homo sapiens
catttaatggggaggacaaaat

SEQ ID NO: 6716510 - DNA, 18 bp, Homo sapiens
catttaattctgaaatca

SEQ ID NO: 6716511 - DNA, 13 bp, Homo sapiens
catttaatttaga

SEQ ID NO: 6716512 - DNA, 23 bp, Homo sapiens
catttaatttcaacctaaatact

SEQ ID NO: 6716513 - DNA, 13 bp, Homo sapiens
catttaatttcat

SEQ ID NO: 6716514 - DNA, 15 bp, Homo sapiens
catttaatttgttat

SEQ ID NO: 6716515 - DNA, 18 bp, Homo sapiens
catttaatttgttataag

SEQ ID NO: 6716516 - DNA, 19 bp, Homo sapiens
catttacaaactgaagagt

SEQ ID NO: 6716517 - DNA, 15 bp, Homo sapiens
catttacaactgaaa

SEQ ID NO: 6716518 - DNA, 18 bp, Homo sapiens
catttacaacttccagat

SEQ ID NO: 6716519 - DNA, 22 bp, Homo sapiens
catttacaacttccagatttga

SEQ ID NO: 6716520 - DNA, 18 bp, Homo sapiens
catttacaataaatattc

SEQ ID NO: 6716521 - DNA, 23 bp, Homo sapiens
catttacaataaatattctgcat

SEQ ID NO: 6716522 - DNA, 11 bp, Homo sapiens
catttacacac

SEQ ID NO: 6716523 - DNA, 12 bp, Homo sapiens
catttacacttt

SEQ ID NO: 6716524 - DNA, 14 bp, Homo sapiens
catttacaggaggg

SEQ ID NO: 6716525 - DNA, 15 bp, Homo sapiens
catttacaggagggc

SEQ ID NO: 6716526 - DNA, 23 bp, Homo sapiens
catttacagtctctttcttcctt

SEQ ID NO: 6716527 - DNA, 20 bp, Homo sapiens
catttacataggaaccaaat

SEQ ID NO: 6716528 - DNA, 15 bp, Homo sapiens
catttacatagtgca

SEQ ID NO: 6716529 - DNA, 15 bp, Homo sapiens
catttacatgtcatt

SEQ ID NO: 6716530 - DNA, 14 bp, Homo sapiens
catttacatgttct

SEQ ID NO: 6716531 - DNA, 18 bp, Homo sapiens
catttaccaaattgcttg

SEQ ID NO: 6716532 - DNA, 15 bp, Homo sapiens
catttaccaacatgt

SEQ ID NO: 6716533 - DNA, 17 bp, Homo sapiens
catttaccaacatgtat

SEQ ID NO: 6716534 - DNA, 21 bp, Homo sapiens
catttaccaacatgtatctgt

SEQ ID NO: 6716535 - DNA, 12 bp, Homo sapiens
catttaccactg

SEQ ID NO: 6716536 - DNA, 20 bp, Homo sapiens
catttaccagcaacttgaac

SEQ ID NO: 6716537 - DNA, 22 bp, Homo sapiens
catttacccttcttttctgact

SEQ ID NO: 6716538 - DNA, 12 bp, Homo sapiens
catttacgaatt

SEQ ID NO: 6716539 - DNA, 15 bp, Homo sapiens
catttacgcctgtaa

SEQ ID NO: 6716540 - DNA, 21 bp, Homo sapiens
catttactaaacatatgattt

SEQ ID NO: 6716541 - DNA, 16 bp, Homo sapiens
catttactatgcacaa

SEQ ID NO: 6716542 - DNA, 22 bp, Homo sapiens
catttactcaccatatttgaat

SEQ ID NO: 6716543 - DNA, 13 bp, Homo sapiens
catttactgaaat

SEQ ID NO: 6716544 - DNA, 14 bp, Homo sapiens
catttactgacact

SEQ ID NO: 6716545 - DNA, 13 bp, Homo sapiens
catttactgacca

SEQ ID NO: 6716546 - DNA, 22 bp, Homo sapiens
catttactgatcatctgctgtg

SEQ ID NO: 6716547 - DNA, 13 bp, Homo sapiens
catttactgtggc

SEQ ID NO: 6716548 - DNA, 14 bp, Homo sapiens
catttactgtggct

SEQ ID NO: 6716549 - DNA, 13 bp, Homo sapiens
catttacttaaga

SEQ ID NO: 6716550 - DNA, 16 bp, Homo sapiens
catttacttaagactt

SEQ ID NO: 6716551 - DNA, 17 bp, Homo sapiens
catttacttaagactta

SEQ ID NO: 6716552 - DNA, 14 bp, Homo sapiens
catttacttaggac

SEQ ID NO: 6716553 - DNA, 21 bp, Homo sapiens
catttactttgtgttcacctt

SEQ ID NO: 6716554 - DNA, 14 bp, Homo sapiens
catttactttgttt

SEQ ID NO: 6716555 - DNA, 15 bp, Homo sapiens
catttacttttaata

SEQ ID NO: 6716556 - DNA, 15 bp, Homo sapiens
catttagaaaagtga

SEQ ID NO: 6716557 - DNA, 15 bp, Homo sapiens
catttagaaaataga

SEQ ID NO: 6716558 - DNA, 12 bp, Homo sapiens
catttagaaatc

SEQ ID NO: 6716559 - DNA, 22 bp, Homo sapiens
catttagaacctgcatttaaga

SEQ ID NO: 6716560 - DNA, 18 bp, Homo sapiens
catttagaacgagcctgg

SEQ ID NO: 6716561 - DNA, 19 bp, Homo sapiens
catttagaactttctgctt

SEQ ID NO: 6716562 - DNA, 16 bp, Homo sapiens
catttagaagaaagat

SEQ ID NO: 6716563 - DNA, 17 bp, Homo sapiens
catttagaagaaagatg

SEQ ID NO: 6716564 - DNA, 20 bp, Homo sapiens
catttagaagcctgacaact

SEQ ID NO: 6716565 - DNA, 21 bp, Homo sapiens
catttagaagctgaagatccc

SEQ ID NO: 6716566 - DNA, 17 bp, Homo sapiens
catttagaatctagaaa

SEQ ID NO: 6716567 - DNA, 20 bp, Homo sapiens
catttagaatttgaaaggaa

SEQ ID NO: 6716568 - DNA, 19 bp, Homo sapiens
catttagagcttttcagaa

SEQ ID NO: 6716569 - DNA, 21 bp, Homo sapiens
catttagataatttgaaaaag

SEQ ID NO: 6716570 - DNA, 22 bp, Homo sapiens
catttagatcctggtttcataa

SEQ ID NO: 6716571 - DNA, 11 bp, Homo sapiens
catttagatgc

SEQ ID NO: 6716572 - DNA, 19 bp, Homo sapiens
catttagattgaaaacttt

SEQ ID NO: 6716573 - DNA, 13 bp, Homo sapiens
catttagcaataa

SEQ ID NO: 6716574 - DNA, 13 bp, Homo sapiens
catttagcacagt

SEQ ID NO: 6716575 - DNA, 17 bp, Homo sapiens
catttagcacagtattt

SEQ ID NO: 6716576 - DNA, 20 bp, Homo sapiens
catttagcatgagttctgca

SEQ ID NO: 6716577 - DNA, 14 bp, Homo sapiens
catttagctggcca

SEQ ID NO: 6716578 - DNA, 21 bp, Homo sapiens
catttagctggccacatggcg

SEQ ID NO: 6716579 - DNA, 17 bp, Homo sapiens
catttaggactgggttc

SEQ ID NO: 6716580 - DNA, 17 bp, Homo sapiens
catttaggatccatgca

SEQ ID NO: 6716581 - DNA, 17 bp, Homo sapiens
catttagggagtattct

SEQ ID NO: 6716582 - DNA, 16 bp, Homo sapiens
catttagtaccctgca

SEQ ID NO: 6716583 - DNA, 19 bp, Homo sapiens
catttagtaccttcaaata

SEQ ID NO: 6716584 - DNA, 17 bp, Homo sapiens
catttagtcatgtgacc

SEQ ID NO: 6716585 - DNA, 20 bp, Homo sapiens
catttagtccaatgtctttt

SEQ ID NO: 6716586 - DNA, 23 bp, Homo sapiens
catttagtcctcaccttctgttt

SEQ ID NO: 6716587 - DNA, 23 bp, Homo sapiens
catttagtggtggtagaaatgat

SEQ ID NO: 6716588 - DNA, 13 bp, Homo sapiens
catttagtgtgaa

SEQ ID NO: 6716589 - DNA, 19 bp, Homo sapiens
catttagttaacacacata

SEQ ID NO: 6716590 - DNA, 14 bp, Homo sapiens
catttagttctttg

SEQ ID NO: 6716591 - DNA, 22 bp, Homo sapiens
catttataaccccagcctgacc

SEQ ID NO: 6716592 - DNA, 23 bp, Homo sapiens
catttataaccccagcctgacct

SEQ ID NO: 6716593 - DNA, 15 bp, Homo sapiens
catttataatactgt

SEQ ID NO: 6716594 - DNA, 22 bp, Homo sapiens
catttataatactgttttaaaa

SEQ ID NO: 6716595 - DNA, 12 bp, Homo sapiens
catttatacaaa

SEQ ID NO: 6716596 - DNA, 18 bp, Homo sapiens
catttatacaaattagaa

SEQ ID NO: 6716597 - DNA, 11 bp, Homo sapiens
catttatactc

SEQ ID NO: 6716598 - DNA, 15 bp, Homo sapiens
catttatactctttt

SEQ ID NO: 6716599 - DNA, 12 bp, Homo sapiens
catttatactgt

SEQ ID NO: 6716600 - DNA, 23 bp, Homo sapiens
catttatactgtagcaatatatt

SEQ ID NO: 6716601 - DNA, 17 bp, Homo sapiens
catttatataaaactta

SEQ ID NO: 6716602 - DNA, 23 bp, Homo sapiens
catttatataaaacttaaaaaca

SEQ ID NO: 6716603 - DNA, 13 bp, Homo sapiens
catttatatagat

SEQ ID NO: 6716604 - DNA, 16 bp, Homo sapiens
catttatatatgaaaa

SEQ ID NO: 6716605 - DNA, 20 bp, Homo sapiens
catttatatatgaaaactat

SEQ ID NO: 6716606 - DNA, 12 bp, Homo sapiens
catttatatatt

SEQ ID NO: 6716607 - DNA, 22 bp, Homo sapiens
catttatatattgaattaatat

SEQ ID NO: 6716608 - DNA, 15 bp, Homo sapiens
catttatatattgga

SEQ ID NO: 6716609 - DNA, 21 bp, Homo sapiens
catttatatgggtttattttc

SEQ ID NO: 6716610 - DNA, 13 bp, Homo sapiens
catttatatgtac

SEQ ID NO: 6716611 - DNA, 21 bp, Homo sapiens
catttatattaaataacatgt

SEQ ID NO: 6716612 - DNA, 20 bp, Homo sapiens
catttatcaagcagagacct

SEQ ID NO: 6716613 - DNA, 18 bp, Homo sapiens
catttatcaatcagtata

SEQ ID NO: 6716614 - DNA, 20 bp, Homo sapiens
catttatcagccttttatgt

SEQ ID NO: 6716615 - DNA, 22 bp, Homo sapiens
catttatccacaggaaagtgtt

SEQ ID NO: 6716616 - DNA, 20 bp, Homo sapiens
catttatccacctccatctt

SEQ ID NO: 6716617 - DNA, 17 bp, Homo sapiens
catttatcctagaaaat

SEQ ID NO: 6716618 - DNA, 18 bp, Homo sapiens
catttatcctagaaaatt

SEQ ID NO: 6716619 - DNA, 14 bp, Homo sapiens
catttatctataat

SEQ ID NO: 6716620 - DNA, 22 bp, Homo sapiens
catttatctataatttacctaa

SEQ ID NO: 6716621 - DNA, 17 bp, Homo sapiens
catttatctattaaaat

SEQ ID NO: 6716622 - DNA, 22 bp, Homo sapiens
catttatctgtacatacttttt

SEQ ID NO: 6716623 - DNA, 14 bp, Homo sapiens
catttatcttctgt

SEQ ID NO: 6716624 - DNA, 22 bp, Homo sapiens
catttatcttctgtttttctca

SEQ ID NO: 6716625 - DNA, 14 bp, Homo sapiens
catttatcttgaag

SEQ ID NO: 6716626 - DNA, 22 bp, Homo sapiens
catttatctttgtattcttcat

SEQ ID NO: 6716627 - DNA, 12 bp, Homo sapiens
catttatctttt

SEQ ID NO: 6716628 - DNA, 16 bp, Homo sapiens
catttatgaagcaagc

SEQ ID NO: 6716629 - DNA, 18 bp, Homo sapiens
catttatgacaagctgta

SEQ ID NO: 6716630 - DNA, 23 bp, Homo sapiens
catttatgagctcttcatgtttc

SEQ ID NO: 6716631 - DNA, 17 bp, Homo sapiens
catttatgatttaataa

SEQ ID NO: 6716632 - DNA, 18 bp, Homo sapiens
catttatgatttaataaa

SEQ ID NO: 6716633 - DNA, 14 bp, Homo sapiens
catttatgcatgag

SEQ ID NO: 6716634 - DNA, 15 bp, Homo sapiens
catttatgcatgaga

SEQ ID NO: 6716635 - DNA, 17 bp, Homo sapiens
catttatgcatgagaac

SEQ ID NO: 6716636 - DNA, 14 bp, Homo sapiens
catttatggaactt

SEQ ID NO: 6716637 - DNA, 21 bp, Homo sapiens
catttatggtcaacacttaag

SEQ ID NO: 6716638 - DNA, 22 bp, Homo sapiens
catttatgtacaaaatgaattg

SEQ ID NO: 6716639 - DNA, 21 bp, Homo sapiens
catttatgtagacattgtaaa

SEQ ID NO: 6716640 - DNA, 21 bp, Homo sapiens
catttatgtgtcagttcattt

SEQ ID NO: 6716641 - DNA, 22 bp, Homo sapiens
catttatgtgtgaagcaaattt

SEQ ID NO: 6716642 - DNA, 17 bp, Homo sapiens
catttatgttatttatg

SEQ ID NO: 6716643 - DNA, 21 bp, Homo sapiens
catttatgttatttatgatgt

SEQ ID NO: 6716644 - DNA, 18 bp, Homo sapiens
catttattaagcagtaca

SEQ ID NO: 6716645 - DNA, 20 bp, Homo sapiens
catttattaagtatatttgt

SEQ ID NO: 6716646 - DNA, 22 bp, Homo sapiens
catttattaagtatatttgtaa

SEQ ID NO: 6716647 - DNA, 16 bp, Homo sapiens
catttatttattactg

SEQ ID NO: 6716648 - DNA, 18 bp, Homo sapiens
catttatttccatattaa

SEQ ID NO: 6716649 - DNA, 15 bp, Homo sapiens
catttattttaagca

SEQ ID NO: 6716650 - DNA, 21 bp, Homo sapiens
catttattttaagcactctta

SEQ ID NO: 6716651 - DNA, 13 bp, Homo sapiens
catttattttatg

SEQ ID NO: 6716652 - DNA, 14 bp, Homo sapiens
catttattttatga

SEQ ID NO: 6716653 - DNA, 16 bp, Homo sapiens
catttattttatgaga

SEQ ID NO: 6716654 - DNA, 17 bp, Homo sapiens
catttattttatgagaa

SEQ ID NO: 6716655 - DNA, 19 bp, Homo sapiens
catttattttatgagaaat

SEQ ID NO: 6716656 - DNA, 14 bp, Homo sapiens
catttattttgaca

SEQ ID NO: 6716657 - DNA, 20 bp, Homo sapiens
catttattttgagaagctct

SEQ ID NO: 6716658 - DNA, 18 bp, Homo sapiens
catttatttttagccatt

SEQ ID NO: 6716659 - DNA, 18 bp, Homo sapiens
catttatttttctcatga

SEQ ID NO: 6716660 - DNA, 22 bp, Homo sapiens
catttcaaaaccaaggaagcag

SEQ ID NO: 6716661 - DNA, 18 bp, Homo sapiens
catttcaaaatatgtgta

SEQ ID NO: 6716662 - DNA, 16 bp, Homo sapiens
catttcaaaattaata

SEQ ID NO: 6716663 - DNA, 15 bp, Homo sapiens
catttcaaagccctg

SEQ ID NO: 6716664 - DNA, 16 bp, Homo sapiens
catttcaaagccctgc

SEQ ID NO: 6716665 - DNA, 12 bp, Homo sapiens
catttcaaataa

SEQ ID NO: 6716666 - DNA, 15 bp, Homo sapiens
catttcaaatctgta

SEQ ID NO: 6716667 - DNA, 18 bp, Homo sapiens
catttcaaatgtgctgtc

SEQ ID NO: 6716668 - DNA, 15 bp, Homo sapiens
catttcaactgtttg

SEQ ID NO: 6716669 - DNA, 14 bp, Homo sapiens
catttcaagaagtc

SEQ ID NO: 6716670 - DNA, 17 bp, Homo sapiens
catttcaagatccaaat

SEQ ID NO: 6716671 - DNA, 18 bp, Homo sapiens
catttcaagatccaaatg

SEQ ID NO: 6716672 - DNA, 15 bp, Homo sapiens
catttcaagcagctg

SEQ ID NO: 6716673 - DNA, 23 bp, Homo sapiens
catttcaaggaatggaatcttct

SEQ ID NO: 6716674 - DNA, 22 bp, Homo sapiens
catttcaaggtaaaatgtagct

SEQ ID NO: 6716675 - DNA, 15 bp, Homo sapiens
catttcaagtttact

SEQ ID NO: 6716676 - DNA, 12 bp, Homo sapiens
catttcaatcat

SEQ ID NO: 6716677 - DNA, 17 bp, Homo sapiens
catttcaatcgtaaaat

SEQ ID NO: 6716678 - DNA, 18 bp, Homo sapiens
catttcaatgtgtataaa

SEQ ID NO: 6716679 - DNA, 18 bp, Homo sapiens
catttcaattcctggccc

SEQ ID NO: 6716680 - DNA, 16 bp, Homo sapiens
catttcaattgctttg

SEQ ID NO: 6716681 - DNA, 23 bp, Homo sapiens
catttcacacaggtcctgaaagt

SEQ ID NO: 6716682 - DNA, 19 bp, Homo sapiens
catttcacacataagaaaa

SEQ ID NO: 6716683 - DNA, 16 bp, Homo sapiens
catttcacagaaaaca

SEQ ID NO: 6716684 - DNA, 16 bp, Homo sapiens
catttcacaggctaat

SEQ ID NO: 6716685 - DNA, 15 bp, Homo sapiens
catttcacattaatg

SEQ ID NO: 6716686 - DNA, 18 bp, Homo sapiens
catttcacatttttgtaa

SEQ ID NO: 6716687 - DNA, 20 bp, Homo sapiens
catttcacccctccctttct

SEQ ID NO: 6716688 - DNA, 16 bp, Homo sapiens
catttcacctgtgaca

SEQ ID NO: 6716689 - DNA, 18 bp, Homo sapiens
catttcacctgtgacaaa

SEQ ID NO: 6716690 - DNA, 16 bp, Homo sapiens
catttcacgaactgtt

SEQ ID NO: 6716691 - DNA, 15 bp, Homo sapiens
catttcacttattta

SEQ ID NO: 6716692 - DNA, 15 bp, Homo sapiens
catttcactttaaag

SEQ ID NO: 6716693 - DNA, 17 bp, Homo sapiens
catttcacttttctgta

SEQ ID NO: 6716694 - DNA, 23 bp, Homo sapiens
catttcagaaggtatcagttata

SEQ ID NO: 6716695 - DNA, 15 bp, Homo sapiens
catttcagacatatc

SEQ ID NO: 6716696 - DNA, 18 bp, Homo sapiens
catttcagagggtaagta

SEQ ID NO: 6716697 - DNA, 20 bp, Homo sapiens
catttcagattttaaaaagg

SEQ ID NO: 6716698 - DNA, 21 bp, Homo sapiens
catttcagcttgaacctgctt

SEQ ID NO: 6716699 - DNA, 22 bp, Homo sapiens
catttcaggactctctccagga

SEQ ID NO: 6716700 - DNA, 15 bp, Homo sapiens
catttcaggagcagc

SEQ ID NO: 6716701 - DNA, 22 bp, Homo sapiens
catttcaggagcagcctcagaa

SEQ ID NO: 6716702 - DNA, 23 bp, Homo sapiens
catttcaggccagtgtggtgtct

SEQ ID NO: 6716703 - DNA, 19 bp, Homo sapiens
catttcagggtcttggctg

SEQ ID NO: 6716704 - DNA, 18 bp, Homo sapiens
catttcagtgtattgttt

SEQ ID NO: 6716705 - DNA, 20 bp, Homo sapiens
catttcagtttgtttacttt

SEQ ID NO: 6716706 - DNA, 14 bp, Homo sapiens
catttcataaaaat

SEQ ID NO: 6716707 - DNA, 15 bp, Homo sapiens
catttcataaactaa

SEQ ID NO: 6716708 - DNA, 19 bp, Homo sapiens
catttcataaggcctgccc

SEQ ID NO: 6716709 - DNA, 22 bp, Homo sapiens
catttcataatttgtttccagc

SEQ ID NO: 6716710 - DNA, 13 bp, Homo sapiens
catttcatacaaa

SEQ ID NO: 6716711 - DNA, 15 bp, Homo sapiens
catttcatacaaatt

SEQ ID NO: 6716712 - DNA, 16 bp, Homo sapiens
catttcatacaacaga

SEQ ID NO: 6716713 - DNA, 23 bp, Homo sapiens
catttcatacaacagaaaccaga

SEQ ID NO: 6716714 - DNA, 10 bp, Homo sapiens
catttcatat

SEQ ID NO: 6716715 - DNA, 15 bp, Homo sapiens
catttcatataaatg

SEQ ID NO: 6716716 - DNA, 18 bp, Homo sapiens
catttcatataaatggaa

SEQ ID NO: 6716717 - DNA, 12 bp, Homo sapiens
catttcatatta

SEQ ID NO: 6716718 - DNA, 19 bp, Homo sapiens
catttcatattctttcaat

SEQ ID NO: 6716719 - DNA, 17 bp, Homo sapiens
catttcatcattgtttc

SEQ ID NO: 6716720 - DNA, 14 bp, Homo sapiens
catttcatcctgtt

SEQ ID NO: 6716721 - DNA, 18 bp, Homo sapiens
catttcatcctgttggct

SEQ ID NO: 6716722 - DNA, 14 bp, Homo sapiens
catttcatcctttc

SEQ ID NO: 6716723 - DNA, 18 bp, Homo sapiens
catttcatctaatttaat

SEQ ID NO: 6716724 - DNA, 14 bp, Homo sapiens
catttcatctattt

SEQ ID NO: 6716725 - DNA, 16 bp, Homo sapiens
catttcatctatttct

SEQ ID NO: 6716726 - DNA, 17 bp, Homo sapiens
catttcatctatttctg

SEQ ID NO: 6716727 - DNA, 13 bp, Homo sapiens
catttcatgaaaa

SEQ ID NO: 6716728 - DNA, 20 bp, Homo sapiens
catttcatgaaaaagctgct

SEQ ID NO: 6716729 - DNA, 17 bp, Homo sapiens
catttcatgaaaatgac

SEQ ID NO: 6716730 - DNA, 16 bp, Homo sapiens
catttcatgaagcaag

SEQ ID NO: 6716731 - DNA, 22 bp, Homo sapiens
catttcatgctctgcaaaagga

SEQ ID NO: 6716732 - DNA, 14 bp, Homo sapiens
catttcatgctttg

SEQ ID NO: 6716733 - DNA, 17 bp, Homo sapiens
catttcatgctttgatt

SEQ ID NO: 6716734 - DNA, 20 bp, Homo sapiens
catttcatgtagtaagattt

SEQ ID NO: 6716735 - DNA, 17 bp, Homo sapiens
catttcatgtgatctat

SEQ ID NO: 6716736 - DNA, 15 bp, Homo sapiens
catttcattatgctt

SEQ ID NO: 6716737 - DNA, 18 bp, Homo sapiens
catttcattatttttcaa

SEQ ID NO: 6716738 - DNA, 15 bp, Homo sapiens
catttcattcaaatc

SEQ ID NO: 6716739 - DNA, 12 bp, Homo sapiens
catttcattcca

SEQ ID NO: 6716740 - DNA, 13 bp, Homo sapiens
catttcattgtat

SEQ ID NO: 6716741 - DNA, 16 bp, Homo sapiens
catttcattgtatgat

SEQ ID NO: 6716742 - DNA, 12 bp, Homo sapiens
catttcatttat

SEQ ID NO: 6716743 - DNA, 16 bp, Homo sapiens
catttccaaacttgaa

SEQ ID NO: 6716744 - DNA, 17 bp, Homo sapiens
catttccaaatgaatga

SEQ ID NO: 6716745 - DNA, 21 bp, Homo sapiens
catttccaaatgaatgacctt

SEQ ID NO: 6716746 - DNA, 17 bp, Homo sapiens
catttccaaattcacaa

SEQ ID NO: 6716747 - DNA, 21 bp, Homo sapiens
catttccaacaccacagacac

SEQ ID NO: 6716748 - DNA, 12 bp, Homo sapiens
catttccaagca

SEQ ID NO: 6716749 - DNA, 23 bp, Homo sapiens
catttccaagctgttagttgctg

SEQ ID NO: 6716750 - DNA, 17 bp, Homo sapiens
catttccacactgtcag

SEQ ID NO: 6716751 - DNA, 16 bp, Homo sapiens
catttccaccaggccg

SEQ ID NO: 6716752 - DNA, 18 bp, Homo sapiens
catttccactgtatattt

SEQ ID NO: 6716753 - DNA, 16 bp, Homo sapiens
catttccataccattg

SEQ ID NO: 6716754 - DNA, 15 bp, Homo sapiens
catttccatggctct

SEQ ID NO: 6716755 - DNA, 17 bp, Homo sapiens
catttccatggctctgt

SEQ ID NO: 6716756 - DNA, 16 bp, Homo sapiens
catttccatgtatgca

SEQ ID NO: 6716757 - DNA, 13 bp, Homo sapiens
catttccattcat

SEQ ID NO: 6716758 - DNA, 14 bp, Homo sapiens
catttccattgctt

SEQ ID NO: 6716759 - DNA, 14 bp, Homo sapiens
catttcccaagtca

SEQ ID NO: 6716760 - DNA, 20 bp, Homo sapiens
catttcccaagtcagacaga

SEQ ID NO: 6716761 - DNA, 18 bp, Homo sapiens
catttcccacatctttcc

SEQ ID NO: 6716762 - DNA, 13 bp, Homo sapiens
catttcccacttc

SEQ ID NO: 6716763 - DNA, 15 bp, Homo sapiens
catttcccacttcca

SEQ ID NO: 6716764 - DNA, 13 bp, Homo sapiens
catttccccagac

SEQ ID NO: 6716765 - DNA, 17 bp, Homo sapiens
catttccccagggcacg

SEQ ID NO: 6716766 - DNA, 17 bp, Homo sapiens
catttcccccaaaggca

SEQ ID NO: 6716767 - DNA, 21 bp, Homo sapiens
catttcccccaccccatttct

SEQ ID NO: 6716768 - DNA, 16 bp, Homo sapiens
catttccccctcctca

SEQ ID NO: 6716769 - DNA, 21 bp, Homo sapiens
catttcccctcccgtcttcct

SEQ ID NO: 6716770 - DNA, 15 bp, Homo sapiens
catttccctcccggg

SEQ ID NO: 6716771 - DNA, 22 bp, Homo sapiens
catttccctccctctcttcccc

SEQ ID NO: 6716772 - DNA, 23 bp, Homo sapiens
catttccggctgctgtgtgtgag

SEQ ID NO: 6716773 - DNA, 19 bp, Homo sapiens
catttccgtaattcttatt

SEQ ID NO: 6716774 - DNA, 16 bp, Homo sapiens
catttccgtccccccc

SEQ ID NO: 6716775 - DNA, 19 bp, Homo sapiens
catttccgtgaagggcacc

SEQ ID NO: 6716776 - DNA, 19 bp, Homo sapiens
catttccgttttgcctgtg

SEQ ID NO: 6716777 - DNA, 15 bp, Homo sapiens
catttcctaaatata

SEQ ID NO: 6716778 - DNA, 12 bp, Homo sapiens
catttcctaatg

SEQ ID NO: 6716779 - DNA, 19 bp, Homo sapiens
catttcctatgtaactgca

SEQ ID NO: 6716780 - DNA, 18 bp, Homo sapiens
catttcctcacactaaga

SEQ ID NO: 6716781 - DNA, 22 bp, Homo sapiens
catttcctctgagctgttatct

SEQ ID NO: 6716782 - DNA, 17 bp, Homo sapiens
catttcctcttccttct

SEQ ID NO: 6716783 - DNA, 19 bp, Homo sapiens
catttcctcttccttctct

SEQ ID NO: 6716784 - DNA, 10 bp, Homo sapiens
catttcctga

SEQ ID NO: 6716785 - DNA, 13 bp, Homo sapiens
catttcctgacag

SEQ ID NO: 6716786 - DNA, 11 bp, Homo sapiens
catttcctgat

SEQ ID NO: 6716787 - DNA, 13 bp, Homo sapiens
catttcctgccct

SEQ ID NO: 6716788 - DNA, 13 bp, Homo sapiens
catttcctgctga

SEQ ID NO: 6716789 - DNA, 17 bp, Homo sapiens
catttcctgggagaaag

SEQ ID NO: 6716790 - DNA, 18 bp, Homo sapiens
catttcctgggagaaaga

SEQ ID NO: 6716791 - DNA, 14 bp, Homo sapiens
catttcctgggtgg

SEQ ID NO: 6716792 - DNA, 21 bp, Homo sapiens
catttcctgggtggctactct

SEQ ID NO: 6716793 - DNA, 22 bp, Homo sapiens
catttcctgggtggctactctg

SEQ ID NO: 6716794 - DNA, 22 bp, Homo sapiens
catttcctgtacaatcatgaac

SEQ ID NO: 6716795 - DNA, 16 bp, Homo sapiens
catttccttcaaggca

SEQ ID NO: 6716796 - DNA, 17 bp, Homo sapiens
catttccttccagccca

SEQ ID NO: 6716797 - DNA, 20 bp, Homo sapiens
catttccttccagcccatcc

SEQ ID NO: 6716798 - DNA, 11 bp, Homo sapiens
catttcctttt

SEQ ID NO: 6716799 - DNA, 20 bp, Homo sapiens
catttccttttcacattaga

SEQ ID NO: 6716800 - DNA, 19 bp, Homo sapiens
catttccttttctctgccc

SEQ ID NO: 6716801 - DNA, 20 bp, Homo sapiens
catttccttttctctgccct

SEQ ID NO: 6716802 - DNA, 21 bp, Homo sapiens
catttcggtggctagtcaagc

SEQ ID NO: 6716803 - DNA, 19 bp, Homo sapiens
catttcgtgagccccatct

SEQ ID NO: 6716804 - DNA, 16 bp, Homo sapiens
catttcgtgtaatatt

SEQ ID NO: 6716805 - DNA, 14 bp, Homo sapiens
catttctaaaagaa

SEQ ID NO: 6716806 - DNA, 22 bp, Homo sapiens
catttctaaaatgttaaaacat

SEQ ID NO: 6716807 - DNA, 17 bp, Homo sapiens
catttctaaaggcctct

SEQ ID NO: 6716808 - DNA, 18 bp, Homo sapiens
catttctaaaggcctctt

SEQ ID NO: 6716809 - DNA, 21 bp, Homo sapiens
catttctaacataagtaagac

SEQ ID NO: 6716810 - DNA, 20 bp, Homo sapiens
catttctaactctgatgtaa

SEQ ID NO: 6716811 - DNA, 21 bp, Homo sapiens
catttctaagcctttgagact

SEQ ID NO: 6716812 - DNA, 20 bp, Homo sapiens
catttctaattatgtagctc

SEQ ID NO: 6716813 - DNA, 18 bp, Homo sapiens
catttctaattcctgttt

SEQ ID NO: 6716814 - DNA, 21 bp, Homo sapiens
catttctactctcccatggct

SEQ ID NO: 6716815 - DNA, 21 bp, Homo sapiens
catttctactcttaagtttct

SEQ ID NO: 6716816 - DNA, 13 bp, Homo sapiens
catttctactgta

SEQ ID NO: 6716817 - DNA, 14 bp, Homo sapiens
catttctactttga

SEQ ID NO: 6716818 - DNA, 16 bp, Homo sapiens
catttctactttgact

SEQ ID NO: 6716819 - DNA, 17 bp, Homo sapiens
catttctactttgacta

SEQ ID NO: 6716820 - DNA, 21 bp, Homo sapiens
catttctagaacaattacatg

SEQ ID NO: 6716821 - DNA, 23 bp, Homo sapiens
catttctagaacaattacatgta

SEQ ID NO: 6716822 - DNA, 24 bp, Homo sapiens
catttctagaacaattacatgtaa

SEQ ID NO: 6716823 - DNA, 14 bp, Homo sapiens
catttctagactca

SEQ ID NO: 6716824 - DNA, 15 bp, Homo sapiens
catttctagactcaa

SEQ ID NO: 6716825 - DNA, 21 bp, Homo sapiens
catttctatactttacaggaa

SEQ ID NO: 6716826 - DNA, 20 bp, Homo sapiens
catttctatagccaaagctg

SEQ ID NO: 6716827 - DNA, 22 bp, Homo sapiens
catttctatagccaaagctgtt

SEQ ID NO: 6716828 - DNA, 17 bp, Homo sapiens
catttctatgcaggcag

SEQ ID NO: 6716829 - DNA, 23 bp, Homo sapiens
catttctatttcataatgaaaaa

SEQ ID NO: 6716830 - DNA, 19 bp, Homo sapiens
catttctatttctcctcca

SEQ ID NO: 6716831 - DNA, 21 bp, Homo sapiens
catttctcaacagttcattgc

SEQ ID NO: 6716832 - DNA, 18 bp, Homo sapiens
catttctcaatcagtgca

SEQ ID NO: 6716833 - DNA, 12 bp, Homo sapiens
catttctcactg

SEQ ID NO: 6716834 - DNA, 13 bp, Homo sapiens
catttctcactga

SEQ ID NO: 6716835 - DNA, 15 bp, Homo sapiens
catttctcactgaaa

SEQ ID NO: 6716836 - DNA, 12 bp, Homo sapiens
catttctcaggc

SEQ ID NO: 6716837 - DNA, 13 bp, Homo sapiens
catttctcaggct

SEQ ID NO: 6716838 - DNA, 19 bp, Homo sapiens
catttctcaggctaggcca

SEQ ID NO: 6716839 - DNA, 22 bp, Homo sapiens
catttctcagtcggtgtgtaat

SEQ ID NO: 6716840 - DNA, 18 bp, Homo sapiens
catttctcagtggcttct

SEQ ID NO: 6716841 - DNA, 12 bp, Homo sapiens
catttctcatcc

SEQ ID NO: 6716842 - DNA, 14 bp, Homo sapiens
catttctcatgctt

SEQ ID NO: 6716843 - DNA, 13 bp, Homo sapiens
catttctcatgtg

SEQ ID NO: 6716844 - DNA, 15 bp, Homo sapiens
catttctcatgtgct

SEQ ID NO: 6716845 - DNA, 16 bp, Homo sapiens
catttctcatgtgctt

SEQ ID NO: 6716846 - DNA, 18 bp, Homo sapiens
catttctcatgtgctttg

SEQ ID NO: 6716847 - DNA, 19 bp, Homo sapiens
catttctcatgtgctttgt

SEQ ID NO: 6716848 - DNA, 13 bp, Homo sapiens
catttctcatgtt

SEQ ID NO: 6716849 - DNA, 17 bp, Homo sapiens
catttctcatgttgaag

SEQ ID NO: 6716850 - DNA, 12 bp, Homo sapiens
catttctccaga

SEQ ID NO: 6716851 - DNA, 15 bp, Homo sapiens
catttctccagaacc

SEQ ID NO: 6716852 - DNA, 12 bp, Homo sapiens
catttctccgtt

SEQ ID NO: 6716853 - DNA, 15 bp, Homo sapiens
catttctctccacct

SEQ ID NO: 6716854 - DNA, 22 bp, Homo sapiens
catttctctcttatatgccaga

SEQ ID NO: 6716855 - DNA, 19 bp, Homo sapiens
catttctctgagcagtcag

SEQ ID NO: 6716856 - DNA, 22 bp, Homo sapiens
catttctctgcgagtagttcca

SEQ ID NO: 6716857 - DNA, 13 bp, Homo sapiens
catttctctgctt

SEQ ID NO: 6716858 - DNA, 23 bp, Homo sapiens
catttctcttctcagctcttcca

SEQ ID NO: 6716859 - DNA, 14 bp, Homo sapiens
catttctctttaaa

SEQ ID NO: 6716860 - DNA, 13 bp, Homo sapiens
catttctctttca

SEQ ID NO: 6716861 - DNA, 14 bp, Homo sapiens
catttctctttcaa

SEQ ID NO: 6716862 - DNA, 19 bp, Homo sapiens
catttctctttgagagagt

SEQ ID NO: 6716863 - DNA, 16 bp, Homo sapiens
catttctgatgtgaaa

SEQ ID NO: 6716864 - DNA, 13 bp, Homo sapiens
catttctgccagc

SEQ ID NO: 6716865 - DNA, 16 bp, Homo sapiens
catttctgccagcgca

SEQ ID NO: 6716866 - DNA, 18 bp, Homo sapiens
catttctgccatgatgtt

SEQ ID NO: 6716867 - DNA, 22 bp, Homo sapiens
catttctgccatgatgtttaca

SEQ ID NO: 6716868 - DNA, 15 bp, Homo sapiens
catttctgctctcag

SEQ ID NO: 6716869 - DNA, 23 bp, Homo sapiens
catttctggattgtggttccatg

SEQ ID NO: 6716870 - DNA, 14 bp, Homo sapiens
catttctgtaaata

SEQ ID NO: 6716871 - DNA, 13 bp, Homo sapiens
catttctgtatac

SEQ ID NO: 6716872 - DNA, 17 bp, Homo sapiens
catttctgtatactgta

SEQ ID NO: 6716873 - DNA, 23 bp, Homo sapiens
catttctgtatactgtaaaagtt

SEQ ID NO: 6716874 - DNA, 13 bp, Homo sapiens
catttctgtattt

SEQ ID NO: 6716875 - DNA, 18 bp, Homo sapiens
catttctgtattttttgt

SEQ ID NO: 6716876 - DNA, 14 bp, Homo sapiens
catttctgtctccc

SEQ ID NO: 6716877 - DNA, 11 bp, Homo sapiens
catttctgttc

SEQ ID NO: 6716878 - DNA, 19 bp, Homo sapiens
catttcttaaaacacatga

SEQ ID NO: 6716879 - DNA, 17 bp, Homo sapiens
catttcttaaaatgttt

SEQ ID NO: 6716880 - DNA, 16 bp, Homo sapiens
catttcttatcacata

SEQ ID NO: 6716881 - DNA, 20 bp, Homo sapiens
catttcttattaaccaaatt

SEQ ID NO: 6716882 - DNA, 12 bp, Homo sapiens
catttcttattt

SEQ ID NO: 6716883 - DNA, 14 bp, Homo sapiens
catttcttcagagg

SEQ ID NO: 6716884 - DNA, 12 bp, Homo sapiens
catttcttccac

SEQ ID NO: 6716885 - DNA, 21 bp, Homo sapiens
catttcttccacaagagccca

SEQ ID NO: 6716886 - DNA, 13 bp, Homo sapiens
catttcttccacg

SEQ ID NO: 6716887 - DNA, 23 bp, Homo sapiens
catttcttctacaactcatacac

SEQ ID NO: 6716888 - DNA, 19 bp, Homo sapiens
catttcttctctctgtgct

SEQ ID NO: 6716889 - DNA, 15 bp, Homo sapiens
catttcttgctagct

SEQ ID NO: 6716890 - DNA, 16 bp, Homo sapiens
catttcttgggccctc

SEQ ID NO: 6716891 - DNA, 23 bp, Homo sapiens
catttcttgtgatgttttgagag

SEQ ID NO: 6716892 - DNA, 16 bp, Homo sapiens
catttcttgtgttctg

SEQ ID NO: 6716893 - DNA, 13 bp, Homo sapiens
catttctttatat

SEQ ID NO: 6716894 - DNA, 14 bp, Homo sapiens
catttctttatatg

SEQ ID NO: 6716895 - DNA, 17 bp, Homo sapiens
catttctttatatggaa

SEQ ID NO: 6716896 - DNA, 17 bp, Homo sapiens
catttctttatttctgt

SEQ ID NO: 6716897 - DNA, 19 bp, Homo sapiens
catttctttcttgctggct

SEQ ID NO: 6716898 - DNA, 20 bp, Homo sapiens
catttctttgtctttttcct

SEQ ID NO: 6716899 - DNA, 18 bp, Homo sapiens
catttctttgtgctttgg

SEQ ID NO: 6716900 - DNA, 16 bp, Homo sapiens
catttcttttaaaata

SEQ ID NO: 6716901 - DNA, 20 bp, Homo sapiens
catttcttttctttttacat

SEQ ID NO: 6716902 - DNA, 18 bp, Homo sapiens
catttctttttaaaaaaa

SEQ ID NO: 6716903 - DNA, 24 bp, Homo sapiens
catttctttttaggctctgagact

SEQ ID NO: 6716904 - DNA, 22 bp, Homo sapiens
catttctttttgggagagactt

SEQ ID NO: 6716905 - DNA, 13 bp, Homo sapiens
catttgaaaatat

SEQ ID NO: 6716906 - DNA, 19 bp, Homo sapiens
catttgaaacccctgtagg

SEQ ID NO: 6716907 - DNA, 17 bp, Homo sapiens
catttgaaagaaagtgt

SEQ ID NO: 6716908 - DNA, 23 bp, Homo sapiens
catttgaaagtgggtttcaattt

SEQ ID NO: 6716909 - DNA, 21 bp, Homo sapiens
catttgaaataaagtaatttt

SEQ ID NO: 6716910 - DNA, 17 bp, Homo sapiens
catttgaacctggatcc

SEQ ID NO: 6716911 - DNA, 19 bp, Homo sapiens
catttgaagtgtacctgtg

SEQ ID NO: 6716912 - DNA, 21 bp, Homo sapiens
catttgaataaagcctgcttt

SEQ ID NO: 6716913 - DNA, 12 bp, Homo sapiens
catttgaatact

SEQ ID NO: 6716914 - DNA, 10 bp, Homo sapiens
catttgaatg

SEQ ID NO: 6716915 - DNA, 12 bp, Homo sapiens
catttgaattct

SEQ ID NO: 6716916 - DNA, 13 bp, Homo sapiens
catttgaattctt

SEQ ID NO: 6716917 - DNA, 22 bp, Homo sapiens
catttgaattcttgatctctaa

SEQ ID NO: 6716918 - DNA, 18 bp, Homo sapiens
catttgacaacacatgtg

SEQ ID NO: 6716919 - DNA, 17 bp, Homo sapiens
catttgacacataaaag

SEQ ID NO: 6716920 - DNA, 20 bp, Homo sapiens
catttgacaggggctcagga

SEQ ID NO: 6716921 - DNA, 15 bp, Homo sapiens
catttgacagtgtgg

SEQ ID NO: 6716922 - DNA, 19 bp, Homo sapiens
catttgacccttgctgtga

SEQ ID NO: 6716923 - DNA, 15 bp, Homo sapiens
catttgagaaatgca

SEQ ID NO: 6716924 - DNA, 15 bp, Homo sapiens
catttgagagaagcc

SEQ ID NO: 6716925 - DNA, 19 bp, Homo sapiens
catttgagatttttggttt

SEQ ID NO: 6716926 - DNA, 16 bp, Homo sapiens
catttgagccatgtca

SEQ ID NO: 6716927 - DNA, 14 bp, Homo sapiens
catttgagcccagg

SEQ ID NO: 6716928 - DNA, 17 bp, Homo sapiens
catttgagcccaggagt

SEQ ID NO: 6716929 - DNA, 22 bp, Homo sapiens
catttgagggcccagccaggag

SEQ ID NO: 6716930 - DNA, 20 bp, Homo sapiens
catttgaggggccaggggca

SEQ ID NO: 6716931 - DNA, 22 bp, Homo sapiens
catttgaggggccaggggcagg

SEQ ID NO: 6716932 - DNA, 23 bp, Homo sapiens
catttgaggggccaggggcaggc

SEQ ID NO: 6716933 - DNA, 14 bp, Homo sapiens
catttgagtctctt

SEQ ID NO: 6716934 - DNA, 23 bp, Homo sapiens
catttgagtttagggttctggtg

SEQ ID NO: 6716935 - DNA, 17 bp, Homo sapiens
catttgataatgataaa

SEQ ID NO: 6716936 - DNA, 11 bp, Homo sapiens
catttgatacc

SEQ ID NO: 6716937 - DNA, 17 bp, Homo sapiens
catttgatacccctggg

SEQ ID NO: 6716938 - DNA, 14 bp, Homo sapiens
catttgatagcaat

SEQ ID NO: 6716939 - DNA, 16 bp, Homo sapiens
catttgatattatcta

SEQ ID NO: 6716940 - DNA, 16 bp, Homo sapiens
catttgatattgtgta

SEQ ID NO: 6716941 - DNA, 17 bp, Homo sapiens
catttgatctgttgcaa

SEQ ID NO: 6716942 - DNA, 17 bp, Homo sapiens
catttgatgcatgtctt

SEQ ID NO: 6716943 - DNA, 14 bp, Homo sapiens
catttgatgctaaa

SEQ ID NO: 6716944 - DNA, 16 bp, Homo sapiens
catttgatgtacatgt

SEQ ID NO: 6716945 - DNA, 22 bp, Homo sapiens
catttgattaaattatgaatga

SEQ ID NO: 6716946 - DNA, 17 bp, Homo sapiens
catttgattaacatttg

SEQ ID NO: 6716947 - DNA, 15 bp, Homo sapiens
catttgattctgtgt

SEQ ID NO: 6716948 - DNA, 14 bp, Homo sapiens
catttgattgtttt

SEQ ID NO: 6716949 - DNA, 14 bp, Homo sapiens
catttgatttcgat

SEQ ID NO: 6716950 - DNA, 14 bp, Homo sapiens
catttgatttgata

SEQ ID NO: 6716951 - DNA, 21 bp, Homo sapiens
catttgatttgatatacagac

SEQ ID NO: 6716952 - DNA, 16 bp, Homo sapiens
catttgatttttctaa

SEQ ID NO: 6716953 - DNA, 13 bp, Homo sapiens
catttgcaagctg

SEQ ID NO: 6716954 - DNA, 22 bp, Homo sapiens
catttgcaagggaaaagtctct

SEQ ID NO: 6716955 - DNA, 19 bp, Homo sapiens
catttgcaataacagctgc

SEQ ID NO: 6716956 - DNA, 21 bp, Homo sapiens
catttgcactggagttctatg

SEQ ID NO: 6716957 - DNA, 14 bp, Homo sapiens
catttgcagctgct

SEQ ID NO: 6716958 - DNA, 15 bp, Homo sapiens
catttgcagctgctg

SEQ ID NO: 6716959 - DNA, 23 bp, Homo sapiens
catttgcaggatctgtctgtgca

SEQ ID NO: 6716960 - DNA, 20 bp, Homo sapiens
catttgcagggtcctcttct

SEQ ID NO: 6716961 - DNA, 20 bp, Homo sapiens
catttgcaggtgaccagaat

SEQ ID NO: 6716962 - DNA, 14 bp, Homo sapiens
catttgcattgggc

SEQ ID NO: 6716963 - DNA, 16 bp, Homo sapiens
catttgcattgggcat

SEQ ID NO: 6716964 - DNA, 17 bp, Homo sapiens
catttgcattgggcatt

SEQ ID NO: 6716965 - DNA, 13 bp, Homo sapiens
catttgcatttgt

SEQ ID NO: 6716966 - DNA, 18 bp, Homo sapiens
catttgccaagggaggcg

SEQ ID NO: 6716967 - DNA, 20 bp, Homo sapiens
catttgccacttagtatttt

SEQ ID NO: 6716968 - DNA, 16 bp, Homo sapiens
catttgccatgctgct

SEQ ID NO: 6716969 - DNA, 12 bp, Homo sapiens
catttgcctatt

SEQ ID NO: 6716970 - DNA, 17 bp, Homo sapiens
catttgcctattcccac

SEQ ID NO: 6716971 - DNA, 18 bp, Homo sapiens
catttgcctattcccaca

SEQ ID NO: 6716972 - DNA, 14 bp, Homo sapiens
catttgcctgcttc

SEQ ID NO: 6716973 - DNA, 14 bp, Homo sapiens
catttgccttgctg

SEQ ID NO: 6716974 - DNA, 15 bp, Homo sapiens
catttgcctttctgg

SEQ ID NO: 6716975 - DNA, 17 bp, Homo sapiens
catttgcctttctggga

SEQ ID NO: 6716976 - DNA, 23 bp, Homo sapiens
catttgcctttctgggagcagaa

SEQ ID NO: 6716977 - DNA, 20 bp, Homo sapiens
catttgcgcacaacttaaaa

SEQ ID NO: 6716978 - DNA, 20 bp, Homo sapiens
catttgctaactagcttgga

SEQ ID NO: 6716979 - DNA, 18 bp, Homo sapiens
catttgctaaggcagctg

SEQ ID NO: 6716980 - DNA, 20 bp, Homo sapiens
catttgctaagtgtatgatg

SEQ ID NO: 6716981 - DNA, 16 bp, Homo sapiens
catttgctaatgaatt

SEQ ID NO: 6716982 - DNA, 18 bp, Homo sapiens
catttgctaatgaatttt

SEQ ID NO: 6716983 - DNA, 21 bp, Homo sapiens
catttgctaatgaattttaaa

SEQ ID NO: 6716984 - DNA, 14 bp, Homo sapiens
catttgctcatgga

SEQ ID NO: 6716985 - DNA, 18 bp, Homo sapiens
catttgctcatggaattg

SEQ ID NO: 6716986 - DNA, 22 bp, Homo sapiens
catttgctcttcagatgccact

SEQ ID NO: 6716987 - DNA, 19 bp, Homo sapiens
catttgctctttcatctct

SEQ ID NO: 6716988 - DNA, 11 bp, Homo sapiens
catttgctgaa

SEQ ID NO: 6716989 - DNA, 13 bp, Homo sapiens
catttgctgaata

SEQ ID NO: 6716990 - DNA, 20 bp, Homo sapiens
catttgctgaatagctacta

SEQ ID NO: 6716991 - DNA, 21 bp, Homo sapiens
catttgctgaatatgcaattt

SEQ ID NO: 6716992 - DNA, 17 bp, Homo sapiens
catttgctgatttctag

SEQ ID NO: 6716993 - DNA, 18 bp, Homo sapiens
catttgctgatttctagt

SEQ ID NO: 6716994 - DNA, 15 bp, Homo sapiens
catttgctgcatggg

SEQ ID NO: 6716995 - DNA, 14 bp, Homo sapiens
catttgctggcctg

SEQ ID NO: 6716996 - DNA, 15 bp, Homo sapiens
catttgctggcctgg

SEQ ID NO: 6716997 - DNA, 17 bp, Homo sapiens
catttgctggcctggca

SEQ ID NO: 6716998 - DNA, 14 bp, Homo sapiens
catttgctgttcat

SEQ ID NO: 6716999 - DNA, 13 bp, Homo sapiens
catttgctgttgt

SEQ ID NO: 6717000 - DNA, 16 bp, Homo sapiens
catttgcttaaacctg

SEQ ID NO: 6717001 - DNA, 20 bp, Homo sapiens
catttgctttgtctcccgga

SEQ ID NO: 6717002 - DNA, 15 bp, Homo sapiens
catttgctttttgtg

SEQ ID NO: 6717003 - DNA, 22 bp, Homo sapiens
catttggaaaccactaaagtag

SEQ ID NO: 6717004 - DNA, 16 bp, Homo sapiens
catttggaaccaaagt

SEQ ID NO: 6717005 - DNA, 20 bp, Homo sapiens
catttggaaggttttaacat

SEQ ID NO: 6717006 - DNA, 12 bp, Homo sapiens
catttggaattg

SEQ ID NO: 6717007 - DNA, 17 bp, Homo sapiens
catttggaattgacgga

SEQ ID NO: 6717008 - DNA, 17 bp, Homo sapiens
catttggaatttttgct

SEQ ID NO: 6717009 - DNA, 17 bp, Homo sapiens
catttggacaaaatgga

SEQ ID NO: 6717010 - DNA, 20 bp, Homo sapiens
catttggagctcttgggtca

SEQ ID NO: 6717011 - DNA, 22 bp, Homo sapiens
catttggagctcttgggtcaga

SEQ ID NO: 6717012 - DNA, 23 bp, Homo sapiens
catttggagctcttgggtcagag

SEQ ID NO: 6717013 - DNA, 14 bp, Homo sapiens
catttggattgggg

SEQ ID NO: 6717014 - DNA, 22 bp, Homo sapiens
catttggattttaaacaaaatt

SEQ ID NO: 6717015 - DNA, 18 bp, Homo sapiens
catttggcactatggttt

SEQ ID NO: 6717016 - DNA, 14 bp, Homo sapiens
catttggcagagtc

SEQ ID NO: 6717017 - DNA, 16 bp, Homo sapiens
catttggcatccctgg

SEQ ID NO: 6717018 - DNA, 16 bp, Homo sapiens
catttggccccagggg

SEQ ID NO: 6717019 - DNA, 17 bp, Homo sapiens
catttggccccagggga

SEQ ID NO: 6717020 - DNA, 15 bp, Homo sapiens
catttggccggctct

SEQ ID NO: 6717021 - DNA, 11 bp, Homo sapiens
catttggcttc

SEQ ID NO: 6717022 - DNA, 15 bp, Homo sapiens
catttggcttcctct

SEQ ID NO: 6717023 - DNA, 20 bp, Homo sapiens
catttggctttccagtcata

SEQ ID NO: 6717024 - DNA, 17 bp, Homo sapiens
catttgggactgtcttg

SEQ ID NO: 6717025 - DNA, 14 bp, Homo sapiens
catttgggcacatt

SEQ ID NO: 6717026 - DNA, 15 bp, Homo sapiens
catttgggctctggt

SEQ ID NO: 6717027 - DNA, 19 bp, Homo sapiens
catttggggcatttgtaaa

SEQ ID NO: 6717028 - DNA, 18 bp, Homo sapiens
catttggggcctttccca

SEQ ID NO: 6717029 - DNA, 23 bp, Homo sapiens
catttggggcctttcccattggt

SEQ ID NO: 6717030 - DNA, 17 bp, Homo sapiens
catttggggtagctaga

SEQ ID NO: 6717031 - DNA, 15 bp, Homo sapiens
catttgggtaaatca

SEQ ID NO: 6717032 - DNA, 22 bp, Homo sapiens
catttgggtattttgtcagttt

SEQ ID NO: 6717033 - DNA, 15 bp, Homo sapiens
catttgggtccagga

SEQ ID NO: 6717034 - DNA, 16 bp, Homo sapiens
catttgggtccaggag

SEQ ID NO: 6717035 - DNA, 23 bp, Homo sapiens
catttggtacacacttgaccttc

SEQ ID NO: 6717036 - DNA, 16 bp, Homo sapiens
catttggtctcaggca

SEQ ID NO: 6717037 - DNA, 13 bp, Homo sapiens
catttggtgcttg

SEQ ID NO: 6717038 - DNA, 23 bp, Homo sapiens
catttggtggcctaatttacaag

SEQ ID NO: 6717039 - DNA, 14 bp, Homo sapiens
catttggtggctct

SEQ ID NO: 6717040 - DNA, 22 bp, Homo sapiens
catttggtgtgttcctgtggga

SEQ ID NO: 6717041 - DNA, 19 bp, Homo sapiens
catttggtgttcctggaag

SEQ ID NO: 6717042 - DNA, 16 bp, Homo sapiens
catttggttaaatcat

SEQ ID NO: 6717043 - DNA, 23 bp, Homo sapiens
catttggttatgttgataaacca

SEQ ID NO: 6717044 - DNA, 21 bp, Homo sapiens
catttggttcattaattctat

SEQ ID NO: 6717045 - DNA, 19 bp, Homo sapiens
catttggttctaagaaacc

SEQ ID NO: 6717046 - DNA, 20 bp, Homo sapiens
catttggtttgattttccct

SEQ ID NO: 6717047 - DNA, 15 bp, Homo sapiens
catttgtaaaaagta

SEQ ID NO: 6717048 - DNA, 14 bp, Homo sapiens
catttgtaaatatt

SEQ ID NO: 6717049 - DNA, 15 bp, Homo sapiens
catttgtaaatatta

SEQ ID NO: 6717050 - DNA, 20 bp, Homo sapiens
catttgtaagtgtaaaaaat

SEQ ID NO: 6717051 - DNA, 23 bp, Homo sapiens
catttgtaatctagttgtcaata

SEQ ID NO: 6717052 - DNA, 15 bp, Homo sapiens
catttgtaatgtatc

SEQ ID NO: 6717053 - DNA, 23 bp, Homo sapiens
catttgtaatttttttctagttg

SEQ ID NO: 6717054 - DNA, 12 bp, Homo sapiens
catttgtacaag

SEQ ID NO: 6717055 - DNA, 17 bp, Homo sapiens
catttgtacaaggtaat

SEQ ID NO: 6717056 - DNA, 20 bp, Homo sapiens
catttgtacaaggtaattgt

SEQ ID NO: 6717057 - DNA, 16 bp, Homo sapiens
catttgtactttattt

SEQ ID NO: 6717058 - DNA, 13 bp, Homo sapiens
catttgtaggtag

SEQ ID NO: 6717059 - DNA, 20 bp, Homo sapiens
catttgtataaaataatttt

SEQ ID NO: 6717060 - DNA, 16 bp, Homo sapiens
catttgtataaagaaa

SEQ ID NO: 6717061 - DNA, 15 bp, Homo sapiens
catttgtatattgtg

SEQ ID NO: 6717062 - DNA, 19 bp, Homo sapiens
catttgtatgtcaaagctt

SEQ ID NO: 6717063 - DNA, 15 bp, Homo sapiens
catttgtatgttgtg

SEQ ID NO: 6717064 - DNA, 23 bp, Homo sapiens
catttgtatgttgtgaagatgtt

SEQ ID NO: 6717065 - DNA, 19 bp, Homo sapiens
catttgtattccattgatt

SEQ ID NO: 6717066 - DNA, 13 bp, Homo sapiens
catttgtattgct

SEQ ID NO: 6717067 - DNA, 17 bp, Homo sapiens
catttgtattgcttatt

SEQ ID NO: 6717068 - DNA, 13 bp, Homo sapiens
catttgtatttgt

SEQ ID NO: 6717069 - DNA, 15 bp, Homo sapiens
catttgtatttgtat

SEQ ID NO: 6717070 - DNA, 12 bp, Homo sapiens
catttgtatttt

SEQ ID NO: 6717071 - DNA, 21 bp, Homo sapiens
catttgtcagtatttttgccg

SEQ ID NO: 6717072 - DNA, 18 bp, Homo sapiens
catttgtcattttcatta

SEQ ID NO: 6717073 - DNA, 12 bp, Homo sapiens
catttgtcccaa

SEQ ID NO: 6717074 - DNA, 13 bp, Homo sapiens
catttgtcccaag

SEQ ID NO: 6717075 - DNA, 13 bp, Homo sapiens
catttgtcctgca

SEQ ID NO: 6717076 - DNA, 18 bp, Homo sapiens
catttgtcctgcagagct

SEQ ID NO: 6717077 - DNA, 18 bp, Homo sapiens
catttgtccttttctgca

SEQ ID NO: 6717078 - DNA, 18 bp, Homo sapiens
catttgtgatatatgtat

SEQ ID NO: 6717079 - DNA, 21 bp, Homo sapiens
catttgtgatcagcattgtga

SEQ ID NO: 6717080 - DNA, 12 bp, Homo sapiens
catttgtgccac

SEQ ID NO: 6717081 - DNA, 16 bp, Homo sapiens
catttgtgccagagga

SEQ ID NO: 6717082 - DNA, 16 bp, Homo sapiens
catttgtgcgtatgca

SEQ ID NO: 6717083 - DNA, 16 bp, Homo sapiens
catttgtgctagaaat

SEQ ID NO: 6717084 - DNA, 18 bp, Homo sapiens
catttgtggcagtccctt

SEQ ID NO: 6717085 - DNA, 22 bp, Homo sapiens
catttgtgggcaagcagatgac

SEQ ID NO: 6717086 - DNA, 23 bp, Homo sapiens
catttgtgggtttttatttccta

SEQ ID NO: 6717087 - DNA, 20 bp, Homo sapiens
catttgtggtcctgaaggaa

SEQ ID NO: 6717088 - DNA, 22 bp, Homo sapiens
catttgtggtgatatagaatta

SEQ ID NO: 6717089 - DNA, 19 bp, Homo sapiens
catttgtggttagaatctt

SEQ ID NO: 6717090 - DNA, 18 bp, Homo sapiens
catttgtgtggaaatcat

SEQ ID NO: 6717091 - DNA, 22 bp, Homo sapiens
catttgtgtgtgtgcaagtgtg

SEQ ID NO: 6717092 - DNA, 16 bp, Homo sapiens
catttgtgttgaagag

SEQ ID NO: 6717093 - DNA, 18 bp, Homo sapiens
catttgttaaaattatca

SEQ ID NO: 6717094 - DNA, 22 bp, Homo sapiens
catttgttaaaattatcaatat

SEQ ID NO: 6717095 - DNA, 13 bp, Homo sapiens
catttgttaatat

SEQ ID NO: 6717096 - DNA, 22 bp, Homo sapiens
catttgttaatatcactcatta

SEQ ID NO: 6717097 - DNA, 18 bp, Homo sapiens
catttgttaatgattctt

SEQ ID NO: 6717098 - DNA, 18 bp, Homo sapiens
catttgttacagtttctt

SEQ ID NO: 6717099 - DNA, 23 bp, Homo sapiens
catttgttatcctcttgtatact

SEQ ID NO: 6717100 - DNA, 16 bp, Homo sapiens
catttgttcagctccc

SEQ ID NO: 6717101 - DNA, 13 bp, Homo sapiens
catttgttcctgc

SEQ ID NO: 6717102 - DNA, 14 bp, Homo sapiens
catttgttgaatag

SEQ ID NO: 6717103 - DNA, 15 bp, Homo sapiens
catttgttgctgctg

SEQ ID NO: 6717104 - DNA, 19 bp, Homo sapiens
catttgttggtaactaatg

SEQ ID NO: 6717105 - DNA, 17 bp, Homo sapiens
catttgttggtttatca

SEQ ID NO: 6717106 - DNA, 20 bp, Homo sapiens
catttgttgtgatgtctttt

SEQ ID NO: 6717107 - DNA, 14 bp, Homo sapiens
catttgttgtttga

SEQ ID NO: 6717108 - DNA, 20 bp, Homo sapiens
catttgtttatgtaatttca

SEQ ID NO: 6717109 - DNA, 15 bp, Homo sapiens
catttgtttctactt

SEQ ID NO: 6717110 - DNA, 21 bp, Homo sapiens
catttgtttctttctctgagg

SEQ ID NO: 6717111 - DNA, 17 bp, Homo sapiens
catttgtttgaactgat

SEQ ID NO: 6717112 - DNA, 22 bp, Homo sapiens
catttgtttgaactgataaaga

SEQ ID NO: 6717113 - DNA, 12 bp, Homo sapiens
catttgtttgct

SEQ ID NO: 6717114 - DNA, 15 bp, Homo sapiens
catttgtttgtattc

SEQ ID NO: 6717115 - DNA, 13 bp, Homo sapiens
catttgttttgct

SEQ ID NO: 6717116 - DNA, 16 bp, Homo sapiens
catttgttttgctttt

SEQ ID NO: 6717117 - DNA, 19 bp, Homo sapiens
catttgttttgtttacaga

SEQ ID NO: 6717118 - DNA, 21 bp, Homo sapiens
cattttaaaaaccaatcattt

SEQ ID NO: 6717119 - DNA, 15 bp, Homo sapiens
cattttaaaaacttt

SEQ ID NO: 6717120 - DNA, 18 bp, Homo sapiens
cattttaaaaactttatt

SEQ ID NO: 6717121 - DNA, 19 bp, Homo sapiens
cattttaaaaactttattg

SEQ ID NO: 6717122 - DNA, 16 bp, Homo sapiens
cattttaaaaataaat

SEQ ID NO: 6717123 - DNA, 21 bp, Homo sapiens
cattttaaaaatagaatacat

SEQ ID NO: 6717124 - DNA, 22 bp, Homo sapiens
cattttaaaagcaattatattg

SEQ ID NO: 6717125 - DNA, 19 bp, Homo sapiens
cattttaaaatgtcttggt

SEQ ID NO: 6717126 - DNA, 22 bp, Homo sapiens
cattttaaacaaaatagaaagt

SEQ ID NO: 6717127 - DNA, 23 bp, Homo sapiens
cattttaaacaaaatagaaagtt

SEQ ID NO: 6717128 - DNA, 15 bp, Homo sapiens
cattttaaatggaca

SEQ ID NO: 6717129 - DNA, 17 bp, Homo sapiens
cattttaaatggacaga

SEQ ID NO: 6717130 - DNA, 14 bp, Homo sapiens
cattttaaatgtct

SEQ ID NO: 6717131 - DNA, 20 bp, Homo sapiens
cattttaaattccactgaaa

SEQ ID NO: 6717132 - DNA, 15 bp, Homo sapiens
cattttaacaagaag

SEQ ID NO: 6717133 - DNA, 11 bp, Homo sapiens
cattttaacat

SEQ ID NO: 6717134 - DNA, 12 bp, Homo sapiens
cattttaacttg

SEQ ID NO: 6717135 - DNA, 17 bp, Homo sapiens
cattttaacttgccaca

SEQ ID NO: 6717136 - DNA, 15 bp, Homo sapiens
cattttaagcataat

SEQ ID NO: 6717137 - DNA, 19 bp, Homo sapiens
cattttaagcataattaat

SEQ ID NO: 6717138 - DNA, 22 bp, Homo sapiens
cattttaaggaaaactacctgt

SEQ ID NO: 6717139 - DNA, 14 bp, Homo sapiens
cattttaaggcaat

SEQ ID NO: 6717140 - DNA, 18 bp, Homo sapiens
cattttaaggttctcaga

SEQ ID NO: 6717141 - DNA, 18 bp, Homo sapiens
cattttaagtaaaagtct

SEQ ID NO: 6717142 - DNA, 18 bp, Homo sapiens
cattttaagtaacgtgct

SEQ ID NO: 6717143 - DNA, 16 bp, Homo sapiens
cattttaagtgcttca

SEQ ID NO: 6717144 - DNA, 22 bp, Homo sapiens
cattttaagtgtttaaaagcaa

SEQ ID NO: 6717145 - DNA, 19 bp, Homo sapiens
cattttaagtttgtagtaa

SEQ ID NO: 6717146 - DNA, 15 bp, Homo sapiens
cattttaatacagat

SEQ ID NO: 6717147 - DNA, 16 bp, Homo sapiens
cattttaatatataat

SEQ ID NO: 6717148 - DNA, 14 bp, Homo sapiens
cattttaattttaa

SEQ ID NO: 6717149 - DNA, 18 bp, Homo sapiens
cattttaattttaaagtg

SEQ ID NO: 6717150 - DNA, 14 bp, Homo sapiens
cattttacaagcat

SEQ ID NO: 6717151 - DNA, 13 bp, Homo sapiens
cattttacacagc

SEQ ID NO: 6717152 - DNA, 16 bp, Homo sapiens
cattttacacttgctt

SEQ ID NO: 6717153 - DNA, 16 bp, Homo sapiens
cattttacagatttct

SEQ ID NO: 6717154 - DNA, 15 bp, Homo sapiens
cattttacagatttt

SEQ ID NO: 6717155 - DNA, 23 bp, Homo sapiens
cattttacagtgaccttttcttc

SEQ ID NO: 6717156 - DNA, 19 bp, Homo sapiens
cattttacagttacttttc

SEQ ID NO: 6717157 - DNA, 16 bp, Homo sapiens
cattttacatagcaca

SEQ ID NO: 6717158 - DNA, 23 bp, Homo sapiens
cattttacctttgacaaaggtaa

SEQ ID NO: 6717159 - DNA, 16 bp, Homo sapiens
cattttacgttttaga

SEQ ID NO: 6717160 - DNA, 22 bp, Homo sapiens
cattttacgttttagaaaattt

SEQ ID NO: 6717161 - DNA, 14 bp, Homo sapiens
cattttactaaaat

SEQ ID NO: 6717162 - DNA, 22 bp, Homo sapiens
cattttactaaaatcgtattct

SEQ ID NO: 6717163 - DNA, 16 bp, Homo sapiens
cattttactatgcctg

SEQ ID NO: 6717164 - DNA, 17 bp, Homo sapiens
cattttactatttgcca

SEQ ID NO: 6717165 - DNA, 15 bp, Homo sapiens
cattttactcagaat

SEQ ID NO: 6717166 - DNA, 16 bp, Homo sapiens
cattttactgtctgta

SEQ ID NO: 6717167 - DNA, 12 bp, Homo sapiens
cattttactgtt

SEQ ID NO: 6717168 - DNA, 20 bp, Homo sapiens
cattttagaaaatcagattt

SEQ ID NO: 6717169 - DNA, 19 bp, Homo sapiens
cattttagaattaaaattt

SEQ ID NO: 6717170 - DNA, 17 bp, Homo sapiens
cattttagacagtaagt

SEQ ID NO: 6717171 - DNA, 12 bp, Homo sapiens
cattttagccca

SEQ ID NO: 6717172 - DNA, 21 bp, Homo sapiens
cattttagcccagtgttttct

SEQ ID NO: 6717173 - DNA, 15 bp, Homo sapiens
cattttagctggtgt

SEQ ID NO: 6717174 - DNA, 15 bp, Homo sapiens
cattttagtcacttt

SEQ ID NO: 6717175 - DNA, 15 bp, Homo sapiens
cattttagtgactgt

SEQ ID NO: 6717176 - DNA, 18 bp, Homo sapiens
cattttagttcctttatt

SEQ ID NO: 6717177 - DNA, 14 bp, Homo sapiens
cattttagttcttt

SEQ ID NO: 6717178 - DNA, 18 bp, Homo sapiens
cattttataaatcgcttt

SEQ ID NO: 6717179 - DNA, 13 bp, Homo sapiens
cattttataattt

SEQ ID NO: 6717180 - DNA, 11 bp, Homo sapiens
cattttataca

SEQ ID NO: 6717181 - DNA, 16 bp, Homo sapiens
cattttatactgtaca

SEQ ID NO: 6717182 - DNA, 19 bp, Homo sapiens
cattttatattgaaaaaaa

SEQ ID NO: 6717183 - DNA, 12 bp, Homo sapiens
cattttatattt

SEQ ID NO: 6717184 - DNA, 20 bp, Homo sapiens
cattttatatttttgtacat

SEQ ID NO: 6717185 - DNA, 22 bp, Homo sapiens
cattttatcaggggaatttcag

SEQ ID NO: 6717186 - DNA, 11 bp, Homo sapiens
cattttatgca

SEQ ID NO: 6717187 - DNA, 20 bp, Homo sapiens
cattttatgtctttcttgta

SEQ ID NO: 6717188 - DNA, 18 bp, Homo sapiens
cattttattaaacatttt

SEQ ID NO: 6717189 - DNA, 19 bp, Homo sapiens
cattttattaaacattttc

SEQ ID NO: 6717190 - DNA, 17 bp, Homo sapiens
cattttattaataatat

SEQ ID NO: 6717191 - DNA, 14 bp, Homo sapiens
cattttattactgt

SEQ ID NO: 6717192 - DNA, 13 bp, Homo sapiens
cattttattgctt

SEQ ID NO: 6717193 - DNA, 18 bp, Homo sapiens
cattttatttacagctgt

SEQ ID NO: 6717194 - DNA, 21 bp, Homo sapiens
cattttattttattatgcatg

SEQ ID NO: 6717195 - DNA, 23 bp, Homo sapiens
cattttattttattatgcatgaa

SEQ ID NO: 6717196 - DNA, 16 bp, Homo sapiens
cattttattttgtaat

SEQ ID NO: 6717197 - DNA, 15 bp, Homo sapiens
cattttattttttgg

SEQ ID NO: 6717198 - DNA, 23 bp, Homo sapiens
cattttcaataacaaaacgaaac

SEQ ID NO: 6717199 - DNA, 15 bp, Homo sapiens
cattttcaatactgt

SEQ ID NO: 6717200 - DNA, 16 bp, Homo sapiens
cattttcaccccaccc

SEQ ID NO: 6717201 - DNA, 17 bp, Homo sapiens
cattttcagaagttaac

SEQ ID NO: 6717202 - DNA, 16 bp, Homo sapiens
cattttcagactgcaa

SEQ ID NO: 6717203 - DNA, 12 bp, Homo sapiens
cattttcagagt

SEQ ID NO: 6717204 - DNA, 16 bp, Homo sapiens
cattttcagagtgaca

SEQ ID NO: 6717205 - DNA, 19 bp, Homo sapiens
cattttcagatccttccaa

SEQ ID NO: 6717206 - DNA, 19 bp, Homo sapiens
cattttcagattcaggcat

SEQ ID NO: 6717207 - DNA, 23 bp, Homo sapiens
cattttcagcatcaaacatgaaa

SEQ ID NO: 6717208 - DNA, 16 bp, Homo sapiens
cattttcagtaccaaa

SEQ ID NO: 6717209 - DNA, 16 bp, Homo sapiens
cattttcatattgtaa

SEQ ID NO: 6717210 - DNA, 11 bp, Homo sapiens
cattttcatct

SEQ ID NO: 6717211 - DNA, 13 bp, Homo sapiens
cattttcatcttc

SEQ ID NO: 6717212 - DNA, 12 bp, Homo sapiens
cattttcatgtg

SEQ ID NO: 6717213 - DNA, 12 bp, Homo sapiens
cattttcattaa

SEQ ID NO: 6717214 - DNA, 19 bp, Homo sapiens
cattttccagtgacttgca

SEQ ID NO: 6717215 - DNA, 12 bp, Homo sapiens
cattttcccaga

SEQ ID NO: 6717216 - DNA, 14 bp, Homo sapiens
cattttcccatcat

SEQ ID NO: 6717217 - DNA, 14 bp, Homo sapiens
cattttccccccac

SEQ ID NO: 6717218 - DNA, 15 bp, Homo sapiens
cattttccccccact

SEQ ID NO: 6717219 - DNA, 22 bp, Homo sapiens
cattttccccccactctcccca

SEQ ID NO: 6717220 - DNA, 17 bp, Homo sapiens
cattttccccttcctca

SEQ ID NO: 6717221 - DNA, 21 bp, Homo sapiens
cattttcctcacacccacctg

SEQ ID NO: 6717222 - DNA, 13 bp, Homo sapiens
cattttcctcctc

SEQ ID NO: 6717223 - DNA, 16 bp, Homo sapiens
cattttcctcctctgc

SEQ ID NO: 6717224 - DNA, 17 bp, Homo sapiens
cattttcctcctctgcc

SEQ ID NO: 6717225 - DNA, 22 bp, Homo sapiens
cattttcctcgcctaggcctgt

SEQ ID NO: 6717226 - DNA, 23 bp, Homo sapiens
cattttcctcttgtcctggccct

SEQ ID NO: 6717227 - DNA, 10 bp, Homo sapiens
cattttcctg

SEQ ID NO: 6717228 - DNA, 20 bp, Homo sapiens
cattttcctgacatttgttt

SEQ ID NO: 6717229 - DNA, 12 bp, Homo sapiens
cattttcctgtt

SEQ ID NO: 6717230 - DNA, 17 bp, Homo sapiens
cattttcctttctgtat

SEQ ID NO: 6717231 - DNA, 12 bp, Homo sapiens
cattttctaaat

SEQ ID NO: 6717232 - DNA, 18 bp, Homo sapiens
cattttctaaataaaaat

SEQ ID NO: 6717233 - DNA, 21 bp, Homo sapiens
cattttctacgtcatgtattt

SEQ ID NO: 6717234 - DNA, 22 bp, Homo sapiens
cattttctacgtcatgtatttt

SEQ ID NO: 6717235 - DNA, 12 bp, Homo sapiens
cattttctagat

SEQ ID NO: 6717236 - DNA, 23 bp, Homo sapiens
cattttctagatacaataaattg

SEQ ID NO: 6717237 - DNA, 20 bp, Homo sapiens
cattttctataagaaaaagg

SEQ ID NO: 6717238 - DNA, 12 bp, Homo sapiens
cattttctcagt

SEQ ID NO: 6717239 - DNA, 16 bp, Homo sapiens
cattttctcctaggag

SEQ ID NO: 6717240 - DNA, 17 bp, Homo sapiens
cattttctctattcttt

SEQ ID NO: 6717241 - DNA, 19 bp, Homo sapiens
cattttctctattctttcc

SEQ ID NO: 6717242 - DNA, 14 bp, Homo sapiens
cattttctcttaga

SEQ ID NO: 6717243 - DNA, 16 bp, Homo sapiens
cattttctcttagaaa

SEQ ID NO: 6717244 - DNA, 20 bp, Homo sapiens
cattttctcttagagatttt

SEQ ID NO: 6717245 - DNA, 18 bp, Homo sapiens
cattttctctttaaaaga

SEQ ID NO: 6717246 - DNA, 19 bp, Homo sapiens
cattttctgacatgcattg

SEQ ID NO: 6717247 - DNA, 22 bp, Homo sapiens
cattttctgacatgcattgttg

SEQ ID NO: 6717248 - DNA, 17 bp, Homo sapiens
cattttctgcaagcctg

SEQ ID NO: 6717249 - DNA, 18 bp, Homo sapiens
cattttctgcaagcctgc

SEQ ID NO: 6717250 - DNA, 14 bp, Homo sapiens
cattttctgcatct

SEQ ID NO: 6717251 - DNA, 22 bp, Homo sapiens
cattttctggccagtgtttaaa

SEQ ID NO: 6717252 - DNA, 18 bp, Homo sapiens
cattttctggtttggcat

SEQ ID NO: 6717253 - DNA, 22 bp, Homo sapiens
cattttctggtttggcatggtg

SEQ ID NO: 6717254 - DNA, 19 bp, Homo sapiens
cattttctgtgtgtacatg

SEQ ID NO: 6717255 - DNA, 12 bp, Homo sapiens
cattttctgtta

SEQ ID NO: 6717256 - DNA, 15 bp, Homo sapiens
cattttcttcacagt

SEQ ID NO: 6717257 - DNA, 21 bp, Homo sapiens
cattttcttcagaattatcca

SEQ ID NO: 6717258 - DNA, 22 bp, Homo sapiens
cattttcttcagagagctaaat

SEQ ID NO: 6717259 - DNA, 22 bp, Homo sapiens
cattttcttgaatttttttctg

SEQ ID NO: 6717260 - DNA, 14 bp, Homo sapiens
cattttcttgtcaa

SEQ ID NO: 6717261 - DNA, 18 bp, Homo sapiens
cattttcttgtcaatgga

SEQ ID NO: 6717262 - DNA, 18 bp, Homo sapiens
cattttcttttcacttcg

SEQ ID NO: 6717263 - DNA, 21 bp, Homo sapiens
cattttcttttgttcttgata

SEQ ID NO: 6717264 - DNA, 18 bp, Homo sapiens
cattttctttttaaattt

SEQ ID NO: 6717265 - DNA, 18 bp, Homo sapiens
cattttctttttttaact

SEQ ID NO: 6717266 - DNA, 19 bp, Homo sapiens
cattttgaaaacccctggc

SEQ ID NO: 6717267 - DNA, 23 bp, Homo sapiens
cattttgaaaacccctggctgaa

SEQ ID NO: 6717268 - DNA, 13 bp, Homo sapiens
cattttgaaacaa

SEQ ID NO: 6717269 - DNA, 14 bp, Homo sapiens
cattttgaaacaaa

SEQ ID NO: 6717270 - DNA, 21 bp, Homo sapiens
cattttgaaagtctgtccttg

SEQ ID NO: 6717271 - DNA, 17 bp, Homo sapiens
cattttgaaataaaaat

SEQ ID NO: 6717272 - DNA, 22 bp, Homo sapiens
cattttgaagctaattatttta

SEQ ID NO: 6717273 - DNA, 23 bp, Homo sapiens
cattttgaatcacatgaattatt

SEQ ID NO: 6717274 - DNA, 16 bp, Homo sapiens
cattttgacaacatgg

SEQ ID NO: 6717275 - DNA, 18 bp, Homo sapiens
cattttgacaacatggct

SEQ ID NO: 6717276 - DNA, 22 bp, Homo sapiens
cattttgacaacatggcttctc

SEQ ID NO: 6717277 - DNA, 14 bp, Homo sapiens
cattttgaccatat

SEQ ID NO: 6717278 - DNA, 15 bp, Homo sapiens
cattttgactggctt

SEQ ID NO: 6717279 - DNA, 12 bp, Homo sapiens
cattttgagcta

SEQ ID NO: 6717280 - DNA, 21 bp, Homo sapiens
cattttgaggttttgtaaaac

SEQ ID NO: 6717281 - DNA, 23 bp, Homo sapiens
cattttgaggttttgtaaaactg

SEQ ID NO: 6717282 - DNA, 12 bp, Homo sapiens
cattttgatgta

SEQ ID NO: 6717283 - DNA, 13 bp, Homo sapiens
cattttgatgtat

SEQ ID NO: 6717284 - DNA, 12 bp, Homo sapiens
cattttgcaaac

SEQ ID NO: 6717285 - DNA, 13 bp, Homo sapiens
cattttgcaaacc

SEQ ID NO: 6717286 - DNA, 14 bp, Homo sapiens
cattttgcactgta

SEQ ID NO: 6717287 - DNA, 15 bp, Homo sapiens
cattttgcagaagga

SEQ ID NO: 6717288 - DNA, 20 bp, Homo sapiens
cattttgcagaaggaaatga

SEQ ID NO: 6717289 - DNA, 22 bp, Homo sapiens
cattttgcagaaggaaatgatg

SEQ ID NO: 6717290 - DNA, 24 bp, Homo sapiens
cattttgcagaaggaaatgatgga

SEQ ID NO: 6717291 - DNA, 20 bp, Homo sapiens
cattttgcagctatggacaa

SEQ ID NO: 6717292 - DNA, 12 bp, Homo sapiens
cattttgcatga

SEQ ID NO: 6717293 - DNA, 13 bp, Homo sapiens
cattttgcattca

SEQ ID NO: 6717294 - DNA, 13 bp, Homo sapiens
cattttgccaaaa

SEQ ID NO: 6717295 - DNA, 15 bp, Homo sapiens
cattttgcctctgtc

SEQ ID NO: 6717296 - DNA, 17 bp, Homo sapiens
cattttgcctgacaatt

SEQ ID NO: 6717297 - DNA, 12 bp, Homo sapiens
cattttgcttta

SEQ ID NO: 6717298 - DNA, 18 bp, Homo sapiens
cattttgctttaatttta

SEQ ID NO: 6717299 - DNA, 11 bp, Homo sapiens
cattttggaaa

SEQ ID NO: 6717300 - DNA, 19 bp, Homo sapiens
cattttggaaggctgaggc

SEQ ID NO: 6717301 - DNA, 20 bp, Homo sapiens
cattttggaagttttcagga

SEQ ID NO: 6717302 - DNA, 20 bp, Homo sapiens
cattttggagagtttcctga

SEQ ID NO: 6717303 - DNA, 13 bp, Homo sapiens
cattttggcatct

SEQ ID NO: 6717304 - DNA, 16 bp, Homo sapiens
cattttgggaaattct

SEQ ID NO: 6717305 - DNA, 21 bp, Homo sapiens
cattttgggccttgctaaatt

SEQ ID NO: 6717306 - DNA, 23 bp, Homo sapiens
cattttgggccttgctaaattga

SEQ ID NO: 6717307 - DNA, 21 bp, Homo sapiens
cattttggggtacccactgct

SEQ ID NO: 6717308 - DNA, 17 bp, Homo sapiens
cattttgggttgtttaa

SEQ ID NO: 6717309 - DNA, 22 bp, Homo sapiens
cattttggtaagagacagaatg

SEQ ID NO: 6717310 - DNA, 23 bp, Homo sapiens
cattttggtaagagacagaatgt

SEQ ID NO: 6717311 - DNA, 14 bp, Homo sapiens
cattttggtacttt

SEQ ID NO: 6717312 - DNA, 14 bp, Homo sapiens
cattttggtgctta

SEQ ID NO: 6717313 - DNA, 19 bp, Homo sapiens
cattttggtttatttttgt

SEQ ID NO: 6717314 - DNA, 23 bp, Homo sapiens
cattttggtttttcctcattgag

SEQ ID NO: 6717315 - DNA, 19 bp, Homo sapiens
cattttgtaaaatattatg

SEQ ID NO: 6717316 - DNA, 13 bp, Homo sapiens
cattttgtaaatc

SEQ ID NO: 6717317 - DNA, 13 bp, Homo sapiens
cattttgtaactg

SEQ ID NO: 6717318 - DNA, 13 bp, Homo sapiens
cattttgtaataa

SEQ ID NO: 6717319 - DNA, 17 bp, Homo sapiens
cattttgtaatatttga

SEQ ID NO: 6717320 - DNA, 23 bp, Homo sapiens
cattttgtacaaagatatgctaa

SEQ ID NO: 6717321 - DNA, 14 bp, Homo sapiens
cattttgtataatt

SEQ ID NO: 6717322 - DNA, 15 bp, Homo sapiens
cattttgtataattg

SEQ ID NO: 6717323 - DNA, 21 bp, Homo sapiens
cattttgtatgctgcatgaaa

SEQ ID NO: 6717324 - DNA, 23 bp, Homo sapiens
cattttgtatggagttaaataaa

SEQ ID NO: 6717325 - DNA, 14 bp, Homo sapiens
cattttgtatgtat

SEQ ID NO: 6717326 - DNA, 14 bp, Homo sapiens
cattttgtctggct

SEQ ID NO: 6717327 - DNA, 16 bp, Homo sapiens
cattttgtctggctgt

SEQ ID NO: 6717328 - DNA, 18 bp, Homo sapiens
cattttgtctggctgtgg

SEQ ID NO: 6717329 - DNA, 21 bp, Homo sapiens
cattttgtctggctgtggccc

SEQ ID NO: 6717330 - DNA, 16 bp, Homo sapiens
cattttgtgaatggat

SEQ ID NO: 6717331 - DNA, 17 bp, Homo sapiens
cattttgtgcagtgatt

SEQ ID NO: 6717332 - DNA, 19 bp, Homo sapiens
cattttgtgtacagtaaac

SEQ ID NO: 6717333 - DNA, 21 bp, Homo sapiens
cattttgtgtcttaagaaaaa

SEQ ID NO: 6717334 - DNA, 14 bp, Homo sapiens
cattttgtgtgaga

SEQ ID NO: 6717335 - DNA, 15 bp, Homo sapiens
cattttgtgtgagac

SEQ ID NO: 6717336 - DNA, 22 bp, Homo sapiens
cattttgtgtgagacttaaaac

SEQ ID NO: 6717337 - DNA, 23 bp, Homo sapiens
cattttgtgtgagacttaaaaca

SEQ ID NO: 6717338 - DNA, 20 bp, Homo sapiens
cattttgttaaaatctactt

SEQ ID NO: 6717339 - DNA, 14 bp, Homo sapiens
cattttgttacata

SEQ ID NO: 6717340 - DNA, 15 bp, Homo sapiens
cattttgttatagaa

SEQ ID NO: 6717341 - DNA, 13 bp, Homo sapiens
cattttgttctta

SEQ ID NO: 6717342 - DNA, 19 bp, Homo sapiens
cattttgttcttacacata

SEQ ID NO: 6717343 - DNA, 12 bp, Homo sapiens
cattttgttgta

SEQ ID NO: 6717344 - DNA, 15 bp, Homo sapiens
cattttgttgtaaaa

SEQ ID NO: 6717345 - DNA, 20 bp, Homo sapiens
cattttgttgtaaaaagaaa

SEQ ID NO: 6717346 - DNA, 23 bp, Homo sapiens
cattttgttgtaaaaagaaaaac

SEQ ID NO: 6717347 - DNA, 15 bp, Homo sapiens
cattttgtttctgta

SEQ ID NO: 6717348 - DNA, 19 bp, Homo sapiens
cattttgtttggtattgta

SEQ ID NO: 6717349 - DNA, 18 bp, Homo sapiens
cattttgttttgctctga

SEQ ID NO: 6717350 - DNA, 21 bp, Homo sapiens
cattttgtttttaatgcagaa

SEQ ID NO: 6717351 - DNA, 15 bp, Homo sapiens
cattttgtttttact

SEQ ID NO: 6717352 - DNA, 16 bp, Homo sapiens
cattttgtttttactg

SEQ ID NO: 6717353 - DNA, 19 bp, Homo sapiens
catttttaaagcctggctt

SEQ ID NO: 6717354 - DNA, 14 bp, Homo sapiens
catttttaaagctt

SEQ ID NO: 6717355 - DNA, 21 bp, Homo sapiens
catttttaaaggacaaacagt

SEQ ID NO: 6717356 - DNA, 22 bp, Homo sapiens
catttttaaaggacaaacagtg

SEQ ID NO: 6717357 - DNA, 23 bp, Homo sapiens
catttttaaaggacaaacagtga

SEQ ID NO: 6717358 - DNA, 13 bp, Homo sapiens
catttttaaatgt

SEQ ID NO: 6717359 - DNA, 14 bp, Homo sapiens
catttttaaatgtg

SEQ ID NO: 6717360 - DNA, 19 bp, Homo sapiens
catttttaaattcttactc

SEQ ID NO: 6717361 - DNA, 15 bp, Homo sapiens
catttttaaccactt

SEQ ID NO: 6717362 - DNA, 21 bp, Homo sapiens
catttttaagaaaggaagcaa

SEQ ID NO: 6717363 - DNA, 21 bp, Homo sapiens
catttttaagatagaacacaa

SEQ ID NO: 6717364 - DNA, 22 bp, Homo sapiens
catttttaagctccatgtgcat

SEQ ID NO: 6717365 - DNA, 18 bp, Homo sapiens
catttttaaggctgtgtg

SEQ ID NO: 6717366 - DNA, 20 bp, Homo sapiens
catttttaagtgctgcattt

SEQ ID NO: 6717367 - DNA, 18 bp, Homo sapiens
catttttaatgtatctat

SEQ ID NO: 6717368 - DNA, 22 bp, Homo sapiens
catttttaatgtatctatttgt

SEQ ID NO: 6717369 - DNA, 20 bp, Homo sapiens
catttttaattcacgtgctt

SEQ ID NO: 6717370 - DNA, 21 bp, Homo sapiens
catttttaattcacgtgcttt

SEQ ID NO: 6717371 - DNA, 14 bp, Homo sapiens
catttttacaagtt

SEQ ID NO: 6717372 - DNA, 15 bp, Homo sapiens
catttttacaataaa

SEQ ID NO: 6717373 - DNA, 16 bp, Homo sapiens
catttttacaatgtaa

SEQ ID NO: 6717374 - DNA, 13 bp, Homo sapiens
catttttacacta

SEQ ID NO: 6717375 - DNA, 18 bp, Homo sapiens
catttttactaaagcagt

SEQ ID NO: 6717376 - DNA, 23 bp, Homo sapiens
catttttactactattctgttaa

SEQ ID NO: 6717377 - DNA, 20 bp, Homo sapiens
catttttactattgttacat

SEQ ID NO: 6717378 - DNA, 22 bp, Homo sapiens
catttttataaactaccaaatt

SEQ ID NO: 6717379 - DNA, 13 bp, Homo sapiens
catttttatacag

SEQ ID NO: 6717380 - DNA, 20 bp, Homo sapiens
catttttatacctgtttaaa

SEQ ID NO: 6717381 - DNA, 18 bp, Homo sapiens
catttttatatgaaataa

SEQ ID NO: 6717382 - DNA, 16 bp, Homo sapiens
catttttatgcagaca

SEQ ID NO: 6717383 - DNA, 15 bp, Homo sapiens
catttttattagaaa

SEQ ID NO: 6717384 - DNA, 14 bp, Homo sapiens
catttttattatat

SEQ ID NO: 6717385 - DNA, 20 bp, Homo sapiens
catttttattcatgccatct

SEQ ID NO: 6717386 - DNA, 23 bp, Homo sapiens
catttttatttcagattttgata

SEQ ID NO: 6717387 - DNA, 14 bp, Homo sapiens
catttttatttctt

SEQ ID NO: 6717388 - DNA, 21 bp, Homo sapiens
catttttcaaaaagtaaaaag

SEQ ID NO: 6717389 - DNA, 17 bp, Homo sapiens
catttttcaatagcaca

SEQ ID NO: 6717390 - DNA, 21 bp, Homo sapiens
catttttcagagttttctaac

SEQ ID NO: 6717391 - DNA, 20 bp, Homo sapiens
catttttcagatataaaaga

SEQ ID NO: 6717392 - DNA, 23 bp, Homo sapiens
catttttcagcagcaaaaccaaa

SEQ ID NO: 6717393 - DNA, 11 bp, Homo sapiens
catttttcata

SEQ ID NO: 6717394 - DNA, 16 bp, Homo sapiens
catttttcatactgaa

SEQ ID NO: 6717395 - DNA, 13 bp, Homo sapiens
catttttcattca

SEQ ID NO: 6717396 - DNA, 14 bp, Homo sapiens
catttttcattcat

SEQ ID NO: 6717397 - DNA, 17 bp, Homo sapiens
catttttcattcatgaa

SEQ ID NO: 6717398 - DNA, 15 bp, Homo sapiens
catttttcccaggac

SEQ ID NO: 6717399 - DNA, 13 bp, Homo sapiens
catttttcctaac

SEQ ID NO: 6717400 - DNA, 18 bp, Homo sapiens
catttttcctctgttcac

SEQ ID NO: 6717401 - DNA, 11 bp, Homo sapiens
catttttcctt

SEQ ID NO: 6717402 - DNA, 14 bp, Homo sapiens
catttttcctttag

SEQ ID NO: 6717403 - DNA, 20 bp, Homo sapiens
catttttctaataatcataa

SEQ ID NO: 6717404 - DNA, 23 bp, Homo sapiens
catttttctataaatcagtattt

SEQ ID NO: 6717405 - DNA, 21 bp, Homo sapiens
catttttctcccaagaaacct

SEQ ID NO: 6717406 - DNA, 22 bp, Homo sapiens
catttttctcccaagaaacctg

SEQ ID NO: 6717407 - DNA, 12 bp, Homo sapiens
catttttctgca

SEQ ID NO: 6717408 - DNA, 14 bp, Homo sapiens
catttttcttgttt

SEQ ID NO: 6717409 - DNA, 14 bp, Homo sapiens
catttttgagccaa

SEQ ID NO: 6717410 - DNA, 16 bp, Homo sapiens
catttttgaggaagtt

SEQ ID NO: 6717411 - DNA, 22 bp, Homo sapiens
catttttgagtaaaacttgtat

SEQ ID NO: 6717412 - DNA, 18 bp, Homo sapiens
catttttgatcaaatgta

SEQ ID NO: 6717413 - DNA, 17 bp, Homo sapiens
catttttgatttatgca

SEQ ID NO: 6717414 - DNA, 17 bp, Homo sapiens
catttttgatttcaggt

SEQ ID NO: 6717415 - DNA, 20 bp, Homo sapiens
catttttgcaaatctaaagt

SEQ ID NO: 6717416 - DNA, 14 bp, Homo sapiens
catttttgccaaaa

SEQ ID NO: 6717417 - DNA, 17 bp, Homo sapiens
catttttgctgaattca

SEQ ID NO: 6717418 - DNA, 12 bp, Homo sapiens
catttttgtaaa

SEQ ID NO: 6717419 - DNA, 20 bp, Homo sapiens
catttttgtaataacattta

SEQ ID NO: 6717420 - DNA, 16 bp, Homo sapiens
catttttgtacattat

SEQ ID NO: 6717421 - DNA, 17 bp, Homo sapiens
catttttgtataaaaag

SEQ ID NO: 6717422 - DNA, 23 bp, Homo sapiens
catttttgtataaaaaggaaatt

SEQ ID NO: 6717423 - DNA, 15 bp, Homo sapiens
catttttgtattttg

SEQ ID NO: 6717424 - DNA, 23 bp, Homo sapiens
catttttgtatttttcatcttta

SEQ ID NO: 6717425 - DNA, 22 bp, Homo sapiens
catttttgtcagtctgagtcat

SEQ ID NO: 6717426 - DNA, 23 bp, Homo sapiens
catttttgtgagcctctttgtaa

SEQ ID NO: 6717427 - DNA, 16 bp, Homo sapiens
catttttgttcttatg

SEQ ID NO: 6717428 - DNA, 18 bp, Homo sapiens
catttttgttttgaaagt

SEQ ID NO: 6717429 - DNA, 23 bp, Homo sapiens
catttttgtttttggtttcttat

SEQ ID NO: 6717430 - DNA, 16 bp, Homo sapiens
cattttttaaaaaatc

SEQ ID NO: 6717431 - DNA, 16 bp, Homo sapiens
cattttttaaaacaag

SEQ ID NO: 6717432 - DNA, 17 bp, Homo sapiens
cattttttaaaagcctt

SEQ ID NO: 6717433 - DNA, 14 bp, Homo sapiens
cattttttacttga

SEQ ID NO: 6717434 - DNA, 18 bp, Homo sapiens
cattttttacttgaatca

SEQ ID NO: 6717435 - DNA, 16 bp, Homo sapiens
cattttttaggtgctt

SEQ ID NO: 6717436 - DNA, 12 bp, Homo sapiens
cattttttatga

SEQ ID NO: 6717437 - DNA, 22 bp, Homo sapiens
cattttttatggctgcatagta

SEQ ID NO: 6717438 - DNA, 12 bp, Homo sapiens
cattttttcctg

SEQ ID NO: 6717439 - DNA, 14 bp, Homo sapiens
cattttttctaata

SEQ ID NO: 6717440 - DNA, 13 bp, Homo sapiens
cattttttcttca

SEQ ID NO: 6717441 - DNA, 14 bp, Homo sapiens
cattttttcttctg

SEQ ID NO: 6717442 - DNA, 20 bp, Homo sapiens
cattttttgaaatgctgaaa

SEQ ID NO: 6717443 - DNA, 22 bp, Homo sapiens
cattttttgaggtatcactgca

SEQ ID NO: 6717444 - DNA, 14 bp, Homo sapiens
cattttttgctata

SEQ ID NO: 6717445 - DNA, 19 bp, Homo sapiens
cattttttgggcagcaatt

SEQ ID NO: 6717446 - DNA, 15 bp, Homo sapiens
cattttttgtctgtg

SEQ ID NO: 6717447 - DNA, 12 bp, Homo sapiens
catttttttaga

SEQ ID NO: 6717448 - DNA, 16 bp, Homo sapiens
catttttttagtttgt

SEQ ID NO: 6717449 - DNA, 15 bp, Homo sapiens
catttttttattcag

SEQ ID NO: 6717450 - DNA, 19 bp, Homo sapiens
catttttttcactcagaat

SEQ ID NO: 6717451 - DNA, 18 bp, Homo sapiens
catttttttccaggctgg

SEQ ID NO: 6717452 - DNA, 16 bp, Homo sapiens
catttttttctttact

SEQ ID NO: 6717453 - DNA, 16 bp, Homo sapiens
catttttttgttccaa

SEQ ID NO: 6717454 - DNA, 23 bp, Homo sapiens
cattttttttaagaaaaaggatg

SEQ ID NO: 6717455 - DNA, 21 bp, Homo sapiens
cattttttttatattgcctta

SEQ ID NO: 6717456 - DNA, 22 bp, Homo sapiens
cattttttttatattgccttat

SEQ ID NO: 6717457 - DNA, 21 bp, Homo sapiens
cattttttttcagcagactat

SEQ ID NO: 6717458 - DNA, 15 bp, Homo sapiens
cattttttttctttg

SEQ ID NO: 6717459 - DNA, 17 bp, Homo sapiens
catttttttttttaatt

SEQ ID NO: 6717460 - DNA, 18 bp, Homo sapiens
cattttttttttttcctt

SEQ ID NO: 6717461 - DNA, 19 bp, Homo sapiens
cattttttttttttccttt

SEQ ID NO: 6717462 - DNA, 19 bp, Homo sapiens
ccaaaaaaaaatacatgct

SEQ ID NO: 6717463 - DNA, 17 bp, Homo sapiens
ccaaaaaaaggaaaaat

SEQ ID NO: 6717464 - DNA, 23 bp, Homo sapiens
ccaaaaaaaggaaaaataatcaa

SEQ ID NO: 6717465 - DNA, 15 bp, Homo sapiens
ccaaaaaaccccagc

SEQ ID NO: 6717466 - DNA, 14 bp, Homo sapiens
ccaaaaaagaaagt

SEQ ID NO: 6717467 - DNA, 21 bp, Homo sapiens
ccaaaaaaggacgtaaaattt

SEQ ID NO: 6717468 - DNA, 16 bp, Homo sapiens
ccaaaaacaaagtgca

SEQ ID NO: 6717469 - DNA, 21 bp, Homo sapiens
ccaaaaacatttgattaataa

SEQ ID NO: 6717470 - DNA, 22 bp, Homo sapiens
ccaaaaacatttgattaataaa

SEQ ID NO: 6717471 - DNA, 18 bp, Homo sapiens
ccaaaaaccaaaagtgca

SEQ ID NO: 6717472 - DNA, 20 bp, Homo sapiens
ccaaaaaccagtattgtaca

SEQ ID NO: 6717473 - DNA, 15 bp, Homo sapiens
ccaaaaagaccagac

SEQ ID NO: 6717474 - DNA, 23 bp, Homo sapiens
ccaaaaagatgctttaattgtgt

SEQ ID NO: 6717475 - DNA, 14 bp, Homo sapiens
ccaaaaagcacata

SEQ ID NO: 6717476 - DNA, 17 bp, Homo sapiens
ccaaaaagctctgaaaa

SEQ ID NO: 6717477 - DNA, 21 bp, Homo sapiens
ccaaaaaggcaaataatggaa

SEQ ID NO: 6717478 - DNA, 16 bp, Homo sapiens
ccaaaaagtgaaataa

SEQ ID NO: 6717479 - DNA, 22 bp, Homo sapiens
ccaaaaatagaaattagatttg

SEQ ID NO: 6717480 - DNA, 13 bp, Homo sapiens
ccaaaaatagcta

SEQ ID NO: 6717481 - DNA, 22 bp, Homo sapiens
ccaaaaattacttagtattgca

SEQ ID NO: 6717482 - DNA, 13 bp, Homo sapiens
ccaaaaattatta

SEQ ID NO: 6717483 - DNA, 18 bp, Homo sapiens
ccaaaacaagccaaagag

SEQ ID NO: 6717484 - DNA, 16 bp, Homo sapiens
ccaaaacaagcctggt

SEQ ID NO: 6717485 - DNA, 19 bp, Homo sapiens
ccaaaacaatctatttaaa

SEQ ID NO: 6717486 - DNA, 14 bp, Homo sapiens
ccaaaacaatgttt

SEQ ID NO: 6717487 - DNA, 23 bp, Homo sapiens
ccaaaacagctttgtctccaaag

SEQ ID NO: 6717488 - DNA, 18 bp, Homo sapiens
ccaaaacataaaaaccaa

SEQ ID NO: 6717489 - DNA, 22 bp, Homo sapiens
ccaaaacattccgtttacattt

SEQ ID NO: 6717490 - DNA, 18 bp, Homo sapiens
ccaaaacatttctggaca

SEQ ID NO: 6717491 - DNA, 21 bp, Homo sapiens
ccaaaacattttaaatgaaag

SEQ ID NO: 6717492 - DNA, 16 bp, Homo sapiens
ccaaaaccaatgctga

SEQ ID NO: 6717493 - DNA, 17 bp, Homo sapiens
ccaaaaccaatgctgat

SEQ ID NO: 6717494 - DNA, 21 bp, Homo sapiens
ccaaaaccaatgctgatgacc

SEQ ID NO: 6717495 - DNA, 15 bp, Homo sapiens
ccaaaacccatcgtg

SEQ ID NO: 6717496 - DNA, 19 bp, Homo sapiens
ccaaaaccgccagctctgt

SEQ ID NO: 6717497 - DNA, 22 bp, Homo sapiens
ccaaaacctcatgacagccaga

SEQ ID NO: 6717498 - DNA, 22 bp, Homo sapiens
ccaaaacgtgggtatttcctgc

SEQ ID NO: 6717499 - DNA, 12 bp, Homo sapiens
ccaaaactgctc

SEQ ID NO: 6717500 - DNA, 13 bp, Homo sapiens
ccaaaacttccaa

SEQ ID NO: 6717501 - DNA, 14 bp, Homo sapiens
ccaaaacttctctt

SEQ ID NO: 6717502 - DNA, 15 bp, Homo sapiens
ccaaaagaaactgac

SEQ ID NO: 6717503 - DNA, 16 bp, Homo sapiens
ccaaaagaaactgaca

SEQ ID NO: 6717504 - DNA, 22 bp, Homo sapiens
ccaaaagaagcccccagctaag

SEQ ID NO: 6717505 - DNA, 17 bp, Homo sapiens
ccaaaagatctggggag

SEQ ID NO: 6717506 - DNA, 14 bp, Homo sapiens
ccaaaagatgcctt

SEQ ID NO: 6717507 - DNA, 23 bp, Homo sapiens
ccaaaagccatgtatttcaggga

SEQ ID NO: 6717508 - DNA, 15 bp, Homo sapiens
ccaaaagctagacag

SEQ ID NO: 6717509 - DNA, 15 bp, Homo sapiens
ccaaaagctgctttc

SEQ ID NO: 6717510 - DNA, 16 bp, Homo sapiens
ccaaaaggaaaaagct

SEQ ID NO: 6717511 - DNA, 18 bp, Homo sapiens
ccaaaaggaaaaagctcc

SEQ ID NO: 6717512 - DNA, 14 bp, Homo sapiens
ccaaaaggcagaag

SEQ ID NO: 6717513 - DNA, 11 bp, Homo sapiens
ccaaaagggaa

SEQ ID NO: 6717514 - DNA, 16 bp, Homo sapiens
ccaaaagggaaaaaat

SEQ ID NO: 6717515 - DNA, 20 bp, Homo sapiens
ccaaaagggcagccaggggc

SEQ ID NO: 6717516 - DNA, 21 bp, Homo sapiens
ccaaaagggcagccaggggct

SEQ ID NO: 6717517 - DNA, 23 bp, Homo sapiens
ccaaaaggtttaagaaatagaat

SEQ ID NO: 6717518 - DNA, 19 bp, Homo sapiens
ccaaaagtccctccctgcc

SEQ ID NO: 6717519 - DNA, 20 bp, Homo sapiens
ccaaaagtgagatgggaagg

SEQ ID NO: 6717520 - DNA, 18 bp, Homo sapiens
ccaaaagtggaagtgaca

SEQ ID NO: 6717521 - DNA, 15 bp, Homo sapiens
ccaaaagtggcctct

SEQ ID NO: 6717522 - DNA, 18 bp, Homo sapiens
ccaaaagttcaacaacac

SEQ ID NO: 6717523 - DNA, 17 bp, Homo sapiens
ccaaaagttttcctgag

SEQ ID NO: 6717524 - DNA, 21 bp, Homo sapiens
ccaaaataactgagaaagaga

SEQ ID NO: 6717525 - DNA, 17 bp, Homo sapiens
ccaaaataagaaaagat

SEQ ID NO: 6717526 - DNA, 23 bp, Homo sapiens
ccaaaataatctatattaaatga

SEQ ID NO: 6717527 - DNA, 14 bp, Homo sapiens
ccaaaataatgtct

SEQ ID NO: 6717528 - DNA, 14 bp, Homo sapiens
ccaaaatacaatgt

SEQ ID NO: 6717529 - DNA, 23 bp, Homo sapiens
ccaaaataccactagtggaaagt

SEQ ID NO: 6717530 - DNA, 20 bp, Homo sapiens
ccaaaataccagagccttca

SEQ ID NO: 6717531 - DNA, 20 bp, Homo sapiens
ccaaaatactccaaagatga

SEQ ID NO: 6717532 - DNA, 19 bp, Homo sapiens
ccaaaatattaacattctt

SEQ ID NO: 6717533 - DNA, 18 bp, Homo sapiens
ccaaaatattttttgcaa

SEQ ID NO: 6717534 - DNA, 20 bp, Homo sapiens
ccaaaatcataagatatttt

SEQ ID NO: 6717535 - DNA, 12 bp, Homo sapiens
ccaaaatcattc

SEQ ID NO: 6717536 - DNA, 16 bp, Homo sapiens
ccaaaatcccctcagc

SEQ ID NO: 6717537 - DNA, 20 bp, Homo sapiens
ccaaaatggtgggattacag

SEQ ID NO: 6717538 - DNA, 13 bp, Homo sapiens
ccaaaatgtcaat

SEQ ID NO: 6717539 - DNA, 11 bp, Homo sapiens
ccaaaatgtga

SEQ ID NO: 6717540 - DNA, 13 bp, Homo sapiens
ccaaaatgtgaag

SEQ ID NO: 6717541 - DNA, 14 bp, Homo sapiens
ccaaaatgtgcctc

SEQ ID NO: 6717542 - DNA, 15 bp, Homo sapiens
ccaaaatgtggaatg

SEQ ID NO: 6717543 - DNA, 17 bp, Homo sapiens
ccaaaatgttgaaatat

SEQ ID NO: 6717544 - DNA, 21 bp, Homo sapiens
ccaaaatgttggtcattttat

SEQ ID NO: 6717545 - DNA, 20 bp, Homo sapiens
ccaaaattactaataaattg

SEQ ID NO: 6717546 - DNA, 22 bp, Homo sapiens
ccaaaattcagaacatcctcca

SEQ ID NO: 6717547 - DNA, 16 bp, Homo sapiens
ccaaaatttattttat

SEQ ID NO: 6717548 - DNA, 21 bp, Homo sapiens
ccaaaattttgtcccatctct

SEQ ID NO: 6717549 - DNA, 12 bp, Homo sapiens
ccaaaattttta

SEQ ID NO: 6717550 - DNA, 13 bp, Homo sapiens
ccaaacaagcctt

SEQ ID NO: 6717551 - DNA, 12 bp, Homo sapiens
ccaaacaaggaa

SEQ ID NO: 6717552 - DNA, 18 bp, Homo sapiens
ccaaacaaggaagccaaa

SEQ ID NO: 6717553 - DNA, 13 bp, Homo sapiens
ccaaacaattatt

SEQ ID NO: 6717554 - DNA, 14 bp, Homo sapiens
ccaaacaattctga

SEQ ID NO: 6717555 - DNA, 16 bp, Homo sapiens
ccaaacaattctgatg

SEQ ID NO: 6717556 - DNA, 17 bp, Homo sapiens
ccaaacacaaaacattc

SEQ ID NO: 6717557 - DNA, 13 bp, Homo sapiens
ccaaacacacaga

SEQ ID NO: 6717558 - DNA, 18 bp, Homo sapiens
ccaaacacacagaagggg

SEQ ID NO: 6717559 - DNA, 16 bp, Homo sapiens
ccaaacacactgtaaa

SEQ ID NO: 6717560 - DNA, 16 bp, Homo sapiens
ccaaacaccagtcacc

SEQ ID NO: 6717561 - DNA, 17 bp, Homo sapiens
ccaaacaccagtcacct

SEQ ID NO: 6717562 - DNA, 13 bp, Homo sapiens
ccaaacaccttca

SEQ ID NO: 6717563 - DNA, 15 bp, Homo sapiens
ccaaacaccttccag

SEQ ID NO: 6717564 - DNA, 12 bp, Homo sapiens
ccaaacactcag

SEQ ID NO: 6717565 - DNA, 12 bp, Homo sapiens
ccaaacactcca

SEQ ID NO: 6717566 - DNA, 15 bp, Homo sapiens
ccaaacactgaggca

SEQ ID NO: 6717567 - DNA, 17 bp, Homo sapiens
ccaaacactgaggcagc

SEQ ID NO: 6717568 - DNA, 15 bp, Homo sapiens
ccaaacacttctgct

SEQ ID NO: 6717569 - DNA, 17 bp, Homo sapiens
ccaaacacttctgcttt

SEQ ID NO: 6717570 - DNA, 14 bp, Homo sapiens
ccaaacagacaaaa

SEQ ID NO: 6717571 - DNA, 12 bp, Homo sapiens
ccaaacagagcc

SEQ ID NO: 6717572 - DNA, 15 bp, Homo sapiens
ccaaacagagcccag

SEQ ID NO: 6717573 - DNA, 13 bp, Homo sapiens
ccaaacagagggc

SEQ ID NO: 6717574 - DNA, 22 bp, Homo sapiens
ccaaacagcaaaccaagagatt

SEQ ID NO: 6717575 - DNA, 15 bp, Homo sapiens
ccaaacagcatgtgc

SEQ ID NO: 6717576 - DNA, 16 bp, Homo sapiens
ccaaacaggctcagag

SEQ ID NO: 6717577 - DNA, 16 bp, Homo sapiens
ccaaacaggtgctggc

SEQ ID NO: 6717578 - DNA, 17 bp, Homo sapiens
ccaaacaggtgctggcc

SEQ ID NO: 6717579 - DNA, 13 bp, Homo sapiens
ccaaacagtgaca

SEQ ID NO: 6717580 - DNA, 19 bp, Homo sapiens
ccaaacatcctacaagaca

SEQ ID NO: 6717581 - DNA, 13 bp, Homo sapiens
ccaaacatctggc

SEQ ID NO: 6717582 - DNA, 15 bp, Homo sapiens
ccaaacatgtattta

SEQ ID NO: 6717583 - DNA, 18 bp, Homo sapiens
ccaaacattaatgttgat

SEQ ID NO: 6717584 - DNA, 20 bp, Homo sapiens
ccaaaccaccagaagcccag

SEQ ID NO: 6717585 - DNA, 14 bp, Homo sapiens
ccaaaccacttttt

SEQ ID NO: 6717586 - DNA, 14 bp, Homo sapiens
ccaaaccaggggga

SEQ ID NO: 6717587 - DNA, 20 bp, Homo sapiens
ccaaaccagtttattctgtg

SEQ ID NO: 6717588 - DNA, 23 bp, Homo sapiens
ccaaaccagtttattctgtggtt

SEQ ID NO: 6717589 - DNA, 12 bp, Homo sapiens
ccaaaccataaa

SEQ ID NO: 6717590 - DNA, 17 bp, Homo sapiens
ccaaaccatcagctgct

SEQ ID NO: 6717591 - DNA, 23 bp, Homo sapiens
ccaaacccacgcgtgttctgaag

SEQ ID NO: 6717592 - DNA, 19 bp, Homo sapiens
ccaaacccacttctggcct

SEQ ID NO: 6717593 - DNA, 15 bp, Homo sapiens
ccaaacccagacaac

SEQ ID NO: 6717594 - DNA, 11 bp, Homo sapiens
ccaaacccagc

SEQ ID NO: 6717595 - DNA, 12 bp, Homo sapiens
ccaaacccagcc

SEQ ID NO: 6717596 - DNA, 16 bp, Homo sapiens
ccaaacccagccactg

SEQ ID NO: 6717597 - DNA, 17 bp, Homo sapiens
ccaaacccagccactgc

SEQ ID NO: 6717598 - DNA, 13 bp, Homo sapiens
ccaaacccagccc

SEQ ID NO: 6717599 - DNA, 15 bp, Homo sapiens
ccaaacccaggctat

SEQ ID NO: 6717600 - DNA, 16 bp, Homo sapiens
ccaaacccatggctct

SEQ ID NO: 6717601 - DNA, 12 bp, Homo sapiens
ccaaaccccagc

SEQ ID NO: 6717602 - DNA, 16 bp, Homo sapiens
ccaaaccccctgcagc

SEQ ID NO: 6717603 - DNA, 15 bp, Homo sapiens
ccaaaccccggggct

SEQ ID NO: 6717604 - DNA, 14 bp, Homo sapiens
ccaaaccctcctgg

SEQ ID NO: 6717605 - DNA, 15 bp, Homo sapiens
ccaaaccctcctggg

SEQ ID NO: 6717606 - DNA, 21 bp, Homo sapiens
ccaaacccttagcagcccagc

SEQ ID NO: 6717607 - DNA, 19 bp, Homo sapiens
ccaaacccttcaactcctg

SEQ ID NO: 6717608 - DNA, 21 bp, Homo sapiens
ccaaacccttcaactcctggc

SEQ ID NO: 6717609 - DNA, 17 bp, Homo sapiens
ccaaaccgccagcgaac

SEQ ID NO: 6717610 - DNA, 18 bp, Homo sapiens
ccaaacctacaagaacta

SEQ ID NO: 6717611 - DNA, 23 bp, Homo sapiens
ccaaacctaccttatagagcaca

SEQ ID NO: 6717612 - DNA, 19 bp, Homo sapiens
ccaaacctcacactactgt

SEQ ID NO: 6717613 - DNA, 16 bp, Homo sapiens
ccaaacctcaccaact

SEQ ID NO: 6717614 - DNA, 17 bp, Homo sapiens
ccaaacctcctgtcagt

SEQ ID NO: 6717615 - DNA, 20 bp, Homo sapiens
ccaaacctcctgtcagtgag

SEQ ID NO: 6717616 - DNA, 12 bp, Homo sapiens
ccaaacctctgt

SEQ ID NO: 6717617 - DNA, 17 bp, Homo sapiens
ccaaacctctgtgagca

SEQ ID NO: 6717618 - DNA, 14 bp, Homo sapiens
ccaaacctctgttc

SEQ ID NO: 6717619 - DNA, 20 bp, Homo sapiens
ccaaacctctgttcagtgta

SEQ ID NO: 6717620 - DNA, 14 bp, Homo sapiens
ccaaacctgggaag

SEQ ID NO: 6717621 - DNA, 13 bp, Homo sapiens
ccaaacctggttc

SEQ ID NO: 6717622 - DNA, 21 bp, Homo sapiens
ccaaaccttcacacacagact

SEQ ID NO: 6717623 - DNA, 16 bp, Homo sapiens
ccaaaccttctaccct

SEQ ID NO: 6717624 - DNA, 22 bp, Homo sapiens
ccaaacgccctttcctcctcag

SEQ ID NO: 6717625 - DNA, 19 bp, Homo sapiens
ccaaacggaactcttcatc

SEQ ID NO: 6717626 - DNA, 14 bp, Homo sapiens
ccaaacgtatttta

SEQ ID NO: 6717627 - DNA, 15 bp, Homo sapiens
ccaaactactttctt

SEQ ID NO: 6717628 - DNA, 17 bp, Homo sapiens
ccaaactcacctgcccc

SEQ ID NO: 6717629 - DNA, 19 bp, Homo sapiens
ccaaactcccaggacctgg

SEQ ID NO: 6717630 - DNA, 22 bp, Homo sapiens
ccaaactccccttccctgggga

SEQ ID NO: 6717631 - DNA, 16 bp, Homo sapiens
ccaaactcctgcctgt

SEQ ID NO: 6717632 - DNA, 18 bp, Homo sapiens
ccaaactctctagtgcag

SEQ ID NO: 6717633 - DNA, 13 bp, Homo sapiens
ccaaactctgcca

SEQ ID NO: 6717634 - DNA, 18 bp, Homo sapiens
ccaaactcttccctctct

SEQ ID NO: 6717635 - DNA, 12 bp, Homo sapiens
ccaaactgacaa

SEQ ID NO: 6717636 - DNA, 16 bp, Homo sapiens
ccaaactgacaatttt

SEQ ID NO: 6717637 - DNA, 20 bp, Homo sapiens
ccaaactgacaattttacct

SEQ ID NO: 6717638 - DNA, 20 bp, Homo sapiens
ccaaactgcacacacagctc

SEQ ID NO: 6717639 - DNA, 14 bp, Homo sapiens
ccaaactgcctaag

SEQ ID NO: 6717640 - DNA, 13 bp, Homo sapiens
ccaaactgctgtc

SEQ ID NO: 6717641 - DNA, 14 bp, Homo sapiens
ccaaactgctgtct

SEQ ID NO: 6717642 - DNA, 13 bp, Homo sapiens
ccaaactgggtct

SEQ ID NO: 6717643 - DNA, 17 bp, Homo sapiens
ccaaactgggtcttcag

SEQ ID NO: 6717644 - DNA, 20 bp, Homo sapiens
ccaaactgggtcttcagctt

SEQ ID NO: 6717645 - DNA, 13 bp, Homo sapiens
ccaaactgtccct

SEQ ID NO: 6717646 - DNA, 20 bp, Homo sapiens
ccaaactgtccctcccttgc

SEQ ID NO: 6717647 - DNA, 21 bp, Homo sapiens
ccaaactgtccctcccttgct

SEQ ID NO: 6717648 - DNA, 23 bp, Homo sapiens
ccaaactgtccctcccttgctga

SEQ ID NO: 6717649 - DNA, 15 bp, Homo sapiens
ccaaactgtgccctg

SEQ ID NO: 6717650 - DNA, 16 bp, Homo sapiens
ccaaactgttcaagaa

SEQ ID NO: 6717651 - DNA, 21 bp, Homo sapiens
ccaaacttatggacactgcct

SEQ ID NO: 6717652 - DNA, 13 bp, Homo sapiens
ccaaacttccagg

SEQ ID NO: 6717653 - DNA, 21 bp, Homo sapiens
ccaaacttctgaactttggaa

SEQ ID NO: 6717654 - DNA, 15 bp, Homo sapiens
ccaaacttgttcatt

SEQ ID NO: 6717655 - DNA, 16 bp, Homo sapiens
ccaaacttgttcattt

SEQ ID NO: 6717656 - DNA, 13 bp, Homo sapiens
ccaaactttaaaa

SEQ ID NO: 6717657 - DNA, 14 bp, Homo sapiens
ccaaactttaaaat

SEQ ID NO: 6717658 - DNA, 12 bp, Homo sapiens
ccaaagaaacaa

SEQ ID NO: 6717659 - DNA, 19 bp, Homo sapiens
ccaaagaaacaagctgtgc

SEQ ID NO: 6717660 - DNA, 20 bp, Homo sapiens
ccaaagaaacaagctgtgca

SEQ ID NO: 6717661 - DNA, 12 bp, Homo sapiens
ccaaagaaactc

SEQ ID NO: 6717662 - DNA, 23 bp, Homo sapiens
ccaaagaaatgaacattccaagg

SEQ ID NO: 6717663 - DNA, 20 bp, Homo sapiens
ccaaagaaatgggcctgcct

SEQ ID NO: 6717664 - DNA, 21 bp, Homo sapiens
ccaaagaaatgggcctgcctg

SEQ ID NO: 6717665 - DNA, 17 bp, Homo sapiens
ccaaagaaccccaggca

SEQ ID NO: 6717666 - DNA, 12 bp, Homo sapiens
ccaaagaactat

SEQ ID NO: 6717667 - DNA, 14 bp, Homo sapiens
ccaaagaatgaatt

SEQ ID NO: 6717668 - DNA, 21 bp, Homo sapiens
ccaaagaattcctgaagccag

SEQ ID NO: 6717669 - DNA, 13 bp, Homo sapiens
ccaaagaattgta

SEQ ID NO: 6717670 - DNA, 13 bp, Homo sapiens
ccaaagacaaata

SEQ ID NO: 6717671 - DNA, 17 bp, Homo sapiens
ccaaagactatttcaaa

SEQ ID NO: 6717672 - DNA, 22 bp, Homo sapiens
ccaaagactctggaggtcatct

SEQ ID NO: 6717673 - DNA, 13 bp, Homo sapiens
ccaaagactgcag

SEQ ID NO: 6717674 - DNA, 15 bp, Homo sapiens
ccaaagactgcagaa

SEQ ID NO: 6717675 - DNA, 17 bp, Homo sapiens
ccaaagactgtactggc

SEQ ID NO: 6717676 - DNA, 19 bp, Homo sapiens
ccaaagactgtactggcca

SEQ ID NO: 6717677 - DNA, 20 bp, Homo sapiens
ccaaagactgtactggccag

SEQ ID NO: 6717678 - DNA, 11 bp, Homo sapiens
ccaaagagaaa

SEQ ID NO: 6717679 - DNA, 13 bp, Homo sapiens
ccaaagagaaaag

SEQ ID NO: 6717680 - DNA, 21 bp, Homo sapiens
ccaaagagaatcccacattag

SEQ ID NO: 6717681 - DNA, 22 bp, Homo sapiens
ccaaagagaatcccacattagc

SEQ ID NO: 6717682 - DNA, 21 bp, Homo sapiens
ccaaagagactggagcatctg

SEQ ID NO: 6717683 - DNA, 16 bp, Homo sapiens
ccaaagagcctggaga

SEQ ID NO: 6717684 - DNA, 22 bp, Homo sapiens
ccaaagagcctggagaagctga

SEQ ID NO: 6717685 - DNA, 16 bp, Homo sapiens
ccaaagagcctttcca

SEQ ID NO: 6717686 - DNA, 17 bp, Homo sapiens
ccaaagaggcattcagc

SEQ ID NO: 6717687 - DNA, 19 bp, Homo sapiens
ccaaagaggcattcagcaa

SEQ ID NO: 6717688 - DNA, 13 bp, Homo sapiens
ccaaagaggctgc

SEQ ID NO: 6717689 - DNA, 16 bp, Homo sapiens
ccaaagaggctgcccc

SEQ ID NO: 6717690 - DNA, 17 bp, Homo sapiens
ccaaagaggctgcccct

SEQ ID NO: 6717691 - DNA, 21 bp, Homo sapiens
ccaaagaggctgcccctctca

SEQ ID NO: 6717692 - DNA, 23 bp, Homo sapiens
ccaaagagggatgtttggaaaaa

SEQ ID NO: 6717693 - DNA, 14 bp, Homo sapiens
ccaaagagtctctg

SEQ ID NO: 6717694 - DNA, 15 bp, Homo sapiens
ccaaagagtctctgg

SEQ ID NO: 6717695 - DNA, 16 bp, Homo sapiens
ccaaagagtgctaagc

SEQ ID NO: 6717696 - DNA, 10 bp, Homo sapiens
ccaaagataa

SEQ ID NO: 6717697 - DNA, 21 bp, Homo sapiens
ccaaagataatgcatattttt

SEQ ID NO: 6717698 - DNA, 19 bp, Homo sapiens
ccaaagatagacaggtcct

SEQ ID NO: 6717699 - DNA, 12 bp, Homo sapiens
ccaaagatccac

SEQ ID NO: 6717700 - DNA, 12 bp, Homo sapiens
ccaaagatccca

SEQ ID NO: 6717701 - DNA, 21 bp, Homo sapiens
ccaaagatctgctcctcgctc

SEQ ID NO: 6717702 - DNA, 22 bp, Homo sapiens
ccaaagatgcagccgccttcct

SEQ ID NO: 6717703 - DNA, 14 bp, Homo sapiens
ccaaagatttcata

SEQ ID NO: 6717704 - DNA, 19 bp, Homo sapiens
ccaaagatttcatatctaa

SEQ ID NO: 6717705 - DNA, 15 bp, Homo sapiens
ccaaagcaaaagaag

SEQ ID NO: 6717706 - DNA, 21 bp, Homo sapiens
ccaaagcaaccacaaatgcat

SEQ ID NO: 6717707 - DNA, 17 bp, Homo sapiens
ccaaagcacagctgggc

SEQ ID NO: 6717708 - DNA, 17 bp, Homo sapiens
ccaaagcacttttaaaa

SEQ ID NO: 6717709 - DNA, 16 bp, Homo sapiens
ccaaagcagggtctgg

SEQ ID NO: 6717710 - DNA, 19 bp, Homo sapiens
ccaaagcagtggagcccag

SEQ ID NO: 6717711 - DNA, 13 bp, Homo sapiens
ccaaagccaccag

SEQ ID NO: 6717712 - DNA, 17 bp, Homo sapiens
ccaaagccacctgctgc

SEQ ID NO: 6717713 - DNA, 15 bp, Homo sapiens
ccaaagccagaacca

SEQ ID NO: 6717714 - DNA, 16 bp, Homo sapiens
ccaaagccaggcctga

SEQ ID NO: 6717715 - DNA, 14 bp, Homo sapiens
ccaaagccagtgaa

SEQ ID NO: 6717716 - DNA, 20 bp, Homo sapiens
ccaaagccatatcaccagtc

SEQ ID NO: 6717717 - DNA, 22 bp, Homo sapiens
ccaaagcccagcccggctgacc

SEQ ID NO: 6717718 - DNA, 13 bp, Homo sapiens
ccaaagccccatg

SEQ ID NO: 6717719 - DNA, 15 bp, Homo sapiens
ccaaagccccatgtg

SEQ ID NO: 6717720 - DNA, 22 bp, Homo sapiens
ccaaagcctcctccagccgcca

SEQ ID NO: 6717721 - DNA, 22 bp, Homo sapiens
ccaaagcctgggcagaaatgtg

SEQ ID NO: 6717722 - DNA, 19 bp, Homo sapiens
ccaaagcctgtcccaggac

SEQ ID NO: 6717723 - DNA, 22 bp, Homo sapiens
ccaaagcgatcatgtcagttgg

SEQ ID NO: 6717724 - DNA, 19 bp, Homo sapiens
ccaaagcgggacgccgcag

SEQ ID NO: 6717725 - DNA, 17 bp, Homo sapiens
ccaaagctaggcctggc

SEQ ID NO: 6717726 - DNA, 23 bp, Homo sapiens
ccaaagctagggtggcccttgca

SEQ ID NO: 6717727 - DNA, 21 bp, Homo sapiens
ccaaagctgagcctgcaggga

SEQ ID NO: 6717728 - DNA, 20 bp, Homo sapiens
ccaaagctgcaggtgccagg

SEQ ID NO: 6717729 - DNA, 17 bp, Homo sapiens
ccaaagctgcctgtgcc

SEQ ID NO: 6717730 - DNA, 19 bp, Homo sapiens
ccaaagctgcctgtgccat

SEQ ID NO: 6717731 - DNA, 18 bp, Homo sapiens
ccaaagctgctgcacagc

SEQ ID NO: 6717732 - DNA, 19 bp, Homo sapiens
ccaaagctgctgcacagct

SEQ ID NO: 6717733 - DNA, 14 bp, Homo sapiens
ccaaagctggccca

SEQ ID NO: 6717734 - DNA, 17 bp, Homo sapiens
ccaaagctggcccagtt

SEQ ID NO: 6717735 - DNA, 23 bp, Homo sapiens
ccaaagctggcccagttgtccat

SEQ ID NO: 6717736 - DNA, 21 bp, Homo sapiens
ccaaagctgttggtctgtccc

SEQ ID NO: 6717737 - DNA, 17 bp, Homo sapiens
ccaaagcttcccacggc

SEQ ID NO: 6717738 - DNA, 20 bp, Homo sapiens
ccaaagctttatctgtcttg

SEQ ID NO: 6717739 - DNA, 15 bp, Homo sapiens
ccaaagctttcctgc

SEQ ID NO: 6717740 - DNA, 19 bp, Homo sapiens
ccaaagctttcctgcccca

SEQ ID NO: 6717741 - DNA, 22 bp, Homo sapiens
ccaaaggaaaaagcacaagaag

SEQ ID NO: 6717742 - DNA, 20 bp, Homo sapiens
ccaaaggaaaatgtctgtaa

SEQ ID NO: 6717743 - DNA, 17 bp, Homo sapiens
ccaaaggaaatccaaaa

SEQ ID NO: 6717744 - DNA, 20 bp, Homo sapiens
ccaaaggaaccgcccagtgc

SEQ ID NO: 6717745 - DNA, 14 bp, Homo sapiens
ccaaaggaactcta

SEQ ID NO: 6717746 - DNA, 15 bp, Homo sapiens
ccaaaggaagcacat

SEQ ID NO: 6717747 - DNA, 21 bp, Homo sapiens
ccaaaggaaggcacccttgac

SEQ ID NO: 6717748 - DNA, 12 bp, Homo sapiens
ccaaaggaaggg

SEQ ID NO: 6717749 - DNA, 18 bp, Homo sapiens
ccaaaggaagtctaggag

SEQ ID NO: 6717750 - DNA, 12 bp, Homo sapiens
ccaaaggacaca

SEQ ID NO: 6717751 - DNA, 17 bp, Homo sapiens
ccaaaggacacaagggt

SEQ ID NO: 6717752 - DNA, 21 bp, Homo sapiens
ccaaaggacgcactgagcaac

SEQ ID NO: 6717753 - DNA, 12 bp, Homo sapiens
ccaaaggaggct

SEQ ID NO: 6717754 - DNA, 16 bp, Homo sapiens
ccaaaggaggctggca

SEQ ID NO: 6717755 - DNA, 17 bp, Homo sapiens
ccaaaggaggctggcag

SEQ ID NO: 6717756 - DNA, 20 bp, Homo sapiens
ccaaaggagtgcatggccac

SEQ ID NO: 6717757 - DNA, 24 bp, Homo sapiens
ccaaaggagtgcatggccacagcc

SEQ ID NO: 6717758 - DNA, 16 bp, Homo sapiens
ccaaaggatgtgatat

SEQ ID NO: 6717759 - DNA, 12 bp, Homo sapiens
ccaaaggcagct

SEQ ID NO: 6717760 - DNA, 16 bp, Homo sapiens
ccaaaggcagctaaga

SEQ ID NO: 6717761 - DNA, 21 bp, Homo sapiens
ccaaaggcagctaagatagaa

SEQ ID NO: 6717762 - DNA, 18 bp, Homo sapiens
ccaaaggcatccaggcca

SEQ ID NO: 6717763 - DNA, 22 bp, Homo sapiens
ccaaaggcatccaggccagggc

SEQ ID NO: 6717764 - DNA, 22 bp, Homo sapiens
ccaaaggcattttattgcttga

SEQ ID NO: 6717765 - DNA, 22 bp, Homo sapiens
ccaaaggccagcggtgaccagc

SEQ ID NO: 6717766 - DNA, 13 bp, Homo sapiens
ccaaaggcccagg

SEQ ID NO: 6717767 - DNA, 16 bp, Homo sapiens
ccaaaggcccagggag

SEQ ID NO: 6717768 - DNA, 12 bp, Homo sapiens
ccaaaggccccc

SEQ ID NO: 6717769 - DNA, 14 bp, Homo sapiens
ccaaaggcccccta

SEQ ID NO: 6717770 - DNA, 15 bp, Homo sapiens
ccaaaggctcctgag

SEQ ID NO: 6717771 - DNA, 16 bp, Homo sapiens
ccaaaggctctctcct

SEQ ID NO: 6717772 - DNA, 20 bp, Homo sapiens
ccaaagggaagtgaggccca

SEQ ID NO: 6717773 - DNA, 22 bp, Homo sapiens
ccaaagggaagtgaggcccaag

SEQ ID NO: 6717774 - DNA, 20 bp, Homo sapiens
ccaaagggaatactcacatt

SEQ ID NO: 6717775 - DNA, 20 bp, Homo sapiens
ccaaagggagagttccagag

SEQ ID NO: 6717776 - DNA, 21 bp, Homo sapiens
ccaaagggagagttccagagg

SEQ ID NO: 6717777 - DNA, 23 bp, Homo sapiens
ccaaagggagggtggcagagaca

SEQ ID NO: 6717778 - DNA, 21 bp, Homo sapiens
ccaaagggagtctgccagggc

SEQ ID NO: 6717779 - DNA, 14 bp, Homo sapiens
ccaaagggcctcct

SEQ ID NO: 6717780 - DNA, 19 bp, Homo sapiens
ccaaaggggacaggcctca

SEQ ID NO: 6717781 - DNA, 14 bp, Homo sapiens
ccaaaggggagcca

SEQ ID NO: 6717782 - DNA, 15 bp, Homo sapiens
ccaaaggggctgctg

SEQ ID NO: 6717783 - DNA, 17 bp, Homo sapiens
ccaaaggggctgctggg

SEQ ID NO: 6717784 - DNA, 20 bp, Homo sapiens
ccaaaggtaagtctgagacc

SEQ ID NO: 6717785 - DNA, 18 bp, Homo sapiens
ccaaaggtcaaaaacaaa

SEQ ID NO: 6717786 - DNA, 17 bp, Homo sapiens
ccaaaggtcaaacaggc

SEQ ID NO: 6717787 - DNA, 13 bp, Homo sapiens
ccaaaggtctaga

SEQ ID NO: 6717788 - DNA, 20 bp, Homo sapiens
ccaaaggtgaaggaatatat

SEQ ID NO: 6717789 - DNA, 17 bp, Homo sapiens
ccaaaggttgtacatag

SEQ ID NO: 6717790 - DNA, 14 bp, Homo sapiens
ccaaagtaaaagaa

SEQ ID NO: 6717791 - DNA, 20 bp, Homo sapiens
ccaaagtacactgtttcaaa

SEQ ID NO: 6717792 - DNA, 22 bp, Homo sapiens
ccaaagtaggtgagctatagtg

SEQ ID NO: 6717793 - DNA, 15 bp, Homo sapiens
ccaaagtagtcctgg

SEQ ID NO: 6717794 - DNA, 20 bp, Homo sapiens
ccaaagtagtcctggcagct

SEQ ID NO: 6717795 - DNA, 14 bp, Homo sapiens
ccaaagtctaaact

SEQ ID NO: 6717796 - DNA, 14 bp, Homo sapiens
ccaaagtctccctt

SEQ ID NO: 6717797 - DNA, 14 bp, Homo sapiens
ccaaagtctctaat

SEQ ID NO: 6717798 - DNA, 23 bp, Homo sapiens
ccaaagtctgccgcccacctcgc

SEQ ID NO: 6717799 - DNA, 14 bp, Homo sapiens
ccaaagtgcagccc

SEQ ID NO: 6717800 - DNA, 20 bp, Homo sapiens
ccaaagtgcagcccttcctc

SEQ ID NO: 6717801 - DNA, 22 bp, Homo sapiens
ccaaagtgcagcccttcctcct

SEQ ID NO: 6717802 - DNA, 16 bp, Homo sapiens
ccaaagtgcatgtcac

SEQ ID NO: 6717803 - DNA, 21 bp, Homo sapiens
ccaaagtgccggtgagaccca

SEQ ID NO: 6717804 - DNA, 13 bp, Homo sapiens
ccaaagtgcctgg

SEQ ID NO: 6717805 - DNA, 15 bp, Homo sapiens
ccaaagtgcctggga

SEQ ID NO: 6717806 - DNA, 22 bp, Homo sapiens
ccaaagtgctgagattacaggt

SEQ ID NO: 6717807 - DNA, 12 bp, Homo sapiens
ccaaagtgctgg

SEQ ID NO: 6717808 - DNA, 16 bp, Homo sapiens
ccaaagtgctgggatt

SEQ ID NO: 6717809 - DNA, 21 bp, Homo sapiens
ccaaagtgctgggattacagg

SEQ ID NO: 6717810 - DNA, 22 bp, Homo sapiens
ccaaagtgctgggattacaggg

SEQ ID NO: 6717811 - DNA, 22 bp, Homo sapiens
ccaaagtgctgggattacaggt

SEQ ID NO: 6717812 - DNA, 15 bp, Homo sapiens
ccaaagtggagctgg

SEQ ID NO: 6717813 - DNA, 20 bp, Homo sapiens
ccaaagtggggagggacaag

SEQ ID NO: 6717814 - DNA, 15 bp, Homo sapiens
ccaaagttaaatgta

SEQ ID NO: 6717815 - DNA, 17 bp, Homo sapiens
ccaaagttagttcagta

SEQ ID NO: 6717816 - DNA, 23 bp, Homo sapiens
ccaaagttctaataatttctaat

SEQ ID NO: 6717817 - DNA, 17 bp, Homo sapiens
ccaaagttggagcttct

SEQ ID NO: 6717818 - DNA, 19 bp, Homo sapiens
ccaaagttgttgtaacctg

SEQ ID NO: 6717819 - DNA, 18 bp, Homo sapiens
ccaaagttttcaaactgc

SEQ ID NO: 6717820 - DNA, 20 bp, Homo sapiens
ccaaagttttgaagtcatct

SEQ ID NO: 6717821 - DNA, 20 bp, Homo sapiens
ccaaataaaaactaaattgt

SEQ ID NO: 6717822 - DNA, 13 bp, Homo sapiens
ccaaataaaatgt

SEQ ID NO: 6717823 - DNA, 15 bp, Homo sapiens
ccaaataaacagcta

SEQ ID NO: 6717824 - DNA, 16 bp, Homo sapiens
ccaaataaacagctat

SEQ ID NO: 6717825 - DNA, 18 bp, Homo sapiens
ccaaataaacatttttta

SEQ ID NO: 6717826 - DNA, 16 bp, Homo sapiens
ccaaataaagataacc

SEQ ID NO: 6717827 - DNA, 12 bp, Homo sapiens
ccaaataaataa

SEQ ID NO: 6717828 - DNA, 20 bp, Homo sapiens
ccaaataaatgtgtaaatgt

SEQ ID NO: 6717829 - DNA, 22 bp, Homo sapiens
ccaaataaatgtgtaaatgtgg

SEQ ID NO: 6717830 - DNA, 16 bp, Homo sapiens
ccaaataacttcagtc

SEQ ID NO: 6717831 - DNA, 19 bp, Homo sapiens
ccaaataagaataacactc

SEQ ID NO: 6717832 - DNA, 17 bp, Homo sapiens
ccaaatacaattcaaat

SEQ ID NO: 6717833 - DNA, 16 bp, Homo sapiens
ccaaatacacatttca

SEQ ID NO: 6717834 - DNA, 23 bp, Homo sapiens
ccaaatacatgataaatgtatca

SEQ ID NO: 6717835 - DNA, 17 bp, Homo sapiens
ccaaatagccaccttga

SEQ ID NO: 6717836 - DNA, 17 bp, Homo sapiens
ccaaatagccccagact

SEQ ID NO: 6717837 - DNA, 20 bp, Homo sapiens
ccaaatagccccagactggg

SEQ ID NO: 6717838 - DNA, 17 bp, Homo sapiens
ccaaatagcttttcact

SEQ ID NO: 6717839 - DNA, 23 bp, Homo sapiens
ccaaatagcttttcacttcttaa

SEQ ID NO: 6717840 - DNA, 23 bp, Homo sapiens
ccaaataggagtcttctgcctct

SEQ ID NO: 6717841 - DNA, 19 bp, Homo sapiens
ccaaataggattaaacaca

SEQ ID NO: 6717842 - DNA, 21 bp, Homo sapiens
ccaaataggctttagaagaga

SEQ ID NO: 6717843 - DNA, 20 bp, Homo sapiens
ccaaatagtgaaaagtagag

SEQ ID NO: 6717844 - DNA, 14 bp, Homo sapiens
ccaaatataaactt

SEQ ID NO: 6717845 - DNA, 15 bp, Homo sapiens
ccaaatataacatga

SEQ ID NO: 6717846 - DNA, 18 bp, Homo sapiens
ccaaatatagcgttccca

SEQ ID NO: 6717847 - DNA, 17 bp, Homo sapiens
ccaaatatatcaaaacg

SEQ ID NO: 6717848 - DNA, 18 bp, Homo sapiens
ccaaatatatttaatggt

SEQ ID NO: 6717849 - DNA, 15 bp, Homo sapiens
ccaaatatgcacttt

SEQ ID NO: 6717850 - DNA, 16 bp, Homo sapiens
ccaaatatgcactttc

SEQ ID NO: 6717851 - DNA, 20 bp, Homo sapiens
ccaaatatgcactttcccta

SEQ ID NO: 6717852 - DNA, 22 bp, Homo sapiens
ccaaatatgcactttccctaga

SEQ ID NO: 6717853 - DNA, 18 bp, Homo sapiens
ccaaatatgtattttcct

SEQ ID NO: 6717854 - DNA, 15 bp, Homo sapiens
ccaaatatgtcctgg

SEQ ID NO: 6717855 - DNA, 18 bp, Homo sapiens
ccaaatattaaagattct

SEQ ID NO: 6717856 - DNA, 20 bp, Homo sapiens
ccaaatattaggcttaaaaa

SEQ ID NO: 6717857 - DNA, 13 bp, Homo sapiens
ccaaatattttag

SEQ ID NO: 6717858 - DNA, 13 bp, Homo sapiens
ccaaatcaaaata

SEQ ID NO: 6717859 - DNA, 20 bp, Homo sapiens
ccaaatcaataagaaggtag

SEQ ID NO: 6717860 - DNA, 18 bp, Homo sapiens
ccaaatcacatctcacct

SEQ ID NO: 6717861 - DNA, 20 bp, Homo sapiens
ccaaatcacccaatcccagt

SEQ ID NO: 6717862 - DNA, 20 bp, Homo sapiens
ccaaatcactgaactttgct

SEQ ID NO: 6717863 - DNA, 16 bp, Homo sapiens
ccaaatcagtttttct

SEQ ID NO: 6717864 - DNA, 14 bp, Homo sapiens
ccaaatcatcctga

SEQ ID NO: 6717865 - DNA, 18 bp, Homo sapiens
ccaaatcatcctgaatct

SEQ ID NO: 6717866 - DNA, 16 bp, Homo sapiens
ccaaatccacaagcca

SEQ ID NO: 6717867 - DNA, 15 bp, Homo sapiens
ccaaatcccctaagc

SEQ ID NO: 6717868 - DNA, 13 bp, Homo sapiens
ccaaatcccctcc

SEQ ID NO: 6717869 - DNA, 21 bp, Homo sapiens
ccaaatccgaacctcctctgt

SEQ ID NO: 6717870 - DNA, 22 bp, Homo sapiens
ccaaatccgaacctcctctgtg

SEQ ID NO: 6717871 - DNA, 18 bp, Homo sapiens
ccaaatccgccagtgttt

SEQ ID NO: 6717872 - DNA, 20 bp, Homo sapiens
ccaaatccgctctcttcctg

SEQ ID NO: 6717873 - DNA, 21 bp, Homo sapiens
ccaaatcctggaaggacacag

SEQ ID NO: 6717874 - DNA, 17 bp, Homo sapiens
ccaaatcctgggcatcc

SEQ ID NO: 6717875 - DNA, 21 bp, Homo sapiens
ccaaatcctgggcatccccag

SEQ ID NO: 6717876 - DNA, 22 bp, Homo sapiens
ccaaatcctgggcatccccagc

SEQ ID NO: 6717877 - DNA, 19 bp, Homo sapiens
ccaaatccttggagtccca

SEQ ID NO: 6717878 - DNA, 21 bp, Homo sapiens
ccaaatccttggagtcccagg

SEQ ID NO: 6717879 - DNA, 16 bp, Homo sapiens
ccaaatctactgagcc

SEQ ID NO: 6717880 - DNA, 17 bp, Homo sapiens
ccaaatctactgagcca

SEQ ID NO: 6717881 - DNA, 21 bp, Homo sapiens
ccaaatctcagttgtttgctt

SEQ ID NO: 6717882 - DNA, 22 bp, Homo sapiens
ccaaatctgacatattatgcct

SEQ ID NO: 6717883 - DNA, 14 bp, Homo sapiens
ccaaatctgtcctc

SEQ ID NO: 6717884 - DNA, 17 bp, Homo sapiens
ccaaatctgtcctctgt

SEQ ID NO: 6717885 - DNA, 19 bp, Homo sapiens
ccaaatctgtcctctgtag

SEQ ID NO: 6717886 - DNA, 22 bp, Homo sapiens
ccaaatctgtcctctgtagtat

SEQ ID NO: 6717887 - DNA, 22 bp, Homo sapiens
ccaaatctgtctccccagaaga

SEQ ID NO: 6717888 - DNA, 17 bp, Homo sapiens
ccaaatcttcctctgga

SEQ ID NO: 6717889 - DNA, 19 bp, Homo sapiens
ccaaatcttgaatttctgc

SEQ ID NO: 6717890 - DNA, 18 bp, Homo sapiens
ccaaatgaaaaatctcaa

SEQ ID NO: 6717891 - DNA, 21 bp, Homo sapiens
ccaaatgaaatatatttaaaa

SEQ ID NO: 6717892 - DNA, 16 bp, Homo sapiens
ccaaatgaatgacctt

SEQ ID NO: 6717893 - DNA, 21 bp, Homo sapiens
ccaaatgaccgagccctggag

SEQ ID NO: 6717894 - DNA, 19 bp, Homo sapiens
ccaaatgatgccacttccc

SEQ ID NO: 6717895 - DNA, 16 bp, Homo sapiens
ccaaatgcaaaattag

SEQ ID NO: 6717896 - DNA, 16 bp, Homo sapiens
ccaaatgcaatttgat

SEQ ID NO: 6717897 - DNA, 15 bp, Homo sapiens
ccaaatgcagcttta

SEQ ID NO: 6717898 - DNA, 18 bp, Homo sapiens
ccaaatgcagctttaaaa

SEQ ID NO: 6717899 - DNA, 21 bp, Homo sapiens
ccaaatgcagggaggggaggc

SEQ ID NO: 6717900 - DNA, 19 bp, Homo sapiens
ccaaatgcatcaatcctgt

SEQ ID NO: 6717901 - DNA, 17 bp, Homo sapiens
ccaaatgcatggtgcag

SEQ ID NO: 6717902 - DNA, 14 bp, Homo sapiens
ccaaatgcctctgc

SEQ ID NO: 6717903 - DNA, 18 bp, Homo sapiens
ccaaatgcctctgccttg

SEQ ID NO: 6717904 - DNA, 15 bp, Homo sapiens
ccaaatgcctgttgt

SEQ ID NO: 6717905 - DNA, 22 bp, Homo sapiens
ccaaatgctgtctccataatgc

SEQ ID NO: 6717906 - DNA, 15 bp, Homo sapiens
ccaaatgctttaaaa

SEQ ID NO: 6717907 - DNA, 17 bp, Homo sapiens
ccaaatggaaacagagg

SEQ ID NO: 6717908 - DNA, 21 bp, Homo sapiens
ccaaatggaaacagaggacca

SEQ ID NO: 6717909 - DNA, 19 bp, Homo sapiens
ccaaatggaattacagact

SEQ ID NO: 6717910 - DNA, 14 bp, Homo sapiens
ccaaatggactggc

SEQ ID NO: 6717911 - DNA, 19 bp, Homo sapiens
ccaaatggagaagctgcag

SEQ ID NO: 6717912 - DNA, 22 bp, Homo sapiens
ccaaatggccagttttctggta

SEQ ID NO: 6717913 - DNA, 18 bp, Homo sapiens
ccaaatggccattttaaa

SEQ ID NO: 6717914 - DNA, 19 bp, Homo sapiens
ccaaatggccattttaaaa

SEQ ID NO: 6717915 - DNA, 13 bp, Homo sapiens
ccaaatggctgct

SEQ ID NO: 6717916 - DNA, 18 bp, Homo sapiens
ccaaatggctgctttgac

SEQ ID NO: 6717917 - DNA, 22 bp, Homo sapiens
ccaaatgtaattgaataaagtt

SEQ ID NO: 6717918 - DNA, 13 bp, Homo sapiens
ccaaatgtccctc

SEQ ID NO: 6717919 - DNA, 18 bp, Homo sapiens
ccaaatgtcggggttggg

SEQ ID NO: 6717920 - DNA, 20 bp, Homo sapiens
ccaaatgtcggggttggggt

SEQ ID NO: 6717921 - DNA, 17 bp, Homo sapiens
ccaaatgtgtacacctg

SEQ ID NO: 6717922 - DNA, 21 bp, Homo sapiens
ccaaatgtgtataattttaaa

SEQ ID NO: 6717923 - DNA, 15 bp, Homo sapiens
ccaaatgttaactgc

SEQ ID NO: 6717924 - DNA, 17 bp, Homo sapiens
ccaaatgttcatcaatg

SEQ ID NO: 6717925 - DNA, 19 bp, Homo sapiens
ccaaatgtttacagggagc

SEQ ID NO: 6717926 - DNA, 13 bp, Homo sapiens
ccaaatgtttata

SEQ ID NO: 6717927 - DNA, 22 bp, Homo sapiens
ccaaattaaacgtaaatgtttt

SEQ ID NO: 6717928 - DNA, 19 bp, Homo sapiens
ccaaattacctaggctgag

SEQ ID NO: 6717929 - DNA, 18 bp, Homo sapiens
ccaaattataagggccct

SEQ ID NO: 6717930 - DNA, 23 bp, Homo sapiens
ccaaattataagggccctgccct

SEQ ID NO: 6717931 - DNA, 18 bp, Homo sapiens
ccaaattatcaagctaat

SEQ ID NO: 6717932 - DNA, 22 bp, Homo sapiens
ccaaattatcaagctaataaaa

SEQ ID NO: 6717933 - DNA, 21 bp, Homo sapiens
ccaaattatcctggtcttttt

SEQ ID NO: 6717934 - DNA, 13 bp, Homo sapiens
ccaaattattaat

SEQ ID NO: 6717935 - DNA, 19 bp, Homo sapiens
ccaaattatttcttaatta

SEQ ID NO: 6717936 - DNA, 12 bp, Homo sapiens
ccaaattatttg

SEQ ID NO: 6717937 - DNA, 19 bp, Homo sapiens
ccaaattcaccttccccta

SEQ ID NO: 6717938 - DNA, 16 bp, Homo sapiens
ccaaattcactttatt

SEQ ID NO: 6717939 - DNA, 19 bp, Homo sapiens
ccaaattcagtttcataaa

SEQ ID NO: 6717940 - DNA, 16 bp, Homo sapiens
ccaaattccctggacc

SEQ ID NO: 6717941 - DNA, 15 bp, Homo sapiens
ccaaattctttattc

SEQ ID NO: 6717942 - DNA, 15 bp, Homo sapiens
ccaaattctttcagt

SEQ ID NO: 6717943 - DNA, 23 bp, Homo sapiens
ccaaattgagtttaacaataata

SEQ ID NO: 6717944 - DNA, 14 bp, Homo sapiens
ccaaattgatgggt

SEQ ID NO: 6717945 - DNA, 15 bp, Homo sapiens
ccaaattgctgagat

SEQ ID NO: 6717946 - DNA, 13 bp, Homo sapiens
ccaaattgcttct

SEQ ID NO: 6717947 - DNA, 19 bp, Homo sapiens
ccaaattgcttctaggagt

SEQ ID NO: 6717948 - DNA, 18 bp, Homo sapiens
ccaaattgcttgagcctg

SEQ ID NO: 6717949 - DNA, 14 bp, Homo sapiens
ccaaattgtcacct

SEQ ID NO: 6717950 - DNA, 21 bp, Homo sapiens
ccaaattgtcacctgcttctc

SEQ ID NO: 6717951 - DNA, 17 bp, Homo sapiens
ccaaattgtctgtctgc

SEQ ID NO: 6717952 - DNA, 22 bp, Homo sapiens
ccaaattgtctgtctgctctta

SEQ ID NO: 6717953 - DNA, 14 bp, Homo sapiens
ccaaattgtttgta

SEQ ID NO: 6717954 - DNA, 11 bp, Homo sapiens
ccaaatttaaa

SEQ ID NO: 6717955 - DNA, 18 bp, Homo sapiens
ccaaatttaaaatgtgtg

SEQ ID NO: 6717956 - DNA, 18 bp, Homo sapiens
ccaaatttaagactctcg

SEQ ID NO: 6717957 - DNA, 11 bp, Homo sapiens
ccaaatttaat

SEQ ID NO: 6717958 - DNA, 14 bp, Homo sapiens
ccaaatttccctgg

SEQ ID NO: 6717959 - DNA, 15 bp, Homo sapiens
ccaaatttccctggg

SEQ ID NO: 6717960 - DNA, 22 bp, Homo sapiens
ccaaatttcctgtttgaaatat

SEQ ID NO: 6717961 - DNA, 20 bp, Homo sapiens
ccaaatttgattgatttgaa

SEQ ID NO: 6717962 - DNA, 14 bp, Homo sapiens
ccaaatttgcttta

SEQ ID NO: 6717963 - DNA, 17 bp, Homo sapiens
ccaaatttgctttacat

SEQ ID NO: 6717964 - DNA, 22 bp, Homo sapiens
ccaaattttattaaaagagtag

SEQ ID NO: 6717965 - DNA, 23 bp, Homo sapiens
ccaaattttcaataaatttctgc

SEQ ID NO: 6717966 - DNA, 17 bp, Homo sapiens
ccaaattttctttttat

SEQ ID NO: 6717967 - DNA, 18 bp, Homo sapiens
ccaacaaacctgcttgtc

SEQ ID NO: 6717968 - DNA, 19 bp, Homo sapiens
ccaacaacagtcagccagc

SEQ ID NO: 6717969 - DNA, 15 bp, Homo sapiens
ccaacaacatgaaac

SEQ ID NO: 6717970 - DNA, 15 bp, Homo sapiens
ccaacaactctgcct

SEQ ID NO: 6717971 - DNA, 15 bp, Homo sapiens
ccaacaagaagaaat

SEQ ID NO: 6717972 - DNA, 19 bp, Homo sapiens
ccaacaagaatgcattgat

SEQ ID NO: 6717973 - DNA, 17 bp, Homo sapiens
ccaacaagttgaagaag

SEQ ID NO: 6717974 - DNA, 16 bp, Homo sapiens
ccaacaataaacagga

SEQ ID NO: 6717975 - DNA, 23 bp, Homo sapiens
ccaacaataaaccaaacccagcc

SEQ ID NO: 6717976 - DNA, 15 bp, Homo sapiens
ccaacaataaagagc

SEQ ID NO: 6717977 - DNA, 22 bp, Homo sapiens
ccaacaatcctagtgctttcct

SEQ ID NO: 6717978 - DNA, 21 bp, Homo sapiens
ccaacaattaggtctgcattt

SEQ ID NO: 6717979 - DNA, 22 bp, Homo sapiens
ccaacaattaggtctgcatttt

SEQ ID NO: 6717980 - DNA, 20 bp, Homo sapiens
ccaacacacaggaactctgt

SEQ ID NO: 6717981 - DNA, 14 bp, Homo sapiens
ccaacacatttcac

SEQ ID NO: 6717982 - DNA, 17 bp, Homo sapiens
ccaacaccaagcacagc

SEQ ID NO: 6717983 - DNA, 21 bp, Homo sapiens
ccaacaccacagacacacaca

SEQ ID NO: 6717984 - DNA, 23 bp, Homo sapiens
ccaacaccacagacacacacacg

SEQ ID NO: 6717985 - DNA, 16 bp, Homo sapiens
ccaacaccatcacagc

SEQ ID NO: 6717986 - DNA, 21 bp, Homo sapiens
ccaacaccatcacagcttgtt

SEQ ID NO: 6717987 - DNA, 15 bp, Homo sapiens
ccaacaccccgcctg

SEQ ID NO: 6717988 - DNA, 22 bp, Homo sapiens
ccaacaccccgcctgcctcctg

SEQ ID NO: 6717989 - DNA, 12 bp, Homo sapiens
ccaacacctgct

SEQ ID NO: 6717990 - DNA, 13 bp, Homo sapiens
ccaacacctgctg

SEQ ID NO: 6717991 - DNA, 14 bp, Homo sapiens
ccaacactcaagaa

SEQ ID NO: 6717992 - DNA, 12 bp, Homo sapiens
ccaacactccag

SEQ ID NO: 6717993 - DNA, 13 bp, Homo sapiens
ccaacactccagg

SEQ ID NO: 6717994 - DNA, 17 bp, Homo sapiens
ccaacactccaggccct

SEQ ID NO: 6717995 - DNA, 20 bp, Homo sapiens
ccaacacttaatcattttat

SEQ ID NO: 6717996 - DNA, 20 bp, Homo sapiens
ccaacagaaacatgccagaa

SEQ ID NO: 6717997 - DNA, 19 bp, Homo sapiens
ccaacagaaaccttttatt

SEQ ID NO: 6717998 - DNA, 15 bp, Homo sapiens
ccaacagacaccctc

SEQ ID NO: 6717999 - DNA, 13 bp, Homo sapiens
ccaacagagtgga

SEQ ID NO: 6718000 - DNA, 22 bp, Homo sapiens
ccaacagagtggactcttccct

SEQ ID NO: 6718001 - DNA, 17 bp, Homo sapiens
ccaacagatgcttttct

SEQ ID NO: 6718002 - DNA, 22 bp, Homo sapiens
ccaacagatgcttttctgtctc

SEQ ID NO: 6718003 - DNA, 16 bp, Homo sapiens
ccaacagcacctcccc

SEQ ID NO: 6718004 - DNA, 22 bp, Homo sapiens
ccaacagcattggcctggccag

SEQ ID NO: 6718005 - DNA, 13 bp, Homo sapiens
ccaacagccatgc

SEQ ID NO: 6718006 - DNA, 15 bp, Homo sapiens
ccaacagcccagcaa

SEQ ID NO: 6718007 - DNA, 18 bp, Homo sapiens
ccaacagcccagcaagaa

SEQ ID NO: 6718008 - DNA, 16 bp, Homo sapiens
ccaacagcctctgtgg

SEQ ID NO: 6718009 - DNA, 23 bp, Homo sapiens
ccaacagcgcccaaaggacgcac

SEQ ID NO: 6718010 - DNA, 21 bp, Homo sapiens
ccaacagctacaacagcctca

SEQ ID NO: 6718011 - DNA, 17 bp, Homo sapiens
ccaacagctcagagatg

SEQ ID NO: 6718012 - DNA, 12 bp, Homo sapiens
ccaacagctgga

SEQ ID NO: 6718013 - DNA, 19 bp, Homo sapiens
ccaacagcttgaccagacc

SEQ ID NO: 6718014 - DNA, 21 bp, Homo sapiens
ccaacagcttgaccagaccta

SEQ ID NO: 6718015 - DNA, 16 bp, Homo sapiens
ccaacaggaggacaat

SEQ ID NO: 6718016 - DNA, 19 bp, Homo sapiens
ccaacaggaggacaattca

SEQ ID NO: 6718017 - DNA, 11 bp, Homo sapiens
ccaacaggcac

SEQ ID NO: 6718018 - DNA, 18 bp, Homo sapiens
ccaacaggcacctctaat

SEQ ID NO: 6718019 - DNA, 20 bp, Homo sapiens
ccaacaggcgtgggatcaga

SEQ ID NO: 6718020 - DNA, 19 bp, Homo sapiens
ccaacagggcaaccaataa

SEQ ID NO: 6718021 - DNA, 21 bp, Homo sapiens
ccaacagggcaaccaataaaa

SEQ ID NO: 6718022 - DNA, 18 bp, Homo sapiens
ccaacaggggctggaggg

SEQ ID NO: 6718023 - DNA, 23 bp, Homo sapiens
ccaacagggtagatttctcttgg

SEQ ID NO: 6718024 - DNA, 18 bp, Homo sapiens
ccaacaggtggcaggacc

SEQ ID NO: 6718025 - DNA, 17 bp, Homo sapiens
ccaacaggtttatctga

SEQ ID NO: 6718026 - DNA, 18 bp, Homo sapiens
ccaacaggtttatctgaa

SEQ ID NO: 6718027 - DNA, 15 bp, Homo sapiens
ccaacagtcatgttt

SEQ ID NO: 6718028 - DNA, 16 bp, Homo sapiens
ccaacagtgtgaagtt

SEQ ID NO: 6718029 - DNA, 22 bp, Homo sapiens
ccaacagtttaatgaagatcta

SEQ ID NO: 6718030 - DNA, 19 bp, Homo sapiens
ccaacatacccttctttaa

SEQ ID NO: 6718031 - DNA, 18 bp, Homo sapiens
ccaacatactcccatctg

SEQ ID NO: 6718032 - DNA, 20 bp, Homo sapiens
ccaacatactcccatctgtg

SEQ ID NO: 6718033 - DNA, 21 bp, Homo sapiens
ccaacatactcccatctgtga

SEQ ID NO: 6718034 - DNA, 13 bp, Homo sapiens
ccaacatataaaa

SEQ ID NO: 6718035 - DNA, 14 bp, Homo sapiens
ccaacatccactct

SEQ ID NO: 6718036 - DNA, 15 bp, Homo sapiens
ccaacatccagatct

SEQ ID NO: 6718037 - DNA, 22 bp, Homo sapiens
ccaacatccagtcctgctgact

SEQ ID NO: 6718038 - DNA, 14 bp, Homo sapiens
ccaacatgaggaca

SEQ ID NO: 6718039 - DNA, 15 bp, Homo sapiens
ccaacatgaggacag

SEQ ID NO: 6718040 - DNA, 17 bp, Homo sapiens
ccaacatgaggacagaa

SEQ ID NO: 6718041 - DNA, 16 bp, Homo sapiens
ccaacatggatgtgtt

SEQ ID NO: 6718042 - DNA, 17 bp, Homo sapiens
ccaacatggatgtgttg

SEQ ID NO: 6718043 - DNA, 14 bp, Homo sapiens
ccaacatgtatctg

SEQ ID NO: 6718044 - DNA, 21 bp, Homo sapiens
ccaacatgtatctgtctactt

SEQ ID NO: 6718045 - DNA, 17 bp, Homo sapiens
ccaacatgtggctcctc

SEQ ID NO: 6718046 - DNA, 14 bp, Homo sapiens
ccaacatgttcaga

SEQ ID NO: 6718047 - DNA, 15 bp, Homo sapiens
ccaacattaaaactc

SEQ ID NO: 6718048 - DNA, 20 bp, Homo sapiens
ccaacattatcctgtgtgat

SEQ ID NO: 6718049 - DNA, 20 bp, Homo sapiens
ccaacattcaaaagcacaaa

SEQ ID NO: 6718050 - DNA, 22 bp, Homo sapiens
ccaacattcaaaagcacaaacc

SEQ ID NO: 6718051 - DNA, 15 bp, Homo sapiens
ccaacattctgcaat

SEQ ID NO: 6718052 - DNA, 20 bp, Homo sapiens
ccaacattgcctatttcagt

SEQ ID NO: 6718053 - DNA, 17 bp, Homo sapiens
ccaacatttcttaaatt

SEQ ID NO: 6718054 - DNA, 14 bp, Homo sapiens
ccaacattttaaaa

SEQ ID NO: 6718055 - DNA, 18 bp, Homo sapiens
ccaacattttttcccagt

SEQ ID NO: 6718056 - DNA, 15 bp, Homo sapiens
ccaaccaaataagac

SEQ ID NO: 6718057 - DNA, 23 bp, Homo sapiens
ccaaccaacttggttctgcttca

SEQ ID NO: 6718058 - DNA, 21 bp, Homo sapiens
ccaaccaagagcacattctta

SEQ ID NO: 6718059 - DNA, 21 bp, Homo sapiens
ccaaccaagaggatttcttca

SEQ ID NO: 6718060 - DNA, 19 bp, Homo sapiens
ccaaccaaggaatttaaaa

SEQ ID NO: 6718061 - DNA, 14 bp, Homo sapiens
ccaaccacaaacca

SEQ ID NO: 6718062 - DNA, 15 bp, Homo sapiens
ccaaccacagaggat

SEQ ID NO: 6718063 - DNA, 15 bp, Homo sapiens
ccaaccacctctggc

SEQ ID NO: 6718064 - DNA, 18 bp, Homo sapiens
ccaaccacctctggccct

SEQ ID NO: 6718065 - DNA, 21 bp, Homo sapiens
ccaaccacctctggccctgtt

SEQ ID NO: 6718066 - DNA, 23 bp, Homo sapiens
ccaaccacctctggccctgttgt

SEQ ID NO: 6718067 - DNA, 17 bp, Homo sapiens
ccaaccagacctggaag

SEQ ID NO: 6718068 - DNA, 21 bp, Homo sapiens
ccaaccagcccgacagtgcca

SEQ ID NO: 6718069 - DNA, 13 bp, Homo sapiens
ccaaccagccttt

SEQ ID NO: 6718070 - DNA, 14 bp, Homo sapiens
ccaaccaggaccca

SEQ ID NO: 6718071 - DNA, 16 bp, Homo sapiens
ccaaccaggacccagg

SEQ ID NO: 6718072 - DNA, 19 bp, Homo sapiens
ccaaccaggacccagggtc

SEQ ID NO: 6718073 - DNA, 21 bp, Homo sapiens
ccaaccaggaggggtctgcct

SEQ ID NO: 6718074 - DNA, 17 bp, Homo sapiens
ccaaccagtgccaagga

SEQ ID NO: 6718075 - DNA, 15 bp, Homo sapiens
ccaaccatcttcact

SEQ ID NO: 6718076 - DNA, 13 bp, Homo sapiens
ccaaccatttcct

SEQ ID NO: 6718077 - DNA, 18 bp, Homo sapiens
ccaacccaaacctggaga

SEQ ID NO: 6718078 - DNA, 13 bp, Homo sapiens
ccaacccaatccc

SEQ ID NO: 6718079 - DNA, 23 bp, Homo sapiens
ccaacccaattcaggactggctc

SEQ ID NO: 6718080 - DNA, 17 bp, Homo sapiens
ccaacccagccacgact

SEQ ID NO: 6718081 - DNA, 22 bp, Homo sapiens
ccaacccaggattcaacatcaa

SEQ ID NO: 6718082 - DNA, 11 bp, Homo sapiens
ccaacccatga

SEQ ID NO: 6718083 - DNA, 16 bp, Homo sapiens
ccaacccatgcatggc

SEQ ID NO: 6718084 - DNA, 16 bp, Homo sapiens
ccaacccatgcccctg

SEQ ID NO: 6718085 - DNA, 14 bp, Homo sapiens
ccaacccatgccct

SEQ ID NO: 6718086 - DNA, 19 bp, Homo sapiens
ccaaccccagcagtcctgg

SEQ ID NO: 6718087 - DNA, 15 bp, Homo sapiens
ccaaccccagctggc

SEQ ID NO: 6718088 - DNA, 23 bp, Homo sapiens
ccaaccccagggcccccacaggc

SEQ ID NO: 6718089 - DNA, 16 bp, Homo sapiens
ccaaccccatcctcac

SEQ ID NO: 6718090 - DNA, 13 bp, Homo sapiens
ccaacccccaccc

SEQ ID NO: 6718091 - DNA, 23 bp, Homo sapiens
ccaacccccagaggtggcccttg

SEQ ID NO: 6718092 - DNA, 16 bp, Homo sapiens
ccaacccccagccccc

SEQ ID NO: 6718093 - DNA, 15 bp, Homo sapiens
ccaacccccatctcc

SEQ ID NO: 6718094 - DNA, 16 bp, Homo sapiens
ccaacccccatctccc

SEQ ID NO: 6718095 - DNA, 13 bp, Homo sapiens
ccaaccccccagc

SEQ ID NO: 6718096 - DNA, 18 bp, Homo sapiens
ccaaccccccagcactga

SEQ ID NO: 6718097 - DNA, 13 bp, Homo sapiens
ccaacccccctcc

SEQ ID NO: 6718098 - DNA, 16 bp, Homo sapiens
ccaacccccctcctgc

SEQ ID NO: 6718099 - DNA, 18 bp, Homo sapiens
ccaacccccctcctgctc

SEQ ID NO: 6718100 - DNA, 22 bp, Homo sapiens
ccaacccccctcctgctcctcc

SEQ ID NO: 6718101 - DNA, 20 bp, Homo sapiens
ccaacccccgcaccaagcag

SEQ ID NO: 6718102 - DNA, 13 bp, Homo sapiens
ccaaccccctgca

SEQ ID NO: 6718103 - DNA, 13 bp, Homo sapiens
ccaacccctcctc

SEQ ID NO: 6718104 - DNA, 15 bp, Homo sapiens
ccaacccctcctccc

SEQ ID NO: 6718105 - DNA, 18 bp, Homo sapiens
ccaacccctcctccctca

SEQ ID NO: 6718106 - DNA, 20 bp, Homo sapiens
ccaacccctcctccctcaga

SEQ ID NO: 6718107 - DNA, 22 bp, Homo sapiens
ccaacccctcctccctcagact

SEQ ID NO: 6718108 - DNA, 15 bp, Homo sapiens
ccaacccctccttcc

SEQ ID NO: 6718109 - DNA, 20 bp, Homo sapiens
ccaacccctccttccccaga

SEQ ID NO: 6718110 - DNA, 18 bp, Homo sapiens
ccaacccctcgcccagtc

SEQ ID NO: 6718111 - DNA, 13 bp, Homo sapiens
ccaacccctctcc

SEQ ID NO: 6718112 - DNA, 18 bp, Homo sapiens
ccaacccctctccaggcc

SEQ ID NO: 6718113 - DNA, 19 bp, Homo sapiens
ccaacccctctccaggcct

SEQ ID NO: 6718114 - DNA, 22 bp, Homo sapiens
ccaacccctgacctaccccagc

SEQ ID NO: 6718115 - DNA, 18 bp, Homo sapiens
ccaacccctgaggaagat

SEQ ID NO: 6718116 - DNA, 21 bp, Homo sapiens
ccaacccggcccaacccagcc

SEQ ID NO: 6718117 - DNA, 19 bp, Homo sapiens
ccaacccgtgcccctggga

SEQ ID NO: 6718118 - DNA, 17 bp, Homo sapiens
ccaacccgtggaggctg

SEQ ID NO: 6718119 - DNA, 20 bp, Homo sapiens
ccaacccgtggaggctgctc

SEQ ID NO: 6718120 - DNA, 21 bp, Homo sapiens
ccaacccgtggaggctgctcg

SEQ ID NO: 6718121 - DNA, 20 bp, Homo sapiens
ccaaccctatctcctgacag

SEQ ID NO: 6718122 - DNA, 23 bp, Homo sapiens
ccaaccctatctcctgacagaag

SEQ ID NO: 6718123 - DNA, 11 bp, Homo sapiens
ccaaccctcag

SEQ ID NO: 6718124 - DNA, 14 bp, Homo sapiens
ccaaccctcagaca

SEQ ID NO: 6718125 - DNA, 14 bp, Homo sapiens
ccaaccctcagagc

SEQ ID NO: 6718126 - DNA, 12 bp, Homo sapiens
ccaaccctcagg

SEQ ID NO: 6718127 - DNA, 12 bp, Homo sapiens
ccaaccctcatc

SEQ ID NO: 6718128 - DNA, 14 bp, Homo sapiens
ccaaccctcggagc

SEQ ID NO: 6718129 - DNA, 14 bp, Homo sapiens
ccaaccctgcccct

SEQ ID NO: 6718130 - DNA, 16 bp, Homo sapiens
ccaaccctgcccctgc

SEQ ID NO: 6718131 - DNA, 22 bp, Homo sapiens
ccaaccctgccgtcaccaccac

SEQ ID NO: 6718132 - DNA, 19 bp, Homo sapiens
ccaaccctgggctggggag

SEQ ID NO: 6718133 - DNA, 18 bp, Homo sapiens
ccaaccctggggaaggag

SEQ ID NO: 6718134 - DNA, 14 bp, Homo sapiens
ccaaccctgtctgt

SEQ ID NO: 6718135 - DNA, 16 bp, Homo sapiens
ccaaccctgtgggctt

SEQ ID NO: 6718136 - DNA, 16 bp, Homo sapiens
ccaaccctgtttcctg

SEQ ID NO: 6718137 - DNA, 23 bp, Homo sapiens
ccaacccttagcttttagcctgg

SEQ ID NO: 6718138 - DNA, 12 bp, Homo sapiens
ccaacccttccc

SEQ ID NO: 6718139 - DNA, 15 bp, Homo sapiens
ccaacccttccctga

SEQ ID NO: 6718140 - DNA, 13 bp, Homo sapiens
ccaacccttctcc

SEQ ID NO: 6718141 - DNA, 16 bp, Homo sapiens
ccaaccgacaggccct

SEQ ID NO: 6718142 - DNA, 18 bp, Homo sapiens
ccaaccgacaggccctgg

SEQ ID NO: 6718143 - DNA, 14 bp, Homo sapiens
ccaacctattttga

SEQ ID NO: 6718144 - DNA, 21 bp, Homo sapiens
ccaacctattttgaagtacca

SEQ ID NO: 6718145 - DNA, 16 bp, Homo sapiens
ccaacctcaatgccct

SEQ ID NO: 6718146 - DNA, 20 bp, Homo sapiens
ccaacctcaatgccctgcca

SEQ ID NO: 6718147 - DNA, 16 bp, Homo sapiens
ccaacctcactgccct

SEQ ID NO: 6718148 - DNA, 15 bp, Homo sapiens
ccaacctcagaggca

SEQ ID NO: 6718149 - DNA, 11 bp, Homo sapiens
ccaacctcagc

SEQ ID NO: 6718150 - DNA, 12 bp, Homo sapiens
ccaacctcagca

SEQ ID NO: 6718151 - DNA, 14 bp, Homo sapiens
ccaacctcagggct

SEQ ID NO: 6718152 - DNA, 22 bp, Homo sapiens
ccaacctcagggctcccagggg

SEQ ID NO: 6718153 - DNA, 12 bp, Homo sapiens
ccaacctccaga

SEQ ID NO: 6718154 - DNA, 13 bp, Homo sapiens
ccaacctcccctg

SEQ ID NO: 6718155 - DNA, 14 bp, Homo sapiens
ccaacctcctgacc

SEQ ID NO: 6718156 - DNA, 14 bp, Homo sapiens
ccaacctcctgctc

SEQ ID NO: 6718157 - DNA, 16 bp, Homo sapiens
ccaacctcctgctctg

SEQ ID NO: 6718158 - DNA, 17 bp, Homo sapiens
ccaacctcctgctctgg

SEQ ID NO: 6718159 - DNA, 23 bp, Homo sapiens
ccaacctctgtggtcacccatgc

SEQ ID NO: 6718160 - DNA, 24 bp, Homo sapiens
ccaacctctgtggtcacccatgca

SEQ ID NO: 6718161 - DNA, 20 bp, Homo sapiens
ccaacctctgttccccaccc

SEQ ID NO: 6718162 - DNA, 22 bp, Homo sapiens
ccaacctctgttccccacccag

SEQ ID NO: 6718163 - DNA, 13 bp, Homo sapiens
ccaacctcttcct

SEQ ID NO: 6718164 - DNA, 20 bp, Homo sapiens
ccaacctctttttcctcctg

SEQ ID NO: 6718165 - DNA, 21 bp, Homo sapiens
ccaacctctttttcctcctgg

SEQ ID NO: 6718166 - DNA, 13 bp, Homo sapiens
ccaacctgaccaa

SEQ ID NO: 6718167 - DNA, 16 bp, Homo sapiens
ccaacctgaccaacat

SEQ ID NO: 6718168 - DNA, 19 bp, Homo sapiens
ccaacctgatgccccttcc

SEQ ID NO: 6718169 - DNA, 17 bp, Homo sapiens
ccaacctgctctcctct

SEQ ID NO: 6718170 - DNA, 21 bp, Homo sapiens
ccaacctggacttcctgtcat

SEQ ID NO: 6718171 - DNA, 21 bp, Homo sapiens
ccaacctggctccctcccacc

SEQ ID NO: 6718172 - DNA, 20 bp, Homo sapiens
ccaacctgtaataaatatga

SEQ ID NO: 6718173 - DNA, 22 bp, Homo sapiens
ccaacctgtaataaatatgagt

SEQ ID NO: 6718174 - DNA, 12 bp, Homo sapiens
ccaacctgtcct

SEQ ID NO: 6718175 - DNA, 17 bp, Homo sapiens
ccaacctgtccttactc

SEQ ID NO: 6718176 - DNA, 22 bp, Homo sapiens
ccaacctgtccttactcagagc

SEQ ID NO: 6718177 - DNA, 23 bp, Homo sapiens
ccaacctgtccttactcagagct

SEQ ID NO: 6718178 - DNA, 12 bp, Homo sapiens
ccaaccttccca

SEQ ID NO: 6718179 - DNA, 20 bp, Homo sapiens
ccaaccttcctttttttaaa

SEQ ID NO: 6718180 - DNA, 14 bp, Homo sapiens
ccaaccttctgccc

SEQ ID NO: 6718181 - DNA, 18 bp, Homo sapiens
ccaaccttctgccctcct

SEQ ID NO: 6718182 - DNA, 19 bp, Homo sapiens
ccaaccttctgccctcctg

SEQ ID NO: 6718183 - DNA, 20 bp, Homo sapiens
ccaaccttctgccctcctgc

SEQ ID NO: 6718184 - DNA, 22 bp, Homo sapiens
ccaaccttctgccctcctgcca

SEQ ID NO: 6718185 - DNA, 23 bp, Homo sapiens
ccaaccttgctcttggggaaggg

SEQ ID NO: 6718186 - DNA, 13 bp, Homo sapiens
ccaaccttgttta

SEQ ID NO: 6718187 - DNA, 14 bp, Homo sapiens
ccaaccttgtttaa

SEQ ID NO: 6718188 - DNA, 15 bp, Homo sapiens
ccaacctttccctca

SEQ ID NO: 6718189 - DNA, 23 bp, Homo sapiens
ccaacctttccctcaccccctcc

SEQ ID NO: 6718190 - DNA, 21 bp, Homo sapiens
ccaacgagacacattgccttc

SEQ ID NO: 6718191 - DNA, 16 bp, Homo sapiens
ccaacgagcctcctca

SEQ ID NO: 6718192 - DNA, 20 bp, Homo sapiens
ccaacgagcctcctcagggg

SEQ ID NO: 6718193 - DNA, 22 bp, Homo sapiens
ccaacgagcctcctcagggggt

SEQ ID NO: 6718194 - DNA, 19 bp, Homo sapiens
ccaacgatcatatctgtat

SEQ ID NO: 6718195 - DNA, 15 bp, Homo sapiens
ccaacgcacaggaaa

SEQ ID NO: 6718196 - DNA, 17 bp, Homo sapiens
ccaacgcccctgtggcc

SEQ ID NO: 6718197 - DNA, 23 bp, Homo sapiens
ccaacgcccctgtggccaactgc

SEQ ID NO: 6718198 - DNA, 13 bp, Homo sapiens
ccaacgccgcctt

SEQ ID NO: 6718199 - DNA, 23 bp, Homo sapiens
ccaacgctgaagcggtcagactg

SEQ ID NO: 6718200 - DNA, 24 bp, Homo sapiens
ccaacggcaagggaacaagtactt

SEQ ID NO: 6718201 - DNA, 16 bp, Homo sapiens
ccaacgggaaaggaaa

SEQ ID NO: 6718202 - DNA, 13 bp, Homo sapiens
ccaacggggtggg

SEQ ID NO: 6718203 - DNA, 17 bp, Homo sapiens
ccaacggggtggggagg

SEQ ID NO: 6718204 - DNA, 18 bp, Homo sapiens
ccaacggggtggggaggg

SEQ ID NO: 6718205 - DNA, 14 bp, Homo sapiens
ccaacgtcccctcc

SEQ ID NO: 6718206 - DNA, 13 bp, Homo sapiens
ccaacgtctgtgc

SEQ ID NO: 6718207 - DNA, 19 bp, Homo sapiens
ccaacgtgcaaagccaagg

SEQ ID NO: 6718208 - DNA, 15 bp, Homo sapiens
ccaacgtggggcagc

SEQ ID NO: 6718209 - DNA, 18 bp, Homo sapiens
ccaacgttactcagggct

SEQ ID NO: 6718210 - DNA, 20 bp, Homo sapiens
ccaacgtttggaagatcctg

SEQ ID NO: 6718211 - DNA, 13 bp, Homo sapiens
ccaactaaataaa

SEQ ID NO: 6718212 - DNA, 14 bp, Homo sapiens
ccaactaagttgta

SEQ ID NO: 6718213 - DNA, 17 bp, Homo sapiens
ccaactaagttgtattt

SEQ ID NO: 6718214 - DNA, 16 bp, Homo sapiens
ccaactacaaccaagc

SEQ ID NO: 6718215 - DNA, 23 bp, Homo sapiens
ccaactacaaccaagctctctgc

SEQ ID NO: 6718216 - DNA, 15 bp, Homo sapiens
ccaactactcagaag

SEQ ID NO: 6718217 - DNA, 18 bp, Homo sapiens
ccaactactgagctgaga

SEQ ID NO: 6718218 - DNA, 17 bp, Homo sapiens
ccaactagcccctgggg

SEQ ID NO: 6718219 - DNA, 21 bp, Homo sapiens
ccaactataaaactaggtgct

SEQ ID NO: 6718220 - DNA, 14 bp, Homo sapiens
ccaactatgattat

SEQ ID NO: 6718221 - DNA, 15 bp, Homo sapiens
ccaactatgtccaga

SEQ ID NO: 6718222 - DNA, 13 bp, Homo sapiens
ccaactattctca

SEQ ID NO: 6718223 - DNA, 16 bp, Homo sapiens
ccaactattctcaggc

SEQ ID NO: 6718224 - DNA, 23 bp, Homo sapiens
ccaactatttattgactctgggt

SEQ ID NO: 6718225 - DNA, 14 bp, Homo sapiens
ccaactatttcaat

SEQ ID NO: 6718226 - DNA, 21 bp, Homo sapiens
ccaactcaagtgtcacctcct

SEQ ID NO: 6718227 - DNA, 23 bp, Homo sapiens
ccaactcaagtgtcacctccttc

SEQ ID NO: 6718228 - DNA, 16 bp, Homo sapiens
ccaactcactgtgctc

SEQ ID NO: 6718229 - DNA, 17 bp, Homo sapiens
ccaactcactgtgctcc

SEQ ID NO: 6718230 - DNA, 16 bp, Homo sapiens
ccaactcacttccagt

SEQ ID NO: 6718231 - DNA, 14 bp, Homo sapiens
ccaactcagaaggg

SEQ ID NO: 6718232 - DNA, 13 bp, Homo sapiens
ccaactcagcctg

SEQ ID NO: 6718233 - DNA, 18 bp, Homo sapiens
ccaactcagcctgttcct

SEQ ID NO: 6718234 - DNA, 23 bp, Homo sapiens
ccaactcagcctgttccttcctg

SEQ ID NO: 6718235 - DNA, 23 bp, Homo sapiens
ccaactccaaacaattctgatga

SEQ ID NO: 6718236 - DNA, 17 bp, Homo sapiens
ccaactccaacatccac

SEQ ID NO: 6718237 - DNA, 18 bp, Homo sapiens
ccaactccaacatccact

SEQ ID NO: 6718238 - DNA, 12 bp, Homo sapiens
ccaactccacag

SEQ ID NO: 6718239 - DNA, 13 bp, Homo sapiens
ccaactccacagg

SEQ ID NO: 6718240 - DNA, 21 bp, Homo sapiens
ccaactccagcaacttcttct

SEQ ID NO: 6718241 - DNA, 15 bp, Homo sapiens
ccaactccaggggca

SEQ ID NO: 6718242 - DNA, 18 bp, Homo sapiens
ccaactccatgaccaggc

SEQ ID NO: 6718243 - DNA, 21 bp, Homo sapiens
ccaactccatggggttcgaga

SEQ ID NO: 6718244 - DNA, 12 bp, Homo sapiens
ccaactcccagc

SEQ ID NO: 6718245 - DNA, 15 bp, Homo sapiens
ccaactcccagccac

SEQ ID NO: 6718246 - DNA, 17 bp, Homo sapiens
ccaactcccttctgctt

SEQ ID NO: 6718247 - DNA, 16 bp, Homo sapiens
ccaactccgaaagtct

SEQ ID NO: 6718248 - DNA, 23 bp, Homo sapiens
ccaactcctagttctagaaaaac

SEQ ID NO: 6718249 - DNA, 15 bp, Homo sapiens
ccaactcctccttgc

SEQ ID NO: 6718250 - DNA, 17 bp, Homo sapiens
ccaactcctgatgccct

SEQ ID NO: 6718251 - DNA, 20 bp, Homo sapiens
ccaactcctttcagccacat

SEQ ID NO: 6718252 - DNA, 15 bp, Homo sapiens
ccaactcgggctccc

SEQ ID NO: 6718253 - DNA, 22 bp, Homo sapiens
ccaactctaaagccaagcactt

SEQ ID NO: 6718254 - DNA, 16 bp, Homo sapiens
ccaactctaacaggca

SEQ ID NO: 6718255 - DNA, 21 bp, Homo sapiens
ccaactctaacaggcactttg

SEQ ID NO: 6718256 - DNA, 13 bp, Homo sapiens
ccaactctaatat

SEQ ID NO: 6718257 - DNA, 18 bp, Homo sapiens
ccaactctaatattgctt

SEQ ID NO: 6718258 - DNA, 21 bp, Homo sapiens
ccaactctagctgggggtggg

SEQ ID NO: 6718259 - DNA, 13 bp, Homo sapiens
ccaactctcccaa

SEQ ID NO: 6718260 - DNA, 12 bp, Homo sapiens
ccaactctcccc

SEQ ID NO: 6718261 - DNA, 18 bp, Homo sapiens
ccaactctccccagtgcc

SEQ ID NO: 6718262 - DNA, 12 bp, Homo sapiens
ccaactctcctg

SEQ ID NO: 6718263 - DNA, 19 bp, Homo sapiens
ccaactctcctggcctggc

SEQ ID NO: 6718264 - DNA, 16 bp, Homo sapiens
ccaactctctcctgta

SEQ ID NO: 6718265 - DNA, 12 bp, Homo sapiens
ccaactctctct

SEQ ID NO: 6718266 - DNA, 17 bp, Homo sapiens
ccaactctctctgcccc

SEQ ID NO: 6718267 - DNA, 18 bp, Homo sapiens
ccaactctctctgtgtcc

SEQ ID NO: 6718268 - DNA, 14 bp, Homo sapiens
ccaactctgagccc

SEQ ID NO: 6718269 - DNA, 22 bp, Homo sapiens
ccaactctgagcccatgttctg

SEQ ID NO: 6718270 - DNA, 13 bp, Homo sapiens
ccaactctgcact

SEQ ID NO: 6718271 - DNA, 14 bp, Homo sapiens
ccaactctgcactc

SEQ ID NO: 6718272 - DNA, 15 bp, Homo sapiens
ccaactcttcctccc

SEQ ID NO: 6718273 - DNA, 17 bp, Homo sapiens
ccaactcttcctcccct

SEQ ID NO: 6718274 - DNA, 18 bp, Homo sapiens
ccaactcttcctcccctc

SEQ ID NO: 6718275 - DNA, 20 bp, Homo sapiens
ccaactcttctccaagtcta

SEQ ID NO: 6718276 - DNA, 23 bp, Homo sapiens
ccaactgaaggctaaaaagcaac

SEQ ID NO: 6718277 - DNA, 15 bp, Homo sapiens
ccaactgaccacctt

SEQ ID NO: 6718278 - DNA, 18 bp, Homo sapiens
ccaactgacttctgctag

SEQ ID NO: 6718279 - DNA, 13 bp, Homo sapiens
ccaactgagccaa

SEQ ID NO: 6718280 - DNA, 16 bp, Homo sapiens
ccaactgatcctgctc

SEQ ID NO: 6718281 - DNA, 19 bp, Homo sapiens
ccaactgatcctgctccag

SEQ ID NO: 6718282 - DNA, 15 bp, Homo sapiens
ccaactgatctgtta

SEQ ID NO: 6718283 - DNA, 22 bp, Homo sapiens
ccaactgattttgtatgtaaat

SEQ ID NO: 6718284 - DNA, 20 bp, Homo sapiens
ccaactgcaaaaaaagcctc

SEQ ID NO: 6718285 - DNA, 21 bp, Homo sapiens
ccaactgcaaaaaaagcctcc

SEQ ID NO: 6718286 - DNA, 12 bp, Homo sapiens
ccaactgcacaa

SEQ ID NO: 6718287 - DNA, 14 bp, Homo sapiens
ccaactgccccagg

SEQ ID NO: 6718288 - DNA, 21 bp, Homo sapiens
ccaactgccctaagcccccag

SEQ ID NO: 6718289 - DNA, 12 bp, Homo sapiens
ccaactgcctcc

SEQ ID NO: 6718290 - DNA, 13 bp, Homo sapiens
ccaactgcctcct

SEQ ID NO: 6718291 - DNA, 18 bp, Homo sapiens
ccaactgctaatgcaaat

SEQ ID NO: 6718292 - DNA, 21 bp, Homo sapiens
ccaactgctccagcctctgcc

SEQ ID NO: 6718293 - DNA, 24 bp, Homo sapiens
ccaactgctccagcctctgccgct

SEQ ID NO: 6718294 - DNA, 14 bp, Homo sapiens
ccaactgctgcccc

SEQ ID NO: 6718295 - DNA, 13 bp, Homo sapiens
ccaactgctgctt

SEQ ID NO: 6718296 - DNA, 15 bp, Homo sapiens
ccaactggaagcaca

SEQ ID NO: 6718297 - DNA, 17 bp, Homo sapiens
ccaactggaagcacaga

SEQ ID NO: 6718298 - DNA, 15 bp, Homo sapiens
ccaactggaaggctt

SEQ ID NO: 6718299 - DNA, 21 bp, Homo sapiens
ccaactggaaggctttattct

SEQ ID NO: 6718300 - DNA, 14 bp, Homo sapiens
ccaactggtcactg

SEQ ID NO: 6718301 - DNA, 16 bp, Homo sapiens
ccaactgtggctggtc

SEQ ID NO: 6718302 - DNA, 20 bp, Homo sapiens
ccaactgtggtagctccagc

SEQ ID NO: 6718303 - DNA, 15 bp, Homo sapiens
ccaactgtgtagcat

SEQ ID NO: 6718304 - DNA, 13 bp, Homo sapiens
ccaactgtgttgt

SEQ ID NO: 6718305 - DNA, 20 bp, Homo sapiens
ccaactgtgttgtattaaca

SEQ ID NO: 6718306 - DNA, 14 bp, Homo sapiens
ccaactgtttccct

SEQ ID NO: 6718307 - DNA, 17 bp, Homo sapiens
ccaactgtttccctgct

SEQ ID NO: 6718308 - DNA, 15 bp, Homo sapiens
ccaacttaaacctgt

SEQ ID NO: 6718309 - DNA, 18 bp, Homo sapiens
ccaacttaagtttagaaa

SEQ ID NO: 6718310 - DNA, 16 bp, Homo sapiens
ccaacttcaccacccc

SEQ ID NO: 6718311 - DNA, 15 bp, Homo sapiens
ccaacttcccctcta

SEQ ID NO: 6718312 - DNA, 21 bp, Homo sapiens
ccaacttcccctctaactgga

SEQ ID NO: 6718313 - DNA, 13 bp, Homo sapiens
ccaacttctccca

SEQ ID NO: 6718314 - DNA, 15 bp, Homo sapiens
ccaacttctcccacc

SEQ ID NO: 6718315 - DNA, 20 bp, Homo sapiens
ccaacttctcccaccccttg

SEQ ID NO: 6718316 - DNA, 19 bp, Homo sapiens
ccaacttctcttgctttct

SEQ ID NO: 6718317 - DNA, 21 bp, Homo sapiens
ccaacttgaaggattgcatcc

SEQ ID NO: 6718318 - DNA, 21 bp, Homo sapiens
ccaacttgagggcccagagca

SEQ ID NO: 6718319 - DNA, 14 bp, Homo sapiens
ccaacttgatgtca

SEQ ID NO: 6718320 - DNA, 14 bp, Homo sapiens
ccaacttgccacat

SEQ ID NO: 6718321 - DNA, 16 bp, Homo sapiens
ccaacttggcagcttt

SEQ ID NO: 6718322 - DNA, 14 bp, Homo sapiens
ccaacttggctttc

SEQ ID NO: 6718323 - DNA, 17 bp, Homo sapiens
ccaacttgtctctgtag

SEQ ID NO: 6718324 - DNA, 12 bp, Homo sapiens
ccaactttccag

SEQ ID NO: 6718325 - DNA, 19 bp, Homo sapiens
ccaactttccccccaaccc

SEQ ID NO: 6718326 - DNA, 19 bp, Homo sapiens
ccaactttctcactgctgt

SEQ ID NO: 6718327 - DNA, 14 bp, Homo sapiens
ccaactttctgtaa

SEQ ID NO: 6718328 - DNA, 12 bp, Homo sapiens
ccaactttgtag

SEQ ID NO: 6718329 - DNA, 16 bp, Homo sapiens
ccaactttttccaagt

SEQ ID NO: 6718330 - DNA, 14 bp, Homo sapiens
ccaagaaaaagaaa

SEQ ID NO: 6718331 - DNA, 11 bp, Homo sapiens
ccaagaaaaat

SEQ ID NO: 6718332 - DNA, 21 bp, Homo sapiens
ccaagaaaaataattaaaaaa

SEQ ID NO: 6718333 - DNA, 20 bp, Homo sapiens
ccaagaaaaggcatggagac

SEQ ID NO: 6718334 - DNA, 23 bp, Homo sapiens
ccaagaaagacagtgtataagga

SEQ ID NO: 6718335 - DNA, 14 bp, Homo sapiens
ccaagaaagatcca

SEQ ID NO: 6718336 - DNA, 15 bp, Homo sapiens
ccaagaaagatgtat

SEQ ID NO: 6718337 - DNA, 13 bp, Homo sapiens
ccaagaaagcagg

SEQ ID NO: 6718338 - DNA, 15 bp, Homo sapiens
ccaagaaagccaaca

SEQ ID NO: 6718339 - DNA, 22 bp, Homo sapiens
ccaagaaataaattcacatcct

SEQ ID NO: 6718340 - DNA, 11 bp, Homo sapiens
ccaagaaattt

SEQ ID NO: 6718341 - DNA, 11 bp, Homo sapiens
ccaagaacata

SEQ ID NO: 6718342 - DNA, 14 bp, Homo sapiens
ccaagaacataaac

SEQ ID NO: 6718343 - DNA, 22 bp, Homo sapiens
ccaagaacataaaccctccaag

SEQ ID NO: 6718344 - DNA, 14 bp, Homo sapiens
ccaagaacattatc

SEQ ID NO: 6718345 - DNA, 22 bp, Homo sapiens
ccaagaacggcttggcagccag

SEQ ID NO: 6718346 - DNA, 19 bp, Homo sapiens
ccaagaactctaaccagtg

SEQ ID NO: 6718347 - DNA, 20 bp, Homo sapiens
ccaagaactctaaccagtgt

SEQ ID NO: 6718348 - DNA, 15 bp, Homo sapiens
ccaagaactctgggc

SEQ ID NO: 6718349 - DNA, 21 bp, Homo sapiens
ccaagaactgaaaacataaaa

SEQ ID NO: 6718350 - DNA, 11 bp, Homo sapiens
ccaagaactgc

SEQ ID NO: 6718351 - DNA, 20 bp, Homo sapiens
ccaagaagcaaagttcaact

SEQ ID NO: 6718352 - DNA, 18 bp, Homo sapiens
ccaagaagcagtggcctt

SEQ ID NO: 6718353 - DNA, 13 bp, Homo sapiens
ccaagaagcccag

SEQ ID NO: 6718354 - DNA, 14 bp, Homo sapiens
ccaagaagcccagg

SEQ ID NO: 6718355 - DNA, 13 bp, Homo sapiens
ccaagaagccctc

SEQ ID NO: 6718356 - DNA, 20 bp, Homo sapiens
ccaagaagccctccttgcca

SEQ ID NO: 6718357 - DNA, 22 bp, Homo sapiens
ccaagaagtctgtccatatgaa

SEQ ID NO: 6718358 - DNA, 17 bp, Homo sapiens
ccaagaagtgaggcctg

SEQ ID NO: 6718359 - DNA, 19 bp, Homo sapiens
ccaagaagtgaggcctggg

SEQ ID NO: 6718360 - DNA, 17 bp, Homo sapiens
ccaagaagtttaaggaa

SEQ ID NO: 6718361 - DNA, 15 bp, Homo sapiens
ccaagaatacttgaa

SEQ ID NO: 6718362 - DNA, 15 bp, Homo sapiens
ccaagaatattgcaa

SEQ ID NO: 6718363 - DNA, 19 bp, Homo sapiens
ccaagaatccacatttcta

SEQ ID NO: 6718364 - DNA, 15 bp, Homo sapiens
ccaagaatgctgaaa

SEQ ID NO: 6718365 - DNA, 11 bp, Homo sapiens
ccaagaatgta

SEQ ID NO: 6718366 - DNA, 17 bp, Homo sapiens
ccaagaatgtacgtcca

SEQ ID NO: 6718367 - DNA, 14 bp, Homo sapiens
ccaagacaaactaa

SEQ ID NO: 6718368 - DNA, 19 bp, Homo sapiens
ccaagacaaactaaacttt

SEQ ID NO: 6718369 - DNA, 13 bp, Homo sapiens
ccaagacaagacc

SEQ ID NO: 6718370 - DNA, 16 bp, Homo sapiens
ccaagacacttcccct

SEQ ID NO: 6718371 - DNA, 12 bp, Homo sapiens
ccaagacagagt

SEQ ID NO: 6718372 - DNA, 23 bp, Homo sapiens
ccaagacagatgccccagagctg

SEQ ID NO: 6718373 - DNA, 23 bp, Homo sapiens
ccaagacagattttcggaacaca

SEQ ID NO: 6718374 - DNA, 18 bp, Homo sapiens
ccaagacagcagcagcct

SEQ ID NO: 6718375 - DNA, 20 bp, Homo sapiens
ccaagacagcagcagcctgc

SEQ ID NO: 6718376 - DNA, 19 bp, Homo sapiens
ccaagacagccatacttcc

SEQ ID NO: 6718377 - DNA, 22 bp, Homo sapiens
ccaagacagtgagacagtctgg

SEQ ID NO: 6718378 - DNA, 22 bp, Homo sapiens
ccaagacagtgctgagattgga

SEQ ID NO: 6718379 - DNA, 13 bp, Homo sapiens
ccaagacagtggc

SEQ ID NO: 6718380 - DNA, 15 bp, Homo sapiens
ccaagacagtggcag

SEQ ID NO: 6718381 - DNA, 13 bp, Homo sapiens
ccaagacattaat

SEQ ID NO: 6718382 - DNA, 16 bp, Homo sapiens
ccaagacattgtcaat

SEQ ID NO: 6718383 - DNA, 23 bp, Homo sapiens
ccaagaccaagcttagtcctggg

SEQ ID NO: 6718384 - DNA, 18 bp, Homo sapiens
ccaagaccaccagggtcc

SEQ ID NO: 6718385 - DNA, 22 bp, Homo sapiens
ccaagaccaccagggtcccagg

SEQ ID NO: 6718386 - DNA, 14 bp, Homo sapiens
ccaagaccagactc

SEQ ID NO: 6718387 - DNA, 21 bp, Homo sapiens
ccaagaccatctctccctcct

SEQ ID NO: 6718388 - DNA, 16 bp, Homo sapiens
ccaagaccccagcttc

SEQ ID NO: 6718389 - DNA, 14 bp, Homo sapiens
ccaagacctcatct

SEQ ID NO: 6718390 - DNA, 20 bp, Homo sapiens
ccaagacctcatctgcctgc

SEQ ID NO: 6718391 - DNA, 21 bp, Homo sapiens
ccaagacctcatctgcctgca

SEQ ID NO: 6718392 - DNA, 19 bp, Homo sapiens
ccaagacctgttggttcca

SEQ ID NO: 6718393 - DNA, 15 bp, Homo sapiens
ccaagaccttctcct

SEQ ID NO: 6718394 - DNA, 16 bp, Homo sapiens
ccaagactcctcaggc

SEQ ID NO: 6718395 - DNA, 14 bp, Homo sapiens
ccaagactctagag

SEQ ID NO: 6718396 - DNA, 21 bp, Homo sapiens
ccaagactctagagtccaagg

SEQ ID NO: 6718397 - DNA, 14 bp, Homo sapiens
ccaagactctatgc

SEQ ID NO: 6718398 - DNA, 15 bp, Homo sapiens
ccaagactctatgct

SEQ ID NO: 6718399 - DNA, 17 bp, Homo sapiens
ccaagactctatgctct

SEQ ID NO: 6718400 - DNA, 20 bp, Homo sapiens
ccaagactctatgctctgga

SEQ ID NO: 6718401 - DNA, 15 bp, Homo sapiens
ccaagactctgctct

SEQ ID NO: 6718402 - DNA, 16 bp, Homo sapiens
ccaagactctgctctc

SEQ ID NO: 6718403 - DNA, 20 bp, Homo sapiens
ccaagacttggcaacagaag

SEQ ID NO: 6718404 - DNA, 23 bp, Homo sapiens
ccaagagaaaggcctgcacacaa

SEQ ID NO: 6718405 - DNA, 11 bp, Homo sapiens
ccaagagaagg

SEQ ID NO: 6718406 - DNA, 20 bp, Homo sapiens
ccaagagaaggggaagcact

SEQ ID NO: 6718407 - DNA, 20 bp, Homo sapiens
ccaagagacatgctgacttt

SEQ ID NO: 6718408 - DNA, 14 bp, Homo sapiens
ccaagagagaaaga

SEQ ID NO: 6718409 - DNA, 11 bp, Homo sapiens
ccaagagagac

SEQ ID NO: 6718410 - DNA, 13 bp, Homo sapiens
ccaagagagacag

SEQ ID NO: 6718411 - DNA, 18 bp, Homo sapiens
ccaagagagacagcacag

SEQ ID NO: 6718412 - DNA, 19 bp, Homo sapiens
ccaagagagacagcacagg

SEQ ID NO: 6718413 - DNA, 16 bp, Homo sapiens
ccaagagaggaaggac

SEQ ID NO: 6718414 - DNA, 20 bp, Homo sapiens
ccaagagaggaaggacccct

SEQ ID NO: 6718415 - DNA, 20 bp, Homo sapiens
ccaagagatctgtgtggctc

SEQ ID NO: 6718416 - DNA, 22 bp, Homo sapiens
ccaagagatctgtgtggctcct

SEQ ID NO: 6718417 - DNA, 12 bp, Homo sapiens
ccaagagatgaa

SEQ ID NO: 6718418 - DNA, 16 bp, Homo sapiens
ccaagagattgctaat

SEQ ID NO: 6718419 - DNA, 20 bp, Homo sapiens
ccaagagattgctaattgct

SEQ ID NO: 6718420 - DNA, 22 bp, Homo sapiens
ccaagagcaaggaaggtaaaaa

SEQ ID NO: 6718421 - DNA, 18 bp, Homo sapiens
ccaagagcaattgcagca

SEQ ID NO: 6718422 - DNA, 20 bp, Homo sapiens
ccaagagcaatttacctggt

SEQ ID NO: 6718423 - DNA, 20 bp, Homo sapiens
ccaagagcaggaggtgcctg

SEQ ID NO: 6718424 - DNA, 21 bp, Homo sapiens
ccaagagcaggaggtgcctga

SEQ ID NO: 6718425 - DNA, 21 bp, Homo sapiens
ccaagagcatcatgcctctga

SEQ ID NO: 6718426 - DNA, 15 bp, Homo sapiens
ccaagagcttccaga

SEQ ID NO: 6718427 - DNA, 18 bp, Homo sapiens
ccaagaggctccctcctg

SEQ ID NO: 6718428 - DNA, 12 bp, Homo sapiens
ccaagaggctga

SEQ ID NO: 6718429 - DNA, 12 bp, Homo sapiens
ccaagaggctgc

SEQ ID NO: 6718430 - DNA, 14 bp, Homo sapiens
ccaagaggctgcag

SEQ ID NO: 6718431 - DNA, 15 bp, Homo sapiens
ccaagaggctgcagc

SEQ ID NO: 6718432 - DNA, 18 bp, Homo sapiens
ccaagaggctggaaaagg

SEQ ID NO: 6718433 - DNA, 17 bp, Homo sapiens
ccaagagggactccaag

SEQ ID NO: 6718434 - DNA, 21 bp, Homo sapiens
ccaagaggggcgggctcagag

SEQ ID NO: 6718435 - DNA, 15 bp, Homo sapiens
ccaagaggtctgagc

SEQ ID NO: 6718436 - DNA, 17 bp, Homo sapiens
ccaagagtaactttact

SEQ ID NO: 6718437 - DNA, 18 bp, Homo sapiens
ccaagagtccaggaggcc

SEQ ID NO: 6718438 - DNA, 16 bp, Homo sapiens
ccaagagtctgatgat

SEQ ID NO: 6718439 - DNA, 18 bp, Homo sapiens
ccaagataagcctgagcc

SEQ ID NO: 6718440 - DNA, 20 bp, Homo sapiens
ccaagataagcctgagcctt

SEQ ID NO: 6718441 - DNA, 18 bp, Homo sapiens
ccaagatacttaagtgct

SEQ ID NO: 6718442 - DNA, 15 bp, Homo sapiens
ccaagataggacctt

SEQ ID NO: 6718443 - DNA, 16 bp, Homo sapiens
ccaagataggggcaca

SEQ ID NO: 6718444 - DNA, 17 bp, Homo sapiens
ccaagatcgcaccactg

SEQ ID NO: 6718445 - DNA, 17 bp, Homo sapiens
ccaagatctacaggaca

SEQ ID NO: 6718446 - DNA, 18 bp, Homo sapiens
ccaagatctgccagacct

SEQ ID NO: 6718447 - DNA, 17 bp, Homo sapiens
ccaagatgactggggtg

SEQ ID NO: 6718448 - DNA, 16 bp, Homo sapiens
ccaagatgagctgcag

SEQ ID NO: 6718449 - DNA, 13 bp, Homo sapiens
ccaagatgcctga

SEQ ID NO: 6718450 - DNA, 22 bp, Homo sapiens
ccaagatggaagtcacctttct

SEQ ID NO: 6718451 - DNA, 23 bp, Homo sapiens
ccaagatggaagtcacctttctg

SEQ ID NO: 6718452 - DNA, 21 bp, Homo sapiens
ccaagatgggcacatgaggag

SEQ ID NO: 6718453 - DNA, 17 bp, Homo sapiens
ccaagatgtaaaacaag

SEQ ID NO: 6718454 - DNA, 17 bp, Homo sapiens
ccaagatgtcaagctgg

SEQ ID NO: 6718455 - DNA, 24 bp, Homo sapiens
ccaagatgtcaagctggccgtgga

SEQ ID NO: 6718456 - DNA, 17 bp, Homo sapiens
ccaagattcaaagagac

SEQ ID NO: 6718457 - DNA, 21 bp, Homo sapiens
ccaagattcacacctgactct

SEQ ID NO: 6718458 - DNA, 14 bp, Homo sapiens
ccaagattctagat

SEQ ID NO: 6718459 - DNA, 21 bp, Homo sapiens
ccaagattgcgccattgcact

SEQ ID NO: 6718460 - DNA, 19 bp, Homo sapiens
ccaagatttaaatgccata

SEQ ID NO: 6718461 - DNA, 13 bp, Homo sapiens
ccaagatttacca

SEQ ID NO: 6718462 - DNA, 21 bp, Homo sapiens
ccaagatttaccaattcaccc

SEQ ID NO: 6718463 - DNA, 14 bp, Homo sapiens
ccaagatttcagaa

SEQ ID NO: 6718464 - DNA, 14 bp, Homo sapiens
ccaagcaaaccaat

SEQ ID NO: 6718465 - DNA, 22 bp, Homo sapiens
ccaagcaacagcctttgaatgt

SEQ ID NO: 6718466 - DNA, 18 bp, Homo sapiens
ccaagcaacctgggtcca

SEQ ID NO: 6718467 - DNA, 20 bp, Homo sapiens
ccaagcacaaactgtcgtct

SEQ ID NO: 6718468 - DNA, 15 bp, Homo sapiens
ccaagcacagagcct

SEQ ID NO: 6718469 - DNA, 17 bp, Homo sapiens
ccaagcacagagcctgg

SEQ ID NO: 6718470 - DNA, 18 bp, Homo sapiens
ccaagcacagagcctggc

SEQ ID NO: 6718471 - DNA, 13 bp, Homo sapiens
ccaagcacagcag

SEQ ID NO: 6718472 - DNA, 14 bp, Homo sapiens
ccaagcacagcagc

SEQ ID NO: 6718473 - DNA, 15 bp, Homo sapiens
ccaagcacagcagcc

SEQ ID NO: 6718474 - DNA, 18 bp, Homo sapiens
ccaagcacagcagcctgg

SEQ ID NO: 6718475 - DNA, 16 bp, Homo sapiens
ccaagcactaccagta

SEQ ID NO: 6718476 - DNA, 22 bp, Homo sapiens
ccaagcactagccttcccagct

SEQ ID NO: 6718477 - DNA, 22 bp, Homo sapiens
ccaagcactcgagaccatcctg

SEQ ID NO: 6718478 - DNA, 12 bp, Homo sapiens
ccaagcactgct

SEQ ID NO: 6718479 - DNA, 14 bp, Homo sapiens
ccaagcactgctca

SEQ ID NO: 6718480 - DNA, 18 bp, Homo sapiens
ccaagcacttctttttct

SEQ ID NO: 6718481 - DNA, 23 bp, Homo sapiens
ccaagcactttacgctgtctgta

SEQ ID NO: 6718482 - DNA, 19 bp, Homo sapiens
ccaagcactttcagtccaa

SEQ ID NO: 6718483 - DNA, 11 bp, Homo sapiens
ccaagcagaaa

SEQ ID NO: 6718484 - DNA, 13 bp, Homo sapiens
ccaagcagactcc

SEQ ID NO: 6718485 - DNA, 18 bp, Homo sapiens
ccaagcagactccagccc

SEQ ID NO: 6718486 - DNA, 20 bp, Homo sapiens
ccaagcagactccagcccct

SEQ ID NO: 6718487 - DNA, 21 bp, Homo sapiens
ccaagcagactccagcccctg

SEQ ID NO: 6718488 - DNA, 22 bp, Homo sapiens
ccaagcagactccagcccctgg

SEQ ID NO: 6718489 - DNA, 18 bp, Homo sapiens
ccaagcagcattcagcac

SEQ ID NO: 6718490 - DNA, 23 bp, Homo sapiens
ccaagcagcattcagcacacccc

SEQ ID NO: 6718491 - DNA, 12 bp, Homo sapiens
ccaagcagccag

SEQ ID NO: 6718492 - DNA, 14 bp, Homo sapiens
ccaagcagccagcc

SEQ ID NO: 6718493 - DNA, 16 bp, Homo sapiens
ccaagcagccagccag

SEQ ID NO: 6718494 - DNA, 21 bp, Homo sapiens
ccaagcagccgcagcgcagcc

SEQ ID NO: 6718495 - DNA, 12 bp, Homo sapiens
ccaagcaggaag

SEQ ID NO: 6718496 - DNA, 14 bp, Homo sapiens
ccaagcaggaagct

SEQ ID NO: 6718497 - DNA, 17 bp, Homo sapiens
ccaagcaggaagctcag

SEQ ID NO: 6718498 - DNA, 22 bp, Homo sapiens
ccaagcaggagacgacaggcga

SEQ ID NO: 6718499 - DNA, 13 bp, Homo sapiens
ccaagcagggagg

SEQ ID NO: 6718500 - DNA, 15 bp, Homo sapiens
ccaagcagtggcctt

SEQ ID NO: 6718501 - DNA, 21 bp, Homo sapiens
ccaagcagttgggactacagg

SEQ ID NO: 6718502 - DNA, 22 bp, Homo sapiens
ccaagcataccaacacgagcag

SEQ ID NO: 6718503 - DNA, 13 bp, Homo sapiens
ccaagcatagaga

SEQ ID NO: 6718504 - DNA, 18 bp, Homo sapiens
ccaagcatcaccctggga

SEQ ID NO: 6718505 - DNA, 19 bp, Homo sapiens
ccaagcatcagggggaaga

SEQ ID NO: 6718506 - DNA, 22 bp, Homo sapiens
ccaagcatcttgggggggtggc

SEQ ID NO: 6718507 - DNA, 13 bp, Homo sapiens
ccaagcatgcccc

SEQ ID NO: 6718508 - DNA, 14 bp, Homo sapiens
ccaagcatgcccca

SEQ ID NO: 6718509 - DNA, 15 bp, Homo sapiens
ccaagccaccgcagc

SEQ ID NO: 6718510 - DNA, 22 bp, Homo sapiens
ccaagccaccgcagctgctgcc

SEQ ID NO: 6718511 - DNA, 19 bp, Homo sapiens
ccaagccagaggctgggtt

SEQ ID NO: 6718512 - DNA, 22 bp, Homo sapiens
ccaagccagggatggggccaca

SEQ ID NO: 6718513 - DNA, 21 bp, Homo sapiens
ccaagccatgggtagcctggg

SEQ ID NO: 6718514 - DNA, 13 bp, Homo sapiens
ccaagcccaaact

SEQ ID NO: 6718515 - DNA, 14 bp, Homo sapiens
ccaagcccaaactt

SEQ ID NO: 6718516 - DNA, 16 bp, Homo sapiens
ccaagcccaccctggg

SEQ ID NO: 6718517 - DNA, 15 bp, Homo sapiens
ccaagccccatctca

SEQ ID NO: 6718518 - DNA, 22 bp, Homo sapiens
ccaagccccatctcatcctggc

SEQ ID NO: 6718519 - DNA, 21 bp, Homo sapiens
ccaagccccctggcagctgcc

SEQ ID NO: 6718520 - DNA, 16 bp, Homo sapiens
ccaagcccctgacccg

SEQ ID NO: 6718521 - DNA, 20 bp, Homo sapiens
ccaagcccctgccctgggga

SEQ ID NO: 6718522 - DNA, 19 bp, Homo sapiens
ccaagccctaagcctgtcc

SEQ ID NO: 6718523 - DNA, 20 bp, Homo sapiens
ccaagccctaagcctgtccc

SEQ ID NO: 6718524 - DNA, 13 bp, Homo sapiens
ccaagccctcagc

SEQ ID NO: 6718525 - DNA, 19 bp, Homo sapiens
ccaagccctcagctggtcc

SEQ ID NO: 6718526 - DNA, 18 bp, Homo sapiens
ccaagccctccgcctaga

SEQ ID NO: 6718527 - DNA, 19 bp, Homo sapiens
ccaagccctgaggcctgag

SEQ ID NO: 6718528 - DNA, 15 bp, Homo sapiens
ccaagccctgcaaat

SEQ ID NO: 6718529 - DNA, 11 bp, Homo sapiens
ccaagcccttt

SEQ ID NO: 6718530 - DNA, 17 bp, Homo sapiens
ccaagccgaccttccct

SEQ ID NO: 6718531 - DNA, 23 bp, Homo sapiens
ccaagccgaccttccctccgcct

SEQ ID NO: 6718532 - DNA, 13 bp, Homo sapiens
ccaagccggccca

SEQ ID NO: 6718533 - DNA, 15 bp, Homo sapiens
ccaagccggtgccca

SEQ ID NO: 6718534 - DNA, 13 bp, Homo sapiens
ccaagccgtggct

SEQ ID NO: 6718535 - DNA, 15 bp, Homo sapiens
ccaagccgtggcttc

SEQ ID NO: 6718536 - DNA, 14 bp, Homo sapiens
ccaagcctccacag

SEQ ID NO: 6718537 - DNA, 20 bp, Homo sapiens
ccaagcctccacagcgaggg

SEQ ID NO: 6718538 - DNA, 14 bp, Homo sapiens
ccaagcctctgccc

SEQ ID NO: 6718539 - DNA, 19 bp, Homo sapiens
ccaagcctctgccccaagg

SEQ ID NO: 6718540 - DNA, 22 bp, Homo sapiens
ccaagcctctgccccaaggggc

SEQ ID NO: 6718541 - DNA, 16 bp, Homo sapiens
ccaagcctctgtcttt

SEQ ID NO: 6718542 - DNA, 12 bp, Homo sapiens
ccaagcctgccc

SEQ ID NO: 6718543 - DNA, 11 bp, Homo sapiens
ccaagcctgct

SEQ ID NO: 6718544 - DNA, 23 bp, Homo sapiens
ccaagcctgctgtgtccttcctc

SEQ ID NO: 6718545 - DNA, 14 bp, Homo sapiens
ccaagcctggcacc

SEQ ID NO: 6718546 - DNA, 17 bp, Homo sapiens
ccaagcctggcacccac

SEQ ID NO: 6718547 - DNA, 21 bp, Homo sapiens
ccaagcctggcacccaccgtc

SEQ ID NO: 6718548 - DNA, 13 bp, Homo sapiens
ccaagcctggcag

SEQ ID NO: 6718549 - DNA, 20 bp, Homo sapiens
ccaagcctggtcagcccaaa

SEQ ID NO: 6718550 - DNA, 22 bp, Homo sapiens
ccaagcgagaatgcaggccccg

SEQ ID NO: 6718551 - DNA, 21 bp, Homo sapiens
ccaagcgaggtcaacagagaa

SEQ ID NO: 6718552 - DNA, 16 bp, Homo sapiens
ccaagcgccctggccc

SEQ ID NO: 6718553 - DNA, 22 bp, Homo sapiens
ccaagcgccctggcccccacat

SEQ ID NO: 6718554 - DNA, 13 bp, Homo sapiens
ccaagcggccctg

SEQ ID NO: 6718555 - DNA, 17 bp, Homo sapiens
ccaagcggccctgtgtg

SEQ ID NO: 6718556 - DNA, 17 bp, Homo sapiens
ccaagcgggggcgtggc

SEQ ID NO: 6718557 - DNA, 18 bp, Homo sapiens
ccaagcgggggcgtggct

SEQ ID NO: 6718558 - DNA, 15 bp, Homo sapiens
ccaagcggtgtctct

SEQ ID NO: 6718559 - DNA, 18 bp, Homo sapiens
ccaagcgttcctggcctt

SEQ ID NO: 6718560 - DNA, 19 bp, Homo sapiens
ccaagcgttcctggccttc

SEQ ID NO: 6718561 - DNA, 19 bp, Homo sapiens
ccaagctaagctgcaggca

SEQ ID NO: 6718562 - DNA, 21 bp, Homo sapiens
ccaagctaagctgcaggcaca

SEQ ID NO: 6718563 - DNA, 15 bp, Homo sapiens
ccaagctagaattcc

SEQ ID NO: 6718564 - DNA, 15 bp, Homo sapiens
ccaagctagactgtg

SEQ ID NO: 6718565 - DNA, 16 bp, Homo sapiens
ccaagctagactgtgt

SEQ ID NO: 6718566 - DNA, 17 bp, Homo sapiens
ccaagctagactgtgtc

SEQ ID NO: 6718567 - DNA, 18 bp, Homo sapiens
ccaagctataaaagccca

SEQ ID NO: 6718568 - DNA, 16 bp, Homo sapiens
ccaagctatcctggct

SEQ ID NO: 6718569 - DNA, 16 bp, Homo sapiens
ccaagctattcctttc

SEQ ID NO: 6718570 - DNA, 20 bp, Homo sapiens
ccaagctattcctttccctt

SEQ ID NO: 6718571 - DNA, 19 bp, Homo sapiens
ccaagctcacacctgtcct

SEQ ID NO: 6718572 - DNA, 18 bp, Homo sapiens
ccaagctcacagttcctc

SEQ ID NO: 6718573 - DNA, 19 bp, Homo sapiens
ccaagctcacagttcctcg

SEQ ID NO: 6718574 - DNA, 16 bp, Homo sapiens
ccaagctcagaaggct

SEQ ID NO: 6718575 - DNA, 23 bp, Homo sapiens
ccaagctcagagcagcctctgtc

SEQ ID NO: 6718576 - DNA, 20 bp, Homo sapiens
ccaagctcaggaccaggcaa

SEQ ID NO: 6718577 - DNA, 15 bp, Homo sapiens
ccaagctcccaagag

SEQ ID NO: 6718578 - DNA, 22 bp, Homo sapiens
ccaagctcccaggcattcccca

SEQ ID NO: 6718579 - DNA, 11 bp, Homo sapiens
ccaagctccct

SEQ ID NO: 6718580 - DNA, 13 bp, Homo sapiens
ccaagctccctgc

SEQ ID NO: 6718581 - DNA, 19 bp, Homo sapiens
ccaagctccctgccccaaa

SEQ ID NO: 6718582 - DNA, 16 bp, Homo sapiens
ccaagctccctggagc

SEQ ID NO: 6718583 - DNA, 18 bp, Homo sapiens
ccaagctccctggagccc

SEQ ID NO: 6718584 - DNA, 19 bp, Homo sapiens
ccaagctccctggagccct

SEQ ID NO: 6718585 - DNA, 13 bp, Homo sapiens
ccaagctcctcct

SEQ ID NO: 6718586 - DNA, 20 bp, Homo sapiens
ccaagctcctcctcggaacc

SEQ ID NO: 6718587 - DNA, 22 bp, Homo sapiens
ccaagctccttgggaggcccca

SEQ ID NO: 6718588 - DNA, 16 bp, Homo sapiens
ccaagctctgctcctc

SEQ ID NO: 6718589 - DNA, 18 bp, Homo sapiens
ccaagctctgctcctctc

SEQ ID NO: 6718590 - DNA, 23 bp, Homo sapiens
ccaagctgagcaacctcttcagc

SEQ ID NO: 6718591 - DNA, 12 bp, Homo sapiens
ccaagctgagga

SEQ ID NO: 6718592 - DNA, 20 bp, Homo sapiens
ccaagctgaggaggtgctgc

SEQ ID NO: 6718593 - DNA, 13 bp, Homo sapiens
ccaagctgaggtg

SEQ ID NO: 6718594 - DNA, 19 bp, Homo sapiens
ccaagctgagtttcctatg

SEQ ID NO: 6718595 - DNA, 23 bp, Homo sapiens
ccaagctgatggacatgagagta

SEQ ID NO: 6718596 - DNA, 11 bp, Homo sapiens
ccaagctgcac

SEQ ID NO: 6718597 - DNA, 23 bp, Homo sapiens
ccaagctgcctcccctctccttc

SEQ ID NO: 6718598 - DNA, 17 bp, Homo sapiens
ccaagctgcctctgggc

SEQ ID NO: 6718599 - DNA, 18 bp, Homo sapiens
ccaagctgcctctgggcc

SEQ ID NO: 6718600 - DNA, 12 bp, Homo sapiens
ccaagctgcggg

SEQ ID NO: 6718601 - DNA, 12 bp, Homo sapiens
ccaagctgctgc

SEQ ID NO: 6718602 - DNA, 13 bp, Homo sapiens
ccaagctggcaca

SEQ ID NO: 6718603 - DNA, 15 bp, Homo sapiens
ccaagctggcacaaa

SEQ ID NO: 6718604 - DNA, 23 bp, Homo sapiens
ccaagctggcacaaaagacagct

SEQ ID NO: 6718605 - DNA, 24 bp, Homo sapiens
ccaagctggcacaaaagacagctg

SEQ ID NO: 6718606 - DNA, 15 bp, Homo sapiens
ccaagctggcagctg

SEQ ID NO: 6718607 - DNA, 18 bp, Homo sapiens
ccaagctgggccccagcc

SEQ ID NO: 6718608 - DNA, 21 bp, Homo sapiens
ccaagctgggccccagcccac

SEQ ID NO: 6718609 - DNA, 14 bp, Homo sapiens
ccaagctgggctcc

SEQ ID NO: 6718610 - DNA, 12 bp, Homo sapiens
ccaagctggtcc

SEQ ID NO: 6718611 - DNA, 13 bp, Homo sapiens
ccaagctgtgcca

SEQ ID NO: 6718612 - DNA, 16 bp, Homo sapiens
ccaagctgtgccaccc

SEQ ID NO: 6718613 - DNA, 17 bp, Homo sapiens
ccaagctgtgttcatcc

SEQ ID NO: 6718614 - DNA, 21 bp, Homo sapiens
ccaagctgttaaagatatttt

SEQ ID NO: 6718615 - DNA, 21 bp, Homo sapiens
ccaagctgttccacttctcta

SEQ ID NO: 6718616 - DNA, 20 bp, Homo sapiens
ccaagcttaaggagaggaga

SEQ ID NO: 6718617 - DNA, 22 bp, Homo sapiens
ccaagcttaaggagaggagagc

SEQ ID NO: 6718618 - DNA, 17 bp, Homo sapiens
ccaagcttcaaccctca

SEQ ID NO: 6718619 - DNA, 22 bp, Homo sapiens
ccaagcttcaaccctcagcctt

SEQ ID NO: 6718620 - DNA, 12 bp, Homo sapiens
ccaagcttcaga

SEQ ID NO: 6718621 - DNA, 14 bp, Homo sapiens
ccaagcttcagagc

SEQ ID NO: 6718622 - DNA, 17 bp, Homo sapiens
ccaagcttccacctgtc

SEQ ID NO: 6718623 - DNA, 22 bp, Homo sapiens
ccaagcttccatagctgctgcc

SEQ ID NO: 6718624 - DNA, 12 bp, Homo sapiens
ccaagcttccct

SEQ ID NO: 6718625 - DNA, 13 bp, Homo sapiens
ccaagcttccctc

SEQ ID NO: 6718626 - DNA, 13 bp, Homo sapiens
ccaagcttcctgt

SEQ ID NO: 6718627 - DNA, 23 bp, Homo sapiens
ccaagcttgtccaacccgaggcc

SEQ ID NO: 6718628 - DNA, 19 bp, Homo sapiens
ccaagcttgtgagagctgg

SEQ ID NO: 6718629 - DNA, 17 bp, Homo sapiens
ccaagcttgtttccctg

SEQ ID NO: 6718630 - DNA, 18 bp, Homo sapiens
ccaagcttgtttccctgc

SEQ ID NO: 6718631 - DNA, 19 bp, Homo sapiens
ccaagcttgtttccctgct

SEQ ID NO: 6718632 - DNA, 22 bp, Homo sapiens
ccaagcttgtttccctgctggc

SEQ ID NO: 6718633 - DNA, 23 bp, Homo sapiens
ccaagctttcttctacaaccaga

SEQ ID NO: 6718634 - DNA, 23 bp, Homo sapiens
ccaaggaaaccacagctgctgga

SEQ ID NO: 6718635 - DNA, 22 bp, Homo sapiens
ccaaggaaacgctacctctctg

SEQ ID NO: 6718636 - DNA, 14 bp, Homo sapiens
ccaaggaacaagac

SEQ ID NO: 6718637 - DNA, 21 bp, Homo sapiens
ccaaggaacctaattgaaatt

SEQ ID NO: 6718638 - DNA, 11 bp, Homo sapiens
ccaaggaagct

SEQ ID NO: 6718639 - DNA, 18 bp, Homo sapiens
ccaaggaaggagcccctg

SEQ ID NO: 6718640 - DNA, 19 bp, Homo sapiens
ccaaggaaggagcccctga

SEQ ID NO: 6718641 - DNA, 21 bp, Homo sapiens
ccaaggaaggagcccctgagt

SEQ ID NO: 6718642 - DNA, 14 bp, Homo sapiens
ccaaggaagtctgt

SEQ ID NO: 6718643 - DNA, 16 bp, Homo sapiens
ccaaggaatgatccat

SEQ ID NO: 6718644 - DNA, 22 bp, Homo sapiens
ccaaggaatgatccatactgaa

SEQ ID NO: 6718645 - DNA, 21 bp, Homo sapiens
ccaaggaatgtgtccaagaca

SEQ ID NO: 6718646 - DNA, 22 bp, Homo sapiens
ccaaggaatgtgtccaagacac

SEQ ID NO: 6718647 - DNA, 15 bp, Homo sapiens
ccaaggacactgatg

SEQ ID NO: 6718648 - DNA, 21 bp, Homo sapiens
ccaaggacactgatgggtcct

SEQ ID NO: 6718649 - DNA, 22 bp, Homo sapiens
ccaaggacactgatgggtcctg

SEQ ID NO: 6718650 - DNA, 13 bp, Homo sapiens
ccaaggacagggc

SEQ ID NO: 6718651 - DNA, 15 bp, Homo sapiens
ccaaggacagttcag

SEQ ID NO: 6718652 - DNA, 13 bp, Homo sapiens
ccaaggacccagc

SEQ ID NO: 6718653 - DNA, 14 bp, Homo sapiens
ccaaggacccagcc

SEQ ID NO: 6718654 - DNA, 16 bp, Homo sapiens
ccaaggacccagccct

SEQ ID NO: 6718655 - DNA, 19 bp, Homo sapiens
ccaaggacccaggcgctgc

SEQ ID NO: 6718656 - DNA, 20 bp, Homo sapiens
ccaaggacccaggcgctgca

SEQ ID NO: 6718657 - DNA, 22 bp, Homo sapiens
ccaaggacctcctcttccccct

SEQ ID NO: 6718658 - DNA, 22 bp, Homo sapiens
ccaaggaccttggaagagcaag

SEQ ID NO: 6718659 - DNA, 16 bp, Homo sapiens
ccaaggactctggcct

SEQ ID NO: 6718660 - DNA, 17 bp, Homo sapiens
ccaaggactctggcctc

SEQ ID NO: 6718661 - DNA, 19 bp, Homo sapiens
ccaaggactgactgagaca

SEQ ID NO: 6718662 - DNA, 22 bp, Homo sapiens
ccaaggactgagcaccctctgg

SEQ ID NO: 6718663 - DNA, 15 bp, Homo sapiens
ccaaggactttccag

SEQ ID NO: 6718664 - DNA, 21 bp, Homo sapiens
ccaaggactttccagtgagga

SEQ ID NO: 6718665 - DNA, 12 bp, Homo sapiens
ccaaggagacca

SEQ ID NO: 6718666 - DNA, 13 bp, Homo sapiens
ccaaggagaccaa

SEQ ID NO: 6718667 - DNA, 12 bp, Homo sapiens
ccaaggagcaca

SEQ ID NO: 6718668 - DNA, 14 bp, Homo sapiens
ccaaggagcacagg

SEQ ID NO: 6718669 - DNA, 19 bp, Homo sapiens
ccaaggagcacaggtccca

SEQ ID NO: 6718670 - DNA, 20 bp, Homo sapiens
ccaaggagcacaggtcccac

SEQ ID NO: 6718671 - DNA, 23 bp, Homo sapiens
ccaaggagcagagaggtggccac

SEQ ID NO: 6718672 - DNA, 13 bp, Homo sapiens
ccaaggagcatcc

SEQ ID NO: 6718673 - DNA, 13 bp, Homo sapiens
ccaaggagcccct

SEQ ID NO: 6718674 - DNA, 15 bp, Homo sapiens
ccaaggagctgagaa

SEQ ID NO: 6718675 - DNA, 17 bp, Homo sapiens
ccaaggagctgagaata

SEQ ID NO: 6718676 - DNA, 19 bp, Homo sapiens
ccaaggagcttacccaagc

SEQ ID NO: 6718677 - DNA, 21 bp, Homo sapiens
ccaaggaggaaaaacagacaa

SEQ ID NO: 6718678 - DNA, 23 bp, Homo sapiens
ccaaggaggaaataactaagaga

SEQ ID NO: 6718679 - DNA, 13 bp, Homo sapiens
ccaaggaggcagc

SEQ ID NO: 6718680 - DNA, 12 bp, Homo sapiens
ccaaggaggggc

SEQ ID NO: 6718681 - DNA, 21 bp, Homo sapiens
ccaaggagggggcctcattgt

SEQ ID NO: 6718682 - DNA, 19 bp, Homo sapiens
ccaaggagtcactgagacc

SEQ ID NO: 6718683 - DNA, 23 bp, Homo sapiens
ccaaggagtcagatggcaatggg

SEQ ID NO: 6718684 - DNA, 19 bp, Homo sapiens
ccaaggataggtattttat

SEQ ID NO: 6718685 - DNA, 18 bp, Homo sapiens
ccaaggatcggactctgc

SEQ ID NO: 6718686 - DNA, 13 bp, Homo sapiens
ccaaggcaaatgt

SEQ ID NO: 6718687 - DNA, 14 bp, Homo sapiens
ccaaggcaaatgtc

SEQ ID NO: 6718688 - DNA, 17 bp, Homo sapiens
ccaaggcaagcatgaat

SEQ ID NO: 6718689 - DNA, 19 bp, Homo sapiens
ccaaggcaagcatgaataa

SEQ ID NO: 6718690 - DNA, 15 bp, Homo sapiens
ccaaggcaaggcagg

SEQ ID NO: 6718691 - DNA, 16 bp, Homo sapiens
ccaaggcaaggcaggt

SEQ ID NO: 6718692 - DNA, 17 bp, Homo sapiens
ccaaggcaaggcaggtg

SEQ ID NO: 6718693 - DNA, 23 bp, Homo sapiens
ccaaggcaaggcaggtgcctcca

SEQ ID NO: 6718694 - DNA, 15 bp, Homo sapiens
ccaaggcactgagcg

SEQ ID NO: 6718695 - DNA, 15 bp, Homo sapiens
ccaaggcagaggcct

SEQ ID NO: 6718696 - DNA, 20 bp, Homo sapiens
ccaaggcagaggcctgggct

SEQ ID NO: 6718697 - DNA, 21 bp, Homo sapiens
ccaaggcagaggcctgggctg

SEQ ID NO: 6718698 - DNA, 22 bp, Homo sapiens
ccaaggcagaggcctgggctgg

SEQ ID NO: 6718699 - DNA, 13 bp, Homo sapiens
ccaaggcagcctc

SEQ ID NO: 6718700 - DNA, 20 bp, Homo sapiens
ccaaggcagcctccagagcc

SEQ ID NO: 6718701 - DNA, 23 bp, Homo sapiens
ccaaggcagcctccagagccagc

SEQ ID NO: 6718702 - DNA, 17 bp, Homo sapiens
ccaaggcagcgacccca

SEQ ID NO: 6718703 - DNA, 20 bp, Homo sapiens
ccaaggcagcgaccccagga

SEQ ID NO: 6718704 - DNA, 20 bp, Homo sapiens
ccaaggcagctcttctggag

SEQ ID NO: 6718705 - DNA, 21 bp, Homo sapiens
ccaaggcagctcttctggagt

SEQ ID NO: 6718706 - DNA, 12 bp, Homo sapiens
ccaaggcagctg

SEQ ID NO: 6718707 - DNA, 13 bp, Homo sapiens
ccaaggcagggcc

SEQ ID NO: 6718708 - DNA, 12 bp, Homo sapiens
ccaaggcagtgc

SEQ ID NO: 6718709 - DNA, 19 bp, Homo sapiens
ccaaggcagtgcatgcatg

SEQ ID NO: 6718710 - DNA, 13 bp, Homo sapiens
ccaaggcagttct

SEQ ID NO: 6718711 - DNA, 14 bp, Homo sapiens
ccaaggcagttctg

SEQ ID NO: 6718712 - DNA, 18 bp, Homo sapiens
ccaaggcagttctgtgtc

SEQ ID NO: 6718713 - DNA, 19 bp, Homo sapiens
ccaaggcagttctgtgtcc

SEQ ID NO: 6718714 - DNA, 16 bp, Homo sapiens
ccaaggccaaaggaag

SEQ ID NO: 6718715 - DNA, 21 bp, Homo sapiens
ccaaggccaaaggaagcacat

SEQ ID NO: 6718716 - DNA, 19 bp, Homo sapiens
ccaaggccagaaggagggg

SEQ ID NO: 6718717 - DNA, 20 bp, Homo sapiens
ccaaggccagccacaccaca

SEQ ID NO: 6718718 - DNA, 16 bp, Homo sapiens
ccaaggccaggccttg

SEQ ID NO: 6718719 - DNA, 22 bp, Homo sapiens
ccaaggccccagggacagaggc

SEQ ID NO: 6718720 - DNA, 19 bp, Homo sapiens
ccaaggcccccacctctgt

SEQ ID NO: 6718721 - DNA, 21 bp, Homo sapiens
ccaaggccccctgcctgccct

SEQ ID NO: 6718722 - DNA, 17 bp, Homo sapiens
ccaaggccctgcatctg

SEQ ID NO: 6718723 - DNA, 16 bp, Homo sapiens
ccaaggccctgtctct

SEQ ID NO: 6718724 - DNA, 16 bp, Homo sapiens
ccaaggccgaagctct

SEQ ID NO: 6718725 - DNA, 20 bp, Homo sapiens
ccaaggccgaagctctggct

SEQ ID NO: 6718726 - DNA, 16 bp, Homo sapiens
ccaaggccgcggccca

SEQ ID NO: 6718727 - DNA, 17 bp, Homo sapiens
ccaaggccgcggcccag

SEQ ID NO: 6718728 - DNA, 20 bp, Homo sapiens
ccaaggccgcggcccagacc

SEQ ID NO: 6718729 - DNA, 17 bp, Homo sapiens
ccaaggcctaccccagt

SEQ ID NO: 6718730 - DNA, 20 bp, Homo sapiens
ccaaggcctaccccagttcc

SEQ ID NO: 6718731 - DNA, 21 bp, Homo sapiens
ccaaggcctatgccacctgca

SEQ ID NO: 6718732 - DNA, 23 bp, Homo sapiens
ccaaggcctatgccacctgcagc

SEQ ID NO: 6718733 - DNA, 23 bp, Homo sapiens
ccaaggcctctcaccccacttcc

SEQ ID NO: 6718734 - DNA, 16 bp, Homo sapiens
ccaaggcctctctctg

SEQ ID NO: 6718735 - DNA, 19 bp, Homo sapiens
ccaaggccttcccctggca

SEQ ID NO: 6718736 - DNA, 17 bp, Homo sapiens
ccaaggcctttcctaca

SEQ ID NO: 6718737 - DNA, 14 bp, Homo sapiens
ccaaggcggcccct

SEQ ID NO: 6718738 - DNA, 16 bp, Homo sapiens
ccaaggcggcccctcc

SEQ ID NO: 6718739 - DNA, 15 bp, Homo sapiens
ccaaggctctcccct

SEQ ID NO: 6718740 - DNA, 16 bp, Homo sapiens
ccaaggctctcccctc

SEQ ID NO: 6718741 - DNA, 13 bp, Homo sapiens
ccaaggctctgtt

SEQ ID NO: 6718742 - DNA, 15 bp, Homo sapiens
ccaaggctgcctgcc

SEQ ID NO: 6718743 - DNA, 16 bp, Homo sapiens
ccaaggctgctcagag

SEQ ID NO: 6718744 - DNA, 17 bp, Homo sapiens
ccaagggaacctgtgtc

SEQ ID NO: 6718745 - DNA, 19 bp, Homo sapiens
ccaagggaacctgtgtccg

SEQ ID NO: 6718746 - DNA, 14 bp, Homo sapiens
ccaagggacaaccc

SEQ ID NO: 6718747 - DNA, 14 bp, Homo sapiens
ccaagggacacagg

SEQ ID NO: 6718748 - DNA, 23 bp, Homo sapiens
ccaagggacacaggagaccaccc

SEQ ID NO: 6718749 - DNA, 22 bp, Homo sapiens
ccaagggacagcaagtgagcag

SEQ ID NO: 6718750 - DNA, 16 bp, Homo sapiens
ccaagggacaggtggg

SEQ ID NO: 6718751 - DNA, 13 bp, Homo sapiens
ccaagggaccagg

SEQ ID NO: 6718752 - DNA, 15 bp, Homo sapiens
ccaagggaggctgct

SEQ ID NO: 6718753 - DNA, 12 bp, Homo sapiens
ccaagggaggga

SEQ ID NO: 6718754 - DNA, 17 bp, Homo sapiens
ccaagggagggaagggc

SEQ ID NO: 6718755 - DNA, 22 bp, Homo sapiens
ccaagggagggtgcagccctct

SEQ ID NO: 6718756 - DNA, 21 bp, Homo sapiens
ccaagggatctggtcctaccc

SEQ ID NO: 6718757 - DNA, 18 bp, Homo sapiens
ccaagggcaaaattccca

SEQ ID NO: 6718758 - DNA, 15 bp, Homo sapiens
ccaagggcagaaagt

SEQ ID NO: 6718759 - DNA, 14 bp, Homo sapiens
ccaagggccaaacc

SEQ ID NO: 6718760 - DNA, 13 bp, Homo sapiens
ccaagggcccaaa

SEQ ID NO: 6718761 - DNA, 12 bp, Homo sapiens
ccaagggcccag

SEQ ID NO: 6718762 - DNA, 13 bp, Homo sapiens
ccaagggcccaga

SEQ ID NO: 6718763 - DNA, 14 bp, Homo sapiens
ccaagggcccagac

SEQ ID NO: 6718764 - DNA, 16 bp, Homo sapiens
ccaagggcccagaccc

SEQ ID NO: 6718765 - DNA, 18 bp, Homo sapiens
ccaagggcccagaccctg

SEQ ID NO: 6718766 - DNA, 14 bp, Homo sapiens
ccaagggccccagg

SEQ ID NO: 6718767 - DNA, 14 bp, Homo sapiens
ccaagggccctggc

SEQ ID NO: 6718768 - DNA, 22 bp, Homo sapiens
ccaagggccctggcacccccac

SEQ ID NO: 6718769 - DNA, 16 bp, Homo sapiens
ccaagggcctggcctg

SEQ ID NO: 6718770 - DNA, 18 bp, Homo sapiens
ccaagggcctggcctgag

SEQ ID NO: 6718771 - DNA, 22 bp, Homo sapiens
ccaagggctgacttctccagga

SEQ ID NO: 6718772 - DNA, 18 bp, Homo sapiens
ccaaggggacttgtgcca

SEQ ID NO: 6718773 - DNA, 20 bp, Homo sapiens
ccaaggggagtcaccttccc

SEQ ID NO: 6718774 - DNA, 14 bp, Homo sapiens
ccaaggggcagtct

SEQ ID NO: 6718775 - DNA, 16 bp, Homo sapiens
ccaaggggccagctgc

SEQ ID NO: 6718776 - DNA, 17 bp, Homo sapiens
ccaaggggccagctgcc

SEQ ID NO: 6718777 - DNA, 18 bp, Homo sapiens
ccaaggggccagctgccc

SEQ ID NO: 6718778 - DNA, 19 bp, Homo sapiens
ccaaggggccagctgcccc

SEQ ID NO: 6718779 - DNA, 17 bp, Homo sapiens
ccaaggggcccacaaag

SEQ ID NO: 6718780 - DNA, 15 bp, Homo sapiens
ccaagggggcagagg

SEQ ID NO: 6718781 - DNA, 23 bp, Homo sapiens
ccaagggggcggggactgctggc

SEQ ID NO: 6718782 - DNA, 15 bp, Homo sapiens
ccaagggggctgctg

SEQ ID NO: 6718783 - DNA, 20 bp, Homo sapiens
ccaagggggctgctgctcct

SEQ ID NO: 6718784 - DNA, 17 bp, Homo sapiens
ccaagggggtgactgga

SEQ ID NO: 6718785 - DNA, 19 bp, Homo sapiens
ccaagggggtgactggaag

SEQ ID NO: 6718786 - DNA, 23 bp, Homo sapiens
ccaaggggtctgctcctgtggcg

SEQ ID NO: 6718787 - DNA, 20 bp, Homo sapiens
ccaaggggtggccgggcaca

SEQ ID NO: 6718788 - DNA, 21 bp, Homo sapiens
ccaaggggtgggcctgtgaat

SEQ ID NO: 6718789 - DNA, 17 bp, Homo sapiens
ccaagggtacagatccc

SEQ ID NO: 6718790 - DNA, 23 bp, Homo sapiens
ccaagggtatccaagttggactg

SEQ ID NO: 6718791 - DNA, 20 bp, Homo sapiens
ccaagggtatgggaagccat

SEQ ID NO: 6718792 - DNA, 23 bp, Homo sapiens
ccaagggttcagagactcagggc

SEQ ID NO: 6718793 - DNA, 22 bp, Homo sapiens
ccaagggttgaattctggagga

SEQ ID NO: 6718794 - DNA, 23 bp, Homo sapiens
ccaagggtttcgactggtccagc

SEQ ID NO: 6718795 - DNA, 20 bp, Homo sapiens
ccaaggtagaatgaccttgt

SEQ ID NO: 6718796 - DNA, 15 bp, Homo sapiens
ccaaggtcccctcca

SEQ ID NO: 6718797 - DNA, 16 bp, Homo sapiens
ccaaggtcccctccac

SEQ ID NO: 6718798 - DNA, 14 bp, Homo sapiens
ccaaggtcctctca

SEQ ID NO: 6718799 - DNA, 16 bp, Homo sapiens
ccaaggtctgagcact

SEQ ID NO: 6718800 - DNA, 19 bp, Homo sapiens
ccaaggtcttcagccatca

SEQ ID NO: 6718801 - DNA, 16 bp, Homo sapiens
ccaaggtcttcttaat

SEQ ID NO: 6718802 - DNA, 21 bp, Homo sapiens
ccaaggtgaggtgaactccag

SEQ ID NO: 6718803 - DNA, 10 bp, Homo sapiens
ccaaggtgca

SEQ ID NO: 6718804 - DNA, 16 bp, Homo sapiens
ccaaggtgcatataga

SEQ ID NO: 6718805 - DNA, 19 bp, Homo sapiens
ccaaggtgcatatagaaaa

SEQ ID NO: 6718806 - DNA, 15 bp, Homo sapiens
ccaaggtgccaccac

SEQ ID NO: 6718807 - DNA, 15 bp, Homo sapiens
ccaaggtgctctgtg

SEQ ID NO: 6718808 - DNA, 17 bp, Homo sapiens
ccaaggtggcagatgtc

SEQ ID NO: 6718809 - DNA, 22 bp, Homo sapiens
ccaaggtggcagatgtcttccc

SEQ ID NO: 6718810 - DNA, 14 bp, Homo sapiens
ccaaggtggcttct

SEQ ID NO: 6718811 - DNA, 13 bp, Homo sapiens
ccaaggtgggagg

SEQ ID NO: 6718812 - DNA, 23 bp, Homo sapiens
ccaaggtggtctgctcgggccca

SEQ ID NO: 6718813 - DNA, 24 bp, Homo sapiens
ccaaggtggtcttggagaggaggt

SEQ ID NO: 6718814 - DNA, 13 bp, Homo sapiens
ccaaggtgtccta

SEQ ID NO: 6718815 - DNA, 17 bp, Homo sapiens
ccaaggttactcagcag

SEQ ID NO: 6718816 - DNA, 21 bp, Homo sapiens
ccaaggttactcagcagcaga

SEQ ID NO: 6718817 - DNA, 22 bp, Homo sapiens
ccaaggttactcagcagcagag

SEQ ID NO: 6718818 - DNA, 14 bp, Homo sapiens
ccaaggttctgggt

SEQ ID NO: 6718819 - DNA, 18 bp, Homo sapiens
ccaaggttgcacagcaag

SEQ ID NO: 6718820 - DNA, 17 bp, Homo sapiens
ccaaggttgtcagcttt

SEQ ID NO: 6718821 - DNA, 20 bp, Homo sapiens
ccaaggtttaaacttctctg

SEQ ID NO: 6718822 - DNA, 23 bp, Homo sapiens
ccaaggtttaaagagtctagatt

SEQ ID NO: 6718823 - DNA, 14 bp, Homo sapiens
ccaagtaaaatgtt

SEQ ID NO: 6718824 - DNA, 16 bp, Homo sapiens
ccaagtaaaatgtttt

SEQ ID NO: 6718825 - DNA, 18 bp, Homo sapiens
ccaagtaaacagggtacc

SEQ ID NO: 6718826 - DNA, 18 bp, Homo sapiens
ccaagtaaagtgatgttt

SEQ ID NO: 6718827 - DNA, 17 bp, Homo sapiens
ccaagtaaatagcaaca

SEQ ID NO: 6718828 - DNA, 20 bp, Homo sapiens
ccaagtaactgggattacag

SEQ ID NO: 6718829 - DNA, 17 bp, Homo sapiens
ccaagtaagaggctgga

SEQ ID NO: 6718830 - DNA, 19 bp, Homo sapiens
ccaagtaagagtggtggcc

SEQ ID NO: 6718831 - DNA, 16 bp, Homo sapiens
ccaagtaatataatgg

SEQ ID NO: 6718832 - DNA, 13 bp, Homo sapiens
ccaagtacagcct

SEQ ID NO: 6718833 - DNA, 17 bp, Homo sapiens
ccaagtaccaatgctgt

SEQ ID NO: 6718834 - DNA, 15 bp, Homo sapiens
ccaagtagcctctcc

SEQ ID NO: 6718835 - DNA, 20 bp, Homo sapiens
ccaagtagctaggactacag

SEQ ID NO: 6718836 - DNA, 14 bp, Homo sapiens
ccaagtagctgcta

SEQ ID NO: 6718837 - DNA, 20 bp, Homo sapiens
ccaagtagctgggagtacag

SEQ ID NO: 6718838 - DNA, 20 bp, Homo sapiens
ccaagtagctgggattacag

SEQ ID NO: 6718839 - DNA, 21 bp, Homo sapiens
ccaagtatgaagtataaatct

SEQ ID NO: 6718840 - DNA, 13 bp, Homo sapiens
ccaagtatgcctt

SEQ ID NO: 6718841 - DNA, 16 bp, Homo sapiens
ccaagtatgccttaag

SEQ ID NO: 6718842 - DNA, 14 bp, Homo sapiens
ccaagtatttcaca

SEQ ID NO: 6718843 - DNA, 19 bp, Homo sapiens
ccaagtcaaacagtgtggc

SEQ ID NO: 6718844 - DNA, 20 bp, Homo sapiens
ccaagtcaacactcttcttg

SEQ ID NO: 6718845 - DNA, 21 bp, Homo sapiens
ccaagtcaacactcttcttga

SEQ ID NO: 6718846 - DNA, 15 bp, Homo sapiens
ccaagtcacacagct

SEQ ID NO: 6718847 - DNA, 14 bp, Homo sapiens
ccaagtcacaccca

SEQ ID NO: 6718848 - DNA, 20 bp, Homo sapiens
ccaagtcagacagatgtcag

SEQ ID NO: 6718849 - DNA, 18 bp, Homo sapiens
ccaagtcagcagtcctag

SEQ ID NO: 6718850 - DNA, 14 bp, Homo sapiens
ccaagtcaggccag

SEQ ID NO: 6718851 - DNA, 15 bp, Homo sapiens
ccaagtcaggccagg

SEQ ID NO: 6718852 - DNA, 13 bp, Homo sapiens
ccaagtcattgtt

SEQ ID NO: 6718853 - DNA, 14 bp, Homo sapiens
ccaagtccaaatgt

SEQ ID NO: 6718854 - DNA, 18 bp, Homo sapiens
ccaagtccaacctgcctg

SEQ ID NO: 6718855 - DNA, 22 bp, Homo sapiens
ccaagtccaacctgcctgtgca

SEQ ID NO: 6718856 - DNA, 16 bp, Homo sapiens
ccaagtccacctgcct

SEQ ID NO: 6718857 - DNA, 12 bp, Homo sapiens
ccaagtcccacc

SEQ ID NO: 6718858 - DNA, 23 bp, Homo sapiens
ccaagtcccaccggttgcttctg

SEQ ID NO: 6718859 - DNA, 16 bp, Homo sapiens
ccaagtccccttctgt

SEQ ID NO: 6718860 - DNA, 15 bp, Homo sapiens
ccaagtccctggaaa

SEQ ID NO: 6718861 - DNA, 22 bp, Homo sapiens
ccaagtccctggaaaaggagct

SEQ ID NO: 6718862 - DNA, 22 bp, Homo sapiens
ccaagtccctgttttctgagcc

SEQ ID NO: 6718863 - DNA, 23 bp, Homo sapiens
ccaagtccctgttttctgagccc

SEQ ID NO: 6718864 - DNA, 20 bp, Homo sapiens
ccaagtcctgaagaggcggg

SEQ ID NO: 6718865 - DNA, 18 bp, Homo sapiens
ccaagtcctgctcctttc

SEQ ID NO: 6718866 - DNA, 19 bp, Homo sapiens
ccaagtcggaacagcagat

SEQ ID NO: 6718867 - DNA, 17 bp, Homo sapiens
ccaagtcggcacccttt

SEQ ID NO: 6718868 - DNA, 22 bp, Homo sapiens
ccaagtctaaaaagacctggcc

SEQ ID NO: 6718869 - DNA, 14 bp, Homo sapiens
ccaagtctaatgaa

SEQ ID NO: 6718870 - DNA, 15 bp, Homo sapiens
ccaagtctaatgaag

SEQ ID NO: 6718871 - DNA, 12 bp, Homo sapiens
ccaagtctctct

SEQ ID NO: 6718872 - DNA, 15 bp, Homo sapiens
ccaagtctctctgtg

SEQ ID NO: 6718873 - DNA, 21 bp, Homo sapiens
ccaagtctctctgtgaataca

SEQ ID NO: 6718874 - DNA, 15 bp, Homo sapiens
ccaagtctctgtgta

SEQ ID NO: 6718875 - DNA, 14 bp, Homo sapiens
ccaagtctgacagc

SEQ ID NO: 6718876 - DNA, 15 bp, Homo sapiens
ccaagtctgacagcc

SEQ ID NO: 6718877 - DNA, 20 bp, Homo sapiens
ccaagtctgacagccagagc

SEQ ID NO: 6718878 - DNA, 22 bp, Homo sapiens
ccaagtcttcagcgagaccctt

SEQ ID NO: 6718879 - DNA, 22 bp, Homo sapiens
ccaagtgaaggttcccaaggac

SEQ ID NO: 6718880 - DNA, 13 bp, Homo sapiens
ccaagtgaccagg

SEQ ID NO: 6718881 - DNA, 17 bp, Homo sapiens
ccaagtgaccagggaag

SEQ ID NO: 6718882 - DNA, 22 bp, Homo sapiens
ccaagtgatccttccacctcag

SEQ ID NO: 6718883 - DNA, 16 bp, Homo sapiens
ccaagtgcaatagatt

SEQ ID NO: 6718884 - DNA, 16 bp, Homo sapiens
ccaagtgcaggctggc

SEQ ID NO: 6718885 - DNA, 18 bp, Homo sapiens
ccaagtgccagaggtggg

SEQ ID NO: 6718886 - DNA, 22 bp, Homo sapiens
ccaagtgccagaggtgggcagg

SEQ ID NO: 6718887 - DNA, 22 bp, Homo sapiens
ccaagtgccatcccacattcgg

SEQ ID NO: 6718888 - DNA, 17 bp, Homo sapiens
ccaagtgccccaccact

SEQ ID NO: 6718889 - DNA, 14 bp, Homo sapiens
ccaagtgccccctc

SEQ ID NO: 6718890 - DNA, 17 bp, Homo sapiens
ccaagtgccccctcacc

SEQ ID NO: 6718891 - DNA, 19 bp, Homo sapiens
ccaagtgccccctcacctc

SEQ ID NO: 6718892 - DNA, 24 bp, Homo sapiens
ccaagtgccccctcacctctccag

SEQ ID NO: 6718893 - DNA, 13 bp, Homo sapiens
ccaagtgcctgct

SEQ ID NO: 6718894 - DNA, 19 bp, Homo sapiens
ccaagtgcctgcttttgat

SEQ ID NO: 6718895 - DNA, 13 bp, Homo sapiens
ccaagtgccttcc

SEQ ID NO: 6718896 - DNA, 19 bp, Homo sapiens
ccaagtgccttgagctgcc

SEQ ID NO: 6718897 - DNA, 13 bp, Homo sapiens
ccaagtgctggcc

SEQ ID NO: 6718898 - DNA, 18 bp, Homo sapiens
ccaagtggaaatcctatt

SEQ ID NO: 6718899 - DNA, 20 bp, Homo sapiens
ccaagtggacgttaggccag

SEQ ID NO: 6718900 - DNA, 21 bp, Homo sapiens
ccaagtggacgttaggccagg

SEQ ID NO: 6718901 - DNA, 19 bp, Homo sapiens
ccaagtggacttggagctg

SEQ ID NO: 6718902 - DNA, 22 bp, Homo sapiens
ccaagtggagcctgacagccag

SEQ ID NO: 6718903 - DNA, 20 bp, Homo sapiens
ccaagtggatattttcttaa

SEQ ID NO: 6718904 - DNA, 23 bp, Homo sapiens
ccaagtggatattttcttaaaac

SEQ ID NO: 6718905 - DNA, 13 bp, Homo sapiens
ccaagtggcagag

SEQ ID NO: 6718906 - DNA, 19 bp, Homo sapiens
ccaagtggcagagcttgga

SEQ ID NO: 6718907 - DNA, 15 bp, Homo sapiens
ccaagtggcccccac

SEQ ID NO: 6718908 - DNA, 17 bp, Homo sapiens
ccaagtggctcttggga

SEQ ID NO: 6718909 - DNA, 11 bp, Homo sapiens
ccaagtggctg

SEQ ID NO: 6718910 - DNA, 19 bp, Homo sapiens
ccaagtggctgggtgccct

SEQ ID NO: 6718911 - DNA, 12 bp, Homo sapiens
ccaagtgggcag

SEQ ID NO: 6718912 - DNA, 18 bp, Homo sapiens
ccaagtgggggcagaggg

SEQ ID NO: 6718913 - DNA, 20 bp, Homo sapiens
ccaagtggggtgctctggtc

SEQ ID NO: 6718914 - DNA, 15 bp, Homo sapiens
ccaagtggggtgctg

SEQ ID NO: 6718915 - DNA, 20 bp, Homo sapiens
ccaagtggtccagcgtcact

SEQ ID NO: 6718916 - DNA, 17 bp, Homo sapiens
ccaagtggtgagcaagc

SEQ ID NO: 6718917 - DNA, 18 bp, Homo sapiens
ccaagtggtgagcaagca

SEQ ID NO: 6718918 - DNA, 21 bp, Homo sapiens
ccaagtggtgggaatcagatc

SEQ ID NO: 6718919 - DNA, 22 bp, Homo sapiens
ccaagtgtagatgtagcattgt

SEQ ID NO: 6718920 - DNA, 13 bp, Homo sapiens
ccaagtgtataat

SEQ ID NO: 6718921 - DNA, 19 bp, Homo sapiens
ccaagtgtatatttgtatc

SEQ ID NO: 6718922 - DNA, 16 bp, Homo sapiens
ccaagtgtattgtaat

SEQ ID NO: 6718923 - DNA, 17 bp, Homo sapiens
ccaagtgtattttaaaa

SEQ ID NO: 6718924 - DNA, 21 bp, Homo sapiens
ccaagtgtattttaaaataga

SEQ ID NO: 6718925 - DNA, 19 bp, Homo sapiens
ccaagtgtcctggaccctg

SEQ ID NO: 6718926 - DNA, 22 bp, Homo sapiens
ccaagtgtctagagtcatgtga

SEQ ID NO: 6718927 - DNA, 14 bp, Homo sapiens
ccaagtgtgaacaa

SEQ ID NO: 6718928 - DNA, 20 bp, Homo sapiens
ccaagtgtgcatattgtaca

SEQ ID NO: 6718929 - DNA, 21 bp, Homo sapiens
ccaagtgtgcatattgtacac

SEQ ID NO: 6718930 - DNA, 21 bp, Homo sapiens
ccaagtgtgctctttttttaa

SEQ ID NO: 6718931 - DNA, 14 bp, Homo sapiens
ccaagtgtgtgtgc

SEQ ID NO: 6718932 - DNA, 16 bp, Homo sapiens
ccaagtgtgtgtgcaa

SEQ ID NO: 6718933 - DNA, 17 bp, Homo sapiens
ccaagtgtgtgtgcaat

SEQ ID NO: 6718934 - DNA, 13 bp, Homo sapiens
ccaagtgtgttgg

SEQ ID NO: 6718935 - DNA, 17 bp, Homo sapiens
ccaagtgtttctgtttc

SEQ ID NO: 6718936 - DNA, 15 bp, Homo sapiens
ccaagtgtttcttgt

SEQ ID NO: 6718937 - DNA, 16 bp, Homo sapiens
ccaagttaaatgtaga

SEQ ID NO: 6718938 - DNA, 22 bp, Homo sapiens
ccaagttagctattgggagcaa

SEQ ID NO: 6718939 - DNA, 14 bp, Homo sapiens
ccaagttatataaa

SEQ ID NO: 6718940 - DNA, 20 bp, Homo sapiens
ccaagttatataaagagaaa

SEQ ID NO: 6718941 - DNA, 12 bp, Homo sapiens
ccaagttatatt

SEQ ID NO: 6718942 - DNA, 17 bp, Homo sapiens
ccaagttatattgaata

SEQ ID NO: 6718943 - DNA, 18 bp, Homo sapiens
ccaagttcacagtagagt

SEQ ID NO: 6718944 - DNA, 16 bp, Homo sapiens
ccaagttctaggcccc

SEQ ID NO: 6718945 - DNA, 20 bp, Homo sapiens
ccaagttctaggccccccag

SEQ ID NO: 6718946 - DNA, 20 bp, Homo sapiens
ccaagttcttcacctctatc

SEQ ID NO: 6718947 - DNA, 16 bp, Homo sapiens
ccaagttgagactcgg

SEQ ID NO: 6718948 - DNA, 22 bp, Homo sapiens
ccaagttgagactcggccgcag

SEQ ID NO: 6718949 - DNA, 18 bp, Homo sapiens
ccaagttgcagtgagcag

SEQ ID NO: 6718950 - DNA, 14 bp, Homo sapiens
ccaagttgctctgt

SEQ ID NO: 6718951 - DNA, 15 bp, Homo sapiens
ccaagttgctctgta

SEQ ID NO: 6718952 - DNA, 16 bp, Homo sapiens
ccaagttgctctgtat

SEQ ID NO: 6718953 - DNA, 17 bp, Homo sapiens
ccaagttgctgtcactg

SEQ ID NO: 6718954 - DNA, 22 bp, Homo sapiens
ccaagttgtgcttgagccagga

SEQ ID NO: 6718955 - DNA, 22 bp, Homo sapiens
ccaagttgtggtgctgacaaag

SEQ ID NO: 6718956 - DNA, 21 bp, Homo sapiens
ccaagtttactcaaccctctc

SEQ ID NO: 6718957 - DNA, 20 bp, Homo sapiens
ccaagtttattcagtaaaca

SEQ ID NO: 6718958 - DNA, 18 bp, Homo sapiens
ccaagtttgacttgtata

SEQ ID NO: 6718959 - DNA, 12 bp, Homo sapiens
ccaagttttgtg

SEQ ID NO: 6718960 - DNA, 17 bp, Homo sapiens
ccaagtttttcagaaag

SEQ ID NO: 6718961 - DNA, 9 bp, Homo sapiens
ccaataaaa

SEQ ID NO: 6718962 - DNA, 17 bp, Homo sapiens
ccaataaaaagttcaga

SEQ ID NO: 6718963 - DNA, 12 bp, Homo sapiens
ccaataaaaatc

SEQ ID NO: 6718964 - DNA, 20 bp, Homo sapiens
ccaataaaaatcaggagcct

SEQ ID NO: 6718965 - DNA, 16 bp, Homo sapiens
ccaataaaacaagaat

SEQ ID NO: 6718966 - DNA, 17 bp, Homo sapiens
ccaataaaactgatgtt

SEQ ID NO: 6718967 - DNA, 23 bp, Homo sapiens
ccaataaaagcaattccaacctt

SEQ ID NO: 6718968 - DNA, 15 bp, Homo sapiens
ccaataaaagtgact

SEQ ID NO: 6718969 - DNA, 21 bp, Homo sapiens
ccaataaaagtgactctcagc

SEQ ID NO: 6718970 - DNA, 16 bp, Homo sapiens
ccaataaaatgtatct

SEQ ID NO: 6718971 - DNA, 16 bp, Homo sapiens
ccaataaacagctccc

SEQ ID NO: 6718972 - DNA, 20 bp, Homo sapiens
ccaataaaccaatgaacgaa

SEQ ID NO: 6718973 - DNA, 13 bp, Homo sapiens
ccaataaaccagg

SEQ ID NO: 6718974 - DNA, 14 bp, Homo sapiens
ccaataaaccagtg

SEQ ID NO: 6718975 - DNA, 18 bp, Homo sapiens
ccaataaaccagtgtgaa

SEQ ID NO: 6718976 - DNA, 11 bp, Homo sapiens
ccaataaactg

SEQ ID NO: 6718977 - DNA, 20 bp, Homo sapiens
ccaataaactgagcgacccc

SEQ ID NO: 6718978 - DNA, 12 bp, Homo sapiens
ccaataaagaat

SEQ ID NO: 6718979 - DNA, 15 bp, Homo sapiens
ccaataaagctcaca

SEQ ID NO: 6718980 - DNA, 18 bp, Homo sapiens
ccaataaaggaggaatca

SEQ ID NO: 6718981 - DNA, 22 bp, Homo sapiens
ccaataaaggaggaatcagacc

SEQ ID NO: 6718982 - DNA, 19 bp, Homo sapiens
ccaataaaggcagctgcct

SEQ ID NO: 6718983 - DNA, 21 bp, Homo sapiens
ccaataaaggcagctgcctct

SEQ ID NO: 6718984 - DNA, 24 bp, Homo sapiens
ccaataaaggcagctgcctctgct

SEQ ID NO: 6718985 - DNA, 20 bp, Homo sapiens
ccaataaaggtcccttagcc

SEQ ID NO: 6718986 - DNA, 15 bp, Homo sapiens
ccaataaagtgatct

SEQ ID NO: 6718987 - DNA, 15 bp, Homo sapiens
ccaataaagtgcctt

SEQ ID NO: 6718988 - DNA, 22 bp, Homo sapiens
ccaataaagtgccttctgggct

SEQ ID NO: 6718989 - DNA, 23 bp, Homo sapiens
ccaataaagtgccttctgggctt

SEQ ID NO: 6718990 - DNA, 12 bp, Homo sapiens
ccaataaataat

SEQ ID NO: 6718991 - DNA, 16 bp, Homo sapiens
ccaataaataatatta

SEQ ID NO: 6718992 - DNA, 22 bp, Homo sapiens
ccaataaatgtgaaattctgtc

SEQ ID NO: 6718993 - DNA, 21 bp, Homo sapiens
ccaataaatgtttgttattta

SEQ ID NO: 6718994 - DNA, 14 bp, Homo sapiens
ccaataacacacag

SEQ ID NO: 6718995 - DNA, 21 bp, Homo sapiens
ccaataataaaaaacaagaaa

SEQ ID NO: 6718996 - DNA, 23 bp, Homo sapiens
ccaataataaatgccctcttctc

SEQ ID NO: 6718997 - DNA, 20 bp, Homo sapiens
ccaataatcagaaaagtaat

SEQ ID NO: 6718998 - DNA, 13 bp, Homo sapiens
ccaataattctgt

SEQ ID NO: 6718999 - DNA, 14 bp, Homo sapiens
ccaatacagtctag

SEQ ID NO: 6719000 - DNA, 23 bp, Homo sapiens
ccaatacatggtgtatagcacca

SEQ ID NO: 6719001 - DNA, 13 bp, Homo sapiens
ccaatacatttgt

SEQ ID NO: 6719002 - DNA, 22 bp, Homo sapiens
ccaataccccgactcaccttgt

SEQ ID NO: 6719003 - DNA, 17 bp, Homo sapiens
ccaataccctactgtgg

SEQ ID NO: 6719004 - DNA, 19 bp, Homo sapiens
ccaataccctactgtgggg

SEQ ID NO: 6719005 - DNA, 19 bp, Homo sapiens
ccaataccctagaagaaaa

SEQ ID NO: 6719006 - DNA, 15 bp, Homo sapiens
ccaataccttcaagg

SEQ ID NO: 6719007 - DNA, 19 bp, Homo sapiens
ccaatactactgtaaatgt

SEQ ID NO: 6719008 - DNA, 18 bp, Homo sapiens
ccaatagcaaattcaaag

SEQ ID NO: 6719009 - DNA, 16 bp, Homo sapiens
ccaatagcctgaattt

SEQ ID NO: 6719010 - DNA, 13 bp, Homo sapiens
ccaataggagtct

SEQ ID NO: 6719011 - DNA, 19 bp, Homo sapiens
ccaataggcaaattaatca

SEQ ID NO: 6719012 - DNA, 18 bp, Homo sapiens
ccaatagggctgagctct

SEQ ID NO: 6719013 - DNA, 17 bp, Homo sapiens
ccaatagtcatatgtga

SEQ ID NO: 6719014 - DNA, 13 bp, Homo sapiens
ccaatatcatgtc

SEQ ID NO: 6719015 - DNA, 22 bp, Homo sapiens
ccaatatcatgtcttgtgcata

SEQ ID NO: 6719016 - DNA, 22 bp, Homo sapiens
ccaatatcatgtgtagatatta

SEQ ID NO: 6719017 - DNA, 21 bp, Homo sapiens
ccaatatccaattttaaaatg

SEQ ID NO: 6719018 - DNA, 13 bp, Homo sapiens
ccaatatcctaat

SEQ ID NO: 6719019 - DNA, 15 bp, Homo sapiens
ccaatatcctaataa

SEQ ID NO: 6719020 - DNA, 20 bp, Homo sapiens
ccaatatcctcgctcccggg

SEQ ID NO: 6719021 - DNA, 18 bp, Homo sapiens
ccaatatggtggccctgg

SEQ ID NO: 6719022 - DNA, 19 bp, Homo sapiens
ccaatatggtggccctggg

SEQ ID NO: 6719023 - DNA, 20 bp, Homo sapiens
ccaatatggtggccctgggg

SEQ ID NO: 6719024 - DNA, 15 bp, Homo sapiens
ccaatatgtattgta

SEQ ID NO: 6719025 - DNA, 22 bp, Homo sapiens
ccaatatgtattgtaaacatgt

SEQ ID NO: 6719026 - DNA, 22 bp, Homo sapiens
ccaatatgtgattttttttccc

SEQ ID NO: 6719027 - DNA, 20 bp, Homo sapiens
ccaatattaccatcttaatc

SEQ ID NO: 6719028 - DNA, 21 bp, Homo sapiens
ccaatattaccatcttaatct

SEQ ID NO: 6719029 - DNA, 17 bp, Homo sapiens
ccaatattattaaaatc

SEQ ID NO: 6719030 - DNA, 22 bp, Homo sapiens
ccaatattggagcatatcaaaa

SEQ ID NO: 6719031 - DNA, 20 bp, Homo sapiens
ccaatatttataattaaaga

SEQ ID NO: 6719032 - DNA, 14 bp, Homo sapiens
ccaatatttgtaga

SEQ ID NO: 6719033 - DNA, 17 bp, Homo sapiens
ccaatcaaagaattaca

SEQ ID NO: 6719034 - DNA, 23 bp, Homo sapiens
ccaatcaacagcatgtctactgc

SEQ ID NO: 6719035 - DNA, 19 bp, Homo sapiens
ccaatcacattcaggcatg

SEQ ID NO: 6719036 - DNA, 16 bp, Homo sapiens
ccaatcacccccagga

SEQ ID NO: 6719037 - DNA, 17 bp, Homo sapiens
ccaatcacccccaggac

SEQ ID NO: 6719038 - DNA, 18 bp, Homo sapiens
ccaatcacccccaggacc

SEQ ID NO: 6719039 - DNA, 20 bp, Homo sapiens
ccaatcacccccaggacctc

SEQ ID NO: 6719040 - DNA, 21 bp, Homo sapiens
ccaatcaccctacaagatgcc

SEQ ID NO: 6719041 - DNA, 13 bp, Homo sapiens
ccaatcactgcct

SEQ ID NO: 6719042 - DNA, 23 bp, Homo sapiens
ccaatcactgtgcttaatttaaa

SEQ ID NO: 6719043 - DNA, 21 bp, Homo sapiens
ccaatcagagaccaggccctg

SEQ ID NO: 6719044 - DNA, 13 bp, Homo sapiens
ccaatcagagagc

SEQ ID NO: 6719045 - DNA, 17 bp, Homo sapiens
ccaatcagagagcctag

SEQ ID NO: 6719046 - DNA, 18 bp, Homo sapiens
ccaatcagcactgaaaat

SEQ ID NO: 6719047 - DNA, 12 bp, Homo sapiens
ccaatcagcttt

SEQ ID NO: 6719048 - DNA, 20 bp, Homo sapiens
ccaatcagcttttgttctag

SEQ ID NO: 6719049 - DNA, 21 bp, Homo sapiens
ccaatcagcttttgttctaga

SEQ ID NO: 6719050 - DNA, 23 bp, Homo sapiens
ccaatcagcttttgttctagact

SEQ ID NO: 6719051 - DNA, 22 bp, Homo sapiens
ccaatcagtagcttaagaaaaa

SEQ ID NO: 6719052 - DNA, 22 bp, Homo sapiens
ccaatccaacccatgcatggcc

SEQ ID NO: 6719053 - DNA, 22 bp, Homo sapiens
ccaatccagagaagcgctgttg

SEQ ID NO: 6719054 - DNA, 20 bp, Homo sapiens
ccaatccaggtacgcacaga

SEQ ID NO: 6719055 - DNA, 23 bp, Homo sapiens
ccaatccaggtacgcacagacag

SEQ ID NO: 6719056 - DNA, 13 bp, Homo sapiens
ccaatccaggtgg

SEQ ID NO: 6719057 - DNA, 21 bp, Homo sapiens
ccaatccaggtgggagagaca

SEQ ID NO: 6719058 - DNA, 23 bp, Homo sapiens
ccaatccaggtgggagagacact

SEQ ID NO: 6719059 - DNA, 17 bp, Homo sapiens
ccaatccatttggcaga

SEQ ID NO: 6719060 - DNA, 13 bp, Homo sapiens
ccaatcccagggc

SEQ ID NO: 6719061 - DNA, 16 bp, Homo sapiens
ccaatcccagggctgg

SEQ ID NO: 6719062 - DNA, 21 bp, Homo sapiens
ccaatcccagttcttcctgca

SEQ ID NO: 6719063 - DNA, 13 bp, Homo sapiens
ccaatccccactc

SEQ ID NO: 6719064 - DNA, 18 bp, Homo sapiens
ccaatcccccagcgctta

SEQ ID NO: 6719065 - DNA, 21 bp, Homo sapiens
ccaatcccctccttgggcact

SEQ ID NO: 6719066 - DNA, 15 bp, Homo sapiens
ccaatccctctccac

SEQ ID NO: 6719067 - DNA, 19 bp, Homo sapiens
ccaatccctctccactctt

SEQ ID NO: 6719068 - DNA, 14 bp, Homo sapiens
ccaatccctgaccc

SEQ ID NO: 6719069 - DNA, 22 bp, Homo sapiens
ccaatccctgccactgggctct

SEQ ID NO: 6719070 - DNA, 21 bp, Homo sapiens
ccaatcctactaataaaccag

SEQ ID NO: 6719071 - DNA, 23 bp, Homo sapiens
ccaatcctatgcatggtttcagc

SEQ ID NO: 6719072 - DNA, 19 bp, Homo sapiens
ccaatcctatgtcatttct

SEQ ID NO: 6719073 - DNA, 14 bp, Homo sapiens
ccaatcctcaccta

SEQ ID NO: 6719074 - DNA, 12 bp, Homo sapiens
ccaatcctcagg

SEQ ID NO: 6719075 - DNA, 18 bp, Homo sapiens
ccaatcctccccgctctg

SEQ ID NO: 6719076 - DNA, 16 bp, Homo sapiens
ccaatcctccctggag

SEQ ID NO: 6719077 - DNA, 17 bp, Homo sapiens
ccaatcctctctcccct

SEQ ID NO: 6719078 - DNA, 14 bp, Homo sapiens
ccaatcctggcagg

SEQ ID NO: 6719079 - DNA, 22 bp, Homo sapiens
ccaatcctttccaccctattcc

SEQ ID NO: 6719080 - DNA, 17 bp, Homo sapiens
ccaatcgggagtagcaa

SEQ ID NO: 6719081 - DNA, 17 bp, Homo sapiens
ccaatcggtgtgttctt

SEQ ID NO: 6719082 - DNA, 18 bp, Homo sapiens
ccaatctaaccacatcaa

SEQ ID NO: 6719083 - DNA, 16 bp, Homo sapiens
ccaatctctgctctct

SEQ ID NO: 6719084 - DNA, 15 bp, Homo sapiens
ccaatctgcacactc

SEQ ID NO: 6719085 - DNA, 18 bp, Homo sapiens
ccaatctgcacactccag

SEQ ID NO: 6719086 - DNA, 13 bp, Homo sapiens
ccaatctggccct

SEQ ID NO: 6719087 - DNA, 23 bp, Homo sapiens
ccaatctggcccttacacactca

SEQ ID NO: 6719088 - DNA, 24 bp, Homo sapiens
ccaatctggcccttacacactcag

SEQ ID NO: 6719089 - DNA, 13 bp, Homo sapiens
ccaatctggctgg

SEQ ID NO: 6719090 - DNA, 13 bp, Homo sapiens
ccaatctgggaag

SEQ ID NO: 6719091 - DNA, 11 bp, Homo sapiens
ccaatctgtac

SEQ ID NO: 6719092 - DNA, 13 bp, Homo sapiens
ccaatctgtgaga

SEQ ID NO: 6719093 - DNA, 18 bp, Homo sapiens
ccaatctgtgagaagttt

SEQ ID NO: 6719094 - DNA, 14 bp, Homo sapiens
ccaatcttactttg

SEQ ID NO: 6719095 - DNA, 16 bp, Homo sapiens
ccaatcttactttgta

SEQ ID NO: 6719096 - DNA, 17 bp, Homo sapiens
ccaatcttactttgtaa

SEQ ID NO: 6719097 - DNA, 23 bp, Homo sapiens
ccaatcttagtttctaaccaaag

SEQ ID NO: 6719098 - DNA, 22 bp, Homo sapiens
ccaatcttctttttcaggctcg

SEQ ID NO: 6719099 - DNA, 15 bp, Homo sapiens
ccaatcttgtttata

SEQ ID NO: 6719100 - DNA, 20 bp, Homo sapiens
ccaatcttgtttatagcaaa

SEQ ID NO: 6719101 - DNA, 14 bp, Homo sapiens
ccaatcttgtttta

SEQ ID NO: 6719102 - DNA, 23 bp, Homo sapiens
ccaatgaaaaaatgtatatgcac

SEQ ID NO: 6719103 - DNA, 17 bp, Homo sapiens
ccaatgaacagctcctc

SEQ ID NO: 6719104 - DNA, 22 bp, Homo sapiens
ccaatgaagaagacaaagtcta

SEQ ID NO: 6719105 - DNA, 12 bp, Homo sapiens
ccaatgaagata

SEQ ID NO: 6719106 - DNA, 20 bp, Homo sapiens
ccaatgaagcaaacacacag

SEQ ID NO: 6719107 - DNA, 12 bp, Homo sapiens
ccaatgaataat

SEQ ID NO: 6719108 - DNA, 17 bp, Homo sapiens
ccaatgacttccctgct

SEQ ID NO: 6719109 - DNA, 23 bp, Homo sapiens
ccaatgagactctagggtccagt

SEQ ID NO: 6719110 - DNA, 16 bp, Homo sapiens
ccaatgagctttctga

SEQ ID NO: 6719111 - DNA, 18 bp, Homo sapiens
ccaatgagctttctgaac

SEQ ID NO: 6719112 - DNA, 22 bp, Homo sapiens
ccaatgagctttctgaacagct

SEQ ID NO: 6719113 - DNA, 19 bp, Homo sapiens
ccaatgaggtctgaaatgg

SEQ ID NO: 6719114 - DNA, 21 bp, Homo sapiens
ccaatgatacccaacagttta

SEQ ID NO: 6719115 - DNA, 17 bp, Homo sapiens
ccaatgattcataacaa

SEQ ID NO: 6719116 - DNA, 19 bp, Homo sapiens
ccaatgcacatccattccc

SEQ ID NO: 6719117 - DNA, 17 bp, Homo sapiens
ccaatgcattggcctct

SEQ ID NO: 6719118 - DNA, 18 bp, Homo sapiens
ccaatgcattggcctctg

SEQ ID NO: 6719119 - DNA, 13 bp, Homo sapiens
ccaatgccaaaaa

SEQ ID NO: 6719120 - DNA, 19 bp, Homo sapiens
ccaatgccaattcatctca

SEQ ID NO: 6719121 - DNA, 14 bp, Homo sapiens
ccaatgccacagac

SEQ ID NO: 6719122 - DNA, 23 bp, Homo sapiens
ccaatgccacagccaagcccacc

SEQ ID NO: 6719123 - DNA, 21 bp, Homo sapiens
ccaatgccatgactgctcagg

SEQ ID NO: 6719124 - DNA, 20 bp, Homo sapiens
ccaatgccgccgtgtttcct

SEQ ID NO: 6719125 - DNA, 22 bp, Homo sapiens
ccaatgcctgtgaagcagtcag

SEQ ID NO: 6719126 - DNA, 15 bp, Homo sapiens
ccaatgcctttttag

SEQ ID NO: 6719127 - DNA, 23 bp, Homo sapiens
ccaatgcggcccactttcctgag

SEQ ID NO: 6719128 - DNA, 17 bp, Homo sapiens
ccaatgctgatgtcctc

SEQ ID NO: 6719129 - DNA, 20 bp, Homo sapiens
ccaatgctgctccaccctcc

SEQ ID NO: 6719130 - DNA, 16 bp, Homo sapiens
ccaatgctgcttttgg

SEQ ID NO: 6719131 - DNA, 18 bp, Homo sapiens
ccaatgcttgcatggaga

SEQ ID NO: 6719132 - DNA, 22 bp, Homo sapiens
ccaatgcttgcatggagaatgg

SEQ ID NO: 6719133 - DNA, 12 bp, Homo sapiens
ccaatggaaacc

SEQ ID NO: 6719134 - DNA, 15 bp, Homo sapiens
ccaatggaaacctca

SEQ ID NO: 6719135 - DNA, 21 bp, Homo sapiens
ccaatggagactgtctcaaga

SEQ ID NO: 6719136 - DNA, 21 bp, Homo sapiens
ccaatggcattattaggtctt

SEQ ID NO: 6719137 - DNA, 19 bp, Homo sapiens
ccaatggcccggcccctcc

SEQ ID NO: 6719138 - DNA, 22 bp, Homo sapiens
ccaatggctgagcctcgtgtcc

SEQ ID NO: 6719139 - DNA, 20 bp, Homo sapiens
ccaatggctgcatcaaatgc

SEQ ID NO: 6719140 - DNA, 15 bp, Homo sapiens
ccaatggctgtaaac

SEQ ID NO: 6719141 - DNA, 18 bp, Homo sapiens
ccaatggctgtaaactat

SEQ ID NO: 6719142 - DNA, 13 bp, Homo sapiens
ccaatgggaagca

SEQ ID NO: 6719143 - DNA, 14 bp, Homo sapiens
ccaatgggaagcag

SEQ ID NO: 6719144 - DNA, 17 bp, Homo sapiens
ccaatgggaagcaggga

SEQ ID NO: 6719145 - DNA, 17 bp, Homo sapiens
ccaatgggaccgtgccc

SEQ ID NO: 6719146 - DNA, 19 bp, Homo sapiens
ccaatgggaccgtgcccca

SEQ ID NO: 6719147 - DNA, 23 bp, Homo sapiens
ccaatgggaccgtgccccacctc

SEQ ID NO: 6719148 - DNA, 22 bp, Homo sapiens
ccaatgggatgaggtcactttt

SEQ ID NO: 6719149 - DNA, 16 bp, Homo sapiens
ccaatggggccagcac

SEQ ID NO: 6719150 - DNA, 22 bp, Homo sapiens
ccaatggtgagggctgagaggg

SEQ ID NO: 6719151 - DNA, 22 bp, Homo sapiens
ccaatggtgatcctctattttg

SEQ ID NO: 6719152 - DNA, 12 bp, Homo sapiens
ccaatggtgctt

SEQ ID NO: 6719153 - DNA, 15 bp, Homo sapiens
ccaatggtgcttccc

SEQ ID NO: 6719154 - DNA, 16 bp, Homo sapiens
ccaatggtgcttcccc

SEQ ID NO: 6719155 - DNA, 20 bp, Homo sapiens
ccaatggtgtagctgtcctc

SEQ ID NO: 6719156 - DNA, 17 bp, Homo sapiens
ccaatgtaccatgttgc

SEQ ID NO: 6719157 - DNA, 15 bp, Homo sapiens
ccaatgtaggagctg

SEQ ID NO: 6719158 - DNA, 17 bp, Homo sapiens
ccaatgtaggagctgcc

SEQ ID NO: 6719159 - DNA, 21 bp, Homo sapiens
ccaatgtattgataagagggc

SEQ ID NO: 6719160 - DNA, 16 bp, Homo sapiens
ccaatgtcaagtggca

SEQ ID NO: 6719161 - DNA, 22 bp, Homo sapiens
ccaatgtccaggtcacaggcat

SEQ ID NO: 6719162 - DNA, 19 bp, Homo sapiens
ccaatgtctgatttaacac

SEQ ID NO: 6719163 - DNA, 11 bp, Homo sapiens
ccaatgtctgc

SEQ ID NO: 6719164 - DNA, 22 bp, Homo sapiens
ccaatgtctggagaccaccagg

SEQ ID NO: 6719165 - DNA, 13 bp, Homo sapiens
ccaatgtcttttg

SEQ ID NO: 6719166 - DNA, 21 bp, Homo sapiens
ccaatgtgaaagattatttaa

SEQ ID NO: 6719167 - DNA, 19 bp, Homo sapiens
ccaatgtgaacagcggctg

SEQ ID NO: 6719168 - DNA, 22 bp, Homo sapiens
ccaatgtggtggcaataaatgt

SEQ ID NO: 6719169 - DNA, 19 bp, Homo sapiens
ccaatgttagagacttttt

SEQ ID NO: 6719170 - DNA, 21 bp, Homo sapiens
ccaatgtttgggatattaaaa

SEQ ID NO: 6719171 - DNA, 21 bp, Homo sapiens
ccaattaaaaacgaaaacctg

SEQ ID NO: 6719172 - DNA, 16 bp, Homo sapiens
ccaattaaaatatata

SEQ ID NO: 6719173 - DNA, 21 bp, Homo sapiens
ccaattaaaatatatataaat

SEQ ID NO: 6719174 - DNA, 13 bp, Homo sapiens
ccaattaaattta

SEQ ID NO: 6719175 - DNA, 16 bp, Homo sapiens
ccaattaaatttattt

SEQ ID NO: 6719176 - DNA, 13 bp, Homo sapiens
ccaattaaggatt

SEQ ID NO: 6719177 - DNA, 19 bp, Homo sapiens
ccaattaagtcctacttta

SEQ ID NO: 6719178 - DNA, 22 bp, Homo sapiens
ccaattaatgattcaattaaca

SEQ ID NO: 6719179 - DNA, 19 bp, Homo sapiens
ccaattacacacagcggga

SEQ ID NO: 6719180 - DNA, 21 bp, Homo sapiens
ccaattacatggaacttttct

SEQ ID NO: 6719181 - DNA, 23 bp, Homo sapiens
ccaattacccataaacagcacac

SEQ ID NO: 6719182 - DNA, 18 bp, Homo sapiens
ccaattacggtgtacagt

SEQ ID NO: 6719183 - DNA, 21 bp, Homo sapiens
ccaattagggggtaaggcccc

SEQ ID NO: 6719184 - DNA, 18 bp, Homo sapiens
ccaattagtcactgctgc

SEQ ID NO: 6719185 - DNA, 13 bp, Homo sapiens
ccaattatcaaaa

SEQ ID NO: 6719186 - DNA, 19 bp, Homo sapiens
ccaattatgcactggccac

SEQ ID NO: 6719187 - DNA, 14 bp, Homo sapiens
ccaattatgttaaa

SEQ ID NO: 6719188 - DNA, 22 bp, Homo sapiens
ccaattatttgactttaattta

SEQ ID NO: 6719189 - DNA, 22 bp, Homo sapiens
ccaattattttcatccttgtct

SEQ ID NO: 6719190 - DNA, 16 bp, Homo sapiens
ccaattcacccactcc

SEQ ID NO: 6719191 - DNA, 21 bp, Homo sapiens
ccaattcaggactggctcacc

SEQ ID NO: 6719192 - DNA, 17 bp, Homo sapiens
ccaattcatttcatcta

SEQ ID NO: 6719193 - DNA, 10 bp, Homo sapiens
ccaattccaa

SEQ ID NO: 6719194 - DNA, 15 bp, Homo sapiens
ccaattccacttcct

SEQ ID NO: 6719195 - DNA, 14 bp, Homo sapiens
ccaattccagagct

SEQ ID NO: 6719196 - DNA, 14 bp, Homo sapiens
ccaattccttgtag

SEQ ID NO: 6719197 - DNA, 14 bp, Homo sapiens
ccaattctgcctgc

SEQ ID NO: 6719198 - DNA, 11 bp, Homo sapiens
ccaattcttac

SEQ ID NO: 6719199 - DNA, 19 bp, Homo sapiens
ccaattcttacaaacatgt

SEQ ID NO: 6719200 - DNA, 22 bp, Homo sapiens
ccaattgatgttttacgtgcaa

SEQ ID NO: 6719201 - DNA, 15 bp, Homo sapiens
ccaattgccctgcca

SEQ ID NO: 6719202 - DNA, 19 bp, Homo sapiens
ccaattgccctgccaggct

SEQ ID NO: 6719203 - DNA, 18 bp, Homo sapiens
ccaattgggaatgcaata

SEQ ID NO: 6719204 - DNA, 14 bp, Homo sapiens
ccaattgtgctgcc

SEQ ID NO: 6719205 - DNA, 18 bp, Homo sapiens
ccaattgtgtagacgata

SEQ ID NO: 6719206 - DNA, 20 bp, Homo sapiens
ccaattgttgacagttctga

SEQ ID NO: 6719207 - DNA, 10 bp, Homo sapiens
ccaatttaag

SEQ ID NO: 6719208 - DNA, 14 bp, Homo sapiens
ccaatttatgcaga

SEQ ID NO: 6719209 - DNA, 11 bp, Homo sapiens
ccaatttcccc

SEQ ID NO: 6719210 - DNA, 11 bp, Homo sapiens
ccaatttcctc

SEQ ID NO: 6719211 - DNA, 12 bp, Homo sapiens
ccaatttcctct

SEQ ID NO: 6719212 - DNA, 13 bp, Homo sapiens
ccaatttcctctc

SEQ ID NO: 6719213 - DNA, 15 bp, Homo sapiens
ccaatttcctctcca

SEQ ID NO: 6719214 - DNA, 20 bp, Homo sapiens
ccaatttcggattttttcca

SEQ ID NO: 6719215 - DNA, 23 bp, Homo sapiens
ccaatttcggattttttccaaaa

SEQ ID NO: 6719216 - DNA, 15 bp, Homo sapiens
ccaatttcttccttc

SEQ ID NO: 6719217 - DNA, 17 bp, Homo sapiens
ccaatttcttccttcca

SEQ ID NO: 6719218 - DNA, 16 bp, Homo sapiens
ccaatttctttctaaa

SEQ ID NO: 6719219 - DNA, 14 bp, Homo sapiens
ccaatttgtaagta

SEQ ID NO: 6719220 - DNA, 15 bp, Homo sapiens
ccaatttgtaagtaa

SEQ ID NO: 6719221 - DNA, 12 bp, Homo sapiens
ccaatttgtctc

SEQ ID NO: 6719222 - DNA, 15 bp, Homo sapiens
ccaatttgtctccta

SEQ ID NO: 6719223 - DNA, 17 bp, Homo sapiens
ccaatttgtctcctact

SEQ ID NO: 6719224 - DNA, 12 bp, Homo sapiens
ccaattttcctt

SEQ ID NO: 6719225 - DNA, 19 bp, Homo sapiens
ccaattttgatctttttat

SEQ ID NO: 6719226 - DNA, 20 bp, Homo sapiens
ccaatttttgtacttttagt

SEQ ID NO: 6719227 - DNA, 15 bp, Homo sapiens
ccaattttttttaag

SEQ ID NO: 6719228 - DNA, 19 bp, Homo sapiens
ccacaaaaaattgctccta

SEQ ID NO: 6719229 - DNA, 13 bp, Homo sapiens
ccacaaaaacaat

SEQ ID NO: 6719230 - DNA, 22 bp, Homo sapiens
ccacaaaaacaggtatatactt

SEQ ID NO: 6719231 - DNA, 17 bp, Homo sapiens
ccacaaaaatagagaaa

SEQ ID NO: 6719232 - DNA, 16 bp, Homo sapiens
ccacaaaacaaagcaa

SEQ ID NO: 6719233 - DNA, 13 bp, Homo sapiens
ccacaaaagcaaa

SEQ ID NO: 6719234 - DNA, 12 bp, Homo sapiens
ccacaaaagttg

SEQ ID NO: 6719235 - DNA, 19 bp, Homo sapiens
ccacaaaattatgctgcat

SEQ ID NO: 6719236 - DNA, 11 bp, Homo sapiens
ccacaaacaat

SEQ ID NO: 6719237 - DNA, 17 bp, Homo sapiens
ccacaaacggagcccct

SEQ ID NO: 6719238 - DNA, 18 bp, Homo sapiens
ccacaaacggagcccctg

SEQ ID NO: 6719239 - DNA, 20 bp, Homo sapiens
ccacaaacggagcccctgaa

SEQ ID NO: 6719240 - DNA, 15 bp, Homo sapiens
ccacaaactccaggc

SEQ ID NO: 6719241 - DNA, 21 bp, Homo sapiens
ccacaaactccaggctggaag

SEQ ID NO: 6719242 - DNA, 15 bp, Homo sapiens
ccacaaactgcctgt

SEQ ID NO: 6719243 - DNA, 16 bp, Homo sapiens
ccacaaactgcctgtt

SEQ ID NO: 6719244 - DNA, 15 bp, Homo sapiens
ccacaaagagaccag

SEQ ID NO: 6719245 - DNA, 16 bp, Homo sapiens
ccacaaagcaaaggca

SEQ ID NO: 6719246 - DNA, 18 bp, Homo sapiens
ccacaaagccccccagct

SEQ ID NO: 6719247 - DNA, 22 bp, Homo sapiens
ccacaaagccccccagctccca

SEQ ID NO: 6719248 - DNA, 19 bp, Homo sapiens
ccacaaagccgtgcctttc

SEQ ID NO: 6719249 - DNA, 9 bp, Homo sapiens
ccacaaagg

SEQ ID NO: 6719250 - DNA, 22 bp, Homo sapiens
ccacaaaggccaaactgctgga

SEQ ID NO: 6719251 - DNA, 13 bp, Homo sapiens
ccacaaaggggag

SEQ ID NO: 6719252 - DNA, 13 bp, Homo sapiens
ccacaaagggtag

SEQ ID NO: 6719253 - DNA, 15 bp, Homo sapiens
ccacaaatctatatt

SEQ ID NO: 6719254 - DNA, 15 bp, Homo sapiens
ccacaaatgctattc

SEQ ID NO: 6719255 - DNA, 22 bp, Homo sapiens
ccacaaatgggaaaaccagact

SEQ ID NO: 6719256 - DNA, 19 bp, Homo sapiens
ccacaacaccagccccact

SEQ ID NO: 6719257 - DNA, 14 bp, Homo sapiens
ccacaacagcctgg

SEQ ID NO: 6719258 - DNA, 15 bp, Homo sapiens
ccacaacagcctggg

SEQ ID NO: 6719259 - DNA, 19 bp, Homo sapiens
ccacaacatgaaaactcca

SEQ ID NO: 6719260 - DNA, 16 bp, Homo sapiens
ccacaacatgaggcca

SEQ ID NO: 6719261 - DNA, 18 bp, Homo sapiens
ccacaaccacggtcacac

SEQ ID NO: 6719262 - DNA, 15 bp, Homo sapiens
ccacaaccaggaaga

SEQ ID NO: 6719263 - DNA, 16 bp, Homo sapiens
ccacaaccaggaagaa

SEQ ID NO: 6719264 - DNA, 13 bp, Homo sapiens
ccacaacctcttc

SEQ ID NO: 6719265 - DNA, 15 bp, Homo sapiens
ccacaacctcttccc

SEQ ID NO: 6719266 - DNA, 23 bp, Homo sapiens
ccacaacctgtggggtctgatgt

SEQ ID NO: 6719267 - DNA, 17 bp, Homo sapiens
ccacaaccttcggctcc

SEQ ID NO: 6719268 - DNA, 14 bp, Homo sapiens
ccacaaccttgcag

SEQ ID NO: 6719269 - DNA, 22 bp, Homo sapiens
ccacaacgtcccctcaagcccc

SEQ ID NO: 6719270 - DNA, 13 bp, Homo sapiens
ccacaactaacaa

SEQ ID NO: 6719271 - DNA, 18 bp, Homo sapiens
ccacaactaacaatgcct

SEQ ID NO: 6719272 - DNA, 19 bp, Homo sapiens
ccacaactcccttgcacgt

SEQ ID NO: 6719273 - DNA, 17 bp, Homo sapiens
ccacaactgacacagga

SEQ ID NO: 6719274 - DNA, 13 bp, Homo sapiens
ccacaactgctgt

SEQ ID NO: 6719275 - DNA, 14 bp, Homo sapiens
ccacaactgctgtg

SEQ ID NO: 6719276 - DNA, 19 bp, Homo sapiens
ccacaactgctgtggcccc

SEQ ID NO: 6719277 - DNA, 21 bp, Homo sapiens
ccacaactgctgtggccccct

SEQ ID NO: 6719278 - DNA, 23 bp, Homo sapiens
ccacaactttgtcgtggttctta

SEQ ID NO: 6719279 - DNA, 13 bp, Homo sapiens
ccacaagaaattc

SEQ ID NO: 6719280 - DNA, 20 bp, Homo sapiens
ccacaagacataatttaaaa

SEQ ID NO: 6719281 - DNA, 20 bp, Homo sapiens
ccacaagagcccaggcctcc

SEQ ID NO: 6719282 - DNA, 15 bp, Homo sapiens
ccacaagattcccag

SEQ ID NO: 6719283 - DNA, 16 bp, Homo sapiens
ccacaagattcccaga

SEQ ID NO: 6719284 - DNA, 24 bp, Homo sapiens
ccacaagattcccagagacaggaa

SEQ ID NO: 6719285 - DNA, 20 bp, Homo sapiens
ccacaagcaccactctgggc

SEQ ID NO: 6719286 - DNA, 11 bp, Homo sapiens
ccacaagcccg

SEQ ID NO: 6719287 - DNA, 16 bp, Homo sapiens
ccacaagcctgagaac

SEQ ID NO: 6719288 - DNA, 17 bp, Homo sapiens
ccacaagcctgagaact

SEQ ID NO: 6719289 - DNA, 23 bp, Homo sapiens
ccacaagcctgagaactgaattt

SEQ ID NO: 6719290 - DNA, 20 bp, Homo sapiens
ccacaagcctgagggaaagg

SEQ ID NO: 6719291 - DNA, 16 bp, Homo sapiens
ccacaagccttactca

SEQ ID NO: 6719292 - DNA, 14 bp, Homo sapiens
ccacaagctgagca

SEQ ID NO: 6719293 - DNA, 17 bp, Homo sapiens
ccacaagctgcactgtg

SEQ ID NO: 6719294 - DNA, 20 bp, Homo sapiens
ccacaagctgcactgtgaac

SEQ ID NO: 6719295 - DNA, 15 bp, Homo sapiens
ccacaagctgtccct

SEQ ID NO: 6719296 - DNA, 17 bp, Homo sapiens
ccacaagctgtccctgc

SEQ ID NO: 6719297 - DNA, 18 bp, Homo sapiens
ccacaagctgtccctgca

SEQ ID NO: 6719298 - DNA, 20 bp, Homo sapiens
ccacaagctgtccctgcagg

SEQ ID NO: 6719299 - DNA, 18 bp, Homo sapiens
ccacaagcttctgtcctg

SEQ ID NO: 6719300 - DNA, 22 bp, Homo sapiens
ccacaagcttctgtcctgcccc

SEQ ID NO: 6719301 - DNA, 15 bp, Homo sapiens
ccacaaggaaaagga

SEQ ID NO: 6719302 - DNA, 17 bp, Homo sapiens
ccacaaggaaaaggagg

SEQ ID NO: 6719303 - DNA, 13 bp, Homo sapiens
ccacaaggaaaga

SEQ ID NO: 6719304 - DNA, 17 bp, Homo sapiens
ccacaaggaaccctcag

SEQ ID NO: 6719305 - DNA, 16 bp, Homo sapiens
ccacaaggaagaaatt

SEQ ID NO: 6719306 - DNA, 21 bp, Homo sapiens
ccacaaggacttcctgtccag

SEQ ID NO: 6719307 - DNA, 12 bp, Homo sapiens
ccacaaggccca

SEQ ID NO: 6719308 - DNA, 13 bp, Homo sapiens
ccacaaggcccag

SEQ ID NO: 6719309 - DNA, 15 bp, Homo sapiens
ccacaaggcctggtc

SEQ ID NO: 6719310 - DNA, 17 bp, Homo sapiens
ccacaaggctgaaaagt

SEQ ID NO: 6719311 - DNA, 16 bp, Homo sapiens
ccacaaggctggccag

SEQ ID NO: 6719312 - DNA, 18 bp, Homo sapiens
ccacaaggctggccagca

SEQ ID NO: 6719313 - DNA, 21 bp, Homo sapiens
ccacaagggactgaggcaagc

SEQ ID NO: 6719314 - DNA, 18 bp, Homo sapiens
ccacaagggcagtggaag

SEQ ID NO: 6719315 - DNA, 18 bp, Homo sapiens
ccacaaggtccactccct

SEQ ID NO: 6719316 - DNA, 23 bp, Homo sapiens
ccacaaggtccccccaccgctca

SEQ ID NO: 6719317 - DNA, 17 bp, Homo sapiens
ccacaagtccagctggg

SEQ ID NO: 6719318 - DNA, 22 bp, Homo sapiens
ccacaagtgaatctttctcctg

SEQ ID NO: 6719319 - DNA, 21 bp, Homo sapiens
ccacaagtggtggtaaccctg

SEQ ID NO: 6719320 - DNA, 22 bp, Homo sapiens
ccacaataaccaagatattttt

SEQ ID NO: 6719321 - DNA, 20 bp, Homo sapiens
ccacaatataaaactgtact

SEQ ID NO: 6719322 - DNA, 16 bp, Homo sapiens
ccacaatcctccccac

SEQ ID NO: 6719323 - DNA, 15 bp, Homo sapiens
ccacaatctgagcac

SEQ ID NO: 6719324 - DNA, 13 bp, Homo sapiens
ccacaatctggct

SEQ ID NO: 6719325 - DNA, 18 bp, Homo sapiens
ccacaatgagatgcatga

SEQ ID NO: 6719326 - DNA, 16 bp, Homo sapiens
ccacaatgcagttctg

SEQ ID NO: 6719327 - DNA, 18 bp, Homo sapiens
ccacaatgcctctcccac

SEQ ID NO: 6719328 - DNA, 19 bp, Homo sapiens
ccacaatgcctctcccacg

SEQ ID NO: 6719329 - DNA, 19 bp, Homo sapiens
ccacaatggagtgggagat

SEQ ID NO: 6719330 - DNA, 14 bp, Homo sapiens
ccacaatggctggg

SEQ ID NO: 6719331 - DNA, 20 bp, Homo sapiens
ccacaatggctgggaggggg

SEQ ID NO: 6719332 - DNA, 17 bp, Homo sapiens
ccacaatttctttaaaa

SEQ ID NO: 6719333 - DNA, 23 bp, Homo sapiens
ccacaatttctttaaaaaagaaa

SEQ ID NO: 6719334 - DNA, 17 bp, Homo sapiens
ccacacaacaccaggac

SEQ ID NO: 6719335 - DNA, 17 bp, Homo sapiens
ccacacaagacagcaga

SEQ ID NO: 6719336 - DNA, 15 bp, Homo sapiens
ccacacaagtgcagt

SEQ ID NO: 6719337 - DNA, 11 bp, Homo sapiens
ccacacacaca

SEQ ID NO: 6719338 - DNA, 13 bp, Homo sapiens
ccacacacacaaa

SEQ ID NO: 6719339 - DNA, 16 bp, Homo sapiens
ccacacacacaaggtg

SEQ ID NO: 6719340 - DNA, 14 bp, Homo sapiens
ccacacacacacac

SEQ ID NO: 6719341 - DNA, 24 bp, Homo sapiens
ccacacacacacacatgcatacac

SEQ ID NO: 6719342 - DNA, 12 bp, Homo sapiens
ccacacacacag

SEQ ID NO: 6719343 - DNA, 13 bp, Homo sapiens
ccacacacacaga

SEQ ID NO: 6719344 - DNA, 14 bp, Homo sapiens
ccacacacacagaa

SEQ ID NO: 6719345 - DNA, 19 bp, Homo sapiens
ccacacacacagaaaatat

SEQ ID NO: 6719346 - DNA, 23 bp, Homo sapiens
ccacacacacccacacactcgcc

SEQ ID NO: 6719347 - DNA, 14 bp, Homo sapiens
ccacacacactcct

SEQ ID NO: 6719348 - DNA, 15 bp, Homo sapiens
ccacacacactcctt

SEQ ID NO: 6719349 - DNA, 22 bp, Homo sapiens
ccacacacagaggaagagcagg

SEQ ID NO: 6719350 - DNA, 12 bp, Homo sapiens
ccacacacaggt

SEQ ID NO: 6719351 - DNA, 18 bp, Homo sapiens
ccacacacagtccaactc

SEQ ID NO: 6719352 - DNA, 13 bp, Homo sapiens
ccacacaccccaa

SEQ ID NO: 6719353 - DNA, 15 bp, Homo sapiens
ccacacactcgcccg

SEQ ID NO: 6719354 - DNA, 22 bp, Homo sapiens
ccacacacttagccattgaaat

SEQ ID NO: 6719355 - DNA, 17 bp, Homo sapiens
ccacacagagatgtcca

SEQ ID NO: 6719356 - DNA, 15 bp, Homo sapiens
ccacacagagcctgc

SEQ ID NO: 6719357 - DNA, 13 bp, Homo sapiens
ccacacagaggac

SEQ ID NO: 6719358 - DNA, 15 bp, Homo sapiens
ccacacagcagtgtc

SEQ ID NO: 6719359 - DNA, 13 bp, Homo sapiens
ccacacagcccag

SEQ ID NO: 6719360 - DNA, 22 bp, Homo sapiens
ccacacagcccagaaggccaga

SEQ ID NO: 6719361 - DNA, 14 bp, Homo sapiens
ccacacagcccgag

SEQ ID NO: 6719362 - DNA, 15 bp, Homo sapiens
ccacacagctacagc

SEQ ID NO: 6719363 - DNA, 14 bp, Homo sapiens
ccacacagctgccc

SEQ ID NO: 6719364 - DNA, 17 bp, Homo sapiens
ccacacagctgccctag

SEQ ID NO: 6719365 - DNA, 11 bp, Homo sapiens
ccacacaggca

SEQ ID NO: 6719366 - DNA, 11 bp, Homo sapiens
ccacacaggcc

SEQ ID NO: 6719367 - DNA, 16 bp, Homo sapiens
ccacacaggcctggcc

SEQ ID NO: 6719368 - DNA, 18 bp, Homo sapiens
ccacacaggcctggccca

SEQ ID NO: 6719369 - DNA, 19 bp, Homo sapiens
ccacacaggcctggcccag

SEQ ID NO: 6719370 - DNA, 20 bp, Homo sapiens
ccacacaggcctggcccagc

SEQ ID NO: 6719371 - DNA, 21 bp, Homo sapiens
ccacacaggcctggcccagcc

SEQ ID NO: 6719372 - DNA, 15 bp, Homo sapiens
ccacacagggcactg

SEQ ID NO: 6719373 - DNA, 12 bp, Homo sapiens
ccacacaggtgt

SEQ ID NO: 6719374 - DNA, 14 bp, Homo sapiens
ccacacagtcccca

SEQ ID NO: 6719375 - DNA, 20 bp, Homo sapiens
ccacacagtgctcaaggcca

SEQ ID NO: 6719376 - DNA, 23 bp, Homo sapiens
ccacacagtgctcaaggccagct

SEQ ID NO: 6719377 - DNA, 12 bp, Homo sapiens
ccacacagtggc

SEQ ID NO: 6719378 - DNA, 19 bp, Homo sapiens
ccacacagtggccggggct

SEQ ID NO: 6719379 - DNA, 15 bp, Homo sapiens
ccacacatcccagcc

SEQ ID NO: 6719380 - DNA, 15 bp, Homo sapiens
ccacacattccagcc

SEQ ID NO: 6719381 - DNA, 16 bp, Homo sapiens
ccacacattccagcca

SEQ ID NO: 6719382 - DNA, 17 bp, Homo sapiens
ccacacattccagccag

SEQ ID NO: 6719383 - DNA, 19 bp, Homo sapiens
ccacacattccagccaggc

SEQ ID NO: 6719384 - DNA, 20 bp, Homo sapiens
ccacacattccagccaggcc

SEQ ID NO: 6719385 - DNA, 19 bp, Homo sapiens
ccacacatttcactgtctg

SEQ ID NO: 6719386 - DNA, 12 bp, Homo sapiens
ccacacatttcc

SEQ ID NO: 6719387 - DNA, 15 bp, Homo sapiens
ccacaccaaacctct

SEQ ID NO: 6719388 - DNA, 20 bp, Homo sapiens
ccacaccaagctgtgccacc

SEQ ID NO: 6719389 - DNA, 18 bp, Homo sapiens
ccacaccaatcagagagc

SEQ ID NO: 6719390 - DNA, 23 bp, Homo sapiens
ccacaccaatcagagagcctaga

SEQ ID NO: 6719391 - DNA, 20 bp, Homo sapiens
ccacaccacagcaagccggc

SEQ ID NO: 6719392 - DNA, 17 bp, Homo sapiens
ccacaccaccgccctcc

SEQ ID NO: 6719393 - DNA, 16 bp, Homo sapiens
ccacaccacctattcc

SEQ ID NO: 6719394 - DNA, 20 bp, Homo sapiens
ccacaccactaaccatcccc

SEQ ID NO: 6719395 - DNA, 13 bp, Homo sapiens
ccacaccactgcc

SEQ ID NO: 6719396 - DNA, 19 bp, Homo sapiens
ccacaccagggccagcctc

SEQ ID NO: 6719397 - DNA, 22 bp, Homo sapiens
ccacaccagtaataaaaagcca

SEQ ID NO: 6719398 - DNA, 14 bp, Homo sapiens
ccacaccagtccac

SEQ ID NO: 6719399 - DNA, 15 bp, Homo sapiens
ccacaccagtggcct

SEQ ID NO: 6719400 - DNA, 21 bp, Homo sapiens
ccacaccataagctactgcca

SEQ ID NO: 6719401 - DNA, 23 bp, Homo sapiens
ccacaccataagctactgccatc

SEQ ID NO: 6719402 - DNA, 20 bp, Homo sapiens
ccacaccatcaccctctggg

SEQ ID NO: 6719403 - DNA, 21 bp, Homo sapiens
ccacaccatcaccctctgggc

SEQ ID NO: 6719404 - DNA, 21 bp, Homo sapiens
ccacaccatctggcccaggct

SEQ ID NO: 6719405 - DNA, 23 bp, Homo sapiens
ccacaccatctggcccaggctgg

SEQ ID NO: 6719406 - DNA, 24 bp, Homo sapiens
ccacaccatctggcccaggctggc

SEQ ID NO: 6719407 - DNA, 17 bp, Homo sapiens
ccacacccaatgctgct

SEQ ID NO: 6719408 - DNA, 22 bp, Homo sapiens
ccacacccaattccactctgat

SEQ ID NO: 6719409 - DNA, 15 bp, Homo sapiens
ccacacccaccccct

SEQ ID NO: 6719410 - DNA, 15 bp, Homo sapiens
ccacacccagccagc

SEQ ID NO: 6719411 - DNA, 21 bp, Homo sapiens
ccacacccagcccacttctgc

SEQ ID NO: 6719412 - DNA, 15 bp, Homo sapiens
ccacacccagcctca

SEQ ID NO: 6719413 - DNA, 15 bp, Homo sapiens
ccacacccagcctct

SEQ ID NO: 6719414 - DNA, 14 bp, Homo sapiens
ccacacccagcggc

SEQ ID NO: 6719415 - DNA, 13 bp, Homo sapiens
ccacacccaggaa

SEQ ID NO: 6719416 - DNA, 17 bp, Homo sapiens
ccacacccaggaaggga

SEQ ID NO: 6719417 - DNA, 22 bp, Homo sapiens
ccacacccaggggaaggccctg

SEQ ID NO: 6719418 - DNA, 22 bp, Homo sapiens
ccacacccaggtctcttccttt

SEQ ID NO: 6719419 - DNA, 21 bp, Homo sapiens
ccacaccccaacacttccagc

SEQ ID NO: 6719420 - DNA, 22 bp, Homo sapiens
ccacaccccagactccaggccc

SEQ ID NO: 6719421 - DNA, 12 bp, Homo sapiens
ccacaccccagc

SEQ ID NO: 6719422 - DNA, 20 bp, Homo sapiens
ccacaccccagcccaccctg

SEQ ID NO: 6719423 - DNA, 17 bp, Homo sapiens
ccacaccccgtctgccc

SEQ ID NO: 6719424 - DNA, 21 bp, Homo sapiens
ccacacccctccaaagcccca

SEQ ID NO: 6719425 - DNA, 19 bp, Homo sapiens
ccacacccctctgctgcaa

SEQ ID NO: 6719426 - DNA, 21 bp, Homo sapiens
ccacacccggctccccctgct

SEQ ID NO: 6719427 - DNA, 16 bp, Homo sapiens
ccacaccctacagcag

SEQ ID NO: 6719428 - DNA, 21 bp, Homo sapiens
ccacaccctatatctccgtgt

SEQ ID NO: 6719429 - DNA, 21 bp, Homo sapiens
ccacaccctcccccgccactc

SEQ ID NO: 6719430 - DNA, 17 bp, Homo sapiens
ccacaccctcggggggt

SEQ ID NO: 6719431 - DNA, 18 bp, Homo sapiens
ccacaccctctcccagga

SEQ ID NO: 6719432 - DNA, 17 bp, Homo sapiens
ccacaccctgcctgctg

SEQ ID NO: 6719433 - DNA, 23 bp, Homo sapiens
ccacaccctgtactgttctgtgt

SEQ ID NO: 6719434 - DNA, 14 bp, Homo sapiens
ccacaccgcagaag

SEQ ID NO: 6719435 - DNA, 15 bp, Homo sapiens
ccacaccgcagaagc

SEQ ID NO: 6719436 - DNA, 16 bp, Homo sapiens
ccacaccgcgtcccag

SEQ ID NO: 6719437 - DNA, 22 bp, Homo sapiens
ccacaccgcgtcccagctcccc

SEQ ID NO: 6719438 - DNA, 16 bp, Homo sapiens
ccacaccgctggctcc

SEQ ID NO: 6719439 - DNA, 15 bp, Homo sapiens
ccacaccggttccct

SEQ ID NO: 6719440 - DNA, 22 bp, Homo sapiens
ccacaccgtggcagcttgctgg

SEQ ID NO: 6719441 - DNA, 14 bp, Homo sapiens
ccacacctaaaact

SEQ ID NO: 6719442 - DNA, 18 bp, Homo sapiens
ccacacctcagttccctt

SEQ ID NO: 6719443 - DNA, 22 bp, Homo sapiens
ccacacctcagttcccttggcc

SEQ ID NO: 6719444 - DNA, 23 bp, Homo sapiens
ccacacctccacagttcagtggc

SEQ ID NO: 6719445 - DNA, 16 bp, Homo sapiens
ccacacctccctgaac

SEQ ID NO: 6719446 - DNA, 14 bp, Homo sapiens
ccacacctcctggg

SEQ ID NO: 6719447 - DNA, 19 bp, Homo sapiens
ccacacctccttccctctc

SEQ ID NO: 6719448 - DNA, 12 bp, Homo sapiens
ccacacctgagc

SEQ ID NO: 6719449 - DNA, 22 bp, Homo sapiens
ccacacctgagcgctgtggact

SEQ ID NO: 6719450 - DNA, 20 bp, Homo sapiens
ccacacctgcagtgccagct

SEQ ID NO: 6719451 - DNA, 14 bp, Homo sapiens
ccacacctgcctct

SEQ ID NO: 6719452 - DNA, 14 bp, Homo sapiens
ccacacctgcctgc

SEQ ID NO: 6719453 - DNA, 13 bp, Homo sapiens
ccacacctgcggc

SEQ ID NO: 6719454 - DNA, 18 bp, Homo sapiens
ccacacctggcactgctg

SEQ ID NO: 6719455 - DNA, 18 bp, Homo sapiens
ccacacctggcatggtgc

SEQ ID NO: 6719456 - DNA, 20 bp, Homo sapiens
ccacacctggccctggggcc

SEQ ID NO: 6719457 - DNA, 22 bp, Homo sapiens
ccacacctggccttaaagaggg

SEQ ID NO: 6719458 - DNA, 17 bp, Homo sapiens
ccacaccttccagggcc

SEQ ID NO: 6719459 - DNA, 21 bp, Homo sapiens
ccacaccttccagggccctag

SEQ ID NO: 6719460 - DNA, 13 bp, Homo sapiens
ccacacgagggcc

SEQ ID NO: 6719461 - DNA, 15 bp, Homo sapiens
ccacacgcaggcggc

SEQ ID NO: 6719462 - DNA, 18 bp, Homo sapiens
ccacacgccggggctggc

SEQ ID NO: 6719463 - DNA, 16 bp, Homo sapiens
ccacacgcctctgtgt

SEQ ID NO: 6719464 - DNA, 19 bp, Homo sapiens
ccacacgcgaccctcggtg

SEQ ID NO: 6719465 - DNA, 19 bp, Homo sapiens
ccacacgctcctccctctg

SEQ ID NO: 6719466 - DNA, 20 bp, Homo sapiens
ccacacgctgcccaggctct

SEQ ID NO: 6719467 - DNA, 17 bp, Homo sapiens
ccacacggagctcctgg

SEQ ID NO: 6719468 - DNA, 16 bp, Homo sapiens
ccacacggcagccccc

SEQ ID NO: 6719469 - DNA, 15 bp, Homo sapiens
ccacacgtgctcgca

SEQ ID NO: 6719470 - DNA, 16 bp, Homo sapiens
ccacacgtgctcgcag

SEQ ID NO: 6719471 - DNA, 21 bp, Homo sapiens
ccacacgtgctcgcagcctgg

SEQ ID NO: 6719472 - DNA, 15 bp, Homo sapiens
ccacactatgcacag

SEQ ID NO: 6719473 - DNA, 19 bp, Homo sapiens
ccacactatgcacagagcc

SEQ ID NO: 6719474 - DNA, 13 bp, Homo sapiens
ccacactatgtgt

SEQ ID NO: 6719475 - DNA, 18 bp, Homo sapiens
ccacactattaccatgag

SEQ ID NO: 6719476 - DNA, 13 bp, Homo sapiens
ccacactcagaaa

SEQ ID NO: 6719477 - DNA, 14 bp, Homo sapiens
ccacactcagcaca

SEQ ID NO: 6719478 - DNA, 13 bp, Homo sapiens
ccacactccactg

SEQ ID NO: 6719479 - DNA, 19 bp, Homo sapiens
ccacactccccgcctgtcc

SEQ ID NO: 6719480 - DNA, 18 bp, Homo sapiens
ccacactccttgtcaaca

SEQ ID NO: 6719481 - DNA, 16 bp, Homo sapiens
ccacactctccatcac

SEQ ID NO: 6719482 - DNA, 19 bp, Homo sapiens
ccacactctttctcctgct

SEQ ID NO: 6719483 - DNA, 14 bp, Homo sapiens
ccacactgaaacca

SEQ ID NO: 6719484 - DNA, 17 bp, Homo sapiens
ccacactgaaaccaaaa

SEQ ID NO: 6719485 - DNA, 15 bp, Homo sapiens
ccacactgaatctcc

SEQ ID NO: 6719486 - DNA, 12 bp, Homo sapiens
ccacactgaggc

SEQ ID NO: 6719487 - DNA, 16 bp, Homo sapiens
ccacactgagttctat

SEQ ID NO: 6719488 - DNA, 14 bp, Homo sapiens
ccacactgatggct

SEQ ID NO: 6719489 - DNA, 19 bp, Homo sapiens
ccacactgatggctcaaga

SEQ ID NO: 6719490 - DNA, 18 bp, Homo sapiens
ccacactgcagggaggag

SEQ ID NO: 6719491 - DNA, 19 bp, Homo sapiens
ccacactgcagggaggagt

SEQ ID NO: 6719492 - DNA, 13 bp, Homo sapiens
ccacactgccacc

SEQ ID NO: 6719493 - DNA, 22 bp, Homo sapiens
ccacactggaatccagttttgg

SEQ ID NO: 6719494 - DNA, 16 bp, Homo sapiens
ccacactgggcctgga

SEQ ID NO: 6719495 - DNA, 13 bp, Homo sapiens
ccacactggggct

SEQ ID NO: 6719496 - DNA, 18 bp, Homo sapiens
ccacactggggctgacac

SEQ ID NO: 6719497 - DNA, 22 bp, Homo sapiens
ccacactggggtgccgcctgcc

SEQ ID NO: 6719498 - DNA, 23 bp, Homo sapiens
ccacactggggtgccgcctgccc

SEQ ID NO: 6719499 - DNA, 14 bp, Homo sapiens
ccacactggtgact

SEQ ID NO: 6719500 - DNA, 17 bp, Homo sapiens
ccacactgtcagagctg

SEQ ID NO: 6719501 - DNA, 18 bp, Homo sapiens
ccacactgtgacacacta

SEQ ID NO: 6719502 - DNA, 14 bp, Homo sapiens
ccacactgtggcca

SEQ ID NO: 6719503 - DNA, 16 bp, Homo sapiens
ccacacttaagccctc

SEQ ID NO: 6719504 - DNA, 18 bp, Homo sapiens
ccacacttcaaactactt

SEQ ID NO: 6719505 - DNA, 16 bp, Homo sapiens
ccacacttcaggctct

SEQ ID NO: 6719506 - DNA, 15 bp, Homo sapiens
ccacacttccctggc

SEQ ID NO: 6719507 - DNA, 16 bp, Homo sapiens
ccacacttccctggcg

SEQ ID NO: 6719508 - DNA, 12 bp, Homo sapiens
ccacacttcctg

SEQ ID NO: 6719509 - DNA, 13 bp, Homo sapiens
ccacacttcctgt

SEQ ID NO: 6719510 - DNA, 18 bp, Homo sapiens
ccacacttcctgtccaga

SEQ ID NO: 6719511 - DNA, 14 bp, Homo sapiens
ccacacttccttta

SEQ ID NO: 6719512 - DNA, 22 bp, Homo sapiens
ccacacttctcaggacacaggc

SEQ ID NO: 6719513 - DNA, 22 bp, Homo sapiens
ccacacttcttgaaacagcctg

SEQ ID NO: 6719514 - DNA, 16 bp, Homo sapiens
ccacacttgaaacctt

SEQ ID NO: 6719515 - DNA, 20 bp, Homo sapiens
ccacacttgcagagctgctg

SEQ ID NO: 6719516 - DNA, 19 bp, Homo sapiens
ccacacttgtgtgccacag

SEQ ID NO: 6719517 - DNA, 15 bp, Homo sapiens
ccacagaaagagagc

SEQ ID NO: 6719518 - DNA, 22 bp, Homo sapiens
ccacagaaagccaggagcagcc

SEQ ID NO: 6719519 - DNA, 23 bp, Homo sapiens
ccacagaaccttcaacccagtgg

SEQ ID NO: 6719520 - DNA, 18 bp, Homo sapiens
ccacagaagccaggagca

SEQ ID NO: 6719521 - DNA, 16 bp, Homo sapiens
ccacagaagctccagg

SEQ ID NO: 6719522 - DNA, 19 bp, Homo sapiens
ccacagaagggggaacgca

SEQ ID NO: 6719523 - DNA, 16 bp, Homo sapiens
ccacagaagtgctttc

SEQ ID NO: 6719524 - DNA, 21 bp, Homo sapiens
ccacagacaaggtagccctgg

SEQ ID NO: 6719525 - DNA, 23 bp, Homo sapiens
ccacagacaatacgtttgataat

SEQ ID NO: 6719526 - DNA, 12 bp, Homo sapiens
ccacagacacac

SEQ ID NO: 6719527 - DNA, 15 bp, Homo sapiens
ccacagacacacaca

SEQ ID NO: 6719528 - DNA, 21 bp, Homo sapiens
ccacagacacacacacgcacg

SEQ ID NO: 6719529 - DNA, 14 bp, Homo sapiens
ccacagacactcct

SEQ ID NO: 6719530 - DNA, 21 bp, Homo sapiens
ccacagacactcctggggggc

SEQ ID NO: 6719531 - DNA, 15 bp, Homo sapiens
ccacagacagatccc

SEQ ID NO: 6719532 - DNA, 17 bp, Homo sapiens
ccacagacagatcccat

SEQ ID NO: 6719533 - DNA, 14 bp, Homo sapiens
ccacagacctgcag

SEQ ID NO: 6719534 - DNA, 18 bp, Homo sapiens
ccacagacggaagggtaa

SEQ ID NO: 6719535 - DNA, 20 bp, Homo sapiens
ccacagactcttacgtggag

SEQ ID NO: 6719536 - DNA, 18 bp, Homo sapiens
ccacagactgccccagcc

SEQ ID NO: 6719537 - DNA, 14 bp, Homo sapiens
ccacagacttgcac

SEQ ID NO: 6719538 - DNA, 17 bp, Homo sapiens
ccacagacttgcactga

SEQ ID NO: 6719539 - DNA, 21 bp, Homo sapiens
ccacagacttgcactgaagcc

SEQ ID NO: 6719540 - DNA, 22 bp, Homo sapiens
ccacagagactgtttgaatgtt

SEQ ID NO: 6719541 - DNA, 13 bp, Homo sapiens
ccacagagagtcc

SEQ ID NO: 6719542 - DNA, 18 bp, Homo sapiens
ccacagagagtcccactg

SEQ ID NO: 6719543 - DNA, 14 bp, Homo sapiens
ccacagagatgcat

SEQ ID NO: 6719544 - DNA, 12 bp, Homo sapiens
ccacagagcctg

SEQ ID NO: 6719545 - DNA, 19 bp, Homo sapiens
ccacagaggacagtgctga

SEQ ID NO: 6719546 - DNA, 16 bp, Homo sapiens
ccacagaggccccacc

SEQ ID NO: 6719547 - DNA, 18 bp, Homo sapiens
ccacagaggccccacctg

SEQ ID NO: 6719548 - DNA, 18 bp, Homo sapiens
ccacagagggctgtgtct

SEQ ID NO: 6719549 - DNA, 22 bp, Homo sapiens
ccacagagtgccatccctgaga

SEQ ID NO: 6719550 - DNA, 15 bp, Homo sapiens
ccacagagtgctgga

SEQ ID NO: 6719551 - DNA, 16 bp, Homo sapiens
ccacagagtgctggac

SEQ ID NO: 6719552 - DNA, 22 bp, Homo sapiens
ccacagagtgtagccaggtccc

SEQ ID NO: 6719553 - DNA, 14 bp, Homo sapiens
ccacagatatcttt

SEQ ID NO: 6719554 - DNA, 11 bp, Homo sapiens
ccacagatcca

SEQ ID NO: 6719555 - DNA, 15 bp, Homo sapiens
ccacagatccatcct

SEQ ID NO: 6719556 - DNA, 20 bp, Homo sapiens
ccacagatgatgaagaaatg

SEQ ID NO: 6719557 - DNA, 20 bp, Homo sapiens
ccacagatggctttcagggc

SEQ ID NO: 6719558 - DNA, 19 bp, Homo sapiens
ccacagatgtctctggggc

SEQ ID NO: 6719559 - DNA, 23 bp, Homo sapiens
ccacagatgtgtctgggagagcc

SEQ ID NO: 6719560 - DNA, 19 bp, Homo sapiens
ccacagattgtttctatac

SEQ ID NO: 6719561 - DNA, 19 bp, Homo sapiens
ccacagcaaccccaggctg

SEQ ID NO: 6719562 - DNA, 20 bp, Homo sapiens
ccacagcaaccccaggctga

SEQ ID NO: 6719563 - DNA, 16 bp, Homo sapiens
ccacagcaactgacct

SEQ ID NO: 6719564 - DNA, 17 bp, Homo sapiens
ccacagcaaggcacctg

SEQ ID NO: 6719565 - DNA, 20 bp, Homo sapiens
ccacagcaaggcacctgcag

SEQ ID NO: 6719566 - DNA, 21 bp, Homo sapiens
ccacagcaagtacagcggctc

SEQ ID NO: 6719567 - DNA, 22 bp, Homo sapiens
ccacagcaagtacagcggctcc

SEQ ID NO: 6719568 - DNA, 23 bp, Homo sapiens
ccacagcaagtacagcggctccc

SEQ ID NO: 6719569 - DNA, 14 bp, Homo sapiens
ccacagcagacacc

SEQ ID NO: 6719570 - DNA, 15 bp, Homo sapiens
ccacagcagacacca

SEQ ID NO: 6719571 - DNA, 22 bp, Homo sapiens
ccacagcagcacctcctccatg

SEQ ID NO: 6719572 - DNA, 20 bp, Homo sapiens
ccacagcagccccaggagaa

SEQ ID NO: 6719573 - DNA, 20 bp, Homo sapiens
ccacagcagcctctgaagtt

SEQ ID NO: 6719574 - DNA, 12 bp, Homo sapiens
ccacagcaggtg

SEQ ID NO: 6719575 - DNA, 23 bp, Homo sapiens
ccacagcagttgaaaagactcca

SEQ ID NO: 6719576 - DNA, 14 bp, Homo sapiens
ccacagccaacaaa

SEQ ID NO: 6719577 - DNA, 22 bp, Homo sapiens
ccacagccaagcccaccctggg

SEQ ID NO: 6719578 - DNA, 12 bp, Homo sapiens
ccacagccagag

SEQ ID NO: 6719579 - DNA, 14 bp, Homo sapiens
ccacagccagagga

SEQ ID NO: 6719580 - DNA, 17 bp, Homo sapiens
ccacagccagaggaggg

SEQ ID NO: 6719581 - DNA, 15 bp, Homo sapiens
ccacagccagcacct

SEQ ID NO: 6719582 - DNA, 11 bp, Homo sapiens
ccacagccagg

SEQ ID NO: 6719583 - DNA, 13 bp, Homo sapiens
ccacagccagggc

SEQ ID NO: 6719584 - DNA, 11 bp, Homo sapiens
ccacagccagt

SEQ ID NO: 6719585 - DNA, 12 bp, Homo sapiens
ccacagccatag

SEQ ID NO: 6719586 - DNA, 16 bp, Homo sapiens
ccacagccatagacct

SEQ ID NO: 6719587 - DNA, 14 bp, Homo sapiens
ccacagcccacgtc

SEQ ID NO: 6719588 - DNA, 15 bp, Homo sapiens
ccacagcccagccac

SEQ ID NO: 6719589 - DNA, 15 bp, Homo sapiens
ccacagcccaggcct

SEQ ID NO: 6719590 - DNA, 21 bp, Homo sapiens
ccacagcccccttgccctccg

SEQ ID NO: 6719591 - DNA, 12 bp, Homo sapiens
ccacagcccctg

SEQ ID NO: 6719592 - DNA, 22 bp, Homo sapiens
ccacagccccttaagggaaagg

SEQ ID NO: 6719593 - DNA, 19 bp, Homo sapiens
ccacagccccttgcttcta

SEQ ID NO: 6719594 - DNA, 13 bp, Homo sapiens
ccacagccctagt

SEQ ID NO: 6719595 - DNA, 12 bp, Homo sapiens
ccacagccctgg

SEQ ID NO: 6719596 - DNA, 15 bp, Homo sapiens
ccacagccctggaat

SEQ ID NO: 6719597 - DNA, 13 bp, Homo sapiens
ccacagccctgtc

SEQ ID NO: 6719598 - DNA, 15 bp, Homo sapiens
ccacagccctgtcag

SEQ ID NO: 6719599 - DNA, 20 bp, Homo sapiens
ccacagccctgtcagcatga

SEQ ID NO: 6719600 - DNA, 20 bp, Homo sapiens
ccacagccctgtcagtgcag

SEQ ID NO: 6719601 - DNA, 23 bp, Homo sapiens
ccacagccctgtcagtgcagccc

SEQ ID NO: 6719602 - DNA, 15 bp, Homo sapiens
ccacagccgcagcct

SEQ ID NO: 6719603 - DNA, 22 bp, Homo sapiens
ccacagccgcctttgggttcca

SEQ ID NO: 6719604 - DNA, 14 bp, Homo sapiens
ccacagcctccaaa

SEQ ID NO: 6719605 - DNA, 13 bp, Homo sapiens
ccacagcctcctt

SEQ ID NO: 6719606 - DNA, 20 bp, Homo sapiens
ccacagcctccttctgtttg

SEQ ID NO: 6719607 - DNA, 14 bp, Homo sapiens
ccacagcctgctgg

SEQ ID NO: 6719608 - DNA, 21 bp, Homo sapiens
ccacagcctgctggcagggcc

SEQ ID NO: 6719609 - DNA, 22 bp, Homo sapiens
ccacagcctgctggcagggcca

SEQ ID NO: 6719610 - DNA, 23 bp, Homo sapiens
ccacagcctgctggcagggccag

SEQ ID NO: 6719611 - DNA, 11 bp, Homo sapiens
ccacagcctgt

SEQ ID NO: 6719612 - DNA, 18 bp, Homo sapiens
ccacagccttccctctgc

SEQ ID NO: 6719613 - DNA, 21 bp, Homo sapiens
ccacagccttccctctgcatt

SEQ ID NO: 6719614 - DNA, 19 bp, Homo sapiens
ccacagccttcggacagac

SEQ ID NO: 6719615 - DNA, 12 bp, Homo sapiens
ccacagcgagcc

SEQ ID NO: 6719616 - DNA, 14 bp, Homo sapiens
ccacagcgagcctg

SEQ ID NO: 6719617 - DNA, 15 bp, Homo sapiens
ccacagcgagggcag

SEQ ID NO: 6719618 - DNA, 18 bp, Homo sapiens
ccacagcgagggcagctg

SEQ ID NO: 6719619 - DNA, 15 bp, Homo sapiens
ccacagcggaggaga

SEQ ID NO: 6719620 - DNA, 18 bp, Homo sapiens
ccacagcggaggagacca

SEQ ID NO: 6719621 - DNA, 19 bp, Homo sapiens
ccacagcggaggagaccag

SEQ ID NO: 6719622 - DNA, 16 bp, Homo sapiens
ccacagcgtccctggc

SEQ ID NO: 6719623 - DNA, 21 bp, Homo sapiens
ccacagcgtccctggcgcagg

SEQ ID NO: 6719624 - DNA, 21 bp, Homo sapiens
ccacagcgtgctggcgacact

SEQ ID NO: 6719625 - DNA, 19 bp, Homo sapiens
ccacagctcccaccccacc

SEQ ID NO: 6719626 - DNA, 14 bp, Homo sapiens
ccacagctccttgc

SEQ ID NO: 6719627 - DNA, 11 bp, Homo sapiens
ccacagctctg

SEQ ID NO: 6719628 - DNA, 15 bp, Homo sapiens
ccacagctctgctgg

SEQ ID NO: 6719629 - DNA, 19 bp, Homo sapiens
ccacagctctgggcctctt

SEQ ID NO: 6719630 - DNA, 19 bp, Homo sapiens
ccacagctgaagagcaagg

SEQ ID NO: 6719631 - DNA, 12 bp, Homo sapiens
ccacagctgcag

SEQ ID NO: 6719632 - DNA, 16 bp, Homo sapiens
ccacagctgcagccca

SEQ ID NO: 6719633 - DNA, 16 bp, Homo sapiens
ccacagctgccctggc

SEQ ID NO: 6719634 - DNA, 12 bp, Homo sapiens
ccacagctgctg

SEQ ID NO: 6719635 - DNA, 18 bp, Homo sapiens
ccacagctgctggccagg

SEQ ID NO: 6719636 - DNA, 20 bp, Homo sapiens
ccacagctgggcagggtgag

SEQ ID NO: 6719637 - DNA, 17 bp, Homo sapiens
ccacagctggggccggt

SEQ ID NO: 6719638 - DNA, 15 bp, Homo sapiens
ccacagctttgcacc

SEQ ID NO: 6719639 - DNA, 22 bp, Homo sapiens
ccacagcttttacgtagtaaaa

SEQ ID NO: 6719640 - DNA, 15 bp, Homo sapiens
ccacagcttttgcaa

SEQ ID NO: 6719641 - DNA, 17 bp, Homo sapiens
ccacaggaacggccctg

SEQ ID NO: 6719642 - DNA, 19 bp, Homo sapiens
ccacaggaacggccctgca

SEQ ID NO: 6719643 - DNA, 21 bp, Homo sapiens
ccacaggaacggccctgcagg

SEQ ID NO: 6719644 - DNA, 23 bp, Homo sapiens
ccacaggaagcctgcagtcctgg

SEQ ID NO: 6719645 - DNA, 17 bp, Homo sapiens
ccacaggaagctcagcc

SEQ ID NO: 6719646 - DNA, 18 bp, Homo sapiens
ccacaggaagctcagcct

SEQ ID NO: 6719647 - DNA, 22 bp, Homo sapiens
ccacaggaagctcagccttctc

SEQ ID NO: 6719648 - DNA, 19 bp, Homo sapiens
ccacaggaaggaggggaga

SEQ ID NO: 6719649 - DNA, 16 bp, Homo sapiens
ccacaggacacagtca

SEQ ID NO: 6719650 - DNA, 20 bp, Homo sapiens
ccacaggacacgaaggctgc

SEQ ID NO: 6719651 - DNA, 16 bp, Homo sapiens
ccacaggacatttctc

SEQ ID NO: 6719652 - DNA, 13 bp, Homo sapiens
ccacaggaccacc

SEQ ID NO: 6719653 - DNA, 18 bp, Homo sapiens
ccacaggaccacctcctc

SEQ ID NO: 6719654 - DNA, 18 bp, Homo sapiens
ccacaggacgaatgcata

SEQ ID NO: 6719655 - DNA, 16 bp, Homo sapiens
ccacaggactgagccc

SEQ ID NO: 6719656 - DNA, 18 bp, Homo sapiens
ccacaggactgagccctc

SEQ ID NO: 6719657 - DNA, 19 bp, Homo sapiens
ccacaggactgagccctct

SEQ ID NO: 6719658 - DNA, 20 bp, Homo sapiens
ccacaggactgagccctctc

SEQ ID NO: 6719659 - DNA, 23 bp, Homo sapiens
ccacaggactgagccctctcact

SEQ ID NO: 6719660 - DNA, 12 bp, Homo sapiens
ccacaggagccg

SEQ ID NO: 6719661 - DNA, 18 bp, Homo sapiens
ccacaggagcgtgtccta

SEQ ID NO: 6719662 - DNA, 16 bp, Homo sapiens
ccacaggagctccctt

SEQ ID NO: 6719663 - DNA, 18 bp, Homo sapiens
ccacaggagggccagcgc

SEQ ID NO: 6719664 - DNA, 17 bp, Homo sapiens
ccacaggatcatcattt

SEQ ID NO: 6719665 - DNA, 23 bp, Homo sapiens
ccacaggatctgaactttgtttc

SEQ ID NO: 6719666 - DNA, 21 bp, Homo sapiens
ccacaggatgaactagccatg

SEQ ID NO: 6719667 - DNA, 19 bp, Homo sapiens
ccacaggcacattaactgt

SEQ ID NO: 6719668 - DNA, 19 bp, Homo sapiens
ccacaggcaggtcacagaa

SEQ ID NO: 6719669 - DNA, 19 bp, Homo sapiens
ccacaggcagtccaggcct

SEQ ID NO: 6719670 - DNA, 13 bp, Homo sapiens
ccacaggccacac

SEQ ID NO: 6719671 - DNA, 17 bp, Homo sapiens
ccacaggcccttcctct

SEQ ID NO: 6719672 - DNA, 16 bp, Homo sapiens
ccacaggcccttgggg

SEQ ID NO: 6719673 - DNA, 17 bp, Homo sapiens
ccacaggcccttggggt

SEQ ID NO: 6719674 - DNA, 12 bp, Homo sapiens
ccacaggcctcc

SEQ ID NO: 6719675 - DNA, 16 bp, Homo sapiens
ccacaggcctccctgt

SEQ ID NO: 6719676 - DNA, 11 bp, Homo sapiens
ccacaggcctg

SEQ ID NO: 6719677 - DNA, 12 bp, Homo sapiens
ccacaggcctga

SEQ ID NO: 6719678 - DNA, 19 bp, Homo sapiens
ccacaggcctgagatttca

SEQ ID NO: 6719679 - DNA, 14 bp, Homo sapiens
ccacaggcctggcc

SEQ ID NO: 6719680 - DNA, 16 bp, Homo sapiens
ccacaggctagatccc

SEQ ID NO: 6719681 - DNA, 15 bp, Homo sapiens
ccacaggctcaggca

SEQ ID NO: 6719682 - DNA, 19 bp, Homo sapiens
ccacaggctcaggcagggg

SEQ ID NO: 6719683 - DNA, 20 bp, Homo sapiens
ccacaggcttacgctgctct

SEQ ID NO: 6719684 - DNA, 14 bp, Homo sapiens
ccacaggcttctga

SEQ ID NO: 6719685 - DNA, 19 bp, Homo sapiens
ccacaggcttctgagcagc

SEQ ID NO: 6719686 - DNA, 20 bp, Homo sapiens
ccacagggaaatactgtatt

SEQ ID NO: 6719687 - DNA, 17 bp, Homo sapiens
ccacagggaaatgtgta

SEQ ID NO: 6719688 - DNA, 20 bp, Homo sapiens
ccacagggaacacattcctt

SEQ ID NO: 6719689 - DNA, 22 bp, Homo sapiens
ccacagggaccacatccacccc

SEQ ID NO: 6719690 - DNA, 14 bp, Homo sapiens
ccacagggaccagg

SEQ ID NO: 6719691 - DNA, 18 bp, Homo sapiens
ccacagggaccagggcca

SEQ ID NO: 6719692 - DNA, 11 bp, Homo sapiens
ccacagggacg

SEQ ID NO: 6719693 - DNA, 13 bp, Homo sapiens
ccacagggagctc

SEQ ID NO: 6719694 - DNA, 17 bp, Homo sapiens
ccacagggcaaggacac

SEQ ID NO: 6719695 - DNA, 14 bp, Homo sapiens
ccacagggccagag

SEQ ID NO: 6719696 - DNA, 22 bp, Homo sapiens
ccacagggcctgacttttacag

SEQ ID NO: 6719697 - DNA, 20 bp, Homo sapiens
ccacagggctaagagctagc

SEQ ID NO: 6719698 - DNA, 22 bp, Homo sapiens
ccacagggctgttttgcctccc

SEQ ID NO: 6719699 - DNA, 19 bp, Homo sapiens
ccacagggcttgttttcca

SEQ ID NO: 6719700 - DNA, 24 bp, Homo sapiens
ccacaggggctatcccttctcaga

SEQ ID NO: 6719701 - DNA, 16 bp, Homo sapiens
ccacaggggggaggca

SEQ ID NO: 6719702 - DNA, 16 bp, Homo sapiens
ccacagggtcccacag

SEQ ID NO: 6719703 - DNA, 18 bp, Homo sapiens
ccacagggtctgcctcca

SEQ ID NO: 6719704 - DNA, 18 bp, Homo sapiens
ccacagggtgggatgagc

SEQ ID NO: 6719705 - DNA, 18 bp, Homo sapiens
ccacaggtaatttctcct

SEQ ID NO: 6719706 - DNA, 14 bp, Homo sapiens
ccacaggtccaagg

SEQ ID NO: 6719707 - DNA, 14 bp, Homo sapiens
ccacaggtcctcca

SEQ ID NO: 6719708 - DNA, 21 bp, Homo sapiens
ccacaggtcctccatcacccc

SEQ ID NO: 6719709 - DNA, 14 bp, Homo sapiens
ccacaggtctagac

SEQ ID NO: 6719710 - DNA, 19 bp, Homo sapiens
ccacaggtgaggggcagga

SEQ ID NO: 6719711 - DNA, 14 bp, Homo sapiens
ccacaggtgcccgc

SEQ ID NO: 6719712 - DNA, 18 bp, Homo sapiens
ccacaggtgcgggaccat

SEQ ID NO: 6719713 - DNA, 21 bp, Homo sapiens
ccacaggtgcgggaccatctg

SEQ ID NO: 6719714 - DNA, 23 bp, Homo sapiens
ccacaggtgtttatacagctcag

SEQ ID NO: 6719715 - DNA, 22 bp, Homo sapiens
ccacaggttcatgccaccatgg

SEQ ID NO: 6719716 - DNA, 23 bp, Homo sapiens
ccacagtaatctttcggtctcct

SEQ ID NO: 6719717 - DNA, 17 bp, Homo sapiens
ccacagtagtcttgatg

SEQ ID NO: 6719718 - DNA, 14 bp, Homo sapiens
ccacagtcaaagaa

SEQ ID NO: 6719719 - DNA, 15 bp, Homo sapiens
ccacagtcacacaga

SEQ ID NO: 6719720 - DNA, 16 bp, Homo sapiens
ccacagtcacacagag

SEQ ID NO: 6719721 - DNA, 13 bp, Homo sapiens
ccacagtcagtgg

SEQ ID NO: 6719722 - DNA, 14 bp, Homo sapiens
ccacagtcagtgga

SEQ ID NO: 6719723 - DNA, 20 bp, Homo sapiens
ccacagtcccccacccacct

SEQ ID NO: 6719724 - DNA, 21 bp, Homo sapiens
ccacagtcccccacccacctc

SEQ ID NO: 6719725 - DNA, 14 bp, Homo sapiens
ccacagtccctcac

SEQ ID NO: 6719726 - DNA, 13 bp, Homo sapiens
ccacagtctccca

SEQ ID NO: 6719727 - DNA, 19 bp, Homo sapiens
ccacagtctcccccaccct

SEQ ID NO: 6719728 - DNA, 13 bp, Homo sapiens
ccacagtctctgg

SEQ ID NO: 6719729 - DNA, 16 bp, Homo sapiens
ccacagtgacagtcac

SEQ ID NO: 6719730 - DNA, 19 bp, Homo sapiens
ccacagtgacagtcacttc

SEQ ID NO: 6719731 - DNA, 21 bp, Homo sapiens
ccacagtgactcgggctcctg

SEQ ID NO: 6719732 - DNA, 19 bp, Homo sapiens
ccacagtgactgggccctg

SEQ ID NO: 6719733 - DNA, 20 bp, Homo sapiens
ccacagtgactgggccctgt

SEQ ID NO: 6719734 - DNA, 24 bp, Homo sapiens
ccacagtgactgggccctgtccag

SEQ ID NO: 6719735 - DNA, 16 bp, Homo sapiens
ccacagtgccacccat

SEQ ID NO: 6719736 - DNA, 12 bp, Homo sapiens
ccacagtgctca

SEQ ID NO: 6719737 - DNA, 18 bp, Homo sapiens
ccacagtgctgcttctct

SEQ ID NO: 6719738 - DNA, 13 bp, Homo sapiens
ccacagtgctggg

SEQ ID NO: 6719739 - DNA, 20 bp, Homo sapiens
ccacagtggaaccagcccag

SEQ ID NO: 6719740 - DNA, 17 bp, Homo sapiens
ccacagtggcgggccca

SEQ ID NO: 6719741 - DNA, 22 bp, Homo sapiens
ccacagtggggcccatggcccc

SEQ ID NO: 6719742 - DNA, 22 bp, Homo sapiens
ccacagtggggctgcaggcagg

SEQ ID NO: 6719743 - DNA, 19 bp, Homo sapiens
ccacagtgggtggcacctc

SEQ ID NO: 6719744 - DNA, 23 bp, Homo sapiens
ccacagtgggtggcacctcctga

SEQ ID NO: 6719745 - DNA, 19 bp, Homo sapiens
ccacagtgtcaggcactgg

SEQ ID NO: 6719746 - DNA, 12 bp, Homo sapiens
ccacagtgtctg

SEQ ID NO: 6719747 - DNA, 22 bp, Homo sapiens
ccacagtgttggcgagaggagg

SEQ ID NO: 6719748 - DNA, 12 bp, Homo sapiens
ccacagttaatt

SEQ ID NO: 6719749 - DNA, 18 bp, Homo sapiens
ccacagttatcttagctg

SEQ ID NO: 6719750 - DNA, 15 bp, Homo sapiens
ccacagttcagtggc

SEQ ID NO: 6719751 - DNA, 22 bp, Homo sapiens
ccacagttcagtggcagggctc

SEQ ID NO: 6719752 - DNA, 23 bp, Homo sapiens
ccacagttctgacgctgacaata

SEQ ID NO: 6719753 - DNA, 20 bp, Homo sapiens
ccacagttgccaccacctct

SEQ ID NO: 6719754 - DNA, 23 bp, Homo sapiens
ccacagttgccaccacctctgtg

SEQ ID NO: 6719755 - DNA, 18 bp, Homo sapiens
ccacagttgtcagttgtg

SEQ ID NO: 6719756 - DNA, 15 bp, Homo sapiens
ccacagttgtgttca

SEQ ID NO: 6719757 - DNA, 23 bp, Homo sapiens
ccacagtttgagaccagcctggg

SEQ ID NO: 6719758 - DNA, 12 bp, Homo sapiens
ccacagttttag

SEQ ID NO: 6719759 - DNA, 14 bp, Homo sapiens
ccacagttttagtt

SEQ ID NO: 6719760 - DNA, 21 bp, Homo sapiens
ccacataaccctgtcacccac

SEQ ID NO: 6719761 - DNA, 22 bp, Homo sapiens
ccacataaggggtttgccattt

SEQ ID NO: 6719762 - DNA, 23 bp, Homo sapiens
ccacataatacattccatcacag

SEQ ID NO: 6719763 - DNA, 23 bp, Homo sapiens
ccacataattcattaaaaacatt

SEQ ID NO: 6719764 - DNA, 14 bp, Homo sapiens
ccacataatttttg

SEQ ID NO: 6719765 - DNA, 14 bp, Homo sapiens
ccacatacactgca

SEQ ID NO: 6719766 - DNA, 16 bp, Homo sapiens
ccacatacactgcatt

SEQ ID NO: 6719767 - DNA, 18 bp, Homo sapiens
ccacatactttacagtaa

SEQ ID NO: 6719768 - DNA, 22 bp, Homo sapiens
ccacatagactttatgcaataa

SEQ ID NO: 6719769 - DNA, 21 bp, Homo sapiens
ccacatagcatgcttcctttc

SEQ ID NO: 6719770 - DNA, 22 bp, Homo sapiens
ccacatagtgatggttcccctg

SEQ ID NO: 6719771 - DNA, 21 bp, Homo sapiens
ccacatatcttacagccagag

SEQ ID NO: 6719772 - DNA, 19 bp, Homo sapiens
ccacatattaaaagggggc

SEQ ID NO: 6719773 - DNA, 20 bp, Homo sapiens
ccacatcaacattccaggga

SEQ ID NO: 6719774 - DNA, 14 bp, Homo sapiens
ccacatcatgttac

SEQ ID NO: 6719775 - DNA, 19 bp, Homo sapiens
ccacatccaactccagcaa

SEQ ID NO: 6719776 - DNA, 16 bp, Homo sapiens
ccacatccattccaga

SEQ ID NO: 6719777 - DNA, 18 bp, Homo sapiens
ccacatccattccagagc

SEQ ID NO: 6719778 - DNA, 19 bp, Homo sapiens
ccacatccccaagcccacc

SEQ ID NO: 6719779 - DNA, 22 bp, Homo sapiens
ccacatccccaagcccaccagg

SEQ ID NO: 6719780 - DNA, 15 bp, Homo sapiens
ccacatccccacctg

SEQ ID NO: 6719781 - DNA, 23 bp, Homo sapiens
ccacatccccaccttccaaggaa

SEQ ID NO: 6719782 - DNA, 16 bp, Homo sapiens
ccacatccccagagcc

SEQ ID NO: 6719783 - DNA, 24 bp, Homo sapiens
ccacatccccagagcccagctctt

SEQ ID NO: 6719784 - DNA, 23 bp, Homo sapiens
ccacatccccgctggctgggggc

SEQ ID NO: 6719785 - DNA, 17 bp, Homo sapiens
ccacatccctgggcctg

SEQ ID NO: 6719786 - DNA, 18 bp, Homo sapiens
ccacatccctgggcctgc

SEQ ID NO: 6719787 - DNA, 19 bp, Homo sapiens
ccacatccctgggcctgct

SEQ ID NO: 6719788 - DNA, 20 bp, Homo sapiens
ccacatccctgggcctgctg

SEQ ID NO: 6719789 - DNA, 23 bp, Homo sapiens
ccacatccctgggcctgctgctg

SEQ ID NO: 6719790 - DNA, 13 bp, Homo sapiens
ccacatcctccac

SEQ ID NO: 6719791 - DNA, 16 bp, Homo sapiens
ccacatcgcacactgg

SEQ ID NO: 6719792 - DNA, 17 bp, Homo sapiens
ccacatcgggctcacct

SEQ ID NO: 6719793 - DNA, 19 bp, Homo sapiens
ccacatctgcatcactcat

SEQ ID NO: 6719794 - DNA, 14 bp, Homo sapiens
ccacatctgcctcc

SEQ ID NO: 6719795 - DNA, 13 bp, Homo sapiens
ccacatctgcctt

SEQ ID NO: 6719796 - DNA, 17 bp, Homo sapiens
ccacatctgtcctcacc

SEQ ID NO: 6719797 - DNA, 14 bp, Homo sapiens
ccacatctgtttca

SEQ ID NO: 6719798 - DNA, 15 bp, Homo sapiens
ccacatctgtttcaa

SEQ ID NO: 6719799 - DNA, 14 bp, Homo sapiens
ccacatcttctcag

SEQ ID NO: 6719800 - DNA, 17 bp, Homo sapiens
ccacatcttgaaaatgc

SEQ ID NO: 6719801 - DNA, 19 bp, Homo sapiens
ccacatcttgaaaatgcca

SEQ ID NO: 6719802 - DNA, 20 bp, Homo sapiens
ccacatcttgaaaatgccac

SEQ ID NO: 6719803 - DNA, 20 bp, Homo sapiens
ccacatcttgctctgctgac

SEQ ID NO: 6719804 - DNA, 15 bp, Homo sapiens
ccacatgacctccat

SEQ ID NO: 6719805 - DNA, 13 bp, Homo sapiens
ccacatgagtccc

SEQ ID NO: 6719806 - DNA, 23 bp, Homo sapiens
ccacatgagtcccagtgggaggc

SEQ ID NO: 6719807 - DNA, 24 bp, Homo sapiens
ccacatgattctgatgtactctaa

SEQ ID NO: 6719808 - DNA, 23 bp, Homo sapiens
ccacatgcacatgtattctgttg

SEQ ID NO: 6719809 - DNA, 18 bp, Homo sapiens
ccacatgcatgtctgcct

SEQ ID NO: 6719810 - DNA, 14 bp, Homo sapiens
ccacatgccactgc

SEQ ID NO: 6719811 - DNA, 20 bp, Homo sapiens
ccacatgccactgcctgcac

SEQ ID NO: 6719812 - DNA, 12 bp, Homo sapiens
ccacatgcccca

SEQ ID NO: 6719813 - DNA, 13 bp, Homo sapiens
ccacatgccccag

SEQ ID NO: 6719814 - DNA, 16 bp, Homo sapiens
ccacatgccccaggct

SEQ ID NO: 6719815 - DNA, 15 bp, Homo sapiens
ccacatgcgctcctg

SEQ ID NO: 6719816 - DNA, 18 bp, Homo sapiens
ccacatgctctgcagtcc

SEQ ID NO: 6719817 - DNA, 14 bp, Homo sapiens
ccacatgctgcctg

SEQ ID NO: 6719818 - DNA, 16 bp, Homo sapiens
ccacatggagccccct

SEQ ID NO: 6719819 - DNA, 17 bp, Homo sapiens
ccacatggcacagagat

SEQ ID NO: 6719820 - DNA, 23 bp, Homo sapiens
ccacatggcttagagaggcttga

SEQ ID NO: 6719821 - DNA, 16 bp, Homo sapiens
ccacatgggaggctca

SEQ ID NO: 6719822 - DNA, 18 bp, Homo sapiens
ccacatggggttcctggt

SEQ ID NO: 6719823 - DNA, 23 bp, Homo sapiens
ccacatgggtactgtctcggcag

SEQ ID NO: 6719824 - DNA, 23 bp, Homo sapiens
ccacatggtccatttcatgtgat

SEQ ID NO: 6719825 - DNA, 18 bp, Homo sapiens
ccacatggtgtggccatc

SEQ ID NO: 6719826 - DNA, 19 bp, Homo sapiens
ccacatggtgtggccatca

SEQ ID NO: 6719827 - DNA, 19 bp, Homo sapiens
ccacatgtgacacatatgc

SEQ ID NO: 6719828 - DNA, 20 bp, Homo sapiens
ccacatgtgtccatcccagc

SEQ ID NO: 6719829 - DNA, 16 bp, Homo sapiens
ccacattactttttat

SEQ ID NO: 6719830 - DNA, 21 bp, Homo sapiens
ccacattcagttcttatcaaa

SEQ ID NO: 6719831 - DNA, 22 bp, Homo sapiens
ccacattccaaaagggggcctg

SEQ ID NO: 6719832 - DNA, 16 bp, Homo sapiens
ccacattccaaacaga

SEQ ID NO: 6719833 - DNA, 11 bp, Homo sapiens
ccacattccat

SEQ ID NO: 6719834 - DNA, 16 bp, Homo sapiens
ccacattcctgatgct

SEQ ID NO: 6719835 - DNA, 17 bp, Homo sapiens
ccacattctacttcagc

SEQ ID NO: 6719836 - DNA, 17 bp, Homo sapiens
ccacattctgctgcccc

SEQ ID NO: 6719837 - DNA, 20 bp, Homo sapiens
ccacattctgctgcccccag

SEQ ID NO: 6719838 - DNA, 18 bp, Homo sapiens
ccacattctggctccacc

SEQ ID NO: 6719839 - DNA, 13 bp, Homo sapiens
ccacattctgtcc

SEQ ID NO: 6719840 - DNA, 16 bp, Homo sapiens
ccacattctgtctctg

SEQ ID NO: 6719841 - DNA, 19 bp, Homo sapiens
ccacattctgtctctgctt

SEQ ID NO: 6719842 - DNA, 16 bp, Homo sapiens
ccacattcttcagttt

SEQ ID NO: 6719843 - DNA, 17 bp, Homo sapiens
ccacattcttcagtttt

SEQ ID NO: 6719844 - DNA, 22 bp, Homo sapiens
ccacattcttcagtttttcact

SEQ ID NO: 6719845 - DNA, 23 bp, Homo sapiens
ccacattcttcagtttttcactt

SEQ ID NO: 6719846 - DNA, 16 bp, Homo sapiens
ccacattgaagaatgt

SEQ ID NO: 6719847 - DNA, 16 bp, Homo sapiens
ccacattgacagtggt

SEQ ID NO: 6719848 - DNA, 15 bp, Homo sapiens
ccacattgatttttc

SEQ ID NO: 6719849 - DNA, 14 bp, Homo sapiens
ccacattgctggct

SEQ ID NO: 6719850 - DNA, 15 bp, Homo sapiens
ccacattgctggctg

SEQ ID NO: 6719851 - DNA, 23 bp, Homo sapiens
ccacattgcttcattaaaacaag

SEQ ID NO: 6719852 - DNA, 17 bp, Homo sapiens
ccacattggaagagcag

SEQ ID NO: 6719853 - DNA, 19 bp, Homo sapiens
ccacattggaagagcagca

SEQ ID NO: 6719854 - DNA, 16 bp, Homo sapiens
ccacattggacttcct

SEQ ID NO: 6719855 - DNA, 17 bp, Homo sapiens
ccacattggacttcctt

SEQ ID NO: 6719856 - DNA, 14 bp, Homo sapiens
ccacattgttttaa

SEQ ID NO: 6719857 - DNA, 19 bp, Homo sapiens
ccacatttagtcctgtact

SEQ ID NO: 6719858 - DNA, 19 bp, Homo sapiens
ccacatttagtctctttat

SEQ ID NO: 6719859 - DNA, 20 bp, Homo sapiens
ccacatttagtctctttatt

SEQ ID NO: 6719860 - DNA, 10 bp, Homo sapiens
ccacatttct

SEQ ID NO: 6719861 - DNA, 18 bp, Homo sapiens
ccacatttctaagccttt

SEQ ID NO: 6719862 - DNA, 18 bp, Homo sapiens
ccacatttctgatcagag

SEQ ID NO: 6719863 - DNA, 21 bp, Homo sapiens
ccacatttctgatcagaggtg

SEQ ID NO: 6719864 - DNA, 23 bp, Homo sapiens
ccacatttctggccatttaacta

SEQ ID NO: 6719865 - DNA, 22 bp, Homo sapiens
ccacatttggaatactttttgt

SEQ ID NO: 6719866 - DNA, 17 bp, Homo sapiens
ccacatttgggctcagg

SEQ ID NO: 6719867 - DNA, 15 bp, Homo sapiens
ccacattttaggatc

SEQ ID NO: 6719868 - DNA, 11 bp, Homo sapiens
ccacattttca

SEQ ID NO: 6719869 - DNA, 16 bp, Homo sapiens
ccaccaaaactgctcc

SEQ ID NO: 6719870 - DNA, 24 bp, Homo sapiens
ccaccaaactgcacacacagctcc

SEQ ID NO: 6719871 - DNA, 13 bp, Homo sapiens
ccaccaaagctgc

SEQ ID NO: 6719872 - DNA, 19 bp, Homo sapiens
ccaccaaagctgcccactg

SEQ ID NO: 6719873 - DNA, 14 bp, Homo sapiens
ccaccaaagtcctg

SEQ ID NO: 6719874 - DNA, 19 bp, Homo sapiens
ccaccaaatgcctctgcct

SEQ ID NO: 6719875 - DNA, 19 bp, Homo sapiens
ccaccaacactgctcacag

SEQ ID NO: 6719876 - DNA, 14 bp, Homo sapiens
ccaccaacatactc

SEQ ID NO: 6719877 - DNA, 18 bp, Homo sapiens
ccaccaacatactcccat

SEQ ID NO: 6719878 - DNA, 20 bp, Homo sapiens
ccaccaacatactcccatct

SEQ ID NO: 6719879 - DNA, 15 bp, Homo sapiens
ccaccaacatcccat

SEQ ID NO: 6719880 - DNA, 14 bp, Homo sapiens
ccaccaaccctcag

SEQ ID NO: 6719881 - DNA, 16 bp, Homo sapiens
ccaccaactctctctg

SEQ ID NO: 6719882 - DNA, 15 bp, Homo sapiens
ccaccaactctgcac

SEQ ID NO: 6719883 - DNA, 17 bp, Homo sapiens
ccaccaactctgcactc

SEQ ID NO: 6719884 - DNA, 19 bp, Homo sapiens
ccaccaactctgcactcca

SEQ ID NO: 6719885 - DNA, 15 bp, Homo sapiens
ccaccaactggccct

SEQ ID NO: 6719886 - DNA, 17 bp, Homo sapiens
ccaccaagagggacgcc

SEQ ID NO: 6719887 - DNA, 18 bp, Homo sapiens
ccaccaagccctgcaaat

SEQ ID NO: 6719888 - DNA, 22 bp, Homo sapiens
ccaccaagcctggtcagcccaa

SEQ ID NO: 6719889 - DNA, 12 bp, Homo sapiens
ccaccaagcctt

SEQ ID NO: 6719890 - DNA, 15 bp, Homo sapiens
ccaccaagctcacac

SEQ ID NO: 6719891 - DNA, 22 bp, Homo sapiens
ccaccaagctgctctccttcac

SEQ ID NO: 6719892 - DNA, 15 bp, Homo sapiens
ccaccaagggatctg

SEQ ID NO: 6719893 - DNA, 14 bp, Homo sapiens
ccaccaaggggctc

SEQ ID NO: 6719894 - DNA, 19 bp, Homo sapiens
ccaccaaggggctcttgaa

SEQ ID NO: 6719895 - DNA, 21 bp, Homo sapiens
ccaccaaggtctcacactcct

SEQ ID NO: 6719896 - DNA, 22 bp, Homo sapiens
ccaccaaggtctcacactcctc

SEQ ID NO: 6719897 - DNA, 17 bp, Homo sapiens
ccaccaaggtcttcagc

SEQ ID NO: 6719898 - DNA, 23 bp, Homo sapiens
ccaccaagtctaaaaagacctgg

SEQ ID NO: 6719899 - DNA, 20 bp, Homo sapiens
ccaccaataaatcagaccat

SEQ ID NO: 6719900 - DNA, 15 bp, Homo sapiens
ccaccaatcctcacc

SEQ ID NO: 6719901 - DNA, 14 bp, Homo sapiens
ccaccacaaaaaga

SEQ ID NO: 6719902 - DNA, 17 bp, Homo sapiens
ccaccacacacaccctt

SEQ ID NO: 6719903 - DNA, 13 bp, Homo sapiens
ccaccacacactg

SEQ ID NO: 6719904 - DNA, 18 bp, Homo sapiens
ccaccacacagtcacccc

SEQ ID NO: 6719905 - DNA, 17 bp, Homo sapiens
ccaccacacatcccagc

SEQ ID NO: 6719906 - DNA, 20 bp, Homo sapiens
ccaccacacatcccagccca

SEQ ID NO: 6719907 - DNA, 17 bp, Homo sapiens
ccaccacacccagccca

SEQ ID NO: 6719908 - DNA, 14 bp, Homo sapiens
ccaccacacccctg

SEQ ID NO: 6719909 - DNA, 13 bp, Homo sapiens
ccaccacactgaa

SEQ ID NO: 6719910 - DNA, 14 bp, Homo sapiens
ccaccacagccagc

SEQ ID NO: 6719911 - DNA, 21 bp, Homo sapiens
ccaccacagccagcacctggc

SEQ ID NO: 6719912 - DNA, 11 bp, Homo sapiens
ccaccacccaa

SEQ ID NO: 6719913 - DNA, 13 bp, Homo sapiens
ccaccacccaacc

SEQ ID NO: 6719914 - DNA, 12 bp, Homo sapiens
ccaccaccccac

SEQ ID NO: 6719915 - DNA, 16 bp, Homo sapiens
ccaccaccccacccac

SEQ ID NO: 6719916 - DNA, 20 bp, Homo sapiens
ccaccaccccccactctgtg

SEQ ID NO: 6719917 - DNA, 14 bp, Homo sapiens
ccaccaccctcagg

SEQ ID NO: 6719918 - DNA, 14 bp, Homo sapiens
ccaccaccctccca

SEQ ID NO: 6719919 - DNA, 23 bp, Homo sapiens
ccaccaccctcccaccatgcgct

SEQ ID NO: 6719920 - DNA, 19 bp, Homo sapiens
ccaccaccctgtcttcctc

SEQ ID NO: 6719921 - DNA, 14 bp, Homo sapiens
ccaccaccggggca

SEQ ID NO: 6719922 - DNA, 12 bp, Homo sapiens
ccaccacctccc

SEQ ID NO: 6719923 - DNA, 22 bp, Homo sapiens
ccaccacctgacggctggggac

SEQ ID NO: 6719924 - DNA, 14 bp, Homo sapiens
ccaccacctggatg

SEQ ID NO: 6719925 - DNA, 12 bp, Homo sapiens
ccaccaccttgg

SEQ ID NO: 6719926 - DNA, 19 bp, Homo sapiens
ccaccacgatgtggccctg

SEQ ID NO: 6719927 - DNA, 18 bp, Homo sapiens
ccaccacgcatgctcagt

SEQ ID NO: 6719928 - DNA, 13 bp, Homo sapiens
ccaccacgcctgg

SEQ ID NO: 6719929 - DNA, 17 bp, Homo sapiens
ccaccacggcattatga

SEQ ID NO: 6719930 - DNA, 22 bp, Homo sapiens
ccaccacggcattatgatccct

SEQ ID NO: 6719931 - DNA, 15 bp, Homo sapiens
ccaccacgtctgcca

SEQ ID NO: 6719932 - DNA, 21 bp, Homo sapiens
ccaccacgtctgccaggccca

SEQ ID NO: 6719933 - DNA, 16 bp, Homo sapiens
ccaccactagagctga

SEQ ID NO: 6719934 - DNA, 20 bp, Homo sapiens
ccaccactaggactctgagg

SEQ ID NO: 6719935 - DNA, 11 bp, Homo sapiens
ccaccactcag

SEQ ID NO: 6719936 - DNA, 15 bp, Homo sapiens
ccaccactcaggcca

SEQ ID NO: 6719937 - DNA, 17 bp, Homo sapiens
ccaccactcctgcctgc

SEQ ID NO: 6719938 - DNA, 16 bp, Homo sapiens
ccaccactctcaggac

SEQ ID NO: 6719939 - DNA, 17 bp, Homo sapiens
ccaccactctcaggacc

SEQ ID NO: 6719940 - DNA, 21 bp, Homo sapiens
ccaccactggccaccaggctg

SEQ ID NO: 6719941 - DNA, 17 bp, Homo sapiens
ccaccactgtccctacc

SEQ ID NO: 6719942 - DNA, 16 bp, Homo sapiens
ccaccacttcagggga

SEQ ID NO: 6719943 - DNA, 19 bp, Homo sapiens
ccaccacttccagagccag

SEQ ID NO: 6719944 - DNA, 16 bp, Homo sapiens
ccaccagaagcaggcc

SEQ ID NO: 6719945 - DNA, 21 bp, Homo sapiens
ccaccagacatcaccctttgc

SEQ ID NO: 6719946 - DNA, 16 bp, Homo sapiens
ccaccagacgccttcc

SEQ ID NO: 6719947 - DNA, 17 bp, Homo sapiens
ccaccagagaccgtcct

SEQ ID NO: 6719948 - DNA, 20 bp, Homo sapiens
ccaccagagaccgtcctcac

SEQ ID NO: 6719949 - DNA, 21 bp, Homo sapiens
ccaccagagaccgtcctcacc

SEQ ID NO: 6719950 - DNA, 15 bp, Homo sapiens
ccaccagagcagggg

SEQ ID NO: 6719951 - DNA, 21 bp, Homo sapiens
ccaccagagcaggggctgctg

SEQ ID NO: 6719952 - DNA, 15 bp, Homo sapiens
ccaccagagccggga

SEQ ID NO: 6719953 - DNA, 15 bp, Homo sapiens
ccaccagagctgcct

SEQ ID NO: 6719954 - DNA, 16 bp, Homo sapiens
ccaccagagctgcctc

SEQ ID NO: 6719955 - DNA, 17 bp, Homo sapiens
ccaccagagctgcctcc

SEQ ID NO: 6719956 - DNA, 19 bp, Homo sapiens
ccaccagcaatgccctgcc

SEQ ID NO: 6719957 - DNA, 14 bp, Homo sapiens
ccaccagcacctta

SEQ ID NO: 6719958 - DNA, 15 bp, Homo sapiens
ccaccagcagaacaa

SEQ ID NO: 6719959 - DNA, 11 bp, Homo sapiens
ccaccagcagc

SEQ ID NO: 6719960 - DNA, 12 bp, Homo sapiens
ccaccagcagca

SEQ ID NO: 6719961 - DNA, 23 bp, Homo sapiens
ccaccagcagcacaattctgtcc

SEQ ID NO: 6719962 - DNA, 14 bp, Homo sapiens
ccaccagcaggcag

SEQ ID NO: 6719963 - DNA, 19 bp, Homo sapiens
ccaccagcaggcaggtgga

SEQ ID NO: 6719964 - DNA, 18 bp, Homo sapiens
ccaccagcatcacctgcc

SEQ ID NO: 6719965 - DNA, 15 bp, Homo sapiens
ccaccagccacctct

SEQ ID NO: 6719966 - DNA, 16 bp, Homo sapiens
ccaccagccacctctt

SEQ ID NO: 6719967 - DNA, 11 bp, Homo sapiens
ccaccagccag

SEQ ID NO: 6719968 - DNA, 12 bp, Homo sapiens
ccaccagccagc

SEQ ID NO: 6719969 - DNA, 19 bp, Homo sapiens
ccaccagccagccctggcc

SEQ ID NO: 6719970 - DNA, 21 bp, Homo sapiens
ccaccagccagccctggccca

SEQ ID NO: 6719971 - DNA, 16 bp, Homo sapiens
ccaccagccccagcaa

SEQ ID NO: 6719972 - DNA, 21 bp, Homo sapiens
ccaccagcccgcaactctcca

SEQ ID NO: 6719973 - DNA, 20 bp, Homo sapiens
ccaccagccctactcctgcg

SEQ ID NO: 6719974 - DNA, 23 bp, Homo sapiens
ccaccagccctactcctgcggct

SEQ ID NO: 6719975 - DNA, 17 bp, Homo sapiens
ccaccagccgccccagc

SEQ ID NO: 6719976 - DNA, 12 bp, Homo sapiens
ccaccagcctaa

SEQ ID NO: 6719977 - DNA, 20 bp, Homo sapiens
ccaccagccttgctctcttc

SEQ ID NO: 6719978 - DNA, 19 bp, Homo sapiens
ccaccagcgcccccactcc

SEQ ID NO: 6719979 - DNA, 20 bp, Homo sapiens
ccaccagctggctctgcagc

SEQ ID NO: 6719980 - DNA, 23 bp, Homo sapiens
ccaccagctggctctgcagcaca

SEQ ID NO: 6719981 - DNA, 16 bp, Homo sapiens
ccaccagctgtgtcca

SEQ ID NO: 6719982 - DNA, 21 bp, Homo sapiens
ccaccagcttccctctgcctg

SEQ ID NO: 6719983 - DNA, 14 bp, Homo sapiens
ccaccaggaacctc

SEQ ID NO: 6719984 - DNA, 18 bp, Homo sapiens
ccaccaggaacctcttca

SEQ ID NO: 6719985 - DNA, 14 bp, Homo sapiens
ccaccaggagaacc

SEQ ID NO: 6719986 - DNA, 16 bp, Homo sapiens
ccaccaggagcacctg

SEQ ID NO: 6719987 - DNA, 19 bp, Homo sapiens
ccaccaggagcacctggac

SEQ ID NO: 6719988 - DNA, 17 bp, Homo sapiens
ccaccaggagcagcagc

SEQ ID NO: 6719989 - DNA, 13 bp, Homo sapiens
ccaccaggccagc

SEQ ID NO: 6719990 - DNA, 18 bp, Homo sapiens
ccaccaggccagctcagg

SEQ ID NO: 6719991 - DNA, 15 bp, Homo sapiens
ccaccaggcctcact

SEQ ID NO: 6719992 - DNA, 22 bp, Homo sapiens
ccaccaggctgctcagggctgg

SEQ ID NO: 6719993 - DNA, 12 bp, Homo sapiens
ccaccaggctgg

SEQ ID NO: 6719994 - DNA, 20 bp, Homo sapiens
ccaccaggctggcgcagcca

SEQ ID NO: 6719995 - DNA, 23 bp, Homo sapiens
ccaccaggctggcgcagccaagg

SEQ ID NO: 6719996 - DNA, 16 bp, Homo sapiens
ccaccagggaccagcc

SEQ ID NO: 6719997 - DNA, 20 bp, Homo sapiens
ccaccagggagcttcctggc

SEQ ID NO: 6719998 - DNA, 23 bp, Homo sapiens
ccaccagggagcttcctggctct

SEQ ID NO: 6719999 - DNA, 11 bp, Homo sapiens
ccaccagggat

SEQ ID NO: 6720000 - DNA, 15 bp, Homo sapiens
ccaccagggccagag

SEQ ID NO: 6720001 - DNA, 21 bp, Homo sapiens
ccaccagggccagagcagctc

SEQ ID NO: 6720002 - DNA, 17 bp, Homo sapiens
ccaccagggctccagga

SEQ ID NO: 6720003 - DNA, 17 bp, Homo sapiens
ccaccagggtcccagga

SEQ ID NO: 6720004 - DNA, 18 bp, Homo sapiens
ccaccagggtcccaggaa

SEQ ID NO: 6720005 - DNA, 19 bp, Homo sapiens
ccaccagggtcccaggaag

SEQ ID NO: 6720006 - DNA, 20 bp, Homo sapiens
ccaccagggtcccaggaagc

SEQ ID NO: 6720007 - DNA, 11 bp, Homo sapiens
ccaccagggtg

SEQ ID NO: 6720008 - DNA, 17 bp, Homo sapiens
ccaccagggtggaccag

SEQ ID NO: 6720009 - DNA, 13 bp, Homo sapiens
ccaccaggtctcc

SEQ ID NO: 6720010 - DNA, 19 bp, Homo sapiens
ccaccaggtgcctttcaaa

SEQ ID NO: 6720011 - DNA, 13 bp, Homo sapiens
ccaccaggtgtca

SEQ ID NO: 6720012 - DNA, 22 bp, Homo sapiens
ccaccagtcagggacagcagcc

SEQ ID NO: 6720013 - DNA, 22 bp, Homo sapiens
ccaccagtctagtccgtcctgg

SEQ ID NO: 6720014 - DNA, 12 bp, Homo sapiens
ccaccagtgcct

SEQ ID NO: 6720015 - DNA, 20 bp, Homo sapiens
ccaccagtgcctctccctgc

SEQ ID NO: 6720016 - DNA, 13 bp, Homo sapiens
ccaccagtggacc

SEQ ID NO: 6720017 - DNA, 21 bp, Homo sapiens
ccaccagtgtagcatcttcct

SEQ ID NO: 6720018 - DNA, 22 bp, Homo sapiens
ccaccagtgtagcatcttcctc

SEQ ID NO: 6720019 - DNA, 12 bp, Homo sapiens
ccaccagtgtcc

SEQ ID NO: 6720020 - DNA, 20 bp, Homo sapiens
ccaccagtgtcctccaagtg

SEQ ID NO: 6720021 - DNA, 21 bp, Homo sapiens
ccaccagtgtcctccaagtgc

SEQ ID NO: 6720022 - DNA, 18 bp, Homo sapiens
ccaccagtgtgtggggga

SEQ ID NO: 6720023 - DNA, 14 bp, Homo sapiens
ccaccagttgctgc

SEQ ID NO: 6720024 - DNA, 17 bp, Homo sapiens
ccaccatatgaattgta

SEQ ID NO: 6720025 - DNA, 19 bp, Homo sapiens
ccaccatatgaattgtaca

SEQ ID NO: 6720026 - DNA, 13 bp, Homo sapiens
ccaccatcaagcc

SEQ ID NO: 6720027 - DNA, 21 bp, Homo sapiens
ccaccatcactcactcactcc

SEQ ID NO: 6720028 - DNA, 18 bp, Homo sapiens
ccaccatcatgtctggct

SEQ ID NO: 6720029 - DNA, 19 bp, Homo sapiens
ccaccatcatgtctggcta

SEQ ID NO: 6720030 - DNA, 13 bp, Homo sapiens
ccaccatccccac

SEQ ID NO: 6720031 - DNA, 11 bp, Homo sapiens
ccaccatccct

SEQ ID NO: 6720032 - DNA, 12 bp, Homo sapiens
ccaccatccctg

SEQ ID NO: 6720033 - DNA, 14 bp, Homo sapiens
ccaccatcctgcag

SEQ ID NO: 6720034 - DNA, 22 bp, Homo sapiens
ccaccatccttccatcctgagg

SEQ ID NO: 6720035 - DNA, 15 bp, Homo sapiens
ccaccatctgctgtc

SEQ ID NO: 6720036 - DNA, 19 bp, Homo sapiens
ccaccatgaccccttctct

SEQ ID NO: 6720037 - DNA, 21 bp, Homo sapiens
ccaccatgcacccctgatgtt

SEQ ID NO: 6720038 - DNA, 22 bp, Homo sapiens
ccaccatgcccagctcagaggg

SEQ ID NO: 6720039 - DNA, 17 bp, Homo sapiens
ccaccatgcccagtcga

SEQ ID NO: 6720040 - DNA, 16 bp, Homo sapiens
ccaccatgcctcacta

SEQ ID NO: 6720041 - DNA, 17 bp, Homo sapiens
ccaccatgcttgcctga

SEQ ID NO: 6720042 - DNA, 19 bp, Homo sapiens
ccaccatgcttgcctgaag

SEQ ID NO: 6720043 - DNA, 16 bp, Homo sapiens
ccaccatggccagcta

SEQ ID NO: 6720044 - DNA, 12 bp, Homo sapiens
ccaccattcctg

SEQ ID NO: 6720045 - DNA, 21 bp, Homo sapiens
ccaccattcctggaaaccaca

SEQ ID NO: 6720046 - DNA, 15 bp, Homo sapiens
ccaccattcctttaa

SEQ ID NO: 6720047 - DNA, 15 bp, Homo sapiens
ccaccatttaaaaat

SEQ ID NO: 6720048 - DNA, 15 bp, Homo sapiens
ccaccatttctgggg

SEQ ID NO: 6720049 - DNA, 21 bp, Homo sapiens
ccaccatttggcatccctggg

SEQ ID NO: 6720050 - DNA, 15 bp, Homo sapiens
ccacccaacagcacc

SEQ ID NO: 6720051 - DNA, 21 bp, Homo sapiens
ccacccaaccccaagccagcc

SEQ ID NO: 6720052 - DNA, 15 bp, Homo sapiens
ccacccaacctgtcc

SEQ ID NO: 6720053 - DNA, 17 bp, Homo sapiens
ccacccaactccacagg

SEQ ID NO: 6720054 - DNA, 19 bp, Homo sapiens
ccacccaactccacagggc

SEQ ID NO: 6720055 - DNA, 14 bp, Homo sapiens
ccacccaagagagg

SEQ ID NO: 6720056 - DNA, 19 bp, Homo sapiens
ccacccaagagaggaagga

SEQ ID NO: 6720057 - DNA, 17 bp, Homo sapiens
ccacccaagcaggaggc

SEQ ID NO: 6720058 - DNA, 16 bp, Homo sapiens
ccacccaagccctcct

SEQ ID NO: 6720059 - DNA, 12 bp, Homo sapiens
ccacccaagcct

SEQ ID NO: 6720060 - DNA, 20 bp, Homo sapiens
ccacccaagcctgctggctg

SEQ ID NO: 6720061 - DNA, 13 bp, Homo sapiens
ccacccaaggaga

SEQ ID NO: 6720062 - DNA, 14 bp, Homo sapiens
ccacccaaggagaa

SEQ ID NO: 6720063 - DNA, 16 bp, Homo sapiens
ccacccaaggagaacg

SEQ ID NO: 6720064 - DNA, 22 bp, Homo sapiens
ccacccaagggcctggcctgag

SEQ ID NO: 6720065 - DNA, 22 bp, Homo sapiens
ccacccacaaactccaggctgg

SEQ ID NO: 6720066 - DNA, 22 bp, Homo sapiens
ccacccacaagaactcctccca

SEQ ID NO: 6720067 - DNA, 15 bp, Homo sapiens
ccacccacacagctg

SEQ ID NO: 6720068 - DNA, 17 bp, Homo sapiens
ccacccacacagctgcc

SEQ ID NO: 6720069 - DNA, 19 bp, Homo sapiens
ccacccacacagctgccct

SEQ ID NO: 6720070 - DNA, 13 bp, Homo sapiens
ccacccacagcca

SEQ ID NO: 6720071 - DNA, 23 bp, Homo sapiens
ccacccaccaaatgcctctgcct

SEQ ID NO: 6720072 - DNA, 15 bp, Homo sapiens
ccacccaccaccgct

SEQ ID NO: 6720073 - DNA, 13 bp, Homo sapiens
ccacccaccccac

SEQ ID NO: 6720074 - DNA, 13 bp, Homo sapiens
ccacccaccccca

SEQ ID NO: 6720075 - DNA, 13 bp, Homo sapiens
ccacccaccccct

SEQ ID NO: 6720076 - DNA, 15 bp, Homo sapiens
ccacccacccctcct

SEQ ID NO: 6720077 - DNA, 13 bp, Homo sapiens
ccacccacctcca

SEQ ID NO: 6720078 - DNA, 17 bp, Homo sapiens
ccacccacctccctgcc

SEQ ID NO: 6720079 - DNA, 15 bp, Homo sapiens
ccacccacttccctg

SEQ ID NO: 6720080 - DNA, 17 bp, Homo sapiens
ccacccacttctgcact

SEQ ID NO: 6720081 - DNA, 22 bp, Homo sapiens
ccacccagaatgagacatccag

SEQ ID NO: 6720082 - DNA, 13 bp, Homo sapiens
ccacccagaccct

SEQ ID NO: 6720083 - DNA, 17 bp, Homo sapiens
ccacccagaccctcctt

SEQ ID NO: 6720084 - DNA, 20 bp, Homo sapiens
ccacccagaccctccttccc

SEQ ID NO: 6720085 - DNA, 13 bp, Homo sapiens
ccacccagaggtc

SEQ ID NO: 6720086 - DNA, 16 bp, Homo sapiens
ccacccagaggtctcc

SEQ ID NO: 6720087 - DNA, 19 bp, Homo sapiens
ccacccagaggtggccctc

SEQ ID NO: 6720088 - DNA, 12 bp, Homo sapiens
ccacccagcagg

SEQ ID NO: 6720089 - DNA, 13 bp, Homo sapiens
ccacccagcaggc

SEQ ID NO: 6720090 - DNA, 11 bp, Homo sapiens
ccacccagccc

SEQ ID NO: 6720091 - DNA, 14 bp, Homo sapiens
ccacccagcccact

SEQ ID NO: 6720092 - DNA, 22 bp, Homo sapiens
ccacccagcccattctctctcc

SEQ ID NO: 6720093 - DNA, 12 bp, Homo sapiens
ccacccagcccc

SEQ ID NO: 6720094 - DNA, 12 bp, Homo sapiens
ccacccagccct

SEQ ID NO: 6720095 - DNA, 14 bp, Homo sapiens
ccacccagcccttc

SEQ ID NO: 6720096 - DNA, 21 bp, Homo sapiens
ccacccagcccttccttgggc

SEQ ID NO: 6720097 - DNA, 12 bp, Homo sapiens
ccacccagctcc

SEQ ID NO: 6720098 - DNA, 12 bp, Homo sapiens
ccacccaggagc

SEQ ID NO: 6720099 - DNA, 23 bp, Homo sapiens
ccacccaggagccccgaggcctt

SEQ ID NO: 6720100 - DNA, 15 bp, Homo sapiens
ccacccaggcaggcc

SEQ ID NO: 6720101 - DNA, 13 bp, Homo sapiens
ccacccagggagc

SEQ ID NO: 6720102 - DNA, 23 bp, Homo sapiens
ccacccaggggcagccccaggcc

SEQ ID NO: 6720103 - DNA, 18 bp, Homo sapiens
ccacccaggtcccccgac

SEQ ID NO: 6720104 - DNA, 12 bp, Homo sapiens
ccacccagtcca

SEQ ID NO: 6720105 - DNA, 14 bp, Homo sapiens
ccacccagtccatg

SEQ ID NO: 6720106 - DNA, 14 bp, Homo sapiens
ccacccagtgctgc

SEQ ID NO: 6720107 - DNA, 15 bp, Homo sapiens
ccacccagtgctgcc

SEQ ID NO: 6720108 - DNA, 17 bp, Homo sapiens
ccacccagtgctgccat

SEQ ID NO: 6720109 - DNA, 19 bp, Homo sapiens
ccacccagtgctgccatgc

SEQ ID NO: 6720110 - DNA, 21 bp, Homo sapiens
ccacccagtgctgccatgcca

SEQ ID NO: 6720111 - DNA, 22 bp, Homo sapiens
ccacccagtgctgccatgccac

SEQ ID NO: 6720112 - DNA, 19 bp, Homo sapiens
ccacccatcgtccacccca

SEQ ID NO: 6720113 - DNA, 21 bp, Homo sapiens
ccacccatcttcctgctgctg

SEQ ID NO: 6720114 - DNA, 23 bp, Homo sapiens
ccacccatggggaggagaccttt

SEQ ID NO: 6720115 - DNA, 16 bp, Homo sapiens
ccacccattcccccat

SEQ ID NO: 6720116 - DNA, 12 bp, Homo sapiens
ccaccccaacat

SEQ ID NO: 6720117 - DNA, 22 bp, Homo sapiens
ccaccccaacctgctctcctct

SEQ ID NO: 6720118 - DNA, 13 bp, Homo sapiens
ccaccccaactct

SEQ ID NO: 6720119 - DNA, 18 bp, Homo sapiens
ccaccccaactctcccca

SEQ ID NO: 6720120 - DNA, 21 bp, Homo sapiens
ccaccccacctcacagctact

SEQ ID NO: 6720121 - DNA, 18 bp, Homo sapiens
ccaccccacgcccgcacc

SEQ ID NO: 6720122 - DNA, 15 bp, Homo sapiens
ccaccccactccagc

SEQ ID NO: 6720123 - DNA, 17 bp, Homo sapiens
ccaccccactccagccc

SEQ ID NO: 6720124 - DNA, 13 bp, Homo sapiens
ccaccccactcta

SEQ ID NO: 6720125 - DNA, 13 bp, Homo sapiens
ccaccccactgag

SEQ ID NO: 6720126 - DNA, 19 bp, Homo sapiens
ccaccccagaaatggtgaa

SEQ ID NO: 6720127 - DNA, 16 bp, Homo sapiens
ccaccccagagttggg

SEQ ID NO: 6720128 - DNA, 12 bp, Homo sapiens
ccaccccagcac

SEQ ID NO: 6720129 - DNA, 13 bp, Homo sapiens
ccaccccagcaca

SEQ ID NO: 6720130 - DNA, 18 bp, Homo sapiens
ccaccccagcacagctcc

SEQ ID NO: 6720131 - DNA, 22 bp, Homo sapiens
ccaccccagcacagctcctccc

SEQ ID NO: 6720132 - DNA, 14 bp, Homo sapiens
ccaccccagccccc

SEQ ID NO: 6720133 - DNA, 14 bp, Homo sapiens
ccaccccagcctaa

SEQ ID NO: 6720134 - DNA, 13 bp, Homo sapiens
ccaccccagctgc

SEQ ID NO: 6720135 - DNA, 12 bp, Homo sapiens
ccaccccaggct

SEQ ID NO: 6720136 - DNA, 14 bp, Homo sapiens
ccaccccagggcag

SEQ ID NO: 6720137 - DNA, 12 bp, Homo sapiens
ccaccccagggt

SEQ ID NO: 6720138 - DNA, 14 bp, Homo sapiens
ccaccccagtcccc

SEQ ID NO: 6720139 - DNA, 18 bp, Homo sapiens
ccaccccataagccctga

SEQ ID NO: 6720140 - DNA, 22 bp, Homo sapiens
ccaccccataatctcattcaaa

SEQ ID NO: 6720141 - DNA, 18 bp, Homo sapiens
ccaccccataccagtcac

SEQ ID NO: 6720142 - DNA, 18 bp, Homo sapiens
ccaccccatccagttcat

SEQ ID NO: 6720143 - DNA, 17 bp, Homo sapiens
ccaccccatccctggct

SEQ ID NO: 6720144 - DNA, 18 bp, Homo sapiens
ccaccccatccctggctg

SEQ ID NO: 6720145 - DNA, 15 bp, Homo sapiens
ccaccccattaaaaa

SEQ ID NO: 6720146 - DNA, 20 bp, Homo sapiens
ccacccccaaagacctgcct

SEQ ID NO: 6720147 - DNA, 13 bp, Homo sapiens
ccacccccaaggt

SEQ ID NO: 6720148 - DNA, 12 bp, Homo sapiens
ccacccccacac

SEQ ID NO: 6720149 - DNA, 15 bp, Homo sapiens
ccacccccaccaagg

SEQ ID NO: 6720150 - DNA, 17 bp, Homo sapiens
ccacccccacccaaggg

SEQ ID NO: 6720151 - DNA, 19 bp, Homo sapiens
ccacccccacccaagggcc

SEQ ID NO: 6720152 - DNA, 14 bp, Homo sapiens
ccacccccagagga

SEQ ID NO: 6720153 - DNA, 19 bp, Homo sapiens
ccacccccagaggaagtgg

SEQ ID NO: 6720154 - DNA, 12 bp, Homo sapiens
ccacccccagcc

SEQ ID NO: 6720155 - DNA, 16 bp, Homo sapiens
ccacccccagccaggc

SEQ ID NO: 6720156 - DNA, 16 bp, Homo sapiens
ccacccccagccccga

SEQ ID NO: 6720157 - DNA, 16 bp, Homo sapiens
ccacccccagccctgg

SEQ ID NO: 6720158 - DNA, 13 bp, Homo sapiens
ccacccccagctc

SEQ ID NO: 6720159 - DNA, 14 bp, Homo sapiens
ccacccccagctcc

SEQ ID NO: 6720160 - DNA, 15 bp, Homo sapiens
ccacccccagctgct

SEQ ID NO: 6720161 - DNA, 18 bp, Homo sapiens
ccacccccaggacccctg

SEQ ID NO: 6720162 - DNA, 12 bp, Homo sapiens
ccacccccaggc

SEQ ID NO: 6720163 - DNA, 22 bp, Homo sapiens
ccacccccaggtcttcctgctt

SEQ ID NO: 6720164 - DNA, 23 bp, Homo sapiens
ccacccccaggtttttgcccatc

SEQ ID NO: 6720165 - DNA, 9 bp, Homo sapiens
ccacccccc

SEQ ID NO: 6720166 - DNA, 13 bp, Homo sapiens
ccaccccccacac

SEQ ID NO: 6720167 - DNA, 21 bp, Homo sapiens
ccaccccccacgtctgtcctc

SEQ ID NO: 6720168 - DNA, 19 bp, Homo sapiens
ccaccccccagcacaggag

SEQ ID NO: 6720169 - DNA, 14 bp, Homo sapiens
ccaccccccagcct

SEQ ID NO: 6720170 - DNA, 20 bp, Homo sapiens
ccacccccgaccctgccctg

SEQ ID NO: 6720171 - DNA, 21 bp, Homo sapiens
ccacccccgagcttgcctcag

SEQ ID NO: 6720172 - DNA, 18 bp, Homo sapiens
ccacccccgccacggcca

SEQ ID NO: 6720173 - DNA, 21 bp, Homo sapiens
ccacccccgccacggccaccc

SEQ ID NO: 6720174 - DNA, 14 bp, Homo sapiens
ccacccccgccatg

SEQ ID NO: 6720175 - DNA, 15 bp, Homo sapiens
ccacccccgctgggg

SEQ ID NO: 6720176 - DNA, 13 bp, Homo sapiens
ccacccccgggtg

SEQ ID NO: 6720177 - DNA, 12 bp, Homo sapiens
ccaccccctagg

SEQ ID NO: 6720178 - DNA, 15 bp, Homo sapiens
ccaccccctccagct

SEQ ID NO: 6720179 - DNA, 18 bp, Homo sapiens
ccaccccctccccagggg

SEQ ID NO: 6720180 - DNA, 19 bp, Homo sapiens
ccaccccctccccagggga

SEQ ID NO: 6720181 - DNA, 15 bp, Homo sapiens
ccaccccctcctccc

SEQ ID NO: 6720182 - DNA, 18 bp, Homo sapiens
ccaccccctcctccccca

SEQ ID NO: 6720183 - DNA, 21 bp, Homo sapiens
ccaccccctctggagaaggcc

SEQ ID NO: 6720184 - DNA, 15 bp, Homo sapiens
ccaccccctgccctg

SEQ ID NO: 6720185 - DNA, 18 bp, Homo sapiens
ccaccccctgctggtgcc

SEQ ID NO: 6720186 - DNA, 16 bp, Homo sapiens
ccaccccctgggcaga

SEQ ID NO: 6720187 - DNA, 14 bp, Homo sapiens
ccaccccctgtccc

SEQ ID NO: 6720188 - DNA, 12 bp, Homo sapiens
ccaccccctgtt

SEQ ID NO: 6720189 - DNA, 14 bp, Homo sapiens
ccaccccctgttcc

SEQ ID NO: 6720190 - DNA, 17 bp, Homo sapiens
ccaccccctgttccctg

SEQ ID NO: 6720191 - DNA, 18 bp, Homo sapiens
ccaccccctgttccctgt

SEQ ID NO: 6720192 - DNA, 12 bp, Homo sapiens
ccacccccttca

SEQ ID NO: 6720193 - DNA, 20 bp, Homo sapiens
ccacccccttcagtgcccac

SEQ ID NO: 6720194 - DNA, 16 bp, Homo sapiens
ccacccccttccctgg

SEQ ID NO: 6720195 - DNA, 18 bp, Homo sapiens
ccacccccttctctgctc

SEQ ID NO: 6720196 - DNA, 23 bp, Homo sapiens
ccacccccttctctgctccacca

SEQ ID NO: 6720197 - DNA, 16 bp, Homo sapiens
ccaccccctttggttt

SEQ ID NO: 6720198 - DNA, 19 bp, Homo sapiens
ccaccccgaaatcagcccc

SEQ ID NO: 6720199 - DNA, 23 bp, Homo sapiens
ccaccccgagggctgagcctggt

SEQ ID NO: 6720200 - DNA, 18 bp, Homo sapiens
ccaccccgccgttccctg

SEQ ID NO: 6720201 - DNA, 22 bp, Homo sapiens
ccaccccgccgttccctgcgct

SEQ ID NO: 6720202 - DNA, 15 bp, Homo sapiens
ccaccccgcctctgg

SEQ ID NO: 6720203 - DNA, 22 bp, Homo sapiens
ccaccccgcctctgggctcaca

SEQ ID NO: 6720204 - DNA, 16 bp, Homo sapiens
ccaccccgcctgccct

SEQ ID NO: 6720205 - DNA, 13 bp, Homo sapiens
ccaccccgctgcc

SEQ ID NO: 6720206 - DNA, 17 bp, Homo sapiens
ccaccccgctgcctggc

SEQ ID NO: 6720207 - DNA, 15 bp, Homo sapiens
ccaccccggccccct

SEQ ID NO: 6720208 - DNA, 19 bp, Homo sapiens
ccaccccggctccccctgc

SEQ ID NO: 6720209 - DNA, 18 bp, Homo sapiens
ccaccccgggctctcctg

SEQ ID NO: 6720210 - DNA, 18 bp, Homo sapiens
ccaccccgggctctctgc

SEQ ID NO: 6720211 - DNA, 20 bp, Homo sapiens
ccaccccgggctctctgctg

SEQ ID NO: 6720212 - DNA, 21 bp, Homo sapiens
ccaccccggggaccctgtgac

SEQ ID NO: 6720213 - DNA, 22 bp, Homo sapiens
ccaccccgtcccggccccgcgc

SEQ ID NO: 6720214 - DNA, 14 bp, Homo sapiens
ccaccccgtcctga

SEQ ID NO: 6720215 - DNA, 16 bp, Homo sapiens
ccaccccgtgccaccc

SEQ ID NO: 6720216 - DNA, 17 bp, Homo sapiens
ccaccccgtgccacccg

SEQ ID NO: 6720217 - DNA, 22 bp, Homo sapiens
ccaccccgttgttgtccctgca

SEQ ID NO: 6720218 - DNA, 14 bp, Homo sapiens
ccacccctaagtgc

SEQ ID NO: 6720219 - DNA, 19 bp, Homo sapiens
ccacccctacacacacact

SEQ ID NO: 6720220 - DNA, 20 bp, Homo sapiens
ccacccctagccaccagtgt

SEQ ID NO: 6720221 - DNA, 19 bp, Homo sapiens
ccacccctcaacacctctg

SEQ ID NO: 6720222 - DNA, 13 bp, Homo sapiens
ccacccctcaagc

SEQ ID NO: 6720223 - DNA, 20 bp, Homo sapiens
ccacccctcactccccaggg

SEQ ID NO: 6720224 - DNA, 14 bp, Homo sapiens
ccacccctccacgt

SEQ ID NO: 6720225 - DNA, 11 bp, Homo sapiens
ccacccctccc

SEQ ID NO: 6720226 - DNA, 15 bp, Homo sapiens
ccacccctccccact

SEQ ID NO: 6720227 - DNA, 14 bp, Homo sapiens
ccacccctccccag

SEQ ID NO: 6720228 - DNA, 14 bp, Homo sapiens
ccacccctccctct

SEQ ID NO: 6720229 - DNA, 19 bp, Homo sapiens
ccacccctccctctgctct

SEQ ID NO: 6720230 - DNA, 21 bp, Homo sapiens
ccacccctccctctgctctca

SEQ ID NO: 6720231 - DNA, 15 bp, Homo sapiens
ccacccctccttcct

SEQ ID NO: 6720232 - DNA, 18 bp, Homo sapiens
ccacccctctcgcctcat

SEQ ID NO: 6720233 - DNA, 12 bp, Homo sapiens
ccacccctctgg

SEQ ID NO: 6720234 - DNA, 16 bp, Homo sapiens
ccacccctcttccccc

SEQ ID NO: 6720235 - DNA, 17 bp, Homo sapiens
ccacccctcttccccct

SEQ ID NO: 6720236 - DNA, 21 bp, Homo sapiens
ccacccctgaactggccccag

SEQ ID NO: 6720237 - DNA, 14 bp, Homo sapiens
ccacccctgccact

SEQ ID NO: 6720238 - DNA, 15 bp, Homo sapiens
ccacccctgcctcca

SEQ ID NO: 6720239 - DNA, 14 bp, Homo sapiens
ccacccctgccttt

SEQ ID NO: 6720240 - DNA, 22 bp, Homo sapiens
ccacccctggaagagcccagtc

SEQ ID NO: 6720241 - DNA, 20 bp, Homo sapiens
ccacccctgggggctctcat

SEQ ID NO: 6720242 - DNA, 21 bp, Homo sapiens
ccacccctgtacccagccacc

SEQ ID NO: 6720243 - DNA, 11 bp, Homo sapiens
ccacccctgtg

SEQ ID NO: 6720244 - DNA, 12 bp, Homo sapiens
ccacccctgtgc

SEQ ID NO: 6720245 - DNA, 16 bp, Homo sapiens
ccaccccttaggcccc

SEQ ID NO: 6720246 - DNA, 16 bp, Homo sapiens
ccaccccttcccgccc

SEQ ID NO: 6720247 - DNA, 12 bp, Homo sapiens
ccaccccttcct

SEQ ID NO: 6720248 - DNA, 20 bp, Homo sapiens
ccaccccttcctcagcctgg

SEQ ID NO: 6720249 - DNA, 16 bp, Homo sapiens
ccaccccttcctgtct

SEQ ID NO: 6720250 - DNA, 16 bp, Homo sapiens
ccaccccttgctctct

SEQ ID NO: 6720251 - DNA, 21 bp, Homo sapiens
ccaccccttgctctctgttct

SEQ ID NO: 6720252 - DNA, 20 bp, Homo sapiens
ccaccccttggaggagagag

SEQ ID NO: 6720253 - DNA, 21 bp, Homo sapiens
ccaccccttggaggagagaga

SEQ ID NO: 6720254 - DNA, 23 bp, Homo sapiens
ccacccctttctagaccaataaa

SEQ ID NO: 6720255 - DNA, 15 bp, Homo sapiens
ccacccgaaatgcca

SEQ ID NO: 6720256 - DNA, 14 bp, Homo sapiens
ccacccgacctggc

SEQ ID NO: 6720257 - DNA, 20 bp, Homo sapiens
ccacccgaggggggccccgg

SEQ ID NO: 6720258 - DNA, 18 bp, Homo sapiens
ccacccgagtacctccag

SEQ ID NO: 6720259 - DNA, 13 bp, Homo sapiens
ccacccgatgctg

SEQ ID NO: 6720260 - DNA, 14 bp, Homo sapiens
ccacccgatgctgc

SEQ ID NO: 6720261 - DNA, 16 bp, Homo sapiens
ccacccgatgctgctt

SEQ ID NO: 6720262 - DNA, 17 bp, Homo sapiens
ccacccgccccagagac

SEQ ID NO: 6720263 - DNA, 20 bp, Homo sapiens
ccacccgccccagagactgc

SEQ ID NO: 6720264 - DNA, 21 bp, Homo sapiens
ccacccgccccgcgcacccca

SEQ ID NO: 6720265 - DNA, 15 bp, Homo sapiens
ccacccgccgcctcc

SEQ ID NO: 6720266 - DNA, 21 bp, Homo sapiens
ccacccgccgcctcccacggc

SEQ ID NO: 6720267 - DNA, 16 bp, Homo sapiens
ccacccgctctggccc

SEQ ID NO: 6720268 - DNA, 15 bp, Homo sapiens
ccacccgctgcccct

SEQ ID NO: 6720269 - DNA, 23 bp, Homo sapiens
ccacccgctgcccctccccgtcc

SEQ ID NO: 6720270 - DNA, 18 bp, Homo sapiens
ccacccggatctccaggc

SEQ ID NO: 6720271 - DNA, 21 bp, Homo sapiens
ccacccggatctccaggccca

SEQ ID NO: 6720272 - DNA, 23 bp, Homo sapiens
ccacccggatctccaggcccagc

SEQ ID NO: 6720273 - DNA, 21 bp, Homo sapiens
ccacccggccacagctgctgg

SEQ ID NO: 6720274 - DNA, 13 bp, Homo sapiens
ccacccggctggc

SEQ ID NO: 6720275 - DNA, 12 bp, Homo sapiens
ccacccgggctg

SEQ ID NO: 6720276 - DNA, 15 bp, Homo sapiens
ccacccgggctgcct

SEQ ID NO: 6720277 - DNA, 21 bp, Homo sapiens
ccacccgggctgcctgcccct

SEQ ID NO: 6720278 - DNA, 21 bp, Homo sapiens
ccacccgggggagcccagtga

SEQ ID NO: 6720279 - DNA, 20 bp, Homo sapiens
ccacccggtggggcccttgg

SEQ ID NO: 6720280 - DNA, 20 bp, Homo sapiens
ccacccgtaggcagcctctc

SEQ ID NO: 6720281 - DNA, 20 bp, Homo sapiens
ccacccgtcctccctcagcc

SEQ ID NO: 6720282 - DNA, 15 bp, Homo sapiens
ccacccgtttccaag

SEQ ID NO: 6720283 - DNA, 18 bp, Homo sapiens
ccacccgtttccaagcct

SEQ ID NO: 6720284 - DNA, 15 bp, Homo sapiens
ccaccctaactgagc

SEQ ID NO: 6720285 - DNA, 20 bp, Homo sapiens
ccaccctaactgagctgcca

SEQ ID NO: 6720286 - DNA, 21 bp, Homo sapiens
ccaccctaactgagctgccag

SEQ ID NO: 6720287 - DNA, 23 bp, Homo sapiens
ccaccctaatttgcccttcagga

SEQ ID NO: 6720288 - DNA, 16 bp, Homo sapiens
ccaccctaccagctcc

SEQ ID NO: 6720289 - DNA, 20 bp, Homo sapiens
ccaccctaccagctcctcca

SEQ ID NO: 6720290 - DNA, 14 bp, Homo sapiens
ccaccctaccccct

SEQ ID NO: 6720291 - DNA, 23 bp, Homo sapiens
ccaccctacgctcatctctggaa

SEQ ID NO: 6720292 - DNA, 12 bp, Homo sapiens
ccaccctagcct

SEQ ID NO: 6720293 - DNA, 20 bp, Homo sapiens
ccaccctatggccactggcc

SEQ ID NO: 6720294 - DNA, 11 bp, Homo sapiens
ccaccctcaca

SEQ ID NO: 6720295 - DNA, 23 bp, Homo sapiens
ccaccctcacacacacagctggg

SEQ ID NO: 6720296 - DNA, 14 bp, Homo sapiens
ccaccctcactggc

SEQ ID NO: 6720297 - DNA, 17 bp, Homo sapiens
ccaccctcagcacccct

SEQ ID NO: 6720298 - DNA, 19 bp, Homo sapiens
ccaccctcatttctgccag

SEQ ID NO: 6720299 - DNA, 17 bp, Homo sapiens
ccaccctccaccttcca

SEQ ID NO: 6720300 - DNA, 15 bp, Homo sapiens
ccaccctccatgctc

SEQ ID NO: 6720301 - DNA, 22 bp, Homo sapiens
ccaccctcccagacctgcctct

SEQ ID NO: 6720302 - DNA, 21 bp, Homo sapiens
ccaccctcccctctcttgcac

SEQ ID NO: 6720303 - DNA, 14 bp, Homo sapiens
ccaccctcctgccc

SEQ ID NO: 6720304 - DNA, 23 bp, Homo sapiens
ccaccctcctggcctcagactgc

SEQ ID NO: 6720305 - DNA, 14 bp, Homo sapiens
ccaccctcctgtct

SEQ ID NO: 6720306 - DNA, 20 bp, Homo sapiens
ccaccctcctgtcttcccag

SEQ ID NO: 6720307 - DNA, 16 bp, Homo sapiens
ccaccctcgctgccac

SEQ ID NO: 6720308 - DNA, 17 bp, Homo sapiens
ccaccctcgctgccacc

SEQ ID NO: 6720309 - DNA, 19 bp, Homo sapiens
ccaccctcggggatgtgtc

SEQ ID NO: 6720310 - DNA, 21 bp, Homo sapiens
ccaccctctccacacccagcc

SEQ ID NO: 6720311 - DNA, 23 bp, Homo sapiens
ccaccctctccacacccagcctg

SEQ ID NO: 6720312 - DNA, 20 bp, Homo sapiens
ccaccctctgagctttgcat

SEQ ID NO: 6720313 - DNA, 23 bp, Homo sapiens
ccaccctctgagctttgcatgtt

SEQ ID NO: 6720314 - DNA, 18 bp, Homo sapiens
ccaccctctgcccaggga

SEQ ID NO: 6720315 - DNA, 20 bp, Homo sapiens
ccaccctctgcgaccggagg

SEQ ID NO: 6720316 - DNA, 12 bp, Homo sapiens
ccaccctctggg

SEQ ID NO: 6720317 - DNA, 13 bp, Homo sapiens
ccaccctctgggg

SEQ ID NO: 6720318 - DNA, 22 bp, Homo sapiens
ccaccctgagccggccccaggc

SEQ ID NO: 6720319 - DNA, 22 bp, Homo sapiens
ccaccctgagcctgacctttct

SEQ ID NO: 6720320 - DNA, 20 bp, Homo sapiens
ccaccctgagctcggggaca

SEQ ID NO: 6720321 - DNA, 22 bp, Homo sapiens
ccaccctgagctcggggacagg

SEQ ID NO: 6720322 - DNA, 21 bp, Homo sapiens
ccaccctgaggagtctgaggt

SEQ ID NO: 6720323 - DNA, 12 bp, Homo sapiens
ccaccctgaggg

SEQ ID NO: 6720324 - DNA, 13 bp, Homo sapiens
ccaccctgccaag

SEQ ID NO: 6720325 - DNA, 21 bp, Homo sapiens
ccaccctgccaagactcctca

SEQ ID NO: 6720326 - DNA, 21 bp, Homo sapiens
ccaccctgcccacccccggga

SEQ ID NO: 6720327 - DNA, 21 bp, Homo sapiens
ccaccctgccccccctaagag

SEQ ID NO: 6720328 - DNA, 21 bp, Homo sapiens
ccaccctgccctgctgagcac

SEQ ID NO: 6720329 - DNA, 16 bp, Homo sapiens
ccaccctgccctggcc

SEQ ID NO: 6720330 - DNA, 18 bp, Homo sapiens
ccaccctgcctctaccca

SEQ ID NO: 6720331 - DNA, 13 bp, Homo sapiens
ccaccctgcctgc

SEQ ID NO: 6720332 - DNA, 16 bp, Homo sapiens
ccaccctgcgggccag

SEQ ID NO: 6720333 - DNA, 17 bp, Homo sapiens
ccaccctgcgggccagg

SEQ ID NO: 6720334 - DNA, 19 bp, Homo sapiens
ccaccctgcgggccagggt

SEQ ID NO: 6720335 - DNA, 15 bp, Homo sapiens
ccaccctgctcctcc

SEQ ID NO: 6720336 - DNA, 15 bp, Homo sapiens
ccaccctgctgcctt

SEQ ID NO: 6720337 - DNA, 19 bp, Homo sapiens
ccaccctgctgccttctga

SEQ ID NO: 6720338 - DNA, 16 bp, Homo sapiens
ccaccctgctgctggt

SEQ ID NO: 6720339 - DNA, 18 bp, Homo sapiens
ccaccctgctgctggtgc

SEQ ID NO: 6720340 - DNA, 11 bp, Homo sapiens
ccaccctggaa

SEQ ID NO: 6720341 - DNA, 17 bp, Homo sapiens
ccaccctggaggctctc

SEQ ID NO: 6720342 - DNA, 12 bp, Homo sapiens
ccaccctggccc

SEQ ID NO: 6720343 - DNA, 20 bp, Homo sapiens
ccaccctggccgagtccaag

SEQ ID NO: 6720344 - DNA, 13 bp, Homo sapiens
ccaccctgggacc

SEQ ID NO: 6720345 - DNA, 17 bp, Homo sapiens
ccaccctgggagacaga

SEQ ID NO: 6720346 - DNA, 23 bp, Homo sapiens
ccaccctgggcaatgcagtgcag

SEQ ID NO: 6720347 - DNA, 16 bp, Homo sapiens
ccaccctgggccctgg

SEQ ID NO: 6720348 - DNA, 22 bp, Homo sapiens
ccaccctgggccctgggctgga

SEQ ID NO: 6720349 - DNA, 15 bp, Homo sapiens
ccaccctgggcctcc

SEQ ID NO: 6720350 - DNA, 15 bp, Homo sapiens
ccaccctgggctcca

SEQ ID NO: 6720351 - DNA, 20 bp, Homo sapiens
ccaccctgggtttggcccct

SEQ ID NO: 6720352 - DNA, 15 bp, Homo sapiens
ccaccctgtcccagg

SEQ ID NO: 6720353 - DNA, 18 bp, Homo sapiens
ccaccctgtcccaggcag

SEQ ID NO: 6720354 - DNA, 19 bp, Homo sapiens
ccaccctgtcccaggcagc

SEQ ID NO: 6720355 - DNA, 22 bp, Homo sapiens
ccaccctgtcccaggcagcgcc

SEQ ID NO: 6720356 - DNA, 23 bp, Homo sapiens
ccaccctgtcccaggcagcgcca

SEQ ID NO: 6720357 - DNA, 16 bp, Homo sapiens
ccaccctgtcccccag

SEQ ID NO: 6720358 - DNA, 16 bp, Homo sapiens
ccaccctgtctgcagg

SEQ ID NO: 6720359 - DNA, 15 bp, Homo sapiens
ccaccctgtcttcct

SEQ ID NO: 6720360 - DNA, 20 bp, Homo sapiens
ccaccctgtcttcctctgca

SEQ ID NO: 6720361 - DNA, 21 bp, Homo sapiens
ccaccctgtcttcctctgcaa

SEQ ID NO: 6720362 - DNA, 22 bp, Homo sapiens
ccaccctgtcttcctctgcaag

SEQ ID NO: 6720363 - DNA, 15 bp, Homo sapiens
ccaccctgttcctgc

SEQ ID NO: 6720364 - DNA, 16 bp, Homo sapiens
ccaccctgttcctgct

SEQ ID NO: 6720365 - DNA, 12 bp, Homo sapiens
ccacccttccat

SEQ ID NO: 6720366 - DNA, 13 bp, Homo sapiens
ccacccttccctg

SEQ ID NO: 6720367 - DNA, 14 bp, Homo sapiens
ccacccttccctgc

SEQ ID NO: 6720368 - DNA, 22 bp, Homo sapiens
ccacccttggcctgtccacctg

SEQ ID NO: 6720369 - DNA, 15 bp, Homo sapiens
ccacccttggtctca

SEQ ID NO: 6720370 - DNA, 23 bp, Homo sapiens
ccaccctttacattttgtgcagt

SEQ ID NO: 6720371 - DNA, 14 bp, Homo sapiens
ccaccctttcacaa

SEQ ID NO: 6720372 - DNA, 12 bp, Homo sapiens
ccaccctttctg

SEQ ID NO: 6720373 - DNA, 17 bp, Homo sapiens
ccaccctttggagacca

SEQ ID NO: 6720374 - DNA, 19 bp, Homo sapiens
ccaccctttttttggggtg

SEQ ID NO: 6720375 - DNA, 13 bp, Homo sapiens
ccaccgaagagcc

SEQ ID NO: 6720376 - DNA, 17 bp, Homo sapiens
ccaccgaagagccctga

SEQ ID NO: 6720377 - DNA, 20 bp, Homo sapiens
ccaccgaagagccctgagct

SEQ ID NO: 6720378 - DNA, 22 bp, Homo sapiens
ccaccgaagtggactggcccct

SEQ ID NO: 6720379 - DNA, 15 bp, Homo sapiens
ccaccgaccaactgc

SEQ ID NO: 6720380 - DNA, 17 bp, Homo sapiens
ccaccgacccttcctgg

SEQ ID NO: 6720381 - DNA, 15 bp, Homo sapiens
ccaccgagctctgtg

SEQ ID NO: 6720382 - DNA, 17 bp, Homo sapiens
ccaccgagctctgtggg

SEQ ID NO: 6720383 - DNA, 16 bp, Homo sapiens
ccaccgaggagcccca

SEQ ID NO: 6720384 - DNA, 17 bp, Homo sapiens
ccaccgattgcaggaca

SEQ ID NO: 6720385 - DNA, 21 bp, Homo sapiens
ccaccgcaccgggccctcctt

SEQ ID NO: 6720386 - DNA, 15 bp, Homo sapiens
ccaccgcagaaggaa

SEQ ID NO: 6720387 - DNA, 19 bp, Homo sapiens
ccaccgcagacaggaccag

SEQ ID NO: 6720388 - DNA, 15 bp, Homo sapiens
ccaccgcagcgtccc

SEQ ID NO: 6720389 - DNA, 18 bp, Homo sapiens
ccaccgcagctgctgcca

SEQ ID NO: 6720390 - DNA, 20 bp, Homo sapiens
ccaccgcaggggactgtctc

SEQ ID NO: 6720391 - DNA, 21 bp, Homo sapiens
ccaccgcatatgcatgccagg

SEQ ID NO: 6720392 - DNA, 22 bp, Homo sapiens
ccaccgcatatgcatgccaggc

SEQ ID NO: 6720393 - DNA, 13 bp, Homo sapiens
ccaccgcatgccc

SEQ ID NO: 6720394 - DNA, 17 bp, Homo sapiens
ccaccgccaccgtgtgc

SEQ ID NO: 6720395 - DNA, 13 bp, Homo sapiens
ccaccgcccagag

SEQ ID NO: 6720396 - DNA, 12 bp, Homo sapiens
ccaccgccccca

SEQ ID NO: 6720397 - DNA, 19 bp, Homo sapiens
ccaccgccctcctcgctgt

SEQ ID NO: 6720398 - DNA, 17 bp, Homo sapiens
ccaccgcctcctacagc

SEQ ID NO: 6720399 - DNA, 13 bp, Homo sapiens
ccaccgcctctgg

SEQ ID NO: 6720400 - DNA, 16 bp, Homo sapiens
ccaccgccttgcccag

SEQ ID NO: 6720401 - DNA, 17 bp, Homo sapiens
ccaccgccttgcccagc

SEQ ID NO: 6720402 - DNA, 17 bp, Homo sapiens
ccaccgcgcccctctgc

SEQ ID NO: 6720403 - DNA, 16 bp, Homo sapiens
ccaccgcgcctacctt

SEQ ID NO: 6720404 - DNA, 15 bp, Homo sapiens
ccaccgcggaggagg

SEQ ID NO: 6720405 - DNA, 14 bp, Homo sapiens
ccaccgcgggtgtg

SEQ ID NO: 6720406 - DNA, 15 bp, Homo sapiens
ccaccgctccccagc

SEQ ID NO: 6720407 - DNA, 15 bp, Homo sapiens
ccaccgctgccagca

SEQ ID NO: 6720408 - DNA, 16 bp, Homo sapiens
ccaccgctgccagcac

SEQ ID NO: 6720409 - DNA, 15 bp, Homo sapiens
ccaccgctgcctaag

SEQ ID NO: 6720410 - DNA, 21 bp, Homo sapiens
ccaccgctgcctaagtggctg

SEQ ID NO: 6720411 - DNA, 19 bp, Homo sapiens
ccaccgctgctccacgcgc

SEQ ID NO: 6720412 - DNA, 16 bp, Homo sapiens
ccaccggaactgggct

SEQ ID NO: 6720413 - DNA, 17 bp, Homo sapiens
ccaccggaactgggctg

SEQ ID NO: 6720414 - DNA, 16 bp, Homo sapiens
ccaccggatgctgtgc

SEQ ID NO: 6720415 - DNA, 23 bp, Homo sapiens
ccaccggcactcatgacggcctg

SEQ ID NO: 6720416 - DNA, 13 bp, Homo sapiens
ccaccggccaggc

SEQ ID NO: 6720417 - DNA, 14 bp, Homo sapiens
ccaccggcctgtgg

SEQ ID NO: 6720418 - DNA, 16 bp, Homo sapiens
ccaccgggagcctccc

SEQ ID NO: 6720419 - DNA, 20 bp, Homo sapiens
ccaccgggagcctccccctc

SEQ ID NO: 6720420 - DNA, 22 bp, Homo sapiens
ccaccgggagcctccccctcag

SEQ ID NO: 6720421 - DNA, 15 bp, Homo sapiens
ccaccgggccactcc

SEQ ID NO: 6720422 - DNA, 19 bp, Homo sapiens
ccaccgggccactccttcc

SEQ ID NO: 6720423 - DNA, 21 bp, Homo sapiens
ccaccgggccactccttcctg

SEQ ID NO: 6720424 - DNA, 22 bp, Homo sapiens
ccaccgggctgggagctctgca

SEQ ID NO: 6720425 - DNA, 23 bp, Homo sapiens
ccaccgggctgggagctctgcag

SEQ ID NO: 6720426 - DNA, 17 bp, Homo sapiens
ccaccgggggtggctct

SEQ ID NO: 6720427 - DNA, 22 bp, Homo sapiens
ccaccgggttctgcagcggcag

SEQ ID NO: 6720428 - DNA, 15 bp, Homo sapiens
ccaccggtccagctg

SEQ ID NO: 6720429 - DNA, 15 bp, Homo sapiens
ccaccggtgccaaac

SEQ ID NO: 6720430 - DNA, 22 bp, Homo sapiens
ccaccggtgccaaacccagccc

SEQ ID NO: 6720431 - DNA, 18 bp, Homo sapiens
ccaccgtacaaccccctc

SEQ ID NO: 6720432 - DNA, 13 bp, Homo sapiens
ccaccgtcccctc

SEQ ID NO: 6720433 - DNA, 14 bp, Homo sapiens
ccaccgtccgccct

SEQ ID NO: 6720434 - DNA, 16 bp, Homo sapiens
ccaccgtccgccctgc

SEQ ID NO: 6720435 - DNA, 18 bp, Homo sapiens
ccaccgtccgccctgctc

SEQ ID NO: 6720436 - DNA, 19 bp, Homo sapiens
ccaccgtccgccctgctcc

SEQ ID NO: 6720437 - DNA, 16 bp, Homo sapiens
ccaccgtctcggccct

SEQ ID NO: 6720438 - DNA, 17 bp, Homo sapiens
ccaccgtctcggccctg

SEQ ID NO: 6720439 - DNA, 23 bp, Homo sapiens
ccaccgtctcggccctgaaccac

SEQ ID NO: 6720440 - DNA, 22 bp, Homo sapiens
ccaccgtgcccaacctcacttg

SEQ ID NO: 6720441 - DNA, 16 bp, Homo sapiens
ccaccgtgcctggcta

SEQ ID NO: 6720442 - DNA, 16 bp, Homo sapiens
ccaccgtggaggagga

SEQ ID NO: 6720443 - DNA, 15 bp, Homo sapiens
ccaccgtgggagagg

SEQ ID NO: 6720444 - DNA, 17 bp, Homo sapiens
ccaccgtgtgcctttcc

SEQ ID NO: 6720445 - DNA, 20 bp, Homo sapiens
ccaccgttaggattcaggca

SEQ ID NO: 6720446 - DNA, 15 bp, Homo sapiens
ccaccgttcagtcat

SEQ ID NO: 6720447 - DNA, 15 bp, Homo sapiens
ccaccgttgtctcat

SEQ ID NO: 6720448 - DNA, 14 bp, Homo sapiens
ccaccgtttcttcc

SEQ ID NO: 6720449 - DNA, 23 bp, Homo sapiens
ccacctaagggctaaggcctctt

SEQ ID NO: 6720450 - DNA, 16 bp, Homo sapiens
ccacctacaaggagat

SEQ ID NO: 6720451 - DNA, 16 bp, Homo sapiens
ccacctacacaggagt

SEQ ID NO: 6720452 - DNA, 17 bp, Homo sapiens
ccacctacacaggagtc

SEQ ID NO: 6720453 - DNA, 21 bp, Homo sapiens
ccacctacacccctgtgctcc

SEQ ID NO: 6720454 - DNA, 14 bp, Homo sapiens
ccacctacccagct

SEQ ID NO: 6720455 - DNA, 15 bp, Homo sapiens
ccacctacccagctg

SEQ ID NO: 6720456 - DNA, 17 bp, Homo sapiens
ccacctactcctgggtc

SEQ ID NO: 6720457 - DNA, 17 bp, Homo sapiens
ccacctacttgtgactg

SEQ ID NO: 6720458 - DNA, 23 bp, Homo sapiens
ccacctacttttctttcctcaga

SEQ ID NO: 6720459 - DNA, 18 bp, Homo sapiens
ccacctagaacactaact

SEQ ID NO: 6720460 - DNA, 20 bp, Homo sapiens
ccacctagaagtctccctgc

SEQ ID NO: 6720461 - DNA, 11 bp, Homo sapiens
ccacctagact

SEQ ID NO: 6720462 - DNA, 14 bp, Homo sapiens
ccacctagcccagg

SEQ ID NO: 6720463 - DNA, 19 bp, Homo sapiens
ccacctagcccaggagaga

SEQ ID NO: 6720464 - DNA, 14 bp, Homo sapiens
ccacctagtctgta

SEQ ID NO: 6720465 - DNA, 15 bp, Homo sapiens
ccacctagtgcccca

SEQ ID NO: 6720466 - DNA, 15 bp, Homo sapiens
ccacctagtggctgt

SEQ ID NO: 6720467 - DNA, 15 bp, Homo sapiens
ccacctatgccagtg

SEQ ID NO: 6720468 - DNA, 15 bp, Homo sapiens
ccacctatgcctgtg

SEQ ID NO: 6720469 - DNA, 16 bp, Homo sapiens
ccacctatgcctgtgg

SEQ ID NO: 6720470 - DNA, 19 bp, Homo sapiens
ccacctatgcctgtggtga

SEQ ID NO: 6720471 - DNA, 16 bp, Homo sapiens
ccacctcacaactcct

SEQ ID NO: 6720472 - DNA, 14 bp, Homo sapiens
ccacctcaccccac

SEQ ID NO: 6720473 - DNA, 18 bp, Homo sapiens
ccacctcacccggcctct

SEQ ID NO: 6720474 - DNA, 23 bp, Homo sapiens
ccacctcacctgtcgcacccact

SEQ ID NO: 6720475 - DNA, 16 bp, Homo sapiens
ccacctcactcctgtt

SEQ ID NO: 6720476 - DNA, 11 bp, Homo sapiens
ccacctcagcc

SEQ ID NO: 6720477 - DNA, 12 bp, Homo sapiens
ccacctcagcct

SEQ ID NO: 6720478 - DNA, 14 bp, Homo sapiens
ccacctcagcctcc

SEQ ID NO: 6720479 - DNA, 16 bp, Homo sapiens
ccacctcagcctccca

SEQ ID NO: 6720480 - DNA, 14 bp, Homo sapiens
ccacctcaggtgac

SEQ ID NO: 6720481 - DNA, 14 bp, Homo sapiens
ccacctcagtccct

SEQ ID NO: 6720482 - DNA, 19 bp, Homo sapiens
ccacctcagtccctctttg

SEQ ID NO: 6720483 - DNA, 19 bp, Homo sapiens
ccacctcagtctcacctgc

SEQ ID NO: 6720484 - DNA, 22 bp, Homo sapiens
ccacctcatcactggactgcat

SEQ ID NO: 6720485 - DNA, 17 bp, Homo sapiens
ccacctcatgcctggcc

SEQ ID NO: 6720486 - DNA, 13 bp, Homo sapiens
ccacctccaccca

SEQ ID NO: 6720487 - DNA, 22 bp, Homo sapiens
ccacctccacccagcccctggc

SEQ ID NO: 6720488 - DNA, 14 bp, Homo sapiens
ccacctccaccccc

SEQ ID NO: 6720489 - DNA, 12 bp, Homo sapiens
ccacctccacct

SEQ ID NO: 6720490 - DNA, 15 bp, Homo sapiens
ccacctccacctgtg

SEQ ID NO: 6720491 - DNA, 17 bp, Homo sapiens
ccacctccacctgtgag

SEQ ID NO: 6720492 - DNA, 18 bp, Homo sapiens
ccacctccacctgtgaga

SEQ ID NO: 6720493 - DNA, 15 bp, Homo sapiens
ccacctccactccca

SEQ ID NO: 6720494 - DNA, 16 bp, Homo sapiens
ccacctccagcccaca

SEQ ID NO: 6720495 - DNA, 20 bp, Homo sapiens
ccacctccagcccgggagcc

SEQ ID NO: 6720496 - DNA, 22 bp, Homo sapiens
ccacctccagcccgggagccta

SEQ ID NO: 6720497 - DNA, 15 bp, Homo sapiens
ccacctccagcctct

SEQ ID NO: 6720498 - DNA, 21 bp, Homo sapiens
ccacctccaggctttcccact

SEQ ID NO: 6720499 - DNA, 14 bp, Homo sapiens
ccacctccagtccc

SEQ ID NO: 6720500 - DNA, 20 bp, Homo sapiens
ccacctccatcttctttgca

SEQ ID NO: 6720501 - DNA, 12 bp, Homo sapiens
ccacctcccacc

SEQ ID NO: 6720502 - DNA, 16 bp, Homo sapiens
ccacctcccaccaaca

SEQ ID NO: 6720503 - DNA, 17 bp, Homo sapiens
ccacctcccaccccact

SEQ ID NO: 6720504 - DNA, 18 bp, Homo sapiens
ccacctcccaccccactc

SEQ ID NO: 6720505 - DNA, 23 bp, Homo sapiens
ccacctcccaccccactccagcc

SEQ ID NO: 6720506 - DNA, 13 bp, Homo sapiens
ccacctcccactc

SEQ ID NO: 6720507 - DNA, 18 bp, Homo sapiens
ccacctcccactcctgct

SEQ ID NO: 6720508 - DNA, 14 bp, Homo sapiens
ccacctccccacac

SEQ ID NO: 6720509 - DNA, 17 bp, Homo sapiens
ccacctccccacgccct

SEQ ID NO: 6720510 - DNA, 18 bp, Homo sapiens
ccacctccccactccagc

SEQ ID NO: 6720511 - DNA, 17 bp, Homo sapiens
ccacctcccccttcccc

SEQ ID NO: 6720512 - DNA, 19 bp, Homo sapiens
ccacctcccctatccaccc

SEQ ID NO: 6720513 - DNA, 14 bp, Homo sapiens
ccacctccccttgc

SEQ ID NO: 6720514 - DNA, 17 bp, Homo sapiens
ccacctccccttgccag

SEQ ID NO: 6720515 - DNA, 23 bp, Homo sapiens
ccacctccctaccaaaaattgcc

SEQ ID NO: 6720516 - DNA, 16 bp, Homo sapiens
ccacctccctcccacc

SEQ ID NO: 6720517 - DNA, 16 bp, Homo sapiens
ccacctccctctgcca

SEQ ID NO: 6720518 - DNA, 21 bp, Homo sapiens
ccacctccctgcaataaaatg

SEQ ID NO: 6720519 - DNA, 15 bp, Homo sapiens
ccacctccctgcagc

SEQ ID NO: 6720520 - DNA, 17 bp, Homo sapiens
ccacctccctgcccagg

SEQ ID NO: 6720521 - DNA, 22 bp, Homo sapiens
ccacctccctgccctgtcctcc

SEQ ID NO: 6720522 - DNA, 17 bp, Homo sapiens
ccacctccctgcgccct

SEQ ID NO: 6720523 - DNA, 15 bp, Homo sapiens
ccacctcccttccca

SEQ ID NO: 6720524 - DNA, 16 bp, Homo sapiens
ccacctccgccagacc

SEQ ID NO: 6720525 - DNA, 15 bp, Homo sapiens
ccacctccgccccag

SEQ ID NO: 6720526 - DNA, 20 bp, Homo sapiens
ccacctcctaaaaggcccag

SEQ ID NO: 6720527 - DNA, 23 bp, Homo sapiens
ccacctcctaaaaggcccagaga

SEQ ID NO: 6720528 - DNA, 15 bp, Homo sapiens
ccacctcctacccct

SEQ ID NO: 6720529 - DNA, 19 bp, Homo sapiens
ccacctcctccccctgttc

SEQ ID NO: 6720530 - DNA, 17 bp, Homo sapiens
ccacctcctctcttgga

SEQ ID NO: 6720531 - DNA, 19 bp, Homo sapiens
ccacctcctgacacccttc

SEQ ID NO: 6720532 - DNA, 21 bp, Homo sapiens
ccacctcctgcggctcagcct

SEQ ID NO: 6720533 - DNA, 16 bp, Homo sapiens
ccacctccttccagca

SEQ ID NO: 6720534 - DNA, 18 bp, Homo sapiens
ccacctccttctctgtct

SEQ ID NO: 6720535 - DNA, 20 bp, Homo sapiens
ccacctcgcaggttcaagca

SEQ ID NO: 6720536 - DNA, 23 bp, Homo sapiens
ccacctcgcggcgcagcccctgg

SEQ ID NO: 6720537 - DNA, 16 bp, Homo sapiens
ccacctcgctcccctc

SEQ ID NO: 6720538 - DNA, 17 bp, Homo sapiens
ccacctcgctcccctct

SEQ ID NO: 6720539 - DNA, 19 bp, Homo sapiens
ccacctcgctcccctctgg

SEQ ID NO: 6720540 - DNA, 20 bp, Homo sapiens
ccacctcgctcccctctgga

SEQ ID NO: 6720541 - DNA, 21 bp, Homo sapiens
ccacctcgctcccctctggaa

SEQ ID NO: 6720542 - DNA, 23 bp, Homo sapiens
ccacctcgctcccctctggaatc

SEQ ID NO: 6720543 - DNA, 14 bp, Homo sapiens
ccacctcggatccc

SEQ ID NO: 6720544 - DNA, 20 bp, Homo sapiens
ccacctcggatcccactgat

SEQ ID NO: 6720545 - DNA, 21 bp, Homo sapiens
ccacctcggatcccactgatt

SEQ ID NO: 6720546 - DNA, 17 bp, Homo sapiens
ccacctcggcacacact

SEQ ID NO: 6720547 - DNA, 13 bp, Homo sapiens
ccacctcggccct

SEQ ID NO: 6720548 - DNA, 20 bp, Homo sapiens
ccacctcggcctcccagagt

SEQ ID NO: 6720549 - DNA, 22 bp, Homo sapiens
ccacctcgtcccgttctccatt

SEQ ID NO: 6720550 - DNA, 21 bp, Homo sapiens
ccacctctaacagcaccaaat

SEQ ID NO: 6720551 - DNA, 13 bp, Homo sapiens
ccacctctcaata

SEQ ID NO: 6720552 - DNA, 16 bp, Homo sapiens
ccacctctccaagggc

SEQ ID NO: 6720553 - DNA, 12 bp, Homo sapiens
ccacctctccct

SEQ ID NO: 6720554 - DNA, 13 bp, Homo sapiens
ccacctctccctc

SEQ ID NO: 6720555 - DNA, 15 bp, Homo sapiens
ccacctctccctgca

SEQ ID NO: 6720556 - DNA, 18 bp, Homo sapiens
ccacctctccctgcatcc

SEQ ID NO: 6720557 - DNA, 21 bp, Homo sapiens
ccacctctccctgcatcctga

SEQ ID NO: 6720558 - DNA, 15 bp, Homo sapiens
ccacctctctcccca

SEQ ID NO: 6720559 - DNA, 14 bp, Homo sapiens
ccacctctctcctt

SEQ ID NO: 6720560 - DNA, 15 bp, Homo sapiens
ccacctctctgcctg

SEQ ID NO: 6720561 - DNA, 17 bp, Homo sapiens
ccacctctctggcttcc

SEQ ID NO: 6720562 - DNA, 13 bp, Homo sapiens
ccacctctctttt

SEQ ID NO: 6720563 - DNA, 21 bp, Homo sapiens
ccacctctcttttcctctctg

SEQ ID NO: 6720564 - DNA, 22 bp, Homo sapiens
ccacctctcttttcctctctgt

SEQ ID NO: 6720565 - DNA, 10 bp, Homo sapiens
ccacctctgc

SEQ ID NO: 6720566 - DNA, 15 bp, Homo sapiens
ccacctctgcctcta

SEQ ID NO: 6720567 - DNA, 20 bp, Homo sapiens
ccacctctgcctctagtccc

SEQ ID NO: 6720568 - DNA, 13 bp, Homo sapiens
ccacctctgcgga

SEQ ID NO: 6720569 - DNA, 19 bp, Homo sapiens
ccacctctgcggaccccag

SEQ ID NO: 6720570 - DNA, 22 bp, Homo sapiens
ccacctctgcggaccccagctg

SEQ ID NO: 6720571 - DNA, 13 bp, Homo sapiens
ccacctctgctgc

SEQ ID NO: 6720572 - DNA, 23 bp, Homo sapiens
ccacctctggccaaatatgcact

SEQ ID NO: 6720573 - DNA, 12 bp, Homo sapiens
ccacctctggtc

SEQ ID NO: 6720574 - DNA, 17 bp, Homo sapiens
ccacctctgtgacctca

SEQ ID NO: 6720575 - DNA, 18 bp, Homo sapiens
ccacctctgtgacctcag

SEQ ID NO: 6720576 - DNA, 20 bp, Homo sapiens
ccacctcttctcttcctgta

SEQ ID NO: 6720577 - DNA, 21 bp, Homo sapiens
ccacctctttctacagcctaa

SEQ ID NO: 6720578 - DNA, 17 bp, Homo sapiens
ccacctgacacaccagg

SEQ ID NO: 6720579 - DNA, 20 bp, Homo sapiens
ccacctgacattccttgctg

SEQ ID NO: 6720580 - DNA, 13 bp, Homo sapiens
ccacctgacctct

SEQ ID NO: 6720581 - DNA, 14 bp, Homo sapiens
ccacctgacctctg

SEQ ID NO: 6720582 - DNA, 16 bp, Homo sapiens
ccacctgacctctgca

SEQ ID NO: 6720583 - DNA, 18 bp, Homo sapiens
ccacctgacggctgggga

SEQ ID NO: 6720584 - DNA, 17 bp, Homo sapiens
ccacctgagaccctggg

SEQ ID NO: 6720585 - DNA, 12 bp, Homo sapiens
ccacctgagctt

SEQ ID NO: 6720586 - DNA, 22 bp, Homo sapiens
ccacctgagctttggacgcaca

SEQ ID NO: 6720587 - DNA, 18 bp, Homo sapiens
ccacctgaggcaggaggg

SEQ ID NO: 6720588 - DNA, 17 bp, Homo sapiens
ccacctgaggctcagcc

SEQ ID NO: 6720589 - DNA, 16 bp, Homo sapiens
ccacctgaggtgggcc

SEQ ID NO: 6720590 - DNA, 17 bp, Homo sapiens
ccacctgcaagatggac

SEQ ID NO: 6720591 - DNA, 21 bp, Homo sapiens
ccacctgcaagtgcccgccct

SEQ ID NO: 6720592 - DNA, 23 bp, Homo sapiens
ccacctgcaagtgcccgccctgc

SEQ ID NO: 6720593 - DNA, 11 bp, Homo sapiens
ccacctgcaca

SEQ ID NO: 6720594 - DNA, 14 bp, Homo sapiens
ccacctgcacaaac

SEQ ID NO: 6720595 - DNA, 18 bp, Homo sapiens
ccacctgcacaaacatag

SEQ ID NO: 6720596 - DNA, 13 bp, Homo sapiens
ccacctgcagccc

SEQ ID NO: 6720597 - DNA, 20 bp, Homo sapiens
ccacctgcagccccaggcct

SEQ ID NO: 6720598 - DNA, 16 bp, Homo sapiens
ccacctgcagcccttt

SEQ ID NO: 6720599 - DNA, 12 bp, Homo sapiens
ccacctgcagct

SEQ ID NO: 6720600 - DNA, 15 bp, Homo sapiens
ccacctgcagctccc

SEQ ID NO: 6720601 - DNA, 12 bp, Homo sapiens
ccacctgcagga

SEQ ID NO: 6720602 - DNA, 18 bp, Homo sapiens
ccacctgcaggaccctgt

SEQ ID NO: 6720603 - DNA, 15 bp, Homo sapiens
ccacctgcagggctg

SEQ ID NO: 6720604 - DNA, 13 bp, Homo sapiens
ccacctgcagtta

SEQ ID NO: 6720605 - DNA, 13 bp, Homo sapiens
ccacctgcatcag

SEQ ID NO: 6720606 - DNA, 14 bp, Homo sapiens
ccacctgcatcagc

SEQ ID NO: 6720607 - DNA, 21 bp, Homo sapiens
ccacctgcatcagcctctggc

SEQ ID NO: 6720608 - DNA, 17 bp, Homo sapiens
ccacctgcatctggggc

SEQ ID NO: 6720609 - DNA, 18 bp, Homo sapiens
ccacctgccaaaagctgg

SEQ ID NO: 6720610 - DNA, 21 bp, Homo sapiens
ccacctgccacccccttccct

SEQ ID NO: 6720611 - DNA, 20 bp, Homo sapiens
ccacctgccactaggctggg

SEQ ID NO: 6720612 - DNA, 23 bp, Homo sapiens
ccacctgccactaggctgggtgc

SEQ ID NO: 6720613 - DNA, 14 bp, Homo sapiens
ccacctgccagcca

SEQ ID NO: 6720614 - DNA, 23 bp, Homo sapiens
ccacctgccagcggtttcctggt

SEQ ID NO: 6720615 - DNA, 12 bp, Homo sapiens
ccacctgccagg

SEQ ID NO: 6720616 - DNA, 21 bp, Homo sapiens
ccacctgccaggctgcaggga

SEQ ID NO: 6720617 - DNA, 16 bp, Homo sapiens
ccacctgcccatcaca

SEQ ID NO: 6720618 - DNA, 23 bp, Homo sapiens
ccacctgcccatcacagggttgg

SEQ ID NO: 6720619 - DNA, 12 bp, Homo sapiens
ccacctgccccc

SEQ ID NO: 6720620 - DNA, 21 bp, Homo sapiens
ccacctgcccggcccaggagc

SEQ ID NO: 6720621 - DNA, 18 bp, Homo sapiens
ccacctgcccttttttct

SEQ ID NO: 6720622 - DNA, 15 bp, Homo sapiens
ccacctgcctatcca

SEQ ID NO: 6720623 - DNA, 16 bp, Homo sapiens
ccacctgcctatccat

SEQ ID NO: 6720624 - DNA, 18 bp, Homo sapiens
ccacctgcctcggcctcc

SEQ ID NO: 6720625 - DNA, 23 bp, Homo sapiens
ccacctgcctcggcctcccaaag

SEQ ID NO: 6720626 - DNA, 12 bp, Homo sapiens
ccacctgcctct

SEQ ID NO: 6720627 - DNA, 11 bp, Homo sapiens
ccacctgcctg

SEQ ID NO: 6720628 - DNA, 12 bp, Homo sapiens
ccacctgcctga

SEQ ID NO: 6720629 - DNA, 15 bp, Homo sapiens
ccacctgcctgacca

SEQ ID NO: 6720630 - DNA, 13 bp, Homo sapiens
ccacctgcctgcg

SEQ ID NO: 6720631 - DNA, 20 bp, Homo sapiens
ccacctgcctgcgtcttccg

SEQ ID NO: 6720632 - DNA, 21 bp, Homo sapiens
ccacctgcctgcgtcttccgc

SEQ ID NO: 6720633 - DNA, 14 bp, Homo sapiens
ccacctgcctggcc

SEQ ID NO: 6720634 - DNA, 17 bp, Homo sapiens
ccacctgcctggccggc

SEQ ID NO: 6720635 - DNA, 20 bp, Homo sapiens
ccacctgcctgttgggccag

SEQ ID NO: 6720636 - DNA, 15 bp, Homo sapiens
ccacctgccttggcc

SEQ ID NO: 6720637 - DNA, 20 bp, Homo sapiens
ccacctgccttggcctccca

SEQ ID NO: 6720638 - DNA, 21 bp, Homo sapiens
ccacctgcgcttctgctggag

SEQ ID NO: 6720639 - DNA, 17 bp, Homo sapiens
ccacctgcggctcccct

SEQ ID NO: 6720640 - DNA, 22 bp, Homo sapiens
ccacctgcggtgctatctcccc

SEQ ID NO: 6720641 - DNA, 19 bp, Homo sapiens
ccacctgctagtgtgaatt

SEQ ID NO: 6720642 - DNA, 22 bp, Homo sapiens
ccacctgctagtgtgaattaaa

SEQ ID NO: 6720643 - DNA, 11 bp, Homo sapiens
ccacctgctcc

SEQ ID NO: 6720644 - DNA, 14 bp, Homo sapiens
ccacctgctcccag

SEQ ID NO: 6720645 - DNA, 16 bp, Homo sapiens
ccacctgctcccaggc

SEQ ID NO: 6720646 - DNA, 14 bp, Homo sapiens
ccacctgctctgct

SEQ ID NO: 6720647 - DNA, 23 bp, Homo sapiens
ccacctgctgagagacccaagga

SEQ ID NO: 6720648 - DNA, 22 bp, Homo sapiens
ccacctgctgcccgtgaggagg

SEQ ID NO: 6720649 - DNA, 21 bp, Homo sapiens
ccacctgctgcgggggagcca

SEQ ID NO: 6720650 - DNA, 13 bp, Homo sapiens
ccacctgctgctg

SEQ ID NO: 6720651 - DNA, 17 bp, Homo sapiens
ccacctgctgctgtatg

SEQ ID NO: 6720652 - DNA, 15 bp, Homo sapiens
ccacctgcttcacag

SEQ ID NO: 6720653 - DNA, 13 bp, Homo sapiens
ccacctgcttctg

SEQ ID NO: 6720654 - DNA, 18 bp, Homo sapiens
ccacctgctttctcctgg

SEQ ID NO: 6720655 - DNA, 17 bp, Homo sapiens
ccacctggaaagccagg

SEQ ID NO: 6720656 - DNA, 20 bp, Homo sapiens
ccacctggacacacactcac

SEQ ID NO: 6720657 - DNA, 23 bp, Homo sapiens
ccacctggacacacactcaccag

SEQ ID NO: 6720658 - DNA, 17 bp, Homo sapiens
ccacctggacccctgca

SEQ ID NO: 6720659 - DNA, 12 bp, Homo sapiens
ccacctggagag

SEQ ID NO: 6720660 - DNA, 16 bp, Homo sapiens
ccacctggagcccgct

SEQ ID NO: 6720661 - DNA, 12 bp, Homo sapiens
ccacctggagtg

SEQ ID NO: 6720662 - DNA, 22 bp, Homo sapiens
ccacctggcaaaggacccttga

SEQ ID NO: 6720663 - DNA, 12 bp, Homo sapiens
ccacctggccac

SEQ ID NO: 6720664 - DNA, 13 bp, Homo sapiens
ccacctggccacc

SEQ ID NO: 6720665 - DNA, 21 bp, Homo sapiens
ccacctggccccttctccagc

SEQ ID NO: 6720666 - DNA, 18 bp, Homo sapiens
ccacctggccctctctga

SEQ ID NO: 6720667 - DNA, 13 bp, Homo sapiens
ccacctggcctct

SEQ ID NO: 6720668 - DNA, 22 bp, Homo sapiens
ccacctggcggagctctcctcc

SEQ ID NO: 6720669 - DNA, 17 bp, Homo sapiens
ccacctgggaacacagt

SEQ ID NO: 6720670 - DNA, 15 bp, Homo sapiens
ccacctgggagatgc

SEQ ID NO: 6720671 - DNA, 13 bp, Homo sapiens
ccacctgggccct

SEQ ID NO: 6720672 - DNA, 18 bp, Homo sapiens
ccacctgggccctaggca

SEQ ID NO: 6720673 - DNA, 20 bp, Homo sapiens
ccacctggggcagtcacctg

SEQ ID NO: 6720674 - DNA, 22 bp, Homo sapiens
ccacctggggtctctctcccta

SEQ ID NO: 6720675 - DNA, 18 bp, Homo sapiens
ccacctggtggccctgcg

SEQ ID NO: 6720676 - DNA, 13 bp, Homo sapiens
ccacctgtagctg

SEQ ID NO: 6720677 - DNA, 17 bp, Homo sapiens
ccacctgtcaacctgaa

SEQ ID NO: 6720678 - DNA, 18 bp, Homo sapiens
ccacctgtcccacctcaa

SEQ ID NO: 6720679 - DNA, 17 bp, Homo sapiens
ccacctgtccggcccag

SEQ ID NO: 6720680 - DNA, 21 bp, Homo sapiens
ccacctgtccggcccagtgcc

SEQ ID NO: 6720681 - DNA, 18 bp, Homo sapiens
ccacctgtctcagcctcc

SEQ ID NO: 6720682 - DNA, 20 bp, Homo sapiens
ccacctgtctcagcctccca

SEQ ID NO: 6720683 - DNA, 15 bp, Homo sapiens
ccacctgtgccctca

SEQ ID NO: 6720684 - DNA, 21 bp, Homo sapiens
ccacctgtgccctcaccacca

SEQ ID NO: 6720685 - DNA, 16 bp, Homo sapiens
ccacctgtgcgagacc

SEQ ID NO: 6720686 - DNA, 16 bp, Homo sapiens
ccacctgtgctgctgc

SEQ ID NO: 6720687 - DNA, 20 bp, Homo sapiens
ccacctgtgcttggaaccag

SEQ ID NO: 6720688 - DNA, 18 bp, Homo sapiens
ccacctgtggggcctggg

SEQ ID NO: 6720689 - DNA, 22 bp, Homo sapiens
ccacctgtgtgttcttttgata

SEQ ID NO: 6720690 - DNA, 23 bp, Homo sapiens
ccacctgttactacttctttttg

SEQ ID NO: 6720691 - DNA, 18 bp, Homo sapiens
ccacctgttcaggagctg

SEQ ID NO: 6720692 - DNA, 16 bp, Homo sapiens
ccacctgttgtcctga

SEQ ID NO: 6720693 - DNA, 21 bp, Homo sapiens
ccacctgtttctggaagactg

SEQ ID NO: 6720694 - DNA, 14 bp, Homo sapiens
ccaccttaaattaa

SEQ ID NO: 6720695 - DNA, 15 bp, Homo sapiens
ccaccttaaattaaa

SEQ ID NO: 6720696 - DNA, 18 bp, Homo sapiens
ccaccttaaattaaacaa

SEQ ID NO: 6720697 - DNA, 22 bp, Homo sapiens
ccaccttaccctactggctgta

SEQ ID NO: 6720698 - DNA, 22 bp, Homo sapiens
ccaccttatacatcacttcctg

SEQ ID NO: 6720699 - DNA, 17 bp, Homo sapiens
ccaccttccagtgagct

SEQ ID NO: 6720700 - DNA, 11 bp, Homo sapiens
ccaccttccca

SEQ ID NO: 6720701 - DNA, 16 bp, Homo sapiens
ccaccttcccagctct

SEQ ID NO: 6720702 - DNA, 14 bp, Homo sapiens
ccaccttcccatgc

SEQ ID NO: 6720703 - DNA, 20 bp, Homo sapiens
ccaccttccctccacctgct

SEQ ID NO: 6720704 - DNA, 15 bp, Homo sapiens
ccaccttcccttcct

SEQ ID NO: 6720705 - DNA, 16 bp, Homo sapiens
ccaccttcctgactgg

SEQ ID NO: 6720706 - DNA, 19 bp, Homo sapiens
ccaccttcctgactgggaa

SEQ ID NO: 6720707 - DNA, 14 bp, Homo sapiens
ccaccttccttgcg

SEQ ID NO: 6720708 - DNA, 18 bp, Homo sapiens
ccaccttctgtccccagc

SEQ ID NO: 6720709 - DNA, 22 bp, Homo sapiens
ccaccttctgtccccagccctg

SEQ ID NO: 6720710 - DNA, 17 bp, Homo sapiens
ccaccttcttgggactg

SEQ ID NO: 6720711 - DNA, 19 bp, Homo sapiens
ccaccttcttgggactgct

SEQ ID NO: 6720712 - DNA, 17 bp, Homo sapiens
ccaccttgaacctgtca

SEQ ID NO: 6720713 - DNA, 20 bp, Homo sapiens
ccaccttgacgtttcttctt

SEQ ID NO: 6720714 - DNA, 13 bp, Homo sapiens
ccaccttgccagg

SEQ ID NO: 6720715 - DNA, 14 bp, Homo sapiens
ccaccttgccaggg

SEQ ID NO: 6720716 - DNA, 18 bp, Homo sapiens
ccaccttggcctcccaaa

SEQ ID NO: 6720717 - DNA, 13 bp, Homo sapiens
ccaccttggctca

SEQ ID NO: 6720718 - DNA, 14 bp, Homo sapiens
ccaccttggctcaa

SEQ ID NO: 6720719 - DNA, 22 bp, Homo sapiens
ccaccttggctctgccagtgga

SEQ ID NO: 6720720 - DNA, 16 bp, Homo sapiens
ccaccttggctgcagg

SEQ ID NO: 6720721 - DNA, 18 bp, Homo sapiens
ccaccttggtccctctca

SEQ ID NO: 6720722 - DNA, 19 bp, Homo sapiens
ccaccttgttggagcctgc

SEQ ID NO: 6720723 - DNA, 16 bp, Homo sapiens
ccacctttcctgttca

SEQ ID NO: 6720724 - DNA, 20 bp, Homo sapiens
ccacctttgggatcagcctc

SEQ ID NO: 6720725 - DNA, 22 bp, Homo sapiens
ccacctttgggatcagcctccg

SEQ ID NO: 6720726 - DNA, 13 bp, Homo sapiens
ccacctttgtgca

SEQ ID NO: 6720727 - DNA, 16 bp, Homo sapiens
ccacctttgtgcagct

SEQ ID NO: 6720728 - DNA, 20 bp, Homo sapiens
ccacctttgtttctccccca

SEQ ID NO: 6720729 - DNA, 18 bp, Homo sapiens
ccaccttttaagttaatg

SEQ ID NO: 6720730 - DNA, 21 bp, Homo sapiens
ccaccttttaagttaatgaaa

SEQ ID NO: 6720731 - DNA, 19 bp, Homo sapiens
ccaccttttgtttttccag

SEQ ID NO: 6720732 - DNA, 14 bp, Homo sapiens
ccacgaaggagccc

SEQ ID NO: 6720733 - DNA, 19 bp, Homo sapiens
ccacgaatttgctggggaa

SEQ ID NO: 6720734 - DNA, 17 bp, Homo sapiens
ccacgacactgcagccc

SEQ ID NO: 6720735 - DNA, 13 bp, Homo sapiens
ccacgaccagccc

SEQ ID NO: 6720736 - DNA, 21 bp, Homo sapiens
ccacgacccctgcctcgaggg

SEQ ID NO: 6720737 - DNA, 23 bp, Homo sapiens
ccacgacccctgcctcgagggcc

SEQ ID NO: 6720738 - DNA, 15 bp, Homo sapiens
ccacgacctgtcctg

SEQ ID NO: 6720739 - DNA, 13 bp, Homo sapiens
ccacgactgccat

SEQ ID NO: 6720740 - DNA, 16 bp, Homo sapiens
ccacgactgtctccat

SEQ ID NO: 6720741 - DNA, 16 bp, Homo sapiens
ccacgagagcgcagca

SEQ ID NO: 6720742 - DNA, 15 bp, Homo sapiens
ccacgaggaccatcg

SEQ ID NO: 6720743 - DNA, 22 bp, Homo sapiens
ccacgaggctgattcctctcat

SEQ ID NO: 6720744 - DNA, 23 bp, Homo sapiens
ccacgaggctgcccccatccagc

SEQ ID NO: 6720745 - DNA, 15 bp, Homo sapiens
ccacgagggctggct

SEQ ID NO: 6720746 - DNA, 17 bp, Homo sapiens
ccacgagggctggctgg

SEQ ID NO: 6720747 - DNA, 19 bp, Homo sapiens
ccacgagggctggctggcc

SEQ ID NO: 6720748 - DNA, 23 bp, Homo sapiens
ccacgaggggacccatgggggct

SEQ ID NO: 6720749 - DNA, 23 bp, Homo sapiens
ccacgagggtctcccctcctgca

SEQ ID NO: 6720750 - DNA, 21 bp, Homo sapiens
ccacgagtcacctgcaagccc

SEQ ID NO: 6720751 - DNA, 15 bp, Homo sapiens
ccacgatcctgccac

SEQ ID NO: 6720752 - DNA, 20 bp, Homo sapiens
ccacgatgacgcctctggac

SEQ ID NO: 6720753 - DNA, 16 bp, Homo sapiens
ccacgatgcctttgag

SEQ ID NO: 6720754 - DNA, 20 bp, Homo sapiens
ccacgatgtcaaggactcct

SEQ ID NO: 6720755 - DNA, 22 bp, Homo sapiens
ccacgattacgtgaataaaatg

SEQ ID NO: 6720756 - DNA, 17 bp, Homo sapiens
ccacgatttagatttaa

SEQ ID NO: 6720757 - DNA, 13 bp, Homo sapiens
ccacgattttaaa

SEQ ID NO: 6720758 - DNA, 17 bp, Homo sapiens
ccacgattttctccagc

SEQ ID NO: 6720759 - DNA, 21 bp, Homo sapiens
ccacgattttctccagctcag

SEQ ID NO: 6720760 - DNA, 22 bp, Homo sapiens
ccacgattttctccagctcaga

SEQ ID NO: 6720761 - DNA, 14 bp, Homo sapiens
ccacgcaaggctgt

SEQ ID NO: 6720762 - DNA, 18 bp, Homo sapiens
ccacgcacctccacgcca

SEQ ID NO: 6720763 - DNA, 13 bp, Homo sapiens
ccacgcactccat

SEQ ID NO: 6720764 - DNA, 15 bp, Homo sapiens
ccacgcactgggcca

SEQ ID NO: 6720765 - DNA, 20 bp, Homo sapiens
ccacgcactgggccacggag

SEQ ID NO: 6720766 - DNA, 15 bp, Homo sapiens
ccacgcacttcctct

SEQ ID NO: 6720767 - DNA, 16 bp, Homo sapiens
ccacgcacttcctctc

SEQ ID NO: 6720768 - DNA, 17 bp, Homo sapiens
ccacgcagacctgcagc

SEQ ID NO: 6720769 - DNA, 23 bp, Homo sapiens
ccacgcagagaagccccgggctt

SEQ ID NO: 6720770 - DNA, 19 bp, Homo sapiens
ccacgcagagccccggagc

SEQ ID NO: 6720771 - DNA, 20 bp, Homo sapiens
ccacgcagagccccggagca

SEQ ID NO: 6720772 - DNA, 13 bp, Homo sapiens
ccacgcagccagg

SEQ ID NO: 6720773 - DNA, 14 bp, Homo sapiens
ccacgcagccagga

SEQ ID NO: 6720774 - DNA, 16 bp, Homo sapiens
ccacgcagccaggaca

SEQ ID NO: 6720775 - DNA, 22 bp, Homo sapiens
ccacgcagggccatccactgtg

SEQ ID NO: 6720776 - DNA, 21 bp, Homo sapiens
ccacgcaggggccctgagcca

SEQ ID NO: 6720777 - DNA, 13 bp, Homo sapiens
ccacgcagtgcct

SEQ ID NO: 6720778 - DNA, 13 bp, Homo sapiens
ccacgccagctgg

SEQ ID NO: 6720779 - DNA, 16 bp, Homo sapiens
ccacgccagctggccc

SEQ ID NO: 6720780 - DNA, 17 bp, Homo sapiens
ccacgccagctggccca

SEQ ID NO: 6720781 - DNA, 18 bp, Homo sapiens
ccacgccagctggcccag

SEQ ID NO: 6720782 - DNA, 19 bp, Homo sapiens
ccacgcccaccagccttgc

SEQ ID NO: 6720783 - DNA, 20 bp, Homo sapiens
ccacgcccaccagccttgct

SEQ ID NO: 6720784 - DNA, 17 bp, Homo sapiens
ccacgcccacccccagt

SEQ ID NO: 6720785 - DNA, 14 bp, Homo sapiens
ccacgccccagccc

SEQ ID NO: 6720786 - DNA, 15 bp, Homo sapiens
ccacgccccagcccg

SEQ ID NO: 6720787 - DNA, 16 bp, Homo sapiens
ccacgccccaggacct

SEQ ID NO: 6720788 - DNA, 13 bp, Homo sapiens
ccacgcccccact

SEQ ID NO: 6720789 - DNA, 19 bp, Homo sapiens
ccacgcccccactggtgac

SEQ ID NO: 6720790 - DNA, 16 bp, Homo sapiens
ccacgcccctgcctga

SEQ ID NO: 6720791 - DNA, 17 bp, Homo sapiens
ccacgcccgggagtggg

SEQ ID NO: 6720792 - DNA, 19 bp, Homo sapiens
ccacgcccgtcctgcctgt

SEQ ID NO: 6720793 - DNA, 22 bp, Homo sapiens
ccacgcccgtcctgcctgtggc

SEQ ID NO: 6720794 - DNA, 17 bp, Homo sapiens
ccacgccctcccctccc

SEQ ID NO: 6720795 - DNA, 22 bp, Homo sapiens
ccacgccctcccctcccctgct

SEQ ID NO: 6720796 - DNA, 20 bp, Homo sapiens
ccacgccctccctgctagca

SEQ ID NO: 6720797 - DNA, 14 bp, Homo sapiens
ccacgccctcctcc

SEQ ID NO: 6720798 - DNA, 17 bp, Homo sapiens
ccacgccctctcctccc

SEQ ID NO: 6720799 - DNA, 12 bp, Homo sapiens
ccacgccctgtt

SEQ ID NO: 6720800 - DNA, 21 bp, Homo sapiens
ccacgcccttggagccttcca

SEQ ID NO: 6720801 - DNA, 19 bp, Homo sapiens
ccacgccgatataagccat

SEQ ID NO: 6720802 - DNA, 15 bp, Homo sapiens
ccacgcctagcctca

SEQ ID NO: 6720803 - DNA, 23 bp, Homo sapiens
ccacgcctatgccctgcccttcc

SEQ ID NO: 6720804 - DNA, 19 bp, Homo sapiens
ccacgcctcaccagccccc

SEQ ID NO: 6720805 - DNA, 17 bp, Homo sapiens
ccacgcctcctggccag

SEQ ID NO: 6720806 - DNA, 18 bp, Homo sapiens
ccacgcctcctggccaga

SEQ ID NO: 6720807 - DNA, 16 bp, Homo sapiens
ccacgcctctctcagc

SEQ ID NO: 6720808 - DNA, 13 bp, Homo sapiens
ccacgcctggaag

SEQ ID NO: 6720809 - DNA, 14 bp, Homo sapiens
ccacgccttgacct

SEQ ID NO: 6720810 - DNA, 13 bp, Homo sapiens
ccacgcgctctgc

SEQ ID NO: 6720811 - DNA, 18 bp, Homo sapiens
ccacgcgctctgcatgct

SEQ ID NO: 6720812 - DNA, 18 bp, Homo sapiens
ccacgcggccacctcacc

SEQ ID NO: 6720813 - DNA, 15 bp, Homo sapiens
ccacgctcaccccct

SEQ ID NO: 6720814 - DNA, 16 bp, Homo sapiens
ccacgctcaggcccgg

SEQ ID NO: 6720815 - DNA, 12 bp, Homo sapiens
ccacgctccagc

SEQ ID NO: 6720816 - DNA, 16 bp, Homo sapiens
ccacgctccagctgcc

SEQ ID NO: 6720817 - DNA, 13 bp, Homo sapiens
ccacgctgactac

SEQ ID NO: 6720818 - DNA, 19 bp, Homo sapiens
ccacgctgactacagggcc

SEQ ID NO: 6720819 - DNA, 18 bp, Homo sapiens
ccacgctggaccttgaac

SEQ ID NO: 6720820 - DNA, 13 bp, Homo sapiens
ccacgctggcctt

SEQ ID NO: 6720821 - DNA, 17 bp, Homo sapiens
ccacgctgggacacaga

SEQ ID NO: 6720822 - DNA, 14 bp, Homo sapiens
ccacgctgggccta

SEQ ID NO: 6720823 - DNA, 23 bp, Homo sapiens
ccacgctgggtattaccatgtaa

SEQ ID NO: 6720824 - DNA, 20 bp, Homo sapiens
ccacgctgtctccagacccc

SEQ ID NO: 6720825 - DNA, 21 bp, Homo sapiens
ccacgctgtctccagaccccc

SEQ ID NO: 6720826 - DNA, 17 bp, Homo sapiens
ccacgctgtggccctgg

SEQ ID NO: 6720827 - DNA, 17 bp, Homo sapiens
ccacgcttctccggatc

SEQ ID NO: 6720828 - DNA, 13 bp, Homo sapiens
ccacgcttctctt

SEQ ID NO: 6720829 - DNA, 23 bp, Homo sapiens
ccacgcttctggaggtggggagg

SEQ ID NO: 6720830 - DNA, 18 bp, Homo sapiens
ccacgctttgctgctacc

SEQ ID NO: 6720831 - DNA, 22 bp, Homo sapiens
ccacgctttttgactgctcacc

SEQ ID NO: 6720832 - DNA, 17 bp, Homo sapiens
ccacggaaggcgggctg

SEQ ID NO: 6720833 - DNA, 15 bp, Homo sapiens
ccacggacccccaga

SEQ ID NO: 6720834 - DNA, 19 bp, Homo sapiens
ccacggacgtttccatcag

SEQ ID NO: 6720835 - DNA, 19 bp, Homo sapiens
ccacggagcgggaggcagc

SEQ ID NO: 6720836 - DNA, 19 bp, Homo sapiens
ccacggaggagggatgctg

SEQ ID NO: 6720837 - DNA, 23 bp, Homo sapiens
ccacggaggagggatgctgctcc

SEQ ID NO: 6720838 - DNA, 21 bp, Homo sapiens
ccacggaggatccactcccag

SEQ ID NO: 6720839 - DNA, 13 bp, Homo sapiens
ccacggagggagg

SEQ ID NO: 6720840 - DNA, 23 bp, Homo sapiens
ccacggatgcgtgggcagaggaa

SEQ ID NO: 6720841 - DNA, 16 bp, Homo sapiens
ccacggcaacccctgc

SEQ ID NO: 6720842 - DNA, 13 bp, Homo sapiens
ccacggcagccac

SEQ ID NO: 6720843 - DNA, 16 bp, Homo sapiens
ccacggcagccaccct

SEQ ID NO: 6720844 - DNA, 23 bp, Homo sapiens
ccacggcatcgcatccgtcctgg

SEQ ID NO: 6720845 - DNA, 23 bp, Homo sapiens
ccacggcattatgatcccttccc

SEQ ID NO: 6720846 - DNA, 14 bp, Homo sapiens
ccacggccacagtc

SEQ ID NO: 6720847 - DNA, 12 bp, Homo sapiens
ccacggccaccc

SEQ ID NO: 6720848 - DNA, 21 bp, Homo sapiens
ccacggccaccctccttcccg

SEQ ID NO: 6720849 - DNA, 15 bp, Homo sapiens
ccacggccaggccag

SEQ ID NO: 6720850 - DNA, 16 bp, Homo sapiens
ccacggccaggccaga

SEQ ID NO: 6720851 - DNA, 14 bp, Homo sapiens
ccacggcccaggga

SEQ ID NO: 6720852 - DNA, 15 bp, Homo sapiens
ccacggcccagggag

SEQ ID NO: 6720853 - DNA, 17 bp, Homo sapiens
ccacggccccgggtcca

SEQ ID NO: 6720854 - DNA, 22 bp, Homo sapiens
ccacggccctgtcagagccgcc

SEQ ID NO: 6720855 - DNA, 23 bp, Homo sapiens
ccacggccctgtcagagccgcca

SEQ ID NO: 6720856 - DNA, 16 bp, Homo sapiens
ccacggccgtccctga

SEQ ID NO: 6720857 - DNA, 14 bp, Homo sapiens
ccacggcctgccca

SEQ ID NO: 6720858 - DNA, 12 bp, Homo sapiens
ccacggcctggc

SEQ ID NO: 6720859 - DNA, 13 bp, Homo sapiens
ccacggcctggga

SEQ ID NO: 6720860 - DNA, 18 bp, Homo sapiens
ccacggctaagaggctgc

SEQ ID NO: 6720861 - DNA, 22 bp, Homo sapiens
ccacggctctcgtccctctgct

SEQ ID NO: 6720862 - DNA, 16 bp, Homo sapiens
ccacggctctgtgccc

SEQ ID NO: 6720863 - DNA, 19 bp, Homo sapiens
ccacggctgagccttcaga

SEQ ID NO: 6720864 - DNA, 19 bp, Homo sapiens
ccacggctggatacctgtg

SEQ ID NO: 6720865 - DNA, 22 bp, Homo sapiens
ccacgggacatcacagggtggg

SEQ ID NO: 6720866 - DNA, 14 bp, Homo sapiens
ccacgggaccttct

SEQ ID NO: 6720867 - DNA, 23 bp, Homo sapiens
ccacgggcacaagacccctgctc

SEQ ID NO: 6720868 - DNA, 23 bp, Homo sapiens
ccacgggcaggggtcagagcact

SEQ ID NO: 6720869 - DNA, 15 bp, Homo sapiens
ccacgggccggccag

SEQ ID NO: 6720870 - DNA, 17 bp, Homo sapiens
ccacgggccggccagct

SEQ ID NO: 6720871 - DNA, 18 bp, Homo sapiens
ccacgggccggccagctg

SEQ ID NO: 6720872 - DNA, 15 bp, Homo sapiens
ccacgggcctcagtt

SEQ ID NO: 6720873 - DNA, 14 bp, Homo sapiens
ccacggggaccact

SEQ ID NO: 6720874 - DNA, 13 bp, Homo sapiens
ccacggggagggg

SEQ ID NO: 6720875 - DNA, 17 bp, Homo sapiens
ccacggggatcacagcg

SEQ ID NO: 6720876 - DNA, 14 bp, Homo sapiens
ccacggggcaaagc

SEQ ID NO: 6720877 - DNA, 22 bp, Homo sapiens
ccacggggcaaagctgctgggc

SEQ ID NO: 6720878 - DNA, 22 bp, Homo sapiens
ccacgggggaggccgaggcagg

SEQ ID NO: 6720879 - DNA, 17 bp, Homo sapiens
ccacgggtctgccatgc

SEQ ID NO: 6720880 - DNA, 21 bp, Homo sapiens
ccacggtcacacctcactgtc

SEQ ID NO: 6720881 - DNA, 18 bp, Homo sapiens
ccacggtccaatccagcc

SEQ ID NO: 6720882 - DNA, 14 bp, Homo sapiens
ccacggtcctttga

SEQ ID NO: 6720883 - DNA, 13 bp, Homo sapiens
ccacggtctgagc

SEQ ID NO: 6720884 - DNA, 17 bp, Homo sapiens
ccacggtctgagctagc

SEQ ID NO: 6720885 - DNA, 18 bp, Homo sapiens
ccacggtctgagctagct

SEQ ID NO: 6720886 - DNA, 16 bp, Homo sapiens
ccacggtctggaggcc

SEQ ID NO: 6720887 - DNA, 18 bp, Homo sapiens
ccacggtctggaggccga

SEQ ID NO: 6720888 - DNA, 21 bp, Homo sapiens
ccacggtctgttcttgaagca

SEQ ID NO: 6720889 - DNA, 13 bp, Homo sapiens
ccacggtcttctg

SEQ ID NO: 6720890 - DNA, 16 bp, Homo sapiens
ccacggtcttctgcat

SEQ ID NO: 6720891 - DNA, 19 bp, Homo sapiens
ccacggtgcgtggctgtgg

SEQ ID NO: 6720892 - DNA, 20 bp, Homo sapiens
ccacggtgcgtggctgtggc

SEQ ID NO: 6720893 - DNA, 14 bp, Homo sapiens
ccacggtttcagct

SEQ ID NO: 6720894 - DNA, 15 bp, Homo sapiens
ccacggtttcagcta

SEQ ID NO: 6720895 - DNA, 16 bp, Homo sapiens
ccacgtaccaagccac

SEQ ID NO: 6720896 - DNA, 22 bp, Homo sapiens
ccacgtaccaagccaccgcagc

SEQ ID NO: 6720897 - DNA, 13 bp, Homo sapiens
ccacgtactgcag

SEQ ID NO: 6720898 - DNA, 17 bp, Homo sapiens
ccacgtactgcagcctc

SEQ ID NO: 6720899 - DNA, 18 bp, Homo sapiens
ccacgtccaatcatgggc

SEQ ID NO: 6720900 - DNA, 15 bp, Homo sapiens
ccacgtcccacccca

SEQ ID NO: 6720901 - DNA, 19 bp, Homo sapiens
ccacgtcccaccccacctc

SEQ ID NO: 6720902 - DNA, 14 bp, Homo sapiens
ccacgtcccagcat

SEQ ID NO: 6720903 - DNA, 22 bp, Homo sapiens
ccacgtcccagcatccctggag

SEQ ID NO: 6720904 - DNA, 16 bp, Homo sapiens
ccacgtcccgctgcct

SEQ ID NO: 6720905 - DNA, 14 bp, Homo sapiens
ccacgtcccgggca

SEQ ID NO: 6720906 - DNA, 22 bp, Homo sapiens
ccacgtcctccaagctcacgac

SEQ ID NO: 6720907 - DNA, 17 bp, Homo sapiens
ccacgtcctcgaattct

SEQ ID NO: 6720908 - DNA, 15 bp, Homo sapiens
ccacgtcctgtcagt

SEQ ID NO: 6720909 - DNA, 18 bp, Homo sapiens
ccacgtcctgtcagtgcc

SEQ ID NO: 6720910 - DNA, 15 bp, Homo sapiens
ccacgtctccctggc

SEQ ID NO: 6720911 - DNA, 14 bp, Homo sapiens
ccacgtctctctgc

SEQ ID NO: 6720912 - DNA, 15 bp, Homo sapiens
ccacgtctctctgcc

SEQ ID NO: 6720913 - DNA, 17 bp, Homo sapiens
ccacgtctctctgcctg

SEQ ID NO: 6720914 - DNA, 19 bp, Homo sapiens
ccacgtctctctgcctgct

SEQ ID NO: 6720915 - DNA, 15 bp, Homo sapiens
ccacgtctgccaggc

SEQ ID NO: 6720916 - DNA, 18 bp, Homo sapiens
ccacgtctggccaggcac

SEQ ID NO: 6720917 - DNA, 23 bp, Homo sapiens
ccacgtctggccaggcactgcct

SEQ ID NO: 6720918 - DNA, 14 bp, Homo sapiens
ccacgtctggctcc

SEQ ID NO: 6720919 - DNA, 17 bp, Homo sapiens
ccacgtctggctccctg

SEQ ID NO: 6720920 - DNA, 17 bp, Homo sapiens
ccacgtctgtgctctgt

SEQ ID NO: 6720921 - DNA, 21 bp, Homo sapiens
ccacgtcttcttgctgcagcc

SEQ ID NO: 6720922 - DNA, 14 bp, Homo sapiens
ccacgtctttcctg

SEQ ID NO: 6720923 - DNA, 17 bp, Homo sapiens
ccacgtgaaactgctgt

SEQ ID NO: 6720924 - DNA, 18 bp, Homo sapiens
ccacgtgaaatttgcctc

SEQ ID NO: 6720925 - DNA, 21 bp, Homo sapiens
ccacgtgcagcacctgtcacc

SEQ ID NO: 6720926 - DNA, 20 bp, Homo sapiens
ccacgtgccaaggagctcag

SEQ ID NO: 6720927 - DNA, 16 bp, Homo sapiens
ccacgtgccaggcccg

SEQ ID NO: 6720928 - DNA, 23 bp, Homo sapiens
ccacgtgccaggcccggggctgg

SEQ ID NO: 6720929 - DNA, 18 bp, Homo sapiens
ccacgtgctggagagtag

SEQ ID NO: 6720930 - DNA, 19 bp, Homo sapiens
ccacgtggactctgtgctc

SEQ ID NO: 6720931 - DNA, 20 bp, Homo sapiens
ccacgtggactctgtgctca

SEQ ID NO: 6720932 - DNA, 13 bp, Homo sapiens
ccacgtggagaaa

SEQ ID NO: 6720933 - DNA, 15 bp, Homo sapiens
ccacgtggagacagc

SEQ ID NO: 6720934 - DNA, 23 bp, Homo sapiens
ccacgtggcctctctctctctcc

SEQ ID NO: 6720935 - DNA, 13 bp, Homo sapiens
ccacgtggtcact

SEQ ID NO: 6720936 - DNA, 16 bp, Homo sapiens
ccacgtggtcactgtg

SEQ ID NO: 6720937 - DNA, 22 bp, Homo sapiens
ccacgtgtaactgtcagccggg

SEQ ID NO: 6720938 - DNA, 18 bp, Homo sapiens
ccacgtgtatagtatctg

SEQ ID NO: 6720939 - DNA, 12 bp, Homo sapiens
ccacgtgtccgt

SEQ ID NO: 6720940 - DNA, 18 bp, Homo sapiens
ccacgtgtccgtccaccc

SEQ ID NO: 6720941 - DNA, 22 bp, Homo sapiens
ccacgtgtgctgtggccaggcc

SEQ ID NO: 6720942 - DNA, 21 bp, Homo sapiens
ccacgtgtttcgggccagggc

SEQ ID NO: 6720943 - DNA, 21 bp, Homo sapiens
ccacgttactcccctggctgg

SEQ ID NO: 6720944 - DNA, 15 bp, Homo sapiens
ccacgttcagggagg

SEQ ID NO: 6720945 - DNA, 17 bp, Homo sapiens
ccacgttcagggagggg

SEQ ID NO: 6720946 - DNA, 20 bp, Homo sapiens
ccacgttcagggaggggccg

SEQ ID NO: 6720947 - DNA, 20 bp, Homo sapiens
ccacgttccacagttgccac

SEQ ID NO: 6720948 - DNA, 21 bp, Homo sapiens
ccacgttccttactgcagaat

SEQ ID NO: 6720949 - DNA, 13 bp, Homo sapiens
ccacgttctatat

SEQ ID NO: 6720950 - DNA, 23 bp, Homo sapiens
ccacgttctctctgcctgtgagc

SEQ ID NO: 6720951 - DNA, 23 bp, Homo sapiens
ccacgttctgctcatcattctct

SEQ ID NO: 6720952 - DNA, 13 bp, Homo sapiens
ccacgttctgtta

SEQ ID NO: 6720953 - DNA, 12 bp, Homo sapiens
ccactaaaaata

SEQ ID NO: 6720954 - DNA, 22 bp, Homo sapiens
ccactaaaagatcgcagtttgc

SEQ ID NO: 6720955 - DNA, 22 bp, Homo sapiens
ccactaaaatccacccagccca

SEQ ID NO: 6720956 - DNA, 21 bp, Homo sapiens
ccactaaaccccatacctgga

SEQ ID NO: 6720957 - DNA, 14 bp, Homo sapiens
ccactaaagcttca

SEQ ID NO: 6720958 - DNA, 16 bp, Homo sapiens
ccactaaagcttcaga

SEQ ID NO: 6720959 - DNA, 21 bp, Homo sapiens
ccactaaagcttcagactcaa

SEQ ID NO: 6720960 - DNA, 19 bp, Homo sapiens
ccactaaatctccaagacc

SEQ ID NO: 6720961 - DNA, 19 bp, Homo sapiens
ccactaaatgagctcctgc

SEQ ID NO: 6720962 - DNA, 23 bp, Homo sapiens
ccactaaatgagctcctgcggga

SEQ ID NO: 6720963 - DNA, 13 bp, Homo sapiens
ccactaaccatcc

SEQ ID NO: 6720964 - DNA, 18 bp, Homo sapiens
ccactaaccatccccaac

SEQ ID NO: 6720965 - DNA, 19 bp, Homo sapiens
ccactaaccatccccaact

SEQ ID NO: 6720966 - DNA, 20 bp, Homo sapiens
ccactaaccatccccaactc

SEQ ID NO: 6720967 - DNA, 16 bp, Homo sapiens
ccactaagcagaggag

SEQ ID NO: 6720968 - DNA, 19 bp, Homo sapiens
ccactaagcagaggagggg

SEQ ID NO: 6720969 - DNA, 22 bp, Homo sapiens
ccactaagcagaggaggggccg

SEQ ID NO: 6720970 - DNA, 18 bp, Homo sapiens
ccactaagctttctcctt

SEQ ID NO: 6720971 - DNA, 18 bp, Homo sapiens
ccactaatattcagtcct

SEQ ID NO: 6720972 - DNA, 23 bp, Homo sapiens
ccactaatcaggaggccaggcca

SEQ ID NO: 6720973 - DNA, 13 bp, Homo sapiens
ccactaattttgt

SEQ ID NO: 6720974 - DNA, 19 bp, Homo sapiens
ccactaattttgttttaaa

SEQ ID NO: 6720975 - DNA, 13 bp, Homo sapiens
ccactacacctgg

SEQ ID NO: 6720976 - DNA, 21 bp, Homo sapiens
ccactacactcaactaatttt

SEQ ID NO: 6720977 - DNA, 14 bp, Homo sapiens
ccactacactccag

SEQ ID NO: 6720978 - DNA, 14 bp, Homo sapiens
ccactacattctgt

SEQ ID NO: 6720979 - DNA, 15 bp, Homo sapiens
ccactacattctgtt

SEQ ID NO: 6720980 - DNA, 17 bp, Homo sapiens
ccactacattctgttaa

SEQ ID NO: 6720981 - DNA, 21 bp, Homo sapiens
ccactaccatacagacagcac

SEQ ID NO: 6720982 - DNA, 22 bp, Homo sapiens
ccactaccccacaccagccttg

SEQ ID NO: 6720983 - DNA, 23 bp, Homo sapiens
ccactaccccacaccagccttgg

SEQ ID NO: 6720984 - DNA, 16 bp, Homo sapiens
ccactaccccttgatt

SEQ ID NO: 6720985 - DNA, 15 bp, Homo sapiens
ccactaccctccctc

SEQ ID NO: 6720986 - DNA, 15 bp, Homo sapiens
ccactacctcctttc

SEQ ID NO: 6720987 - DNA, 19 bp, Homo sapiens
ccactacctcctttcctat

SEQ ID NO: 6720988 - DNA, 13 bp, Homo sapiens
ccactaccttctg

SEQ ID NO: 6720989 - DNA, 14 bp, Homo sapiens
ccactacctttgtc

SEQ ID NO: 6720990 - DNA, 20 bp, Homo sapiens
ccactacgctcctgtctcca

SEQ ID NO: 6720991 - DNA, 23 bp, Homo sapiens
ccactactcaatactacctctga

SEQ ID NO: 6720992 - DNA, 12 bp, Homo sapiens
ccactactgcag

SEQ ID NO: 6720993 - DNA, 13 bp, Homo sapiens
ccactactgcagc

SEQ ID NO: 6720994 - DNA, 23 bp, Homo sapiens
ccactactgtgtagactcctgct

SEQ ID NO: 6720995 - DNA, 21 bp, Homo sapiens
ccactacttgtggggctaagg

SEQ ID NO: 6720996 - DNA, 14 bp, Homo sapiens
ccactagagggccc

SEQ ID NO: 6720997 - DNA, 18 bp, Homo sapiens
ccactagagggcccatca

SEQ ID NO: 6720998 - DNA, 22 bp, Homo sapiens
ccactagagggcccatcaggca

SEQ ID NO: 6720999 - DNA, 23 bp, Homo sapiens
ccactagagggcccatcaggcag

SEQ ID NO: 6721000 - DNA, 21 bp, Homo sapiens
ccactagaggggcacccacca

SEQ ID NO: 6721001 - DNA, 23 bp, Homo sapiens
ccactagccctctttctctctgt

SEQ ID NO: 6721002 - DNA, 16 bp, Homo sapiens
ccactagcctcagggg

SEQ ID NO: 6721003 - DNA, 20 bp, Homo sapiens
ccactagctaagcaagccag

SEQ ID NO: 6721004 - DNA, 19 bp, Homo sapiens
ccactaggaatcccagagg

SEQ ID NO: 6721005 - DNA, 22 bp, Homo sapiens
ccactaggccctggtctggctt

SEQ ID NO: 6721006 - DNA, 20 bp, Homo sapiens
ccactaggctgggtgcccac

SEQ ID NO: 6721007 - DNA, 21 bp, Homo sapiens
ccactaggctgggtgcccaca

SEQ ID NO: 6721008 - DNA, 17 bp, Homo sapiens
ccactaggtgcccagtc

SEQ ID NO: 6721009 - DNA, 17 bp, Homo sapiens
ccactaggtgtccccaa

SEQ ID NO: 6721010 - DNA, 23 bp, Homo sapiens
ccactagtaagtaattatgcact

SEQ ID NO: 6721011 - DNA, 16 bp, Homo sapiens
ccactagtgcaaatca

SEQ ID NO: 6721012 - DNA, 17 bp, Homo sapiens
ccactagtgcaaatcat

SEQ ID NO: 6721013 - DNA, 13 bp, Homo sapiens
ccactatcacata

SEQ ID NO: 6721014 - DNA, 22 bp, Homo sapiens
ccactatctccgttccatctgg

SEQ ID NO: 6721015 - DNA, 14 bp, Homo sapiens
ccactatctgggtg

SEQ ID NO: 6721016 - DNA, 14 bp, Homo sapiens
ccactatgcacaga

SEQ ID NO: 6721017 - DNA, 12 bp, Homo sapiens
ccactattttca

SEQ ID NO: 6721018 - DNA, 18 bp, Homo sapiens
ccactatttttattttct

SEQ ID NO: 6721019 - DNA, 14 bp, Homo sapiens
ccactcaaaatatg

SEQ ID NO: 6721020 - DNA, 14 bp, Homo sapiens
ccactcaaaggcca

SEQ ID NO: 6721021 - DNA, 15 bp, Homo sapiens
ccactcaaaggccag

SEQ ID NO: 6721022 - DNA, 19 bp, Homo sapiens
ccactcaaaggccagacct

SEQ ID NO: 6721023 - DNA, 20 bp, Homo sapiens
ccactcaaattaatctttct

SEQ ID NO: 6721024 - DNA, 17 bp, Homo sapiens
ccactcaacagagagga

SEQ ID NO: 6721025 - DNA, 17 bp, Homo sapiens
ccactcaagaccaaatg

SEQ ID NO: 6721026 - DNA, 23 bp, Homo sapiens
ccactcaagaccaaatggaaaca

SEQ ID NO: 6721027 - DNA, 12 bp, Homo sapiens
ccactcaagcca

SEQ ID NO: 6721028 - DNA, 17 bp, Homo sapiens
ccactcaagccaagcag

SEQ ID NO: 6721029 - DNA, 18 bp, Homo sapiens
ccactcaagccaagcagc

SEQ ID NO: 6721030 - DNA, 14 bp, Homo sapiens
ccactcacaacagc

SEQ ID NO: 6721031 - DNA, 15 bp, Homo sapiens
ccactcacacagcca

SEQ ID NO: 6721032 - DNA, 17 bp, Homo sapiens
ccactcacacagccagg

SEQ ID NO: 6721033 - DNA, 16 bp, Homo sapiens
ccactcacacttggag

SEQ ID NO: 6721034 - DNA, 16 bp, Homo sapiens
ccactcaccagtgtcc

SEQ ID NO: 6721035 - DNA, 22 bp, Homo sapiens
ccactcaccccctttgctgtga

SEQ ID NO: 6721036 - DNA, 12 bp, Homo sapiens
ccactcaccccg

SEQ ID NO: 6721037 - DNA, 13 bp, Homo sapiens
ccactcaccccgg

SEQ ID NO: 6721038 - DNA, 14 bp, Homo sapiens
ccactcacccttcc

SEQ ID NO: 6721039 - DNA, 17 bp, Homo sapiens
ccactcacccttcctgg

SEQ ID NO: 6721040 - DNA, 19 bp, Homo sapiens
ccactcacccttcctggcc

SEQ ID NO: 6721041 - DNA, 14 bp, Homo sapiens
ccactcacctttct

SEQ ID NO: 6721042 - DNA, 22 bp, Homo sapiens
ccactcacctttctccactggg

SEQ ID NO: 6721043 - DNA, 13 bp, Homo sapiens
ccactcactgcat

SEQ ID NO: 6721044 - DNA, 16 bp, Homo sapiens
ccactcagaggccccc

SEQ ID NO: 6721045 - DNA, 18 bp, Homo sapiens
ccactcagaggcccccag

SEQ ID NO: 6721046 - DNA, 19 bp, Homo sapiens
ccactcagaggcccccagt

SEQ ID NO: 6721047 - DNA, 13 bp, Homo sapiens
ccactcagcactc

SEQ ID NO: 6721048 - DNA, 22 bp, Homo sapiens
ccactcagcactctggactcca

SEQ ID NO: 6721049 - DNA, 17 bp, Homo sapiens
ccactcagcccctagga

SEQ ID NO: 6721050 - DNA, 18 bp, Homo sapiens
ccactcagcccctaggag

SEQ ID NO: 6721051 - DNA, 15 bp, Homo sapiens
ccactcagctgtcct

SEQ ID NO: 6721052 - DNA, 18 bp, Homo sapiens
ccactcaggcatttgact

SEQ ID NO: 6721053 - DNA, 13 bp, Homo sapiens
ccactcaggccaa

SEQ ID NO: 6721054 - DNA, 20 bp, Homo sapiens
ccactcaggccaacaagcca

SEQ ID NO: 6721055 - DNA, 16 bp, Homo sapiens
ccactcaggccacagt

SEQ ID NO: 6721056 - DNA, 14 bp, Homo sapiens
ccactcagggctgc

SEQ ID NO: 6721057 - DNA, 18 bp, Homo sapiens
ccactcagggctggcccg

SEQ ID NO: 6721058 - DNA, 16 bp, Homo sapiens
ccactcaggggacccc

SEQ ID NO: 6721059 - DNA, 18 bp, Homo sapiens
ccactcaggggaccccac

SEQ ID NO: 6721060 - DNA, 16 bp, Homo sapiens
ccactcaggtctgttt

SEQ ID NO: 6721061 - DNA, 16 bp, Homo sapiens
ccactcaggtgcacac

SEQ ID NO: 6721062 - DNA, 22 bp, Homo sapiens
ccactcagtaggtctgaaggcc

SEQ ID NO: 6721063 - DNA, 24 bp, Homo sapiens
ccactcagtaggtctgaaggcctc

SEQ ID NO: 6721064 - DNA, 14 bp, Homo sapiens
ccactcagtgcctc

SEQ ID NO: 6721065 - DNA, 22 bp, Homo sapiens
ccactcagttaaggaagatcct

SEQ ID NO: 6721066 - DNA, 16 bp, Homo sapiens
ccactcagttgttcct

SEQ ID NO: 6721067 - DNA, 19 bp, Homo sapiens
ccactcatgtgactctttc

SEQ ID NO: 6721068 - DNA, 22 bp, Homo sapiens
ccactcatgtgactctttccaa

SEQ ID NO: 6721069 - DNA, 21 bp, Homo sapiens
ccactcatgttgttcccacac

SEQ ID NO: 6721070 - DNA, 13 bp, Homo sapiens
ccactcatttcat

SEQ ID NO: 6721071 - DNA, 14 bp, Homo sapiens
ccactcatttcatc

SEQ ID NO: 6721072 - DNA, 15 bp, Homo sapiens
ccactcatttcatct

SEQ ID NO: 6721073 - DNA, 13 bp, Homo sapiens
ccactccaaactc

SEQ ID NO: 6721074 - DNA, 20 bp, Homo sapiens
ccactccaagatgccctcat

SEQ ID NO: 6721075 - DNA, 13 bp, Homo sapiens
ccactccaagccc

SEQ ID NO: 6721076 - DNA, 22 bp, Homo sapiens
ccactccaagccccctggcagc

SEQ ID NO: 6721077 - DNA, 14 bp, Homo sapiens
ccactccacaccag

SEQ ID NO: 6721078 - DNA, 20 bp, Homo sapiens
ccactccaccctgttagttt

SEQ ID NO: 6721079 - DNA, 12 bp, Homo sapiens
ccactccagccc

SEQ ID NO: 6721080 - DNA, 16 bp, Homo sapiens
ccactccagcccgcag

SEQ ID NO: 6721081 - DNA, 12 bp, Homo sapiens
ccactccagcct

SEQ ID NO: 6721082 - DNA, 17 bp, Homo sapiens
ccactccagcctgggga

SEQ ID NO: 6721083 - DNA, 16 bp, Homo sapiens
ccactccagctctgag

SEQ ID NO: 6721084 - DNA, 22 bp, Homo sapiens
ccactcccagcagctcaaccta

SEQ ID NO: 6721085 - DNA, 12 bp, Homo sapiens
ccactcccagga

SEQ ID NO: 6721086 - DNA, 13 bp, Homo sapiens
ccactcccaggca

SEQ ID NO: 6721087 - DNA, 13 bp, Homo sapiens
ccactcccagggg

SEQ ID NO: 6721088 - DNA, 19 bp, Homo sapiens
ccactcccatcccttcaac

SEQ ID NO: 6721089 - DNA, 15 bp, Homo sapiens
ccactccccaacccc

SEQ ID NO: 6721090 - DNA, 15 bp, Homo sapiens
ccactccccagcccc

SEQ ID NO: 6721091 - DNA, 22 bp, Homo sapiens
ccactccccagtgctcctgtgc

SEQ ID NO: 6721092 - DNA, 23 bp, Homo sapiens
ccactcccccacccatggggagg

SEQ ID NO: 6721093 - DNA, 16 bp, Homo sapiens
ccactcccccacctga

SEQ ID NO: 6721094 - DNA, 13 bp, Homo sapiens
ccactcccccagg

SEQ ID NO: 6721095 - DNA, 22 bp, Homo sapiens
ccactcccccaggagcagctgg

SEQ ID NO: 6721096 - DNA, 20 bp, Homo sapiens
ccactcccccgtttctcctt

SEQ ID NO: 6721097 - DNA, 22 bp, Homo sapiens
ccactcccccgtttctcctttt

SEQ ID NO: 6721098 - DNA, 17 bp, Homo sapiens
ccactcccccttccctt

SEQ ID NO: 6721099 - DNA, 15 bp, Homo sapiens
ccactccccggcatg

SEQ ID NO: 6721100 - DNA, 14 bp, Homo sapiens
ccactcccctcaca

SEQ ID NO: 6721101 - DNA, 22 bp, Homo sapiens
ccactcccctccactctctacc

SEQ ID NO: 6721102 - DNA, 21 bp, Homo sapiens
ccactcccgggccaagacaga

SEQ ID NO: 6721103 - DNA, 14 bp, Homo sapiens
ccactccctgagct

SEQ ID NO: 6721104 - DNA, 18 bp, Homo sapiens
ccactccctgagctttgg

SEQ ID NO: 6721105 - DNA, 15 bp, Homo sapiens
ccactccctgccaac

SEQ ID NO: 6721106 - DNA, 12 bp, Homo sapiens
ccactccctgct

SEQ ID NO: 6721107 - DNA, 14 bp, Homo sapiens
ccactccctgctcc

SEQ ID NO: 6721108 - DNA, 23 bp, Homo sapiens
ccactccctgggggcgctgttcc

SEQ ID NO: 6721109 - DNA, 17 bp, Homo sapiens
ccactccctttcccctc

SEQ ID NO: 6721110 - DNA, 20 bp, Homo sapiens
ccactccgagaggtgggcca

SEQ ID NO: 6721111 - DNA, 15 bp, Homo sapiens
ccactccgccagcca

SEQ ID NO: 6721112 - DNA, 17 bp, Homo sapiens
ccactccgccagccaca

SEQ ID NO: 6721113 - DNA, 19 bp, Homo sapiens
ccactccgccagccacagg

SEQ ID NO: 6721114 - DNA, 20 bp, Homo sapiens
ccactccgccagccacagga

SEQ ID NO: 6721115 - DNA, 21 bp, Homo sapiens
ccactccgccagccacaggac

SEQ ID NO: 6721116 - DNA, 23 bp, Homo sapiens
ccactccgccagccacaggacca

SEQ ID NO: 6721117 - DNA, 21 bp, Homo sapiens
ccactccggattccggccctg

SEQ ID NO: 6721118 - DNA, 14 bp, Homo sapiens
ccactccggttccc

SEQ ID NO: 6721119 - DNA, 16 bp, Homo sapiens
ccactcctcccaactc

SEQ ID NO: 6721120 - DNA, 17 bp, Homo sapiens
ccactcctcccaactct

SEQ ID NO: 6721121 - DNA, 18 bp, Homo sapiens
ccactcctcccaactctg

SEQ ID NO: 6721122 - DNA, 22 bp, Homo sapiens
ccactcctcccaactctggcct

SEQ ID NO: 6721123 - DNA, 15 bp, Homo sapiens
ccactcctccctccg

SEQ ID NO: 6721124 - DNA, 12 bp, Homo sapiens
ccactcctcctc

SEQ ID NO: 6721125 - DNA, 15 bp, Homo sapiens
ccactcctcctccag

SEQ ID NO: 6721126 - DNA, 22 bp, Homo sapiens
ccactcctcctccagcccaccc

SEQ ID NO: 6721127 - DNA, 15 bp, Homo sapiens
ccactcctcctcctt

SEQ ID NO: 6721128 - DNA, 13 bp, Homo sapiens
ccactcctctccc

SEQ ID NO: 6721129 - DNA, 18 bp, Homo sapiens
ccactcctctcccttgag

SEQ ID NO: 6721130 - DNA, 20 bp, Homo sapiens
ccactcctctgactcagggc

SEQ ID NO: 6721131 - DNA, 14 bp, Homo sapiens
ccactcctctgctg

SEQ ID NO: 6721132 - DNA, 15 bp, Homo sapiens
ccactcctgacccag

SEQ ID NO: 6721133 - DNA, 18 bp, Homo sapiens
ccactcctgccagcccgg

SEQ ID NO: 6721134 - DNA, 14 bp, Homo sapiens
ccactcctgcctgc

SEQ ID NO: 6721135 - DNA, 16 bp, Homo sapiens
ccactcctgcctgccc

SEQ ID NO: 6721136 - DNA, 13 bp, Homo sapiens
ccactcctgctct

SEQ ID NO: 6721137 - DNA, 17 bp, Homo sapiens
ccactcctgctctgctc

SEQ ID NO: 6721138 - DNA, 13 bp, Homo sapiens
ccactccttgtcc

SEQ ID NO: 6721139 - DNA, 17 bp, Homo sapiens
ccactcgccttcttaga

SEQ ID NO: 6721140 - DNA, 16 bp, Homo sapiens
ccactcgcttccccca

SEQ ID NO: 6721141 - DNA, 23 bp, Homo sapiens
ccactcggatggaccaacctgct

SEQ ID NO: 6721142 - DNA, 16 bp, Homo sapiens
ccactcggggccccca

SEQ ID NO: 6721143 - DNA, 18 bp, Homo sapiens
ccactcggggcccccatc

SEQ ID NO: 6721144 - DNA, 21 bp, Homo sapiens
ccactcgggggtggagtgaga

SEQ ID NO: 6721145 - DNA, 22 bp, Homo sapiens
ccactcgtccaagggacagccc

SEQ ID NO: 6721146 - DNA, 17 bp, Homo sapiens
ccactctactgccccag

SEQ ID NO: 6721147 - DNA, 23 bp, Homo sapiens
ccactctaggggtcaggctccat

SEQ ID NO: 6721148 - DNA, 15 bp, Homo sapiens
ccactctcagagact

SEQ ID NO: 6721149 - DNA, 21 bp, Homo sapiens
ccactctcagagactcccagg

SEQ ID NO: 6721150 - DNA, 16 bp, Homo sapiens
ccactctcagaggccc

SEQ ID NO: 6721151 - DNA, 16 bp, Homo sapiens
ccactctcaggaccac

SEQ ID NO: 6721152 - DNA, 20 bp, Homo sapiens
ccactctcaggaccaccctg

SEQ ID NO: 6721153 - DNA, 14 bp, Homo sapiens
ccactctcaggagg

SEQ ID NO: 6721154 - DNA, 18 bp, Homo sapiens
ccactctcattccccagg

SEQ ID NO: 6721155 - DNA, 16 bp, Homo sapiens
ccactctccacctcac

SEQ ID NO: 6721156 - DNA, 12 bp, Homo sapiens
ccactctcccca

SEQ ID NO: 6721157 - DNA, 14 bp, Homo sapiens
ccactctccccaca

SEQ ID NO: 6721158 - DNA, 17 bp, Homo sapiens
ccactctccccacacta

SEQ ID NO: 6721159 - DNA, 17 bp, Homo sapiens
ccactctctcacccacc

SEQ ID NO: 6721160 - DNA, 19 bp, Homo sapiens
ccactctctcacccaccag

SEQ ID NO: 6721161 - DNA, 21 bp, Homo sapiens
ccactctctcacccaccagct

SEQ ID NO: 6721162 - DNA, 21 bp, Homo sapiens
ccactctctcttgttcttact

SEQ ID NO: 6721163 - DNA, 22 bp, Homo sapiens
ccactctctcttgttcttactt

SEQ ID NO: 6721164 - DNA, 12 bp, Homo sapiens
ccactctctgcc

SEQ ID NO: 6721165 - DNA, 20 bp, Homo sapiens
ccactctctgggactctcct

SEQ ID NO: 6721166 - DNA, 13 bp, Homo sapiens
ccactctcttccc

SEQ ID NO: 6721167 - DNA, 14 bp, Homo sapiens
ccactctcttccct

SEQ ID NO: 6721168 - DNA, 23 bp, Homo sapiens
ccactctcttccctttccccagc

SEQ ID NO: 6721169 - DNA, 18 bp, Homo sapiens
ccactctgaggtctcacc

SEQ ID NO: 6721170 - DNA, 20 bp, Homo sapiens
ccactctgaggtctcacctt

SEQ ID NO: 6721171 - DNA, 23 bp, Homo sapiens
ccactctgaggtctcaccttcgc

SEQ ID NO: 6721172 - DNA, 23 bp, Homo sapiens
ccactctgattcacctcttcctc

SEQ ID NO: 6721173 - DNA, 13 bp, Homo sapiens
ccactctgcactg

SEQ ID NO: 6721174 - DNA, 14 bp, Homo sapiens
ccactctgcctctg

SEQ ID NO: 6721175 - DNA, 14 bp, Homo sapiens
ccactctgcctgcc

SEQ ID NO: 6721176 - DNA, 12 bp, Homo sapiens
ccactctgctcc

SEQ ID NO: 6721177 - DNA, 14 bp, Homo sapiens
ccactctgctccca

SEQ ID NO: 6721178 - DNA, 21 bp, Homo sapiens
ccactctgctcgccttagcac

SEQ ID NO: 6721179 - DNA, 15 bp, Homo sapiens
ccactctgctctgat

SEQ ID NO: 6721180 - DNA, 17 bp, Homo sapiens
ccactctgctgaggcca

SEQ ID NO: 6721181 - DNA, 19 bp, Homo sapiens
ccactctgctgaggccaga

SEQ ID NO: 6721182 - DNA, 12 bp, Homo sapiens
ccactctgctgc

SEQ ID NO: 6721183 - DNA, 14 bp, Homo sapiens
ccactctgctgcct

SEQ ID NO: 6721184 - DNA, 15 bp, Homo sapiens
ccactctgctgcctg

SEQ ID NO: 6721185 - DNA, 17 bp, Homo sapiens
ccactctgcttctctga

SEQ ID NO: 6721186 - DNA, 19 bp, Homo sapiens
ccactctgcttctctgact

SEQ ID NO: 6721187 - DNA, 21 bp, Homo sapiens
ccactctgctttgactgagca

SEQ ID NO: 6721188 - DNA, 17 bp, Homo sapiens
ccactctggcagccaca

SEQ ID NO: 6721189 - DNA, 22 bp, Homo sapiens
ccactctggcagccacacttct

SEQ ID NO: 6721190 - DNA, 20 bp, Homo sapiens
ccactctgggcaaagcccct

SEQ ID NO: 6721191 - DNA, 22 bp, Homo sapiens
ccactctgggcacaagcagggc

SEQ ID NO: 6721192 - DNA, 11 bp, Homo sapiens
ccactctgtaa

SEQ ID NO: 6721193 - DNA, 14 bp, Homo sapiens
ccactctgtaattg

SEQ ID NO: 6721194 - DNA, 19 bp, Homo sapiens
ccactctgtatctatgcaa

SEQ ID NO: 6721195 - DNA, 22 bp, Homo sapiens
ccactctgtgcctgaccttgag

SEQ ID NO: 6721196 - DNA, 16 bp, Homo sapiens
ccactcttcatatatg

SEQ ID NO: 6721197 - DNA, 18 bp, Homo sapiens
ccactcttcctttctcct

SEQ ID NO: 6721198 - DNA, 11 bp, Homo sapiens
ccactcttctc

SEQ ID NO: 6721199 - DNA, 19 bp, Homo sapiens
ccactcttctttaagccat

SEQ ID NO: 6721200 - DNA, 14 bp, Homo sapiens
ccactcttgaagag

SEQ ID NO: 6721201 - DNA, 15 bp, Homo sapiens
ccactcttgatctct

SEQ ID NO: 6721202 - DNA, 12 bp, Homo sapiens
ccactctttgaa

SEQ ID NO: 6721203 - DNA, 15 bp, Homo sapiens
ccactgaaaaaatat

SEQ ID NO: 6721204 - DNA, 17 bp, Homo sapiens
ccactgaaacctctgtt

SEQ ID NO: 6721205 - DNA, 20 bp, Homo sapiens
ccactgaaacctctgttctc

SEQ ID NO: 6721206 - DNA, 21 bp, Homo sapiens
ccactgaaacctctgttctca

SEQ ID NO: 6721207 - DNA, 14 bp, Homo sapiens
ccactgaaatctgt

SEQ ID NO: 6721208 - DNA, 20 bp, Homo sapiens
ccactgaaatgaccaagaca

SEQ ID NO: 6721209 - DNA, 14 bp, Homo sapiens
ccactgaacaaaac

SEQ ID NO: 6721210 - DNA, 10 bp, Homo sapiens
ccactgaaga

SEQ ID NO: 6721211 - DNA, 21 bp, Homo sapiens
ccactgaagtagtgtgcagtt

SEQ ID NO: 6721212 - DNA, 16 bp, Homo sapiens
ccactgaatctgagaa

SEQ ID NO: 6721213 - DNA, 16 bp, Homo sapiens
ccactgaatctgtaca

SEQ ID NO: 6721214 - DNA, 16 bp, Homo sapiens
ccactgaattcactcc

SEQ ID NO: 6721215 - DNA, 21 bp, Homo sapiens
ccactgaattcactccagtca

SEQ ID NO: 6721216 - DNA, 23 bp, Homo sapiens
ccactgaattgacatgaccctct

SEQ ID NO: 6721217 - DNA, 19 bp, Homo sapiens
ccactgacaaacgtcccca

SEQ ID NO: 6721218 - DNA, 21 bp, Homo sapiens
ccactgacaaacgtccccagc

SEQ ID NO: 6721219 - DNA, 15 bp, Homo sapiens
ccactgacagcctcc

SEQ ID NO: 6721220 - DNA, 18 bp, Homo sapiens
ccactgacctcaccggca

SEQ ID NO: 6721221 - DNA, 22 bp, Homo sapiens
ccactgacctcaccggcatgct

SEQ ID NO: 6721222 - DNA, 13 bp, Homo sapiens
ccactgacctgcc

SEQ ID NO: 6721223 - DNA, 16 bp, Homo sapiens
ccactgacctgcccat

SEQ ID NO: 6721224 - DNA, 19 bp, Homo sapiens
ccactgacctgcccatgtc

SEQ ID NO: 6721225 - DNA, 15 bp, Homo sapiens
ccactgacctggaag

SEQ ID NO: 6721226 - DNA, 23 bp, Homo sapiens
ccactgacctggaagagctgggt

SEQ ID NO: 6721227 - DNA, 13 bp, Homo sapiens
ccactgacctggt

SEQ ID NO: 6721228 - DNA, 16 bp, Homo sapiens
ccactgagacggcaga

SEQ ID NO: 6721229 - DNA, 19 bp, Homo sapiens
ccactgagactttcccctc

SEQ ID NO: 6721230 - DNA, 20 bp, Homo sapiens
ccactgagactttcccctct

SEQ ID NO: 6721231 - DNA, 18 bp, Homo sapiens
ccactgagagcgagatgg

SEQ ID NO: 6721232 - DNA, 21 bp, Homo sapiens
ccactgagagctgctcctttg

SEQ ID NO: 6721233 - DNA, 21 bp, Homo sapiens
ccactgagccaggcttttctc

SEQ ID NO: 6721234 - DNA, 11 bp, Homo sapiens
ccactgagctc

SEQ ID NO: 6721235 - DNA, 17 bp, Homo sapiens
ccactgagctctgcctc

SEQ ID NO: 6721236 - DNA, 19 bp, Homo sapiens
ccactgagctctgcctcaa

SEQ ID NO: 6721237 - DNA, 11 bp, Homo sapiens
ccactgagctg

SEQ ID NO: 6721238 - DNA, 11 bp, Homo sapiens
ccactgaggag

SEQ ID NO: 6721239 - DNA, 12 bp, Homo sapiens
ccactgaggaga

SEQ ID NO: 6721240 - DNA, 22 bp, Homo sapiens
ccactgagtctcattcctctgt

SEQ ID NO: 6721241 - DNA, 22 bp, Homo sapiens
ccactgatagatgtctattctt

SEQ ID NO: 6721242 - DNA, 23 bp, Homo sapiens
ccactgatattcagaattatgat

SEQ ID NO: 6721243 - DNA, 17 bp, Homo sapiens
ccactgatgctgttctc

SEQ ID NO: 6721244 - DNA, 21 bp, Homo sapiens
ccactgatggaaacaaagtgg

SEQ ID NO: 6721245 - DNA, 18 bp, Homo sapiens
ccactgcaaacaataaac

SEQ ID NO: 6721246 - DNA, 20 bp, Homo sapiens
ccactgcaaataaagccttt

SEQ ID NO: 6721247 - DNA, 16 bp, Homo sapiens
ccactgcacagagctc

SEQ ID NO: 6721248 - DNA, 20 bp, Homo sapiens
ccactgcacagagctctcca

SEQ ID NO: 6721249 - DNA, 19 bp, Homo sapiens
ccactgcaccccctcctgc

SEQ ID NO: 6721250 - DNA, 22 bp, Homo sapiens
ccactgcaccccctcctgctgc

SEQ ID NO: 6721251 - DNA, 18 bp, Homo sapiens
ccactgcaccccgtctca

SEQ ID NO: 6721252 - DNA, 13 bp, Homo sapiens
ccactgcaccgcc

SEQ ID NO: 6721253 - DNA, 13 bp, Homo sapiens
ccactgcaccggg

SEQ ID NO: 6721254 - DNA, 16 bp, Homo sapiens
ccactgcactccagcc

SEQ ID NO: 6721255 - DNA, 23 bp, Homo sapiens
ccactgcactccagcctgagtga

SEQ ID NO: 6721256 - DNA, 19 bp, Homo sapiens
ccactgcactccagcctgg

SEQ ID NO: 6721257 - DNA, 21 bp, Homo sapiens
ccactgcactccagcctgggc

SEQ ID NO: 6721258 - DNA, 23 bp, Homo sapiens
ccactgcactccagcctgggtca

SEQ ID NO: 6721259 - DNA, 19 bp, Homo sapiens
ccactgcactttccaatgc

SEQ ID NO: 6721260 - DNA, 20 bp, Homo sapiens
ccactgcagtccgcagtctg

SEQ ID NO: 6721261 - DNA, 19 bp, Homo sapiens
ccactgcataccaacctgg

SEQ ID NO: 6721262 - DNA, 23 bp, Homo sapiens
ccactgcatcgtttcatcttcca

SEQ ID NO: 6721263 - DNA, 19 bp, Homo sapiens
ccactgccaagcttcctgt

SEQ ID NO: 6721264 - DNA, 14 bp, Homo sapiens
ccactgccagcagc

SEQ ID NO: 6721265 - DNA, 15 bp, Homo sapiens
ccactgccagcagca

SEQ ID NO: 6721266 - DNA, 17 bp, Homo sapiens
ccactgccagcagcagc

SEQ ID NO: 6721267 - DNA, 23 bp, Homo sapiens
ccactgccagcagcagcaggtga

SEQ ID NO: 6721268 - DNA, 21 bp, Homo sapiens
ccactgccaggattttgtatt

SEQ ID NO: 6721269 - DNA, 13 bp, Homo sapiens
ccactgccaggca

SEQ ID NO: 6721270 - DNA, 16 bp, Homo sapiens
ccactgccaggcacct

SEQ ID NO: 6721271 - DNA, 18 bp, Homo sapiens
ccactgccaggcacctgg

SEQ ID NO: 6721272 - DNA, 12 bp, Homo sapiens
ccactgccatgt

SEQ ID NO: 6721273 - DNA, 16 bp, Homo sapiens
ccactgccatgtaccc

SEQ ID NO: 6721274 - DNA, 16 bp, Homo sapiens
ccactgccattaccca

SEQ ID NO: 6721275 - DNA, 21 bp, Homo sapiens
ccactgccattacccagtgcc

SEQ ID NO: 6721276 - DNA, 16 bp, Homo sapiens
ccactgcccactggcc

SEQ ID NO: 6721277 - DNA, 17 bp, Homo sapiens
ccactgccccctgctgc

SEQ ID NO: 6721278 - DNA, 19 bp, Homo sapiens
ccactgccccctgctgcca

SEQ ID NO: 6721279 - DNA, 15 bp, Homo sapiens
ccactgcccgagctg

SEQ ID NO: 6721280 - DNA, 22 bp, Homo sapiens
ccactgcccgagctggtgcatt

SEQ ID NO: 6721281 - DNA, 21 bp, Homo sapiens
ccactgccctccagggccagg

SEQ ID NO: 6721282 - DNA, 16 bp, Homo sapiens
ccactgccgcctcctt

SEQ ID NO: 6721283 - DNA, 13 bp, Homo sapiens
ccactgcctcagg

SEQ ID NO: 6721284 - DNA, 15 bp, Homo sapiens
ccactgcctcaggtt

SEQ ID NO: 6721285 - DNA, 19 bp, Homo sapiens
ccactgcctcaggttccta

SEQ ID NO: 6721286 - DNA, 13 bp, Homo sapiens
ccactgcctcctc

SEQ ID NO: 6721287 - DNA, 21 bp, Homo sapiens
ccactgcctcctccctggctg

SEQ ID NO: 6721288 - DNA, 15 bp, Homo sapiens
ccactgcctctccct

SEQ ID NO: 6721289 - DNA, 17 bp, Homo sapiens
ccactgcctctccctct

SEQ ID NO: 6721290 - DNA, 18 bp, Homo sapiens
ccactgcctctgccttag

SEQ ID NO: 6721291 - DNA, 13 bp, Homo sapiens
ccactgcctcttc

SEQ ID NO: 6721292 - DNA, 16 bp, Homo sapiens
ccactgcctcttcctc

SEQ ID NO: 6721293 - DNA, 11 bp, Homo sapiens
ccactgcctgc

SEQ ID NO: 6721294 - DNA, 14 bp, Homo sapiens
ccactgcctgcacc

SEQ ID NO: 6721295 - DNA, 18 bp, Homo sapiens
ccactgcctgcacctttc

SEQ ID NO: 6721296 - DNA, 12 bp, Homo sapiens
ccactgcctgcc

SEQ ID NO: 6721297 - DNA, 14 bp, Homo sapiens
ccactgcctgccca

SEQ ID NO: 6721298 - DNA, 14 bp, Homo sapiens
ccactgccttcgct

SEQ ID NO: 6721299 - DNA, 18 bp, Homo sapiens
ccactgccttcgcttctt

SEQ ID NO: 6721300 - DNA, 23 bp, Homo sapiens
ccactgccttcgcttcttgcctc

SEQ ID NO: 6721301 - DNA, 15 bp, Homo sapiens
ccactgcgcccggcc

SEQ ID NO: 6721302 - DNA, 18 bp, Homo sapiens
ccactgcggggagacaga

SEQ ID NO: 6721303 - DNA, 15 bp, Homo sapiens
ccactgctaaggctg

SEQ ID NO: 6721304 - DNA, 18 bp, Homo sapiens
ccactgctaaggctgctg

SEQ ID NO: 6721305 - DNA, 19 bp, Homo sapiens
ccactgctaaggctgctgg

SEQ ID NO: 6721306 - DNA, 20 bp, Homo sapiens
ccactgctaaggctgctggc

SEQ ID NO: 6721307 - DNA, 12 bp, Homo sapiens
ccactgctaata

SEQ ID NO: 6721308 - DNA, 13 bp, Homo sapiens
ccactgctaataa

SEQ ID NO: 6721309 - DNA, 14 bp, Homo sapiens
ccactgctaataaa

SEQ ID NO: 6721310 - DNA, 15 bp, Homo sapiens
ccactgctaataaat

SEQ ID NO: 6721311 - DNA, 16 bp, Homo sapiens
ccactgctaataaatg

SEQ ID NO: 6721312 - DNA, 22 bp, Homo sapiens
ccactgctatgccatttcttct

SEQ ID NO: 6721313 - DNA, 14 bp, Homo sapiens
ccactgctccattt

SEQ ID NO: 6721314 - DNA, 24 bp, Homo sapiens
ccactgctccctaagccagcctgg

SEQ ID NO: 6721315 - DNA, 17 bp, Homo sapiens
ccactgctctcagcctc

SEQ ID NO: 6721316 - DNA, 11 bp, Homo sapiens
ccactgctctg

SEQ ID NO: 6721317 - DNA, 11 bp, Homo sapiens
ccactgctctt

SEQ ID NO: 6721318 - DNA, 20 bp, Homo sapiens
ccactgctgaaaaagaaaaa

SEQ ID NO: 6721319 - DNA, 13 bp, Homo sapiens
ccactgctgagct

SEQ ID NO: 6721320 - DNA, 14 bp, Homo sapiens
ccactgctgaggag

SEQ ID NO: 6721321 - DNA, 16 bp, Homo sapiens
ccactgctgaggagtc

SEQ ID NO: 6721322 - DNA, 14 bp, Homo sapiens
ccactgctgcacct

SEQ ID NO: 6721323 - DNA, 18 bp, Homo sapiens
ccactgctgcagtagggg

SEQ ID NO: 6721324 - DNA, 15 bp, Homo sapiens
ccactgctggctgca

SEQ ID NO: 6721325 - DNA, 16 bp, Homo sapiens
ccactgctggtgccag

SEQ ID NO: 6721326 - DNA, 14 bp, Homo sapiens
ccactgctggtgtt

SEQ ID NO: 6721327 - DNA, 21 bp, Homo sapiens
ccactgctggtgtttatgtga

SEQ ID NO: 6721328 - DNA, 18 bp, Homo sapiens
ccactgcttcccactggg

SEQ ID NO: 6721329 - DNA, 21 bp, Homo sapiens
ccactgcttcccactggggcc

SEQ ID NO: 6721330 - DNA, 14 bp, Homo sapiens
ccactgcttctctt

SEQ ID NO: 6721331 - DNA, 15 bp, Homo sapiens
ccactgcttctcttt

SEQ ID NO: 6721332 - DNA, 20 bp, Homo sapiens
ccactgcttcttatggtggt

SEQ ID NO: 6721333 - DNA, 17 bp, Homo sapiens
ccactggaacagcccat

SEQ ID NO: 6721334 - DNA, 22 bp, Homo sapiens
ccactggaacgtttcactgcaa

SEQ ID NO: 6721335 - DNA, 19 bp, Homo sapiens
ccactggaaggaacatgga

SEQ ID NO: 6721336 - DNA, 20 bp, Homo sapiens
ccactggaaggaacatggag

SEQ ID NO: 6721337 - DNA, 18 bp, Homo sapiens
ccactggaaggagcacat

SEQ ID NO: 6721338 - DNA, 15 bp, Homo sapiens
ccactggaagggcag

SEQ ID NO: 6721339 - DNA, 14 bp, Homo sapiens
ccactggacagacc

SEQ ID NO: 6721340 - DNA, 22 bp, Homo sapiens
ccactggacagacccaggtctt

SEQ ID NO: 6721341 - DNA, 18 bp, Homo sapiens
ccactggactgacctggt

SEQ ID NO: 6721342 - DNA, 23 bp, Homo sapiens
ccactggactgggttttgtctct

SEQ ID NO: 6721343 - DNA, 20 bp, Homo sapiens
ccactggacttgagcttggc

SEQ ID NO: 6721344 - DNA, 11 bp, Homo sapiens
ccactggaggt

SEQ ID NO: 6721345 - DNA, 21 bp, Homo sapiens
ccactggatcctgctgctttg

SEQ ID NO: 6721346 - DNA, 21 bp, Homo sapiens
ccactggcacttgcctgctgc

SEQ ID NO: 6721347 - DNA, 16 bp, Homo sapiens
ccactggcatcgcagc

SEQ ID NO: 6721348 - DNA, 20 bp, Homo sapiens
ccactggcatcgcagcttcc

SEQ ID NO: 6721349 - DNA, 22 bp, Homo sapiens
ccactggcatcgcagcttcctg

SEQ ID NO: 6721350 - DNA, 11 bp, Homo sapiens
ccactggccac

SEQ ID NO: 6721351 - DNA, 16 bp, Homo sapiens
ccactggccaccaggc

SEQ ID NO: 6721352 - DNA, 18 bp, Homo sapiens
ccactggccaccaggctg

SEQ ID NO: 6721353 - DNA, 19 bp, Homo sapiens
ccactggccaccaggctgg

SEQ ID NO: 6721354 - DNA, 12 bp, Homo sapiens
ccactggccagt

SEQ ID NO: 6721355 - DNA, 24 bp, Homo sapiens
ccactggccagtcctagagctcct

SEQ ID NO: 6721356 - DNA, 11 bp, Homo sapiens
ccactggccat

SEQ ID NO: 6721357 - DNA, 14 bp, Homo sapiens
ccactggccctgtt

SEQ ID NO: 6721358 - DNA, 18 bp, Homo sapiens
ccactggccctgtttctc

SEQ ID NO: 6721359 - DNA, 19 bp, Homo sapiens
ccactggccgctgagcgcc

SEQ ID NO: 6721360 - DNA, 11 bp, Homo sapiens
ccactggcctg

SEQ ID NO: 6721361 - DNA, 16 bp, Homo sapiens
ccactggcctgcccgt

SEQ ID NO: 6721362 - DNA, 15 bp, Homo sapiens
ccactggctcctcca

SEQ ID NO: 6721363 - DNA, 19 bp, Homo sapiens
ccactggctcctcccagca

SEQ ID NO: 6721364 - DNA, 14 bp, Homo sapiens
ccactggctgagaa

SEQ ID NO: 6721365 - DNA, 21 bp, Homo sapiens
ccactggctgagaatctgggg

SEQ ID NO: 6721366 - DNA, 15 bp, Homo sapiens
ccactggctgctaac

SEQ ID NO: 6721367 - DNA, 16 bp, Homo sapiens
ccactggctgctaaca

SEQ ID NO: 6721368 - DNA, 15 bp, Homo sapiens
ccactggctggagga

SEQ ID NO: 6721369 - DNA, 17 bp, Homo sapiens
ccactggctgtgcctcc

SEQ ID NO: 6721370 - DNA, 21 bp, Homo sapiens
ccactggctgtgcctcccccg

SEQ ID NO: 6721371 - DNA, 15 bp, Homo sapiens
ccactggctgtgggc

SEQ ID NO: 6721372 - DNA, 21 bp, Homo sapiens
ccactggctgtgggctccctt

SEQ ID NO: 6721373 - DNA, 22 bp, Homo sapiens
ccactggctgtgggctcccttc

SEQ ID NO: 6721374 - DNA, 17 bp, Homo sapiens
aaaaactaaaaactaga

SEQ ID NO: 6721375 - DNA, 13 bp, Homo sapiens
aaaaactaaagca

SEQ ID NO: 6721376 - DNA, 20 bp, Homo sapiens
aaaaactaaatctctaatat

SEQ ID NO: 6721377 - DNA, 20 bp, Homo sapiens
aaaaactaaatgtgaaatcc

SEQ ID NO: 6721378 - DNA, 19 bp, Homo sapiens
aaaaactacaaccaatgga

SEQ ID NO: 6721379 - DNA, 22 bp, Homo sapiens
aaaaactagaaggcttctctcc

SEQ ID NO: 6721380 - DNA, 18 bp, Homo sapiens
aaaaactcaaccaaatgg

SEQ ID NO: 6721381 - DNA, 22 bp, Homo sapiens
aaaaactcaaccaaatggtaca

SEQ ID NO: 6721382 - DNA, 23 bp, Homo sapiens
aaaaactcaattaaaattttgtt

SEQ ID NO: 6721383 - DNA, 22 bp, Homo sapiens
aaaaactcccatatcatataaa

SEQ ID NO: 6721384 - DNA, 14 bp, Homo sapiens
aaaaactcctgtgt

SEQ ID NO: 6721385 - DNA, 23 bp, Homo sapiens
aaaaactcctgtgtcggtcagaa

SEQ ID NO: 6721386 - DNA, 18 bp, Homo sapiens
aaaaactctctcccagga

SEQ ID NO: 6721387 - DNA, 14 bp, Homo sapiens
aaaaactcttcagt

SEQ ID NO: 6721388 - DNA, 14 bp, Homo sapiens
aaaaactgaaaaat

SEQ ID NO: 6721389 - DNA, 14 bp, Homo sapiens
aaaaactgaagatg

SEQ ID NO: 6721390 - DNA, 13 bp, Homo sapiens
aaaaactgaaggt

SEQ ID NO: 6721391 - DNA, 22 bp, Homo sapiens
aaaaactgatcaaaaataaact

SEQ ID NO: 6721392 - DNA, 15 bp, Homo sapiens
aaaaactgatttttt

SEQ ID NO: 6721393 - DNA, 23 bp, Homo sapiens
aaaaactgcctttgatacaggca

SEQ ID NO: 6721394 - DNA, 12 bp, Homo sapiens
aaaaactgctta

SEQ ID NO: 6721395 - DNA, 18 bp, Homo sapiens
aaaaactggccttttgat

SEQ ID NO: 6721396 - DNA, 21 bp, Homo sapiens
aaaaactggctttttcccagc

SEQ ID NO: 6721397 - DNA, 23 bp, Homo sapiens
aaaaactgggataactgatttct

SEQ ID NO: 6721398 - DNA, 12 bp, Homo sapiens
aaaaactgtgta

SEQ ID NO: 6721399 - DNA, 12 bp, Homo sapiens
aaaaacttacaa

SEQ ID NO: 6721400 - DNA, 14 bp, Homo sapiens
aaaaacttccattc

SEQ ID NO: 6721401 - DNA, 19 bp, Homo sapiens
aaaaacttccattctttct

SEQ ID NO: 6721402 - DNA, 15 bp, Homo sapiens
aaaaacttgaaaata

SEQ ID NO: 6721403 - DNA, 14 bp, Homo sapiens
aaaaacttggcact

SEQ ID NO: 6721404 - DNA, 12 bp, Homo sapiens
aaaaactttatt

SEQ ID NO: 6721405 - DNA, 13 bp, Homo sapiens
aaaaactttcatt

SEQ ID NO: 6721406 - DNA, 15 bp, Homo sapiens
aaaaactttccatga

SEQ ID NO: 6721407 - DNA, 19 bp, Homo sapiens
aaaaactttctctttgcca

SEQ ID NO: 6721408 - DNA, 23 bp, Homo sapiens
aaaaacttttcatttcagatttt

SEQ ID NO: 6721409 - DNA, 14 bp, Homo sapiens
aaaaacttttgagg

SEQ ID NO: 6721410 - DNA, 19 bp, Homo sapiens
aaaaacttttttctttgaa

SEQ ID NO: 6721411 - DNA, 10 bp, Homo sapiens
aaaaagaaaa

SEQ ID NO: 6721412 - DNA, 11 bp, Homo sapiens
aaaaagaaaaa

SEQ ID NO: 6721413 - DNA, 15 bp, Homo sapiens
aaaaagaaaaaaaga

SEQ ID NO: 6721414 - DNA, 12 bp, Homo sapiens
aaaaagaaaaac

SEQ ID NO: 6721415 - DNA, 18 bp, Homo sapiens
aaaaagaaaaatctcatt

SEQ ID NO: 6721416 - DNA, 12 bp, Homo sapiens
aaaaagaaaaca

SEQ ID NO: 6721417 - DNA, 14 bp, Homo sapiens
aaaaagaaacattg

SEQ ID NO: 6721418 - DNA, 16 bp, Homo sapiens
aaaaagaaacatttgg

SEQ ID NO: 6721419 - DNA, 12 bp, Homo sapiens
aaaaagaaactt

SEQ ID NO: 6721420 - DNA, 13 bp, Homo sapiens
aaaaagaaagaaa

SEQ ID NO: 6721421 - DNA, 18 bp, Homo sapiens
aaaaagaaagaaagagga

SEQ ID NO: 6721422 - DNA, 23 bp, Homo sapiens
aaaaagaaaggctgttaaataca

SEQ ID NO: 6721423 - DNA, 14 bp, Homo sapiens
aaaaagaaatcttg

SEQ ID NO: 6721424 - DNA, 14 bp, Homo sapiens
aaaaagaaatgaaa

SEQ ID NO: 6721425 - DNA, 12 bp, Homo sapiens
aaaaagaaatta

SEQ ID NO: 6721426 - DNA, 13 bp, Homo sapiens
aaaaagaaattgt

SEQ ID NO: 6721427 - DNA, 11 bp, Homo sapiens
aaaaagaacag

SEQ ID NO: 6721428 - DNA, 12 bp, Homo sapiens
aaaaagaagaag

SEQ ID NO: 6721429 - DNA, 12 bp, Homo sapiens
aaaaagaagagt

SEQ ID NO: 6721430 - DNA, 14 bp, Homo sapiens
aaaaagaagccaca

SEQ ID NO: 6721431 - DNA, 18 bp, Homo sapiens
aaaaagaagttactttgt

SEQ ID NO: 6721432 - DNA, 19 bp, Homo sapiens
aaaaagaagttactttgta

SEQ ID NO: 6721433 - DNA, 22 bp, Homo sapiens
aaaaagaatcggcagtattttc

SEQ ID NO: 6721434 - DNA, 13 bp, Homo sapiens
aaaaagacaaaaa

SEQ ID NO: 6721435 - DNA, 14 bp, Homo sapiens
aaaaagacctggcc

SEQ ID NO: 6721436 - DNA, 16 bp, Homo sapiens
aaaaagacgatgttta

SEQ ID NO: 6721437 - DNA, 17 bp, Homo sapiens
aaaaagacgatgtttat

SEQ ID NO: 6721438 - DNA, 15 bp, Homo sapiens
aaaaagactcttttt

SEQ ID NO: 6721439 - DNA, 18 bp, Homo sapiens
aaaaagactgaacatgtt

SEQ ID NO: 6721440 - DNA, 21 bp, Homo sapiens
aaaaagactgaacatgtttac

SEQ ID NO: 6721441 - DNA, 23 bp, Homo sapiens
aaaaagactgtcaaatgaacttt

SEQ ID NO: 6721442 - DNA, 14 bp, Homo sapiens
aaaaagacttcaaa

SEQ ID NO: 6721443 - DNA, 10 bp, Homo sapiens
aaaaagagaa

SEQ ID NO: 6721444 - DNA, 20 bp, Homo sapiens
aaaaagagaaaaaccaatga

SEQ ID NO: 6721445 - DNA, 19 bp, Homo sapiens
aaaaagagaattagattat

SEQ ID NO: 6721446 - DNA, 18 bp, Homo sapiens
aaaaagaggaaagaatga

SEQ ID NO: 6721447 - DNA, 21 bp, Homo sapiens
aaaaagaggagaaaagctcaa

SEQ ID NO: 6721448 - DNA, 12 bp, Homo sapiens
aaaaagaggcta

SEQ ID NO: 6721449 - DNA, 13 bp, Homo sapiens
aaaaagataaaca

SEQ ID NO: 6721450 - DNA, 19 bp, Homo sapiens
aaaaagataaacacaagat

SEQ ID NO: 6721451 - DNA, 10 bp, Homo sapiens
aaaaagatat

SEQ ID NO: 6721452 - DNA, 17 bp, Homo sapiens
aaaaagatatattaaaa

SEQ ID NO: 6721453 - DNA, 11 bp, Homo sapiens
aaaaagatccc

SEQ ID NO: 6721454 - DNA, 21 bp, Homo sapiens
aaaaagatgatcgctgtattt

SEQ ID NO: 6721455 - DNA, 20 bp, Homo sapiens
aaaaagatgttcagtcattt

SEQ ID NO: 6721456 - DNA, 15 bp, Homo sapiens
aaaaagattctacta

SEQ ID NO: 6721457 - DNA, 13 bp, Homo sapiens
aaaaagattcttt

SEQ ID NO: 6721458 - DNA, 15 bp, Homo sapiens
aaaaagattcttttt

SEQ ID NO: 6721459 - DNA, 22 bp, Homo sapiens
aaaaagatttaacaaatacatt

SEQ ID NO: 6721460 - DNA, 13 bp, Homo sapiens
aaaaagatttgtt

SEQ ID NO: 6721461 - DNA, 12 bp, Homo sapiens
aaaaagattttt

SEQ ID NO: 6721462 - DNA, 11 bp, Homo sapiens
aaaaagcaaaa

SEQ ID NO: 6721463 - DNA, 16 bp, Homo sapiens
aaaaagcaagaattct

SEQ ID NO: 6721464 - DNA, 23 bp, Homo sapiens
aaaaagcacaaagttctcagagc

SEQ ID NO: 6721465 - DNA, 13 bp, Homo sapiens
aaaaagcacagct

SEQ ID NO: 6721466 - DNA, 15 bp, Homo sapiens
aaaaagcacatacat

SEQ ID NO: 6721467 - DNA, 17 bp, Homo sapiens
aaaaagcactagtataa

SEQ ID NO: 6721468 - DNA, 22 bp, Homo sapiens
aaaaagcagaattttaatgtga

SEQ ID NO: 6721469 - DNA, 20 bp, Homo sapiens
aaaaagcagcagaggtgaga

SEQ ID NO: 6721470 - DNA, 16 bp, Homo sapiens
aaaaagcagtcctctt

SEQ ID NO: 6721471 - DNA, 15 bp, Homo sapiens
aaaaagcagtttttg

SEQ ID NO: 6721472 - DNA, 17 bp, Homo sapiens
aaaaagcataaaaacat

SEQ ID NO: 6721473 - DNA, 13 bp, Homo sapiens
aaaaagcatgaga

SEQ ID NO: 6721474 - DNA, 18 bp, Homo sapiens
aaaaagcatgatgggaaa

SEQ ID NO: 6721475 - DNA, 14 bp, Homo sapiens
aaaaagcatgtaca

SEQ ID NO: 6721476 - DNA, 20 bp, Homo sapiens
aaaaagcatgtacagtgttc

SEQ ID NO: 6721477 - DNA, 22 bp, Homo sapiens
aaaaagccaacaggtaaacaca

SEQ ID NO: 6721478 - DNA, 17 bp, Homo sapiens
aaaaagccagtttgggt

SEQ ID NO: 6721479 - DNA, 21 bp, Homo sapiens
aaaaagccctatgtgaaaaga

SEQ ID NO: 6721480 - DNA, 22 bp, Homo sapiens
aaaaagccctatgtgaaaagat

SEQ ID NO: 6721481 - DNA, 20 bp, Homo sapiens
aaaaagcctacattctccag

SEQ ID NO: 6721482 - DNA, 20 bp, Homo sapiens
aaaaagcctccaagggtttc

SEQ ID NO: 6721483 - DNA, 15 bp, Homo sapiens
aaaaagcctggtttt

SEQ ID NO: 6721484 - DNA, 12 bp, Homo sapiens
aaaaagccttac

SEQ ID NO: 6721485 - DNA, 19 bp, Homo sapiens
aaaaagcgctgtttccttg

SEQ ID NO: 6721486 - DNA, 16 bp, Homo sapiens
aaaaagctaacatctt

SEQ ID NO: 6721487 - DNA, 22 bp, Homo sapiens
aaaaagctaatgtgcagggata

SEQ ID NO: 6721488 - DNA, 14 bp, Homo sapiens
aaaaagctcactgc

SEQ ID NO: 6721489 - DNA, 20 bp, Homo sapiens
aaaaagctccaaatgcagct

SEQ ID NO: 6721490 - DNA, 14 bp, Homo sapiens
aaaaagctctgaaa

SEQ ID NO: 6721491 - DNA, 15 bp, Homo sapiens
aaaaagctctgaaaa

SEQ ID NO: 6721492 - DNA, 22 bp, Homo sapiens
aaaaagctgctatccaatgata

SEQ ID NO: 6721493 - DNA, 15 bp, Homo sapiens
aaaaagcttaaaact

SEQ ID NO: 6721494 - DNA, 19 bp, Homo sapiens
aaaaagcttaaaactttga

SEQ ID NO: 6721495 - DNA, 20 bp, Homo sapiens
aaaaagcttaaacattgcct

SEQ ID NO: 6721496 - DNA, 13 bp, Homo sapiens
aaaaagcttcccc

SEQ ID NO: 6721497 - DNA, 19 bp, Homo sapiens
aaaaagctttatgattttc

SEQ ID NO: 6721498 - DNA, 10 bp, Homo sapiens
aaaaaggaaa

SEQ ID NO: 6721499 - DNA, 18 bp, Homo sapiens
aaaaaggaaaaatgtaga

SEQ ID NO: 6721500 - DNA, 17 bp, Homo sapiens
aaaaaggaaacttcctt

SEQ ID NO: 6721501 - DNA, 20 bp, Homo sapiens
aaaaaggaaagaaaactaac

SEQ ID NO: 6721502 - DNA, 14 bp, Homo sapiens
aaaaaggaaatatt

SEQ ID NO: 6721503 - DNA, 15 bp, Homo sapiens
aaaaaggaaatattc

SEQ ID NO: 6721504 - DNA, 24 bp, Homo sapiens
aaaaaggaaatattctttctcata

SEQ ID NO: 6721505 - DNA, 11 bp, Homo sapiens
aaaaaggaagg

SEQ ID NO: 6721506 - DNA, 16 bp, Homo sapiens
aaaaaggacatcagca

SEQ ID NO: 6721507 - DNA, 22 bp, Homo sapiens
aaaaaggaccaactggcttctg

SEQ ID NO: 6721508 - DNA, 20 bp, Homo sapiens
aaaaaggactggaaaaatga

SEQ ID NO: 6721509 - DNA, 22 bp, Homo sapiens
aaaaaggatgaaagtctgagaa

SEQ ID NO: 6721510 - DNA, 21 bp, Homo sapiens
aaaaaggatgcacagagttgt

SEQ ID NO: 6721511 - DNA, 16 bp, Homo sapiens
aaaaaggcaagccaca

SEQ ID NO: 6721512 - DNA, 17 bp, Homo sapiens
aaaaaggcattgtttga

SEQ ID NO: 6721513 - DNA, 16 bp, Homo sapiens
aaaaaggccaaagata

SEQ ID NO: 6721514 - DNA, 14 bp, Homo sapiens
aaaaaggcctttgg

SEQ ID NO: 6721515 - DNA, 15 bp, Homo sapiens
aaaaaggcctttggg

SEQ ID NO: 6721516 - DNA, 22 bp, Homo sapiens
aaaaaggctagtttattttgtt

SEQ ID NO: 6721517 - DNA, 20 bp, Homo sapiens
aaaaaggcttataaaacaga

SEQ ID NO: 6721518 - DNA, 15 bp, Homo sapiens
aaaaagggagaaaga

SEQ ID NO: 6721519 - DNA, 23 bp, Homo sapiens
aaaaagggcttgaggtgaatttc

SEQ ID NO: 6721520 - DNA, 16 bp, Homo sapiens
aaaaaggggaggagaa

SEQ ID NO: 6721521 - DNA, 11 bp, Homo sapiens
aaaaagggtca

SEQ ID NO: 6721522 - DNA, 19 bp, Homo sapiens
aaaaagggtcaatgctatt

SEQ ID NO: 6721523 - DNA, 14 bp, Homo sapiens
aaaaaggtaaatgg

SEQ ID NO: 6721524 - DNA, 15 bp, Homo sapiens
aaaaaggtaactaac

SEQ ID NO: 6721525 - DNA, 18 bp, Homo sapiens
aaaaaggtagtttttctg

SEQ ID NO: 6721526 - DNA, 19 bp, Homo sapiens
aaaaaggttaacagtaaaa

SEQ ID NO: 6721527 - DNA, 21 bp, Homo sapiens
aaaaagtaagtaccactcagg

SEQ ID NO: 6721528 - DNA, 23 bp, Homo sapiens
aaaaagtaatgacttagaaactg

SEQ ID NO: 6721529 - DNA, 21 bp, Homo sapiens
aaaaagtacaatgaactgctt

SEQ ID NO: 6721530 - DNA, 22 bp, Homo sapiens
aaaaagtacatagtgaatttta

SEQ ID NO: 6721531 - DNA, 19 bp, Homo sapiens
aaaaagtagattaaaatat

SEQ ID NO: 6721532 - DNA, 20 bp, Homo sapiens
aaaaagtagcaaatgtttac

SEQ ID NO: 6721533 - DNA, 15 bp, Homo sapiens
aaaaagtaggctgcc

SEQ ID NO: 6721534 - DNA, 18 bp, Homo sapiens
aaaaagtatacttttgtt

SEQ ID NO: 6721535 - DNA, 13 bp, Homo sapiens
aaaaagtatatat

SEQ ID NO: 6721536 - DNA, 14 bp, Homo sapiens
aaaaagtatatatt

SEQ ID NO: 6721537 - DNA, 14 bp, Homo sapiens
aaaaagtattattt

SEQ ID NO: 6721538 - DNA, 15 bp, Homo sapiens
aaaaagtattatttt

SEQ ID NO: 6721539 - DNA, 21 bp, Homo sapiens
aaaaagtattgccaaacatta

SEQ ID NO: 6721540 - DNA, 13 bp, Homo sapiens
aaaaagtattttt

SEQ ID NO: 6721541 - DNA, 20 bp, Homo sapiens
aaaaagtcaatgtacttgtt

SEQ ID NO: 6721542 - DNA, 20 bp, Homo sapiens
aaaaagtccaattttaattt

SEQ ID NO: 6721543 - DNA, 18 bp, Homo sapiens
aaaaagtctaccaaagga

SEQ ID NO: 6721544 - DNA, 17 bp, Homo sapiens
aaaaagtctctatttaa

SEQ ID NO: 6721545 - DNA, 22 bp, Homo sapiens
aaaaagtctctatttaaattct

SEQ ID NO: 6721546 - DNA, 14 bp, Homo sapiens
aaaaagtcttttaa

SEQ ID NO: 6721547 - DNA, 16 bp, Homo sapiens
aaaaagtgaacttttg

SEQ ID NO: 6721548 - DNA, 22 bp, Homo sapiens
aaaaagtgaacttttgtaattt

SEQ ID NO: 6721549 - DNA, 16 bp, Homo sapiens
aaaaagtgattgtgaa

SEQ ID NO: 6721550 - DNA, 19 bp, Homo sapiens
aaaaagtggaatttcttgt

SEQ ID NO: 6721551 - DNA, 15 bp, Homo sapiens
aaaaagtggggcaga

SEQ ID NO: 6721552 - DNA, 20 bp, Homo sapiens
aaaaagtgggttttttagtt

SEQ ID NO: 6721553 - DNA, 14 bp, Homo sapiens
aaaaagtgtacatg

SEQ ID NO: 6721554 - DNA, 13 bp, Homo sapiens
aaaaagtgtttat

SEQ ID NO: 6721555 - DNA, 21 bp, Homo sapiens
ccactgggacagctggctggg

SEQ ID NO: 6721556 - DNA, 18 bp, Homo sapiens
ccactgggaccaaccctg

SEQ ID NO: 6721557 - DNA, 19 bp, Homo sapiens
ccactgggacccgaggatt

SEQ ID NO: 6721558 - DNA, 18 bp, Homo sapiens
ccactgggacggctcctg

SEQ ID NO: 6721559 - DNA, 21 bp, Homo sapiens
ccactgggacggctcctgctt

SEQ ID NO: 6721560 - DNA, 16 bp, Homo sapiens
ccactgggactcccag

SEQ ID NO: 6721561 - DNA, 19 bp, Homo sapiens
ccactgggactcccagcag

SEQ ID NO: 6721562 - DNA, 22 bp, Homo sapiens
ccactgggactcccagcagagc

SEQ ID NO: 6721563 - DNA, 23 bp, Homo sapiens
ccactgggactcccagcagagcc

SEQ ID NO: 6721564 - DNA, 11 bp, Homo sapiens
ccactgggaga

SEQ ID NO: 6721565 - DNA, 19 bp, Homo sapiens
ccactgggatagaggaatc

SEQ ID NO: 6721566 - DNA, 16 bp, Homo sapiens
ccactgggcccctcag

SEQ ID NO: 6721567 - DNA, 15 bp, Homo sapiens
ccactgggcccctgt

SEQ ID NO: 6721568 - DNA, 17 bp, Homo sapiens
ccactgggcccctgtcc

SEQ ID NO: 6721569 - DNA, 16 bp, Homo sapiens
ccactgggccctgggg

SEQ ID NO: 6721570 - DNA, 14 bp, Homo sapiens
ccactgggcctgct

SEQ ID NO: 6721571 - DNA, 15 bp, Homo sapiens
ccactgggcctgcta

SEQ ID NO: 6721572 - DNA, 19 bp, Homo sapiens
ccactgggctctggacctc

SEQ ID NO: 6721573 - DNA, 18 bp, Homo sapiens
ccactggggaatgctccc

SEQ ID NO: 6721574 - DNA, 18 bp, Homo sapiens
ccactggggactttattt

SEQ ID NO: 6721575 - DNA, 18 bp, Homo sapiens
ccactggggctcagagcc

SEQ ID NO: 6721576 - DNA, 15 bp, Homo sapiens
ccactgggtctcact

SEQ ID NO: 6721577 - DNA, 19 bp, Homo sapiens
ccactggttaaaataaagc

SEQ ID NO: 6721578 - DNA, 23 bp, Homo sapiens
ccactggttaaaataaagcctat

SEQ ID NO: 6721579 - DNA, 19 bp, Homo sapiens
ccactggtttctcagaatc

SEQ ID NO: 6721580 - DNA, 22 bp, Homo sapiens
ccactgtaatacgtagctctct

SEQ ID NO: 6721581 - DNA, 17 bp, Homo sapiens
ccactgtaattaaaact

SEQ ID NO: 6721582 - DNA, 18 bp, Homo sapiens
ccactgtacttgctcttg

SEQ ID NO: 6721583 - DNA, 20 bp, Homo sapiens
ccactgtacttgctcttgat

SEQ ID NO: 6721584 - DNA, 13 bp, Homo sapiens
ccactgtcacagg

SEQ ID NO: 6721585 - DNA, 15 bp, Homo sapiens
ccactgtcacaggca

SEQ ID NO: 6721586 - DNA, 18 bp, Homo sapiens
ccactgtccccctaccca

SEQ ID NO: 6721587 - DNA, 20 bp, Homo sapiens
ccactgtccccctacccacc

SEQ ID NO: 6721588 - DNA, 21 bp, Homo sapiens
ccactgtccccctacccaccg

SEQ ID NO: 6721589 - DNA, 22 bp, Homo sapiens
ccactgtccccctacccaccga

SEQ ID NO: 6721590 - DNA, 14 bp, Homo sapiens
ccactgtccctacc

SEQ ID NO: 6721591 - DNA, 17 bp, Homo sapiens
ccactgtccctgtcctt

SEQ ID NO: 6721592 - DNA, 14 bp, Homo sapiens
ccactgtccgcctc

SEQ ID NO: 6721593 - DNA, 15 bp, Homo sapiens
ccactgtccgcctct

SEQ ID NO: 6721594 - DNA, 17 bp, Homo sapiens
ccactgtccgctgtctc

SEQ ID NO: 6721595 - DNA, 22 bp, Homo sapiens
ccactgtcctaccagttgccct

SEQ ID NO: 6721596 - DNA, 12 bp, Homo sapiens
ccactgtcctgg

SEQ ID NO: 6721597 - DNA, 13 bp, Homo sapiens
ccactgtcctggg

SEQ ID NO: 6721598 - DNA, 15 bp, Homo sapiens
ccactgtcctgggcg

SEQ ID NO: 6721599 - DNA, 22 bp, Homo sapiens
ccactgtcctgggcgccctgga

SEQ ID NO: 6721600 - DNA, 17 bp, Homo sapiens
ccactgtcctttctcca

SEQ ID NO: 6721601 - DNA, 19 bp, Homo sapiens
ccactgtcctttctccagg

SEQ ID NO: 6721602 - DNA, 20 bp, Homo sapiens
ccactgtcctttctccaggc

SEQ ID NO: 6721603 - DNA, 22 bp, Homo sapiens
ccactgtctccacccaccttga

SEQ ID NO: 6721604 - DNA, 15 bp, Homo sapiens
ccactgtcttgcagt

SEQ ID NO: 6721605 - DNA, 18 bp, Homo sapiens
ccactgtcttgcagtgga

SEQ ID NO: 6721606 - DNA, 18 bp, Homo sapiens
ccactgtcttgcctgcca

SEQ ID NO: 6721607 - DNA, 19 bp, Homo sapiens
ccactgtcttgcctgccag

SEQ ID NO: 6721608 - DNA, 15 bp, Homo sapiens
ccactgtctttaaaa

SEQ ID NO: 6721609 - DNA, 15 bp, Homo sapiens
ccactgtctttttct

SEQ ID NO: 6721610 - DNA, 15 bp, Homo sapiens
ccactgtgaagagaa

SEQ ID NO: 6721611 - DNA, 16 bp, Homo sapiens
ccactgtgcaccaggc

SEQ ID NO: 6721612 - DNA, 17 bp, Homo sapiens
ccactgtgccactgact

SEQ ID NO: 6721613 - DNA, 15 bp, Homo sapiens
ccactgtgcctcaga

SEQ ID NO: 6721614 - DNA, 19 bp, Homo sapiens
ccactgtgcctcagagacc

SEQ ID NO: 6721615 - DNA, 20 bp, Homo sapiens
ccactgtgcctcagagacca

SEQ ID NO: 6721616 - DNA, 19 bp, Homo sapiens
ccactgtgcgtggggctcc

SEQ ID NO: 6721617 - DNA, 17 bp, Homo sapiens
ccactgtggaagtccct

SEQ ID NO: 6721618 - DNA, 20 bp, Homo sapiens
ccactgtggaagtccctcag

SEQ ID NO: 6721619 - DNA, 23 bp, Homo sapiens
ccactgtggaagtccctcagagg

SEQ ID NO: 6721620 - DNA, 17 bp, Homo sapiens
ccactgtggccttctca

SEQ ID NO: 6721621 - DNA, 16 bp, Homo sapiens
ccactgtggcgttctg

SEQ ID NO: 6721622 - DNA, 20 bp, Homo sapiens
ccactgtggggcaagcctga

SEQ ID NO: 6721623 - DNA, 18 bp, Homo sapiens
ccactgtgtactggagcc

SEQ ID NO: 6721624 - DNA, 23 bp, Homo sapiens
ccactgtgtactggagcctgcat

SEQ ID NO: 6721625 - DNA, 16 bp, Homo sapiens
ccactgtgtcccagtg

SEQ ID NO: 6721626 - DNA, 13 bp, Homo sapiens
ccactgtgtctct

SEQ ID NO: 6721627 - DNA, 14 bp, Homo sapiens
ccactgtgtctctg

SEQ ID NO: 6721628 - DNA, 15 bp, Homo sapiens
ccactgtgtctctgt

SEQ ID NO: 6721629 - DNA, 13 bp, Homo sapiens
ccactgtgttcct

SEQ ID NO: 6721630 - DNA, 23 bp, Homo sapiens
ccactgttcagcggagctgactg

SEQ ID NO: 6721631 - DNA, 19 bp, Homo sapiens
ccactgtttcatgagccca

SEQ ID NO: 6721632 - DNA, 18 bp, Homo sapiens
ccactgtttctcttgagc

SEQ ID NO: 6721633 - DNA, 22 bp, Homo sapiens
ccactgtttctcttgagctggc

SEQ ID NO: 6721634 - DNA, 20 bp, Homo sapiens
ccactgtttcttgcttgtac

SEQ ID NO: 6721635 - DNA, 15 bp, Homo sapiens
ccactgtttggaaat

SEQ ID NO: 6721636 - DNA, 16 bp, Homo sapiens
ccacttaaaaaatgtc

SEQ ID NO: 6721637 - DNA, 17 bp, Homo sapiens
ccacttaaaaaatgtcc

SEQ ID NO: 6721638 - DNA, 23 bp, Homo sapiens
ccacttaatcttctctcttgatt

SEQ ID NO: 6721639 - DNA, 18 bp, Homo sapiens
ccacttacagtgtgataa

SEQ ID NO: 6721640 - DNA, 21 bp, Homo sapiens
ccacttacatttacaaactga

SEQ ID NO: 6721641 - DNA, 19 bp, Homo sapiens
ccacttaccttcaataaag

SEQ ID NO: 6721642 - DNA, 19 bp, Homo sapiens
ccacttagaaattgcattt

SEQ ID NO: 6721643 - DNA, 16 bp, Homo sapiens
ccacttaggctttgta

SEQ ID NO: 6721644 - DNA, 20 bp, Homo sapiens
ccacttagtccactctgagt

SEQ ID NO: 6721645 - DNA, 17 bp, Homo sapiens
ccacttagtgctggtcc

SEQ ID NO: 6721646 - DNA, 17 bp, Homo sapiens
ccacttagttaaaattg

SEQ ID NO: 6721647 - DNA, 18 bp, Homo sapiens
ccacttagttttgggagg

SEQ ID NO: 6721648 - DNA, 15 bp, Homo sapiens
ccacttatagcctct

SEQ ID NO: 6721649 - DNA, 21 bp, Homo sapiens
ccacttatatcaacttatttt

SEQ ID NO: 6721650 - DNA, 22 bp, Homo sapiens
ccacttattccccattcttcct

SEQ ID NO: 6721651 - DNA, 17 bp, Homo sapiens
ccacttatttccatgga

SEQ ID NO: 6721652 - DNA, 16 bp, Homo sapiens
ccacttattttacatt

SEQ ID NO: 6721653 - DNA, 17 bp, Homo sapiens
ccacttcaagtgaccac

SEQ ID NO: 6721654 - DNA, 16 bp, Homo sapiens
ccacttcacagctgga

SEQ ID NO: 6721655 - DNA, 14 bp, Homo sapiens
ccacttcaccccca

SEQ ID NO: 6721656 - DNA, 19 bp, Homo sapiens
ccacttcacccccaacttc

SEQ ID NO: 6721657 - DNA, 13 bp, Homo sapiens
ccacttcaccttc

SEQ ID NO: 6721658 - DNA, 14 bp, Homo sapiens
ccacttcactgtga

SEQ ID NO: 6721659 - DNA, 17 bp, Homo sapiens
ccacttcactttcttca

SEQ ID NO: 6721660 - DNA, 13 bp, Homo sapiens
ccacttcagctga

SEQ ID NO: 6721661 - DNA, 14 bp, Homo sapiens
ccacttcaggagcc

SEQ ID NO: 6721662 - DNA, 16 bp, Homo sapiens
ccacttcaggagccct

SEQ ID NO: 6721663 - DNA, 22 bp, Homo sapiens
ccacttcatgcccactgccgat

SEQ ID NO: 6721664 - DNA, 17 bp, Homo sapiens
ccacttcattccagcag

SEQ ID NO: 6721665 - DNA, 20 bp, Homo sapiens
ccacttcattccagcagctg

SEQ ID NO: 6721666 - DNA, 21 bp, Homo sapiens
ccacttcattcttgaaagctg

SEQ ID NO: 6721667 - DNA, 18 bp, Homo sapiens
ccacttccaggggaacct

SEQ ID NO: 6721668 - DNA, 19 bp, Homo sapiens
ccacttccaggggaacctg

SEQ ID NO: 6721669 - DNA, 14 bp, Homo sapiens
ccacttccaggtct

SEQ ID NO: 6721670 - DNA, 14 bp, Homo sapiens
ccacttcccaggta

SEQ ID NO: 6721671 - DNA, 21 bp, Homo sapiens
ccacttcccatctccagggaa

SEQ ID NO: 6721672 - DNA, 22 bp, Homo sapiens
ccacttcccatctccagggaag

SEQ ID NO: 6721673 - DNA, 16 bp, Homo sapiens
ccacttccccacactt

SEQ ID NO: 6721674 - DNA, 19 bp, Homo sapiens
ccacttcccctcctacccc

SEQ ID NO: 6721675 - DNA, 17 bp, Homo sapiens
ccacttcccgtttcctc

SEQ ID NO: 6721676 - DNA, 12 bp, Homo sapiens
ccacttccctca

SEQ ID NO: 6721677 - DNA, 17 bp, Homo sapiens
ccacttccctgcaaggt

SEQ ID NO: 6721678 - DNA, 23 bp, Homo sapiens
ccacttccctgggttagactgcc

SEQ ID NO: 6721679 - DNA, 21 bp, Homo sapiens
ccacttcctcctacctgggga

SEQ ID NO: 6721680 - DNA, 22 bp, Homo sapiens
ccacttcctcctacctggggac

SEQ ID NO: 6721681 - DNA, 10 bp, Homo sapiens
ccacttcctt

SEQ ID NO: 6721682 - DNA, 12 bp, Homo sapiens
ccacttccttaa

SEQ ID NO: 6721683 - DNA, 17 bp, Homo sapiens
ccacttccttaacagct

SEQ ID NO: 6721684 - DNA, 20 bp, Homo sapiens
ccacttccttaacagctgta

SEQ ID NO: 6721685 - DNA, 23 bp, Homo sapiens
ccacttcctttcctactgtcctg

SEQ ID NO: 6721686 - DNA, 19 bp, Homo sapiens
ccacttcctttgtgtttat

SEQ ID NO: 6721687 - DNA, 21 bp, Homo sapiens
ccacttcctttgtgtttatat

SEQ ID NO: 6721688 - DNA, 15 bp, Homo sapiens
ccacttcgcacacac

SEQ ID NO: 6721689 - DNA, 20 bp, Homo sapiens
ccacttctcatcacacacat

SEQ ID NO: 6721690 - DNA, 14 bp, Homo sapiens
ccacttctccatgc

SEQ ID NO: 6721691 - DNA, 12 bp, Homo sapiens
ccacttctcccc

SEQ ID NO: 6721692 - DNA, 13 bp, Homo sapiens
ccacttctcccca

SEQ ID NO: 6721693 - DNA, 18 bp, Homo sapiens
ccacttctctactctgga

SEQ ID NO: 6721694 - DNA, 19 bp, Homo sapiens
ccacttctctactctggaa

SEQ ID NO: 6721695 - DNA, 13 bp, Homo sapiens
ccacttctctcca

SEQ ID NO: 6721696 - DNA, 12 bp, Homo sapiens
ccacttctctgc

SEQ ID NO: 6721697 - DNA, 13 bp, Homo sapiens
ccacttctctgct

SEQ ID NO: 6721698 - DNA, 19 bp, Homo sapiens
ccacttctctgctgcctct

SEQ ID NO: 6721699 - DNA, 13 bp, Homo sapiens
ccacttctctggg

SEQ ID NO: 6721700 - DNA, 15 bp, Homo sapiens
ccacttctctgggtc

SEQ ID NO: 6721701 - DNA, 19 bp, Homo sapiens
ccacttctctgggtcccgg

SEQ ID NO: 6721702 - DNA, 14 bp, Homo sapiens
ccacttctgacagc

SEQ ID NO: 6721703 - DNA, 16 bp, Homo sapiens
ccacttctgacagcct

SEQ ID NO: 6721704 - DNA, 18 bp, Homo sapiens
ccacttctgacagcctca

SEQ ID NO: 6721705 - DNA, 13 bp, Homo sapiens
ccacttctgccag

SEQ ID NO: 6721706 - DNA, 22 bp, Homo sapiens
ccacttctgcgggctccctcct

SEQ ID NO: 6721707 - DNA, 23 bp, Homo sapiens
ccacttctgcgggctccctcctc

SEQ ID NO: 6721708 - DNA, 13 bp, Homo sapiens
ccacttctggcat

SEQ ID NO: 6721709 - DNA, 15 bp, Homo sapiens
ccacttctggccaca

SEQ ID NO: 6721710 - DNA, 17 bp, Homo sapiens
ccacttctggccacatc

SEQ ID NO: 6721711 - DNA, 18 bp, Homo sapiens
ccacttctggtcaatcaa

SEQ ID NO: 6721712 - DNA, 18 bp, Homo sapiens
ccacttctggtcccctgt

SEQ ID NO: 6721713 - DNA, 21 bp, Homo sapiens
ccacttctggtcccctgtggt

SEQ ID NO: 6721714 - DNA, 14 bp, Homo sapiens
ccacttctgtgcca

SEQ ID NO: 6721715 - DNA, 15 bp, Homo sapiens
ccacttctgtgggca

SEQ ID NO: 6721716 - DNA, 23 bp, Homo sapiens
ccacttctgtgggcatggccgct

SEQ ID NO: 6721717 - DNA, 17 bp, Homo sapiens
ccacttctgtgtagaca

SEQ ID NO: 6721718 - DNA, 19 bp, Homo sapiens
ccacttcttaaaggcctgg

SEQ ID NO: 6721719 - DNA, 17 bp, Homo sapiens
ccacttcttcctttctc

SEQ ID NO: 6721720 - DNA, 18 bp, Homo sapiens
ccacttcttcctttctct

SEQ ID NO: 6721721 - DNA, 22 bp, Homo sapiens
ccacttcttcctttctctttct

SEQ ID NO: 6721722 - DNA, 12 bp, Homo sapiens
ccacttcttggt

SEQ ID NO: 6721723 - DNA, 15 bp, Homo sapiens
ccacttgacattcct

SEQ ID NO: 6721724 - DNA, 16 bp, Homo sapiens
ccacttgacattcctt

SEQ ID NO: 6721725 - DNA, 15 bp, Homo sapiens
ccacttgacctgaga

SEQ ID NO: 6721726 - DNA, 15 bp, Homo sapiens
ccacttgaggcctga

SEQ ID NO: 6721727 - DNA, 18 bp, Homo sapiens
ccacttgaggcctgatct

SEQ ID NO: 6721728 - DNA, 20 bp, Homo sapiens
ccacttgaggcctgatctgc

SEQ ID NO: 6721729 - DNA, 16 bp, Homo sapiens
ccacttgaggctggca

SEQ ID NO: 6721730 - DNA, 16 bp, Homo sapiens
ccacttgatgtctgag

SEQ ID NO: 6721731 - DNA, 21 bp, Homo sapiens
ccacttgcactgtgcttgctc

SEQ ID NO: 6721732 - DNA, 15 bp, Homo sapiens
ccacttgccagggct

SEQ ID NO: 6721733 - DNA, 16 bp, Homo sapiens
ccacttgccagggctc

SEQ ID NO: 6721734 - DNA, 14 bp, Homo sapiens
ccacttgccctgtg

SEQ ID NO: 6721735 - DNA, 12 bp, Homo sapiens
ccacttgcctct

SEQ ID NO: 6721736 - DNA, 14 bp, Homo sapiens
ccacttgcctgggg

SEQ ID NO: 6721737 - DNA, 12 bp, Homo sapiens
ccacttgccttt

SEQ ID NO: 6721738 - DNA, 14 bp, Homo sapiens
ccacttgctcagac

SEQ ID NO: 6721739 - DNA, 21 bp, Homo sapiens
ccacttgctgcactcttgcac

SEQ ID NO: 6721740 - DNA, 18 bp, Homo sapiens
ccacttggacatgggccc

SEQ ID NO: 6721741 - DNA, 13 bp, Homo sapiens
ccacttggccacc

SEQ ID NO: 6721742 - DNA, 15 bp, Homo sapiens
ccacttggccaccag

SEQ ID NO: 6721743 - DNA, 22 bp, Homo sapiens
ccacttggcccagaaagctgcg

SEQ ID NO: 6721744 - DNA, 16 bp, Homo sapiens
ccacttgggtcttccc

SEQ ID NO: 6721745 - DNA, 17 bp, Homo sapiens
ccacttgggtcttccct

SEQ ID NO: 6721746 - DNA, 16 bp, Homo sapiens
ccacttggtctgtgag

SEQ ID NO: 6721747 - DNA, 19 bp, Homo sapiens
ccacttggtctgtgagatg

SEQ ID NO: 6721748 - DNA, 10 bp, Homo sapiens
ccacttgtat

SEQ ID NO: 6721749 - DNA, 22 bp, Homo sapiens
ccacttgtcatccataaagcaa

SEQ ID NO: 6721750 - DNA, 17 bp, Homo sapiens
ccacttgtccatgtgaa

SEQ ID NO: 6721751 - DNA, 15 bp, Homo sapiens
ccacttgtgggcttc

SEQ ID NO: 6721752 - DNA, 22 bp, Homo sapiens
ccacttgtgggcttcaggtgtt

SEQ ID NO: 6721753 - DNA, 19 bp, Homo sapiens
ccacttgttcattctgtga

SEQ ID NO: 6721754 - DNA, 19 bp, Homo sapiens
ccactttacccacctagaa

SEQ ID NO: 6721755 - DNA, 14 bp, Homo sapiens
ccactttattgcca

SEQ ID NO: 6721756 - DNA, 21 bp, Homo sapiens
ccactttcaagacagatgagc

SEQ ID NO: 6721757 - DNA, 19 bp, Homo sapiens
ccactttcaagctgcactg

SEQ ID NO: 6721758 - DNA, 18 bp, Homo sapiens
ccactttcacgtggcctc

SEQ ID NO: 6721759 - DNA, 13 bp, Homo sapiens
ccactttcagagc

SEQ ID NO: 6721760 - DNA, 22 bp, Homo sapiens
ccactttcagagcccccagccc

SEQ ID NO: 6721761 - DNA, 17 bp, Homo sapiens
ccactttcagctgtctt

SEQ ID NO: 6721762 - DNA, 20 bp, Homo sapiens
ccactttccaagtcactgca

SEQ ID NO: 6721763 - DNA, 15 bp, Homo sapiens
ccactttccagcctg

SEQ ID NO: 6721764 - DNA, 14 bp, Homo sapiens
ccactttcccttcc

SEQ ID NO: 6721765 - DNA, 17 bp, Homo sapiens
ccactttcctctctctc

SEQ ID NO: 6721766 - DNA, 14 bp, Homo sapiens
ccactttcctgagc

SEQ ID NO: 6721767 - DNA, 24 bp, Homo sapiens
ccactttcctgagctgtcgctgcc

SEQ ID NO: 6721768 - DNA, 23 bp, Homo sapiens
ccactttccttttctattccttc

SEQ ID NO: 6721769 - DNA, 13 bp, Homo sapiens
ccactttcgcctc

SEQ ID NO: 6721770 - DNA, 20 bp, Homo sapiens
ccactttcgcctcctccagc

SEQ ID NO: 6721771 - DNA, 15 bp, Homo sapiens
ccactttctgttcct

SEQ ID NO: 6721772 - DNA, 15 bp, Homo sapiens
ccactttgactcaga

SEQ ID NO: 6721773 - DNA, 23 bp, Homo sapiens
ccactttgactcagaggctggga

SEQ ID NO: 6721774 - DNA, 15 bp, Homo sapiens
ccactttgagagggc

SEQ ID NO: 6721775 - DNA, 20 bp, Homo sapiens
ccactttgcacagctctccg

SEQ ID NO: 6721776 - DNA, 18 bp, Homo sapiens
ccactttgcagacctggg

SEQ ID NO: 6721777 - DNA, 13 bp, Homo sapiens
ccactttgctggt

SEQ ID NO: 6721778 - DNA, 17 bp, Homo sapiens
ccactttgctgttcctt

SEQ ID NO: 6721779 - DNA, 17 bp, Homo sapiens
ccactttggcctccgtt

SEQ ID NO: 6721780 - DNA, 20 bp, Homo sapiens
ccactttggcttctcctgtg

SEQ ID NO: 6721781 - DNA, 18 bp, Homo sapiens
ccactttggtcccgtgca

SEQ ID NO: 6721782 - DNA, 21 bp, Homo sapiens
ccactttggtcccgtgcagct

SEQ ID NO: 6721783 - DNA, 15 bp, Homo sapiens
ccactttgtaatttt

SEQ ID NO: 6721784 - DNA, 17 bp, Homo sapiens
ccactttgtataaattt

SEQ ID NO: 6721785 - DNA, 13 bp, Homo sapiens
ccactttgtccat

SEQ ID NO: 6721786 - DNA, 17 bp, Homo sapiens
ccactttgtctgtacat

SEQ ID NO: 6721787 - DNA, 18 bp, Homo sapiens
ccactttgtctgtacata

SEQ ID NO: 6721788 - DNA, 14 bp, Homo sapiens
ccactttgttggaa

SEQ ID NO: 6721789 - DNA, 20 bp, Homo sapiens
ccactttgttggcccttcca

SEQ ID NO: 6721790 - DNA, 13 bp, Homo sapiens
ccacttttattta

SEQ ID NO: 6721791 - DNA, 13 bp, Homo sapiens
ccacttttcattg

SEQ ID NO: 6721792 - DNA, 17 bp, Homo sapiens
ccacttttccagtattt

SEQ ID NO: 6721793 - DNA, 12 bp, Homo sapiens
ccacttttctag

SEQ ID NO: 6721794 - DNA, 19 bp, Homo sapiens
ccacttttctagttaactt

SEQ ID NO: 6721795 - DNA, 16 bp, Homo sapiens
ccacttttcttcttcc

SEQ ID NO: 6721796 - DNA, 17 bp, Homo sapiens
ccacttttcttcttcct

SEQ ID NO: 6721797 - DNA, 21 bp, Homo sapiens
ccacttttgttcttggtttgt

SEQ ID NO: 6721798 - DNA, 12 bp, Homo sapiens
ccactttttaac

SEQ ID NO: 6721799 - DNA, 13 bp, Homo sapiens
ccactttttgcag

SEQ ID NO: 6721800 - DNA, 14 bp, Homo sapiens
ccactttttgcagc

SEQ ID NO: 6721801 - DNA, 16 bp, Homo sapiens
ccactttttgcagctt

SEQ ID NO: 6721802 - DNA, 17 bp, Homo sapiens
ccactttttgcagcttt

SEQ ID NO: 6721803 - DNA, 14 bp, Homo sapiens
ccagaaaaaaggac

SEQ ID NO: 6721804 - DNA, 20 bp, Homo sapiens
ccagaaaaaagtgtttataa

SEQ ID NO: 6721805 - DNA, 18 bp, Homo sapiens
ccagaaaaactggctctg

SEQ ID NO: 6721806 - DNA, 22 bp, Homo sapiens
ccagaaaaactggctctgattg

SEQ ID NO: 6721807 - DNA, 14 bp, Homo sapiens
ccagaaaaagaaga

SEQ ID NO: 6721808 - DNA, 23 bp, Homo sapiens
ccagaaaaataaatgtcactgcc

SEQ ID NO: 6721809 - DNA, 16 bp, Homo sapiens
ccagaaaaatgaaaag

SEQ ID NO: 6721810 - DNA, 20 bp, Homo sapiens
ccagaaaaatgaaaagcaat

SEQ ID NO: 6721811 - DNA, 17 bp, Homo sapiens
ccagaaaacctccagta

SEQ ID NO: 6721812 - DNA, 14 bp, Homo sapiens
ccagaaaaggacag

SEQ ID NO: 6721813 - DNA, 17 bp, Homo sapiens
ccagaaaatatgatata

SEQ ID NO: 6721814 - DNA, 23 bp, Homo sapiens
ccagaaaatatgatatatatgta

SEQ ID NO: 6721815 - DNA, 15 bp, Homo sapiens
ccagaaacagctgct

SEQ ID NO: 6721816 - DNA, 15 bp, Homo sapiens
ccagaaacagtggga

SEQ ID NO: 6721817 - DNA, 13 bp, Homo sapiens
ccagaaacatctc

SEQ ID NO: 6721818 - DNA, 16 bp, Homo sapiens
ccagaaaccaaactag

SEQ ID NO: 6721819 - DNA, 18 bp, Homo sapiens
ccagaaacctgggagaga

SEQ ID NO: 6721820 - DNA, 22 bp, Homo sapiens
ccagaaactcctgtttctcctt

SEQ ID NO: 6721821 - DNA, 12 bp, Homo sapiens
ccagaaagaaaa

SEQ ID NO: 6721822 - DNA, 16 bp, Homo sapiens
ccagaaagaaaatgaa

SEQ ID NO: 6721823 - DNA, 19 bp, Homo sapiens
ccagaaagaaggacacttg

SEQ ID NO: 6721824 - DNA, 14 bp, Homo sapiens
ccagaaagaggaat

SEQ ID NO: 6721825 - DNA, 21 bp, Homo sapiens
ccagaaagaggaataaaatga

SEQ ID NO: 6721826 - DNA, 21 bp, Homo sapiens
ccagaaagcagttgagacaag

SEQ ID NO: 6721827 - DNA, 22 bp, Homo sapiens
ccagaaagccccacccaggcca

SEQ ID NO: 6721828 - DNA, 15 bp, Homo sapiens
ccagaaagccctctt

SEQ ID NO: 6721829 - DNA, 21 bp, Homo sapiens
ccagaaagcctcctgccccct

SEQ ID NO: 6721830 - DNA, 21 bp, Homo sapiens
ccagaaagcctctctctccct

SEQ ID NO: 6721831 - DNA, 15 bp, Homo sapiens
ccagaaaggatattt

SEQ ID NO: 6721832 - DNA, 23 bp, Homo sapiens
ccagaaaggatatttaagaaaat

SEQ ID NO: 6721833 - DNA, 16 bp, Homo sapiens
ccagaaagggtgccag

SEQ ID NO: 6721834 - DNA, 12 bp, Homo sapiens
ccagaaaggtga

SEQ ID NO: 6721835 - DNA, 22 bp, Homo sapiens
ccagaaaggtgtgaggagagag

SEQ ID NO: 6721836 - DNA, 15 bp, Homo sapiens
ccagaaagtaaaggt

SEQ ID NO: 6721837 - DNA, 18 bp, Homo sapiens
ccagaaagtcccccctcg

SEQ ID NO: 6721838 - DNA, 16 bp, Homo sapiens
ccagaaatcactgtga

SEQ ID NO: 6721839 - DNA, 23 bp, Homo sapiens
ccagaaatgggcagttctcccag

SEQ ID NO: 6721840 - DNA, 22 bp, Homo sapiens
ccagaaattattggtatatttg

SEQ ID NO: 6721841 - DNA, 15 bp, Homo sapiens
ccagaaattccagta

SEQ ID NO: 6721842 - DNA, 19 bp, Homo sapiens
ccagaaattctggcccagc

SEQ ID NO: 6721843 - DNA, 14 bp, Homo sapiens
ccagaacagcatgg

SEQ ID NO: 6721844 - DNA, 15 bp, Homo sapiens
ccagaacagcatggc

SEQ ID NO: 6721845 - DNA, 15 bp, Homo sapiens
ccagaacagtatgaa

SEQ ID NO: 6721846 - DNA, 13 bp, Homo sapiens
ccagaaccagtta

SEQ ID NO: 6721847 - DNA, 21 bp, Homo sapiens
ccagaaccccaactcccagcc

SEQ ID NO: 6721848 - DNA, 16 bp, Homo sapiens
ccagaacctcagcatt

SEQ ID NO: 6721849 - DNA, 24 bp, Homo sapiens
ccagaacctctaagtgctgctgtg

SEQ ID NO: 6721850 - DNA, 14 bp, Homo sapiens
ccagaacctgtcct

SEQ ID NO: 6721851 - DNA, 23 bp, Homo sapiens
ccagaacgcaccccactgggaga

SEQ ID NO: 6721852 - DNA, 15 bp, Homo sapiens
ccagaacgccctgtg

SEQ ID NO: 6721853 - DNA, 17 bp, Homo sapiens
ccagaacgccctgtgtc

SEQ ID NO: 6721854 - DNA, 13 bp, Homo sapiens
ccagaacgggcct

SEQ ID NO: 6721855 - DNA, 15 bp, Homo sapiens
ccagaacgggcctcc

SEQ ID NO: 6721856 - DNA, 17 bp, Homo sapiens
ccagaacgggcctcccc

SEQ ID NO: 6721857 - DNA, 16 bp, Homo sapiens
ccagaacgtggtttgc

SEQ ID NO: 6721858 - DNA, 16 bp, Homo sapiens
ccagaactctgcctgc

SEQ ID NO: 6721859 - DNA, 20 bp, Homo sapiens
ccagaactctgcctgccctt

SEQ ID NO: 6721860 - DNA, 22 bp, Homo sapiens
ccagaactgaggtcactgggtt

SEQ ID NO: 6721861 - DNA, 22 bp, Homo sapiens
ccagaactggctgggcccctgg

SEQ ID NO: 6721862 - DNA, 15 bp, Homo sapiens
ccagaactttttcct

SEQ ID NO: 6721863 - DNA, 18 bp, Homo sapiens
ccagaactttttcctctc

SEQ ID NO: 6721864 - DNA, 22 bp, Homo sapiens
ccagaagaaaatagtggtgtga

SEQ ID NO: 6721865 - DNA, 18 bp, Homo sapiens
ccagaagaaaattctcct

SEQ ID NO: 6721866 - DNA, 18 bp, Homo sapiens
ccagaagaagagaagctg

SEQ ID NO: 6721867 - DNA, 19 bp, Homo sapiens
ccagaagaagagaagctgc

SEQ ID NO: 6721868 - DNA, 22 bp, Homo sapiens
ccagaagaagagaagctgctga

SEQ ID NO: 6721869 - DNA, 21 bp, Homo sapiens
ccagaagaagggtggagtcag

SEQ ID NO: 6721870 - DNA, 17 bp, Homo sapiens
ccagaagaatattcagg

SEQ ID NO: 6721871 - DNA, 19 bp, Homo sapiens
ccagaagacaaaggcccaa

SEQ ID NO: 6721872 - DNA, 23 bp, Homo sapiens
ccagaagacctcccttcaggtgc

SEQ ID NO: 6721873 - DNA, 15 bp, Homo sapiens
ccagaagagaattca

SEQ ID NO: 6721874 - DNA, 17 bp, Homo sapiens
ccagaagagaattcagt

SEQ ID NO: 6721875 - DNA, 22 bp, Homo sapiens
ccagaagagaattcagtatttt

SEQ ID NO: 6721876 - DNA, 14 bp, Homo sapiens
ccagaagagcccat

SEQ ID NO: 6721877 - DNA, 18 bp, Homo sapiens
ccagaagatcccctcagg

SEQ ID NO: 6721878 - DNA, 21 bp, Homo sapiens
ccagaagatgtattcagagcc

SEQ ID NO: 6721879 - DNA, 14 bp, Homo sapiens
ccagaagattagca

SEQ ID NO: 6721880 - DNA, 14 bp, Homo sapiens
ccagaagcagcagc

SEQ ID NO: 6721881 - DNA, 15 bp, Homo sapiens
ccagaagcagtaata

SEQ ID NO: 6721882 - DNA, 10 bp, Homo sapiens
ccagaagcct

SEQ ID NO: 6721883 - DNA, 21 bp, Homo sapiens
ccagaagcctccttacattaa

SEQ ID NO: 6721884 - DNA, 19 bp, Homo sapiens
ccagaagcctctggctaga

SEQ ID NO: 6721885 - DNA, 17 bp, Homo sapiens
ccagaagctcccccagc

SEQ ID NO: 6721886 - DNA, 18 bp, Homo sapiens
ccagaagctcccccagca

SEQ ID NO: 6721887 - DNA, 19 bp, Homo sapiens
ccagaagctcccccagcaa

SEQ ID NO: 6721888 - DNA, 22 bp, Homo sapiens
ccagaaggaacccggtcccagg

SEQ ID NO: 6721889 - DNA, 17 bp, Homo sapiens
ccagaaggagacaggca

SEQ ID NO: 6721890 - DNA, 16 bp, Homo sapiens
ccagaaggagggcaga

SEQ ID NO: 6721891 - DNA, 17 bp, Homo sapiens
ccagaaggagggcagag

SEQ ID NO: 6721892 - DNA, 20 bp, Homo sapiens
ccagaaggcaatcaagagct

SEQ ID NO: 6721893 - DNA, 17 bp, Homo sapiens
ccagaaggcagcaaaga

SEQ ID NO: 6721894 - DNA, 19 bp, Homo sapiens
ccagaaggctgggtccagg

SEQ ID NO: 6721895 - DNA, 22 bp, Homo sapiens
ccagaaggggcacgcctgccca

SEQ ID NO: 6721896 - DNA, 22 bp, Homo sapiens
ccagaaggggctgcttgctttt

SEQ ID NO: 6721897 - DNA, 15 bp, Homo sapiens
ccagaagggggccat

SEQ ID NO: 6721898 - DNA, 14 bp, Homo sapiens
ccagaaggggtttg

SEQ ID NO: 6721899 - DNA, 20 bp, Homo sapiens
ccagaagtattgtttacatt

SEQ ID NO: 6721900 - DNA, 15 bp, Homo sapiens
ccagaagtccctccc

SEQ ID NO: 6721901 - DNA, 20 bp, Homo sapiens
ccagaagtgaatgggaaagg

SEQ ID NO: 6721902 - DNA, 14 bp, Homo sapiens
ccagaagtggcagg

SEQ ID NO: 6721903 - DNA, 15 bp, Homo sapiens
ccagaagtggcagga

SEQ ID NO: 6721904 - DNA, 16 bp, Homo sapiens
ccagaagtgtgactgg

SEQ ID NO: 6721905 - DNA, 23 bp, Homo sapiens
ccagaagttgtggatttcagttt

SEQ ID NO: 6721906 - DNA, 22 bp, Homo sapiens
ccagaagtttgagatcagcctg

SEQ ID NO: 6721907 - DNA, 23 bp, Homo sapiens
ccagaagtttgagatcagcctgg

SEQ ID NO: 6721908 - DNA, 16 bp, Homo sapiens
ccagaataaacccagc

SEQ ID NO: 6721909 - DNA, 14 bp, Homo sapiens
ccagaataagtgct

SEQ ID NO: 6721910 - DNA, 20 bp, Homo sapiens
ccagaatcagattcaggagc

SEQ ID NO: 6721911 - DNA, 14 bp, Homo sapiens
ccagaatcccagcc

SEQ ID NO: 6721912 - DNA, 15 bp, Homo sapiens
ccagaatcccctggg

SEQ ID NO: 6721913 - DNA, 17 bp, Homo sapiens
ccagaatccctctaacc

SEQ ID NO: 6721914 - DNA, 16 bp, Homo sapiens
ccagaatctaaagcca

SEQ ID NO: 6721915 - DNA, 17 bp, Homo sapiens
ccagaatctgctgttgc

SEQ ID NO: 6721916 - DNA, 17 bp, Homo sapiens
ccagaatcttgactttc

SEQ ID NO: 6721917 - DNA, 15 bp, Homo sapiens
ccagaatgaccttga

SEQ ID NO: 6721918 - DNA, 20 bp, Homo sapiens
ccagaatgaggcacatgaca

SEQ ID NO: 6721919 - DNA, 22 bp, Homo sapiens
ccagaatgctgaactccttgtt

SEQ ID NO: 6721920 - DNA, 16 bp, Homo sapiens
ccagaatgctgtacat

SEQ ID NO: 6721921 - DNA, 17 bp, Homo sapiens
ccagaatgctgtacatc

SEQ ID NO: 6721922 - DNA, 16 bp, Homo sapiens
ccagaatgctttagga

SEQ ID NO: 6721923 - DNA, 21 bp, Homo sapiens
ccagaatgtcagattcctttc

SEQ ID NO: 6721924 - DNA, 23 bp, Homo sapiens
ccagaatgttactgactcctcag

SEQ ID NO: 6721925 - DNA, 16 bp, Homo sapiens
ccagaattaaagacct

SEQ ID NO: 6721926 - DNA, 20 bp, Homo sapiens
ccagaattagtcctcacagc

SEQ ID NO: 6721927 - DNA, 12 bp, Homo sapiens
ccagaattccct

SEQ ID NO: 6721928 - DNA, 22 bp, Homo sapiens
ccagaattcccttgaattgtgt

SEQ ID NO: 6721929 - DNA, 18 bp, Homo sapiens
ccagaattgtcctcaagg

SEQ ID NO: 6721930 - DNA, 19 bp, Homo sapiens
ccagaatttaccatcatct

SEQ ID NO: 6721931 - DNA, 21 bp, Homo sapiens
ccagaatttaccatcatctct

SEQ ID NO: 6721932 - DNA, 18 bp, Homo sapiens
ccagaatttcccaaagca

SEQ ID NO: 6721933 - DNA, 15 bp, Homo sapiens
ccagaatttggaaat

SEQ ID NO: 6721934 - DNA, 17 bp, Homo sapiens
ccagaatttggaaatcc

SEQ ID NO: 6721935 - DNA, 18 bp, Homo sapiens
ccagaatttggaaatcct

SEQ ID NO: 6721936 - DNA, 21 bp, Homo sapiens
ccagaatttggaaatcctagt

SEQ ID NO: 6721937 - DNA, 21 bp, Homo sapiens
ccagacaaagatgtcttaacc

SEQ ID NO: 6721938 - DNA, 20 bp, Homo sapiens
ccagacaaataggagtgagt

SEQ ID NO: 6721939 - DNA, 22 bp, Homo sapiens
ccagacaacgggcccatggcct

SEQ ID NO: 6721940 - DNA, 22 bp, Homo sapiens
ccagacaaggaaatacccttct

SEQ ID NO: 6721941 - DNA, 18 bp, Homo sapiens
ccagacaaggagagcgga

SEQ ID NO: 6721942 - DNA, 21 bp, Homo sapiens
ccagacacagactggcaataa

SEQ ID NO: 6721943 - DNA, 23 bp, Homo sapiens
ccagacacagactggcaataaac

SEQ ID NO: 6721944 - DNA, 12 bp, Homo sapiens
ccagacacagag

SEQ ID NO: 6721945 - DNA, 20 bp, Homo sapiens
ccagacacagagacatggga

SEQ ID NO: 6721946 - DNA, 14 bp, Homo sapiens
ccagacacagccca

SEQ ID NO: 6721947 - DNA, 17 bp, Homo sapiens
ccagacacaggccgtgg

SEQ ID NO: 6721948 - DNA, 22 bp, Homo sapiens
ccagacacattctcctgtgccc

SEQ ID NO: 6721949 - DNA, 14 bp, Homo sapiens
ccagacaccatcac

SEQ ID NO: 6721950 - DNA, 16 bp, Homo sapiens
ccagacaccatgtgca

SEQ ID NO: 6721951 - DNA, 20 bp, Homo sapiens
ccagacaccatgtgcaataa

SEQ ID NO: 6721952 - DNA, 10 bp, Homo sapiens
ccagacaccc

SEQ ID NO: 6721953 - DNA, 15 bp, Homo sapiens
ccagacacccaggac

SEQ ID NO: 6721954 - DNA, 21 bp, Homo sapiens
ccagacaccttgacagggcac

SEQ ID NO: 6721955 - DNA, 15 bp, Homo sapiens
ccagacactctgctc

SEQ ID NO: 6721956 - DNA, 23 bp, Homo sapiens
ccagacactgaccatccactcta

SEQ ID NO: 6721957 - DNA, 21 bp, Homo sapiens
ccagacagaccttcacagatg

SEQ ID NO: 6721958 - DNA, 18 bp, Homo sapiens
ccagacagagatcagaat

SEQ ID NO: 6721959 - DNA, 17 bp, Homo sapiens
ccagacagagggtcaca

SEQ ID NO: 6721960 - DNA, 23 bp, Homo sapiens
ccagacagagggtcacagtgttt

SEQ ID NO: 6721961 - DNA, 18 bp, Homo sapiens
ccagacagagtggatctg

SEQ ID NO: 6721962 - DNA, 14 bp, Homo sapiens
ccagacagatacag

SEQ ID NO: 6721963 - DNA, 18 bp, Homo sapiens
ccagacagcaaggtgtgg

SEQ ID NO: 6721964 - DNA, 23 bp, Homo sapiens
ccagacagcaaggtgtggaggct

SEQ ID NO: 6721965 - DNA, 13 bp, Homo sapiens
ccagacagcctgt

SEQ ID NO: 6721966 - DNA, 13 bp, Homo sapiens
ccagacagctgct

SEQ ID NO: 6721967 - DNA, 16 bp, Homo sapiens
ccagacagctgctcag

SEQ ID NO: 6721968 - DNA, 19 bp, Homo sapiens
ccagacagctgctcagagc

SEQ ID NO: 6721969 - DNA, 20 bp, Homo sapiens
ccagacagcttgactgcttt

SEQ ID NO: 6721970 - DNA, 22 bp, Homo sapiens
ccagacaggaggagtgggacag

SEQ ID NO: 6721971 - DNA, 12 bp, Homo sapiens
ccagacaggccc

SEQ ID NO: 6721972 - DNA, 13 bp, Homo sapiens
ccagacagggctc

SEQ ID NO: 6721973 - DNA, 16 bp, Homo sapiens
ccagacagggctccag

SEQ ID NO: 6721974 - DNA, 19 bp, Homo sapiens
ccagacagggctccagcct

SEQ ID NO: 6721975 - DNA, 20 bp, Homo sapiens
ccagacagggctccagcctg

SEQ ID NO: 6721976 - DNA, 15 bp, Homo sapiens
ccagacatcaccctt

SEQ ID NO: 6721977 - DNA, 14 bp, Homo sapiens
ccagacatgctgcc

SEQ ID NO: 6721978 - DNA, 17 bp, Homo sapiens
ccagacatgctgcccac

SEQ ID NO: 6721979 - DNA, 19 bp, Homo sapiens
ccagacatgtggtgggaca

SEQ ID NO: 6721980 - DNA, 23 bp, Homo sapiens
ccagacatgtggtgggacaggga

SEQ ID NO: 6721981 - DNA, 22 bp, Homo sapiens
ccagacattctcgcttccctga

SEQ ID NO: 6721982 - DNA, 14 bp, Homo sapiens
ccagaccaaagcaa

SEQ ID NO: 6721983 - DNA, 17 bp, Homo sapiens
ccagaccaaccctggga

SEQ ID NO: 6721984 - DNA, 19 bp, Homo sapiens
ccagaccaaccctgggacc

SEQ ID NO: 6721985 - DNA, 14 bp, Homo sapiens
ccagaccacagcag

SEQ ID NO: 6721986 - DNA, 12 bp, Homo sapiens
ccagaccacctg

SEQ ID NO: 6721987 - DNA, 17 bp, Homo sapiens
ccagaccacctgccagc

SEQ ID NO: 6721988 - DNA, 20 bp, Homo sapiens
ccagaccacctgccagccat

SEQ ID NO: 6721989 - DNA, 22 bp, Homo sapiens
ccagaccacctgccagccatca

SEQ ID NO: 6721990 - DNA, 15 bp, Homo sapiens
ccagaccagattaaa

SEQ ID NO: 6721991 - DNA, 16 bp, Homo sapiens
ccagaccaggaaaggc

SEQ ID NO: 6721992 - DNA, 15 bp, Homo sapiens
ccagaccagtagtga

SEQ ID NO: 6721993 - DNA, 18 bp, Homo sapiens
ccagaccagtagtgacca

SEQ ID NO: 6721994 - DNA, 19 bp, Homo sapiens
ccagaccagtagtgaccaa

SEQ ID NO: 6721995 - DNA, 14 bp, Homo sapiens
ccagaccatgggcc

SEQ ID NO: 6721996 - DNA, 15 bp, Homo sapiens
ccagaccattgtctt

SEQ ID NO: 6721997 - DNA, 17 bp, Homo sapiens
ccagacccacctggagc

SEQ ID NO: 6721998 - DNA, 22 bp, Homo sapiens
ccagacccacctggagcccgct

SEQ ID NO: 6721999 - DNA, 13 bp, Homo sapiens
ccagacccactct

SEQ ID NO: 6722000 - DNA, 19 bp, Homo sapiens
ccagacccactctgcggcc

SEQ ID NO: 6722001 - DNA, 11 bp, Homo sapiens
ccagacccaga

SEQ ID NO: 6722002 - DNA, 15 bp, Homo sapiens
ccagacccagaggcc

SEQ ID NO: 6722003 - DNA, 17 bp, Homo sapiens
ccagacccagaggtcca

SEQ ID NO: 6722004 - DNA, 21 bp, Homo sapiens
ccagacccagcccgcggcctg

SEQ ID NO: 6722005 - DNA, 23 bp, Homo sapiens
ccagacccagcccgcggcctgga

SEQ ID NO: 6722006 - DNA, 13 bp, Homo sapiens
ccagacccagggc

SEQ ID NO: 6722007 - DNA, 14 bp, Homo sapiens
ccagacccagggca

SEQ ID NO: 6722008 - DNA, 21 bp, Homo sapiens
ccagacccatgtgctgggaaa

SEQ ID NO: 6722009 - DNA, 14 bp, Homo sapiens
ccagacccattcct

SEQ ID NO: 6722010 - DNA, 14 bp, Homo sapiens
ccagaccccagggc

SEQ ID NO: 6722011 - DNA, 20 bp, Homo sapiens
ccagaccccatccagccagg

SEQ ID NO: 6722012 - DNA, 12 bp, Homo sapiens
ccagacccccac

SEQ ID NO: 6722013 - DNA, 15 bp, Homo sapiens
ccagacccccacccc

SEQ ID NO: 6722014 - DNA, 19 bp, Homo sapiens
ccagacccccaccccttcc

SEQ ID NO: 6722015 - DNA, 22 bp, Homo sapiens
ccagacccccaccccttcccca

SEQ ID NO: 6722016 - DNA, 14 bp, Homo sapiens
ccagacccccagca

SEQ ID NO: 6722017 - DNA, 14 bp, Homo sapiens
ccagaccccccagc

SEQ ID NO: 6722018 - DNA, 21 bp, Homo sapiens
ccagaccccccagcccctcct

SEQ ID NO: 6722019 - DNA, 22 bp, Homo sapiens
ccagaccccccagcccctcctc

SEQ ID NO: 6722020 - DNA, 14 bp, Homo sapiens
ccagacccccttgc

SEQ ID NO: 6722021 - DNA, 21 bp, Homo sapiens
ccagacccccttgcccaggcc

SEQ ID NO: 6722022 - DNA, 21 bp, Homo sapiens
ccagaccccgcagcacgcctc

SEQ ID NO: 6722023 - DNA, 12 bp, Homo sapiens
ccagaccccgcc

SEQ ID NO: 6722024 - DNA, 17 bp, Homo sapiens
ccagaccccgtggctct

SEQ ID NO: 6722025 - DNA, 20 bp, Homo sapiens
ccagaccccgtggctctggg

SEQ ID NO: 6722026 - DNA, 21 bp, Homo sapiens
ccagaccccgtggctctggga

SEQ ID NO: 6722027 - DNA, 20 bp, Homo sapiens
ccagacccctctggccagga

SEQ ID NO: 6722028 - DNA, 23 bp, Homo sapiens
ccagacccctctggccaggatgg

SEQ ID NO: 6722029 - DNA, 15 bp, Homo sapiens
ccagacccctggctt

SEQ ID NO: 6722030 - DNA, 12 bp, Homo sapiens
ccagaccctcct

SEQ ID NO: 6722031 - DNA, 14 bp, Homo sapiens
ccagaccctgcctg

SEQ ID NO: 6722032 - DNA, 16 bp, Homo sapiens
ccagaccctgcctgag

SEQ ID NO: 6722033 - DNA, 19 bp, Homo sapiens
ccagaccctgcctgagccc

SEQ ID NO: 6722034 - DNA, 12 bp, Homo sapiens
ccagaccctggg

SEQ ID NO: 6722035 - DNA, 22 bp, Homo sapiens
ccagacccttcttgcctgctgg

SEQ ID NO: 6722036 - DNA, 17 bp, Homo sapiens
ccagacctagacctggg

SEQ ID NO: 6722037 - DNA, 22 bp, Homo sapiens
ccagacctctgaatgtcccaga

SEQ ID NO: 6722038 - DNA, 23 bp, Homo sapiens
ccagacctctgaatgtcccagag

SEQ ID NO: 6722039 - DNA, 20 bp, Homo sapiens
ccagacctgatcctggaggc

SEQ ID NO: 6722040 - DNA, 23 bp, Homo sapiens
ccagacctgatcctggaggccca

SEQ ID NO: 6722041 - DNA, 14 bp, Homo sapiens
ccagacctgcagac

SEQ ID NO: 6722042 - DNA, 21 bp, Homo sapiens
ccagacctgcagacgcccaga

SEQ ID NO: 6722043 - DNA, 20 bp, Homo sapiens
ccagacctgcccctccctct

SEQ ID NO: 6722044 - DNA, 21 bp, Homo sapiens
ccagacctgcctcttccccct

SEQ ID NO: 6722045 - DNA, 22 bp, Homo sapiens
ccagacctggaagaacaggcct

SEQ ID NO: 6722046 - DNA, 17 bp, Homo sapiens
ccagacctggcctctgc

SEQ ID NO: 6722047 - DNA, 19 bp, Homo sapiens
ccagacctggctccactct

SEQ ID NO: 6722048 - DNA, 20 bp, Homo sapiens
ccagacctggctccactctt

SEQ ID NO: 6722049 - DNA, 16 bp, Homo sapiens
ccagacctgggccctg

SEQ ID NO: 6722050 - DNA, 17 bp, Homo sapiens
ccagacctgggccctgg

SEQ ID NO: 6722051 - DNA, 19 bp, Homo sapiens
ccagacctgtcgtctctcc

SEQ ID NO: 6722052 - DNA, 19 bp, Homo sapiens
ccagaccttaagacactgt

SEQ ID NO: 6722053 - DNA, 13 bp, Homo sapiens
ccagacgatgtct

SEQ ID NO: 6722054 - DNA, 18 bp, Homo sapiens
ccagacgcacgtgggtct

SEQ ID NO: 6722055 - DNA, 23 bp, Homo sapiens
ccagacgcacgtgggtcttcagg

SEQ ID NO: 6722056 - DNA, 17 bp, Homo sapiens
ccagacgcatagactga

SEQ ID NO: 6722057 - DNA, 19 bp, Homo sapiens
ccagacgccttcctctctg

SEQ ID NO: 6722058 - DNA, 15 bp, Homo sapiens
ccagacggcacccac

SEQ ID NO: 6722059 - DNA, 15 bp, Homo sapiens
ccagacggctccact

SEQ ID NO: 6722060 - DNA, 16 bp, Homo sapiens
ccagacggttcaccag

SEQ ID NO: 6722061 - DNA, 17 bp, Homo sapiens
ccagacggttcaccagc

SEQ ID NO: 6722062 - DNA, 15 bp, Homo sapiens
ccagacgtcaggccc

SEQ ID NO: 6722063 - DNA, 22 bp, Homo sapiens
ccagacgtcaggccctgactcc

SEQ ID NO: 6722064 - DNA, 20 bp, Homo sapiens
ccagacgtggtgcttctcac

SEQ ID NO: 6722065 - DNA, 18 bp, Homo sapiens
ccagacgtggtggctcac

SEQ ID NO: 6722066 - DNA, 19 bp, Homo sapiens
ccagactaaaggatccaga

SEQ ID NO: 6722067 - DNA, 21 bp, Homo sapiens
ccagactaaaggatccagaga

SEQ ID NO: 6722068 - DNA, 19 bp, Homo sapiens
ccagactagacaccttctg

SEQ ID NO: 6722069 - DNA, 22 bp, Homo sapiens
ccagactcaaacggaggaagcc

SEQ ID NO: 6722070 - DNA, 21 bp, Homo sapiens
ccagactcacttgccattgcc

SEQ ID NO: 6722071 - DNA, 16 bp, Homo sapiens
ccagactcagagctct

SEQ ID NO: 6722072 - DNA, 14 bp, Homo sapiens
ccagactcagctgg

SEQ ID NO: 6722073 - DNA, 22 bp, Homo sapiens
ccagactcagctggaagtctac

SEQ ID NO: 6722074 - DNA, 14 bp, Homo sapiens
ccagactccaggcc

SEQ ID NO: 6722075 - DNA, 13 bp, Homo sapiens
ccagactcccttg

SEQ ID NO: 6722076 - DNA, 19 bp, Homo sapiens
ccagactccgcctgaggcc

SEQ ID NO: 6722077 - DNA, 15 bp, Homo sapiens
ccagactcctttcct

SEQ ID NO: 6722078 - DNA, 21 bp, Homo sapiens
ccagactcgttcttctgggaa

SEQ ID NO: 6722079 - DNA, 17 bp, Homo sapiens
ccagactctaggttata

SEQ ID NO: 6722080 - DNA, 12 bp, Homo sapiens
ccagactctcag

SEQ ID NO: 6722081 - DNA, 13 bp, Homo sapiens
ccagactctcagg

SEQ ID NO: 6722082 - DNA, 14 bp, Homo sapiens
ccagactctctgtg

SEQ ID NO: 6722083 - DNA, 13 bp, Homo sapiens
ccagactctgccc

SEQ ID NO: 6722084 - DNA, 19 bp, Homo sapiens
ccagactgaaccagagctg

SEQ ID NO: 6722085 - DNA, 21 bp, Homo sapiens
ccagactgaaccagagctgga

SEQ ID NO: 6722086 - DNA, 13 bp, Homo sapiens
ccagactgagctc

SEQ ID NO: 6722087 - DNA, 14 bp, Homo sapiens
ccagactgagctct

SEQ ID NO: 6722088 - DNA, 17 bp, Homo sapiens
ccagactgagctctcca

SEQ ID NO: 6722089 - DNA, 14 bp, Homo sapiens
ccagactgatgagc

SEQ ID NO: 6722090 - DNA, 16 bp, Homo sapiens
ccagactgatgagcac

SEQ ID NO: 6722091 - DNA, 17 bp, Homo sapiens
ccagactgatgagcaca

SEQ ID NO: 6722092 - DNA, 18 bp, Homo sapiens
ccagactgatgagcacat

SEQ ID NO: 6722093 - DNA, 18 bp, Homo sapiens
ccagactgcggagcagcc

SEQ ID NO: 6722094 - DNA, 19 bp, Homo sapiens
ccagactgcggagcagcct

SEQ ID NO: 6722095 - DNA, 20 bp, Homo sapiens
ccagactgcggagcagcctc

SEQ ID NO: 6722096 - DNA, 23 bp, Homo sapiens
ccagactgcggagcagcctccag

SEQ ID NO: 6722097 - DNA, 12 bp, Homo sapiens
ccagactgggcc

SEQ ID NO: 6722098 - DNA, 19 bp, Homo sapiens
ccagactgggcccaggcag

SEQ ID NO: 6722099 - DNA, 21 bp, Homo sapiens
ccagactgggcccaggcaggt

SEQ ID NO: 6722100 - DNA, 23 bp, Homo sapiens
ccagactgggcccaggcaggtct

SEQ ID NO: 6722101 - DNA, 13 bp, Homo sapiens
ccagactgtccag

SEQ ID NO: 6722102 - DNA, 15 bp, Homo sapiens
ccagactgtccaggg

SEQ ID NO: 6722103 - DNA, 17 bp, Homo sapiens
ccagactgtccagggaa

SEQ ID NO: 6722104 - DNA, 18 bp, Homo sapiens
ccagactgtctccacggc

SEQ ID NO: 6722105 - DNA, 13 bp, Homo sapiens
ccagactgtggag

SEQ ID NO: 6722106 - DNA, 15 bp, Homo sapiens
ccagactgttagaaa

SEQ ID NO: 6722107 - DNA, 19 bp, Homo sapiens
ccagacttcaaaaataaaa

SEQ ID NO: 6722108 - DNA, 17 bp, Homo sapiens
ccagacttcaaaaggaa

SEQ ID NO: 6722109 - DNA, 13 bp, Homo sapiens
ccagacttccttg

SEQ ID NO: 6722110 - DNA, 19 bp, Homo sapiens
ccagacttcgctattccca

SEQ ID NO: 6722111 - DNA, 23 bp, Homo sapiens
ccagacttcgctattcccaggca

SEQ ID NO: 6722112 - DNA, 14 bp, Homo sapiens
ccagacttctaaaa

SEQ ID NO: 6722113 - DNA, 20 bp, Homo sapiens
ccagacttctaaaataaatg

SEQ ID NO: 6722114 - DNA, 19 bp, Homo sapiens
ccagacttctctttcttat

SEQ ID NO: 6722115 - DNA, 15 bp, Homo sapiens
ccagacttgcttcct

SEQ ID NO: 6722116 - DNA, 19 bp, Homo sapiens
ccagacttggcctccagct

SEQ ID NO: 6722117 - DNA, 13 bp, Homo sapiens
ccagacttgtttc

SEQ ID NO: 6722118 - DNA, 15 bp, Homo sapiens
ccagacttgtttcct

SEQ ID NO: 6722119 - DNA, 21 bp, Homo sapiens
ccagactttacatgacacagc

SEQ ID NO: 6722120 - DNA, 18 bp, Homo sapiens
ccagactttctacacctg

SEQ ID NO: 6722121 - DNA, 19 bp, Homo sapiens
ccagagaaactgccacata

SEQ ID NO: 6722122 - DNA, 15 bp, Homo sapiens
ccagagaaagcaaag

SEQ ID NO: 6722123 - DNA, 16 bp, Homo sapiens
ccagagaaagcaaagg

SEQ ID NO: 6722124 - DNA, 18 bp, Homo sapiens
ccagagaaagcaaaggtg

SEQ ID NO: 6722125 - DNA, 21 bp, Homo sapiens
ccagagaaagcacaatttaaa

SEQ ID NO: 6722126 - DNA, 16 bp, Homo sapiens
ccagagaaagcgcaga

SEQ ID NO: 6722127 - DNA, 14 bp, Homo sapiens
ccagagaaaggaaa

SEQ ID NO: 6722128 - DNA, 16 bp, Homo sapiens
ccagagaaaggggagc

SEQ ID NO: 6722129 - DNA, 19 bp, Homo sapiens
ccagagaaaggggagccca

SEQ ID NO: 6722130 - DNA, 22 bp, Homo sapiens
ccagagaaagttggtgctgctc

SEQ ID NO: 6722131 - DNA, 12 bp, Homo sapiens
ccagagaacaag

SEQ ID NO: 6722132 - DNA, 21 bp, Homo sapiens
ccagagaacaatcactattct

SEQ ID NO: 6722133 - DNA, 16 bp, Homo sapiens
ccagagaagccccgca

SEQ ID NO: 6722134 - DNA, 17 bp, Homo sapiens
ccagagaagccccgcac

SEQ ID NO: 6722135 - DNA, 12 bp, Homo sapiens
ccagagaagcct

SEQ ID NO: 6722136 - DNA, 15 bp, Homo sapiens
ccagagaagcctcag

SEQ ID NO: 6722137 - DNA, 20 bp, Homo sapiens
ccagagaagcctcagtccct

SEQ ID NO: 6722138 - DNA, 16 bp, Homo sapiens
ccagagaagctcattt

SEQ ID NO: 6722139 - DNA, 10 bp, Homo sapiens
ccagagaagg

SEQ ID NO: 6722140 - DNA, 19 bp, Homo sapiens
ccagagaaggggtgtgcat

SEQ ID NO: 6722141 - DNA, 20 bp, Homo sapiens
ccagagaagtctggtcagag

SEQ ID NO: 6722142 - DNA, 22 bp, Homo sapiens
ccagagaagtctggtcagagcc

SEQ ID NO: 6722143 - DNA, 16 bp, Homo sapiens
ccagagaagtgacagg

SEQ ID NO: 6722144 - DNA, 17 bp, Homo sapiens
ccagagaatcagggcag

SEQ ID NO: 6722145 - DNA, 19 bp, Homo sapiens
ccagagaatcagggcaggc

SEQ ID NO: 6722146 - DNA, 14 bp, Homo sapiens
ccagagaatcttaa

SEQ ID NO: 6722147 - DNA, 18 bp, Homo sapiens
ccagagaatgctttgaaa

SEQ ID NO: 6722148 - DNA, 14 bp, Homo sapiens
ccagagacaagact

SEQ ID NO: 6722149 - DNA, 16 bp, Homo sapiens
ccagagacacaagcct

SEQ ID NO: 6722150 - DNA, 18 bp, Homo sapiens
ccagagacacaagccttc

SEQ ID NO: 6722151 - DNA, 19 bp, Homo sapiens
ccagagacacagcccccac

SEQ ID NO: 6722152 - DNA, 14 bp, Homo sapiens
ccagagacactgag

SEQ ID NO: 6722153 - DNA, 15 bp, Homo sapiens
ccagagacactgagc

SEQ ID NO: 6722154 - DNA, 18 bp, Homo sapiens
ccagagacactgagccag

SEQ ID NO: 6722155 - DNA, 19 bp, Homo sapiens
ccagagacactgagccagt

SEQ ID NO: 6722156 - DNA, 17 bp, Homo sapiens
ccagagacagaggatgt

SEQ ID NO: 6722157 - DNA, 13 bp, Homo sapiens
ccagagacaggga

SEQ ID NO: 6722158 - DNA, 21 bp, Homo sapiens
ccagagacagggaaaggtcag

SEQ ID NO: 6722159 - DNA, 20 bp, Homo sapiens
ccagagacatacttgaaggg

SEQ ID NO: 6722160 - DNA, 21 bp, Homo sapiens
ccagagacatgggcctcccac

SEQ ID NO: 6722161 - DNA, 14 bp, Homo sapiens
ccagagaccaaata

SEQ ID NO: 6722162 - DNA, 20 bp, Homo sapiens
ccagagaccaggctgtgtcc

SEQ ID NO: 6722163 - DNA, 20 bp, Homo sapiens
ccagagacccaacagcagtg

SEQ ID NO: 6722164 - DNA, 16 bp, Homo sapiens
ccagagacccagcgga

SEQ ID NO: 6722165 - DNA, 19 bp, Homo sapiens
ccagagacccctcaatccc

SEQ ID NO: 6722166 - DNA, 18 bp, Homo sapiens
ccagagacccggggatgg

SEQ ID NO: 6722167 - DNA, 18 bp, Homo sapiens
ccagagaccgtcctcacc

SEQ ID NO: 6722168 - DNA, 21 bp, Homo sapiens
ccagagaccgtcctcacccct

SEQ ID NO: 6722169 - DNA, 21 bp, Homo sapiens
ccagagacctgaggcagatga

SEQ ID NO: 6722170 - DNA, 21 bp, Homo sapiens
ccagagacctgctccagatcc

SEQ ID NO: 6722171 - DNA, 16 bp, Homo sapiens
ccagagacctttgccc

SEQ ID NO: 6722172 - DNA, 15 bp, Homo sapiens
ccagagaccttttct

SEQ ID NO: 6722173 - DNA, 14 bp, Homo sapiens
ccagagacgcccag

SEQ ID NO: 6722174 - DNA, 15 bp, Homo sapiens
ccagagacgcccagc

SEQ ID NO: 6722175 - DNA, 18 bp, Homo sapiens
ccagagacgcccagcccc

SEQ ID NO: 6722176 - DNA, 18 bp, Homo sapiens
ccagagactgggatggga

SEQ ID NO: 6722177 - DNA, 16 bp, Homo sapiens
ccagagactttgtaga

SEQ ID NO: 6722178 - DNA, 15 bp, Homo sapiens
ccagagagaaaaaga

SEQ ID NO: 6722179 - DNA, 16 bp, Homo sapiens
ccagagagaagagccc

SEQ ID NO: 6722180 - DNA, 19 bp, Homo sapiens
ccagagagaagagccccac

SEQ ID NO: 6722181 - DNA, 12 bp, Homo sapiens
ccagagagaagc

SEQ ID NO: 6722182 - DNA, 20 bp, Homo sapiens
ccagagagaagcaccccacc

SEQ ID NO: 6722183 - DNA, 17 bp, Homo sapiens
ccagagagaccctgcaa

SEQ ID NO: 6722184 - DNA, 18 bp, Homo sapiens
ccagagagaccctgccaa

SEQ ID NO: 6722185 - DNA, 20 bp, Homo sapiens
ccagagagagaagtgcccct

SEQ ID NO: 6722186 - DNA, 23 bp, Homo sapiens
ccagagagagaagtgcccctgct

SEQ ID NO: 6722187 - DNA, 17 bp, Homo sapiens
ccagagagagcaaggaa

SEQ ID NO: 6722188 - DNA, 13 bp, Homo sapiens
ccagagagaggag

SEQ ID NO: 6722189 - DNA, 14 bp, Homo sapiens
ccagagagaggatg

SEQ ID NO: 6722190 - DNA, 20 bp, Homo sapiens
ccagagagaggatgcagagg

SEQ ID NO: 6722191 - DNA, 19 bp, Homo sapiens
ccagagagaggatgtggaa

SEQ ID NO: 6722192 - DNA, 19 bp, Homo sapiens
ccagagagaggcgtcctgg

SEQ ID NO: 6722193 - DNA, 22 bp, Homo sapiens
ccagagagaggcgtcctggtga

SEQ ID NO: 6722194 - DNA, 19 bp, Homo sapiens
ccagagagaggggcctgca

SEQ ID NO: 6722195 - DNA, 20 bp, Homo sapiens
ccagagagaggggcctgcag

SEQ ID NO: 6722196 - DNA, 21 bp, Homo sapiens
ccagagagaggggcctgcagg

SEQ ID NO: 6722197 - DNA, 18 bp, Homo sapiens
ccagagagcaactctgag

SEQ ID NO: 6722198 - DNA, 20 bp, Homo sapiens
ccagagagcaactctgagat

SEQ ID NO: 6722199 - DNA, 21 bp, Homo sapiens
ccagagagcaactctgagatc

SEQ ID NO: 6722200 - DNA, 13 bp, Homo sapiens
ccagagagcaggc

SEQ ID NO: 6722201 - DNA, 16 bp, Homo sapiens
ccagagagcaggcagg

SEQ ID NO: 6722202 - DNA, 15 bp, Homo sapiens
ccagagagcagggga

SEQ ID NO: 6722203 - DNA, 23 bp, Homo sapiens
ccagagagcaggggagcttggga

SEQ ID NO: 6722204 - DNA, 13 bp, Homo sapiens
ccagagagcccga

SEQ ID NO: 6722205 - DNA, 13 bp, Homo sapiens
ccagagagcctcc

SEQ ID NO: 6722206 - DNA, 22 bp, Homo sapiens
ccagagagcctggtgctgctgc

SEQ ID NO: 6722207 - DNA, 20 bp, Homo sapiens
ccagagaggagcacctgaac

SEQ ID NO: 6722208 - DNA, 22 bp, Homo sapiens
ccagagaggctggatgacttgc

SEQ ID NO: 6722209 - DNA, 12 bp, Homo sapiens
ccagagagggaa

SEQ ID NO: 6722210 - DNA, 19 bp, Homo sapiens
ccagagagggaaaaggcag

SEQ ID NO: 6722211 - DNA, 20 bp, Homo sapiens
ccagagagggaaaaggcagg

SEQ ID NO: 6722212 - DNA, 23 bp, Homo sapiens
ccagagagggactgacacccatg

SEQ ID NO: 6722213 - DNA, 15 bp, Homo sapiens
ccagagagggcccag

SEQ ID NO: 6722214 - DNA, 17 bp, Homo sapiens
ccagagagggcccagct

SEQ ID NO: 6722215 - DNA, 19 bp, Homo sapiens
ccagagagggcccagctgt

SEQ ID NO: 6722216 - DNA, 23 bp, Homo sapiens
ccagagagggcccagctgtagcc

SEQ ID NO: 6722217 - DNA, 19 bp, Homo sapiens
ccagagaggggacatttcc

SEQ ID NO: 6722218 - DNA, 20 bp, Homo sapiens
ccagagaggggacatttccc

SEQ ID NO: 6722219 - DNA, 19 bp, Homo sapiens
ccagagagtggagagagca

SEQ ID NO: 6722220 - DNA, 21 bp, Homo sapiens
ccagagagtggagagagcagg

SEQ ID NO: 6722221 - DNA, 13 bp, Homo sapiens
ccagagatccaaa

SEQ ID NO: 6722222 - DNA, 19 bp, Homo sapiens
ccagagatgagtgtctgga

SEQ ID NO: 6722223 - DNA, 15 bp, Homo sapiens
ccagagatgcctcca

SEQ ID NO: 6722224 - DNA, 16 bp, Homo sapiens
ccagagatgcctccac

SEQ ID NO: 6722225 - DNA, 23 bp, Homo sapiens
ccagagatgcctccaccgctgcc

SEQ ID NO: 6722226 - DNA, 22 bp, Homo sapiens
ccagagatgggactgggagggc

SEQ ID NO: 6722227 - DNA, 15 bp, Homo sapiens
ccagagattcatttt

SEQ ID NO: 6722228 - DNA, 13 bp, Homo sapiens
ccagagcaaacag

SEQ ID NO: 6722229 - DNA, 17 bp, Homo sapiens
ccagagcaaacagaaaa

SEQ ID NO: 6722230 - DNA, 18 bp, Homo sapiens
ccagagcaaagggccagg

SEQ ID NO: 6722231 - DNA, 20 bp, Homo sapiens
ccagagcaagcttttttatt

SEQ ID NO: 6722232 - DNA, 22 bp, Homo sapiens
ccagagcacaagaaggccagcc

SEQ ID NO: 6722233 - DNA, 18 bp, Homo sapiens
ccagagcacaggagctgc

SEQ ID NO: 6722234 - DNA, 12 bp, Homo sapiens
ccagagcacccc

SEQ ID NO: 6722235 - DNA, 14 bp, Homo sapiens
ccagagcacctcag

SEQ ID NO: 6722236 - DNA, 15 bp, Homo sapiens
ccagagcacctcagg

SEQ ID NO: 6722237 - DNA, 20 bp, Homo sapiens
ccagagcacctcaggaccct

SEQ ID NO: 6722238 - DNA, 17 bp, Homo sapiens
ccagagcacctgctgtc

SEQ ID NO: 6722239 - DNA, 20 bp, Homo sapiens
ccagagcacctgctgtctgg

SEQ ID NO: 6722240 - DNA, 16 bp, Homo sapiens
ccagagcactgtatac

SEQ ID NO: 6722241 - DNA, 13 bp, Homo sapiens
ccagagcacttta

SEQ ID NO: 6722242 - DNA, 14 bp, Homo sapiens
ccagagcactttag

SEQ ID NO: 6722243 - DNA, 13 bp, Homo sapiens
ccagagcagagcc

SEQ ID NO: 6722244 - DNA, 22 bp, Homo sapiens
ccagagcagagtttacgggtct

SEQ ID NO: 6722245 - DNA, 15 bp, Homo sapiens
ccagagcagatgcag

SEQ ID NO: 6722246 - DNA, 16 bp, Homo sapiens
ccagagcagatgcaga

SEQ ID NO: 6722247 - DNA, 13 bp, Homo sapiens
ccagagcagctcc

SEQ ID NO: 6722248 - DNA, 14 bp, Homo sapiens
ccagagcagctcca

SEQ ID NO: 6722249 - DNA, 22 bp, Homo sapiens
ccagagcaggaaattcagccca

SEQ ID NO: 6722250 - DNA, 14 bp, Homo sapiens
ccagagcaggagac

SEQ ID NO: 6722251 - DNA, 17 bp, Homo sapiens
ccagagcaggagcccct

SEQ ID NO: 6722252 - DNA, 14 bp, Homo sapiens
ccagagcaggaggc

SEQ ID NO: 6722253 - DNA, 13 bp, Homo sapiens
ccagagcaggggc

SEQ ID NO: 6722254 - DNA, 14 bp, Homo sapiens
ccagagcaggggct

SEQ ID NO: 6722255 - DNA, 17 bp, Homo sapiens
ccagagcaggggctgct

SEQ ID NO: 6722256 - DNA, 18 bp, Homo sapiens
ccagagcaggggctgctg

SEQ ID NO: 6722257 - DNA, 22 bp, Homo sapiens
ccagagcaggggctgctggggg

SEQ ID NO: 6722258 - DNA, 12 bp, Homo sapiens
ccagagcagggt

SEQ ID NO: 6722259 - DNA, 14 bp, Homo sapiens
ccagagcagggtct

SEQ ID NO: 6722260 - DNA, 14 bp, Homo sapiens
ccagagcagggtgt

SEQ ID NO: 6722261 - DNA, 13 bp, Homo sapiens
ccagagcatctgc

SEQ ID NO: 6722262 - DNA, 19 bp, Homo sapiens
ccagagcatctgccccagg

SEQ ID NO: 6722263 - DNA, 22 bp, Homo sapiens
ccagagcatctgccccaggtac

SEQ ID NO: 6722264 - DNA, 21 bp, Homo sapiens
ccagagcattacgtgagccag

SEQ ID NO: 6722265 - DNA, 20 bp, Homo sapiens
ccagagcatttccaacacca

SEQ ID NO: 6722266 - DNA, 22 bp, Homo sapiens
ccagagcatttccaacaccaca

SEQ ID NO: 6722267 - DNA, 14 bp, Homo sapiens
ccagagccaacctg

SEQ ID NO: 6722268 - DNA, 14 bp, Homo sapiens
ccagagccacacat

SEQ ID NO: 6722269 - DNA, 14 bp, Homo sapiens
ccagagccacagtt

SEQ ID NO: 6722270 - DNA, 15 bp, Homo sapiens
ccagagccacagttc

SEQ ID NO: 6722271 - DNA, 17 bp, Homo sapiens
ccagagccactaccttt

SEQ ID NO: 6722272 - DNA, 22 bp, Homo sapiens
ccagagccagaaagggtgccag

SEQ ID NO: 6722273 - DNA, 12 bp, Homo sapiens
ccagagccagat

SEQ ID NO: 6722274 - DNA, 16 bp, Homo sapiens
ccagagccagatgcag

SEQ ID NO: 6722275 - DNA, 17 bp, Homo sapiens
ccagagccagatgcagg

SEQ ID NO: 6722276 - DNA, 18 bp, Homo sapiens
ccagagccagatgcagga

SEQ ID NO: 6722277 - DNA, 20 bp, Homo sapiens
ccagagccagatgcaggaca

SEQ ID NO: 6722278 - DNA, 14 bp, Homo sapiens
ccagagccagcctg

SEQ ID NO: 6722279 - DNA, 16 bp, Homo sapiens
ccagagccagcctggg

SEQ ID NO: 6722280 - DNA, 11 bp, Homo sapiens
ccagagccagg

SEQ ID NO: 6722281 - DNA, 15 bp, Homo sapiens
ccagagccagggctg

SEQ ID NO: 6722282 - DNA, 16 bp, Homo sapiens
ccagagccatgccagg

SEQ ID NO: 6722283 - DNA, 18 bp, Homo sapiens
ccagagccatgccaggct

SEQ ID NO: 6722284 - DNA, 14 bp, Homo sapiens
ccagagcccacctt

SEQ ID NO: 6722285 - DNA, 16 bp, Homo sapiens
ccagagcccaccttgg

SEQ ID NO: 6722286 - DNA, 22 bp, Homo sapiens
ccagagcccaccttggctcaag

SEQ ID NO: 6722287 - DNA, 15 bp, Homo sapiens
ccagagcccactcca

SEQ ID NO: 6722288 - DNA, 16 bp, Homo sapiens
ccagagcccagctcca

SEQ ID NO: 6722289 - DNA, 21 bp, Homo sapiens
ccagagcccagctcttgctct

SEQ ID NO: 6722290 - DNA, 14 bp, Homo sapiens
ccagagcccaggct

SEQ ID NO: 6722291 - DNA, 16 bp, Homo sapiens
ccagagcccatgctca

SEQ ID NO: 6722292 - DNA, 10 bp, Homo sapiens
ccagagcccc

SEQ ID NO: 6722293 - DNA, 16 bp, Homo sapiens
ccagagccccaagcag

SEQ ID NO: 6722294 - DNA, 17 bp, Homo sapiens
ccagagccccaagcagg

SEQ ID NO: 6722295 - DNA, 13 bp, Homo sapiens
ccagagccccaca

SEQ ID NO: 6722296 - DNA, 21 bp, Homo sapiens
ccagagcccctcctccagccc

SEQ ID NO: 6722297 - DNA, 20 bp, Homo sapiens
ccagagcccgtcagcgtggg

SEQ ID NO: 6722298 - DNA, 12 bp, Homo sapiens
ccagagccctgc

SEQ ID NO: 6722299 - DNA, 14 bp, Homo sapiens
ccagagccctgcag

SEQ ID NO: 6722300 - DNA, 15 bp, Homo sapiens
ccagagccctgcagt

SEQ ID NO: 6722301 - DNA, 16 bp, Homo sapiens
ccagagccctgcagtc

SEQ ID NO: 6722302 - DNA, 19 bp, Homo sapiens
ccagagccctgcagtcacg

SEQ ID NO: 6722303 - DNA, 20 bp, Homo sapiens
ccagagcccttcactgccat

SEQ ID NO: 6722304 - DNA, 22 bp, Homo sapiens
ccagagccggcatccttgcctg

SEQ ID NO: 6722305 - DNA, 23 bp, Homo sapiens
ccagagcctcaaatgagaaaatg

SEQ ID NO: 6722306 - DNA, 20 bp, Homo sapiens
ccagagcctccctcagccac

SEQ ID NO: 6722307 - DNA, 12 bp, Homo sapiens
ccagagcctctg

SEQ ID NO: 6722308 - DNA, 14 bp, Homo sapiens
ccagagcctgggcg

SEQ ID NO: 6722309 - DNA, 15 bp, Homo sapiens
ccagagcctgggcgc

SEQ ID NO: 6722310 - DNA, 16 bp, Homo sapiens
ccagagcctggggctc

SEQ ID NO: 6722311 - DNA, 17 bp, Homo sapiens
ccagagccttctcctgc

SEQ ID NO: 6722312 - DNA, 18 bp, Homo sapiens
ccagagccttctcctgcc

SEQ ID NO: 6722313 - DNA, 23 bp, Homo sapiens
ccagagccttctcctgcctacat

SEQ ID NO: 6722314 - DNA, 23 bp, Homo sapiens
ccagagcgaggaaaggattttac

SEQ ID NO: 6722315 - DNA, 17 bp, Homo sapiens
ccagagcggtatctctg

SEQ ID NO: 6722316 - DNA, 18 bp, Homo sapiens
ccagagcggtatctctgg

SEQ ID NO: 6722317 - DNA, 12 bp, Homo sapiens
ccagagctagtt

SEQ ID NO: 6722318 - DNA, 22 bp, Homo sapiens
ccagagctcatttcggggtcag

SEQ ID NO: 6722319 - DNA, 16 bp, Homo sapiens
ccagagctcccaggac

SEQ ID NO: 6722320 - DNA, 19 bp, Homo sapiens
ccagagctcccaggacgca

SEQ ID NO: 6722321 - DNA, 23 bp, Homo sapiens
ccagagctcccccgtggtgcctg

SEQ ID NO: 6722322 - DNA, 20 bp, Homo sapiens
ccagagctccgatgcccgcc

SEQ ID NO: 6722323 - DNA, 14 bp, Homo sapiens
ccagagctctgacc

SEQ ID NO: 6722324 - DNA, 16 bp, Homo sapiens
ccagagctctgaccca

SEQ ID NO: 6722325 - DNA, 23 bp, Homo sapiens
ccagagctctgacccacagcctc

SEQ ID NO: 6722326 - DNA, 13 bp, Homo sapiens
ccagagctctgga

SEQ ID NO: 6722327 - DNA, 21 bp, Homo sapiens
ccagagctctggagccacctg

SEQ ID NO: 6722328 - DNA, 12 bp, Homo sapiens
ccagagctgcca

SEQ ID NO: 6722329 - DNA, 19 bp, Homo sapiens
ccagagctgccacctgcct

SEQ ID NO: 6722330 - DNA, 14 bp, Homo sapiens
ccagagctgccagt

SEQ ID NO: 6722331 - DNA, 15 bp, Homo sapiens
ccagagctgcctccc

SEQ ID NO: 6722332 - DNA, 16 bp, Homo sapiens
ccagagctgcctcccc

SEQ ID NO: 6722333 - DNA, 21 bp, Homo sapiens
ccagagctgcctccccaatcc

SEQ ID NO: 6722334 - DNA, 13 bp, Homo sapiens
ccagagctgcctg

SEQ ID NO: 6722335 - DNA, 23 bp, Homo sapiens
ccagagctgcttccccgtcacct

SEQ ID NO: 6722336 - DNA, 13 bp, Homo sapiens
ccagagctggaag

SEQ ID NO: 6722337 - DNA, 17 bp, Homo sapiens
ccagagctggaaggcag

SEQ ID NO: 6722338 - DNA, 20 bp, Homo sapiens
ccagagctggaaggcagggc

SEQ ID NO: 6722339 - DNA, 12 bp, Homo sapiens
ccagagctggcc

SEQ ID NO: 6722340 - DNA, 20 bp, Homo sapiens
ccagagctggcgctcagcag

SEQ ID NO: 6722341 - DNA, 22 bp, Homo sapiens
ccagagctggcgctcagcagcc

SEQ ID NO: 6722342 - DNA, 14 bp, Homo sapiens
ccagagctgggagg

SEQ ID NO: 6722343 - DNA, 15 bp, Homo sapiens
ccagagctgggtgag

SEQ ID NO: 6722344 - DNA, 14 bp, Homo sapiens
ccagagctggtgga

SEQ ID NO: 6722345 - DNA, 18 bp, Homo sapiens
ccagagctggtggaccca

SEQ ID NO: 6722346 - DNA, 16 bp, Homo sapiens
ccagagctgtcctcct

SEQ ID NO: 6722347 - DNA, 23 bp, Homo sapiens
ccagagctgtctgaactcacgtg

SEQ ID NO: 6722348 - DNA, 14 bp, Homo sapiens
ccagagctgtgcca

SEQ ID NO: 6722349 - DNA, 15 bp, Homo sapiens
ccagagctgtgccag

SEQ ID NO: 6722350 - DNA, 17 bp, Homo sapiens
ccagagctgtgcctgct

SEQ ID NO: 6722351 - DNA, 20 bp, Homo sapiens
ccagagctgtgcctgctcag

SEQ ID NO: 6722352 - DNA, 21 bp, Homo sapiens
ccagagctgtttatggcctca

SEQ ID NO: 6722353 - DNA, 20 bp, Homo sapiens
ccagagctgtttggatacag

SEQ ID NO: 6722354 - DNA, 21 bp, Homo sapiens
ccagagcttattggccactgg

SEQ ID NO: 6722355 - DNA, 17 bp, Homo sapiens
ccagagcttctctgggc

SEQ ID NO: 6722356 - DNA, 21 bp, Homo sapiens
ccagagcttctctgggctgaa

SEQ ID NO: 6722357 - DNA, 22 bp, Homo sapiens
ccagagcttctctgggctgaat

SEQ ID NO: 6722358 - DNA, 17 bp, Homo sapiens
ccagaggaaatctgaat

SEQ ID NO: 6722359 - DNA, 17 bp, Homo sapiens
ccagaggaacctgaggc

SEQ ID NO: 6722360 - DNA, 18 bp, Homo sapiens
ccagaggaagaaaatgag

SEQ ID NO: 6722361 - DNA, 18 bp, Homo sapiens
ccagaggaaggaaaagga

SEQ ID NO: 6722362 - DNA, 22 bp, Homo sapiens
ccagaggaaggggccagaggct

SEQ ID NO: 6722363 - DNA, 23 bp, Homo sapiens
ccagaggaattgattgtcagcca

SEQ ID NO: 6722364 - DNA, 18 bp, Homo sapiens
ccagaggacaaggaagtg

SEQ ID NO: 6722365 - DNA, 16 bp, Homo sapiens
ccagaggacacaggca

SEQ ID NO: 6722366 - DNA, 18 bp, Homo sapiens
ccagaggacctgagactc

SEQ ID NO: 6722367 - DNA, 15 bp, Homo sapiens
ccagaggactcccaa

SEQ ID NO: 6722368 - DNA, 20 bp, Homo sapiens
ccagaggactcccaaccctg

SEQ ID NO: 6722369 - DNA, 16 bp, Homo sapiens
ccagaggactctgctt

SEQ ID NO: 6722370 - DNA, 22 bp, Homo sapiens
ccagaggactgtgatgccctgc

SEQ ID NO: 6722371 - DNA, 21 bp, Homo sapiens
ccagaggagagaggaccccct

SEQ ID NO: 6722372 - DNA, 21 bp, Homo sapiens
ccagaggagagctgctgggcc

SEQ ID NO: 6722373 - DNA, 22 bp, Homo sapiens
ccagaggagaggagacagacac

SEQ ID NO: 6722374 - DNA, 19 bp, Homo sapiens
ccagaggagagtggcctgg

SEQ ID NO: 6722375 - DNA, 22 bp, Homo sapiens
ccagaggagagtggcctgggtc

SEQ ID NO: 6722376 - DNA, 17 bp, Homo sapiens
ccagaggagccaccagt

SEQ ID NO: 6722377 - DNA, 12 bp, Homo sapiens
ccagaggagccc

SEQ ID NO: 6722378 - DNA, 16 bp, Homo sapiens
ccagaggagcccagcg

SEQ ID NO: 6722379 - DNA, 22 bp, Homo sapiens
ccagaggagcccagcggcccaa

SEQ ID NO: 6722380 - DNA, 15 bp, Homo sapiens
ccagaggagcctttt

SEQ ID NO: 6722381 - DNA, 17 bp, Homo sapiens
ccagaggagccttttta

SEQ ID NO: 6722382 - DNA, 21 bp, Homo sapiens
ccagaggagctgggagccggg

SEQ ID NO: 6722383 - DNA, 13 bp, Homo sapiens
ccagaggagggca

SEQ ID NO: 6722384 - DNA, 15 bp, Homo sapiens
ccagaggagggcaga

SEQ ID NO: 6722385 - DNA, 21 bp, Homo sapiens
ccagaggagggcagagggaga

SEQ ID NO: 6722386 - DNA, 16 bp, Homo sapiens
ccagaggaggtgcccg

SEQ ID NO: 6722387 - DNA, 23 bp, Homo sapiens
ccagaggatgctctttcccagga

SEQ ID NO: 6722388 - DNA, 21 bp, Homo sapiens
ccagaggcacagccggggcct

SEQ ID NO: 6722389 - DNA, 11 bp, Homo sapiens
ccagaggcaga

SEQ ID NO: 6722390 - DNA, 16 bp, Homo sapiens
ccagaggcagagcctg

SEQ ID NO: 6722391 - DNA, 13 bp, Homo sapiens
ccagaggcagagg

SEQ ID NO: 6722392 - DNA, 18 bp, Homo sapiens
ccagaggcagaggttgca

SEQ ID NO: 6722393 - DNA, 21 bp, Homo sapiens
ccagaggcagctaaggggcag

SEQ ID NO: 6722394 - DNA, 19 bp, Homo sapiens
ccagaggccaacactgtgg

SEQ ID NO: 6722395 - DNA, 12 bp, Homo sapiens
ccagaggccagg

SEQ ID NO: 6722396 - DNA, 19 bp, Homo sapiens
ccagaggcccccagcccag

SEQ ID NO: 6722397 - DNA, 15 bp, Homo sapiens
ccagaggccctgaag

SEQ ID NO: 6722398 - DNA, 13 bp, Homo sapiens
ccagaggccctgg

SEQ ID NO: 6722399 - DNA, 14 bp, Homo sapiens
ccagaggccctgga

SEQ ID NO: 6722400 - DNA, 21 bp, Homo sapiens
ccagaggccgaaggtgcctca

SEQ ID NO: 6722401 - DNA, 15 bp, Homo sapiens
ccagaggcctggtgc

SEQ ID NO: 6722402 - DNA, 13 bp, Homo sapiens
ccagaggctcctg

SEQ ID NO: 6722403 - DNA, 14 bp, Homo sapiens
ccagaggctcctgg

SEQ ID NO: 6722404 - DNA, 15 bp, Homo sapiens
ccagaggctcctgga

SEQ ID NO: 6722405 - DNA, 18 bp, Homo sapiens
ccagaggctcctggagcc

SEQ ID NO: 6722406 - DNA, 15 bp, Homo sapiens
ccagaggctggagac

SEQ ID NO: 6722407 - DNA, 17 bp, Homo sapiens
ccagaggctgggagtcc

SEQ ID NO: 6722408 - DNA, 13 bp, Homo sapiens
ccagagggacagg

SEQ ID NO: 6722409 - DNA, 13 bp, Homo sapiens
ccagagggactgg

SEQ ID NO: 6722410 - DNA, 17 bp, Homo sapiens
ccagagggactggacag

SEQ ID NO: 6722411 - DNA, 22 bp, Homo sapiens
ccagagggactggacagccagg

SEQ ID NO: 6722412 - DNA, 13 bp, Homo sapiens
ccagagggagcag

SEQ ID NO: 6722413 - DNA, 16 bp, Homo sapiens
ccagagggagctgtgg

SEQ ID NO: 6722414 - DNA, 16 bp, Homo sapiens
ccagagggagtgacag

SEQ ID NO: 6722415 - DNA, 18 bp, Homo sapiens
ccagagggagtgacagag

SEQ ID NO: 6722416 - DNA, 19 bp, Homo sapiens
ccagagggagtgacagagg

SEQ ID NO: 6722417 - DNA, 23 bp, Homo sapiens
ccagagggagtgacagaggcagc

SEQ ID NO: 6722418 - DNA, 23 bp, Homo sapiens
ccagagggcactcagaagttgtg

SEQ ID NO: 6722419 - DNA, 13 bp, Homo sapiens
ccagagggcagtg

SEQ ID NO: 6722420 - DNA, 13 bp, Homo sapiens
ccagagggcatgc

SEQ ID NO: 6722421 - DNA, 18 bp, Homo sapiens
ccagagggcatgctgaat

SEQ ID NO: 6722422 - DNA, 11 bp, Homo sapiens
ccagagggcca

SEQ ID NO: 6722423 - DNA, 12 bp, Homo sapiens
ccagagggccag

SEQ ID NO: 6722424 - DNA, 14 bp, Homo sapiens
ccagagggccagca

SEQ ID NO: 6722425 - DNA, 17 bp, Homo sapiens
ccagagggccagcaggc

SEQ ID NO: 6722426 - DNA, 19 bp, Homo sapiens
ccagagggccagcaggctc

SEQ ID NO: 6722427 - DNA, 13 bp, Homo sapiens
ccagagggcccag

SEQ ID NO: 6722428 - DNA, 17 bp, Homo sapiens
ccagagggcccaggcag

SEQ ID NO: 6722429 - DNA, 13 bp, Homo sapiens
ccagagggcccct

SEQ ID NO: 6722430 - DNA, 16 bp, Homo sapiens
ccagagggcccctcac

SEQ ID NO: 6722431 - DNA, 18 bp, Homo sapiens
ccagagggcccctcactg

SEQ ID NO: 6722432 - DNA, 23 bp, Homo sapiens
ccagaggggaaggagggtacagc

SEQ ID NO: 6722433 - DNA, 19 bp, Homo sapiens
ccagaggggacgctgagga

SEQ ID NO: 6722434 - DNA, 20 bp, Homo sapiens
ccagaggggacgctgaggaa

SEQ ID NO: 6722435 - DNA, 18 bp, Homo sapiens
ccagaggggcctgccacc

SEQ ID NO: 6722436 - DNA, 20 bp, Homo sapiens
ccagaggggcctgccacctg

SEQ ID NO: 6722437 - DNA, 21 bp, Homo sapiens
ccagaggggcggggccaggat

SEQ ID NO: 6722438 - DNA, 19 bp, Homo sapiens
ccagagggggccagaggga

SEQ ID NO: 6722439 - DNA, 20 bp, Homo sapiens
ccagagggggcgtgcctgcc

SEQ ID NO: 6722440 - DNA, 19 bp, Homo sapiens
ccagagggtagggcagcag

SEQ ID NO: 6722441 - DNA, 16 bp, Homo sapiens
ccagagggtgggcttc

SEQ ID NO: 6722442 - DNA, 17 bp, Homo sapiens
ccagagggtgtggcttt

SEQ ID NO: 6722443 - DNA, 18 bp, Homo sapiens
ccagagggttgctggtcc

SEQ ID NO: 6722444 - DNA, 19 bp, Homo sapiens
ccagagggttgctggtcct

SEQ ID NO: 6722445 - DNA, 22 bp, Homo sapiens
ccagaggtaacagaacagcttc

SEQ ID NO: 6722446 - DNA, 19 bp, Homo sapiens
ccagaggtccagcccatct

SEQ ID NO: 6722447 - DNA, 15 bp, Homo sapiens
ccagaggtccaggtc

SEQ ID NO: 6722448 - DNA, 15 bp, Homo sapiens
ccagaggtcctccgt

SEQ ID NO: 6722449 - DNA, 17 bp, Homo sapiens
ccagaggtcgcagctac

SEQ ID NO: 6722450 - DNA, 22 bp, Homo sapiens
ccagaggtctcatctcccaggc

SEQ ID NO: 6722451 - DNA, 15 bp, Homo sapiens
ccagaggtctcccta

SEQ ID NO: 6722452 - DNA, 16 bp, Homo sapiens
ccagaggtctccctat

SEQ ID NO: 6722453 - DNA, 22 bp, Homo sapiens
ccagaggtgacccaatgctcct

SEQ ID NO: 6722454 - DNA, 17 bp, Homo sapiens
ccagaggtggagccaag

SEQ ID NO: 6722455 - DNA, 14 bp, Homo sapiens
ccagaggtggatgt

SEQ ID NO: 6722456 - DNA, 11 bp, Homo sapiens
ccagaggtggc

SEQ ID NO: 6722457 - DNA, 23 bp, Homo sapiens
ccagaggtggcaggagaatttct

SEQ ID NO: 6722458 - DNA, 15 bp, Homo sapiens
ccagaggtggccctc

SEQ ID NO: 6722459 - DNA, 19 bp, Homo sapiens
ccagaggtggccctcccag

SEQ ID NO: 6722460 - DNA, 21 bp, Homo sapiens
ccagaggtggccctcccaggc

SEQ ID NO: 6722461 - DNA, 15 bp, Homo sapiens
ccagaggtggccctt

SEQ ID NO: 6722462 - DNA, 18 bp, Homo sapiens
ccagaggtgggaggcccc

SEQ ID NO: 6722463 - DNA, 15 bp, Homo sapiens
ccagaggtgggcagg

SEQ ID NO: 6722464 - DNA, 13 bp, Homo sapiens
ccagaggtgggga

SEQ ID NO: 6722465 - DNA, 18 bp, Homo sapiens
ccagaggtggggaagaga

SEQ ID NO: 6722466 - DNA, 20 bp, Homo sapiens
ccagaggtggggaagagagc

SEQ ID NO: 6722467 - DNA, 22 bp, Homo sapiens
ccagaggtgtcgggacatggtt

SEQ ID NO: 6722468 - DNA, 20 bp, Homo sapiens
ccagaggttatctgcctggc

SEQ ID NO: 6722469 - DNA, 21 bp, Homo sapiens
ccagaggttatctgcctggcc

SEQ ID NO: 6722470 - DNA, 22 bp, Homo sapiens
ccagaggttatctgcctggcct

SEQ ID NO: 6722471 - DNA, 23 bp, Homo sapiens
ccagaggttatctgcctggcctg

SEQ ID NO: 6722472 - DNA, 22 bp, Homo sapiens
ccagaggttttaggaaacctgg

SEQ ID NO: 6722473 - DNA, 22 bp, Homo sapiens
ccagagtagagccaggtgctta

SEQ ID NO: 6722474 - DNA, 23 bp, Homo sapiens
ccagagtagccatgaggaggcag

SEQ ID NO: 6722475 - DNA, 20 bp, Homo sapiens
ccagagtattgggattacag

SEQ ID NO: 6722476 - DNA, 22 bp, Homo sapiens
ccagagtcaacaaattaaataa

SEQ ID NO: 6722477 - DNA, 23 bp, Homo sapiens
ccagagtcaacaaattaaataaa

SEQ ID NO: 6722478 - DNA, 17 bp, Homo sapiens
ccagagtcagaggagaa

SEQ ID NO: 6722479 - DNA, 14 bp, Homo sapiens
ccagagtcaggaag

SEQ ID NO: 6722480 - DNA, 16 bp, Homo sapiens
ccagagtcaggaagag

SEQ ID NO: 6722481 - DNA, 15 bp, Homo sapiens
ccagagtcctggccc

SEQ ID NO: 6722482 - DNA, 22 bp, Homo sapiens
ccagagtcctggcccttgatgc

SEQ ID NO: 6722483 - DNA, 13 bp, Homo sapiens
ccagagtctccca

SEQ ID NO: 6722484 - DNA, 21 bp, Homo sapiens
ccagagtctcccagtgggtga

SEQ ID NO: 6722485 - DNA, 17 bp, Homo sapiens
ccagagtctgagccccc

SEQ ID NO: 6722486 - DNA, 12 bp, Homo sapiens
ccagagtctgga

SEQ ID NO: 6722487 - DNA, 19 bp, Homo sapiens
ccagagtcttaagggtcac

SEQ ID NO: 6722488 - DNA, 13 bp, Homo sapiens
ccagagtgctgtc

SEQ ID NO: 6722489 - DNA, 18 bp, Homo sapiens
ccagagtgctgtcgggac

SEQ ID NO: 6722490 - DNA, 19 bp, Homo sapiens
ccagagtggagtctgagtc

SEQ ID NO: 6722491 - DNA, 15 bp, Homo sapiens
ccagagtggccacgg

SEQ ID NO: 6722492 - DNA, 20 bp, Homo sapiens
ccagagtggccacggcccag

SEQ ID NO: 6722493 - DNA, 21 bp, Homo sapiens
ccagagtggccacggcccagg

SEQ ID NO: 6722494 - DNA, 15 bp, Homo sapiens
ccagagtggcctggc

SEQ ID NO: 6722495 - DNA, 22 bp, Homo sapiens
ccagagtggcctggccaggagc

SEQ ID NO: 6722496 - DNA, 12 bp, Homo sapiens
ccagagtggctg

SEQ ID NO: 6722497 - DNA, 14 bp, Homo sapiens
ccagagtgggagag

SEQ ID NO: 6722498 - DNA, 20 bp, Homo sapiens
ccagagtgtagggggccttg

SEQ ID NO: 6722499 - DNA, 18 bp, Homo sapiens
ccagagtgtcctgctacc

SEQ ID NO: 6722500 - DNA, 18 bp, Homo sapiens
ccagagtgtgcagactga

SEQ ID NO: 6722501 - DNA, 18 bp, Homo sapiens
ccagagtgtgggaaggga

SEQ ID NO: 6722502 - DNA, 22 bp, Homo sapiens
ccagagttccacaaatctatat

SEQ ID NO: 6722503 - DNA, 23 bp, Homo sapiens
ccagagttccacaaatctatatt

SEQ ID NO: 6722504 - DNA, 18 bp, Homo sapiens
ccagagttccccatgcag

SEQ ID NO: 6722505 - DNA, 19 bp, Homo sapiens
ccagagttcttgcaccctc

SEQ ID NO: 6722506 - DNA, 23 bp, Homo sapiens
ccagagttgggatgcggggcaga

SEQ ID NO: 6722507 - DNA, 15 bp, Homo sapiens
ccagagttgttctca

SEQ ID NO: 6722508 - DNA, 22 bp, Homo sapiens
ccagagtttgcctccctgcact

SEQ ID NO: 6722509 - DNA, 20 bp, Homo sapiens
ccagagtttttatgtagcag

SEQ ID NO: 6722510 - DNA, 19 bp, Homo sapiens
ccagataaaattatagatg

SEQ ID NO: 6722511 - DNA, 21 bp, Homo sapiens
ccagataactaaggtgaagaa

SEQ ID NO: 6722512 - DNA, 13 bp, Homo sapiens
ccagataagttat

SEQ ID NO: 6722513 - DNA, 15 bp, Homo sapiens
ccagataatatatta

SEQ ID NO: 6722514 - DNA, 21 bp, Homo sapiens
ccagatacacccaaagtatca

SEQ ID NO: 6722515 - DNA, 23 bp, Homo sapiens
ccagatacagcacatccacccag

SEQ ID NO: 6722516 - DNA, 20 bp, Homo sapiens
ccagataccatgatgctgag

SEQ ID NO: 6722517 - DNA, 18 bp, Homo sapiens
ccagatacctgtgaggac

SEQ ID NO: 6722518 - DNA, 21 bp, Homo sapiens
ccagatacgggggctgtgact

SEQ ID NO: 6722519 - DNA, 14 bp, Homo sapiens
ccagatagagaaat

SEQ ID NO: 6722520 - DNA, 22 bp, Homo sapiens
ccagatagagctgggtggcctg

SEQ ID NO: 6722521 - DNA, 14 bp, Homo sapiens
ccagatagtcccag

SEQ ID NO: 6722522 - DNA, 17 bp, Homo sapiens
ccagatagtgtagctga

SEQ ID NO: 6722523 - DNA, 13 bp, Homo sapiens
ccagatataactg

SEQ ID NO: 6722524 - DNA, 15 bp, Homo sapiens
ccagatataactgtc

SEQ ID NO: 6722525 - DNA, 20 bp, Homo sapiens
ccagatataactgtcttgtt

SEQ ID NO: 6722526 - DNA, 21 bp, Homo sapiens
ccagatataactgtcttgttt

SEQ ID NO: 6722527 - DNA, 18 bp, Homo sapiens
ccagatatcatctaccta

SEQ ID NO: 6722528 - DNA, 23 bp, Homo sapiens
ccagatatccacataaatgctcc

SEQ ID NO: 6722529 - DNA, 14 bp, Homo sapiens
ccagatatggaaac

SEQ ID NO: 6722530 - DNA, 15 bp, Homo sapiens
ccagatcaaaattgt

SEQ ID NO: 6722531 - DNA, 18 bp, Homo sapiens
ccagatcaagcctgcctc

SEQ ID NO: 6722532 - DNA, 19 bp, Homo sapiens
ccagatcaagcctgcctca

SEQ ID NO: 6722533 - DNA, 18 bp, Homo sapiens
ccagatcactgccacact

SEQ ID NO: 6722534 - DNA, 21 bp, Homo sapiens
ccagatcaggaaccagggcct

SEQ ID NO: 6722535 - DNA, 22 bp, Homo sapiens
ccagatcaggaaccagggcctc

SEQ ID NO: 6722536 - DNA, 22 bp, Homo sapiens
ccagatccaggaacacatgcac

SEQ ID NO: 6722537 - DNA, 20 bp, Homo sapiens
ccagatccagtatcttgttt

SEQ ID NO: 6722538 - DNA, 13 bp, Homo sapiens
ccagatcccaaga

SEQ ID NO: 6722539 - DNA, 14 bp, Homo sapiens
ccagatcccaagag

SEQ ID NO: 6722540 - DNA, 13 bp, Homo sapiens
ccagatcccagaa

SEQ ID NO: 6722541 - DNA, 18 bp, Homo sapiens
ccagatcccagaaggacc

SEQ ID NO: 6722542 - DNA, 19 bp, Homo sapiens
ccagatcccaggcccctgg

SEQ ID NO: 6722543 - DNA, 15 bp, Homo sapiens
ccagatccccagggc

SEQ ID NO: 6722544 - DNA, 17 bp, Homo sapiens
ccagatccccagggcag

SEQ ID NO: 6722545 - DNA, 21 bp, Homo sapiens
ccagatccccagggcagcctc

SEQ ID NO: 6722546 - DNA, 21 bp, Homo sapiens
ccagatccttttccagaaata

SEQ ID NO: 6722547 - DNA, 17 bp, Homo sapiens
ccagatccttttccatc

SEQ ID NO: 6722548 - DNA, 15 bp, Homo sapiens
ccagatcgctgtgtt

SEQ ID NO: 6722549 - DNA, 19 bp, Homo sapiens
ccagatcggatctgttgca

SEQ ID NO: 6722550 - DNA, 22 bp, Homo sapiens
ccagatcgttctgccacttgca

SEQ ID NO: 6722551 - DNA, 19 bp, Homo sapiens
ccagatctgcactgggtgt

SEQ ID NO: 6722552 - DNA, 17 bp, Homo sapiens
ccagatctgcctgggcc

SEQ ID NO: 6722553 - DNA, 18 bp, Homo sapiens
ccagatctgcctgggcct

SEQ ID NO: 6722554 - DNA, 13 bp, Homo sapiens
ccagatctggtcc

SEQ ID NO: 6722555 - DNA, 19 bp, Homo sapiens
ccagatcttgcctccagag

SEQ ID NO: 6722556 - DNA, 16 bp, Homo sapiens
ccagatctttcagaaa

SEQ ID NO: 6722557 - DNA, 13 bp, Homo sapiens
ccagatgaacatt

SEQ ID NO: 6722558 - DNA, 15 bp, Homo sapiens
ccagatgaacatttc

SEQ ID NO: 6722559 - DNA, 16 bp, Homo sapiens
ccagatgaactgactg

SEQ ID NO: 6722560 - DNA, 15 bp, Homo sapiens
ccagatgaaggaaag

SEQ ID NO: 6722561 - DNA, 16 bp, Homo sapiens
ccagatgacaccctaa

SEQ ID NO: 6722562 - DNA, 16 bp, Homo sapiens
ccagatgacagggagc

SEQ ID NO: 6722563 - DNA, 14 bp, Homo sapiens
ccagatgagaagtt

SEQ ID NO: 6722564 - DNA, 22 bp, Homo sapiens
ccagatgagaagttaagcagcc

SEQ ID NO: 6722565 - DNA, 23 bp, Homo sapiens
ccagatgaggatccgaaacggca

SEQ ID NO: 6722566 - DNA, 19 bp, Homo sapiens
ccagatgatcccagtcact

SEQ ID NO: 6722567 - DNA, 22 bp, Homo sapiens
ccagatgatcccagtcactcct

SEQ ID NO: 6722568 - DNA, 22 bp, Homo sapiens
ccagatgatccttgcacagaca

SEQ ID NO: 6722569 - DNA, 18 bp, Homo sapiens
ccagatgcacatccctgg

SEQ ID NO: 6722570 - DNA, 15 bp, Homo sapiens
ccagatgcaccagcc

SEQ ID NO: 6722571 - DNA, 16 bp, Homo sapiens
ccagatgcagctcaag

SEQ ID NO: 6722572 - DNA, 13 bp, Homo sapiens
ccagatgcaggac

SEQ ID NO: 6722573 - DNA, 18 bp, Homo sapiens
ccagatgcaggacaggag

SEQ ID NO: 6722574 - DNA, 15 bp, Homo sapiens
ccagatgcagggcag

SEQ ID NO: 6722575 - DNA, 18 bp, Homo sapiens
ccagatgcagggcagtca

SEQ ID NO: 6722576 - DNA, 13 bp, Homo sapiens
ccagatgccctgt

SEQ ID NO: 6722577 - DNA, 22 bp, Homo sapiens
ccagatgccctttggaaagcca

SEQ ID NO: 6722578 - DNA, 13 bp, Homo sapiens
ccagatgccttcc

SEQ ID NO: 6722579 - DNA, 16 bp, Homo sapiens
ccagatgccttctaga

SEQ ID NO: 6722580 - DNA, 22 bp, Homo sapiens
ccagatgcggggacaggctgga

SEQ ID NO: 6722581 - DNA, 21 bp, Homo sapiens
ccagatgctagagcctctgcc

SEQ ID NO: 6722582 - DNA, 14 bp, Homo sapiens
ccagatgctgaaaa

SEQ ID NO: 6722583 - DNA, 21 bp, Homo sapiens
ccagatgctgatgttcagtgt

SEQ ID NO: 6722584 - DNA, 23 bp, Homo sapiens
ccagatgctgatgttcagtgtaa

SEQ ID NO: 6722585 - DNA, 11 bp, Homo sapiens
ccagatgctgg

SEQ ID NO: 6722586 - DNA, 12 bp, Homo sapiens
ccagatgctggg

SEQ ID NO: 6722587 - DNA, 14 bp, Homo sapiens
ccagatgctgggca

SEQ ID NO: 6722588 - DNA, 18 bp, Homo sapiens
ccagatggaaaaataaca

SEQ ID NO: 6722589 - DNA, 12 bp, Homo sapiens
ccagatggcccc

SEQ ID NO: 6722590 - DNA, 13 bp, Homo sapiens
ccagatggcccct

SEQ ID NO: 6722591 - DNA, 13 bp, Homo sapiens
ccagatggctccc

SEQ ID NO: 6722592 - DNA, 17 bp, Homo sapiens
ccagatggctccctggg

SEQ ID NO: 6722593 - DNA, 22 bp, Homo sapiens
ccagatggctccctgggctggc

SEQ ID NO: 6722594 - DNA, 23 bp, Homo sapiens
ccagatggctccctgggctggca

SEQ ID NO: 6722595 - DNA, 22 bp, Homo sapiens
ccagatggcttcggagggccgc

SEQ ID NO: 6722596 - DNA, 24 bp, Homo sapiens
ccagatgggccacggctgagcctt

SEQ ID NO: 6722597 - DNA, 16 bp, Homo sapiens
ccagatgggggaaagc

SEQ ID NO: 6722598 - DNA, 20 bp, Homo sapiens
ccagatgggggaaagcacag

SEQ ID NO: 6722599 - DNA, 15 bp, Homo sapiens
ccagatggttgtgta

SEQ ID NO: 6722600 - DNA, 18 bp, Homo sapiens
ccagatggttgtgtatgg

SEQ ID NO: 6722601 - DNA, 23 bp, Homo sapiens
ccagatggttgtgtatgggtagc

SEQ ID NO: 6722602 - DNA, 12 bp, Homo sapiens
ccagatggtttc

SEQ ID NO: 6722603 - DNA, 15 bp, Homo sapiens
ccagatggtttccta

SEQ ID NO: 6722604 - DNA, 19 bp, Homo sapiens
ccagatgtcgctgggtcct

SEQ ID NO: 6722605 - DNA, 24 bp, Homo sapiens
ccagatgtcgctgggtcctctgca

SEQ ID NO: 6722606 - DNA, 19 bp, Homo sapiens
ccagatgtgcttttattta

SEQ ID NO: 6722607 - DNA, 16 bp, Homo sapiens
ccagatgtgggctcag

SEQ ID NO: 6722608 - DNA, 17 bp, Homo sapiens
ccagatgtgggctcaga

SEQ ID NO: 6722609 - DNA, 23 bp, Homo sapiens
ccagatgtgtgttgcttctctat

SEQ ID NO: 6722610 - DNA, 21 bp, Homo sapiens
ccagatgttgcttttgaaaag

SEQ ID NO: 6722611 - DNA, 17 bp, Homo sapiens
ccagatgttgtctgaac

SEQ ID NO: 6722612 - DNA, 18 bp, Homo sapiens
ccagatgttttatttatg

SEQ ID NO: 6722613 - DNA, 12 bp, Homo sapiens
ccagatgttttg

SEQ ID NO: 6722614 - DNA, 15 bp, Homo sapiens
ccagattaaacttca

SEQ ID NO: 6722615 - DNA, 11 bp, Homo sapiens
ccagattacaa

SEQ ID NO: 6722616 - DNA, 21 bp, Homo sapiens
ccagattacaggaatgaagaa

SEQ ID NO: 6722617 - DNA, 18 bp, Homo sapiens
ccagattactccttcctt

SEQ ID NO: 6722618 - DNA, 15 bp, Homo sapiens
ccagattaggcctgg

SEQ ID NO: 6722619 - DNA, 17 bp, Homo sapiens
ccagattaggcctggag

SEQ ID NO: 6722620 - DNA, 14 bp, Homo sapiens
ccagattataatgc

SEQ ID NO: 6722621 - DNA, 23 bp, Homo sapiens
ccagattatctatttgtgtgtgt

SEQ ID NO: 6722622 - DNA, 23 bp, Homo sapiens
ccagattattttctatatttgga

SEQ ID NO: 6722623 - DNA, 18 bp, Homo sapiens
ccagattcacttctgaat

SEQ ID NO: 6722624 - DNA, 15 bp, Homo sapiens
ccagattcccaggcc

SEQ ID NO: 6722625 - DNA, 15 bp, Homo sapiens
ccagattcccctgtg

SEQ ID NO: 6722626 - DNA, 16 bp, Homo sapiens
ccagattcccctgtgt

SEQ ID NO: 6722627 - DNA, 20 bp, Homo sapiens
ccagattctatcctcatctt

SEQ ID NO: 6722628 - DNA, 15 bp, Homo sapiens
ccagattctcttgaa

SEQ ID NO: 6722629 - DNA, 17 bp, Homo sapiens
ccagattctgcctctct

SEQ ID NO: 6722630 - DNA, 19 bp, Homo sapiens
ccagattctgcctctctgg

SEQ ID NO: 6722631 - DNA, 12 bp, Homo sapiens
ccagattcttca

SEQ ID NO: 6722632 - DNA, 12 bp, Homo sapiens
ccagattgaaaa

SEQ ID NO: 6722633 - DNA, 19 bp, Homo sapiens
ccagattgaaaagtgtcct

SEQ ID NO: 6722634 - DNA, 21 bp, Homo sapiens
ccagattgacgacaagtgctg

SEQ ID NO: 6722635 - DNA, 20 bp, Homo sapiens
ccagattgcaacaggctggg

SEQ ID NO: 6722636 - DNA, 18 bp, Homo sapiens
ccagattggccaattaaa

SEQ ID NO: 6722637 - DNA, 16 bp, Homo sapiens
ccagattggctcacac

SEQ ID NO: 6722638 - DNA, 14 bp, Homo sapiens
ccagattgggggcc

SEQ ID NO: 6722639 - DNA, 16 bp, Homo sapiens
ccagattgggggccct

SEQ ID NO: 6722640 - DNA, 17 bp, Homo sapiens
ccagattgggggccctg

SEQ ID NO: 6722641 - DNA, 21 bp, Homo sapiens
ccagattgggggccctggggt

SEQ ID NO: 6722642 - DNA, 15 bp, Homo sapiens
ccagattgtggggtg

SEQ ID NO: 6722643 - DNA, 17 bp, Homo sapiens
ccagattgtggtgggcc

SEQ ID NO: 6722644 - DNA, 14 bp, Homo sapiens
ccagattgtgtaca

SEQ ID NO: 6722645 - DNA, 14 bp, Homo sapiens
ccagatttaaataa

SEQ ID NO: 6722646 - DNA, 13 bp, Homo sapiens
ccagatttacact

SEQ ID NO: 6722647 - DNA, 14 bp, Homo sapiens
ccagatttcactct

SEQ ID NO: 6722648 - DNA, 21 bp, Homo sapiens
ccagatttgctaatttatcct

SEQ ID NO: 6722649 - DNA, 12 bp, Homo sapiens
ccagatttgtct

SEQ ID NO: 6722650 - DNA, 15 bp, Homo sapiens
ccagattttgctgta

SEQ ID NO: 6722651 - DNA, 13 bp, Homo sapiens
ccagatttttaat

SEQ ID NO: 6722652 - DNA, 10 bp, Homo sapiens
ccagcaaaag

SEQ ID NO: 6722653 - DNA, 22 bp, Homo sapiens
ccagcaaaagagctattgccaa

SEQ ID NO: 6722654 - DNA, 16 bp, Homo sapiens
ccagcaaaatccaaac

SEQ ID NO: 6722655 - DNA, 18 bp, Homo sapiens
ccagcaaaatccaaactg

SEQ ID NO: 6722656 - DNA, 21 bp, Homo sapiens
ccagcaaaatccaaactgctg

SEQ ID NO: 6722657 - DNA, 19 bp, Homo sapiens
ccagcaaaatggaagcaaa

SEQ ID NO: 6722658 - DNA, 16 bp, Homo sapiens
ccagcaaagagaatgt

SEQ ID NO: 6722659 - DNA, 21 bp, Homo sapiens
ccagcaaagagtgggctgcat

SEQ ID NO: 6722660 - DNA, 22 bp, Homo sapiens
ccagcaaagccccatgctggag

SEQ ID NO: 6722661 - DNA, 15 bp, Homo sapiens
ccagcaaagccccca

SEQ ID NO: 6722662 - DNA, 19 bp, Homo sapiens
ccagcaaagcccccagagc

SEQ ID NO: 6722663 - DNA, 24 bp, Homo sapiens
ccagcaaagcccccagagcccagg

SEQ ID NO: 6722664 - DNA, 16 bp, Homo sapiens
ccagcaaagcctccag

SEQ ID NO: 6722665 - DNA, 17 bp, Homo sapiens
ccagcaaagcctccagc

SEQ ID NO: 6722666 - DNA, 20 bp, Homo sapiens
ccagcaaagtgattccctgc

SEQ ID NO: 6722667 - DNA, 18 bp, Homo sapiens
ccagcaaagttttcagat

SEQ ID NO: 6722668 - DNA, 19 bp, Homo sapiens
ccagcaaataaagcagtca

SEQ ID NO: 6722669 - DNA, 17 bp, Homo sapiens
ccagcaacacagcctgg

SEQ ID NO: 6722670 - DNA, 18 bp, Homo sapiens
ccagcaacacgtcattgt

SEQ ID NO: 6722671 - DNA, 22 bp, Homo sapiens
ccagcaacactccggtcagccc

SEQ ID NO: 6722672 - DNA, 13 bp, Homo sapiens
ccagcaacatctc

SEQ ID NO: 6722673 - DNA, 19 bp, Homo sapiens
ccagcaacatctcgagccc

SEQ ID NO: 6722674 - DNA, 23 bp, Homo sapiens
ccagcaacatctcgagccccctg

SEQ ID NO: 6722675 - DNA, 23 bp, Homo sapiens
ccagcaacattataatggccctg

SEQ ID NO: 6722676 - DNA, 17 bp, Homo sapiens
ccagcaaccctcctatc

SEQ ID NO: 6722677 - DNA, 18 bp, Homo sapiens
ccagcaaccctcctatca

SEQ ID NO: 6722678 - DNA, 17 bp, Homo sapiens
ccagcaactctgactct

SEQ ID NO: 6722679 - DNA, 11 bp, Homo sapiens
ccagcaactga

SEQ ID NO: 6722680 - DNA, 15 bp, Homo sapiens
ccagcaactgaataa

SEQ ID NO: 6722681 - DNA, 16 bp, Homo sapiens
ccagcaactgaataaa

SEQ ID NO: 6722682 - DNA, 14 bp, Homo sapiens
ccagcaactgccct

SEQ ID NO: 6722683 - DNA, 18 bp, Homo sapiens
ccagcaactgcccttcca

SEQ ID NO: 6722684 - DNA, 17 bp, Homo sapiens
ccagcaacttttctcat

SEQ ID NO: 6722685 - DNA, 13 bp, Homo sapiens
ccagcaagacctc

SEQ ID NO: 6722686 - DNA, 18 bp, Homo sapiens
ccagcaagagcacaagag

SEQ ID NO: 6722687 - DNA, 23 bp, Homo sapiens
ccagcaagaggaaggggtgctgt

SEQ ID NO: 6722688 - DNA, 14 bp, Homo sapiens
ccagcaagcagtct

SEQ ID NO: 6722689 - DNA, 17 bp, Homo sapiens
ccagcaagcagtgccct

SEQ ID NO: 6722690 - DNA, 13 bp, Homo sapiens
ccagcaaggcaga

SEQ ID NO: 6722691 - DNA, 15 bp, Homo sapiens
ccagcaaggggaccc

SEQ ID NO: 6722692 - DNA, 14 bp, Homo sapiens
ccagcaagtcccag

SEQ ID NO: 6722693 - DNA, 15 bp, Homo sapiens
ccagcaagtgagagc

SEQ ID NO: 6722694 - DNA, 17 bp, Homo sapiens
ccagcaagtttcacctt

SEQ ID NO: 6722695 - DNA, 13 bp, Homo sapiens
ccagcaataagaa

SEQ ID NO: 6722696 - DNA, 14 bp, Homo sapiens
ccagcaataagaaa

SEQ ID NO: 6722697 - DNA, 18 bp, Homo sapiens
ccagcaataagaaatgaa

SEQ ID NO: 6722698 - DNA, 21 bp, Homo sapiens
ccagcaataagaaatgaacaa

SEQ ID NO: 6722699 - DNA, 22 bp, Homo sapiens
ccagcaataagaaatgaacaaa

SEQ ID NO: 6722700 - DNA, 17 bp, Homo sapiens
ccagcaatatgtaaata

SEQ ID NO: 6722701 - DNA, 17 bp, Homo sapiens
ccagcaatgatgtccag

SEQ ID NO: 6722702 - DNA, 18 bp, Homo sapiens
ccagcaatgatgtccaga

SEQ ID NO: 6722703 - DNA, 18 bp, Homo sapiens
ccagcaatgccctgcctt

SEQ ID NO: 6722704 - DNA, 21 bp, Homo sapiens
ccagcaattcataaaaactgc

SEQ ID NO: 6722705 - DNA, 16 bp, Homo sapiens
ccagcaattctcctgc

SEQ ID NO: 6722706 - DNA, 17 bp, Homo sapiens
ccagcacaaacacaagg

SEQ ID NO: 6722707 - DNA, 20 bp, Homo sapiens
ccagcacaaacacaaggtca

SEQ ID NO: 6722708 - DNA, 23 bp, Homo sapiens
ccagcacaaagcactggccttgc

SEQ ID NO: 6722709 - DNA, 19 bp, Homo sapiens
ccagcacaactcagtctgt

SEQ ID NO: 6722710 - DNA, 14 bp, Homo sapiens
ccagcacacacaca

SEQ ID NO: 6722711 - DNA, 23 bp, Homo sapiens
ccagcacacacacataagcactg

SEQ ID NO: 6722712 - DNA, 17 bp, Homo sapiens
ccagcacaccgggccaa

SEQ ID NO: 6722713 - DNA, 12 bp, Homo sapiens
ccagcacactcc

SEQ ID NO: 6722714 - DNA, 16 bp, Homo sapiens
ccagcacactcccgag

SEQ ID NO: 6722715 - DNA, 20 bp, Homo sapiens
ccagcacactgggaggccga

SEQ ID NO: 6722716 - DNA, 12 bp, Homo sapiens
ccagcacagaag

SEQ ID NO: 6722717 - DNA, 12 bp, Homo sapiens
ccagcacagact

SEQ ID NO: 6722718 - DNA, 14 bp, Homo sapiens
ccagcacagagcgt

SEQ ID NO: 6722719 - DNA, 18 bp, Homo sapiens
ccagcacagagcgtcctt

SEQ ID NO: 6722720 - DNA, 13 bp, Homo sapiens
ccagcacagccac

SEQ ID NO: 6722721 - DNA, 14 bp, Homo sapiens
ccagcacagccacc

SEQ ID NO: 6722722 - DNA, 15 bp, Homo sapiens
ccagcacagccacct

SEQ ID NO: 6722723 - DNA, 19 bp, Homo sapiens
ccagcacagccacctccgc

SEQ ID NO: 6722724 - DNA, 23 bp, Homo sapiens
ccagcacagccacctccgccaga

SEQ ID NO: 6722725 - DNA, 20 bp, Homo sapiens
ccagcacagctcctcccctg

SEQ ID NO: 6722726 - DNA, 20 bp, Homo sapiens
ccagcacagctgaggaccct

SEQ ID NO: 6722727 - DNA, 19 bp, Homo sapiens
ccagcacagcttagatttc

SEQ ID NO: 6722728 - DNA, 22 bp, Homo sapiens
ccagcacagcttagatttcata

SEQ ID NO: 6722729 - DNA, 14 bp, Homo sapiens
ccagcacaggggcc

SEQ ID NO: 6722730 - DNA, 18 bp, Homo sapiens
ccagcacaggggccccag

SEQ ID NO: 6722731 - DNA, 18 bp, Homo sapiens
ccagcacatagcttgcct

SEQ ID NO: 6722732 - DNA, 21 bp, Homo sapiens
ccagcacatccatcagcaccc

SEQ ID NO: 6722733 - DNA, 21 bp, Homo sapiens
ccagcacatccccctctcctc

SEQ ID NO: 6722734 - DNA, 23 bp, Homo sapiens
ccagcacatgcggcttccgaggg

SEQ ID NO: 6722735 - DNA, 20 bp, Homo sapiens
ccagcacatggccatagagg

SEQ ID NO: 6722736 - DNA, 22 bp, Homo sapiens
ccagcaccatccgccagggccc

SEQ ID NO: 6722737 - DNA, 17 bp, Homo sapiens
ccagcacccaaagggtt

SEQ ID NO: 6722738 - DNA, 14 bp, Homo sapiens
ccagcacccagcaa

SEQ ID NO: 6722739 - DNA, 20 bp, Homo sapiens
ccagcacccagtcctctgcc

SEQ ID NO: 6722740 - DNA, 18 bp, Homo sapiens
ccagcacccatgccccac

SEQ ID NO: 6722741 - DNA, 18 bp, Homo sapiens
ccagcacccccacgccct

SEQ ID NO: 6722742 - DNA, 22 bp, Homo sapiens
ccagcaccccctctcctggagg

SEQ ID NO: 6722743 - DNA, 17 bp, Homo sapiens
ccagcacccgggctcag

SEQ ID NO: 6722744 - DNA, 12 bp, Homo sapiens
ccagcaccgagc

SEQ ID NO: 6722745 - DNA, 22 bp, Homo sapiens
ccagcacctaggtggggcctgg

SEQ ID NO: 6722746 - DNA, 17 bp, Homo sapiens
ccagcacctcagcctgc

SEQ ID NO: 6722747 - DNA, 18 bp, Homo sapiens
ccagcacctcctccgtgg

SEQ ID NO: 6722748 - DNA, 14 bp, Homo sapiens
ccagcacctgccag

SEQ ID NO: 6722749 - DNA, 15 bp, Homo sapiens
ccagcacctgccagg

SEQ ID NO: 6722750 - DNA, 17 bp, Homo sapiens
ccagcacctgccagggc

SEQ ID NO: 6722751 - DNA, 18 bp, Homo sapiens
ccagcacctgccagggcc

SEQ ID NO: 6722752 - DNA, 15 bp, Homo sapiens
ccagcacctgcctcc

SEQ ID NO: 6722753 - DNA, 16 bp, Homo sapiens
ccagcacctgcctcct

SEQ ID NO: 6722754 - DNA, 18 bp, Homo sapiens
ccagcacctgctcccagt

SEQ ID NO: 6722755 - DNA, 15 bp, Homo sapiens
ccagcacctggcatc

SEQ ID NO: 6722756 - DNA, 19 bp, Homo sapiens
ccagcaccttctttctgga

SEQ ID NO: 6722757 - DNA, 22 bp, Homo sapiens
ccagcaccttctttctggactg

SEQ ID NO: 6722758 - DNA, 16 bp, Homo sapiens
ccagcaccttgcagat

SEQ ID NO: 6722759 - DNA, 15 bp, Homo sapiens
ccagcaccttgtgcc

SEQ ID NO: 6722760 - DNA, 18 bp, Homo sapiens
ccagcactaaagcagtgg

SEQ ID NO: 6722761 - DNA, 22 bp, Homo sapiens
ccagcactaaggccgtgtctct

SEQ ID NO: 6722762 - DNA, 21 bp, Homo sapiens
ccagcactagtaaaggaggaa

SEQ ID NO: 6722763 - DNA, 21 bp, Homo sapiens
ccagcactatgctttccttct

SEQ ID NO: 6722764 - DNA, 15 bp, Homo sapiens
ccagcactcaataaa

SEQ ID NO: 6722765 - DNA, 16 bp, Homo sapiens
ccagcactccatcact

SEQ ID NO: 6722766 - DNA, 22 bp, Homo sapiens
ccagcactccatcactgagagc

SEQ ID NO: 6722767 - DNA, 17 bp, Homo sapiens
ccagcactcccagggcc

SEQ ID NO: 6722768 - DNA, 18 bp, Homo sapiens
ccagcactcccagggccc

SEQ ID NO: 6722769 - DNA, 19 bp, Homo sapiens
ccagcactcccagggcccg

SEQ ID NO: 6722770 - DNA, 13 bp, Homo sapiens
ccagcactcccct

SEQ ID NO: 6722771 - DNA, 14 bp, Homo sapiens
ccagcactcccctt

SEQ ID NO: 6722772 - DNA, 17 bp, Homo sapiens
ccagcactccccttgcc

SEQ ID NO: 6722773 - DNA, 21 bp, Homo sapiens
ccagcactccccttgccttcc

SEQ ID NO: 6722774 - DNA, 16 bp, Homo sapiens
ccagcactcctctgtc

SEQ ID NO: 6722775 - DNA, 20 bp, Homo sapiens
ccagcactcctctgtctctg

SEQ ID NO: 6722776 - DNA, 13 bp, Homo sapiens
ccagcactgagga

SEQ ID NO: 6722777 - DNA, 17 bp, Homo sapiens
ccagcactgcccatccc

SEQ ID NO: 6722778 - DNA, 14 bp, Homo sapiens
ccagcactgcctcc

SEQ ID NO: 6722779 - DNA, 18 bp, Homo sapiens
ccagcactgcctcctgtt

SEQ ID NO: 6722780 - DNA, 12 bp, Homo sapiens
ccagcactgctt

SEQ ID NO: 6722781 - DNA, 15 bp, Homo sapiens
ccagcactgcttgag

SEQ ID NO: 6722782 - DNA, 18 bp, Homo sapiens
ccagcactggaggggccc

SEQ ID NO: 6722783 - DNA, 21 bp, Homo sapiens
ccagcactggaggggcccacc

SEQ ID NO: 6722784 - DNA, 14 bp, Homo sapiens
ccagcactgtgaag

SEQ ID NO: 6722785 - DNA, 20 bp, Homo sapiens
ccagcactgtgaagacccag

SEQ ID NO: 6722786 - DNA, 21 bp, Homo sapiens
ccagcacttggagaggctgag

SEQ ID NO: 6722787 - DNA, 19 bp, Homo sapiens
ccagcactttgagaggctg

SEQ ID NO: 6722788 - DNA, 19 bp, Homo sapiens
ccagcactttgggagacca

SEQ ID NO: 6722789 - DNA, 16 bp, Homo sapiens
ccagcactttgggagg

SEQ ID NO: 6722790 - DNA, 20 bp, Homo sapiens
ccagcactttgggaggccga

SEQ ID NO: 6722791 - DNA, 24 bp, Homo sapiens
ccagcactttgggaggccgaggtg

SEQ ID NO: 6722792 - DNA, 16 bp, Homo sapiens
ccagcagaaatgcctt

SEQ ID NO: 6722793 - DNA, 17 bp, Homo sapiens
ccagcagaaccagcctc

SEQ ID NO: 6722794 - DNA, 18 bp, Homo sapiens
ccagcagaaccagcctca

SEQ ID NO: 6722795 - DNA, 14 bp, Homo sapiens
ccagcagaactgaa

SEQ ID NO: 6722796 - DNA, 22 bp, Homo sapiens
ccagcagaagacaaaaagacaa

SEQ ID NO: 6722797 - DNA, 16 bp, Homo sapiens
ccagcagaagagggag

SEQ ID NO: 6722798 - DNA, 16 bp, Homo sapiens
ccagcagacagagcca

SEQ ID NO: 6722799 - DNA, 19 bp, Homo sapiens
ccagcagagcaccttagac

SEQ ID NO: 6722800 - DNA, 14 bp, Homo sapiens
ccagcagagcatgt

SEQ ID NO: 6722801 - DNA, 20 bp, Homo sapiens
ccagcagagccagggcaggg

SEQ ID NO: 6722802 - DNA, 22 bp, Homo sapiens
ccagcagagccagggcagggcg

SEQ ID NO: 6722803 - DNA, 12 bp, Homo sapiens
ccagcagagccc

SEQ ID NO: 6722804 - DNA, 13 bp, Homo sapiens
ccagcagagccca

SEQ ID NO: 6722805 - DNA, 21 bp, Homo sapiens
ccagcagagcccaccagccag

SEQ ID NO: 6722806 - DNA, 20 bp, Homo sapiens
ccagcagagccgttcctggg

SEQ ID NO: 6722807 - DNA, 17 bp, Homo sapiens
ccagcagaggcaggctg

SEQ ID NO: 6722808 - DNA, 21 bp, Homo sapiens
ccagcagaggcaggctgggac

SEQ ID NO: 6722809 - DNA, 16 bp, Homo sapiens
ccagcagagggcgcca

SEQ ID NO: 6722810 - DNA, 22 bp, Homo sapiens
ccagcagagggcgccaccacca

SEQ ID NO: 6722811 - DNA, 20 bp, Homo sapiens
ccagcagataaggccgagcc

SEQ ID NO: 6722812 - DNA, 18 bp, Homo sapiens
ccagcagatcccagctca

SEQ ID NO: 6722813 - DNA, 14 bp, Homo sapiens
ccagcagatgttta

SEQ ID NO: 6722814 - DNA, 15 bp, Homo sapiens
ccagcagattattca

SEQ ID NO: 6722815 - DNA, 22 bp, Homo sapiens
ccagcagattattcactgattt

SEQ ID NO: 6722816 - DNA, 18 bp, Homo sapiens
ccagcagatttccagcct

SEQ ID NO: 6722817 - DNA, 17 bp, Homo sapiens
ccagcagcaactgaaaa

SEQ ID NO: 6722818 - DNA, 20 bp, Homo sapiens
ccagcagcaatctgtcttta

SEQ ID NO: 6722819 - DNA, 13 bp, Homo sapiens
ccagcagcacaat

SEQ ID NO: 6722820 - DNA, 16 bp, Homo sapiens
ccagcagcacaattct

SEQ ID NO: 6722821 - DNA, 22 bp, Homo sapiens
ccagcagcacaattctgtccct

SEQ ID NO: 6722822 - DNA, 13 bp, Homo sapiens
ccagcagcacacc

SEQ ID NO: 6722823 - DNA, 16 bp, Homo sapiens
ccagcagcacacctca

SEQ ID NO: 6722824 - DNA, 17 bp, Homo sapiens
ccagcagcactggaacc

SEQ ID NO: 6722825 - DNA, 12 bp, Homo sapiens
ccagcagcagaa

SEQ ID NO: 6722826 - DNA, 14 bp, Homo sapiens
ccagcagcagagaa

SEQ ID NO: 6722827 - DNA, 23 bp, Homo sapiens
ccagcagcagcacttagacctgc

SEQ ID NO: 6722828 - DNA, 15 bp, Homo sapiens
ccagcagcagcaggt

SEQ ID NO: 6722829 - DNA, 23 bp, Homo sapiens
ccagcagcagcccaagcttccct

SEQ ID NO: 6722830 - DNA, 22 bp, Homo sapiens
ccagcagcaggatgggctgagc

SEQ ID NO: 6722831 - DNA, 23 bp, Homo sapiens
ccagcagcatagaacaggacctc

SEQ ID NO: 6722832 - DNA, 13 bp, Homo sapiens
ccagcagcatggc

SEQ ID NO: 6722833 - DNA, 23 bp, Homo sapiens
ccagcagcatggcatagccccgg

SEQ ID NO: 6722834 - DNA, 16 bp, Homo sapiens
ccagcagccagctctc

SEQ ID NO: 6722835 - DNA, 18 bp, Homo sapiens
ccagcagccagctctcag

SEQ ID NO: 6722836 - DNA, 19 bp, Homo sapiens
ccagcagccagctctcagc

SEQ ID NO: 6722837 - DNA, 21 bp, Homo sapiens
ccagcagccccacaccagggc

SEQ ID NO: 6722838 - DNA, 22 bp, Homo sapiens
ccagcagcccccactgcacccc

SEQ ID NO: 6722839 - DNA, 22 bp, Homo sapiens
ccagcagccccgtctgcccacc

SEQ ID NO: 6722840 - DNA, 15 bp, Homo sapiens
ccagcagcccctgag

SEQ ID NO: 6722841 - DNA, 21 bp, Homo sapiens
ccagcagccctaaggatctct

SEQ ID NO: 6722842 - DNA, 21 bp, Homo sapiens
ccagcagccctggcctgtgga

SEQ ID NO: 6722843 - DNA, 18 bp, Homo sapiens
ccagcagcctcgcacagg

SEQ ID NO: 6722844 - DNA, 19 bp, Homo sapiens
ccagcagcctcgcacaggc

SEQ ID NO: 6722845 - DNA, 20 bp, Homo sapiens
ccagcagcctcgcacaggcc

SEQ ID NO: 6722846 - DNA, 14 bp, Homo sapiens
ccagcagcctgcca

SEQ ID NO: 6722847 - DNA, 16 bp, Homo sapiens
ccagcagcctgccagc

SEQ ID NO: 6722848 - DNA, 19 bp, Homo sapiens
ccagcagcctggaccctgt

SEQ ID NO: 6722849 - DNA, 17 bp, Homo sapiens
ccagcagccttccagtg

SEQ ID NO: 6722850 - DNA, 19 bp, Homo sapiens
ccagcagcgcccgaggcca

SEQ ID NO: 6722851 - DNA, 20 bp, Homo sapiens
ccagcagcgcgcaggcctgc

SEQ ID NO: 6722852 - DNA, 23 bp, Homo sapiens
ccagcagctcaacctaccctggt

SEQ ID NO: 6722853 - DNA, 12 bp, Homo sapiens
ccagcagctcac

SEQ ID NO: 6722854 - DNA, 17 bp, Homo sapiens
ccagcagctgaagtctc

SEQ ID NO: 6722855 - DNA, 22 bp, Homo sapiens
ccagcagctgatgcctccttgg

SEQ ID NO: 6722856 - DNA, 18 bp, Homo sapiens
ccagcagctgcgggtctg

SEQ ID NO: 6722857 - DNA, 24 bp, Homo sapiens
ccagcagctgcgggtctgaaggaa

SEQ ID NO: 6722858 - DNA, 21 bp, Homo sapiens
ccagcagcttaagtccagctc

SEQ ID NO: 6722859 - DNA, 15 bp, Homo sapiens
ccagcagcttggctg

SEQ ID NO: 6722860 - DNA, 19 bp, Homo sapiens
ccagcagcttggctgagcc

SEQ ID NO: 6722861 - DNA, 14 bp, Homo sapiens
ccagcaggaagcca

SEQ ID NO: 6722862 - DNA, 19 bp, Homo sapiens
ccagcaggaaggaccccac

SEQ ID NO: 6722863 - DNA, 20 bp, Homo sapiens
ccagcaggaaggaccccaca

SEQ ID NO: 6722864 - DNA, 13 bp, Homo sapiens
ccagcaggaataa

SEQ ID NO: 6722865 - DNA, 14 bp, Homo sapiens
ccagcaggaataaa

SEQ ID NO: 6722866 - DNA, 15 bp, Homo sapiens
ccagcaggaatttct

SEQ ID NO: 6722867 - DNA, 21 bp, Homo sapiens
ccagcaggagagactgagcag

SEQ ID NO: 6722868 - DNA, 13 bp, Homo sapiens
ccagcaggaggga

SEQ ID NO: 6722869 - DNA, 20 bp, Homo sapiens
ccagcaggagggacagtctc

SEQ ID NO: 6722870 - DNA, 21 bp, Homo sapiens
ccagcaggaggttctgggcct

SEQ ID NO: 6722871 - DNA, 12 bp, Homo sapiens
ccagcaggcaga

SEQ ID NO: 6722872 - DNA, 19 bp, Homo sapiens
ccagcaggcagcgcctgtc

SEQ ID NO: 6722873 - DNA, 13 bp, Homo sapiens
ccagcaggcaggc

SEQ ID NO: 6722874 - DNA, 22 bp, Homo sapiens
ccagcaggcaggcactgtggcc

SEQ ID NO: 6722875 - DNA, 20 bp, Homo sapiens
ccagcaggccagggactcag

SEQ ID NO: 6722876 - DNA, 11 bp, Homo sapiens
ccagcaggccc

SEQ ID NO: 6722877 - DNA, 16 bp, Homo sapiens
ccagcaggcccagcat

SEQ ID NO: 6722878 - DNA, 21 bp, Homo sapiens
ccagcaggcccagcatgcagg

SEQ ID NO: 6722879 - DNA, 16 bp, Homo sapiens
ccagcaggcctccctg

SEQ ID NO: 6722880 - DNA, 17 bp, Homo sapiens
ccagcaggcctccctga

SEQ ID NO: 6722881 - DNA, 23 bp, Homo sapiens
ccagcaggcgtcaccatccacct

SEQ ID NO: 6722882 - DNA, 12 bp, Homo sapiens
ccagcaggctcc

SEQ ID NO: 6722883 - DNA, 16 bp, Homo sapiens
ccagcaggctcctcag

SEQ ID NO: 6722884 - DNA, 17 bp, Homo sapiens
ccagcaggctcctcagc

SEQ ID NO: 6722885 - DNA, 18 bp, Homo sapiens
ccagcaggctcctcagcc

SEQ ID NO: 6722886 - DNA, 20 bp, Homo sapiens
ccagcaggctcctcagccct

SEQ ID NO: 6722887 - DNA, 21 bp, Homo sapiens
ccagcaggctcctcagccctc

SEQ ID NO: 6722888 - DNA, 23 bp, Homo sapiens
ccagcaggctcctggctgtgccc

SEQ ID NO: 6722889 - DNA, 17 bp, Homo sapiens
ccagcaggctctcaggc

SEQ ID NO: 6722890 - DNA, 18 bp, Homo sapiens
ccagcaggctctcaggcc

SEQ ID NO: 6722891 - DNA, 20 bp, Homo sapiens
ccagcaggctctcaggccag

SEQ ID NO: 6722892 - DNA, 20 bp, Homo sapiens
ccagcagggcatcttggaaa

SEQ ID NO: 6722893 - DNA, 15 bp, Homo sapiens
ccagcagggctgtga

SEQ ID NO: 6722894 - DNA, 22 bp, Homo sapiens
ccagcaggggcagaaggaggaa

SEQ ID NO: 6722895 - DNA, 18 bp, Homo sapiens
ccagcaggggccctcact

SEQ ID NO: 6722896 - DNA, 17 bp, Homo sapiens
ccagcagtacaataaaa

SEQ ID NO: 6722897 - DNA, 21 bp, Homo sapiens
ccagcagtcaattaacaataa

SEQ ID NO: 6722898 - DNA, 16 bp, Homo sapiens
ccagcagtcacaggtc

SEQ ID NO: 6722899 - DNA, 17 bp, Homo sapiens
ccagcagtcacttcggc

SEQ ID NO: 6722900 - DNA, 14 bp, Homo sapiens
ccagcagtcctggg

SEQ ID NO: 6722901 - DNA, 16 bp, Homo sapiens
ccagcagtgctgggcc

SEQ ID NO: 6722902 - DNA, 18 bp, Homo sapiens
ccagcagtgggggtcaga

SEQ ID NO: 6722903 - DNA, 20 bp, Homo sapiens
ccagcagtggtattaatact

SEQ ID NO: 6722904 - DNA, 18 bp, Homo sapiens
ccagcagtgtggagaccc

SEQ ID NO: 6722905 - DNA, 22 bp, Homo sapiens
ccagcagtgttgctcagctcct

SEQ ID NO: 6722906 - DNA, 20 bp, Homo sapiens
ccagcagtgtttaaaaaatg

SEQ ID NO: 6722907 - DNA, 18 bp, Homo sapiens
ccagcagttcagagctgc

SEQ ID NO: 6722908 - DNA, 22 bp, Homo sapiens
ccagcagttgaatgacaacaga

SEQ ID NO: 6722909 - DNA, 15 bp, Homo sapiens
ccagcagttgttcca

SEQ ID NO: 6722910 - DNA, 22 bp, Homo sapiens
ccagcagttttcaagtcaaatt

SEQ ID NO: 6722911 - DNA, 12 bp, Homo sapiens
ccagcatacagt

SEQ ID NO: 6722912 - DNA, 16 bp, Homo sapiens
ccagcatacagtttgg

SEQ ID NO: 6722913 - DNA, 13 bp, Homo sapiens
ccagcatacattt

SEQ ID NO: 6722914 - DNA, 19 bp, Homo sapiens
ccagcataggggggagggt

SEQ ID NO: 6722915 - DNA, 19 bp, Homo sapiens
ccagcatatatagtattta

SEQ ID NO: 6722916 - DNA, 17 bp, Homo sapiens
ccagcatcacctgcctg

SEQ ID NO: 6722917 - DNA, 16 bp, Homo sapiens
ccagcatcagcacagc

SEQ ID NO: 6722918 - DNA, 18 bp, Homo sapiens
ccagcatccacactgccg

SEQ ID NO: 6722919 - DNA, 19 bp, Homo sapiens
ccagcatccaccttggctc

SEQ ID NO: 6722920 - DNA, 15 bp, Homo sapiens
ccagcatccagcctg

SEQ ID NO: 6722921 - DNA, 18 bp, Homo sapiens
ccagcatccagcctgtgt

SEQ ID NO: 6722922 - DNA, 15 bp, Homo sapiens
ccagcatcccagcct

SEQ ID NO: 6722923 - DNA, 12 bp, Homo sapiens
ccagcatccctg

SEQ ID NO: 6722924 - DNA, 19 bp, Homo sapiens
ccagcatccctggagcagg

SEQ ID NO: 6722925 - DNA, 18 bp, Homo sapiens
ccagcatcccttgaccag

SEQ ID NO: 6722926 - DNA, 15 bp, Homo sapiens
ccagcatcctgcttc

SEQ ID NO: 6722927 - DNA, 15 bp, Homo sapiens
ccagcatcgggggcc

SEQ ID NO: 6722928 - DNA, 17 bp, Homo sapiens
ccagcatcgggggcctg

SEQ ID NO: 6722929 - DNA, 18 bp, Homo sapiens
ccagcatcgggggcctgc

SEQ ID NO: 6722930 - DNA, 19 bp, Homo sapiens
ccagcatcgggggcctgca

SEQ ID NO: 6722931 - DNA, 20 bp, Homo sapiens
ccagcatcgggggcctgcaa

SEQ ID NO: 6722932 - DNA, 11 bp, Homo sapiens
ccagcatctcc

SEQ ID NO: 6722933 - DNA, 12 bp, Homo sapiens
ccagcatctctg

SEQ ID NO: 6722934 - DNA, 18 bp, Homo sapiens
ccagcatctggaagatgt

SEQ ID NO: 6722935 - DNA, 13 bp, Homo sapiens
ccagcatctgggc

SEQ ID NO: 6722936 - DNA, 14 bp, Homo sapiens
ccagcatctgggcc

SEQ ID NO: 6722937 - DNA, 21 bp, Homo sapiens
ccagcatctgggccttggcct

SEQ ID NO: 6722938 - DNA, 19 bp, Homo sapiens
ccagcatcttttccatcct

SEQ ID NO: 6722939 - DNA, 22 bp, Homo sapiens
ccagcatcttttccatcctgag

SEQ ID NO: 6722940 - DNA, 18 bp, Homo sapiens
ccagcatgacataacagt

SEQ ID NO: 6722941 - DNA, 21 bp, Homo sapiens
ccagcatgacataacagtgca

SEQ ID NO: 6722942 - DNA, 18 bp, Homo sapiens
ccagcatgactttcctta

SEQ ID NO: 6722943 - DNA, 18 bp, Homo sapiens
ccagcatgcaccacgggc

SEQ ID NO: 6722944 - DNA, 19 bp, Homo sapiens
ccagcatggatgaaacctt

SEQ ID NO: 6722945 - DNA, 19 bp, Homo sapiens
ccagcatgtaaagagctgg

SEQ ID NO: 6722946 - DNA, 19 bp, Homo sapiens
ccagcatgtcactcccaga

SEQ ID NO: 6722947 - DNA, 11 bp, Homo sapiens
ccagcatgtgt

SEQ ID NO: 6722948 - DNA, 12 bp, Homo sapiens
ccagcatgtgtg

SEQ ID NO: 6722949 - DNA, 15 bp, Homo sapiens
ccagcattacgatcc

SEQ ID NO: 6722950 - DNA, 16 bp, Homo sapiens
ccagcattcagcacac

SEQ ID NO: 6722951 - DNA, 14 bp, Homo sapiens
ccagcattccagcc

SEQ ID NO: 6722952 - DNA, 18 bp, Homo sapiens
ccagcattccagcccctc

SEQ ID NO: 6722953 - DNA, 14 bp, Homo sapiens
ccagcattccagct

SEQ ID NO: 6722954 - DNA, 18 bp, Homo sapiens
ccagcattccagctctgc

SEQ ID NO: 6722955 - DNA, 20 bp, Homo sapiens
ccagcattccagctctgccc

SEQ ID NO: 6722956 - DNA, 15 bp, Homo sapiens
ccagcattcccaggt

SEQ ID NO: 6722957 - DNA, 14 bp, Homo sapiens
ccagcattccctac

SEQ ID NO: 6722958 - DNA, 16 bp, Homo sapiens
ccagcattctcaggca

SEQ ID NO: 6722959 - DNA, 20 bp, Homo sapiens
ccagcattctcaggcaccag

SEQ ID NO: 6722960 - DNA, 17 bp, Homo sapiens
ccagcattgctggttct

SEQ ID NO: 6722961 - DNA, 22 bp, Homo sapiens
ccagcattgttgagctgtcatc

SEQ ID NO: 6722962 - DNA, 16 bp, Homo sapiens
ccagcatttagctggc

SEQ ID NO: 6722963 - DNA, 18 bp, Homo sapiens
ccagcatttagctggcca

SEQ ID NO: 6722964 - DNA, 20 bp, Homo sapiens
ccagcatttagctggccaca

SEQ ID NO: 6722965 - DNA, 23 bp, Homo sapiens
ccagcatttggttttacacagga

SEQ ID NO: 6722966 - DNA, 17 bp, Homo sapiens
ccagcatttgtccaccc

SEQ ID NO: 6722967 - DNA, 15 bp, Homo sapiens
ccagcatttgtcctt

SEQ ID NO: 6722968 - DNA, 19 bp, Homo sapiens
ccagcattttgagaggctg

SEQ ID NO: 6722969 - DNA, 15 bp, Homo sapiens
ccagccaaagcctcc

SEQ ID NO: 6722970 - DNA, 18 bp, Homo sapiens
ccagccaacccctgtgga

SEQ ID NO: 6722971 - DNA, 22 bp, Homo sapiens
ccagccaacttttgcatgtttt

SEQ ID NO: 6722972 - DNA, 21 bp, Homo sapiens
ccagccaaggataccggacac

SEQ ID NO: 6722973 - DNA, 14 bp, Homo sapiens
ccagccaagggtcc

SEQ ID NO: 6722974 - DNA, 13 bp, Homo sapiens
ccagccaagtgcc

SEQ ID NO: 6722975 - DNA, 13 bp, Homo sapiens
ccagccacacaga

SEQ ID NO: 6722976 - DNA, 19 bp, Homo sapiens
ccagccacacagagcctgc

SEQ ID NO: 6722977 - DNA, 15 bp, Homo sapiens
ccagccacagacccc

SEQ ID NO: 6722978 - DNA, 18 bp, Homo sapiens
ccagccacagacccctgg

SEQ ID NO: 6722979 - DNA, 22 bp, Homo sapiens
ccagccacagacccctgggagc

SEQ ID NO: 6722980 - DNA, 20 bp, Homo sapiens
ccagccacagcctccccacc

SEQ ID NO: 6722981 - DNA, 11 bp, Homo sapiens
ccagccacagg

SEQ ID NO: 6722982 - DNA, 12 bp, Homo sapiens
ccagccacagga

SEQ ID NO: 6722983 - DNA, 14 bp, Homo sapiens
ccagccacaggacc

SEQ ID NO: 6722984 - DNA, 15 bp, Homo sapiens
ccagccacaggacca

SEQ ID NO: 6722985 - DNA, 18 bp, Homo sapiens
ccagccacaggaccacct

SEQ ID NO: 6722986 - DNA, 14 bp, Homo sapiens
ccagccacaggcca

SEQ ID NO: 6722987 - DNA, 20 bp, Homo sapiens
ccagccacagtacatatgta

SEQ ID NO: 6722988 - DNA, 18 bp, Homo sapiens
ccagccaccaaggctgcc

SEQ ID NO: 6722989 - DNA, 24 bp, Homo sapiens
ccagccaccaccctcaggtgcctc

SEQ ID NO: 6722990 - DNA, 18 bp, Homo sapiens
ccagccacccagccagga

SEQ ID NO: 6722991 - DNA, 11 bp, Homo sapiens
ccagccacccc

SEQ ID NO: 6722992 - DNA, 22 bp, Homo sapiens
ccagccaccccgggctctctgc

SEQ ID NO: 6722993 - DNA, 17 bp, Homo sapiens
ccagccacccctcagat

SEQ ID NO: 6722994 - DNA, 19 bp, Homo sapiens
ccagccacccctgccactc

SEQ ID NO: 6722995 - DNA, 21 bp, Homo sapiens
ccagccacccggatctccagg

SEQ ID NO: 6722996 - DNA, 22 bp, Homo sapiens
ccagccacccggatctccaggc

SEQ ID NO: 6722997 - DNA, 13 bp, Homo sapiens
ccagccacctccc

SEQ ID NO: 6722998 - DNA, 18 bp, Homo sapiens
ccagccaccttcctgact

SEQ ID NO: 6722999 - DNA, 21 bp, Homo sapiens
ccagccaccttcctgactggg

SEQ ID NO: 6723000 - DNA, 18 bp, Homo sapiens
ccagccacgcagggccat

SEQ ID NO: 6723001 - DNA, 24 bp, Homo sapiens
ccagccacgcagggccatccactg

SEQ ID NO: 6723002 - DNA, 22 bp, Homo sapiens
ccagccacggagggaggcacca

SEQ ID NO: 6723003 - DNA, 21 bp, Homo sapiens
ccagccactccaagccccctg

SEQ ID NO: 6723004 - DNA, 16 bp, Homo sapiens
ccagccactccccagc

SEQ ID NO: 6723005 - DNA, 22 bp, Homo sapiens
ccagccactccccagccagcct

SEQ ID NO: 6723006 - DNA, 14 bp, Homo sapiens
ccagccactgcagc

SEQ ID NO: 6723007 - DNA, 19 bp, Homo sapiens
ccagccactgtcaccgagc

SEQ ID NO: 6723008 - DNA, 14 bp, Homo sapiens
ccagccagacccca

SEQ ID NO: 6723009 - DNA, 19 bp, Homo sapiens
ccagccagagtttgcctcc

SEQ ID NO: 6723010 - DNA, 22 bp, Homo sapiens
ccagccagcaatgatgtccaga

SEQ ID NO: 6723011 - DNA, 14 bp, Homo sapiens
ccagccagcagcag

SEQ ID NO: 6723012 - DNA, 13 bp, Homo sapiens
ccagccagcagcc

SEQ ID NO: 6723013 - DNA, 13 bp, Homo sapiens
ccagccagcagga

SEQ ID NO: 6723014 - DNA, 13 bp, Homo sapiens
ccagccagcaggt

SEQ ID NO: 6723015 - DNA, 14 bp, Homo sapiens
ccagccagccactc

SEQ ID NO: 6723016 - DNA, 15 bp, Homo sapiens
ccagccagccactct

SEQ ID NO: 6723017 - DNA, 16 bp, Homo sapiens
ccagccagccactcta

SEQ ID NO: 6723018 - DNA, 12 bp, Homo sapiens
ccagccagcccg

SEQ ID NO: 6723019 - DNA, 14 bp, Homo sapiens
ccagccagccctgg

SEQ ID NO: 6723020 - DNA, 13 bp, Homo sapiens
ccagccagccctt

SEQ ID NO: 6723021 - DNA, 20 bp, Homo sapiens
ccagccagcccttcccaggc

SEQ ID NO: 6723022 - DNA, 22 bp, Homo sapiens
ccagccagcgcaggccctggtg

SEQ ID NO: 6723023 - DNA, 20 bp, Homo sapiens
ccagccagcgcctccctcca

SEQ ID NO: 6723024 - DNA, 22 bp, Homo sapiens
ccagccagcgcctccctccacc

SEQ ID NO: 6723025 - DNA, 20 bp, Homo sapiens
ccagccagcgtcccttggtg

SEQ ID NO: 6723026 - DNA, 14 bp, Homo sapiens
ccagccagctcctg

SEQ ID NO: 6723027 - DNA, 17 bp, Homo sapiens
ccagccagctgcagggc

SEQ ID NO: 6723028 - DNA, 18 bp, Homo sapiens
ccagccagctgcagggca

SEQ ID NO: 6723029 - DNA, 19 bp, Homo sapiens
ccagccagctgcagggcac

SEQ ID NO: 6723030 - DNA, 21 bp, Homo sapiens
ccagccagctgcagggcacgg

SEQ ID NO: 6723031 - DNA, 17 bp, Homo sapiens
ccagccaggaagatgaa

SEQ ID NO: 6723032 - DNA, 22 bp, Homo sapiens
ccagccaggatcccaagcgtcc

SEQ ID NO: 6723033 - DNA, 23 bp, Homo sapiens
ccagccaggatcccaagcgtccc

SEQ ID NO: 6723034 - DNA, 13 bp, Homo sapiens
ccagccaggccca

SEQ ID NO: 6723035 - DNA, 18 bp, Homo sapiens
ccagccaggcccagccga

SEQ ID NO: 6723036 - DNA, 20 bp, Homo sapiens
ccagccaggcccagccgacc

SEQ ID NO: 6723037 - DNA, 17 bp, Homo sapiens
ccagccaggcccaggcc

SEQ ID NO: 6723038 - DNA, 21 bp, Homo sapiens
ccagccaggcccaggccagcc

SEQ ID NO: 6723039 - DNA, 17 bp, Homo sapiens
ccagccaggccccaggc

SEQ ID NO: 6723040 - DNA, 13 bp, Homo sapiens
ccagccaggccct

SEQ ID NO: 6723041 - DNA, 17 bp, Homo sapiens
ccagccaggcgggctca

SEQ ID NO: 6723042 - DNA, 21 bp, Homo sapiens
ccagccaggcgggctcaagga

SEQ ID NO: 6723043 - DNA, 14 bp, Homo sapiens
ccagccaggctctg

SEQ ID NO: 6723044 - DNA, 15 bp, Homo sapiens
ccagccaggctctgt

SEQ ID NO: 6723045 - DNA, 19 bp, Homo sapiens
ccagccagggagcttgcca

SEQ ID NO: 6723046 - DNA, 14 bp, Homo sapiens
ccagccagggctgc

SEQ ID NO: 6723047 - DNA, 22 bp, Homo sapiens
ccagccagtcttgcctaggcca

SEQ ID NO: 6723048 - DNA, 22 bp, Homo sapiens
ccagccagtgacctgaggaagc

SEQ ID NO: 6723049 - DNA, 23 bp, Homo sapiens
ccagccagtgacctgaggaagcg

SEQ ID NO: 6723050 - DNA, 12 bp, Homo sapiens
ccagccagtggc

SEQ ID NO: 6723051 - DNA, 18 bp, Homo sapiens
ccagccagttggtggggc

SEQ ID NO: 6723052 - DNA, 21 bp, Homo sapiens
ccagccataaaagcattgtct

SEQ ID NO: 6723053 - DNA, 20 bp, Homo sapiens
ccagccatcaagagactgag

SEQ ID NO: 6723054 - DNA, 16 bp, Homo sapiens
ccagccatcacaaggg

SEQ ID NO: 6723055 - DNA, 15 bp, Homo sapiens
ccagccatctgccca

SEQ ID NO: 6723056 - DNA, 17 bp, Homo sapiens
ccagccatctgcccagg

SEQ ID NO: 6723057 - DNA, 16 bp, Homo sapiens
ccagccatgccagctg

SEQ ID NO: 6723058 - DNA, 14 bp, Homo sapiens
ccagccatgcccag

SEQ ID NO: 6723059 - DNA, 13 bp, Homo sapiens
ccagccatggctg

SEQ ID NO: 6723060 - DNA, 17 bp, Homo sapiens
ccagccattctggtatt

SEQ ID NO: 6723061 - DNA, 13 bp, Homo sapiens
ccagcccaaacct

SEQ ID NO: 6723062 - DNA, 15 bp, Homo sapiens
ccagcccaaacctgg

SEQ ID NO: 6723063 - DNA, 17 bp, Homo sapiens
ccagcccaaacctggga

SEQ ID NO: 6723064 - DNA, 13 bp, Homo sapiens
ccagcccaagcac

SEQ ID NO: 6723065 - DNA, 18 bp, Homo sapiens
ccagcccaagtagagggg

SEQ ID NO: 6723066 - DNA, 19 bp, Homo sapiens
ccagcccaagtgaggcagc

SEQ ID NO: 6723067 - DNA, 21 bp, Homo sapiens
ccagcccaagtgaggcagccg

SEQ ID NO: 6723068 - DNA, 11 bp, Homo sapiens
ccagcccaata

SEQ ID NO: 6723069 - DNA, 12 bp, Homo sapiens
ccagcccaataa

SEQ ID NO: 6723070 - DNA, 15 bp, Homo sapiens
ccagcccaataaagg

SEQ ID NO: 6723071 - DNA, 12 bp, Homo sapiens
ccagcccacacc

SEQ ID NO: 6723072 - DNA, 15 bp, Homo sapiens
ccagcccacagagcc

SEQ ID NO: 6723073 - DNA, 19 bp, Homo sapiens
ccagcccacagtgctcagt

SEQ ID NO: 6723074 - DNA, 22 bp, Homo sapiens
ccagcccacatccattccagag

SEQ ID NO: 6723075 - DNA, 17 bp, Homo sapiens
ccagcccaccccatggc

SEQ ID NO: 6723076 - DNA, 13 bp, Homo sapiens
ccagcccaccccc

SEQ ID NO: 6723077 - DNA, 21 bp, Homo sapiens
ccagcccacccccggcagcag

SEQ ID NO: 6723078 - DNA, 15 bp, Homo sapiens
ccagcccaccctgcc

SEQ ID NO: 6723079 - DNA, 15 bp, Homo sapiens
ccagcccaccctgct

SEQ ID NO: 6723080 - DNA, 17 bp, Homo sapiens
ccagcccacctgctccc

SEQ ID NO: 6723081 - DNA, 18 bp, Homo sapiens
ccagcccacctgctccca

SEQ ID NO: 6723082 - DNA, 21 bp, Homo sapiens
ccagcccacgctgactacagg

SEQ ID NO: 6723083 - DNA, 13 bp, Homo sapiens
ccagcccactgcc

SEQ ID NO: 6723084 - DNA, 14 bp, Homo sapiens
ccagcccactgcct

SEQ ID NO: 6723085 - DNA, 16 bp, Homo sapiens
ccagcccacttctgcc

SEQ ID NO: 6723086 - DNA, 17 bp, Homo sapiens
ccagcccacttctgcca

SEQ ID NO: 6723087 - DNA, 18 bp, Homo sapiens
ccagcccagacagcaagg

SEQ ID NO: 6723088 - DNA, 12 bp, Homo sapiens
ccagcccagaga

SEQ ID NO: 6723089 - DNA, 13 bp, Homo sapiens
ccagcccagagac

SEQ ID NO: 6723090 - DNA, 13 bp, Homo sapiens
ccagcccagagcc

SEQ ID NO: 6723091 - DNA, 17 bp, Homo sapiens
ccagcccagagcccggt

SEQ ID NO: 6723092 - DNA, 15 bp, Homo sapiens
ccagcccagatgttt

SEQ ID NO: 6723093 - DNA, 17 bp, Homo sapiens
ccagcccagattgtctt

SEQ ID NO: 6723094 - DNA, 11 bp, Homo sapiens
ccagcccagca

SEQ ID NO: 6723095 - DNA, 13 bp, Homo sapiens
ccagcccagcacc

SEQ ID NO: 6723096 - DNA, 17 bp, Homo sapiens
ccagcccagcacccctt

SEQ ID NO: 6723097 - DNA, 18 bp, Homo sapiens
ccagcccagcaccccttc

SEQ ID NO: 6723098 - DNA, 13 bp, Homo sapiens
ccagcccagcaga

SEQ ID NO: 6723099 - DNA, 14 bp, Homo sapiens
ccagcccagcagac

SEQ ID NO: 6723100 - DNA, 11 bp, Homo sapiens
ccagcccagcc

SEQ ID NO: 6723101 - DNA, 13 bp, Homo sapiens
ccagcccagccag

SEQ ID NO: 6723102 - DNA, 16 bp, Homo sapiens
ccagcccagccccact

SEQ ID NO: 6723103 - DNA, 16 bp, Homo sapiens
ccagcccagcctgccc

SEQ ID NO: 6723104 - DNA, 12 bp, Homo sapiens
ccagcccagctg

SEQ ID NO: 6723105 - DNA, 16 bp, Homo sapiens
ccagcccagctgctct

SEQ ID NO: 6723106 - DNA, 23 bp, Homo sapiens
ccagcccagctgctctgcccaga

SEQ ID NO: 6723107 - DNA, 22 bp, Homo sapiens
ccagcccaggagtttgaggctg

SEQ ID NO: 6723108 - DNA, 16 bp, Homo sapiens
ccagcccaggcctggt

SEQ ID NO: 6723109 - DNA, 15 bp, Homo sapiens
ccagcccagggctcc

SEQ ID NO: 6723110 - DNA, 21 bp, Homo sapiens
ccagcccagggttcccccagc

SEQ ID NO: 6723111 - DNA, 17 bp, Homo sapiens
ccagcccatctcggagc

SEQ ID NO: 6723112 - DNA, 20 bp, Homo sapiens
ccagcccatctcggagcatc

SEQ ID NO: 6723113 - DNA, 15 bp, Homo sapiens
ccagcccatgctggc

SEQ ID NO: 6723114 - DNA, 16 bp, Homo sapiens
ccagcccatgctggct

SEQ ID NO: 6723115 - DNA, 18 bp, Homo sapiens
ccagcccatgctggctgg

SEQ ID NO: 6723116 - DNA, 23 bp, Homo sapiens
ccagcccatggagattgacctgg

SEQ ID NO: 6723117 - DNA, 20 bp, Homo sapiens
ccagcccatggcccccaata

SEQ ID NO: 6723118 - DNA, 21 bp, Homo sapiens
ccagcccatggcccccaataa

SEQ ID NO: 6723119 - DNA, 23 bp, Homo sapiens
ccagcccatggcccccaataaag

SEQ ID NO: 6723120 - DNA, 17 bp, Homo sapiens
ccagcccattctctctc

SEQ ID NO: 6723121 - DNA, 21 bp, Homo sapiens
ccagcccattctctctcctgt

SEQ ID NO: 6723122 - DNA, 14 bp, Homo sapiens
ccagcccattgctg

SEQ ID NO: 6723123 - DNA, 19 bp, Homo sapiens
ccagcccattggccgagct

SEQ ID NO: 6723124 - DNA, 23 bp, Homo sapiens
ccagcccattggccgagctcctg

SEQ ID NO: 6723125 - DNA, 18 bp, Homo sapiens
ccagcccatttgggcaga

SEQ ID NO: 6723126 - DNA, 13 bp, Homo sapiens
ccagccccaagct

SEQ ID NO: 6723127 - DNA, 14 bp, Homo sapiens
ccagccccacacag

SEQ ID NO: 6723128 - DNA, 16 bp, Homo sapiens
ccagccccacacagct

SEQ ID NO: 6723129 - DNA, 17 bp, Homo sapiens
ccagccccacccaggag

SEQ ID NO: 6723130 - DNA, 17 bp, Homo sapiens
ccagccccacccccagc

SEQ ID NO: 6723131 - DNA, 22 bp, Homo sapiens
ccagccccacccccagccaggc

SEQ ID NO: 6723132 - DNA, 19 bp, Homo sapiens
ccagccccaccctgttttg

SEQ ID NO: 6723133 - DNA, 17 bp, Homo sapiens
ccagccccactgccctc

SEQ ID NO: 6723134 - DNA, 22 bp, Homo sapiens
ccagccccactgccctccaggg

SEQ ID NO: 6723135 - DNA, 14 bp, Homo sapiens
ccagccccagcaag

SEQ ID NO: 6723136 - DNA, 13 bp, Homo sapiens
ccagccccaggcc

SEQ ID NO: 6723137 - DNA, 16 bp, Homo sapiens
ccagccccaggcctgg

SEQ ID NO: 6723138 - DNA, 17 bp, Homo sapiens
ccagccccaggcctggc

SEQ ID NO: 6723139 - DNA, 12 bp, Homo sapiens
ccagccccaggg

SEQ ID NO: 6723140 - DNA, 14 bp, Homo sapiens
ccagccccaggggt

SEQ ID NO: 6723141 - DNA, 23 bp, Homo sapiens
ccagccccaggggtgcctgtggg

SEQ ID NO: 6723142 - DNA, 11 bp, Homo sapiens
ccagccccatc

SEQ ID NO: 6723143 - DNA, 19 bp, Homo sapiens
ccagccccatccctgtcct

SEQ ID NO: 6723144 - DNA, 15 bp, Homo sapiens
ccagccccatcctct

SEQ ID NO: 6723145 - DNA, 23 bp, Homo sapiens
ccagccccatcttggtcctgtca

SEQ ID NO: 6723146 - DNA, 19 bp, Homo sapiens
ccagcccccacagccctgg

SEQ ID NO: 6723147 - DNA, 18 bp, Homo sapiens
ccagcccccacccatgcc

SEQ ID NO: 6723148 - DNA, 22 bp, Homo sapiens
ccagcccccacccatgccagcg

SEQ ID NO: 6723149 - DNA, 14 bp, Homo sapiens
ccagcccccagggc

SEQ ID NO: 6723150 - DNA, 18 bp, Homo sapiens
ccagcccccagtgcgctc

SEQ ID NO: 6723151 - DNA, 16 bp, Homo sapiens
ccagccccccacccca

SEQ ID NO: 6723152 - DNA, 15 bp, Homo sapiens
ccagcccccccaccc

SEQ ID NO: 6723153 - DNA, 19 bp, Homo sapiens
ccagcccccccacccaccc

SEQ ID NO: 6723154 - DNA, 20 bp, Homo sapiens
ccagcccccccacccacccc

SEQ ID NO: 6723155 - DNA, 16 bp, Homo sapiens
ccagccccccgcgcgc

SEQ ID NO: 6723156 - DNA, 22 bp, Homo sapiens
ccagccccccgcgcgcccaccc

SEQ ID NO: 6723157 - DNA, 22 bp, Homo sapiens
ccagccccctaagagagcacct

SEQ ID NO: 6723158 - DNA, 18 bp, Homo sapiens
ccagccccctccagctca

SEQ ID NO: 6723159 - DNA, 14 bp, Homo sapiens
ccagccccctccca

SEQ ID NO: 6723160 - DNA, 17 bp, Homo sapiens
ccagccccctcccaccg

SEQ ID NO: 6723161 - DNA, 23 bp, Homo sapiens
ccagccccctcccaccgctgcct

SEQ ID NO: 6723162 - DNA, 18 bp, Homo sapiens
ccagccccctcctggtgc

SEQ ID NO: 6723163 - DNA, 14 bp, Homo sapiens
ccagccccctgacc

SEQ ID NO: 6723164 - DNA, 20 bp, Homo sapiens
ccagccccctttgggcccag

SEQ ID NO: 6723165 - DNA, 15 bp, Homo sapiens
ccagccccgactcca

SEQ ID NO: 6723166 - DNA, 19 bp, Homo sapiens
ccagccccgactccagcca

SEQ ID NO: 6723167 - DNA, 21 bp, Homo sapiens
ccagccccggcaagccacagg

SEQ ID NO: 6723168 - DNA, 17 bp, Homo sapiens
ccagccccggggtgagt

SEQ ID NO: 6723169 - DNA, 16 bp, Homo sapiens
ccagccccgtcccaga

SEQ ID NO: 6723170 - DNA, 18 bp, Homo sapiens
ccagccccgtcccagagg

SEQ ID NO: 6723171 - DNA, 19 bp, Homo sapiens
ccagccccgtcccagaggc

SEQ ID NO: 6723172 - DNA, 20 bp, Homo sapiens
ccagccccgtcccagaggcc

SEQ ID NO: 6723173 - DNA, 17 bp, Homo sapiens
ccagccccgtgccagga

SEQ ID NO: 6723174 - DNA, 18 bp, Homo sapiens
ccagcccctaagccccgt

SEQ ID NO: 6723175 - DNA, 15 bp, Homo sapiens
ccagcccctagaaac

SEQ ID NO: 6723176 - DNA, 13 bp, Homo sapiens
ccagcccctccca

SEQ ID NO: 6723177 - DNA, 14 bp, Homo sapiens
ccagcccctcccac

SEQ ID NO: 6723178 - DNA, 17 bp, Homo sapiens
ccagcccctcccccatc

SEQ ID NO: 6723179 - DNA, 18 bp, Homo sapiens
ccagcccctccccgcctc

SEQ ID NO: 6723180 - DNA, 20 bp, Homo sapiens
ccagcccctcctccccttcc

SEQ ID NO: 6723181 - DNA, 23 bp, Homo sapiens
ccagcccctcctccccttcctgc

SEQ ID NO: 6723182 - DNA, 20 bp, Homo sapiens
ccagcccctcctccctcagg

SEQ ID NO: 6723183 - DNA, 23 bp, Homo sapiens
ccagcccctctcccctctctgct

SEQ ID NO: 6723184 - DNA, 13 bp, Homo sapiens
ccagcccctctgg

SEQ ID NO: 6723185 - DNA, 14 bp, Homo sapiens
ccagcccctctggt

SEQ ID NO: 6723186 - DNA, 15 bp, Homo sapiens
ccagcccctctggtc

SEQ ID NO: 6723187 - DNA, 17 bp, Homo sapiens
ccagcccctctggtcgc

SEQ ID NO: 6723188 - DNA, 23 bp, Homo sapiens
ccagcccctctggtcgctcctgc

SEQ ID NO: 6723189 - DNA, 17 bp, Homo sapiens
ccagcccctcttcccca

SEQ ID NO: 6723190 - DNA, 18 bp, Homo sapiens
ccagcccctgccccagcc

SEQ ID NO: 6723191 - DNA, 22 bp, Homo sapiens
ccagcccctgccccagcccaag

SEQ ID NO: 6723192 - DNA, 15 bp, Homo sapiens
ccagcccctgcccct

SEQ ID NO: 6723193 - DNA, 14 bp, Homo sapiens
ccagcccctgcctg

SEQ ID NO: 6723194 - DNA, 15 bp, Homo sapiens
ccagcccctgcctgg

SEQ ID NO: 6723195 - DNA, 14 bp, Homo sapiens
ccagcccctgctgg

SEQ ID NO: 6723196 - DNA, 15 bp, Homo sapiens
ccagcccctgctggc

SEQ ID NO: 6723197 - DNA, 18 bp, Homo sapiens
ccagcccctgctggctgg

SEQ ID NO: 6723198 - DNA, 11 bp, Homo sapiens
ccagcccctgg

SEQ ID NO: 6723199 - DNA, 20 bp, Homo sapiens
ccagcccctggacccctggg

SEQ ID NO: 6723200 - DNA, 21 bp, Homo sapiens
ccagcccctggacccctgggg

SEQ ID NO: 6723201 - DNA, 18 bp, Homo sapiens
ccagcccctggatgcagc

SEQ ID NO: 6723202 - DNA, 23 bp, Homo sapiens
ccagcccctggccccaggacctg

SEQ ID NO: 6723203 - DNA, 14 bp, Homo sapiens
ccagcccctggggc

SEQ ID NO: 6723204 - DNA, 16 bp, Homo sapiens
ccagcccctggggccc

SEQ ID NO: 6723205 - DNA, 21 bp, Homo sapiens
ccagcccctggggcccagccc

SEQ ID NO: 6723206 - DNA, 22 bp, Homo sapiens
ccagcccctggtggtgggggct

SEQ ID NO: 6723207 - DNA, 11 bp, Homo sapiens
ccagcccctgt

SEQ ID NO: 6723208 - DNA, 13 bp, Homo sapiens
ccagcccctgtcc

SEQ ID NO: 6723209 - DNA, 10 bp, Homo sapiens
ccagcccctt

SEQ ID NO: 6723210 - DNA, 16 bp, Homo sapiens
ccagccccttcccctg

SEQ ID NO: 6723211 - DNA, 19 bp, Homo sapiens
ccagccccttcccctggga

SEQ ID NO: 6723212 - DNA, 16 bp, Homo sapiens
ccagccccttctcaga

SEQ ID NO: 6723213 - DNA, 16 bp, Homo sapiens
ccagccccttctgacc

SEQ ID NO: 6723214 - DNA, 17 bp, Homo sapiens
ccagccccttctgaccc

SEQ ID NO: 6723215 - DNA, 14 bp, Homo sapiens
ccagcccctttcca

SEQ ID NO: 6723216 - DNA, 17 bp, Homo sapiens
ccagcccctttccaaaa

SEQ ID NO: 6723217 - DNA, 17 bp, Homo sapiens
ccagcccctttgcctct

SEQ ID NO: 6723218 - DNA, 19 bp, Homo sapiens
ccagccccttttctctgct

SEQ ID NO: 6723219 - DNA, 16 bp, Homo sapiens
ccagcccgaacaccat

SEQ ID NO: 6723220 - DNA, 17 bp, Homo sapiens
ccagcccgaacaccatt

SEQ ID NO: 6723221 - DNA, 22 bp, Homo sapiens
ccagcccgacagtgccatcccc

SEQ ID NO: 6723222 - DNA, 20 bp, Homo sapiens
ccagcccgcaactctccagc

SEQ ID NO: 6723223 - DNA, 16 bp, Homo sapiens
ccagcccgccgcccgc

SEQ ID NO: 6723224 - DNA, 13 bp, Homo sapiens
ccagcccgcggcc

SEQ ID NO: 6723225 - DNA, 22 bp, Homo sapiens
ccagcccggccgctccaccagc

SEQ ID NO: 6723226 - DNA, 14 bp, Homo sapiens
ccagcccggcctgc

SEQ ID NO: 6723227 - DNA, 16 bp, Homo sapiens
ccagcccggctcggcc

SEQ ID NO: 6723228 - DNA, 15 bp, Homo sapiens
ccagcccgggagcct

SEQ ID NO: 6723229 - DNA, 17 bp, Homo sapiens
ccagcccgggagcctag

SEQ ID NO: 6723230 - DNA, 21 bp, Homo sapiens
ccagccctacatcttcagctc

SEQ ID NO: 6723231 - DNA, 23 bp, Homo sapiens
ccagccctacatcttcagctccc

SEQ ID NO: 6723232 - DNA, 20 bp, Homo sapiens
ccagccctagctgtcccatg

SEQ ID NO: 6723233 - DNA, 13 bp, Homo sapiens
ccagccctaggct

SEQ ID NO: 6723234 - DNA, 13 bp, Homo sapiens
ccagccctcagaa

SEQ ID NO: 6723235 - DNA, 13 bp, Homo sapiens
ccagccctcagca

SEQ ID NO: 6723236 - DNA, 15 bp, Homo sapiens
ccagccctcaggcca

SEQ ID NO: 6723237 - DNA, 15 bp, Homo sapiens
ccagccctcagtcac

SEQ ID NO: 6723238 - DNA, 22 bp, Homo sapiens
ccagccctccagagcaggagac

SEQ ID NO: 6723239 - DNA, 14 bp, Homo sapiens
ccagccctcccagc

SEQ ID NO: 6723240 - DNA, 14 bp, Homo sapiens
ccagccctccccac

SEQ ID NO: 6723241 - DNA, 14 bp, Homo sapiens
ccagccctccccat

SEQ ID NO: 6723242 - DNA, 21 bp, Homo sapiens
ccagccctccccatggagcca

SEQ ID NO: 6723243 - DNA, 19 bp, Homo sapiens
ccagccctccctgtcctcc

SEQ ID NO: 6723244 - DNA, 22 bp, Homo sapiens
ccagccctccctgtcctcctcg

SEQ ID NO: 6723245 - DNA, 22 bp, Homo sapiens
ccagccctccgccagccctgtt

SEQ ID NO: 6723246 - DNA, 21 bp, Homo sapiens
ccagccctccttatcaaagga

SEQ ID NO: 6723247 - DNA, 17 bp, Homo sapiens
ccagccctccttcaggg

SEQ ID NO: 6723248 - DNA, 15 bp, Homo sapiens
ccagccctctgtggc

SEQ ID NO: 6723249 - DNA, 11 bp, Homo sapiens
ccagccctgag

SEQ ID NO: 6723250 - DNA, 13 bp, Homo sapiens
ccagccctgaggg

SEQ ID NO: 6723251 - DNA, 22 bp, Homo sapiens
ccagccctgaggggtggactag

SEQ ID NO: 6723252 - DNA, 13 bp, Homo sapiens
ccagccctgcacg

SEQ ID NO: 6723253 - DNA, 14 bp, Homo sapiens
ccagccctgcacga

SEQ ID NO: 6723254 - DNA, 13 bp, Homo sapiens
ccagccctgcagc

SEQ ID NO: 6723255 - DNA, 14 bp, Homo sapiens
ccagccctgcagcc

SEQ ID NO: 6723256 - DNA, 14 bp, Homo sapiens
ccagccctgccagg

SEQ ID NO: 6723257 - DNA, 17 bp, Homo sapiens
ccagccctgccaggagg

SEQ ID NO: 6723258 - DNA, 15 bp, Homo sapiens
ccagccctgcccaga

SEQ ID NO: 6723259 - DNA, 21 bp, Homo sapiens
ccagccctgctgcttcctaac

SEQ ID NO: 6723260 - DNA, 14 bp, Homo sapiens
ccagccctgctggc

SEQ ID NO: 6723261 - DNA, 16 bp, Homo sapiens
ccagccctgctggccg

SEQ ID NO: 6723262 - DNA, 20 bp, Homo sapiens
ccagccctgctggggatccc

SEQ ID NO: 6723263 - DNA, 20 bp, Homo sapiens
ccagccctggcccaggtgcc

SEQ ID NO: 6723264 - DNA, 17 bp, Homo sapiens
ccagccctggctctgca

SEQ ID NO: 6723265 - DNA, 17 bp, Homo sapiens
ccagccctggctgaagg

SEQ ID NO: 6723266 - DNA, 12 bp, Homo sapiens
ccagccctggga

SEQ ID NO: 6723267 - DNA, 16 bp, Homo sapiens
ccagccctgggcttgg

SEQ ID NO: 6723268 - DNA, 15 bp, Homo sapiens
ccagccctggggctg

SEQ ID NO: 6723269 - DNA, 21 bp, Homo sapiens
ccagccctggggtatgagctg

SEQ ID NO: 6723270 - DNA, 13 bp, Homo sapiens
ccagccctggtct

SEQ ID NO: 6723271 - DNA, 20 bp, Homo sapiens
ccagccctggtctcagcagc

SEQ ID NO: 6723272 - DNA, 15 bp, Homo sapiens
ccagccctggtggcc

SEQ ID NO: 6723273 - DNA, 22 bp, Homo sapiens
ccagccctggttctccatcccc

SEQ ID NO: 6723274 - DNA, 12 bp, Homo sapiens
ccagccctgtcc

SEQ ID NO: 6723275 - DNA, 14 bp, Homo sapiens
ccagccctgtcctg

SEQ ID NO: 6723276 - DNA, 21 bp, Homo sapiens
ccagccctgttccgcctcact

SEQ ID NO: 6723277 - DNA, 16 bp, Homo sapiens
ccagcccttagcaggg

SEQ ID NO: 6723278 - DNA, 16 bp, Homo sapiens
ccagcccttcccaggc

SEQ ID NO: 6723279 - DNA, 17 bp, Homo sapiens
ccagcccttcccaggcc

SEQ ID NO: 6723280 - DNA, 20 bp, Homo sapiens
ccagcccttcccaggccagc

SEQ ID NO: 6723281 - DNA, 16 bp, Homo sapiens
ccagcccttccctgct

SEQ ID NO: 6723282 - DNA, 17 bp, Homo sapiens
ccagcccttccctgctt

SEQ ID NO: 6723283 - DNA, 13 bp, Homo sapiens
ccagcccttcctc

SEQ ID NO: 6723284 - DNA, 18 bp, Homo sapiens
ccagcccttcctctgctc

SEQ ID NO: 6723285 - DNA, 13 bp, Homo sapiens
ccagcccttcctt

SEQ ID NO: 6723286 - DNA, 13 bp, Homo sapiens
ccagcccttctgc

SEQ ID NO: 6723287 - DNA, 14 bp, Homo sapiens
ccagcccttctgcc

SEQ ID NO: 6723288 - DNA, 15 bp, Homo sapiens
ccagcccttctgcct

SEQ ID NO: 6723289 - DNA, 20 bp, Homo sapiens
ccagcccttgagctccccaa

SEQ ID NO: 6723290 - DNA, 17 bp, Homo sapiens
ccagcccttgctctacc

SEQ ID NO: 6723291 - DNA, 20 bp, Homo sapiens
ccagccctttgggaggccga

SEQ ID NO: 6723292 - DNA, 21 bp, Homo sapiens
ccagcccttttgttgagccag

SEQ ID NO: 6723293 - DNA, 17 bp, Homo sapiens
ccagccgaccccctctc

SEQ ID NO: 6723294 - DNA, 18 bp, Homo sapiens
ccagccgaccccctctcc

SEQ ID NO: 6723295 - DNA, 20 bp, Homo sapiens
ccagccgaccccctctccct

SEQ ID NO: 6723296 - DNA, 14 bp, Homo sapiens
ccagccgaccctcc

SEQ ID NO: 6723297 - DNA, 15 bp, Homo sapiens
ccagccgaccctcct

SEQ ID NO: 6723298 - DNA, 16 bp, Homo sapiens
ccagccgaccctcctg

SEQ ID NO: 6723299 - DNA, 17 bp, Homo sapiens
ccagccgagatagccaa

SEQ ID NO: 6723300 - DNA, 16 bp, Homo sapiens
ccagccgattcctcca

SEQ ID NO: 6723301 - DNA, 18 bp, Homo sapiens
ccagccgattcctccagc

SEQ ID NO: 6723302 - DNA, 22 bp, Homo sapiens
ccagccgattcctccagccctg

SEQ ID NO: 6723303 - DNA, 18 bp, Homo sapiens
ccagccgccatgctcctg

SEQ ID NO: 6723304 - DNA, 16 bp, Homo sapiens
ccagccgccccagccc

SEQ ID NO: 6723305 - DNA, 18 bp, Homo sapiens
ccagccgccccagcccct

SEQ ID NO: 6723306 - DNA, 18 bp, Homo sapiens
ccagccgctctcctgcca

SEQ ID NO: 6723307 - DNA, 21 bp, Homo sapiens
ccagccgctctcctgccacat

SEQ ID NO: 6723308 - DNA, 14 bp, Homo sapiens
ccagccgctgcagg

SEQ ID NO: 6723309 - DNA, 21 bp, Homo sapiens
ccagccgctgcagggctccca

SEQ ID NO: 6723310 - DNA, 16 bp, Homo sapiens
ccagccgctgcccggc

SEQ ID NO: 6723311 - DNA, 21 bp, Homo sapiens
ccagccggacacaagcggccc

SEQ ID NO: 6723312 - DNA, 23 bp, Homo sapiens
ccagccggagggacgcggaggag

SEQ ID NO: 6723313 - DNA, 17 bp, Homo sapiens
ccagccggccaatggaa

SEQ ID NO: 6723314 - DNA, 19 bp, Homo sapiens
ccagccggccaatggaaac

SEQ ID NO: 6723315 - DNA, 22 bp, Homo sapiens
ccagccggccaatggaaacctc

SEQ ID NO: 6723316 - DNA, 14 bp, Homo sapiens
ccagccggcctctc

SEQ ID NO: 6723317 - DNA, 23 bp, Homo sapiens
ccagccggcctctctggcctccc

SEQ ID NO: 6723318 - DNA, 14 bp, Homo sapiens
ccagccggggtggg

SEQ ID NO: 6723319 - DNA, 15 bp, Homo sapiens
ccagccggtgcctgg

SEQ ID NO: 6723320 - DNA, 19 bp, Homo sapiens
ccagccgtaatggggactc

SEQ ID NO: 6723321 - DNA, 18 bp, Homo sapiens
ccagccgtgatgctcagg

SEQ ID NO: 6723322 - DNA, 19 bp, Homo sapiens
ccagccgtgatgctcaggc

SEQ ID NO: 6723323 - DNA, 16 bp, Homo sapiens
ccagccgtggccagag

SEQ ID NO: 6723324 - DNA, 23 bp, Homo sapiens
ccagcctaagggagacaggcctt

SEQ ID NO: 6723325 - DNA, 16 bp, Homo sapiens
ccagcctacactgcca

SEQ ID NO: 6723326 - DNA, 20 bp, Homo sapiens
ccagcctacccctcctgcgc

SEQ ID NO: 6723327 - DNA, 12 bp, Homo sapiens
ccagcctaccct

SEQ ID NO: 6723328 - DNA, 16 bp, Homo sapiens
ccagcctacctctcca

SEQ ID NO: 6723329 - DNA, 18 bp, Homo sapiens
ccagcctagcccttgtcc

SEQ ID NO: 6723330 - DNA, 20 bp, Homo sapiens
ccagcctagcccttgtccct

SEQ ID NO: 6723331 - DNA, 20 bp, Homo sapiens
ccagcctagcctggctctgc

SEQ ID NO: 6723332 - DNA, 17 bp, Homo sapiens
ccagcctatatttcctc

SEQ ID NO: 6723333 - DNA, 20 bp, Homo sapiens
ccagcctatcaggtgcccct

SEQ ID NO: 6723334 - DNA, 21 bp, Homo sapiens
ccagcctatcaggtgcccctc

SEQ ID NO: 6723335 - DNA, 20 bp, Homo sapiens
ccagcctatctctcttctgc

SEQ ID NO: 6723336 - DNA, 19 bp, Homo sapiens
ccagcctatgagcatcctg

SEQ ID NO: 6723337 - DNA, 20 bp, Homo sapiens
ccagcctcaaatccaggacc

SEQ ID NO: 6723338 - DNA, 17 bp, Homo sapiens
ccagcctcacagatgct

SEQ ID NO: 6723339 - DNA, 19 bp, Homo sapiens
ccagcctcacagatgctgg

SEQ ID NO: 6723340 - DNA, 22 bp, Homo sapiens
ccagcctcactccatttcccac

SEQ ID NO: 6723341 - DNA, 17 bp, Homo sapiens
ccagcctcacttccttt

SEQ ID NO: 6723342 - DNA, 23 bp, Homo sapiens
ccagcctcagaagccttcttgct

SEQ ID NO: 6723343 - DNA, 15 bp, Homo sapiens
ccagcctcagaaggc

SEQ ID NO: 6723344 - DNA, 23 bp, Homo sapiens
ccagcctcagagatctcccttct

SEQ ID NO: 6723345 - DNA, 19 bp, Homo sapiens
ccagcctcagatccaggca

SEQ ID NO: 6723346 - DNA, 11 bp, Homo sapiens
ccagcctcagc

SEQ ID NO: 6723347 - DNA, 14 bp, Homo sapiens
ccagcctcagccca

SEQ ID NO: 6723348 - DNA, 17 bp, Homo sapiens
ccagcctcagcccaact

SEQ ID NO: 6723349 - DNA, 12 bp, Homo sapiens
ccagcctcagcg

SEQ ID NO: 6723350 - DNA, 13 bp, Homo sapiens
ccagcctcagcgc

SEQ ID NO: 6723351 - DNA, 22 bp, Homo sapiens
ccagcctcagcggaccactctt

SEQ ID NO: 6723352 - DNA, 19 bp, Homo sapiens
ccagcctcagctcagcctc

SEQ ID NO: 6723353 - DNA, 15 bp, Homo sapiens
ccagcctcagtcctc

SEQ ID NO: 6723354 - DNA, 21 bp, Homo sapiens
ccagcctcagtcctcccctca

SEQ ID NO: 6723355 - DNA, 14 bp, Homo sapiens
ccagcctcagtgca

SEQ ID NO: 6723356 - DNA, 17 bp, Homo sapiens
ccagcctcattgtgcca

SEQ ID NO: 6723357 - DNA, 21 bp, Homo sapiens
ccagcctccaagctccatctc

SEQ ID NO: 6723358 - DNA, 12 bp, Homo sapiens
ccagcctccagg

SEQ ID NO: 6723359 - DNA, 19 bp, Homo sapiens
ccagcctccaggcccccaa

SEQ ID NO: 6723360 - DNA, 16 bp, Homo sapiens
ccagcctccagggcat

SEQ ID NO: 6723361 - DNA, 15 bp, Homo sapiens
ccagcctccatgctg

SEQ ID NO: 6723362 - DNA, 16 bp, Homo sapiens
ccagcctcccccaggc

SEQ ID NO: 6723363 - DNA, 23 bp, Homo sapiens
ccagcctcccccaggctgcgcct

SEQ ID NO: 6723364 - DNA, 17 bp, Homo sapiens
ccagcctccctgaagcc

SEQ ID NO: 6723365 - DNA, 21 bp, Homo sapiens
ccagcctccctgaagcctttg

SEQ ID NO: 6723366 - DNA, 19 bp, Homo sapiens
ccagcctccctgtctccag

SEQ ID NO: 6723367 - DNA, 19 bp, Homo sapiens
ccagcctccgtatttcaga

SEQ ID NO: 6723368 - DNA, 14 bp, Homo sapiens
ccagcctcctccca

SEQ ID NO: 6723369 - DNA, 12 bp, Homo sapiens
ccagcctcctga

SEQ ID NO: 6723370 - DNA, 15 bp, Homo sapiens
ccagcctcctgagta

SEQ ID NO: 6723371 - DNA, 14 bp, Homo sapiens
ccagcctcctgggg

SEQ ID NO: 6723372 - DNA, 18 bp, Homo sapiens
ccagcctcgcatgccaga

SEQ ID NO: 6723373 - DNA, 22 bp, Homo sapiens
ccagcctcgcatgccagagcct

SEQ ID NO: 6723374 - DNA, 16 bp, Homo sapiens
ccagcctcgcctgtca

SEQ ID NO: 6723375 - DNA, 21 bp, Homo sapiens
ccagcctcgcctgtcaccccc

SEQ ID NO: 6723376 - DNA, 12 bp, Homo sapiens
ccagcctcggcc

SEQ ID NO: 6723377 - DNA, 20 bp, Homo sapiens
ccagcctcgttggagagcag

SEQ ID NO: 6723378 - DNA, 17 bp, Homo sapiens
ccagcctctccccgctc

SEQ ID NO: 6723379 - DNA, 22 bp, Homo sapiens
ccagcctctcccctgattacac

SEQ ID NO: 6723380 - DNA, 13 bp, Homo sapiens
ccagcctctcccg

SEQ ID NO: 6723381 - DNA, 16 bp, Homo sapiens
ccagcctctcccggct

SEQ ID NO: 6723382 - DNA, 23 bp, Homo sapiens
ccagcctctcccggctgcctgcc

SEQ ID NO: 6723383 - DNA, 18 bp, Homo sapiens
ccagcctctcctccttgg

SEQ ID NO: 6723384 - DNA, 23 bp, Homo sapiens
ccagcctctcctccttgggcagg

SEQ ID NO: 6723385 - DNA, 19 bp, Homo sapiens
ccagcctctctggctcagc

SEQ ID NO: 6723386 - DNA, 12 bp, Homo sapiens
ccagcctctctt

SEQ ID NO: 6723387 - DNA, 21 bp, Homo sapiens
ccagcctctcttggtttcctt

SEQ ID NO: 6723388 - DNA, 19 bp, Homo sapiens
ccagcctctgagcccctgg

SEQ ID NO: 6723389 - DNA, 12 bp, Homo sapiens
ccagcctctgcc

SEQ ID NO: 6723390 - DNA, 13 bp, Homo sapiens
ccagcctctgccc

SEQ ID NO: 6723391 - DNA, 14 bp, Homo sapiens
ccagcctctgcccc

SEQ ID NO: 6723392 - DNA, 15 bp, Homo sapiens
ccagcctctgcccca

SEQ ID NO: 6723393 - DNA, 17 bp, Homo sapiens
ccagcctctgccccacc

SEQ ID NO: 6723394 - DNA, 20 bp, Homo sapiens
ccagcctctgccccacccat

SEQ ID NO: 6723395 - DNA, 20 bp, Homo sapiens
ccagcctctgccgctgccat

SEQ ID NO: 6723396 - DNA, 15 bp, Homo sapiens
ccagcctctggcatt

SEQ ID NO: 6723397 - DNA, 12 bp, Homo sapiens
ccagcctctggg

SEQ ID NO: 6723398 - DNA, 16 bp, Homo sapiens
ccagcctctggggcag

SEQ ID NO: 6723399 - DNA, 18 bp, Homo sapiens
ccagcctcttatcactgg

SEQ ID NO: 6723400 - DNA, 23 bp, Homo sapiens
ccagcctgacaacagcctgagaa

SEQ ID NO: 6723401 - DNA, 17 bp, Homo sapiens
ccagcctgacctgagac

SEQ ID NO: 6723402 - DNA, 18 bp, Homo sapiens
ccagcctgacctgagact

SEQ ID NO: 6723403 - DNA, 19 bp, Homo sapiens
ccagcctgagatgtaggct

SEQ ID NO: 6723404 - DNA, 15 bp, Homo sapiens
ccagcctgagccaca

SEQ ID NO: 6723405 - DNA, 19 bp, Homo sapiens
ccagcctgagccacagtgg

SEQ ID NO: 6723406 - DNA, 13 bp, Homo sapiens
ccagcctgaggca

SEQ ID NO: 6723407 - DNA, 15 bp, Homo sapiens
ccagcctgaggtgcc

SEQ ID NO: 6723408 - DNA, 16 bp, Homo sapiens
ccagcctgaggtgccc

SEQ ID NO: 6723409 - DNA, 21 bp, Homo sapiens
ccagcctgaggtgcccactcc

SEQ ID NO: 6723410 - DNA, 17 bp, Homo sapiens
ccagcctgagtgacaga

SEQ ID NO: 6723411 - DNA, 22 bp, Homo sapiens
ccagcctgcatctagctggagc

SEQ ID NO: 6723412 - DNA, 23 bp, Homo sapiens
ccagcctgcatctagctggagcc

SEQ ID NO: 6723413 - DNA, 12 bp, Homo sapiens
ccagcctgccag

SEQ ID NO: 6723414 - DNA, 16 bp, Homo sapiens
ccagcctgccaggccc

SEQ ID NO: 6723415 - DNA, 19 bp, Homo sapiens
ccagcctgcccaagcccag

SEQ ID NO: 6723416 - DNA, 22 bp, Homo sapiens
ccagcctgcccaagcccaggcc

SEQ ID NO: 6723417 - DNA, 23 bp, Homo sapiens
ccagcctgcccaagcccaggcca

SEQ ID NO: 6723418 - DNA, 17 bp, Homo sapiens
ccagcctgccccctatc

SEQ ID NO: 6723419 - DNA, 18 bp, Homo sapiens
ccagcctgccccctatct

SEQ ID NO: 6723420 - DNA, 21 bp, Homo sapiens
ccagcctgccctccagctgct

SEQ ID NO: 6723421 - DNA, 22 bp, Homo sapiens
ccagcctgccctccagctgctg

SEQ ID NO: 6723422 - DNA, 15 bp, Homo sapiens
ccagcctgcgcctgc

SEQ ID NO: 6723423 - DNA, 21 bp, Homo sapiens
ccagcctgcgggaagctgacc

SEQ ID NO: 6723424 - DNA, 15 bp, Homo sapiens
ccagcctgctagcta

SEQ ID NO: 6723425 - DNA, 19 bp, Homo sapiens
ccagcctgctagctagctc

SEQ ID NO: 6723426 - DNA, 21 bp, Homo sapiens
ccagcctgctagctagctcaa

SEQ ID NO: 6723427 - DNA, 14 bp, Homo sapiens
ccagcctgcttccc

SEQ ID NO: 6723428 - DNA, 12 bp, Homo sapiens
ccagcctggagc

SEQ ID NO: 6723429 - DNA, 15 bp, Homo sapiens
ccagcctggatgcca

SEQ ID NO: 6723430 - DNA, 15 bp, Homo sapiens
ccagcctggcatcag

SEQ ID NO: 6723431 - DNA, 16 bp, Homo sapiens
ccagcctggccacgca

SEQ ID NO: 6723432 - DNA, 17 bp, Homo sapiens
ccagcctggccagacaa

SEQ ID NO: 6723433 - DNA, 21 bp, Homo sapiens
ccagcctggccagacaagaag

SEQ ID NO: 6723434 - DNA, 13 bp, Homo sapiens
ccagcctggcccc

SEQ ID NO: 6723435 - DNA, 20 bp, Homo sapiens
ccagcctggccccggccttt

SEQ ID NO: 6723436 - DNA, 15 bp, Homo sapiens
ccagcctggcctcct

SEQ ID NO: 6723437 - DNA, 16 bp, Homo sapiens
ccagcctggcctcctg

SEQ ID NO: 6723438 - DNA, 17 bp, Homo sapiens
ccagcctggcctcctgc

SEQ ID NO: 6723439 - DNA, 22 bp, Homo sapiens
ccagcctggcctcctgcctcta

SEQ ID NO: 6723440 - DNA, 20 bp, Homo sapiens
ccagcctggctgggactggg

SEQ ID NO: 6723441 - DNA, 18 bp, Homo sapiens
ccagcctggcttctggag

SEQ ID NO: 6723442 - DNA, 20 bp, Homo sapiens
ccagcctgggaaagcccctg

SEQ ID NO: 6723443 - DNA, 12 bp, Homo sapiens
ccagcctgggac

SEQ ID NO: 6723444 - DNA, 14 bp, Homo sapiens
ccagcctgggacac

SEQ ID NO: 6723445 - DNA, 14 bp, Homo sapiens
ccagcctgggactc

SEQ ID NO: 6723446 - DNA, 19 bp, Homo sapiens
ccagcctgggactcccagt

SEQ ID NO: 6723447 - DNA, 13 bp, Homo sapiens
ccagcctgggagc

SEQ ID NO: 6723448 - DNA, 15 bp, Homo sapiens
ccagcctgggagccc

SEQ ID NO: 6723449 - DNA, 17 bp, Homo sapiens
ccagcctgggagcccag

SEQ ID NO: 6723450 - DNA, 18 bp, Homo sapiens
ccagcctgggagcccaga

SEQ ID NO: 6723451 - DNA, 19 bp, Homo sapiens
ccagcctgggagcccagag

SEQ ID NO: 6723452 - DNA, 18 bp, Homo sapiens
ccagcctgggaggcacag

SEQ ID NO: 6723453 - DNA, 11 bp, Homo sapiens
ccagcctgggc

SEQ ID NO: 6723454 - DNA, 18 bp, Homo sapiens
ccagcctgggcagccagg

SEQ ID NO: 6723455 - DNA, 21 bp, Homo sapiens
ccagcctgggcccatctccct

SEQ ID NO: 6723456 - DNA, 19 bp, Homo sapiens
ccagcctgggcctatggag

SEQ ID NO: 6723457 - DNA, 16 bp, Homo sapiens
ccagcctgggcgacag

SEQ ID NO: 6723458 - DNA, 20 bp, Homo sapiens
ccagcctgggcgacagagca

SEQ ID NO: 6723459 - DNA, 13 bp, Homo sapiens
ccagcctgggctc

SEQ ID NO: 6723460 - DNA, 14 bp, Homo sapiens
ccagcctgggctcc

SEQ ID NO: 6723461 - DNA, 20 bp, Homo sapiens
ccagcctggggaccccactt

SEQ ID NO: 6723462 - DNA, 13 bp, Homo sapiens
ccagcctggggcc

SEQ ID NO: 6723463 - DNA, 17 bp, Homo sapiens
ccagcctggggcctggc

SEQ ID NO: 6723464 - DNA, 17 bp, Homo sapiens
ccagcctggggccttcc

SEQ ID NO: 6723465 - DNA, 23 bp, Homo sapiens
ccagcctggggccttcctggctt

SEQ ID NO: 6723466 - DNA, 13 bp, Homo sapiens
ccagcctggggct

SEQ ID NO: 6723467 - DNA, 20 bp, Homo sapiens
ccagcctggggctccctctc

SEQ ID NO: 6723468 - DNA, 23 bp, Homo sapiens
ccagcctggggctccctctctgg

SEQ ID NO: 6723469 - DNA, 21 bp, Homo sapiens
ccagcctggggctgaggctga

SEQ ID NO: 6723470 - DNA, 22 bp, Homo sapiens
ccagcctgggtcacagagtgag

SEQ ID NO: 6723471 - DNA, 14 bp, Homo sapiens
ccagcctggtcaac

SEQ ID NO: 6723472 - DNA, 13 bp, Homo sapiens
ccagcctggtggc

SEQ ID NO: 6723473 - DNA, 17 bp, Homo sapiens
ccagcctggtggcccag

SEQ ID NO: 6723474 - DNA, 23 bp, Homo sapiens
ccagcctgtatcttgtctgagac

SEQ ID NO: 6723475 - DNA, 14 bp, Homo sapiens
ccagcctgtcaccc

SEQ ID NO: 6723476 - DNA, 18 bp, Homo sapiens
ccagcctgtcccactggc

SEQ ID NO: 6723477 - DNA, 23 bp, Homo sapiens
ccagcctgtcccactggctcctc

SEQ ID NO: 6723478 - DNA, 14 bp, Homo sapiens
ccagcctgtcctgg

SEQ ID NO: 6723479 - DNA, 13 bp, Homo sapiens
ccagcctgtggtt

SEQ ID NO: 6723480 - DNA, 13 bp, Homo sapiens
ccagcctgtgtgt

SEQ ID NO: 6723481 - DNA, 14 bp, Homo sapiens
ccagccttatgtgt

SEQ ID NO: 6723482 - DNA, 21 bp, Homo sapiens
ccagccttatgtgttacatta

SEQ ID NO: 6723483 - DNA, 14 bp, Homo sapiens
ccagccttccaggt

SEQ ID NO: 6723484 - DNA, 22 bp, Homo sapiens
ccagccttcctctgcagctgac

SEQ ID NO: 6723485 - DNA, 17 bp, Homo sapiens
ccagccttctctctctg

SEQ ID NO: 6723486 - DNA, 22 bp, Homo sapiens
ccagccttcttccatcccagga

SEQ ID NO: 6723487 - DNA, 22 bp, Homo sapiens
ccagccttgaactgtggccacc

SEQ ID NO: 6723488 - DNA, 22 bp, Homo sapiens
ccagccttgagatgcttcactt

SEQ ID NO: 6723489 - DNA, 19 bp, Homo sapiens
ccagccttgagccctggct

SEQ ID NO: 6723490 - DNA, 21 bp, Homo sapiens
ccagccttgagccctggctgt

SEQ ID NO: 6723491 - DNA, 14 bp, Homo sapiens
ccagccttgctctc

SEQ ID NO: 6723492 - DNA, 17 bp, Homo sapiens
ccagccttgctctcttc

SEQ ID NO: 6723493 - DNA, 18 bp, Homo sapiens
ccagccttgctctcttca

SEQ ID NO: 6723494 - DNA, 19 bp, Homo sapiens
ccagccttgctctcttcaa

SEQ ID NO: 6723495 - DNA, 12 bp, Homo sapiens
ccagccttggag

SEQ ID NO: 6723496 - DNA, 21 bp, Homo sapiens
ccagcctttctaaggctcagc

SEQ ID NO: 6723497 - DNA, 18 bp, Homo sapiens
ccagcctttctcccaggc

SEQ ID NO: 6723498 - DNA, 12 bp, Homo sapiens
ccagcctttctt

SEQ ID NO: 6723499 - DNA, 20 bp, Homo sapiens
ccagcctttgatcaggtggg

SEQ ID NO: 6723500 - DNA, 19 bp, Homo sapiens
ccagcctttgctccctccc

SEQ ID NO: 6723501 - DNA, 23 bp, Homo sapiens
ccagcctttgctccctccccgct

SEQ ID NO: 6723502 - DNA, 15 bp, Homo sapiens
ccagcctttgttccc

SEQ ID NO: 6723503 - DNA, 15 bp, Homo sapiens
ccagcgacatttctc

SEQ ID NO: 6723504 - DNA, 15 bp, Homo sapiens
ccagcgacctctctg

SEQ ID NO: 6723505 - DNA, 19 bp, Homo sapiens
ccagcgacctctctgcctc

SEQ ID NO: 6723506 - DNA, 17 bp, Homo sapiens
ccagcgacgcggcccgc

SEQ ID NO: 6723507 - DNA, 21 bp, Homo sapiens
ccagcgagagagtttcaaaag

SEQ ID NO: 6723508 - DNA, 13 bp, Homo sapiens
ccagcgagccaca

SEQ ID NO: 6723509 - DNA, 15 bp, Homo sapiens
ccagcgagccctggt

SEQ ID NO: 6723510 - DNA, 16 bp, Homo sapiens
ccagcgagccctggtg

SEQ ID NO: 6723511 - DNA, 13 bp, Homo sapiens
ccagcgagcgccc

SEQ ID NO: 6723512 - DNA, 22 bp, Homo sapiens
ccagcgaggcgaggctgcctct

SEQ ID NO: 6723513 - DNA, 19 bp, Homo sapiens
ccagcgatctctccactgt

SEQ ID NO: 6723514 - DNA, 21 bp, Homo sapiens
ccagcgatctctccactgtgc

SEQ ID NO: 6723515 - DNA, 13 bp, Homo sapiens
ccagcgatggtgc

SEQ ID NO: 6723516 - DNA, 14 bp, Homo sapiens
ccagcgatggtgct

SEQ ID NO: 6723517 - DNA, 15 bp, Homo sapiens
ccagcgatggtgctg

SEQ ID NO: 6723518 - DNA, 20 bp, Homo sapiens
ccagcgatggtgctgcccag

SEQ ID NO: 6723519 - DNA, 19 bp, Homo sapiens
ccagcgattccctctccca

SEQ ID NO: 6723520 - DNA, 22 bp, Homo sapiens
ccagcgattccctctcccaggc

SEQ ID NO: 6723521 - DNA, 21 bp, Homo sapiens
ccagcgcagcgccagggctca

SEQ ID NO: 6723522 - DNA, 18 bp, Homo sapiens
ccagcgccagggcccagg

SEQ ID NO: 6723523 - DNA, 20 bp, Homo sapiens
ccagcgccagggcccaggcc

SEQ ID NO: 6723524 - DNA, 20 bp, Homo sapiens
ccagcgcccccactcctcct

SEQ ID NO: 6723525 - DNA, 15 bp, Homo sapiens
ccagcgcccccagaa

SEQ ID NO: 6723526 - DNA, 18 bp, Homo sapiens
ccagcgcccctcagcctc

SEQ ID NO: 6723527 - DNA, 16 bp, Homo sapiens
ccagcgcccgctgggc

SEQ ID NO: 6723528 - DNA, 23 bp, Homo sapiens
ccagcgccggggggagggaggag

SEQ ID NO: 6723529 - DNA, 21 bp, Homo sapiens
ccagcgcctccctccacccca

SEQ ID NO: 6723530 - DNA, 22 bp, Homo sapiens
ccagcgcctccctccaccccag

SEQ ID NO: 6723531 - DNA, 15 bp, Homo sapiens
ccagcgcctgccctc

SEQ ID NO: 6723532 - DNA, 22 bp, Homo sapiens
ccagcgcctgtgctgaggactc

SEQ ID NO: 6723533 - DNA, 13 bp, Homo sapiens
ccagcgcggccag

SEQ ID NO: 6723534 - DNA, 14 bp, Homo sapiens
ccagcgcggccagc

SEQ ID NO: 6723535 - DNA, 21 bp, Homo sapiens
ccagcgcggccagcgtcccag

SEQ ID NO: 6723536 - DNA, 19 bp, Homo sapiens
ccagcgcggcttggccgcc

SEQ ID NO: 6723537 - DNA, 18 bp, Homo sapiens
ccagcgctcgccacgctc

SEQ ID NO: 6723538 - DNA, 19 bp, Homo sapiens
ccagcgctcgccacgctca

SEQ ID NO: 6723539 - DNA, 12 bp, Homo sapiens
ccagcgctctcc

SEQ ID NO: 6723540 - DNA, 13 bp, Homo sapiens
ccagcgctctcct

SEQ ID NO: 6723541 - DNA, 14 bp, Homo sapiens
ccagcgctctgcct

SEQ ID NO: 6723542 - DNA, 15 bp, Homo sapiens
ccagcgctgaacaga

SEQ ID NO: 6723543 - DNA, 14 bp, Homo sapiens
ccagcgctgagtgg

SEQ ID NO: 6723544 - DNA, 20 bp, Homo sapiens
ccagcgctggcccccccagc

SEQ ID NO: 6723545 - DNA, 21 bp, Homo sapiens
ccagcgctggcccccccagcc

SEQ ID NO: 6723546 - DNA, 13 bp, Homo sapiens
ccagcggaaacag

SEQ ID NO: 6723547 - DNA, 15 bp, Homo sapiens
ccagcggacagtggc

SEQ ID NO: 6723548 - DNA, 22 bp, Homo sapiens
ccagcggcagatgggcctgtgt

SEQ ID NO: 6723549 - DNA, 19 bp, Homo sapiens
ccagcggcccaagagcccg

SEQ ID NO: 6723550 - DNA, 21 bp, Homo sapiens
ccagcggccccccgcacagcc

SEQ ID NO: 6723551 - DNA, 22 bp, Homo sapiens
ccagcggccccccgcacagcca

SEQ ID NO: 6723552 - DNA, 14 bp, Homo sapiens
ccagcggccctccc

SEQ ID NO: 6723553 - DNA, 15 bp, Homo sapiens
ccagcggccctccca

SEQ ID NO: 6723554 - DNA, 15 bp, Homo sapiens
ccagcggcctcaggg

SEQ ID NO: 6723555 - DNA, 17 bp, Homo sapiens
ccagcggcctcagggtc

SEQ ID NO: 6723556 - DNA, 15 bp, Homo sapiens
ccagcggctccaact

SEQ ID NO: 6723557 - DNA, 23 bp, Homo sapiens
ccagcgggaatggcagctgccac

SEQ ID NO: 6723558 - DNA, 14 bp, Homo sapiens
ccagcgggcacagg

SEQ ID NO: 6723559 - DNA, 13 bp, Homo sapiens
ccagcgggccctc

SEQ ID NO: 6723560 - DNA, 18 bp, Homo sapiens
ccagcgggccctctgccg

SEQ ID NO: 6723561 - DNA, 12 bp, Homo sapiens
ccagcggggctg

SEQ ID NO: 6723562 - DNA, 16 bp, Homo sapiens
ccagcggggcttctgg

SEQ ID NO: 6723563 - DNA, 19 bp, Homo sapiens
ccagcggggcttctgggcg

SEQ ID NO: 6723564 - DNA, 22 bp, Homo sapiens
ccagcggtgaccagcctgtcac

SEQ ID NO: 6723565 - DNA, 15 bp, Homo sapiens
ccagcggtgggacct

SEQ ID NO: 6723566 - DNA, 18 bp, Homo sapiens
ccagcggttcctgtgcag

SEQ ID NO: 6723567 - DNA, 19 bp, Homo sapiens
ccagcggttcctgtgcaga

SEQ ID NO: 6723568 - DNA, 17 bp, Homo sapiens
ccagcggtttccacttg

SEQ ID NO: 6723569 - DNA, 20 bp, Homo sapiens
ccagcggtttccacttgtgg

SEQ ID NO: 6723570 - DNA, 19 bp, Homo sapiens
ccagcgtatatataagaaa

SEQ ID NO: 6723571 - DNA, 21 bp, Homo sapiens
ccagcgtatatataagaaaga

SEQ ID NO: 6723572 - DNA, 19 bp, Homo sapiens
ccagcgtcactccagtgct

SEQ ID NO: 6723573 - DNA, 15 bp, Homo sapiens
ccagcgtcagaagtc

SEQ ID NO: 6723574 - DNA, 23 bp, Homo sapiens
ccagcgtcagctgctccctggca

SEQ ID NO: 6723575 - DNA, 13 bp, Homo sapiens
ccagcgtcccagg

SEQ ID NO: 6723576 - DNA, 21 bp, Homo sapiens
ccagcgtcccagtctctggca

SEQ ID NO: 6723577 - DNA, 12 bp, Homo sapiens
ccagcgtcctca

SEQ ID NO: 6723578 - DNA, 19 bp, Homo sapiens
ccagcgtcctcagcacccc

SEQ ID NO: 6723579 - DNA, 20 bp, Homo sapiens
ccagcgtcctcagcacccca

SEQ ID NO: 6723580 - DNA, 13 bp, Homo sapiens
ccagcgtcctcct

SEQ ID NO: 6723581 - DNA, 17 bp, Homo sapiens
ccagcgtcctcctctgt

SEQ ID NO: 6723582 - DNA, 17 bp, Homo sapiens
ccagcgtcggtctgtgc

SEQ ID NO: 6723583 - DNA, 19 bp, Homo sapiens
ccagcgtcggtctgtgccc

SEQ ID NO: 6723584 - DNA, 16 bp, Homo sapiens
ccagcgtctgcagggt

SEQ ID NO: 6723585 - DNA, 23 bp, Homo sapiens
ccagcgtctgcgcggatgtagca

SEQ ID NO: 6723586 - DNA, 15 bp, Homo sapiens
ccagcgtctgctgtt

SEQ ID NO: 6723587 - DNA, 15 bp, Homo sapiens
ccagcgtctgttgtg

SEQ ID NO: 6723588 - DNA, 14 bp, Homo sapiens
ccagcgtgacggag

SEQ ID NO: 6723589 - DNA, 13 bp, Homo sapiens
ccagcgtggccca

SEQ ID NO: 6723590 - DNA, 14 bp, Homo sapiens
ccagcgtggcccag

SEQ ID NO: 6723591 - DNA, 15 bp, Homo sapiens
ccagcgtggcccagg

SEQ ID NO: 6723592 - DNA, 18 bp, Homo sapiens
ccagcgtggcctccgtga

SEQ ID NO: 6723593 - DNA, 12 bp, Homo sapiens
ccagcgtggggc

SEQ ID NO: 6723594 - DNA, 14 bp, Homo sapiens
ccagcgtgggggtg

SEQ ID NO: 6723595 - DNA, 16 bp, Homo sapiens
ccagcgtgggggtggc

SEQ ID NO: 6723596 - DNA, 14 bp, Homo sapiens
ccagcgttcccttc

SEQ ID NO: 6723597 - DNA, 22 bp, Homo sapiens
ccagcgttgggtttgctcatgt

SEQ ID NO: 6723598 - DNA, 22 bp, Homo sapiens
ccagcgtttgaggggctggcct

SEQ ID NO: 6723599 - DNA, 18 bp, Homo sapiens
ccagctaacccgtgcaga

SEQ ID NO: 6723600 - DNA, 14 bp, Homo sapiens
ccagctaactccag

SEQ ID NO: 6723601 - DNA, 19 bp, Homo sapiens
ccagctaagaacctggaac

SEQ ID NO: 6723602 - DNA, 16 bp, Homo sapiens
ccagctaataaaccag

SEQ ID NO: 6723603 - DNA, 20 bp, Homo sapiens
ccagctaatacccagagcac

SEQ ID NO: 6723604 - DNA, 14 bp, Homo sapiens
ccagctaattgaga

SEQ ID NO: 6723605 - DNA, 15 bp, Homo sapiens
ccagctaatttttgt

SEQ ID NO: 6723606 - DNA, 18 bp, Homo sapiens
ccagctacacctttctcc

SEQ ID NO: 6723607 - DNA, 19 bp, Homo sapiens
ccagctacacctttctcct

SEQ ID NO: 6723608 - DNA, 20 bp, Homo sapiens
ccagctacattcctcagctg

SEQ ID NO: 6723609 - DNA, 22 bp, Homo sapiens
ccagctacattcctcagctgcc

SEQ ID NO: 6723610 - DNA, 23 bp, Homo sapiens
ccagctaccaagtcagacaccaa

SEQ ID NO: 6723611 - DNA, 13 bp, Homo sapiens
ccagctaccacca

SEQ ID NO: 6723612 - DNA, 15 bp, Homo sapiens
ccagctacccaggag

SEQ ID NO: 6723613 - DNA, 14 bp, Homo sapiens
ccagctaccccttc

SEQ ID NO: 6723614 - DNA, 16 bp, Homo sapiens
ccagctaccccttgtg

SEQ ID NO: 6723615 - DNA, 21 bp, Homo sapiens
ccagctaccccttgtgggcaa

SEQ ID NO: 6723616 - DNA, 20 bp, Homo sapiens
ccagctactagggaggctga

SEQ ID NO: 6723617 - DNA, 21 bp, Homo sapiens
ccagctactagggaggctgag

SEQ ID NO: 6723618 - DNA, 16 bp, Homo sapiens
ccagctactcagaagc

SEQ ID NO: 6723619 - DNA, 23 bp, Homo sapiens
ccagctactcagaagcctgaggc

SEQ ID NO: 6723620 - DNA, 19 bp, Homo sapiens
ccagctactcaggaggctg

SEQ ID NO: 6723621 - DNA, 19 bp, Homo sapiens
ccagctactcatgaggctg

SEQ ID NO: 6723622 - DNA, 22 bp, Homo sapiens
ccagctactctgtccaggccac

SEQ ID NO: 6723623 - DNA, 20 bp, Homo sapiens
ccagctactggggaggctga

SEQ ID NO: 6723624 - DNA, 18 bp, Homo sapiens
ccagctacttagctggcc

SEQ ID NO: 6723625 - DNA, 15 bp, Homo sapiens
ccagctacttgggag

SEQ ID NO: 6723626 - DNA, 20 bp, Homo sapiens
ccagctacttgggaggttga

SEQ ID NO: 6723627 - DNA, 20 bp, Homo sapiens
ccagctagccaactcctcct

SEQ ID NO: 6723628 - DNA, 21 bp, Homo sapiens
ccagctagccaactcctcctt

SEQ ID NO: 6723629 - DNA, 14 bp, Homo sapiens
ccagctagggctgg

SEQ ID NO: 6723630 - DNA, 20 bp, Homo sapiens
ccagctagtgacccacatgc

SEQ ID NO: 6723631 - DNA, 20 bp, Homo sapiens
ccagctagtttttgtatttt

SEQ ID NO: 6723632 - DNA, 18 bp, Homo sapiens
ccagctatacctgtgcct

SEQ ID NO: 6723633 - DNA, 13 bp, Homo sapiens
ccagctatctgcc

SEQ ID NO: 6723634 - DNA, 22 bp, Homo sapiens
ccagctatctgcctgacaggct

SEQ ID NO: 6723635 - DNA, 21 bp, Homo sapiens
ccagctatctgtcatctctct

SEQ ID NO: 6723636 - DNA, 16 bp, Homo sapiens
ccagctatctttcttg

SEQ ID NO: 6723637 - DNA, 20 bp, Homo sapiens
ccagctattaccacacttgg

SEQ ID NO: 6723638 - DNA, 18 bp, Homo sapiens
ccagctattttctgacca

SEQ ID NO: 6723639 - DNA, 20 bp, Homo sapiens
ccagctattttctgaccaaa

SEQ ID NO: 6723640 - DNA, 21 bp, Homo sapiens
ccagctattttctgaccaaaa

SEQ ID NO: 6723641 - DNA, 19 bp, Homo sapiens
ccagctatttttactagaa

SEQ ID NO: 6723642 - DNA, 22 bp, Homo sapiens
ccagctcaatggactggaaggg

SEQ ID NO: 6723643 - DNA, 17 bp, Homo sapiens
ccagctcacaagcccag

SEQ ID NO: 6723644 - DNA, 16 bp, Homo sapiens
ccagctcaccagcccc

SEQ ID NO: 6723645 - DNA, 22 bp, Homo sapiens
ccagctcaccagccccagtgcc

SEQ ID NO: 6723646 - DNA, 12 bp, Homo sapiens
ccagctcacccc

SEQ ID NO: 6723647 - DNA, 23 bp, Homo sapiens
ccagctcaccccccacactcact

SEQ ID NO: 6723648 - DNA, 15 bp, Homo sapiens
ccagctcactccctg

SEQ ID NO: 6723649 - DNA, 16 bp, Homo sapiens
ccagctcactgcagcc

SEQ ID NO: 6723650 - DNA, 17 bp, Homo sapiens
ccagctcactgcagcct

SEQ ID NO: 6723651 - DNA, 19 bp, Homo sapiens
ccagctcactgcagcctcg

SEQ ID NO: 6723652 - DNA, 14 bp, Homo sapiens
ccagctcagaaccc

SEQ ID NO: 6723653 - DNA, 15 bp, Homo sapiens
ccagctcagaaccca

SEQ ID NO: 6723654 - DNA, 17 bp, Homo sapiens
ccagctcagagccccgc

SEQ ID NO: 6723655 - DNA, 18 bp, Homo sapiens
ccagctcagagccccgcc

SEQ ID NO: 6723656 - DNA, 14 bp, Homo sapiens
ccagctcagaggcc

SEQ ID NO: 6723657 - DNA, 19 bp, Homo sapiens
ccagctcagaggcccagga

SEQ ID NO: 6723658 - DNA, 15 bp, Homo sapiens
ccagctcagcagtga

SEQ ID NO: 6723659 - DNA, 22 bp, Homo sapiens
ccagctcagcagttcacttcct

SEQ ID NO: 6723660 - DNA, 13 bp, Homo sapiens
ccagctcagcccc

SEQ ID NO: 6723661 - DNA, 20 bp, Homo sapiens
ccagctcagccccggccact

SEQ ID NO: 6723662 - DNA, 21 bp, Homo sapiens
ccagctcagccctggcctggc

SEQ ID NO: 6723663 - DNA, 21 bp, Homo sapiens
ccagctcaggctactgccact

SEQ ID NO: 6723664 - DNA, 20 bp, Homo sapiens
ccagctcaggggacactggc

SEQ ID NO: 6723665 - DNA, 21 bp, Homo sapiens
ccagctcaggtgactggagcc

SEQ ID NO: 6723666 - DNA, 11 bp, Homo sapiens
ccagctcagtc

SEQ ID NO: 6723667 - DNA, 19 bp, Homo sapiens
ccagctcagtcccacagcc

SEQ ID NO: 6723668 - DNA, 18 bp, Homo sapiens
ccagctcagtcttcccta

SEQ ID NO: 6723669 - DNA, 12 bp, Homo sapiens
ccagctcatctc

SEQ ID NO: 6723670 - DNA, 22 bp, Homo sapiens
ccagctcatgtaggtgagcctg

SEQ ID NO: 6723671 - DNA, 23 bp, Homo sapiens
ccagctcatgtaggtgagcctgg

SEQ ID NO: 6723672 - DNA, 14 bp, Homo sapiens
ccagctccaacctg

SEQ ID NO: 6723673 - DNA, 15 bp, Homo sapiens
ccagctccaacctgc

SEQ ID NO: 6723674 - DNA, 13 bp, Homo sapiens
ccagctccacagg

SEQ ID NO: 6723675 - DNA, 15 bp, Homo sapiens
ccagctccacagggt

SEQ ID NO: 6723676 - DNA, 18 bp, Homo sapiens
ccagctccactcagggct

SEQ ID NO: 6723677 - DNA, 21 bp, Homo sapiens
ccagctccactcagggctggc

SEQ ID NO: 6723678 - DNA, 18 bp, Homo sapiens
ccagctccactggcctgc

SEQ ID NO: 6723679 - DNA, 16 bp, Homo sapiens
ccagctccaggcagga

SEQ ID NO: 6723680 - DNA, 15 bp, Homo sapiens
ccagctccaggccca

SEQ ID NO: 6723681 - DNA, 14 bp, Homo sapiens
ccagctccaggggc

SEQ ID NO: 6723682 - DNA, 15 bp, Homo sapiens
ccagctccaggggcc

SEQ ID NO: 6723683 - DNA, 21 bp, Homo sapiens
ccagctccaggggcccttggg

SEQ ID NO: 6723684 - DNA, 9 bp, Homo sapiens
ccagctccc

SEQ ID NO: 6723685 - DNA, 23 bp, Homo sapiens
ccagctcccacaccgcgtcccag

SEQ ID NO: 6723686 - DNA, 19 bp, Homo sapiens
ccagctcccacctcccctt

SEQ ID NO: 6723687 - DNA, 17 bp, Homo sapiens
ccagctcccactccctt

SEQ ID NO: 6723688 - DNA, 18 bp, Homo sapiens
ccagctcccagatggccc

SEQ ID NO: 6723689 - DNA, 23 bp, Homo sapiens
ccagctccccagcccacctgctc

SEQ ID NO: 6723690 - DNA, 14 bp, Homo sapiens
ccagctccccagga

SEQ ID NO: 6723691 - DNA, 13 bp, Homo sapiens
ccagctcccccag

SEQ ID NO: 6723692 - DNA, 15 bp, Homo sapiens
ccagctcccccaggc

SEQ ID NO: 6723693 - DNA, 16 bp, Homo sapiens
ccagctcccccaggca

SEQ ID NO: 6723694 - DNA, 19 bp, Homo sapiens
ccagctcccccaggcagaa

SEQ ID NO: 6723695 - DNA, 14 bp, Homo sapiens
ccagctccccccac

SEQ ID NO: 6723696 - DNA, 21 bp, Homo sapiens
ccagctcccccgggaggggcc

SEQ ID NO: 6723697 - DNA, 22 bp, Homo sapiens
ccagctcccgtgtaaataattt

SEQ ID NO: 6723698 - DNA, 21 bp, Homo sapiens
ccagctccctagactgcatcc

SEQ ID NO: 6723699 - DNA, 18 bp, Homo sapiens
ccagctccctcccctgct

SEQ ID NO: 6723700 - DNA, 23 bp, Homo sapiens
ccagctccctcgtcttcagctgc

SEQ ID NO: 6723701 - DNA, 22 bp, Homo sapiens
ccagctccctgaatctgaccac

SEQ ID NO: 6723702 - DNA, 13 bp, Homo sapiens
ccagctccctgca

SEQ ID NO: 6723703 - DNA, 16 bp, Homo sapiens
ccagctccctgcaccg

SEQ ID NO: 6723704 - DNA, 18 bp, Homo sapiens
ccagctccctgcaccgcc

SEQ ID NO: 6723705 - DNA, 18 bp, Homo sapiens
ccagctccctgtgccccc

SEQ ID NO: 6723706 - DNA, 19 bp, Homo sapiens
ccagctccctgtgccccca

SEQ ID NO: 6723707 - DNA, 22 bp, Homo sapiens
ccagctcccttgggaaggacac

SEQ ID NO: 6723708 - DNA, 14 bp, Homo sapiens
ccagctccgacctc

SEQ ID NO: 6723709 - DNA, 20 bp, Homo sapiens
ccagctccgacctctctcag

SEQ ID NO: 6723710 - DNA, 18 bp, Homo sapiens
ccagctccggcctgtcct

SEQ ID NO: 6723711 - DNA, 20 bp, Homo sapiens
ccagctccggcctgtcctcc

SEQ ID NO: 6723712 - DNA, 14 bp, Homo sapiens
ccagctccgtgttt

SEQ ID NO: 6723713 - DNA, 18 bp, Homo sapiens
ccagctccgtgtttctct

SEQ ID NO: 6723714 - DNA, 15 bp, Homo sapiens
ccagctcctcaccca

SEQ ID NO: 6723715 - DNA, 16 bp, Homo sapiens
ccagctcctcacccag

SEQ ID NO: 6723716 - DNA, 18 bp, Homo sapiens
ccagctcctcactcacct

SEQ ID NO: 6723717 - DNA, 12 bp, Homo sapiens
ccagctcctcat

SEQ ID NO: 6723718 - DNA, 23 bp, Homo sapiens
ccagctcctcatccagggctctg

SEQ ID NO: 6723719 - DNA, 14 bp, Homo sapiens
ccagctcctccagc

SEQ ID NO: 6723720 - DNA, 20 bp, Homo sapiens
ccagctcctccagccctgcc

SEQ ID NO: 6723721 - DNA, 12 bp, Homo sapiens
ccagctcctccc

SEQ ID NO: 6723722 - DNA, 13 bp, Homo sapiens
ccagctcctccca

SEQ ID NO: 6723723 - DNA, 20 bp, Homo sapiens
ccagctcctcccttgttctc

SEQ ID NO: 6723724 - DNA, 20 bp, Homo sapiens
ccagctcctctctgaagcga

SEQ ID NO: 6723725 - DNA, 12 bp, Homo sapiens
ccagctcctctg

SEQ ID NO: 6723726 - DNA, 15 bp, Homo sapiens
ccagctcctctgagc

SEQ ID NO: 6723727 - DNA, 21 bp, Homo sapiens
ccagctcctctgagccatacc

SEQ ID NO: 6723728 - DNA, 23 bp, Homo sapiens
ccagctcctgacactgctggaga

SEQ ID NO: 6723729 - DNA, 18 bp, Homo sapiens
ccagctcctgccccgccg

SEQ ID NO: 6723730 - DNA, 21 bp, Homo sapiens
ccagctcctgggcagcttgag

SEQ ID NO: 6723731 - DNA, 21 bp, Homo sapiens
ccagctccttggctgcagcca

SEQ ID NO: 6723732 - DNA, 19 bp, Homo sapiens
ccagctcctttctcctgtg

SEQ ID NO: 6723733 - DNA, 20 bp, Homo sapiens
ccagctcctttctcctgtga

SEQ ID NO: 6723734 - DNA, 17 bp, Homo sapiens
ccagctcgcacccccct

SEQ ID NO: 6723735 - DNA, 18 bp, Homo sapiens
ccagctctaagcagccag

SEQ ID NO: 6723736 - DNA, 18 bp, Homo sapiens
ccagctctacattctgct

SEQ ID NO: 6723737 - DNA, 20 bp, Homo sapiens
ccagctctacattctgctct

SEQ ID NO: 6723738 - DNA, 21 bp, Homo sapiens
ccagctctagacaaccctgca

SEQ ID NO: 6723739 - DNA, 20 bp, Homo sapiens
ccagctctagcctctggact

SEQ ID NO: 6723740 - DNA, 12 bp, Homo sapiens
ccagctctcagc

SEQ ID NO: 6723741 - DNA, 15 bp, Homo sapiens
ccagctctcccacat

SEQ ID NO: 6723742 - DNA, 22 bp, Homo sapiens
ccagctctcccacatcccactg

SEQ ID NO: 6723743 - DNA, 16 bp, Homo sapiens
ccagctctcccatgga

SEQ ID NO: 6723744 - DNA, 13 bp, Homo sapiens
ccagctctcccct

SEQ ID NO: 6723745 - DNA, 23 bp, Homo sapiens
ccagctctccctctggccctgcc

SEQ ID NO: 6723746 - DNA, 16 bp, Homo sapiens
ccagctctctctcctg

SEQ ID NO: 6723747 - DNA, 17 bp, Homo sapiens
ccagctctctctcctgg

SEQ ID NO: 6723748 - DNA, 13 bp, Homo sapiens
ccagctctctgac

SEQ ID NO: 6723749 - DNA, 14 bp, Homo sapiens
ccagctctctgacg

SEQ ID NO: 6723750 - DNA, 20 bp, Homo sapiens
ccagctctgaaaccagtgtt

SEQ ID NO: 6723751 - DNA, 14 bp, Homo sapiens
ccagctctgacatc

SEQ ID NO: 6723752 - DNA, 17 bp, Homo sapiens
ccagctctgacatccct

SEQ ID NO: 6723753 - DNA, 18 bp, Homo sapiens
ccagctctgacatccctt

SEQ ID NO: 6723754 - DNA, 20 bp, Homo sapiens
ccagctctgacatcccttcc

SEQ ID NO: 6723755 - DNA, 22 bp, Homo sapiens
ccagctctgagacccttttctc

SEQ ID NO: 6723756 - DNA, 21 bp, Homo sapiens
ccagctctgaggactgcacca

SEQ ID NO: 6723757 - DNA, 16 bp, Homo sapiens
ccagctctgcccccgc

SEQ ID NO: 6723758 - DNA, 20 bp, Homo sapiens
ccagctctgccgtctctgga

SEQ ID NO: 6723759 - DNA, 22 bp, Homo sapiens
ccagctctgcgtcggtcctggt

SEQ ID NO: 6723760 - DNA, 12 bp, Homo sapiens
ccagctctggag

SEQ ID NO: 6723761 - DNA, 19 bp, Homo sapiens
ccagctctggaggggaggg

SEQ ID NO: 6723762 - DNA, 14 bp, Homo sapiens
ccagctctggatga

SEQ ID NO: 6723763 - DNA, 20 bp, Homo sapiens
ccagctctggatgaaggcaa

SEQ ID NO: 6723764 - DNA, 13 bp, Homo sapiens
ccagctctggcac

SEQ ID NO: 6723765 - DNA, 16 bp, Homo sapiens
ccagctctggcacagt

SEQ ID NO: 6723766 - DNA, 12 bp, Homo sapiens
ccagctctggct

SEQ ID NO: 6723767 - DNA, 13 bp, Homo sapiens
ccagctctgggag

SEQ ID NO: 6723768 - DNA, 17 bp, Homo sapiens
ccagctctgggagccct

SEQ ID NO: 6723769 - DNA, 17 bp, Homo sapiens
ccagctctggtccatag

SEQ ID NO: 6723770 - DNA, 20 bp, Homo sapiens
ccagctctgtcaccctggcc

SEQ ID NO: 6723771 - DNA, 17 bp, Homo sapiens
ccagctctgtcctcttg

SEQ ID NO: 6723772 - DNA, 14 bp, Homo sapiens
ccagctctgtggcc

SEQ ID NO: 6723773 - DNA, 15 bp, Homo sapiens
ccagctctgtggcct

SEQ ID NO: 6723774 - DNA, 14 bp, Homo sapiens
ccagctctgtgggc

SEQ ID NO: 6723775 - DNA, 14 bp, Homo sapiens
ccagctctgttctt

SEQ ID NO: 6723776 - DNA, 16 bp, Homo sapiens
ccagctctgttcttcc

SEQ ID NO: 6723777 - DNA, 21 bp, Homo sapiens
ccagctctgttcttcctcagc

SEQ ID NO: 6723778 - DNA, 16 bp, Homo sapiens
ccagctcttcctagct

SEQ ID NO: 6723779 - DNA, 20 bp, Homo sapiens
ccagctcttcctagctggag

SEQ ID NO: 6723780 - DNA, 18 bp, Homo sapiens
ccagctcttctcttccta

SEQ ID NO: 6723781 - DNA, 21 bp, Homo sapiens
ccagctcttctcttcctagat

SEQ ID NO: 6723782 - DNA, 12 bp, Homo sapiens
ccagctcttgct

SEQ ID NO: 6723783 - DNA, 16 bp, Homo sapiens
ccagctcttgctctct

SEQ ID NO: 6723784 - DNA, 18 bp, Homo sapiens
ccagctcttgctctcttg

SEQ ID NO: 6723785 - DNA, 21 bp, Homo sapiens
ccagctcttggcccctgtgtg

SEQ ID NO: 6723786 - DNA, 14 bp, Homo sapiens
ccagctctttagaa

SEQ ID NO: 6723787 - DNA, 20 bp, Homo sapiens
ccagctgacagtcctctcca

SEQ ID NO: 6723788 - DNA, 22 bp, Homo sapiens
ccagctgacagtcctctccacc

SEQ ID NO: 6723789 - DNA, 23 bp, Homo sapiens
ccagctgacagtcctctccacct

SEQ ID NO: 6723790 - DNA, 23 bp, Homo sapiens
ccagctgactaaactttttttct

SEQ ID NO: 6723791 - DNA, 16 bp, Homo sapiens
ccagctgactgtggcc

SEQ ID NO: 6723792 - DNA, 20 bp, Homo sapiens
ccagctgactgtggccccct

SEQ ID NO: 6723793 - DNA, 17 bp, Homo sapiens
ccagctgagcgccagga

SEQ ID NO: 6723794 - DNA, 14 bp, Homo sapiens
ccagctgaggctgg

SEQ ID NO: 6723795 - DNA, 19 bp, Homo sapiens
ccagctgagtctgaattct

SEQ ID NO: 6723796 - DNA, 20 bp, Homo sapiens
ccagctgagtctgaattctg

SEQ ID NO: 6723797 - DNA, 10 bp, Homo sapiens
ccagctgcac

SEQ ID NO: 6723798 - DNA, 11 bp, Homo sapiens
ccagctgcact

SEQ ID NO: 6723799 - DNA, 20 bp, Homo sapiens
ccagctgcagccccttgctc

SEQ ID NO: 6723800 - DNA, 16 bp, Homo sapiens
ccagctgcaggaatca

SEQ ID NO: 6723801 - DNA, 15 bp, Homo sapiens
ccagctgcagggcac

SEQ ID NO: 6723802 - DNA, 17 bp, Homo sapiens
ccagctgcagggcacgg

SEQ ID NO: 6723803 - DNA, 22 bp, Homo sapiens
ccagctgcagggcacggggacc

SEQ ID NO: 6723804 - DNA, 13 bp, Homo sapiens
ccagctgccaagt

SEQ ID NO: 6723805 - DNA, 14 bp, Homo sapiens
ccagctgccaagtg

SEQ ID NO: 6723806 - DNA, 19 bp, Homo sapiens
ccagctgccaagtgctctt

SEQ ID NO: 6723807 - DNA, 21 bp, Homo sapiens
ccagctgccaggcggccctgg

SEQ ID NO: 6723808 - DNA, 18 bp, Homo sapiens
ccagctgccccagccaga

SEQ ID NO: 6723809 - DNA, 23 bp, Homo sapiens
ccagctgcccccagagccacagt

SEQ ID NO: 6723810 - DNA, 18 bp, Homo sapiens
ccagctgccccggcccct

SEQ ID NO: 6723811 - DNA, 16 bp, Homo sapiens
ccagctgcccctccct

SEQ ID NO: 6723812 - DNA, 18 bp, Homo sapiens
ccagctgcccctccctca

SEQ ID NO: 6723813 - DNA, 20 bp, Homo sapiens
ccagctgcccctccctcagg

SEQ ID NO: 6723814 - DNA, 19 bp, Homo sapiens
ccagctgcccttgcagggt

SEQ ID NO: 6723815 - DNA, 15 bp, Homo sapiens
ccagctgccgcacca

SEQ ID NO: 6723816 - DNA, 18 bp, Homo sapiens
ccagctgccgcaccagcc

SEQ ID NO: 6723817 - DNA, 23 bp, Homo sapiens
ccagctgccgcccccggactctg

SEQ ID NO: 6723818 - DNA, 12 bp, Homo sapiens
ccagctgcctag

SEQ ID NO: 6723819 - DNA, 22 bp, Homo sapiens
ccagctgcctagattcagggaa

SEQ ID NO: 6723820 - DNA, 15 bp, Homo sapiens
ccagctgcctattga

SEQ ID NO: 6723821 - DNA, 18 bp, Homo sapiens
ccagctgcctggagaggg

SEQ ID NO: 6723822 - DNA, 13 bp, Homo sapiens
ccagctgcctggg

SEQ ID NO: 6723823 - DNA, 16 bp, Homo sapiens
ccagctgcctgggagg

SEQ ID NO: 6723824 - DNA, 16 bp, Homo sapiens
ccagctgcctgtgcct

SEQ ID NO: 6723825 - DNA, 19 bp, Homo sapiens
ccagctgccttcctcatcc

SEQ ID NO: 6723826 - DNA, 20 bp, Homo sapiens
ccagctgccttcctcatccc

SEQ ID NO: 6723827 - DNA, 16 bp, Homo sapiens
ccagctgcgcttgctt

SEQ ID NO: 6723828 - DNA, 18 bp, Homo sapiens
ccagctgcgcttgctttt

SEQ ID NO: 6723829 - DNA, 19 bp, Homo sapiens
ccagctgcggcatccctgt

SEQ ID NO: 6723830 - DNA, 16 bp, Homo sapiens
ccagctgcggccaggc

SEQ ID NO: 6723831 - DNA, 9 bp, Homo sapiens
ccagctgct

SEQ ID NO: 6723832 - DNA, 10 bp, Homo sapiens
ccagctgcta

SEQ ID NO: 6723833 - DNA, 17 bp, Homo sapiens
ccagctgctcccctccc

SEQ ID NO: 6723834 - DNA, 21 bp, Homo sapiens
ccagctgctcccctccctcct

SEQ ID NO: 6723835 - DNA, 21 bp, Homo sapiens
ccagctgctcccctgccacgc

SEQ ID NO: 6723836 - DNA, 16 bp, Homo sapiens
ccagctgctcctcgca

SEQ ID NO: 6723837 - DNA, 21 bp, Homo sapiens
ccagctgctctaagcccagga

SEQ ID NO: 6723838 - DNA, 15 bp, Homo sapiens
ccagctgctctgccc

SEQ ID NO: 6723839 - DNA, 23 bp, Homo sapiens
ccagctgctctgcccagagctgg

SEQ ID NO: 6723840 - DNA, 21 bp, Homo sapiens
ccagctgctctgccccttggg

SEQ ID NO: 6723841 - DNA, 22 bp, Homo sapiens
ccagctgctgagatcctggact

SEQ ID NO: 6723842 - DNA, 14 bp, Homo sapiens
ccagctgctgagcc

SEQ ID NO: 6723843 - DNA, 19 bp, Homo sapiens
ccagctgctgagccgcaga

SEQ ID NO: 6723844 - DNA, 15 bp, Homo sapiens
ccagctgctgctctg

SEQ ID NO: 6723845 - DNA, 16 bp, Homo sapiens
ccagctgctgtgcccc

SEQ ID NO: 6723846 - DNA, 20 bp, Homo sapiens
ccagctgctgtgccccacca

SEQ ID NO: 6723847 - DNA, 21 bp, Homo sapiens
ccagctgctgtgccccaccac

SEQ ID NO: 6723848 - DNA, 14 bp, Homo sapiens
ccagctgcttctgc

SEQ ID NO: 6723849 - DNA, 15 bp, Homo sapiens
ccagctgcttctgcc

SEQ ID NO: 6723850 - DNA, 16 bp, Homo sapiens
ccagctgcttctgccc

SEQ ID NO: 6723851 - DNA, 21 bp, Homo sapiens
ccagctgcttctgcccacccc

SEQ ID NO: 6723852 - DNA, 13 bp, Homo sapiens
ccagctgcttggg

SEQ ID NO: 6723853 - DNA, 20 bp, Homo sapiens
ccagctgcttgggcttcatc

SEQ ID NO: 6723854 - DNA, 12 bp, Homo sapiens
ccagctggaagg

SEQ ID NO: 6723855 - DNA, 24 bp, Homo sapiens
ccagctggagaaatatggtactca

SEQ ID NO: 6723856 - DNA, 17 bp, Homo sapiens
ccagctggaggcagggg

SEQ ID NO: 6723857 - DNA, 23 bp, Homo sapiens
ccagctggagtgagggcctcaga

SEQ ID NO: 6723858 - DNA, 12 bp, Homo sapiens
ccagctggatcc

SEQ ID NO: 6723859 - DNA, 13 bp, Homo sapiens
ccagctggccacc

SEQ ID NO: 6723860 - DNA, 13 bp, Homo sapiens
ccagctggccgga

SEQ ID NO: 6723861 - DNA, 12 bp, Homo sapiens
ccagctggcctg

SEQ ID NO: 6723862 - DNA, 15 bp, Homo sapiens
ccagctggcctggac

SEQ ID NO: 6723863 - DNA, 16 bp, Homo sapiens
ccagctggcctggaca

SEQ ID NO: 6723864 - DNA, 17 bp, Homo sapiens
ccagctggcctggacag

SEQ ID NO: 6723865 - DNA, 19 bp, Homo sapiens
ccagctggcctggccccca

SEQ ID NO: 6723866 - DNA, 22 bp, Homo sapiens
ccagctggcctggcccccagct

SEQ ID NO: 6723867 - DNA, 17 bp, Homo sapiens
ccagctggctctgcagc

SEQ ID NO: 6723868 - DNA, 21 bp, Homo sapiens
ccagctgggaggcaagagggg

SEQ ID NO: 6723869 - DNA, 14 bp, Homo sapiens
ccagctgggcccag

SEQ ID NO: 6723870 - DNA, 19 bp, Homo sapiens
ccagctgggccgggaccca

SEQ ID NO: 6723871 - DNA, 19 bp, Homo sapiens
ccagctgggcctcctgcct

SEQ ID NO: 6723872 - DNA, 11 bp, Homo sapiens
ccagctgggct

SEQ ID NO: 6723873 - DNA, 20 bp, Homo sapiens
ccagctgggctagaggctga

SEQ ID NO: 6723874 - DNA, 19 bp, Homo sapiens
ccagctgggctctgcaatt

SEQ ID NO: 6723875 - DNA, 16 bp, Homo sapiens
ccagctgggctctgcc

SEQ ID NO: 6723876 - DNA, 22 bp, Homo sapiens
ccagctgggctctgccacccta

SEQ ID NO: 6723877 - DNA, 18 bp, Homo sapiens
ccagctgggctgttggct

SEQ ID NO: 6723878 - DNA, 19 bp, Homo sapiens
ccagctggggagatggggg

SEQ ID NO: 6723879 - DNA, 21 bp, Homo sapiens
ccagctggggccagaggctgg

SEQ ID NO: 6723880 - DNA, 18 bp, Homo sapiens
ccagctggggccaggctg

SEQ ID NO: 6723881 - DNA, 21 bp, Homo sapiens
ccagctggggccaggctgggt

SEQ ID NO: 6723882 - DNA, 23 bp, Homo sapiens
ccagctggggccaggctgggtcg

SEQ ID NO: 6723883 - DNA, 17 bp, Homo sapiens
ccagctgggtgccccag

SEQ ID NO: 6723884 - DNA, 17 bp, Homo sapiens
ccagctgggttggaaaa

SEQ ID NO: 6723885 - DNA, 12 bp, Homo sapiens
ccagctggtcct

SEQ ID NO: 6723886 - DNA, 15 bp, Homo sapiens
ccagctggtcctgtg

SEQ ID NO: 6723887 - DNA, 17 bp, Homo sapiens
ccagctggtcctgtgga

SEQ ID NO: 6723888 - DNA, 16 bp, Homo sapiens
ccagctggtgaatcca

SEQ ID NO: 6723889 - DNA, 21 bp, Homo sapiens
ccagctggtgagtgatgcggc

SEQ ID NO: 6723890 - DNA, 14 bp, Homo sapiens
ccagctggtgcccc

SEQ ID NO: 6723891 - DNA, 14 bp, Homo sapiens
ccagctggtgctgc

SEQ ID NO: 6723892 - DNA, 18 bp, Homo sapiens
ccagctggtgctgcaagg

SEQ ID NO: 6723893 - DNA, 21 bp, Homo sapiens
ccagctggtgctgcaaggaag

SEQ ID NO: 6723894 - DNA, 23 bp, Homo sapiens
ccagctgtactgagttctcatcc

SEQ ID NO: 6723895 - DNA, 20 bp, Homo sapiens
ccagctgtagccatggctca

SEQ ID NO: 6723896 - DNA, 23 bp, Homo sapiens
ccagctgtagccatggctcaggc

SEQ ID NO: 6723897 - DNA, 16 bp, Homo sapiens
ccagctgtcagcctgg

SEQ ID NO: 6723898 - DNA, 22 bp, Homo sapiens
ccagctgtcgtctgactctggg

SEQ ID NO: 6723899 - DNA, 13 bp, Homo sapiens
ccagctgtctgtg

SEQ ID NO: 6723900 - DNA, 18 bp, Homo sapiens
ccagctgtgaagagactc

SEQ ID NO: 6723901 - DNA, 15 bp, Homo sapiens
ccagctgtgagcctt

SEQ ID NO: 6723902 - DNA, 16 bp, Homo sapiens
ccagctgtgagccttg

SEQ ID NO: 6723903 - DNA, 22 bp, Homo sapiens
ccagctgtgcagcacgtctcag

SEQ ID NO: 6723904 - DNA, 22 bp, Homo sapiens
ccagctgtgcgagaacacaagc

SEQ ID NO: 6723905 - DNA, 20 bp, Homo sapiens
ccagctgtgctctggacagg

SEQ ID NO: 6723906 - DNA, 17 bp, Homo sapiens
ccagctgtgctgggagg

SEQ ID NO: 6723907 - DNA, 21 bp, Homo sapiens
ccagctgtgctgggaggtccc

SEQ ID NO: 6723908 - DNA, 22 bp, Homo sapiens
ccagctgtgctgggaggtccca

SEQ ID NO: 6723909 - DNA, 15 bp, Homo sapiens
ccagctgtgcttatg

SEQ ID NO: 6723910 - DNA, 14 bp, Homo sapiens
ccagctgtgtcctt

SEQ ID NO: 6723911 - DNA, 19 bp, Homo sapiens
ccagctgtgttcacactgt

SEQ ID NO: 6723912 - DNA, 17 bp, Homo sapiens
ccagctgttcagctggt

SEQ ID NO: 6723913 - DNA, 22 bp, Homo sapiens
ccagctgttctgtcccttggag

SEQ ID NO: 6723914 - DNA, 16 bp, Homo sapiens
ccagcttaaaacactt

SEQ ID NO: 6723915 - DNA, 19 bp, Homo sapiens
ccagcttaaaggggctaga

SEQ ID NO: 6723916 - DNA, 19 bp, Homo sapiens
ccagcttaaatcctagcag

SEQ ID NO: 6723917 - DNA, 20 bp, Homo sapiens
ccagcttatagtcatatata

SEQ ID NO: 6723918 - DNA, 16 bp, Homo sapiens
ccagcttcacctctgg

SEQ ID NO: 6723919 - DNA, 17 bp, Homo sapiens
ccagcttcacctctggg

SEQ ID NO: 6723920 - DNA, 20 bp, Homo sapiens
ccagcttcacttctgactct

SEQ ID NO: 6723921 - DNA, 19 bp, Homo sapiens
ccagcttcaggcaccagca

SEQ ID NO: 6723922 - DNA, 20 bp, Homo sapiens
ccagcttcaggcaccagcat

SEQ ID NO: 6723923 - DNA, 19 bp, Homo sapiens
ccagcttcatgtggcttcc

SEQ ID NO: 6723924 - DNA, 13 bp, Homo sapiens
ccagcttccaaag

SEQ ID NO: 6723925 - DNA, 15 bp, Homo sapiens
ccagcttccagcagg

SEQ ID NO: 6723926 - DNA, 16 bp, Homo sapiens
ccagcttccagcagga

SEQ ID NO: 6723927 - DNA, 17 bp, Homo sapiens
ccagcttccagcaggag

SEQ ID NO: 6723928 - DNA, 10 bp, Homo sapiens
ccagcttccc

SEQ ID NO: 6723929 - DNA, 21 bp, Homo sapiens
ccagcttcccctcgctgtcct

SEQ ID NO: 6723930 - DNA, 14 bp, Homo sapiens
ccagcttccctctg

SEQ ID NO: 6723931 - DNA, 22 bp, Homo sapiens
ccagcttccctctgcctgaccc

SEQ ID NO: 6723932 - DNA, 15 bp, Homo sapiens
ccagcttcctctgag

SEQ ID NO: 6723933 - DNA, 16 bp, Homo sapiens
ccagcttcctctgagc

SEQ ID NO: 6723934 - DNA, 18 bp, Homo sapiens
ccagcttcctctgagccg

SEQ ID NO: 6723935 - DNA, 14 bp, Homo sapiens
ccagcttcctggtg

SEQ ID NO: 6723936 - DNA, 17 bp, Homo sapiens
ccagcttcctgtgcaga

SEQ ID NO: 6723937 - DNA, 19 bp, Homo sapiens
ccagcttcctgtgcagaag

SEQ ID NO: 6723938 - DNA, 15 bp, Homo sapiens
ccagcttcctgtggg

SEQ ID NO: 6723939 - DNA, 22 bp, Homo sapiens
ccagcttcctgtgggccaggag

SEQ ID NO: 6723940 - DNA, 13 bp, Homo sapiens
ccagcttccttca

SEQ ID NO: 6723941 - DNA, 20 bp, Homo sapiens
ccagcttccttcagagagca

SEQ ID NO: 6723942 - DNA, 16 bp, Homo sapiens
ccagcttcgtcagctc

SEQ ID NO: 6723943 - DNA, 20 bp, Homo sapiens
ccagcttcgtgctggaggaa

SEQ ID NO: 6723944 - DNA, 21 bp, Homo sapiens
ccagcttctcagtttctgcct

SEQ ID NO: 6723945 - DNA, 22 bp, Homo sapiens
ccagcttctcagtttctgcctg

SEQ ID NO: 6723946 - DNA, 21 bp, Homo sapiens
ccagcttctcatgttaaatat

SEQ ID NO: 6723947 - DNA, 22 bp, Homo sapiens
ccagcttctcatgttaaatatt

SEQ ID NO: 6723948 - DNA, 18 bp, Homo sapiens
ccagcttctccaggctct

SEQ ID NO: 6723949 - DNA, 13 bp, Homo sapiens
ccagcttctctct

SEQ ID NO: 6723950 - DNA, 14 bp, Homo sapiens
ccagcttctctctc

SEQ ID NO: 6723951 - DNA, 15 bp, Homo sapiens
ccagcttctctctcc

SEQ ID NO: 6723952 - DNA, 23 bp, Homo sapiens
ccagcttctggtactctcctaga

SEQ ID NO: 6723953 - DNA, 16 bp, Homo sapiens
ccagcttctttctcgg

SEQ ID NO: 6723954 - DNA, 15 bp, Homo sapiens
ccagcttgccagatg

SEQ ID NO: 6723955 - DNA, 21 bp, Homo sapiens
ccagcttgcctgtttcttctc

SEQ ID NO: 6723956 - DNA, 14 bp, Homo sapiens
ccagcttgcttctc

SEQ ID NO: 6723957 - DNA, 17 bp, Homo sapiens
ccagcttggagtgccac

SEQ ID NO: 6723958 - DNA, 22 bp, Homo sapiens
ccagcttggctcgatgtttgcc

SEQ ID NO: 6723959 - DNA, 14 bp, Homo sapiens
ccagcttggggcca

SEQ ID NO: 6723960 - DNA, 21 bp, Homo sapiens
ccagcttggggccaccaaagc

SEQ ID NO: 6723961 - DNA, 22 bp, Homo sapiens
ccagcttggggccaccaaagct

SEQ ID NO: 6723962 - DNA, 17 bp, Homo sapiens
ccagcttgtggagcccc

SEQ ID NO: 6723963 - DNA, 18 bp, Homo sapiens
ccagcttgtggagcccca

SEQ ID NO: 6723964 - DNA, 19 bp, Homo sapiens
ccagcttgtggagccccac

SEQ ID NO: 6723965 - DNA, 23 bp, Homo sapiens
ccagcttgtggagccccacactg

SEQ ID NO: 6723966 - DNA, 18 bp, Homo sapiens
ccagcttgttctgggctc

SEQ ID NO: 6723967 - DNA, 22 bp, Homo sapiens
ccagctttaagggttgtgagcc

SEQ ID NO: 6723968 - DNA, 20 bp, Homo sapiens
ccagctttatctgtcacaca

SEQ ID NO: 6723969 - DNA, 16 bp, Homo sapiens
ccagctttctctttgt

SEQ ID NO: 6723970 - DNA, 14 bp, Homo sapiens
ccagctttctgcag

SEQ ID NO: 6723971 - DNA, 18 bp, Homo sapiens
ccagctttctgcagactg

SEQ ID NO: 6723972 - DNA, 21 bp, Homo sapiens
ccagctttgacgtattatctg

SEQ ID NO: 6723973 - DNA, 22 bp, Homo sapiens
ccagctttgcccaacaccagcc

SEQ ID NO: 6723974 - DNA, 18 bp, Homo sapiens
ccagcttttaaccatctg

SEQ ID NO: 6723975 - DNA, 13 bp, Homo sapiens
ccagcttttccca

SEQ ID NO: 6723976 - DNA, 13 bp, Homo sapiens
ccagcttttcttg

SEQ ID NO: 6723977 - DNA, 18 bp, Homo sapiens
ccagcttttcttgccagc

SEQ ID NO: 6723978 - DNA, 18 bp, Homo sapiens
ccagctttttctctcagg

SEQ ID NO: 6723979 - DNA, 21 bp, Homo sapiens
ccaggaaaaaaaaaaaaagaa

SEQ ID NO: 6723980 - DNA, 12 bp, Homo sapiens
ccaggaaaaaat

SEQ ID NO: 6723981 - DNA, 17 bp, Homo sapiens
ccaggaaaaacctgtgg

SEQ ID NO: 6723982 - DNA, 18 bp, Homo sapiens
ccaggaaaaacctgtggg

SEQ ID NO: 6723983 - DNA, 21 bp, Homo sapiens
ccaggaaaactgggacatagg

SEQ ID NO: 6723984 - DNA, 20 bp, Homo sapiens
ccaggaaaatgtgaggggaa

SEQ ID NO: 6723985 - DNA, 17 bp, Homo sapiens
ccaggaaacaagggaag

SEQ ID NO: 6723986 - DNA, 21 bp, Homo sapiens
ccaggaaaccctcttcttccc

SEQ ID NO: 6723987 - DNA, 15 bp, Homo sapiens
ccaggaaactgctac

SEQ ID NO: 6723988 - DNA, 13 bp, Homo sapiens
ccaggaaagaaac

SEQ ID NO: 6723989 - DNA, 15 bp, Homo sapiens
ccaggaaagaggcat

SEQ ID NO: 6723990 - DNA, 21 bp, Homo sapiens
ccaggaaagatgtcccacagg

SEQ ID NO: 6723991 - DNA, 18 bp, Homo sapiens
ccaggaaaggaggaccag

SEQ ID NO: 6723992 - DNA, 14 bp, Homo sapiens
ccaggaaaggctcc

SEQ ID NO: 6723993 - DNA, 18 bp, Homo sapiens
ccaggaaaggctccagga

SEQ ID NO: 6723994 - DNA, 22 bp, Homo sapiens
ccaggaaaggctccaggagcag

SEQ ID NO: 6723995 - DNA, 20 bp, Homo sapiens
ccaggaaaggcttggctggt

SEQ ID NO: 6723996 - DNA, 19 bp, Homo sapiens
ccaggaacacatgcacaca

SEQ ID NO: 6723997 - DNA, 22 bp, Homo sapiens
ccaggaacacccgactcctcaa

SEQ ID NO: 6723998 - DNA, 16 bp, Homo sapiens
ccaggaacagggacca

SEQ ID NO: 6723999 - DNA, 22 bp, Homo sapiens
ccaggaacagggaccagctccc

SEQ ID NO: 6724000 - DNA, 17 bp, Homo sapiens
ccaggaaccaaaaagag

SEQ ID NO: 6724001 - DNA, 22 bp, Homo sapiens
ccaggaaccgaacatatcattt

SEQ ID NO: 6724002 - DNA, 15 bp, Homo sapiens
ccaggaactgcctgg

SEQ ID NO: 6724003 - DNA, 18 bp, Homo sapiens
ccaggaactgcctgggcc

SEQ ID NO: 6724004 - DNA, 22 bp, Homo sapiens
ccaggaactggctcctttgcct

SEQ ID NO: 6724005 - DNA, 17 bp, Homo sapiens
ccaggaagaagcagggg

SEQ ID NO: 6724006 - DNA, 19 bp, Homo sapiens
ccaggaagaaggcccggga

SEQ ID NO: 6724007 - DNA, 20 bp, Homo sapiens
ccaggaagaaggcccgggag

SEQ ID NO: 6724008 - DNA, 12 bp, Homo sapiens
ccaggaagccag

SEQ ID NO: 6724009 - DNA, 16 bp, Homo sapiens
ccaggaagccagagcc

SEQ ID NO: 6724010 - DNA, 17 bp, Homo sapiens
ccaggaagccagcaggc

SEQ ID NO: 6724011 - DNA, 20 bp, Homo sapiens
ccaggaagccagcaggctct

SEQ ID NO: 6724012 - DNA, 19 bp, Homo sapiens
ccaggaagcccactgcctc

SEQ ID NO: 6724013 - DNA, 20 bp, Homo sapiens
ccaggaagcccactgcctcc

SEQ ID NO: 6724014 - DNA, 15 bp, Homo sapiens
ccaggaagcccagga

SEQ ID NO: 6724015 - DNA, 18 bp, Homo sapiens
ccaggaagcccaggagcc

SEQ ID NO: 6724016 - DNA, 23 bp, Homo sapiens
ccaggaagccccgctcaggtagc

SEQ ID NO: 6724017 - DNA, 15 bp, Homo sapiens
ccaggaagccgtgcc

SEQ ID NO: 6724018 - DNA, 20 bp, Homo sapiens
ccaggaagccgtgccctgcc

SEQ ID NO: 6724019 - DNA, 14 bp, Homo sapiens
ccaggaaggaaaca

SEQ ID NO: 6724020 - DNA, 17 bp, Homo sapiens
ccaggaaggaaacagat

SEQ ID NO: 6724021 - DNA, 19 bp, Homo sapiens
ccaggaaggacagactggc

SEQ ID NO: 6724022 - DNA, 20 bp, Homo sapiens
ccaggaaggacagactggcc

SEQ ID NO: 6724023 - DNA, 17 bp, Homo sapiens
ccaggaaggcagctgct

SEQ ID NO: 6724024 - DNA, 19 bp, Homo sapiens
ccaggaaggcagctgctct

SEQ ID NO: 6724025 - DNA, 23 bp, Homo sapiens
ccaggaaggccaaaatcaagagt

SEQ ID NO: 6724026 - DNA, 19 bp, Homo sapiens
ccaggaaggcggcaggcag

SEQ ID NO: 6724027 - DNA, 23 bp, Homo sapiens
ccaggaagggaaagcgggcagcc

SEQ ID NO: 6724028 - DNA, 16 bp, Homo sapiens
ccaggaaggggacagg

SEQ ID NO: 6724029 - DNA, 18 bp, Homo sapiens
ccaggaaggggctggact

SEQ ID NO: 6724030 - DNA, 21 bp, Homo sapiens
ccaggaagggggtccacccag

SEQ ID NO: 6724031 - DNA, 22 bp, Homo sapiens
ccaggaagggggtccacccagc

SEQ ID NO: 6724032 - DNA, 18 bp, Homo sapiens
ccaggaaggtagcccagc

SEQ ID NO: 6724033 - DNA, 14 bp, Homo sapiens
ccaggaagtaattt

SEQ ID NO: 6724034 - DNA, 23 bp, Homo sapiens
ccaggaagtaattttcttctcat

SEQ ID NO: 6724035 - DNA, 16 bp, Homo sapiens
ccaggaagtagcacag

SEQ ID NO: 6724036 - DNA, 20 bp, Homo sapiens
ccaggaagtgcttattctct

SEQ ID NO: 6724037 - DNA, 16 bp, Homo sapiens
ccaggaagtggctcag

SEQ ID NO: 6724038 - DNA, 14 bp, Homo sapiens
ccaggaatagtgga

SEQ ID NO: 6724039 - DNA, 14 bp, Homo sapiens
ccaggaatatgaca

SEQ ID NO: 6724040 - DNA, 13 bp, Homo sapiens
ccaggaatattaa

SEQ ID NO: 6724041 - DNA, 14 bp, Homo sapiens
ccaggaatctgcca

SEQ ID NO: 6724042 - DNA, 17 bp, Homo sapiens
ccaggaatgctgggccc

SEQ ID NO: 6724043 - DNA, 15 bp, Homo sapiens
ccaggaatggtgctt

SEQ ID NO: 6724044 - DNA, 20 bp, Homo sapiens
ccaggaatgttaaagtcagt

SEQ ID NO: 6724045 - DNA, 22 bp, Homo sapiens
ccaggaattgatacgtttatta

SEQ ID NO: 6724046 - DNA, 17 bp, Homo sapiens
ccaggaatttcccagga

SEQ ID NO: 6724047 - DNA, 18 bp, Homo sapiens
ccaggaatttcccaggac

SEQ ID NO: 6724048 - DNA, 20 bp, Homo sapiens
ccaggaatttcccaggaccc

SEQ ID NO: 6724049 - DNA, 22 bp, Homo sapiens
ccaggaatttcccaggaccctg

SEQ ID NO: 6724050 - DNA, 20 bp, Homo sapiens
ccaggaatttgggaccctgc

SEQ ID NO: 6724051 - DNA, 20 bp, Homo sapiens
ccaggacaagcatggtccca

SEQ ID NO: 6724052 - DNA, 22 bp, Homo sapiens
ccaggacaatgaaatactccag

SEQ ID NO: 6724053 - DNA, 22 bp, Homo sapiens
ccaggacacaacgctgctgcct

SEQ ID NO: 6724054 - DNA, 15 bp, Homo sapiens
ccaggacacactgaa

SEQ ID NO: 6724055 - DNA, 18 bp, Homo sapiens
ccaggacaccacacccag

SEQ ID NO: 6724056 - DNA, 21 bp, Homo sapiens
ccaggacaccagtccaggtag

SEQ ID NO: 6724057 - DNA, 23 bp, Homo sapiens
ccaggacacctgccccagcgcgg

SEQ ID NO: 6724058 - DNA, 21 bp, Homo sapiens
ccaggacacctttctctgccg

SEQ ID NO: 6724059 - DNA, 19 bp, Homo sapiens
ccaggacactaccctgaga

SEQ ID NO: 6724060 - DNA, 16 bp, Homo sapiens
ccaggacactgccttt

SEQ ID NO: 6724061 - DNA, 16 bp, Homo sapiens
ccaggacagcagcact

SEQ ID NO: 6724062 - DNA, 15 bp, Homo sapiens
ccaggacagctgcag

SEQ ID NO: 6724063 - DNA, 23 bp, Homo sapiens
ccaggacagctggctgctgacag

SEQ ID NO: 6724064 - DNA, 13 bp, Homo sapiens
ccaggacaggacc

SEQ ID NO: 6724065 - DNA, 14 bp, Homo sapiens
ccaggacaggacca

SEQ ID NO: 6724066 - DNA, 20 bp, Homo sapiens
ccaggacaggagatgctgtg

SEQ ID NO: 6724067 - DNA, 13 bp, Homo sapiens
ccaggacaggatc

SEQ ID NO: 6724068 - DNA, 13 bp, Homo sapiens
ccaggacaggctg

SEQ ID NO: 6724069 - DNA, 22 bp, Homo sapiens
ccaggaccaagcttaaggagag

SEQ ID NO: 6724070 - DNA, 19 bp, Homo sapiens
ccaggaccaagggcagagg

SEQ ID NO: 6724071 - DNA, 12 bp, Homo sapiens
ccaggaccacac

SEQ ID NO: 6724072 - DNA, 20 bp, Homo sapiens
ccaggaccacacagtcccca

SEQ ID NO: 6724073 - DNA, 21 bp, Homo sapiens
ccaggaccacacagtccccag

SEQ ID NO: 6724074 - DNA, 13 bp, Homo sapiens
ccaggaccacagg

SEQ ID NO: 6724075 - DNA, 16 bp, Homo sapiens
ccaggaccacaggctc

SEQ ID NO: 6724076 - DNA, 17 bp, Homo sapiens
ccaggaccacaggctca

SEQ ID NO: 6724077 - DNA, 12 bp, Homo sapiens
ccaggaccagcc

SEQ ID NO: 6724078 - DNA, 14 bp, Homo sapiens
ccaggaccagctca

SEQ ID NO: 6724079 - DNA, 20 bp, Homo sapiens
ccaggaccagctcaggacag

SEQ ID NO: 6724080 - DNA, 14 bp, Homo sapiens
ccaggaccagctgg

SEQ ID NO: 6724081 - DNA, 15 bp, Homo sapiens
ccaggaccatcatcc

SEQ ID NO: 6724082 - DNA, 17 bp, Homo sapiens
ccaggacccaccactgg

SEQ ID NO: 6724083 - DNA, 19 bp, Homo sapiens
ccaggacccaccactggaa

SEQ ID NO: 6724084 - DNA, 20 bp, Homo sapiens
ccaggacccaccactggaag

SEQ ID NO: 6724085 - DNA, 22 bp, Homo sapiens
ccaggacccaccactggaagca

SEQ ID NO: 6724086 - DNA, 14 bp, Homo sapiens
ccaggacccaggga

SEQ ID NO: 6724087 - DNA, 16 bp, Homo sapiens
ccaggacccagggaga

SEQ ID NO: 6724088 - DNA, 23 bp, Homo sapiens
ccaggacccagggagaggctgtg

SEQ ID NO: 6724089 - DNA, 19 bp, Homo sapiens
ccaggacccatctttctca

SEQ ID NO: 6724090 - DNA, 12 bp, Homo sapiens
ccaggacccccc

SEQ ID NO: 6724091 - DNA, 20 bp, Homo sapiens
ccaggacccccgaggggagg

SEQ ID NO: 6724092 - DNA, 19 bp, Homo sapiens
ccaggacccgccagccccg

SEQ ID NO: 6724093 - DNA, 18 bp, Homo sapiens
ccaggacccgcctgctcc

SEQ ID NO: 6724094 - DNA, 22 bp, Homo sapiens
ccaggacccgcctgctcccatc

SEQ ID NO: 6724095 - DNA, 22 bp, Homo sapiens
ccaggaccctccactcactgct

SEQ ID NO: 6724096 - DNA, 16 bp, Homo sapiens
ccaggaccctgaaggg

SEQ ID NO: 6724097 - DNA, 18 bp, Homo sapiens
ccaggaccctgaaggggc

SEQ ID NO: 6724098 - DNA, 20 bp, Homo sapiens
ccaggaccctgccaggcaca

SEQ ID NO: 6724099 - DNA, 21 bp, Homo sapiens
ccaggaccctgccaggcacag

SEQ ID NO: 6724100 - DNA, 22 bp, Homo sapiens
ccaggaccctgccaggcacagg

SEQ ID NO: 6724101 - DNA, 15 bp, Homo sapiens
ccaggaccctgggtc

SEQ ID NO: 6724102 - DNA, 23 bp, Homo sapiens
ccaggaccctgggtcaccttcct

SEQ ID NO: 6724103 - DNA, 22 bp, Homo sapiens
ccaggacctagtcggggggtgg

SEQ ID NO: 6724104 - DNA, 14 bp, Homo sapiens
ccaggacctccgga

SEQ ID NO: 6724105 - DNA, 14 bp, Homo sapiens
ccaggacctctggg

SEQ ID NO: 6724106 - DNA, 17 bp, Homo sapiens
ccaggacctgagcctgg

SEQ ID NO: 6724107 - DNA, 16 bp, Homo sapiens
ccaggaccttgcttcc

SEQ ID NO: 6724108 - DNA, 22 bp, Homo sapiens
ccaggaccttgcttccttctca

SEQ ID NO: 6724109 - DNA, 21 bp, Homo sapiens
ccaggacgcagggagaccctg

SEQ ID NO: 6724110 - DNA, 17 bp, Homo sapiens
ccaggacgcttctgaat

SEQ ID NO: 6724111 - DNA, 22 bp, Homo sapiens
ccaggacgcttctgaatgctgc

SEQ ID NO: 6724112 - DNA, 16 bp, Homo sapiens
ccaggacggggccggc

SEQ ID NO: 6724113 - DNA, 18 bp, Homo sapiens
ccaggacggggccggcca

SEQ ID NO: 6724114 - DNA, 19 bp, Homo sapiens
ccaggacggggccggccag

SEQ ID NO: 6724115 - DNA, 20 bp, Homo sapiens
ccaggacggtctgtgcccga

SEQ ID NO: 6724116 - DNA, 16 bp, Homo sapiens
ccaggactagagcaca

SEQ ID NO: 6724117 - DNA, 19 bp, Homo sapiens
ccaggactatagcccaggt

SEQ ID NO: 6724118 - DNA, 22 bp, Homo sapiens
ccaggactatagcccaggtcct

SEQ ID NO: 6724119 - DNA, 22 bp, Homo sapiens
ccaggactcagggactcaggcc

SEQ ID NO: 6724120 - DNA, 18 bp, Homo sapiens
ccaggactccactggaca

SEQ ID NO: 6724121 - DNA, 20 bp, Homo sapiens
ccaggactccactggacaga

SEQ ID NO: 6724122 - DNA, 21 bp, Homo sapiens
ccaggactccactggacagac

SEQ ID NO: 6724123 - DNA, 18 bp, Homo sapiens
ccaggactccctcctcac

SEQ ID NO: 6724124 - DNA, 20 bp, Homo sapiens
ccaggactccttagactgat

SEQ ID NO: 6724125 - DNA, 23 bp, Homo sapiens
ccaggactccttgttctgctctg

SEQ ID NO: 6724126 - DNA, 17 bp, Homo sapiens
ccaggactctctgcttg

SEQ ID NO: 6724127 - DNA, 15 bp, Homo sapiens
ccaggactctctttc

SEQ ID NO: 6724128 - DNA, 17 bp, Homo sapiens
ccaggactctgcagcct

SEQ ID NO: 6724129 - DNA, 20 bp, Homo sapiens
ccaggactctgcagcctcag

SEQ ID NO: 6724130 - DNA, 21 bp, Homo sapiens
ccaggactctgcagcctcaga

SEQ ID NO: 6724131 - DNA, 21 bp, Homo sapiens
ccaggactctgccttccaggc

SEQ ID NO: 6724132 - DNA, 15 bp, Homo sapiens
ccaggactctggcac

SEQ ID NO: 6724133 - DNA, 18 bp, Homo sapiens
ccaggactggaaaaagtg

SEQ ID NO: 6724134 - DNA, 13 bp, Homo sapiens
ccaggactgggcc

SEQ ID NO: 6724135 - DNA, 14 bp, Homo sapiens
ccaggactgggcca

SEQ ID NO: 6724136 - DNA, 22 bp, Homo sapiens
ccaggactgggtctgacctggt

SEQ ID NO: 6724137 - DNA, 23 bp, Homo sapiens
ccaggactgtcattttggcatct

SEQ ID NO: 6724138 - DNA, 14 bp, Homo sapiens
ccaggactgtttca

SEQ ID NO: 6724139 - DNA, 18 bp, Homo sapiens
ccaggacttggggtcagg

SEQ ID NO: 6724140 - DNA, 20 bp, Homo sapiens
ccaggagaaagccgggggag

SEQ ID NO: 6724141 - DNA, 21 bp, Homo sapiens
ccaggagaaagccgggggagg

SEQ ID NO: 6724142 - DNA, 22 bp, Homo sapiens
ccaggagaaagccgggggaggg

SEQ ID NO: 6724143 - DNA, 22 bp, Homo sapiens
ccaggagaagctcagctgcatt

SEQ ID NO: 6724144 - DNA, 13 bp, Homo sapiens
ccaggagaaggga

SEQ ID NO: 6724145 - DNA, 16 bp, Homo sapiens
ccaggagaaggggccc

SEQ ID NO: 6724146 - DNA, 21 bp, Homo sapiens
ccaggagaagggggctctgcc

SEQ ID NO: 6724147 - DNA, 12 bp, Homo sapiens
ccaggagaaggt

SEQ ID NO: 6724148 - DNA, 20 bp, Homo sapiens
ccaggagaagtgctccctgg

SEQ ID NO: 6724149 - DNA, 20 bp, Homo sapiens
ccaggagaattaggaaggcc

SEQ ID NO: 6724150 - DNA, 16 bp, Homo sapiens
ccaggagacctccagc

SEQ ID NO: 6724151 - DNA, 17 bp, Homo sapiens
ccaggagacctccagct

SEQ ID NO: 6724152 - DNA, 12 bp, Homo sapiens
ccaggagacctg

SEQ ID NO: 6724153 - DNA, 17 bp, Homo sapiens
ccaggagacctgctctc

SEQ ID NO: 6724154 - DNA, 14 bp, Homo sapiens
ccaggagagacaga

SEQ ID NO: 6724155 - DNA, 13 bp, Homo sapiens
ccaggagagagat

SEQ ID NO: 6724156 - DNA, 22 bp, Homo sapiens
ccaggagagagatctagaaagt

SEQ ID NO: 6724157 - DNA, 16 bp, Homo sapiens
ccaggagagagccagg

SEQ ID NO: 6724158 - DNA, 23 bp, Homo sapiens
ccaggagagagccaggatgccca

SEQ ID NO: 6724159 - DNA, 23 bp, Homo sapiens
ccaggagagccagccctccctgt

SEQ ID NO: 6724160 - DNA, 15 bp, Homo sapiens
ccaggagagcctggg

SEQ ID NO: 6724161 - DNA, 15 bp, Homo sapiens
ccaggagatggcccc

SEQ ID NO: 6724162 - DNA, 17 bp, Homo sapiens
ccaggagatgggtccag

SEQ ID NO: 6724163 - DNA, 22 bp, Homo sapiens
ccaggagattggatttgctgtg

SEQ ID NO: 6724164 - DNA, 12 bp, Homo sapiens
ccaggagcaaat

SEQ ID NO: 6724165 - DNA, 21 bp, Homo sapiens
ccaggagcaagtgaggccgga

SEQ ID NO: 6724166 - DNA, 20 bp, Homo sapiens
ccaggagcaatgggactgga

SEQ ID NO: 6724167 - DNA, 19 bp, Homo sapiens
ccaggagcacacggccctg

SEQ ID NO: 6724168 - DNA, 13 bp, Homo sapiens
ccaggagcacctg

SEQ ID NO: 6724169 - DNA, 17 bp, Homo sapiens
ccaggagcacctggacc

SEQ ID NO: 6724170 - DNA, 14 bp, Homo sapiens
ccaggagcagcagc

SEQ ID NO: 6724171 - DNA, 17 bp, Homo sapiens
ccaggagcagcagccag

SEQ ID NO: 6724172 - DNA, 21 bp, Homo sapiens
ccaggagcagcagccagcacc

SEQ ID NO: 6724173 - DNA, 22 bp, Homo sapiens
ccaggagcagcagccagcacca

SEQ ID NO: 6724174 - DNA, 14 bp, Homo sapiens
ccaggagcagccac

SEQ ID NO: 6724175 - DNA, 13 bp, Homo sapiens
ccaggagcagcct

SEQ ID NO: 6724176 - DNA, 14 bp, Homo sapiens
ccaggagcagcctc

SEQ ID NO: 6724177 - DNA, 19 bp, Homo sapiens
ccaggagcagctggcactg

SEQ ID NO: 6724178 - DNA, 21 bp, Homo sapiens
ccaggagcagctggcactgac

SEQ ID NO: 6724179 - DNA, 16 bp, Homo sapiens
ccaggagcagcttttg

SEQ ID NO: 6724180 - DNA, 15 bp, Homo sapiens
ccaggagcaggcacg

SEQ ID NO: 6724181 - DNA, 23 bp, Homo sapiens
ccaggagcatccacctccttctc

SEQ ID NO: 6724182 - DNA, 19 bp, Homo sapiens
ccaggagcattttgtgtct

SEQ ID NO: 6724183 - DNA, 11 bp, Homo sapiens
ccaggagccca

SEQ ID NO: 6724184 - DNA, 14 bp, Homo sapiens
ccaggagcccagag

SEQ ID NO: 6724185 - DNA, 12 bp, Homo sapiens
ccaggagcccca

SEQ ID NO: 6724186 - DNA, 13 bp, Homo sapiens
ccaggagccccag

SEQ ID NO: 6724187 - DNA, 16 bp, Homo sapiens
ccaggagccccagcca

SEQ ID NO: 6724188 - DNA, 20 bp, Homo sapiens
ccaggagccccagccagccc

SEQ ID NO: 6724189 - DNA, 21 bp, Homo sapiens
ccaggagccccagccagccct

SEQ ID NO: 6724190 - DNA, 19 bp, Homo sapiens
ccaggagccggacacttct

SEQ ID NO: 6724191 - DNA, 20 bp, Homo sapiens
ccaggagccgggcctcccac

SEQ ID NO: 6724192 - DNA, 16 bp, Homo sapiens
ccaggagcctgcccag

SEQ ID NO: 6724193 - DNA, 17 bp, Homo sapiens
ccaggagcctggaggga

SEQ ID NO: 6724194 - DNA, 21 bp, Homo sapiens
ccaggagctcaggtggggagt

SEQ ID NO: 6724195 - DNA, 17 bp, Homo sapiens
ccaggagctccagtgtc

SEQ ID NO: 6724196 - DNA, 18 bp, Homo sapiens
ccaggagctccagtgtcc

SEQ ID NO: 6724197 - DNA, 20 bp, Homo sapiens
ccaggagctccagtgtcctg

SEQ ID NO: 6724198 - DNA, 14 bp, Homo sapiens
ccaggagctcccct

SEQ ID NO: 6724199 - DNA, 19 bp, Homo sapiens
ccaggagctctctgctgag

SEQ ID NO: 6724200 - DNA, 20 bp, Homo sapiens
ccaggagctctctgctgagc

SEQ ID NO: 6724201 - DNA, 22 bp, Homo sapiens
ccaggagctctctgctgagcag

SEQ ID NO: 6724202 - DNA, 12 bp, Homo sapiens
ccaggagctctg

SEQ ID NO: 6724203 - DNA, 14 bp, Homo sapiens
ccaggagctctgcg

SEQ ID NO: 6724204 - DNA, 18 bp, Homo sapiens
ccaggagctctgcgccag

SEQ ID NO: 6724205 - DNA, 19 bp, Homo sapiens
ccaggagctctgcgccagg

SEQ ID NO: 6724206 - DNA, 21 bp, Homo sapiens
ccaggagctctgcgccaggca

SEQ ID NO: 6724207 - DNA, 17 bp, Homo sapiens
ccaggagctgagtcacc

SEQ ID NO: 6724208 - DNA, 19 bp, Homo sapiens
ccaggagctgagtcacctc

SEQ ID NO: 6724209 - DNA, 21 bp, Homo sapiens
ccaggagctgagtcacctcct

SEQ ID NO: 6724210 - DNA, 23 bp, Homo sapiens
ccaggagctgagtcacctcctcc

SEQ ID NO: 6724211 - DNA, 18 bp, Homo sapiens
ccaggagctgatggcagc

SEQ ID NO: 6724212 - DNA, 19 bp, Homo sapiens
ccaggagctgatggcagct

SEQ ID NO: 6724213 - DNA, 15 bp, Homo sapiens
ccaggagctgtcacc

SEQ ID NO: 6724214 - DNA, 21 bp, Homo sapiens
ccaggagcttcttcgttcctg

SEQ ID NO: 6724215 - DNA, 18 bp, Homo sapiens
ccaggaggacccagggct

SEQ ID NO: 6724216 - DNA, 20 bp, Homo sapiens
ccaggaggcagggaggcagc

SEQ ID NO: 6724217 - DNA, 21 bp, Homo sapiens
ccaggaggcagggaggcagcc

SEQ ID NO: 6724218 - DNA, 22 bp, Homo sapiens
ccaggaggcagggaggcagccg

SEQ ID NO: 6724219 - DNA, 12 bp, Homo sapiens
ccaggaggcagt

SEQ ID NO: 6724220 - DNA, 17 bp, Homo sapiens
ccaggaggcagtggaca

SEQ ID NO: 6724221 - DNA, 18 bp, Homo sapiens
ccaggaggccagccttga

SEQ ID NO: 6724222 - DNA, 21 bp, Homo sapiens
ccaggaggccggggggagcag

SEQ ID NO: 6724223 - DNA, 13 bp, Homo sapiens
ccaggaggcctgg

SEQ ID NO: 6724224 - DNA, 15 bp, Homo sapiens
ccaggaggcctggga

SEQ ID NO: 6724225 - DNA, 17 bp, Homo sapiens
ccaggaggcctgggccg

SEQ ID NO: 6724226 - DNA, 22 bp, Homo sapiens
ccaggaggcggaccttgtagtg

SEQ ID NO: 6724227 - DNA, 22 bp, Homo sapiens
ccaggaggctgaggcaggagaa

SEQ ID NO: 6724228 - DNA, 23 bp, Homo sapiens
ccaggaggctgaggcaggagaat

SEQ ID NO: 6724229 - DNA, 14 bp, Homo sapiens
ccaggaggctgcgg

SEQ ID NO: 6724230 - DNA, 12 bp, Homo sapiens
ccaggaggcttt

SEQ ID NO: 6724231 - DNA, 22 bp, Homo sapiens
ccaggagggacaaaggagcctg

SEQ ID NO: 6724232 - DNA, 24 bp, Homo sapiens
ccaggagggacaaaggagcctgtg

SEQ ID NO: 6724233 - DNA, 16 bp, Homo sapiens
ccaggagggagagcct

SEQ ID NO: 6724234 - DNA, 17 bp, Homo sapiens
ccaggagggagagcctc

SEQ ID NO: 6724235 - DNA, 19 bp, Homo sapiens
ccaggagggagagcctctg

SEQ ID NO: 6724236 - DNA, 15 bp, Homo sapiens
ccaggagggaggcag

SEQ ID NO: 6724237 - DNA, 19 bp, Homo sapiens
ccaggagggcacagcaggg

SEQ ID NO: 6724238 - DNA, 22 bp, Homo sapiens
ccaggagggcacagcaggggag

SEQ ID NO: 6724239 - DNA, 15 bp, Homo sapiens
ccaggagggcactgg

SEQ ID NO: 6724240 - DNA, 19 bp, Homo sapiens
ccaggagggcactggagct

SEQ ID NO: 6724241 - DNA, 20 bp, Homo sapiens
ccaggagggcactggagctg

SEQ ID NO: 6724242 - DNA, 18 bp, Homo sapiens
ccaggaggggcctctgaa

SEQ ID NO: 6724243 - DNA, 17 bp, Homo sapiens
ccaggaggggcctgggc

SEQ ID NO: 6724244 - DNA, 19 bp, Homo sapiens
ccaggaggggcctgggcag

SEQ ID NO: 6724245 - DNA, 14 bp, Homo sapiens
ccaggaggggcttc

SEQ ID NO: 6724246 - DNA, 16 bp, Homo sapiens
ccaggaggggtctgcc

SEQ ID NO: 6724247 - DNA, 18 bp, Homo sapiens
ccaggagggtaacagaag

SEQ ID NO: 6724248 - DNA, 21 bp, Homo sapiens
ccaggagggtaacagaagagg

SEQ ID NO: 6724249 - DNA, 16 bp, Homo sapiens
ccaggaggtcaagcct

SEQ ID NO: 6724250 - DNA, 21 bp, Homo sapiens
ccaggaggtcaagcctgcagc

SEQ ID NO: 6724251 - DNA, 17 bp, Homo sapiens
ccaggaggtcctcctct

SEQ ID NO: 6724252 - DNA, 16 bp, Homo sapiens
ccaggaggtgcagtgg

SEQ ID NO: 6724253 - DNA, 18 bp, Homo sapiens
ccaggaggtgcagtggag

SEQ ID NO: 6724254 - DNA, 16 bp, Homo sapiens
ccaggagtaagacaag

SEQ ID NO: 6724255 - DNA, 18 bp, Homo sapiens
ccaggagtaagcccaagc

SEQ ID NO: 6724256 - DNA, 13 bp, Homo sapiens
ccaggagtccagg

SEQ ID NO: 6724257 - DNA, 15 bp, Homo sapiens
ccaggagtccaggcc

SEQ ID NO: 6724258 - DNA, 16 bp, Homo sapiens
ccaggagtccaggccc

SEQ ID NO: 6724259 - DNA, 20 bp, Homo sapiens
ccaggagtccaggcccccag

SEQ ID NO: 6724260 - DNA, 21 bp, Homo sapiens
ccaggagtccaggcccccagc

SEQ ID NO: 6724261 - DNA, 20 bp, Homo sapiens
ccaggagtctgagaccagcc

SEQ ID NO: 6724262 - DNA, 17 bp, Homo sapiens
ccaggagtctgtgctct

SEQ ID NO: 6724263 - DNA, 21 bp, Homo sapiens
ccaggagtggggagagttgtg

SEQ ID NO: 6724264 - DNA, 20 bp, Homo sapiens
ccaggagttcgaggctgcag

SEQ ID NO: 6724265 - DNA, 14 bp, Homo sapiens
ccaggagttctgaa

SEQ ID NO: 6724266 - DNA, 16 bp, Homo sapiens
ccaggagttctgctca

SEQ ID NO: 6724267 - DNA, 17 bp, Homo sapiens
ccaggagttctgctcat

SEQ ID NO: 6724268 - DNA, 19 bp, Homo sapiens
ccaggagttgacgcatcct

SEQ ID NO: 6724269 - DNA, 23 bp, Homo sapiens
ccaggagtttaagaccagcctgg

SEQ ID NO: 6724270 - DNA, 22 bp, Homo sapiens
ccaggagtttgagacaagccct

SEQ ID NO: 6724271 - DNA, 17 bp, Homo sapiens
ccaggagtttgagacca

SEQ ID NO: 6724272 - DNA, 20 bp, Homo sapiens
ccaggagtttgaggctgcag

SEQ ID NO: 6724273 - DNA, 18 bp, Homo sapiens
ccaggagtttggccagaa

SEQ ID NO: 6724274 - DNA, 14 bp, Homo sapiens
ccaggataaggaga

SEQ ID NO: 6724275 - DNA, 15 bp, Homo sapiens
ccaggataaggagac

SEQ ID NO: 6724276 - DNA, 20 bp, Homo sapiens
ccaggataaggagactgagg

SEQ ID NO: 6724277 - DNA, 23 bp, Homo sapiens
ccaggataaggagactgaggctt

SEQ ID NO: 6724278 - DNA, 20 bp, Homo sapiens
ccaggataatttttaaacca

SEQ ID NO: 6724279 - DNA, 21 bp, Homo sapiens
ccaggatactggcacagaggt

SEQ ID NO: 6724280 - DNA, 23 bp, Homo sapiens
ccaggatagtgggcaccccactg

SEQ ID NO: 6724281 - DNA, 18 bp, Homo sapiens
ccaggatatttctgagag

SEQ ID NO: 6724282 - DNA, 19 bp, Homo sapiens
ccaggatcactctctgctg

SEQ ID NO: 6724283 - DNA, 19 bp, Homo sapiens
ccaggatcagattgcatgt

SEQ ID NO: 6724284 - DNA, 18 bp, Homo sapiens
ccaggatcccaagcctcc

SEQ ID NO: 6724285 - DNA, 22 bp, Homo sapiens
ccaggatcccaagcctcctgct

SEQ ID NO: 6724286 - DNA, 24 bp, Homo sapiens
ccaggatcccaagcgtcccgtccc

SEQ ID NO: 6724287 - DNA, 22 bp, Homo sapiens
ccaggatcccagagcttcccag

SEQ ID NO: 6724288 - DNA, 17 bp, Homo sapiens
ccaggatcccaggggcc

SEQ ID NO: 6724289 - DNA, 16 bp, Homo sapiens
ccaggatcccctgcta

SEQ ID NO: 6724290 - DNA, 18 bp, Homo sapiens
ccaggatcccctgctact

SEQ ID NO: 6724291 - DNA, 15 bp, Homo sapiens
ccaggatcctcctgg

SEQ ID NO: 6724292 - DNA, 19 bp, Homo sapiens
ccaggatcgctttgtactt

SEQ ID NO: 6724293 - DNA, 14 bp, Homo sapiens
ccaggatgaaggcg

SEQ ID NO: 6724294 - DNA, 17 bp, Homo sapiens
ccaggatgaaggcgtgc

SEQ ID NO: 6724295 - DNA, 21 bp, Homo sapiens
ccaggatgaaggggccagacc

SEQ ID NO: 6724296 - DNA, 22 bp, Homo sapiens
ccaggatgacacctccatttct

SEQ ID NO: 6724297 - DNA, 19 bp, Homo sapiens
ccaggatgactagatcctg

SEQ ID NO: 6724298 - DNA, 21 bp, Homo sapiens
ccaggatgataagttcctttc

SEQ ID NO: 6724299 - DNA, 17 bp, Homo sapiens
ccaggatgcatgcaggg

SEQ ID NO: 6724300 - DNA, 14 bp, Homo sapiens
ccaggatgcccacc

SEQ ID NO: 6724301 - DNA, 14 bp, Homo sapiens
ccaggatgcctgag

SEQ ID NO: 6724302 - DNA, 21 bp, Homo sapiens
ccaggatgctcccccagggaa

SEQ ID NO: 6724303 - DNA, 22 bp, Homo sapiens
ccaggatggaattcttcctcct

SEQ ID NO: 6724304 - DNA, 18 bp, Homo sapiens
ccaggatggactcttctc

SEQ ID NO: 6724305 - DNA, 18 bp, Homo sapiens
ccaggatggagcaagctc

SEQ ID NO: 6724306 - DNA, 15 bp, Homo sapiens
ccaggatggagggtc

SEQ ID NO: 6724307 - DNA, 20 bp, Homo sapiens
ccaggatggcccttcccact

SEQ ID NO: 6724308 - DNA, 11 bp, Homo sapiens
ccaggatggcg

SEQ ID NO: 6724309 - DNA, 17 bp, Homo sapiens
ccaggatggcgcaggaa

SEQ ID NO: 6724310 - DNA, 17 bp, Homo sapiens
ccaggatggggaggggc

SEQ ID NO: 6724311 - DNA, 16 bp, Homo sapiens
ccaggatggtcccagc

SEQ ID NO: 6724312 - DNA, 13 bp, Homo sapiens
ccaggatggtctc

SEQ ID NO: 6724313 - DNA, 22 bp, Homo sapiens
ccaggatggtctcgatctcctg

SEQ ID NO: 6724314 - DNA, 14 bp, Homo sapiens
ccaggatggtctgg

SEQ ID NO: 6724315 - DNA, 20 bp, Homo sapiens
ccaggatggtgcaggatggc

SEQ ID NO: 6724316 - DNA, 15 bp, Homo sapiens
ccaggattcccagag

SEQ ID NO: 6724317 - DNA, 18 bp, Homo sapiens
ccaggattcctcttttct

SEQ ID NO: 6724318 - DNA, 17 bp, Homo sapiens
ccaggattgaagagcat

SEQ ID NO: 6724319 - DNA, 18 bp, Homo sapiens
ccaggattgaagagcatt

SEQ ID NO: 6724320 - DNA, 18 bp, Homo sapiens
ccaggattggcctgtgtc

SEQ ID NO: 6724321 - DNA, 20 bp, Homo sapiens
ccaggattggggacctgatg

SEQ ID NO: 6724322 - DNA, 19 bp, Homo sapiens
ccaggattgtacgtgggag

SEQ ID NO: 6724323 - DNA, 13 bp, Homo sapiens
ccaggattgtcac

SEQ ID NO: 6724324 - DNA, 21 bp, Homo sapiens
ccaggattgtccacaaatgtc

SEQ ID NO: 6724325 - DNA, 20 bp, Homo sapiens
ccaggatttattttactttg

SEQ ID NO: 6724326 - DNA, 16 bp, Homo sapiens
ccaggatttattttga

SEQ ID NO: 6724327 - DNA, 13 bp, Homo sapiens
ccaggatttctaa

SEQ ID NO: 6724328 - DNA, 20 bp, Homo sapiens
ccaggattttaacaaaagca

SEQ ID NO: 6724329 - DNA, 23 bp, Homo sapiens
ccaggattttaacaaaagcaaga

SEQ ID NO: 6724330 - DNA, 15 bp, Homo sapiens
ccaggattttgtatt

SEQ ID NO: 6724331 - DNA, 16 bp, Homo sapiens
ccaggcaaagctggag

SEQ ID NO: 6724332 - DNA, 19 bp, Homo sapiens
ccaggcaaataaaattccc

SEQ ID NO: 6724333 - DNA, 15 bp, Homo sapiens
ccaggcaacctccca

SEQ ID NO: 6724334 - DNA, 16 bp, Homo sapiens
ccaggcaacctcccat

SEQ ID NO: 6724335 - DNA, 20 bp, Homo sapiens
ccaggcaacctcccatccca

SEQ ID NO: 6724336 - DNA, 13 bp, Homo sapiens
ccaggcaagaaaa

SEQ ID NO: 6724337 - DNA, 15 bp, Homo sapiens
ccaggcaagaaaagc

SEQ ID NO: 6724338 - DNA, 23 bp, Homo sapiens
ccaggcaagaaaagcgcagagaa

SEQ ID NO: 6724339 - DNA, 20 bp, Homo sapiens
ccaggcaagaaagcttcctt

SEQ ID NO: 6724340 - DNA, 21 bp, Homo sapiens
ccaggcaagaaagcttccttc

SEQ ID NO: 6724341 - DNA, 18 bp, Homo sapiens
ccaggcaagtgggaccag

SEQ ID NO: 6724342 - DNA, 20 bp, Homo sapiens
ccaggcaatagtgttgagga

SEQ ID NO: 6724343 - DNA, 19 bp, Homo sapiens
ccaggcaatggcctaaact

SEQ ID NO: 6724344 - DNA, 15 bp, Homo sapiens
ccaggcacacactgt

SEQ ID NO: 6724345 - DNA, 13 bp, Homo sapiens
ccaggcacaggat

SEQ ID NO: 6724346 - DNA, 12 bp, Homo sapiens
ccaggcacaggc

SEQ ID NO: 6724347 - DNA, 16 bp, Homo sapiens
ccaggcacaggcaggg

SEQ ID NO: 6724348 - DNA, 17 bp, Homo sapiens
ccaggcacaggcagggc

SEQ ID NO: 6724349 - DNA, 20 bp, Homo sapiens
ccaggcacaggcagggcagg

SEQ ID NO: 6724350 - DNA, 13 bp, Homo sapiens
ccaggcacagggc

SEQ ID NO: 6724351 - DNA, 16 bp, Homo sapiens
ccaggcacagggcccg

SEQ ID NO: 6724352 - DNA, 17 bp, Homo sapiens
ccaggcacagggcccgc

SEQ ID NO: 6724353 - DNA, 18 bp, Homo sapiens
ccaggcacagggcccgca

SEQ ID NO: 6724354 - DNA, 19 bp, Homo sapiens
ccaggcacagggcccgcag

SEQ ID NO: 6724355 - DNA, 19 bp, Homo sapiens
ccaggcacatggctggggg

SEQ ID NO: 6724356 - DNA, 14 bp, Homo sapiens
ccaggcaccacagc

SEQ ID NO: 6724357 - DNA, 15 bp, Homo sapiens
ccaggcaccacagcc

SEQ ID NO: 6724358 - DNA, 15 bp, Homo sapiens
ccaggcaccaccagg

SEQ ID NO: 6724359 - DNA, 15 bp, Homo sapiens
ccaggcaccaggcag

SEQ ID NO: 6724360 - DNA, 15 bp, Homo sapiens
ccaggcaccatctcc

SEQ ID NO: 6724361 - DNA, 17 bp, Homo sapiens
ccaggcaccatctgcca

SEQ ID NO: 6724362 - DNA, 18 bp, Homo sapiens
ccaggcaccatctgccaa

SEQ ID NO: 6724363 - DNA, 20 bp, Homo sapiens
ccaggcacccacatccccaa

SEQ ID NO: 6724364 - DNA, 16 bp, Homo sapiens
ccaggcacccatgtgg

SEQ ID NO: 6724365 - DNA, 16 bp, Homo sapiens
ccaggcaccccctgga

SEQ ID NO: 6724366 - DNA, 18 bp, Homo sapiens
ccaggcaccccctggaga

SEQ ID NO: 6724367 - DNA, 21 bp, Homo sapiens
ccaggcacccttctttcctct

SEQ ID NO: 6724368 - DNA, 15 bp, Homo sapiens
ccaggcaccgcctgc

SEQ ID NO: 6724369 - DNA, 15 bp, Homo sapiens
ccaggcacctggcct

SEQ ID NO: 6724370 - DNA, 16 bp, Homo sapiens
ccaggcacctggcctg

SEQ ID NO: 6724371 - DNA, 18 bp, Homo sapiens
ccaggcacctggcctgct

SEQ ID NO: 6724372 - DNA, 22 bp, Homo sapiens
ccaggcacctggcctgctggga

SEQ ID NO: 6724373 - DNA, 21 bp, Homo sapiens
ccaggcacgaacccacctgct

SEQ ID NO: 6724374 - DNA, 22 bp, Homo sapiens
ccaggcacgaacccacctgctg

SEQ ID NO: 6724375 - DNA, 16 bp, Homo sapiens
ccaggcacggtttgga

SEQ ID NO: 6724376 - DNA, 16 bp, Homo sapiens
ccaggcacgtcccgga

SEQ ID NO: 6724377 - DNA, 15 bp, Homo sapiens
ccaggcactgtctta

SEQ ID NO: 6724378 - DNA, 17 bp, Homo sapiens
ccaggcagaaaactggc

SEQ ID NO: 6724379 - DNA, 20 bp, Homo sapiens
ccaggcagaaatagttgtct

SEQ ID NO: 6724380 - DNA, 19 bp, Homo sapiens
ccaggcagaatggctgcac

SEQ ID NO: 6724381 - DNA, 18 bp, Homo sapiens
ccaggcagacaaccttgt

SEQ ID NO: 6724382 - DNA, 23 bp, Homo sapiens
ccaggcagagacaataaaacatt

SEQ ID NO: 6724383 - DNA, 23 bp, Homo sapiens
ccaggcagagagcgaccagcagg

SEQ ID NO: 6724384 - DNA, 13 bp, Homo sapiens
ccaggcagagctg

SEQ ID NO: 6724385 - DNA, 23 bp, Homo sapiens
ccaggcagagctgacgggaggcc

SEQ ID NO: 6724386 - DNA, 18 bp, Homo sapiens
ccaggcagagctgagggc

SEQ ID NO: 6724387 - DNA, 15 bp, Homo sapiens
ccaggcagagttctg

SEQ ID NO: 6724388 - DNA, 17 bp, Homo sapiens
ccaggcagatccaggac

SEQ ID NO: 6724389 - DNA, 18 bp, Homo sapiens
ccaggcagatccaggact

SEQ ID NO: 6724390 - DNA, 17 bp, Homo sapiens
ccaggcagatcctctgg

SEQ ID NO: 6724391 - DNA, 21 bp, Homo sapiens
ccaggcagatcctctggacac

SEQ ID NO: 6724392 - DNA, 16 bp, Homo sapiens
ccaggcagatgacctc

SEQ ID NO: 6724393 - DNA, 15 bp, Homo sapiens
ccaggcagcacccag

SEQ ID NO: 6724394 - DNA, 17 bp, Homo sapiens
ccaggcagccaccagtg

SEQ ID NO: 6724395 - DNA, 17 bp, Homo sapiens
ccaggcagcctctgggg

SEQ ID NO: 6724396 - DNA, 16 bp, Homo sapiens
ccaggcagcgccactg

SEQ ID NO: 6724397 - DNA, 15 bp, Homo sapiens
ccaggcagctccagc

SEQ ID NO: 6724398 - DNA, 17 bp, Homo sapiens
ccaggcagctccctcct

SEQ ID NO: 6724399 - DNA, 12 bp, Homo sapiens
ccaggcagctga

SEQ ID NO: 6724400 - DNA, 15 bp, Homo sapiens
ccaggcagctgagac

SEQ ID NO: 6724401 - DNA, 19 bp, Homo sapiens
ccaggcagctgagaccagg

SEQ ID NO: 6724402 - DNA, 20 bp, Homo sapiens
ccaggcagctgtcactgctg

SEQ ID NO: 6724403 - DNA, 16 bp, Homo sapiens
ccaggcaggacgagac

SEQ ID NO: 6724404 - DNA, 20 bp, Homo sapiens
ccaggcaggacgagactcct

SEQ ID NO: 6724405 - DNA, 19 bp, Homo sapiens
ccaggcaggcaaaggcccc

SEQ ID NO: 6724406 - DNA, 15 bp, Homo sapiens
ccaggcaggccaggc

SEQ ID NO: 6724407 - DNA, 18 bp, Homo sapiens
ccaggcaggccaggctgc

SEQ ID NO: 6724408 - DNA, 21 bp, Homo sapiens
ccaggcaggccaggctgcctc

SEQ ID NO: 6724409 - DNA, 21 bp, Homo sapiens
ccaggcaggctaaggcgtgga

SEQ ID NO: 6724410 - DNA, 12 bp, Homo sapiens
ccaggcagggag

SEQ ID NO: 6724411 - DNA, 18 bp, Homo sapiens
ccaggcagggagagagta

SEQ ID NO: 6724412 - DNA, 13 bp, Homo sapiens
ccaggcagggagg

SEQ ID NO: 6724413 - DNA, 15 bp, Homo sapiens
ccaggcagggaggga

SEQ ID NO: 6724414 - DNA, 18 bp, Homo sapiens
ccaggcagggagggaaac

SEQ ID NO: 6724415 - DNA, 23 bp, Homo sapiens
ccaggcagggagtgtctgcagtc

SEQ ID NO: 6724416 - DNA, 19 bp, Homo sapiens
ccaggcaggggtgggagag

SEQ ID NO: 6724417 - DNA, 14 bp, Homo sapiens
ccaggcaggtagcc

SEQ ID NO: 6724418 - DNA, 18 bp, Homo sapiens
ccaggcaggtagccaggg

SEQ ID NO: 6724419 - DNA, 14 bp, Homo sapiens
ccaggcaggtcttg

SEQ ID NO: 6724420 - DNA, 21 bp, Homo sapiens
ccaggcatatgtttccccatc

SEQ ID NO: 6724421 - DNA, 18 bp, Homo sapiens
ccaggcatcactgattcc

SEQ ID NO: 6724422 - DNA, 21 bp, Homo sapiens
ccaggcatccatcttggaaga

SEQ ID NO: 6724423 - DNA, 14 bp, Homo sapiens
ccaggcatcccatc

SEQ ID NO: 6724424 - DNA, 17 bp, Homo sapiens
ccaggcatcccatccct

SEQ ID NO: 6724425 - DNA, 17 bp, Homo sapiens
ccaggcatctccttggg

SEQ ID NO: 6724426 - DNA, 15 bp, Homo sapiens
ccaggcatgaccctg

SEQ ID NO: 6724427 - DNA, 17 bp, Homo sapiens
ccaggcatgaccctgga

SEQ ID NO: 6724428 - DNA, 19 bp, Homo sapiens
ccaggcatgaccctggagc

SEQ ID NO: 6724429 - DNA, 14 bp, Homo sapiens
ccaggcatgcagct

SEQ ID NO: 6724430 - DNA, 16 bp, Homo sapiens
ccaggcatgcagctgc

SEQ ID NO: 6724431 - DNA, 17 bp, Homo sapiens
ccaggcatgcagctgcc

SEQ ID NO: 6724432 - DNA, 20 bp, Homo sapiens
ccaggcatgcagctgcctgg

SEQ ID NO: 6724433 - DNA, 17 bp, Homo sapiens
ccaggcatgctggcctc

SEQ ID NO: 6724434 - DNA, 21 bp, Homo sapiens
ccaggcatggaaagatgggga

SEQ ID NO: 6724435 - DNA, 15 bp, Homo sapiens
ccaggcatggcccag

SEQ ID NO: 6724436 - DNA, 19 bp, Homo sapiens
ccaggcatggcccagcctg

SEQ ID NO: 6724437 - DNA, 23 bp, Homo sapiens
ccaggcatggcccagcctggagc

SEQ ID NO: 6724438 - DNA, 19 bp, Homo sapiens
ccaggcatggcgaggctga

SEQ ID NO: 6724439 - DNA, 19 bp, Homo sapiens
ccaggcatgggtcccttcc

SEQ ID NO: 6724440 - DNA, 17 bp, Homo sapiens
ccaggccaaagccccat

SEQ ID NO: 6724441 - DNA, 23 bp, Homo sapiens
ccaggccaaaggggacctggaag

SEQ ID NO: 6724442 - DNA, 17 bp, Homo sapiens
ccaggccaacagtagcc

SEQ ID NO: 6724443 - DNA, 14 bp, Homo sapiens
ccaggccaactgcc

SEQ ID NO: 6724444 - DNA, 23 bp, Homo sapiens
ccaggccaactgccccgcgtctt

SEQ ID NO: 6724445 - DNA, 12 bp, Homo sapiens
ccaggccaatcc

SEQ ID NO: 6724446 - DNA, 19 bp, Homo sapiens
ccaggccacatggggctgg

SEQ ID NO: 6724447 - DNA, 10 bp, Homo sapiens
ccaggccacc

SEQ ID NO: 6724448 - DNA, 15 bp, Homo sapiens
ccaggccaccaggat

SEQ ID NO: 6724449 - DNA, 12 bp, Homo sapiens
ccaggccaccca

SEQ ID NO: 6724450 - DNA, 17 bp, Homo sapiens
ccaggccacccactgtg

SEQ ID NO: 6724451 - DNA, 21 bp, Homo sapiens
ccaggccacctccccagcatt

SEQ ID NO: 6724452 - DNA, 18 bp, Homo sapiens
ccaggccactctcagaga

SEQ ID NO: 6724453 - DNA, 15 bp, Homo sapiens
ccaggccactgtggc

SEQ ID NO: 6724454 - DNA, 18 bp, Homo sapiens
ccaggccactgtggccag

SEQ ID NO: 6724455 - DNA, 20 bp, Homo sapiens
ccaggccactgtggccagag

SEQ ID NO: 6724456 - DNA, 22 bp, Homo sapiens
ccaggccactgtggccagagct

SEQ ID NO: 6724457 - DNA, 14 bp, Homo sapiens
ccaggccagaggga

SEQ ID NO: 6724458 - DNA, 11 bp, Homo sapiens
ccaggccagcc

SEQ ID NO: 6724459 - DNA, 13 bp, Homo sapiens
ccaggccagcccc

SEQ ID NO: 6724460 - DNA, 14 bp, Homo sapiens
ccaggccagccccc

SEQ ID NO: 6724461 - DNA, 20 bp, Homo sapiens
ccaggccagcccccccaccc

SEQ ID NO: 6724462 - DNA, 21 bp, Homo sapiens
ccaggccagcccccccaccca

SEQ ID NO: 6724463 - DNA, 22 bp, Homo sapiens
ccaggccagcccccccacccac

SEQ ID NO: 6724464 - DNA, 12 bp, Homo sapiens
ccaggccagcct

SEQ ID NO: 6724465 - DNA, 16 bp, Homo sapiens
ccaggccagcctccga

SEQ ID NO: 6724466 - DNA, 19 bp, Homo sapiens
ccaggccagcctccgagag

SEQ ID NO: 6724467 - DNA, 23 bp, Homo sapiens
ccaggccagcctccgagagggag

SEQ ID NO: 6724468 - DNA, 14 bp, Homo sapiens
ccaggccagcgagg

SEQ ID NO: 6724469 - DNA, 11 bp, Homo sapiens
ccaggccagct

SEQ ID NO: 6724470 - DNA, 15 bp, Homo sapiens
ccaggccagctcctt

SEQ ID NO: 6724471 - DNA, 17 bp, Homo sapiens
ccaggccaggactctgc

SEQ ID NO: 6724472 - DNA, 14 bp, Homo sapiens
ccaggccagggctc

SEQ ID NO: 6724473 - DNA, 17 bp, Homo sapiens
ccaggccagggctcctg

SEQ ID NO: 6724474 - DNA, 14 bp, Homo sapiens
ccaggccaggtagc

SEQ ID NO: 6724475 - DNA, 18 bp, Homo sapiens
ccaggccaggtgaggtcc

SEQ ID NO: 6724476 - DNA, 17 bp, Homo sapiens
ccaggccaggtgcccag

SEQ ID NO: 6724477 - DNA, 19 bp, Homo sapiens
ccaggccaggtgcccagga

SEQ ID NO: 6724478 - DNA, 21 bp, Homo sapiens
ccaggccagtcagacgccagg

SEQ ID NO: 6724479 - DNA, 19 bp, Homo sapiens
ccaggccatgtggcctgcc

SEQ ID NO: 6724480 - DNA, 14 bp, Homo sapiens
ccaggcccaaggct

SEQ ID NO: 6724481 - DNA, 17 bp, Homo sapiens
ccaggcccaaggctccc

SEQ ID NO: 6724482 - DNA, 18 bp, Homo sapiens
ccaggcccaaggctcccg

SEQ ID NO: 6724483 - DNA, 23 bp, Homo sapiens
ccaggcccaccatcaccaccgcc

SEQ ID NO: 6724484 - DNA, 18 bp, Homo sapiens
ccaggcccacgaggagca

SEQ ID NO: 6724485 - DNA, 21 bp, Homo sapiens
ccaggcccacgaggagcagca

SEQ ID NO: 6724486 - DNA, 14 bp, Homo sapiens
ccaggcccactcag

SEQ ID NO: 6724487 - DNA, 15 bp, Homo sapiens
ccaggcccactcagg

SEQ ID NO: 6724488 - DNA, 22 bp, Homo sapiens
ccaggcccactgtgcctcagag

SEQ ID NO: 6724489 - DNA, 18 bp, Homo sapiens
ccaggcccagccctcctt

SEQ ID NO: 6724490 - DNA, 21 bp, Homo sapiens
ccaggcccagccctccttcag

SEQ ID NO: 6724491 - DNA, 18 bp, Homo sapiens
ccaggcccagccgacccc

SEQ ID NO: 6724492 - DNA, 14 bp, Homo sapiens
ccaggcccagcctg

SEQ ID NO: 6724493 - DNA, 18 bp, Homo sapiens
ccaggcccagcctggccc

SEQ ID NO: 6724494 - DNA, 19 bp, Homo sapiens
ccaggcccagcctggcccc

SEQ ID NO: 6724495 - DNA, 13 bp, Homo sapiens
ccaggcccaggag

SEQ ID NO: 6724496 - DNA, 15 bp, Homo sapiens
ccaggcccaggcaga

SEQ ID NO: 6724497 - DNA, 16 bp, Homo sapiens
ccaggcccaggccagc

SEQ ID NO: 6724498 - DNA, 17 bp, Homo sapiens
ccaggcccaggccagcc

SEQ ID NO: 6724499 - DNA, 21 bp, Homo sapiens
ccaggcccagtccactgggga

SEQ ID NO: 6724500 - DNA, 14 bp, Homo sapiens
ccaggcccatctca

SEQ ID NO: 6724501 - DNA, 22 bp, Homo sapiens
ccaggcccatgccaaggcctcc

SEQ ID NO: 6724502 - DNA, 18 bp, Homo sapiens
ccaggccccaccccttcc

SEQ ID NO: 6724503 - DNA, 19 bp, Homo sapiens
ccaggccccaccccttccc

SEQ ID NO: 6724504 - DNA, 13 bp, Homo sapiens
ccaggccccagac

SEQ ID NO: 6724505 - DNA, 13 bp, Homo sapiens
ccaggccccagcc

SEQ ID NO: 6724506 - DNA, 15 bp, Homo sapiens
ccaggccccagcctc

SEQ ID NO: 6724507 - DNA, 16 bp, Homo sapiens
ccaggccccaggaagc

SEQ ID NO: 6724508 - DNA, 17 bp, Homo sapiens
ccaggccccaggaagcc

SEQ ID NO: 6724509 - DNA, 14 bp, Homo sapiens
ccaggccccaggcc

SEQ ID NO: 6724510 - DNA, 15 bp, Homo sapiens
ccaggccccaggctg

SEQ ID NO: 6724511 - DNA, 17 bp, Homo sapiens
ccaggccccaggctgga

SEQ ID NO: 6724512 - DNA, 21 bp, Homo sapiens
ccaggccccaggctggatgct

SEQ ID NO: 6724513 - DNA, 13 bp, Homo sapiens
ccaggccccaggt

SEQ ID NO: 6724514 - DNA, 20 bp, Homo sapiens
ccaggccccatgacctccag

SEQ ID NO: 6724515 - DNA, 16 bp, Homo sapiens
ccaggcccccctgtca

SEQ ID NO: 6724516 - DNA, 22 bp, Homo sapiens
ccaggcccccggctttcctccg

SEQ ID NO: 6724517 - DNA, 23 bp, Homo sapiens
ccaggcccccggctttcctccgg

SEQ ID NO: 6724518 - DNA, 20 bp, Homo sapiens
ccaggccccgaggacccaga

SEQ ID NO: 6724519 - DNA, 21 bp, Homo sapiens
ccaggccccgaggacccagac

SEQ ID NO: 6724520 - DNA, 23 bp, Homo sapiens
ccaggccccgaggacccagaccc

SEQ ID NO: 6724521 - DNA, 12 bp, Homo sapiens
ccaggcccctga

SEQ ID NO: 6724522 - DNA, 17 bp, Homo sapiens
ccaggcccctgaggact

SEQ ID NO: 6724523 - DNA, 21 bp, Homo sapiens
ccaggcccctgccaccctggg

SEQ ID NO: 6724524 - DNA, 21 bp, Homo sapiens
ccaggcccctggaggctgcct

SEQ ID NO: 6724525 - DNA, 13 bp, Homo sapiens
ccaggcccgccct

SEQ ID NO: 6724526 - DNA, 15 bp, Homo sapiens
ccaggcccgccctgc

SEQ ID NO: 6724527 - DNA, 18 bp, Homo sapiens
ccaggcccgcgggcacag

SEQ ID NO: 6724528 - DNA, 22 bp, Homo sapiens
ccaggcccgcgggcacagccag

SEQ ID NO: 6724529 - DNA, 23 bp, Homo sapiens
ccaggcccgcgggcacagccagc

SEQ ID NO: 6724530 - DNA, 18 bp, Homo sapiens
ccaggcccggtgaggcca

SEQ ID NO: 6724531 - DNA, 23 bp, Homo sapiens
ccaggcccgtctgtccatctgcc

SEQ ID NO: 6724532 - DNA, 17 bp, Homo sapiens
ccaggcccgtgggcgca

SEQ ID NO: 6724533 - DNA, 14 bp, Homo sapiens
ccaggccctactac

SEQ ID NO: 6724534 - DNA, 16 bp, Homo sapiens
ccaggccctagaccct

SEQ ID NO: 6724535 - DNA, 21 bp, Homo sapiens
ccaggccctccagtgggctga

SEQ ID NO: 6724536 - DNA, 14 bp, Homo sapiens
ccaggccctccatg

SEQ ID NO: 6724537 - DNA, 15 bp, Homo sapiens
ccaggccctcccacc

SEQ ID NO: 6724538 - DNA, 22 bp, Homo sapiens
ccaggccctcccaccaccccat

SEQ ID NO: 6724539 - DNA, 17 bp, Homo sapiens
ccaggccctccctgact

SEQ ID NO: 6724540 - DNA, 19 bp, Homo sapiens
ccaggccctcctctcccat

SEQ ID NO: 6724541 - DNA, 21 bp, Homo sapiens
ccaggccctcctgctggctga

SEQ ID NO: 6724542 - DNA, 12 bp, Homo sapiens
ccaggccctctc

SEQ ID NO: 6724543 - DNA, 13 bp, Homo sapiens
ccaggccctctgc

SEQ ID NO: 6724544 - DNA, 22 bp, Homo sapiens
ccaggccctctgcccactccct

SEQ ID NO: 6724545 - DNA, 23 bp, Homo sapiens
ccaggccctctgcccactccctg

SEQ ID NO: 6724546 - DNA, 14 bp, Homo sapiens
ccaggccctgagag

SEQ ID NO: 6724547 - DNA, 14 bp, Homo sapiens
ccaggccctgccag

SEQ ID NO: 6724548 - DNA, 21 bp, Homo sapiens
ccaggccctgccagagcaggg

SEQ ID NO: 6724549 - DNA, 23 bp, Homo sapiens
ccaggccctgccagagcaggggg

SEQ ID NO: 6724550 - DNA, 23 bp, Homo sapiens
ccaggccctgcttacctctgttt

SEQ ID NO: 6724551 - DNA, 21 bp, Homo sapiens
ccaggccctggagggcagaga

SEQ ID NO: 6724552 - DNA, 14 bp, Homo sapiens
ccaggccctgggtc

SEQ ID NO: 6724553 - DNA, 15 bp, Homo sapiens
ccaggccctgggtct

SEQ ID NO: 6724554 - DNA, 17 bp, Homo sapiens
ccaggcccttggctgca

SEQ ID NO: 6724555 - DNA, 14 bp, Homo sapiens
ccaggccctttggc

SEQ ID NO: 6724556 - DNA, 17 bp, Homo sapiens
ccaggccctttggcttc

SEQ ID NO: 6724557 - DNA, 20 bp, Homo sapiens
ccaggccctttggcttctga

SEQ ID NO: 6724558 - DNA, 17 bp, Homo sapiens
ccaggccgacaggaggc

SEQ ID NO: 6724559 - DNA, 14 bp, Homo sapiens
ccaggccgaggaag

SEQ ID NO: 6724560 - DNA, 19 bp, Homo sapiens
ccaggccgcagctcttgcc

SEQ ID NO: 6724561 - DNA, 21 bp, Homo sapiens
ccaggccgcagctcttgccct

SEQ ID NO: 6724562 - DNA, 19 bp, Homo sapiens
ccaggccgcatggcccctc

SEQ ID NO: 6724563 - DNA, 20 bp, Homo sapiens
ccaggccgcctgccataccg

SEQ ID NO: 6724564 - DNA, 17 bp, Homo sapiens
ccaggccgcgcccagca

SEQ ID NO: 6724565 - DNA, 18 bp, Homo sapiens
ccaggccgcgcccagcag

SEQ ID NO: 6724566 - DNA, 22 bp, Homo sapiens
ccaggccgcgcccagcagaggc

SEQ ID NO: 6724567 - DNA, 13 bp, Homo sapiens
ccaggccggagcc

SEQ ID NO: 6724568 - DNA, 14 bp, Homo sapiens
ccaggccggagccc

SEQ ID NO: 6724569 - DNA, 14 bp, Homo sapiens
ccaggccggccagc

SEQ ID NO: 6724570 - DNA, 17 bp, Homo sapiens
ccaggccggccagcctc

SEQ ID NO: 6724571 - DNA, 18 bp, Homo sapiens
ccaggccggccagcctca

SEQ ID NO: 6724572 - DNA, 14 bp, Homo sapiens
ccaggccggcccag

SEQ ID NO: 6724573 - DNA, 20 bp, Homo sapiens
ccaggccgggcttgggccct

SEQ ID NO: 6724574 - DNA, 23 bp, Homo sapiens
ccaggccgggcttgggccctgca

SEQ ID NO: 6724575 - DNA, 21 bp, Homo sapiens
ccaggccggggtggagcatgg

SEQ ID NO: 6724576 - DNA, 22 bp, Homo sapiens
ccaggccggtgtgggctgtgtc

SEQ ID NO: 6724577 - DNA, 15 bp, Homo sapiens
ccaggccgtcctccc

SEQ ID NO: 6724578 - DNA, 20 bp, Homo sapiens
ccaggccgtggactggctca

SEQ ID NO: 6724579 - DNA, 21 bp, Homo sapiens
ccaggccgtttgctttttcag

SEQ ID NO: 6724580 - DNA, 16 bp, Homo sapiens
ccaggcctactcctgt

SEQ ID NO: 6724581 - DNA, 18 bp, Homo sapiens
ccaggcctactcctgtct

SEQ ID NO: 6724582 - DNA, 21 bp, Homo sapiens
ccaggcctactcctgtcttct

SEQ ID NO: 6724583 - DNA, 23 bp, Homo sapiens
ccaggcctactcctgtcttctgc

SEQ ID NO: 6724584 - DNA, 21 bp, Homo sapiens
ccaggcctagtaaccaaggcc

SEQ ID NO: 6724585 - DNA, 24 bp, Homo sapiens
ccaggcctatgttgatccatccag

SEQ ID NO: 6724586 - DNA, 18 bp, Homo sapiens
ccaggcctcaccacctga

SEQ ID NO: 6724587 - DNA, 21 bp, Homo sapiens
ccaggcctcaccacctgacgc

SEQ ID NO: 6724588 - DNA, 13 bp, Homo sapiens
ccaggcctcactg

SEQ ID NO: 6724589 - DNA, 16 bp, Homo sapiens
ccaggcctcactggct

SEQ ID NO: 6724590 - DNA, 23 bp, Homo sapiens
ccaggcctcactggctcatgccc

SEQ ID NO: 6724591 - DNA, 14 bp, Homo sapiens
ccaggcctcagcct

SEQ ID NO: 6724592 - DNA, 17 bp, Homo sapiens
ccaggcctcagctcttg

SEQ ID NO: 6724593 - DNA, 21 bp, Homo sapiens
ccaggcctcagtctcccttct

SEQ ID NO: 6724594 - DNA, 13 bp, Homo sapiens
ccaggcctccaga

SEQ ID NO: 6724595 - DNA, 16 bp, Homo sapiens
ccaggcctccagcctc

SEQ ID NO: 6724596 - DNA, 14 bp, Homo sapiens
ccaggcctccagct

SEQ ID NO: 6724597 - DNA, 17 bp, Homo sapiens
ccaggcctccagctcag

SEQ ID NO: 6724598 - DNA, 17 bp, Homo sapiens
ccaggcctccccagcac

SEQ ID NO: 6724599 - DNA, 18 bp, Homo sapiens
ccaggcctccccagcacc

SEQ ID NO: 6724600 - DNA, 18 bp, Homo sapiens
ccaggcctcccgcatgct

SEQ ID NO: 6724601 - DNA, 12 bp, Homo sapiens
ccaggcctccct

SEQ ID NO: 6724602 - DNA, 18 bp, Homo sapiens
ccaggcctccctgcagac

SEQ ID NO: 6724603 - DNA, 20 bp, Homo sapiens
ccaggcctccctgcagactc

SEQ ID NO: 6724604 - DNA, 13 bp, Homo sapiens
ccaggcctcctac

SEQ ID NO: 6724605 - DNA, 22 bp, Homo sapiens
ccaggcctcgcacttgcagagg

SEQ ID NO: 6724606 - DNA, 20 bp, Homo sapiens
ccaggcctctactaggtctg

SEQ ID NO: 6724607 - DNA, 23 bp, Homo sapiens
ccaggcctctccctcctccagga

SEQ ID NO: 6724608 - DNA, 22 bp, Homo sapiens
ccaggcctctcggtgctccatc

SEQ ID NO: 6724609 - DNA, 17 bp, Homo sapiens
ccaggcctctctctgct

SEQ ID NO: 6724610 - DNA, 20 bp, Homo sapiens
ccaggcctctctctgctcca

SEQ ID NO: 6724611 - DNA, 13 bp, Homo sapiens
ccaggcctctgcc

SEQ ID NO: 6724612 - DNA, 14 bp, Homo sapiens
ccaggcctctgctg

SEQ ID NO: 6724613 - DNA, 17 bp, Homo sapiens
ccaggcctctgtgtcct

SEQ ID NO: 6724614 - DNA, 14 bp, Homo sapiens
ccaggcctgagctg

SEQ ID NO: 6724615 - DNA, 16 bp, Homo sapiens
ccaggcctgagctgct

SEQ ID NO: 6724616 - DNA, 15 bp, Homo sapiens
ccaggcctgaggctg

SEQ ID NO: 6724617 - DNA, 22 bp, Homo sapiens
ccaggcctgattcactggcctg

SEQ ID NO: 6724618 - DNA, 14 bp, Homo sapiens
ccaggcctgcagac

SEQ ID NO: 6724619 - DNA, 13 bp, Homo sapiens
ccaggcctgcatt

SEQ ID NO: 6724620 - DNA, 16 bp, Homo sapiens
ccaggcctgcctccca

SEQ ID NO: 6724621 - DNA, 13 bp, Homo sapiens
ccaggcctgctgg

SEQ ID NO: 6724622 - DNA, 16 bp, Homo sapiens
ccaggcctggagggca

SEQ ID NO: 6724623 - DNA, 17 bp, Homo sapiens
ccaggcctggccatgtg

SEQ ID NO: 6724624 - DNA, 23 bp, Homo sapiens
ccaggcctggcccggctgggccc

SEQ ID NO: 6724625 - DNA, 17 bp, Homo sapiens
ccaggcctggcctctgg

SEQ ID NO: 6724626 - DNA, 17 bp, Homo sapiens
ccaggcctgggccagag

SEQ ID NO: 6724627 - DNA, 14 bp, Homo sapiens
ccaggcctgggtca

SEQ ID NO: 6724628 - DNA, 23 bp, Homo sapiens
ccaggcctgggtgatctgctgct

SEQ ID NO: 6724629 - DNA, 14 bp, Homo sapiens
ccaggcctgtcaag

SEQ ID NO: 6724630 - DNA, 15 bp, Homo sapiens
ccaggcctgtccacc

SEQ ID NO: 6724631 - DNA, 16 bp, Homo sapiens
ccaggcctgtccaccc

SEQ ID NO: 6724632 - DNA, 18 bp, Homo sapiens
ccaggcctgtccaccctg

SEQ ID NO: 6724633 - DNA, 21 bp, Homo sapiens
ccaggcctgtccaccctgcca

SEQ ID NO: 6724634 - DNA, 19 bp, Homo sapiens
ccaggcctgtggctccctt

SEQ ID NO: 6724635 - DNA, 18 bp, Homo sapiens
ccaggccttatctccaag

SEQ ID NO: 6724636 - DNA, 21 bp, Homo sapiens
ccaggccttatctgaaaggcc

SEQ ID NO: 6724637 - DNA, 15 bp, Homo sapiens
ccaggccttcatcct

SEQ ID NO: 6724638 - DNA, 23 bp, Homo sapiens
ccaggccttcatcctcctcccca

SEQ ID NO: 6724639 - DNA, 18 bp, Homo sapiens
ccaggccttgctgactct

SEQ ID NO: 6724640 - DNA, 12 bp, Homo sapiens
ccaggccttgtc

SEQ ID NO: 6724641 - DNA, 14 bp, Homo sapiens
ccaggcctttggag

SEQ ID NO: 6724642 - DNA, 15 bp, Homo sapiens
ccaggcgagcctgac

SEQ ID NO: 6724643 - DNA, 16 bp, Homo sapiens
ccaggcgagcctgact

SEQ ID NO: 6724644 - DNA, 20 bp, Homo sapiens
ccaggcgagcctgactctgt

SEQ ID NO: 6724645 - DNA, 12 bp, Homo sapiens
ccaggcgaggcc

SEQ ID NO: 6724646 - DNA, 18 bp, Homo sapiens
ccaggcgaggcccttggc

SEQ ID NO: 6724647 - DNA, 18 bp, Homo sapiens
ccaggcgcaggggctcac

SEQ ID NO: 6724648 - DNA, 15 bp, Homo sapiens
ccaggcgcatgtctg

SEQ ID NO: 6724649 - DNA, 18 bp, Homo sapiens
ccaggcgcatgtctgcac

SEQ ID NO: 6724650 - DNA, 19 bp, Homo sapiens
ccaggcgcatgtctgcacc

SEQ ID NO: 6724651 - DNA, 22 bp, Homo sapiens
ccaggcgcatgtctgcacctcc

SEQ ID NO: 6724652 - DNA, 20 bp, Homo sapiens
ccaggcgcgccgacgcctgt

SEQ ID NO: 6724653 - DNA, 18 bp, Homo sapiens
ccaggcgcggtggctcac

SEQ ID NO: 6724654 - DNA, 12 bp, Homo sapiens
ccaggcgctgca

SEQ ID NO: 6724655 - DNA, 15 bp, Homo sapiens
ccaggcgctgcatac

SEQ ID NO: 6724656 - DNA, 15 bp, Homo sapiens
ccaggcggaggggct

SEQ ID NO: 6724657 - DNA, 22 bp, Homo sapiens
ccaggcggaggggcttggagca

SEQ ID NO: 6724658 - DNA, 14 bp, Homo sapiens
ccaggcggccctgg

SEQ ID NO: 6724659 - DNA, 17 bp, Homo sapiens
ccaggcggccctgggga

SEQ ID NO: 6724660 - DNA, 17 bp, Homo sapiens
ccaggcgggagatggac

SEQ ID NO: 6724661 - DNA, 21 bp, Homo sapiens
ccaggcgggagcggtggccct

SEQ ID NO: 6724662 - DNA, 23 bp, Homo sapiens
ccaggcgggcggcacgccaacag

SEQ ID NO: 6724663 - DNA, 16 bp, Homo sapiens
ccaggcgggctcaagg

SEQ ID NO: 6724664 - DNA, 20 bp, Homo sapiens
ccaggcgttggtgccacttc

SEQ ID NO: 6724665 - DNA, 20 bp, Homo sapiens
ccaggctaattagaggatgt

SEQ ID NO: 6724666 - DNA, 20 bp, Homo sapiens
ccaggctagagtgcaatggt

SEQ ID NO: 6724667 - DNA, 16 bp, Homo sapiens
ccaggctagagtgcag

SEQ ID NO: 6724668 - DNA, 21 bp, Homo sapiens
ccaggctatggttgccacccc

SEQ ID NO: 6724669 - DNA, 20 bp, Homo sapiens
ccaggctcactcacagagtc

SEQ ID NO: 6724670 - DNA, 12 bp, Homo sapiens
ccaggctcagga

SEQ ID NO: 6724671 - DNA, 14 bp, Homo sapiens
ccaggctcaggctg

SEQ ID NO: 6724672 - DNA, 16 bp, Homo sapiens
ccaggctcaggctgcc

SEQ ID NO: 6724673 - DNA, 17 bp, Homo sapiens
ccaggctcaggctgccc

SEQ ID NO: 6724674 - DNA, 15 bp, Homo sapiens
ccaggctccaatggg

SEQ ID NO: 6724675 - DNA, 12 bp, Homo sapiens
ccaggctccagg

SEQ ID NO: 6724676 - DNA, 14 bp, Homo sapiens
ccaggctccatggg

SEQ ID NO: 6724677 - DNA, 16 bp, Homo sapiens
ccaggctccatgggga

SEQ ID NO: 6724678 - DNA, 18 bp, Homo sapiens
ccaggctcccctgcccgc

SEQ ID NO: 6724679 - DNA, 16 bp, Homo sapiens
ccaggctcccctggtc

SEQ ID NO: 6724680 - DNA, 17 bp, Homo sapiens
ccaggctcccctggtct

SEQ ID NO: 6724681 - DNA, 23 bp, Homo sapiens
ccaggctcccgaccccatccacc

SEQ ID NO: 6724682 - DNA, 12 bp, Homo sapiens
ccaggctccctc

SEQ ID NO: 6724683 - DNA, 20 bp, Homo sapiens
ccaggctccctccctcccag

SEQ ID NO: 6724684 - DNA, 13 bp, Homo sapiens
ccaggctccctga

SEQ ID NO: 6724685 - DNA, 23 bp, Homo sapiens
ccaggctccctgaccaccctgcc

SEQ ID NO: 6724686 - DNA, 20 bp, Homo sapiens
ccaggctcctacctgtctgc

SEQ ID NO: 6724687 - DNA, 15 bp, Homo sapiens
ccaggctccttcctg

SEQ ID NO: 6724688 - DNA, 21 bp, Homo sapiens
ccaggctcctttagcgcccag

SEQ ID NO: 6724689 - DNA, 16 bp, Homo sapiens
ccaggctctccctctc

SEQ ID NO: 6724690 - DNA, 23 bp, Homo sapiens
ccaggctctccctctctgcacct

SEQ ID NO: 6724691 - DNA, 15 bp, Homo sapiens
ccaggctctccgggc

SEQ ID NO: 6724692 - DNA, 13 bp, Homo sapiens
ccaggctctgcct

SEQ ID NO: 6724693 - DNA, 15 bp, Homo sapiens
ccaggctctgcctgg

SEQ ID NO: 6724694 - DNA, 16 bp, Homo sapiens
ccaggctctgctgact

SEQ ID NO: 6724695 - DNA, 17 bp, Homo sapiens
ccaggctctgctgactt

SEQ ID NO: 6724696 - DNA, 12 bp, Homo sapiens
ccaggctctggg

SEQ ID NO: 6724697 - DNA, 14 bp, Homo sapiens
ccaggctctgggaa

SEQ ID NO: 6724698 - DNA, 16 bp, Homo sapiens
ccaggctctgggaagg

SEQ ID NO: 6724699 - DNA, 14 bp, Homo sapiens
ccaggctctgtgct

SEQ ID NO: 6724700 - DNA, 22 bp, Homo sapiens
ccaggctctttggggtcagcca

SEQ ID NO: 6724701 - DNA, 13 bp, Homo sapiens
ccaggctgaagca

SEQ ID NO: 6724702 - DNA, 23 bp, Homo sapiens
ccaggctgaccacagcacagcca

SEQ ID NO: 6724703 - DNA, 15 bp, Homo sapiens
ccaggctgagagcca

SEQ ID NO: 6724704 - DNA, 17 bp, Homo sapiens
ccaggctgagagccaga

SEQ ID NO: 6724705 - DNA, 22 bp, Homo sapiens
ccaggctgagagccagatgcct

SEQ ID NO: 6724706 - DNA, 12 bp, Homo sapiens
ccaggctgagcc

SEQ ID NO: 6724707 - DNA, 13 bp, Homo sapiens
ccaggctgagcca

SEQ ID NO: 6724708 - DNA, 16 bp, Homo sapiens
ccaggctgagccatga

SEQ ID NO: 6724709 - DNA, 17 bp, Homo sapiens
ccaggctgagccatgag

SEQ ID NO: 6724710 - DNA, 14 bp, Homo sapiens
ccaggctgagccga

SEQ ID NO: 6724711 - DNA, 17 bp, Homo sapiens
ccaggctgagcctcagt

SEQ ID NO: 6724712 - DNA, 22 bp, Homo sapiens
ccaggctgagcctcagtctccc

SEQ ID NO: 6724713 - DNA, 15 bp, Homo sapiens
ccaggctgcactgca

SEQ ID NO: 6724714 - DNA, 18 bp, Homo sapiens
ccaggctgcactgcagtg

SEQ ID NO: 6724715 - DNA, 15 bp, Homo sapiens
ccaggctgcagcctc

SEQ ID NO: 6724716 - DNA, 18 bp, Homo sapiens
ccaggctgcagcctccac

SEQ ID NO: 6724717 - DNA, 13 bp, Homo sapiens
ccaggctgcaggg

SEQ ID NO: 6724718 - DNA, 18 bp, Homo sapiens
ccaggctgcagggacagt

SEQ ID NO: 6724719 - DNA, 13 bp, Homo sapiens
ccaggctgcaggt

SEQ ID NO: 6724720 - DNA, 17 bp, Homo sapiens
ccaggctgcatagaagg

SEQ ID NO: 6724721 - DNA, 13 bp, Homo sapiens
ccaggctgccaag

SEQ ID NO: 6724722 - DNA, 22 bp, Homo sapiens
ccaggctgccaggcaccatctg

SEQ ID NO: 6724723 - DNA, 11 bp, Homo sapiens
ccaggctgccc

SEQ ID NO: 6724724 - DNA, 18 bp, Homo sapiens
ccaggctgcccactctgg

SEQ ID NO: 6724725 - DNA, 19 bp, Homo sapiens
ccaggctgcccactctggg

SEQ ID NO: 6724726 - DNA, 15 bp, Homo sapiens
ccaggctgcccagag

SEQ ID NO: 6724727 - DNA, 17 bp, Homo sapiens
ccaggctgcccagagct

SEQ ID NO: 6724728 - DNA, 20 bp, Homo sapiens
ccaggctgcccccaacactc

SEQ ID NO: 6724729 - DNA, 17 bp, Homo sapiens
ccaggctgccggctccc

SEQ ID NO: 6724730 - DNA, 18 bp, Homo sapiens
ccaggctgccgtggggcc

SEQ ID NO: 6724731 - DNA, 13 bp, Homo sapiens
ccaggctgcctcc

SEQ ID NO: 6724732 - DNA, 14 bp, Homo sapiens
ccaggctgcctcct

SEQ ID NO: 6724733 - DNA, 20 bp, Homo sapiens
ccaggctgcctcctgccctt

SEQ ID NO: 6724734 - DNA, 21 bp, Homo sapiens
ccaggctgcctcctgccctta

SEQ ID NO: 6724735 - DNA, 13 bp, Homo sapiens
ccaggctgcctcg

SEQ ID NO: 6724736 - DNA, 17 bp, Homo sapiens
ccaggctgcgcctgccc

SEQ ID NO: 6724737 - DNA, 19 bp, Homo sapiens
ccaggctgcggtgggcagc

SEQ ID NO: 6724738 - DNA, 21 bp, Homo sapiens
ccaggctgctaacctggaaag

SEQ ID NO: 6724739 - DNA, 21 bp, Homo sapiens
ccaggctgctgcatggcactg

SEQ ID NO: 6724740 - DNA, 14 bp, Homo sapiens
ccaggctgctggac

SEQ ID NO: 6724741 - DNA, 11 bp, Homo sapiens
ccaggctggac

SEQ ID NO: 6724742 - DNA, 23 bp, Homo sapiens
ccaggctggacaccctctgccga

SEQ ID NO: 6724743 - DNA, 13 bp, Homo sapiens
ccaggctggacat

SEQ ID NO: 6724744 - DNA, 15 bp, Homo sapiens
ccaggctggagctgg

SEQ ID NO: 6724745 - DNA, 16 bp, Homo sapiens
ccaggctggagtgcaa

SEQ ID NO: 6724746 - DNA, 19 bp, Homo sapiens
ccaggctggagtgcaatgg

SEQ ID NO: 6724747 - DNA, 20 bp, Homo sapiens
ccaggctggagtgcaatggt

SEQ ID NO: 6724748 - DNA, 21 bp, Homo sapiens
ccaggctggagtgcagtggct

SEQ ID NO: 6724749 - DNA, 18 bp, Homo sapiens
ccaggctggatgctgggt

SEQ ID NO: 6724750 - DNA, 13 bp, Homo sapiens
ccaggctggccag

SEQ ID NO: 6724751 - DNA, 23 bp, Homo sapiens
ccaggctggccagccccacagcc

SEQ ID NO: 6724752 - DNA, 16 bp, Homo sapiens
ccaggctggccagtgc

SEQ ID NO: 6724753 - DNA, 17 bp, Homo sapiens
ccaggctggccagtgct

SEQ ID NO: 6724754 - DNA, 21 bp, Homo sapiens
ccaggctggcccccacccacc

SEQ ID NO: 6724755 - DNA, 14 bp, Homo sapiens
ccaggctggcgcag

SEQ ID NO: 6724756 - DNA, 17 bp, Homo sapiens
ccaggctggcgcagcca

SEQ ID NO: 6724757 - DNA, 18 bp, Homo sapiens
ccaggctggcgcagccaa

SEQ ID NO: 6724758 - DNA, 21 bp, Homo sapiens
ccaggctggcgcagccaaggc

SEQ ID NO: 6724759 - DNA, 22 bp, Homo sapiens
ccaggctggcgcagccaaggcc

SEQ ID NO: 6724760 - DNA, 14 bp, Homo sapiens
ccaggctgggagag

SEQ ID NO: 6724761 - DNA, 15 bp, Homo sapiens
ccaggctgggagagc

SEQ ID NO: 6724762 - DNA, 21 bp, Homo sapiens
ccaggctgggagagccttcca

SEQ ID NO: 6724763 - DNA, 13 bp, Homo sapiens
ccaggctgggagg

SEQ ID NO: 6724764 - DNA, 18 bp, Homo sapiens
ccaggctgggcaaggagg

SEQ ID NO: 6724765 - DNA, 15 bp, Homo sapiens
ccaggctgggctcag

SEQ ID NO: 6724766 - DNA, 20 bp, Homo sapiens
ccaggctgggctctgcctgt

SEQ ID NO: 6724767 - DNA, 23 bp, Homo sapiens
ccaggctgggctctgcctgtctg

SEQ ID NO: 6724768 - DNA, 13 bp, Homo sapiens
ccaggctgggctg

SEQ ID NO: 6724769 - DNA, 17 bp, Homo sapiens
ccaggctgggctgagcc

SEQ ID NO: 6724770 - DNA, 12 bp, Homo sapiens
ccaggctggggc

SEQ ID NO: 6724771 - DNA, 19 bp, Homo sapiens
ccaggctggggcctggcct

SEQ ID NO: 6724772 - DNA, 12 bp, Homo sapiens
ccaggctgggtc

SEQ ID NO: 6724773 - DNA, 16 bp, Homo sapiens
ccaggctgggtgacag

SEQ ID NO: 6724774 - DNA, 17 bp, Homo sapiens
ccaggctgggtgacaga

SEQ ID NO: 6724775 - DNA, 17 bp, Homo sapiens
ccaggctggtctaaaac

SEQ ID NO: 6724776 - DNA, 20 bp, Homo sapiens
ccaggctggtctaaaactcc

SEQ ID NO: 6724777 - DNA, 14 bp, Homo sapiens
ccaggctggtctca

SEQ ID NO: 6724778 - DNA, 19 bp, Homo sapiens
ccaggctggtctcaaactc

SEQ ID NO: 6724779 - DNA, 23 bp, Homo sapiens
ccaggctggtctcaaactcctga

SEQ ID NO: 6724780 - DNA, 20 bp, Homo sapiens
ccaggctggtctcaaacttc

SEQ ID NO: 6724781 - DNA, 21 bp, Homo sapiens
ccaggctggtcttgaattcct

SEQ ID NO: 6724782 - DNA, 21 bp, Homo sapiens
ccaggctgtaaatgagggcag

SEQ ID NO: 6724783 - DNA, 22 bp, Homo sapiens
ccaggctgtaagcattctgagc

SEQ ID NO: 6724784 - DNA, 24 bp, Homo sapiens
ccaggctgtatcccatgagcctca

SEQ ID NO: 6724785 - DNA, 13 bp, Homo sapiens
ccaggctgtctag

SEQ ID NO: 6724786 - DNA, 21 bp, Homo sapiens
ccaggctgtgggcctcaagga

SEQ ID NO: 6724787 - DNA, 20 bp, Homo sapiens
ccaggctgtgggtagatgtg

SEQ ID NO: 6724788 - DNA, 15 bp, Homo sapiens
ccaggctgttctcag

SEQ ID NO: 6724789 - DNA, 16 bp, Homo sapiens
ccaggcttactgagct

SEQ ID NO: 6724790 - DNA, 17 bp, Homo sapiens
ccaggcttagtcactga

SEQ ID NO: 6724791 - DNA, 17 bp, Homo sapiens
ccaggcttcacagtctg

SEQ ID NO: 6724792 - DNA, 20 bp, Homo sapiens
ccaggcttccacacttctgg

SEQ ID NO: 6724793 - DNA, 18 bp, Homo sapiens
ccaggcttcctgccctag

SEQ ID NO: 6724794 - DNA, 23 bp, Homo sapiens
ccaggcttcctgggtcctgcctg

SEQ ID NO: 6724795 - DNA, 19 bp, Homo sapiens
ccaggcttctcccggacct

SEQ ID NO: 6724796 - DNA, 15 bp, Homo sapiens
ccaggcttctgctgg

SEQ ID NO: 6724797 - DNA, 13 bp, Homo sapiens
ccaggcttgcctg

SEQ ID NO: 6724798 - DNA, 16 bp, Homo sapiens
ccaggcttgcctgggc

SEQ ID NO: 6724799 - DNA, 18 bp, Homo sapiens
ccaggcttgcctgggctg

SEQ ID NO: 6724800 - DNA, 21 bp, Homo sapiens
ccaggcttgcctgggctgggc

SEQ ID NO: 6724801 - DNA, 23 bp, Homo sapiens
ccaggcttgcctgggctgggcag

SEQ ID NO: 6724802 - DNA, 22 bp, Homo sapiens
ccaggcttggatggaacatgcc

SEQ ID NO: 6724803 - DNA, 14 bp, Homo sapiens
ccaggcttggcctt

SEQ ID NO: 6724804 - DNA, 19 bp, Homo sapiens
ccaggctttctagaaagaa

SEQ ID NO: 6724805 - DNA, 14 bp, Homo sapiens
ccagggaaaaagac

SEQ ID NO: 6724806 - DNA, 18 bp, Homo sapiens
ccagggaaaatgacttta

SEQ ID NO: 6724807 - DNA, 18 bp, Homo sapiens
ccagggaaacagcctctc

SEQ ID NO: 6724808 - DNA, 19 bp, Homo sapiens
ccagggaaacagcctctct

SEQ ID NO: 6724809 - DNA, 20 bp, Homo sapiens
ccagggaaacagcctctctc

SEQ ID NO: 6724810 - DNA, 17 bp, Homo sapiens
ccagggaaatgcctcga

SEQ ID NO: 6724811 - DNA, 14 bp, Homo sapiens
ccagggaaccagag

SEQ ID NO: 6724812 - DNA, 21 bp, Homo sapiens
ccagggaactggcctgctgcg

SEQ ID NO: 6724813 - DNA, 13 bp, Homo sapiens
ccagggaagacag

SEQ ID NO: 6724814 - DNA, 15 bp, Homo sapiens
ccagggaagacagag

SEQ ID NO: 6724815 - DNA, 16 bp, Homo sapiens
ccagggaagacagagc

SEQ ID NO: 6724816 - DNA, 20 bp, Homo sapiens
ccagggaagacagagcaggc

SEQ ID NO: 6724817 - DNA, 17 bp, Homo sapiens
ccagggaagagaaagtg

SEQ ID NO: 6724818 - DNA, 14 bp, Homo sapiens
ccagggaagcagca

SEQ ID NO: 6724819 - DNA, 16 bp, Homo sapiens
ccagggaagcagcagc

SEQ ID NO: 6724820 - DNA, 18 bp, Homo sapiens
ccagggaagcctgggtgt

SEQ ID NO: 6724821 - DNA, 10 bp, Homo sapiens
ccagggaagg

SEQ ID NO: 6724822 - DNA, 13 bp, Homo sapiens
ccagggaaggaaa

SEQ ID NO: 6724823 - DNA, 19 bp, Homo sapiens
ccagggaaggtggccacag

SEQ ID NO: 6724824 - DNA, 17 bp, Homo sapiens
ccagggaagtgctctga

SEQ ID NO: 6724825 - DNA, 16 bp, Homo sapiens
ccagggaatcagggag

SEQ ID NO: 6724826 - DNA, 17 bp, Homo sapiens
ccagggaatcagggagc

SEQ ID NO: 6724827 - DNA, 21 bp, Homo sapiens
ccagggaatcagggagcactg

SEQ ID NO: 6724828 - DNA, 17 bp, Homo sapiens
ccagggaatccaagcct

SEQ ID NO: 6724829 - DNA, 18 bp, Homo sapiens
ccagggaatccaagcctc

SEQ ID NO: 6724830 - DNA, 21 bp, Homo sapiens
ccagggaatccgcctgcagag

SEQ ID NO: 6724831 - DNA, 23 bp, Homo sapiens
ccagggaattcttacagccaagt

SEQ ID NO: 6724832 - DNA, 13 bp, Homo sapiens
ccagggacaagct

SEQ ID NO: 6724833 - DNA, 14 bp, Homo sapiens
ccagggacaccagc

SEQ ID NO: 6724834 - DNA, 16 bp, Homo sapiens
ccagggacaccagcca

SEQ ID NO: 6724835 - DNA, 17 bp, Homo sapiens
ccagggacaccagccag

SEQ ID NO: 6724836 - DNA, 20 bp, Homo sapiens
ccagggacaccagccaggct

SEQ ID NO: 6724837 - DNA, 20 bp, Homo sapiens
ccagggacacccacacaggt

SEQ ID NO: 6724838 - DNA, 20 bp, Homo sapiens
ccagggacagaggccaagga

SEQ ID NO: 6724839 - DNA, 22 bp, Homo sapiens
ccagggacagaggccccagcct

SEQ ID NO: 6724840 - DNA, 22 bp, Homo sapiens
ccagggacagagggggtggcct

SEQ ID NO: 6724841 - DNA, 16 bp, Homo sapiens
ccagggacagggccct

SEQ ID NO: 6724842 - DNA, 22 bp, Homo sapiens
ccagggacatgtatgcttccag

SEQ ID NO: 6724843 - DNA, 23 bp, Homo sapiens
ccagggacccaggtgtgcctgtg

SEQ ID NO: 6724844 - DNA, 18 bp, Homo sapiens
ccagggacccccgaggcc

SEQ ID NO: 6724845 - DNA, 19 bp, Homo sapiens
ccagggacccccgaggccc

SEQ ID NO: 6724846 - DNA, 22 bp, Homo sapiens
ccagggacccccgaggcccccc

SEQ ID NO: 6724847 - DNA, 21 bp, Homo sapiens
ccagggaccctggagtatttg

SEQ ID NO: 6724848 - DNA, 16 bp, Homo sapiens
ccagggacccttgcct

SEQ ID NO: 6724849 - DNA, 22 bp, Homo sapiens
ccagggacccttgcctgcctcc

SEQ ID NO: 6724850 - DNA, 22 bp, Homo sapiens
ccagggactcggcccagggccg

SEQ ID NO: 6724851 - DNA, 13 bp, Homo sapiens
ccagggagaccga

SEQ ID NO: 6724852 - DNA, 19 bp, Homo sapiens
ccagggagactttctgaag

SEQ ID NO: 6724853 - DNA, 14 bp, Homo sapiens
ccagggagagccca

SEQ ID NO: 6724854 - DNA, 17 bp, Homo sapiens
ccagggagagcccagga

SEQ ID NO: 6724855 - DNA, 21 bp, Homo sapiens
ccagggagagcccaggagctc

SEQ ID NO: 6724856 - DNA, 14 bp, Homo sapiens
ccagggagaggctg

SEQ ID NO: 6724857 - DNA, 16 bp, Homo sapiens
ccagggagaggctgtg

SEQ ID NO: 6724858 - DNA, 17 bp, Homo sapiens
ccagggagaggctgtgt

SEQ ID NO: 6724859 - DNA, 12 bp, Homo sapiens
ccagggagatgt

SEQ ID NO: 6724860 - DNA, 13 bp, Homo sapiens
ccagggagcccgg

SEQ ID NO: 6724861 - DNA, 12 bp, Homo sapiens
ccagggagcctt

SEQ ID NO: 6724862 - DNA, 22 bp, Homo sapiens
ccagggagcctttggttctggc

SEQ ID NO: 6724863 - DNA, 18 bp, Homo sapiens
ccagggagcggaaagcag

SEQ ID NO: 6724864 - DNA, 17 bp, Homo sapiens
ccagggagctctgggga

SEQ ID NO: 6724865 - DNA, 18 bp, Homo sapiens
ccagggagctctggggac

SEQ ID NO: 6724866 - DNA, 16 bp, Homo sapiens
ccagggagcttcctgg

SEQ ID NO: 6724867 - DNA, 17 bp, Homo sapiens
ccagggagcttcctggc

SEQ ID NO: 6724868 - DNA, 17 bp, Homo sapiens
ccagggaggaagccgca

SEQ ID NO: 6724869 - DNA, 15 bp, Homo sapiens
ccagggaggagagga

SEQ ID NO: 6724870 - DNA, 19 bp, Homo sapiens
ccagggaggcagagcggga

SEQ ID NO: 6724871 - DNA, 17 bp, Homo sapiens
ccagggaggcagcctag

SEQ ID NO: 6724872 - DNA, 18 bp, Homo sapiens
ccagggaggcagcgtggg

SEQ ID NO: 6724873 - DNA, 19 bp, Homo sapiens
ccagggaggcagcgtgggc

SEQ ID NO: 6724874 - DNA, 20 bp, Homo sapiens
ccagggaggcgatgccagcc

SEQ ID NO: 6724875 - DNA, 22 bp, Homo sapiens
ccagggaggcgatgccagcctt

SEQ ID NO: 6724876 - DNA, 19 bp, Homo sapiens
ccagggaggcgcagggaca

SEQ ID NO: 6724877 - DNA, 20 bp, Homo sapiens
ccagggagggtatttattgg

SEQ ID NO: 6724878 - DNA, 19 bp, Homo sapiens
ccagggagggtgagctggt

SEQ ID NO: 6724879 - DNA, 19 bp, Homo sapiens
ccagggaggtggaaggacc

SEQ ID NO: 6724880 - DNA, 20 bp, Homo sapiens
ccagggaggtggaaggaccc

SEQ ID NO: 6724881 - DNA, 22 bp, Homo sapiens
ccagggaggtggaaggaccctg

SEQ ID NO: 6724882 - DNA, 15 bp, Homo sapiens
ccagggaggtggcag

SEQ ID NO: 6724883 - DNA, 16 bp, Homo sapiens
ccagggagtccagggt

SEQ ID NO: 6724884 - DNA, 16 bp, Homo sapiens
ccagggagtcccctcc

SEQ ID NO: 6724885 - DNA, 19 bp, Homo sapiens
ccagggagtgagcagctac

SEQ ID NO: 6724886 - DNA, 16 bp, Homo sapiens
ccagggatcacagacc

SEQ ID NO: 6724887 - DNA, 21 bp, Homo sapiens
ccagggatcacagaccacagg

SEQ ID NO: 6724888 - DNA, 22 bp, Homo sapiens
ccagggatcacagaccacagga

SEQ ID NO: 6724889 - DNA, 20 bp, Homo sapiens
ccagggatgaagaaagactc

SEQ ID NO: 6724890 - DNA, 15 bp, Homo sapiens
ccagggatgagccaa

SEQ ID NO: 6724891 - DNA, 18 bp, Homo sapiens
ccagggatgctgggctgg

SEQ ID NO: 6724892 - DNA, 21 bp, Homo sapiens
ccagggatgctgggctgggcc

SEQ ID NO: 6724893 - DNA, 19 bp, Homo sapiens
ccagggatggcagtggctg

SEQ ID NO: 6724894 - DNA, 22 bp, Homo sapiens
ccagggatggcagtggctgtga

SEQ ID NO: 6724895 - DNA, 14 bp, Homo sapiens
ccagggatgggcag

SEQ ID NO: 6724896 - DNA, 15 bp, Homo sapiens
ccagggatgggcagc

SEQ ID NO: 6724897 - DNA, 21 bp, Homo sapiens
ccagggatggggccacagcca

SEQ ID NO: 6724898 - DNA, 22 bp, Homo sapiens
ccagggatggggccacagccag

SEQ ID NO: 6724899 - DNA, 17 bp, Homo sapiens
ccagggatgggggatgg

SEQ ID NO: 6724900 - DNA, 21 bp, Homo sapiens
ccagggatgggggatgggcca

SEQ ID NO: 6724901 - DNA, 17 bp, Homo sapiens
ccagggatttgcctcac

SEQ ID NO: 6724902 - DNA, 21 bp, Homo sapiens
ccagggcaagggttaaggcct

SEQ ID NO: 6724903 - DNA, 23 bp, Homo sapiens
ccagggcaagggttaaggcctga

SEQ ID NO: 6724904 - DNA, 20 bp, Homo sapiens
ccagggcaatgccatcagcc

SEQ ID NO: 6724905 - DNA, 23 bp, Homo sapiens
ccagggcaatgccatcagcccct

SEQ ID NO: 6724906 - DNA, 15 bp, Homo sapiens
ccagggcacagctgg

SEQ ID NO: 6724907 - DNA, 20 bp, Homo sapiens
ccagggcacaggagctacct

SEQ ID NO: 6724908 - DNA, 21 bp, Homo sapiens
ccagggcaccatccagctccc

SEQ ID NO: 6724909 - DNA, 15 bp, Homo sapiens
ccagggcacccaggc

SEQ ID NO: 6724910 - DNA, 22 bp, Homo sapiens
ccagggcaccctgtggccctgg

SEQ ID NO: 6724911 - DNA, 23 bp, Homo sapiens
ccagggcaccctgtggccctggc

SEQ ID NO: 6724912 - DNA, 22 bp, Homo sapiens
ccagggcaccgtattcctctcc

SEQ ID NO: 6724913 - DNA, 20 bp, Homo sapiens
ccagggcactgccagcccac

SEQ ID NO: 6724914 - DNA, 15 bp, Homo sapiens
ccagggcagaggaat

SEQ ID NO: 6724915 - DNA, 17 bp, Homo sapiens
ccagggcagaggaatgt

SEQ ID NO: 6724916 - DNA, 14 bp, Homo sapiens
ccagggcagatgtg

SEQ ID NO: 6724917 - DNA, 16 bp, Homo sapiens
ccagggcagcaggcca

SEQ ID NO: 6724918 - DNA, 13 bp, Homo sapiens
ccagggcagccag

SEQ ID NO: 6724919 - DNA, 13 bp, Homo sapiens
ccagggcagcggc

SEQ ID NO: 6724920 - DNA, 18 bp, Homo sapiens
ccagggcaggctacccct

SEQ ID NO: 6724921 - DNA, 13 bp, Homo sapiens
ccagggcagggcg

SEQ ID NO: 6724922 - DNA, 19 bp, Homo sapiens
ccagggcagggcgagctgc

SEQ ID NO: 6724923 - DNA, 22 bp, Homo sapiens
ccagggcagggcgagctgcagg

SEQ ID NO: 6724924 - DNA, 16 bp, Homo sapiens
ccagggcagggtctgg

SEQ ID NO: 6724925 - DNA, 19 bp, Homo sapiens
ccagggcatattaaaggct

SEQ ID NO: 6724926 - DNA, 19 bp, Homo sapiens
ccagggcatccgcagccca

SEQ ID NO: 6724927 - DNA, 21 bp, Homo sapiens
ccagggcatccgcagcccagg

SEQ ID NO: 6724928 - DNA, 13 bp, Homo sapiens
ccagggcatctct

SEQ ID NO: 6724929 - DNA, 21 bp, Homo sapiens
ccagggcatcttgctggctac

SEQ ID NO: 6724930 - DNA, 23 bp, Homo sapiens
ccagggcatgtgtatgtgtctgc

SEQ ID NO: 6724931 - DNA, 19 bp, Homo sapiens
ccagggcattgctcagccc

SEQ ID NO: 6724932 - DNA, 21 bp, Homo sapiens
ccagggcattgctcagcccgc

SEQ ID NO: 6724933 - DNA, 21 bp, Homo sapiens
ccagggcattgtgttcactgt

SEQ ID NO: 6724934 - DNA, 15 bp, Homo sapiens
ccagggccaccgcag

SEQ ID NO: 6724935 - DNA, 19 bp, Homo sapiens
ccagggccacgtgccaggc

SEQ ID NO: 6724936 - DNA, 17 bp, Homo sapiens
ccagggccactctgcct

SEQ ID NO: 6724937 - DNA, 19 bp, Homo sapiens
ccagggccactctgcctct

SEQ ID NO: 6724938 - DNA, 13 bp, Homo sapiens
ccagggccagaag

SEQ ID NO: 6724939 - DNA, 18 bp, Homo sapiens
ccagggccagagcagctc

SEQ ID NO: 6724940 - DNA, 22 bp, Homo sapiens
ccagggccagcaggcagcgcct

SEQ ID NO: 6724941 - DNA, 14 bp, Homo sapiens
ccagggccagcctc

SEQ ID NO: 6724942 - DNA, 15 bp, Homo sapiens
ccagggccagcctct

SEQ ID NO: 6724943 - DNA, 12 bp, Homo sapiens
ccagggccagga

SEQ ID NO: 6724944 - DNA, 19 bp, Homo sapiens
ccagggccatctcctccca

SEQ ID NO: 6724945 - DNA, 21 bp, Homo sapiens
ccagggcccaaagcccagctc

SEQ ID NO: 6724946 - DNA, 16 bp, Homo sapiens
ccagggcccaccccag

SEQ ID NO: 6724947 - DNA, 13 bp, Homo sapiens
ccagggcccagag

SEQ ID NO: 6724948 - DNA, 17 bp, Homo sapiens
ccagggcccaggcaaat

SEQ ID NO: 6724949 - DNA, 12 bp, Homo sapiens
ccagggccccca

SEQ ID NO: 6724950 - DNA, 21 bp, Homo sapiens
ccagggcccccaccgaggttc

SEQ ID NO: 6724951 - DNA, 12 bp, Homo sapiens
ccagggcccctc

SEQ ID NO: 6724952 - DNA, 22 bp, Homo sapiens
ccagggcccctcaccctgcctt

SEQ ID NO: 6724953 - DNA, 19 bp, Homo sapiens
ccagggcccctccctctgc

SEQ ID NO: 6724954 - DNA, 21 bp, Homo sapiens
ccagggcccctccctctgccc

SEQ ID NO: 6724955 - DNA, 23 bp, Homo sapiens
ccagggcccctccctctgcccca

SEQ ID NO: 6724956 - DNA, 22 bp, Homo sapiens
ccagggcccctctccccaggga

SEQ ID NO: 6724957 - DNA, 12 bp, Homo sapiens
ccagggcccggc

SEQ ID NO: 6724958 - DNA, 20 bp, Homo sapiens
ccagggcccggcacagagtc

SEQ ID NO: 6724959 - DNA, 16 bp, Homo sapiens
ccagggcccgggaagc

SEQ ID NO: 6724960 - DNA, 22 bp, Homo sapiens
ccagggcccgggcacccacaag

SEQ ID NO: 6724961 - DNA, 12 bp, Homo sapiens
ccagggccctaa

SEQ ID NO: 6724962 - DNA, 13 bp, Homo sapiens
ccagggccctccc

SEQ ID NO: 6724963 - DNA, 16 bp, Homo sapiens
ccagggccctcccagc

SEQ ID NO: 6724964 - DNA, 14 bp, Homo sapiens
ccagggccctgctc

SEQ ID NO: 6724965 - DNA, 18 bp, Homo sapiens
ccagggccctgctcaggc

SEQ ID NO: 6724966 - DNA, 22 bp, Homo sapiens
ccagggccctgctcaggcctca

SEQ ID NO: 6724967 - DNA, 15 bp, Homo sapiens
ccagggccctggatg

SEQ ID NO: 6724968 - DNA, 16 bp, Homo sapiens
ccagggccctggccag

SEQ ID NO: 6724969 - DNA, 18 bp, Homo sapiens
ccagggccctggccagcc

SEQ ID NO: 6724970 - DNA, 22 bp, Homo sapiens
ccagggcctactgccacccgct

SEQ ID NO: 6724971 - DNA, 14 bp, Homo sapiens
ccagggcctaggac

SEQ ID NO: 6724972 - DNA, 18 bp, Homo sapiens
ccagggcctccaggactg

SEQ ID NO: 6724973 - DNA, 12 bp, Homo sapiens
ccagggcctccc

SEQ ID NO: 6724974 - DNA, 14 bp, Homo sapiens
ccagggcctccctg

SEQ ID NO: 6724975 - DNA, 17 bp, Homo sapiens
ccagggcctccctgttc

SEQ ID NO: 6724976 - DNA, 23 bp, Homo sapiens
ccagggcctccctgttcacggtg

SEQ ID NO: 6724977 - DNA, 12 bp, Homo sapiens
ccagggcctcct

SEQ ID NO: 6724978 - DNA, 21 bp, Homo sapiens
ccagggcctcctgggggacct

SEQ ID NO: 6724979 - DNA, 13 bp, Homo sapiens
ccagggcctctgg

SEQ ID NO: 6724980 - DNA, 21 bp, Homo sapiens
ccagggcctctgtgcagacag

SEQ ID NO: 6724981 - DNA, 19 bp, Homo sapiens
ccagggcctgacaccccct

SEQ ID NO: 6724982 - DNA, 14 bp, Homo sapiens
ccagggcctgactt

SEQ ID NO: 6724983 - DNA, 18 bp, Homo sapiens
ccagggcctgacttgagc

SEQ ID NO: 6724984 - DNA, 22 bp, Homo sapiens
ccagggcctgacttgagccact

SEQ ID NO: 6724985 - DNA, 14 bp, Homo sapiens
ccagggcctgagcc

SEQ ID NO: 6724986 - DNA, 17 bp, Homo sapiens
ccagggcctgagcctgg

SEQ ID NO: 6724987 - DNA, 14 bp, Homo sapiens
ccagggcctgcgga

SEQ ID NO: 6724988 - DNA, 15 bp, Homo sapiens
ccagggcctgcggag

SEQ ID NO: 6724989 - DNA, 20 bp, Homo sapiens
ccagggcctggaagacagag

SEQ ID NO: 6724990 - DNA, 21 bp, Homo sapiens
ccagggcctggaagacagaga

SEQ ID NO: 6724991 - DNA, 16 bp, Homo sapiens
ccagggcctgggggca

SEQ ID NO: 6724992 - DNA, 13 bp, Homo sapiens
ccagggcctggtg

SEQ ID NO: 6724993 - DNA, 20 bp, Homo sapiens
ccagggccttttctggcacc

SEQ ID NO: 6724994 - DNA, 17 bp, Homo sapiens
ccagggcgcaggggagg

SEQ ID NO: 6724995 - DNA, 20 bp, Homo sapiens
ccagggcgccagggtgctgt

SEQ ID NO: 6724996 - DNA, 14 bp, Homo sapiens
ccagggcggccagg

SEQ ID NO: 6724997 - DNA, 17 bp, Homo sapiens
ccagggcggccagggac

SEQ ID NO: 6724998 - DNA, 20 bp, Homo sapiens
ccagggcggccagggaccca

SEQ ID NO: 6724999 - DNA, 20 bp, Homo sapiens
ccagggcgggagtgggggct

SEQ ID NO: 6725000 - DNA, 21 bp, Homo sapiens
ccagggctagtgaagtggcct

SEQ ID NO: 6725001 - DNA, 19 bp, Homo sapiens
ccagggctatgggagcagc

SEQ ID NO: 6725002 - DNA, 14 bp, Homo sapiens
ccagggctcagatg

SEQ ID NO: 6725003 - DNA, 21 bp, Homo sapiens
ccagggctcagatggggcctg

SEQ ID NO: 6725004 - DNA, 12 bp, Homo sapiens
ccagggctcagc

SEQ ID NO: 6725005 - DNA, 15 bp, Homo sapiens
ccagggctcagcctg

SEQ ID NO: 6725006 - DNA, 16 bp, Homo sapiens
ccagggctcagcctgg

SEQ ID NO: 6725007 - DNA, 19 bp, Homo sapiens
ccagggctccagcactacc

SEQ ID NO: 6725008 - DNA, 17 bp, Homo sapiens
ccagggctccagcccct

SEQ ID NO: 6725009 - DNA, 18 bp, Homo sapiens
ccagggctccctcctgga

SEQ ID NO: 6725010 - DNA, 14 bp, Homo sapiens
ccagggctcctgca

SEQ ID NO: 6725011 - DNA, 16 bp, Homo sapiens
ccagggctcgggcgct

SEQ ID NO: 6725012 - DNA, 17 bp, Homo sapiens
ccagggctcgggcgctg

SEQ ID NO: 6725013 - DNA, 15 bp, Homo sapiens
ccagggctctctgga

SEQ ID NO: 6725014 - DNA, 18 bp, Homo sapiens
ccagggctctctggacca

SEQ ID NO: 6725015 - DNA, 16 bp, Homo sapiens
ccagggctctgaccag

SEQ ID NO: 6725016 - DNA, 14 bp, Homo sapiens
ccagggctctgcag

SEQ ID NO: 6725017 - DNA, 16 bp, Homo sapiens
ccagggctctgcagca

SEQ ID NO: 6725018 - DNA, 22 bp, Homo sapiens
ccagggctctgcagcacctcac

SEQ ID NO: 6725019 - DNA, 18 bp, Homo sapiens
ccagggctctgcaggcca

SEQ ID NO: 6725020 - DNA, 14 bp, Homo sapiens
ccagggctctgccc

SEQ ID NO: 6725021 - DNA, 17 bp, Homo sapiens
ccagggctctgccccag

SEQ ID NO: 6725022 - DNA, 12 bp, Homo sapiens
ccagggctctgg

SEQ ID NO: 6725023 - DNA, 16 bp, Homo sapiens
ccagggctctggcagg

SEQ ID NO: 6725024 - DNA, 17 bp, Homo sapiens
ccagggctctggcaggt

SEQ ID NO: 6725025 - DNA, 19 bp, Homo sapiens
ccagggctctgggggcaga

SEQ ID NO: 6725026 - DNA, 21 bp, Homo sapiens
ccagggctgcaaaactggaag

SEQ ID NO: 6725027 - DNA, 22 bp, Homo sapiens
ccagggctgcaaaactggaagc

SEQ ID NO: 6725028 - DNA, 14 bp, Homo sapiens
ccagggctgcaggg

SEQ ID NO: 6725029 - DNA, 19 bp, Homo sapiens
ccagggctgcccctgtagg

SEQ ID NO: 6725030 - DNA, 18 bp, Homo sapiens
ccagggctgccctgagaa

SEQ ID NO: 6725031 - DNA, 19 bp, Homo sapiens
ccagggctgccctgagaag

SEQ ID NO: 6725032 - DNA, 21 bp, Homo sapiens
ccagggctgccctgagaagct

SEQ ID NO: 6725033 - DNA, 23 bp, Homo sapiens
ccagggctgccctgagaagctgc

SEQ ID NO: 6725034 - DNA, 22 bp, Homo sapiens
ccagggctggactgaggcctga

SEQ ID NO: 6725035 - DNA, 15 bp, Homo sapiens
ccagggctggatgga

SEQ ID NO: 6725036 - DNA, 19 bp, Homo sapiens
ccagggctggatggacaga

SEQ ID NO: 6725037 - DNA, 21 bp, Homo sapiens
ccagggctggatggacagaca

SEQ ID NO: 6725038 - DNA, 17 bp, Homo sapiens
ccagggctggccctagg

SEQ ID NO: 6725039 - DNA, 18 bp, Homo sapiens
ccagggctggctctgcac

SEQ ID NO: 6725040 - DNA, 11 bp, Homo sapiens
ccagggctggg

SEQ ID NO: 6725041 - DNA, 21 bp, Homo sapiens
ccagggctgggaggaaggact

SEQ ID NO: 6725042 - DNA, 14 bp, Homo sapiens
ccagggctggggac

SEQ ID NO: 6725043 - DNA, 18 bp, Homo sapiens
ccagggctggggcagcct

SEQ ID NO: 6725044 - DNA, 21 bp, Homo sapiens
ccagggctggggcagcctctg

SEQ ID NO: 6725045 - DNA, 23 bp, Homo sapiens
ccagggctggggttgccagaggc

SEQ ID NO: 6725046 - DNA, 12 bp, Homo sapiens
ccagggctgggt

SEQ ID NO: 6725047 - DNA, 15 bp, Homo sapiens
ccagggctgggtcac

SEQ ID NO: 6725048 - DNA, 22 bp, Homo sapiens
ccagggctgtaactgccaggct

SEQ ID NO: 6725049 - DNA, 17 bp, Homo sapiens
ccagggctgtgggtggg

SEQ ID NO: 6725050 - DNA, 21 bp, Homo sapiens
ccagggcttacctgtacactg

SEQ ID NO: 6725051 - DNA, 20 bp, Homo sapiens
ccagggcttcctcttccggg

SEQ ID NO: 6725052 - DNA, 20 bp, Homo sapiens
ccaggggaaaatcagcctgc

SEQ ID NO: 6725053 - DNA, 12 bp, Homo sapiens
ccaggggaacct

SEQ ID NO: 6725054 - DNA, 15 bp, Homo sapiens
ccaggggaacctgcc

SEQ ID NO: 6725055 - DNA, 16 bp, Homo sapiens
ccaggggaacctgcca

SEQ ID NO: 6725056 - DNA, 17 bp, Homo sapiens
ccaggggaacctgccat

SEQ ID NO: 6725057 - DNA, 24 bp, Homo sapiens
ccaggggaacctgccatgccagga

SEQ ID NO: 6725058 - DNA, 16 bp, Homo sapiens
ccaggggaaggaagga

SEQ ID NO: 6725059 - DNA, 18 bp, Homo sapiens
ccaggggaaggccctgag

SEQ ID NO: 6725060 - DNA, 20 bp, Homo sapiens
ccaggggaaggccctgaggc

SEQ ID NO: 6725061 - DNA, 19 bp, Homo sapiens
ccaggggaagggtcccttt

SEQ ID NO: 6725062 - DNA, 18 bp, Homo sapiens
ccaggggaccttcctgtc

SEQ ID NO: 6725063 - DNA, 21 bp, Homo sapiens
ccaggggagaatgcagcccac

SEQ ID NO: 6725064 - DNA, 20 bp, Homo sapiens
ccaggggagagggtctggag

SEQ ID NO: 6725065 - DNA, 21 bp, Homo sapiens
ccaggggagagggtctggaga

SEQ ID NO: 6725066 - DNA, 13 bp, Homo sapiens
ccaggggagccag

SEQ ID NO: 6725067 - DNA, 18 bp, Homo sapiens
ccaggggagccagctgct

SEQ ID NO: 6725068 - DNA, 21 bp, Homo sapiens
ccaggggagccagctgcttga

SEQ ID NO: 6725069 - DNA, 13 bp, Homo sapiens
ccaggggagccct

SEQ ID NO: 6725070 - DNA, 14 bp, Homo sapiens
ccaggggaggagcc

SEQ ID NO: 6725071 - DNA, 16 bp, Homo sapiens
ccaggggaggagcctg

SEQ ID NO: 6725072 - DNA, 19 bp, Homo sapiens
ccaggggagggaaaagcta

SEQ ID NO: 6725073 - DNA, 18 bp, Homo sapiens
ccaggggatgagtggagg

SEQ ID NO: 6725074 - DNA, 12 bp, Homo sapiens
ccaggggcacac

SEQ ID NO: 6725075 - DNA, 14 bp, Homo sapiens
ccaggggcagcaag

SEQ ID NO: 6725076 - DNA, 17 bp, Homo sapiens
ccaggggcagcaaggcc

SEQ ID NO: 6725077 - DNA, 18 bp, Homo sapiens
ccaggggcagcaaggcct

SEQ ID NO: 6725078 - DNA, 20 bp, Homo sapiens
ccaggggcagcaaggccttg

SEQ ID NO: 6725079 - DNA, 23 bp, Homo sapiens
ccaggggcagccacaccactgcc

SEQ ID NO: 6725080 - DNA, 19 bp, Homo sapiens
ccaggggcagccccaggcc

SEQ ID NO: 6725081 - DNA, 15 bp, Homo sapiens
ccaggggcaggactg

SEQ ID NO: 6725082 - DNA, 16 bp, Homo sapiens
ccaggggcaggcacag

SEQ ID NO: 6725083 - DNA, 17 bp, Homo sapiens
ccaggggcaggcacagc

SEQ ID NO: 6725084 - DNA, 20 bp, Homo sapiens
ccaggggcaggcagctaggc

SEQ ID NO: 6725085 - DNA, 15 bp, Homo sapiens
ccaggggcatgactg

SEQ ID NO: 6725086 - DNA, 20 bp, Homo sapiens
ccaggggccaacctcaggct

SEQ ID NO: 6725087 - DNA, 22 bp, Homo sapiens
ccaggggccaacctcaggctcc

SEQ ID NO: 6725088 - DNA, 19 bp, Homo sapiens
ccaggggccaattttggat

SEQ ID NO: 6725089 - DNA, 19 bp, Homo sapiens
ccaggggcccaaggcggcc

SEQ ID NO: 6725090 - DNA, 18 bp, Homo sapiens
ccaggggcccacagggaa

SEQ ID NO: 6725091 - DNA, 21 bp, Homo sapiens
ccaggggcccaccctctgccc

SEQ ID NO: 6725092 - DNA, 19 bp, Homo sapiens
ccaggggcccctccagctt

SEQ ID NO: 6725093 - DNA, 14 bp, Homo sapiens
ccaggggcccttgg

SEQ ID NO: 6725094 - DNA, 22 bp, Homo sapiens
ccaggggcccttgggacagcca

SEQ ID NO: 6725095 - DNA, 19 bp, Homo sapiens
ccaggggccggccagtggc

SEQ ID NO: 6725096 - DNA, 14 bp, Homo sapiens
ccaggggcctgcag

SEQ ID NO: 6725097 - DNA, 15 bp, Homo sapiens
ccaggggcctgcaga

SEQ ID NO: 6725098 - DNA, 16 bp, Homo sapiens
ccaggggcctgcagaa

SEQ ID NO: 6725099 - DNA, 21 bp, Homo sapiens
ccaggggcctgcagaaggaaa

SEQ ID NO: 6725100 - DNA, 14 bp, Homo sapiens
ccaggggcgaggcc

SEQ ID NO: 6725101 - DNA, 21 bp, Homo sapiens
ccaggggctgcttcctcctgg

SEQ ID NO: 6725102 - DNA, 21 bp, Homo sapiens
ccaggggctggcttcaggagg

SEQ ID NO: 6725103 - DNA, 14 bp, Homo sapiens
ccaggggctgggga

SEQ ID NO: 6725104 - DNA, 21 bp, Homo sapiens
ccaggggctggtgggacagtg

SEQ ID NO: 6725105 - DNA, 22 bp, Homo sapiens
ccaggggcttctccccctcagc

SEQ ID NO: 6725106 - DNA, 20 bp, Homo sapiens
ccagggggaagatgccaagg

SEQ ID NO: 6725107 - DNA, 21 bp, Homo sapiens
ccagggggaagcaccagcctc

SEQ ID NO: 6725108 - DNA, 18 bp, Homo sapiens
ccagggggatgccactcc

SEQ ID NO: 6725109 - DNA, 15 bp, Homo sapiens
ccagggggcaagagg

SEQ ID NO: 6725110 - DNA, 18 bp, Homo sapiens
ccagggggccctctgcct

SEQ ID NO: 6725111 - DNA, 20 bp, Homo sapiens
ccagggggcctgcaggcccc

SEQ ID NO: 6725112 - DNA, 23 bp, Homo sapiens
ccaggggggacaatatgtgccaa

SEQ ID NO: 6725113 - DNA, 20 bp, Homo sapiens
ccaggggggcctcctcctag

SEQ ID NO: 6725114 - DNA, 19 bp, Homo sapiens
ccaggggggtgaggagctg

SEQ ID NO: 6725115 - DNA, 20 bp, Homo sapiens
ccaggggggtgaggagctgg

SEQ ID NO: 6725116 - DNA, 18 bp, Homo sapiens
ccagggggtgccctccca

SEQ ID NO: 6725117 - DNA, 17 bp, Homo sapiens
ccaggggtcccctggca

SEQ ID NO: 6725118 - DNA, 16 bp, Homo sapiens
ccaggggtctccctgg

SEQ ID NO: 6725119 - DNA, 19 bp, Homo sapiens
ccaggggtctgtctgcttt

SEQ ID NO: 6725120 - DNA, 17 bp, Homo sapiens
ccaggggtgagccccgc

SEQ ID NO: 6725121 - DNA, 19 bp, Homo sapiens
ccaggggtgatttcagaga

SEQ ID NO: 6725122 - DNA, 21 bp, Homo sapiens
ccaggggtgatttcagagagg

SEQ ID NO: 6725123 - DNA, 13 bp, Homo sapiens
ccaggggtgcccc

SEQ ID NO: 6725124 - DNA, 16 bp, Homo sapiens
ccaggggtgccccctc

SEQ ID NO: 6725125 - DNA, 19 bp, Homo sapiens
ccaggggtgccccctcctc

SEQ ID NO: 6725126 - DNA, 20 bp, Homo sapiens
ccaggggtgccccctcctct

SEQ ID NO: 6725127 - DNA, 17 bp, Homo sapiens
ccaggggtgctcctgtg

SEQ ID NO: 6725128 - DNA, 21 bp, Homo sapiens
ccaggggtgggacaccctgtg

SEQ ID NO: 6725129 - DNA, 16 bp, Homo sapiens
ccaggggtggggccca

SEQ ID NO: 6725130 - DNA, 22 bp, Homo sapiens
ccaggggtggtgagggcagttc

SEQ ID NO: 6725131 - DNA, 15 bp, Homo sapiens
ccaggggtgtcccag

SEQ ID NO: 6725132 - DNA, 14 bp, Homo sapiens
ccaggggttctgag

SEQ ID NO: 6725133 - DNA, 19 bp, Homo sapiens
ccaggggttctgagaagcg

SEQ ID NO: 6725134 - DNA, 13 bp, Homo sapiens
ccaggggtttctc

SEQ ID NO: 6725135 - DNA, 19 bp, Homo sapiens
ccagggtagacttggagct

SEQ ID NO: 6725136 - DNA, 20 bp, Homo sapiens
ccagggtagcccgcctgcca

SEQ ID NO: 6725137 - DNA, 22 bp, Homo sapiens
ccagggtaggcaaggctgccgg

SEQ ID NO: 6725138 - DNA, 17 bp, Homo sapiens
ccagggtatgaagagtg

SEQ ID NO: 6725139 - DNA, 21 bp, Homo sapiens
ccagggtcactgaaggcctgg

SEQ ID NO: 6725140 - DNA, 17 bp, Homo sapiens
ccagggtcagaaacagg

SEQ ID NO: 6725141 - DNA, 18 bp, Homo sapiens
ccagggtcagaaacagga

SEQ ID NO: 6725142 - DNA, 14 bp, Homo sapiens
ccagggtcaggcgg

SEQ ID NO: 6725143 - DNA, 15 bp, Homo sapiens
ccagggtccagccct

SEQ ID NO: 6725144 - DNA, 18 bp, Homo sapiens
ccagggtccagccctccg

SEQ ID NO: 6725145 - DNA, 20 bp, Homo sapiens
ccagggtccagccctccgcc

SEQ ID NO: 6725146 - DNA, 14 bp, Homo sapiens
ccagggtcccaccc

SEQ ID NO: 6725147 - DNA, 21 bp, Homo sapiens
ccagggtcccagcctggccac

SEQ ID NO: 6725148 - DNA, 14 bp, Homo sapiens
ccagggtcccagga

SEQ ID NO: 6725149 - DNA, 15 bp, Homo sapiens
ccagggtcccaggaa

SEQ ID NO: 6725150 - DNA, 17 bp, Homo sapiens
ccagggtcccaggaagc

SEQ ID NO: 6725151 - DNA, 18 bp, Homo sapiens
ccagggtcccaggaagcc

SEQ ID NO: 6725152 - DNA, 22 bp, Homo sapiens
ccagggtcccctccccagctcc

SEQ ID NO: 6725153 - DNA, 14 bp, Homo sapiens
ccagggtcccctgc

SEQ ID NO: 6725154 - DNA, 18 bp, Homo sapiens
ccagggtcccctgccacc

SEQ ID NO: 6725155 - DNA, 17 bp, Homo sapiens
ccagggtccctctgtgt

SEQ ID NO: 6725156 - DNA, 14 bp, Homo sapiens
ccagggtccgcacc

SEQ ID NO: 6725157 - DNA, 16 bp, Homo sapiens
ccagggtccgcaccag

SEQ ID NO: 6725158 - DNA, 22 bp, Homo sapiens
ccagggtccgcaccagctgctc

SEQ ID NO: 6725159 - DNA, 18 bp, Homo sapiens
ccagggtcctctagccca

SEQ ID NO: 6725160 - DNA, 15 bp, Homo sapiens
ccagggtcctgagtg

SEQ ID NO: 6725161 - DNA, 21 bp, Homo sapiens
ccagggtcgtctttgtgtatg

SEQ ID NO: 6725162 - DNA, 19 bp, Homo sapiens
ccagggtctaaagagaaca

SEQ ID NO: 6725163 - DNA, 16 bp, Homo sapiens
ccagggtctcactgag

SEQ ID NO: 6725164 - DNA, 13 bp, Homo sapiens
ccagggtctccag

SEQ ID NO: 6725165 - DNA, 17 bp, Homo sapiens
ccagggtctccagaaag

SEQ ID NO: 6725166 - DNA, 20 bp, Homo sapiens
ccagggtctcgtcaggaggt

SEQ ID NO: 6725167 - DNA, 15 bp, Homo sapiens
ccagggtctgaaagg

SEQ ID NO: 6725168 - DNA, 17 bp, Homo sapiens
ccagggtctgaaagggg

SEQ ID NO: 6725169 - DNA, 18 bp, Homo sapiens
ccagggtctggcagagcc

SEQ ID NO: 6725170 - DNA, 22 bp, Homo sapiens
ccagggtctggcagagcctctg

SEQ ID NO: 6725171 - DNA, 14 bp, Homo sapiens
ccagggtcttgggc

SEQ ID NO: 6725172 - DNA, 19 bp, Homo sapiens
ccagggtcttgggctactg

SEQ ID NO: 6725173 - DNA, 21 bp, Homo sapiens
ccagggtcttgggctactggc

SEQ ID NO: 6725174 - DNA, 23 bp, Homo sapiens
ccagggtcttgggctactggcag

SEQ ID NO: 6725175 - DNA, 19 bp, Homo sapiens
ccagggtctttactgggaa

SEQ ID NO: 6725176 - DNA, 16 bp, Homo sapiens
ccagggtgacaaggcc

SEQ ID NO: 6725177 - DNA, 19 bp, Homo sapiens
ccagggtgacaaggcctgc

SEQ ID NO: 6725178 - DNA, 22 bp, Homo sapiens
ccagggtgacaaggcctgcttg

SEQ ID NO: 6725179 - DNA, 23 bp, Homo sapiens
ccagggtgagaacgtgcccagcc

SEQ ID NO: 6725180 - DNA, 15 bp, Homo sapiens
ccagggtgagagctg

SEQ ID NO: 6725181 - DNA, 18 bp, Homo sapiens
ccagggtgagcagggccc

SEQ ID NO: 6725182 - DNA, 15 bp, Homo sapiens
ccagggtgcccagaa

SEQ ID NO: 6725183 - DNA, 15 bp, Homo sapiens
ccagggtggaccagg

SEQ ID NO: 6725184 - DNA, 17 bp, Homo sapiens
ccagggtggaccaggcc

SEQ ID NO: 6725185 - DNA, 20 bp, Homo sapiens
ccagggtggacttagaaagc

SEQ ID NO: 6725186 - DNA, 22 bp, Homo sapiens
ccagggtggacttagaaagcag

SEQ ID NO: 6725187 - DNA, 22 bp, Homo sapiens
ccagggtggagctgagaagagg

SEQ ID NO: 6725188 - DNA, 17 bp, Homo sapiens
ccagggtggcagcaaca

SEQ ID NO: 6725189 - DNA, 17 bp, Homo sapiens
ccagggtggccacacag

SEQ ID NO: 6725190 - DNA, 19 bp, Homo sapiens
ccagggtggccacacaggc

SEQ ID NO: 6725191 - DNA, 20 bp, Homo sapiens
ccagggtggccacacaggca

SEQ ID NO: 6725192 - DNA, 23 bp, Homo sapiens
ccagggtggtcttcaagcctggc

SEQ ID NO: 6725193 - DNA, 18 bp, Homo sapiens
ccagggtggttagaggaa

SEQ ID NO: 6725194 - DNA, 23 bp, Homo sapiens
ccagggtgtgactcgggagctgc

SEQ ID NO: 6725195 - DNA, 20 bp, Homo sapiens
ccagggtgtttgcagctgtg

SEQ ID NO: 6725196 - DNA, 22 bp, Homo sapiens
ccagggtgtttgcagctgtgag

SEQ ID NO: 6725197 - DNA, 20 bp, Homo sapiens
ccagggttgtgctttctagc

SEQ ID NO: 6725198 - DNA, 13 bp, Homo sapiens
ccagggttttaac

SEQ ID NO: 6725199 - DNA, 16 bp, Homo sapiens
ccagggttttaacttt

SEQ ID NO: 6725200 - DNA, 13 bp, Homo sapiens
ccagggttttgcc

SEQ ID NO: 6725201 - DNA, 20 bp, Homo sapiens
ccaggtaaagtcaaagcttt

SEQ ID NO: 6725202 - DNA, 16 bp, Homo sapiens
ccaggtaactttgaag

SEQ ID NO: 6725203 - DNA, 16 bp, Homo sapiens
ccaggtaactttgctt

SEQ ID NO: 6725204 - DNA, 18 bp, Homo sapiens
ccaggtaatgagggactg

SEQ ID NO: 6725205 - DNA, 21 bp, Homo sapiens
ccaggtaatgtgggtctacca

SEQ ID NO: 6725206 - DNA, 16 bp, Homo sapiens
ccaggtacacctcccc

SEQ ID NO: 6725207 - DNA, 18 bp, Homo sapiens
ccaggtacacctccccct

SEQ ID NO: 6725208 - DNA, 20 bp, Homo sapiens
ccaggtacaggagaggcagc

SEQ ID NO: 6725209 - DNA, 20 bp, Homo sapiens
ccaggtaccacccttcagac

SEQ ID NO: 6725210 - DNA, 19 bp, Homo sapiens
ccaggtaccagctgcgctt

SEQ ID NO: 6725211 - DNA, 23 bp, Homo sapiens
ccaggtaccttctcacctgtgag

SEQ ID NO: 6725212 - DNA, 16 bp, Homo sapiens
ccaggtacgcacagac

SEQ ID NO: 6725213 - DNA, 18 bp, Homo sapiens
ccaggtacgcacagacag

SEQ ID NO: 6725214 - DNA, 20 bp, Homo sapiens
ccaggtactgagtggggagt

SEQ ID NO: 6725215 - DNA, 20 bp, Homo sapiens
ccaggtagcaagagagcagc

SEQ ID NO: 6725216 - DNA, 16 bp, Homo sapiens
ccaggtagcagcaaat

SEQ ID NO: 6725217 - DNA, 17 bp, Homo sapiens
ccaggtagcagcaaata

SEQ ID NO: 6725218 - DNA, 14 bp, Homo sapiens
ccaggtagctggga

SEQ ID NO: 6725219 - DNA, 15 bp, Homo sapiens
ccaggtagctgggat

SEQ ID NO: 6725220 - DNA, 16 bp, Homo sapiens
ccaggtagttggaact

SEQ ID NO: 6725221 - DNA, 21 bp, Homo sapiens
ccaggtagttggaactttctg

SEQ ID NO: 6725222 - DNA, 19 bp, Homo sapiens
ccaggtatcctgggggaag

SEQ ID NO: 6725223 - DNA, 18 bp, Homo sapiens
ccaggtatctccaggatt

SEQ ID NO: 6725224 - DNA, 22 bp, Homo sapiens
ccaggtatctgatgatgttctg

SEQ ID NO: 6725225 - DNA, 15 bp, Homo sapiens
ccaggtatggctctg

SEQ ID NO: 6725226 - DNA, 17 bp, Homo sapiens
ccaggtatggctctgca

SEQ ID NO: 6725227 - DNA, 13 bp, Homo sapiens
ccaggtcaacaga

SEQ ID NO: 6725228 - DNA, 19 bp, Homo sapiens
ccaggtcaacagaatgaaa

SEQ ID NO: 6725229 - DNA, 20 bp, Homo sapiens
ccaggtcaacagaatgaaaa

SEQ ID NO: 6725230 - DNA, 22 bp, Homo sapiens
ccaggtcaacagaatgaaaaat

SEQ ID NO: 6725231 - DNA, 14 bp, Homo sapiens
ccaggtcacaggca

SEQ ID NO: 6725232 - DNA, 15 bp, Homo sapiens
ccaggtcacaggcat

SEQ ID NO: 6725233 - DNA, 20 bp, Homo sapiens
ccaggtcaccaagcagtggc

SEQ ID NO: 6725234 - DNA, 19 bp, Homo sapiens
ccaggtcaccatcctcaga

SEQ ID NO: 6725235 - DNA, 13 bp, Homo sapiens
ccaggtcagccct

SEQ ID NO: 6725236 - DNA, 14 bp, Homo sapiens
ccaggtcagccctg

SEQ ID NO: 6725237 - DNA, 19 bp, Homo sapiens
ccaggtcagccctgtgtct

SEQ ID NO: 6725238 - DNA, 23 bp, Homo sapiens
ccaggtcaggatgcacatttctg

SEQ ID NO: 6725239 - DNA, 16 bp, Homo sapiens
ccaggtcaggggctcc

SEQ ID NO: 6725240 - DNA, 19 bp, Homo sapiens
ccaggtcaggggctcccta

SEQ ID NO: 6725241 - DNA, 17 bp, Homo sapiens
ccaggtccaatgagctt

SEQ ID NO: 6725242 - DNA, 20 bp, Homo sapiens
ccaggtccaatgagctttct

SEQ ID NO: 6725243 - DNA, 14 bp, Homo sapiens
ccaggtccagctct

SEQ ID NO: 6725244 - DNA, 15 bp, Homo sapiens
ccaggtccattttgc

SEQ ID NO: 6725245 - DNA, 23 bp, Homo sapiens
ccaggtcccagcccctcctccct

SEQ ID NO: 6725246 - DNA, 17 bp, Homo sapiens
ccaggtccccctgcagc

SEQ ID NO: 6725247 - DNA, 13 bp, Homo sapiens
ccaggtcccgagc

SEQ ID NO: 6725248 - DNA, 21 bp, Homo sapiens
ccaggtccctccgcggctgga

SEQ ID NO: 6725249 - DNA, 12 bp, Homo sapiens
ccaggtccctct

SEQ ID NO: 6725250 - DNA, 16 bp, Homo sapiens
ccaggtccctctcatt

SEQ ID NO: 6725251 - DNA, 18 bp, Homo sapiens
ccaggtcctcacagcagt

SEQ ID NO: 6725252 - DNA, 21 bp, Homo sapiens
ccaggtcctcacagcagtcac

SEQ ID NO: 6725253 - DNA, 19 bp, Homo sapiens
ccaggtcctcagatgggaa

SEQ ID NO: 6725254 - DNA, 21 bp, Homo sapiens
ccaggtcctgctccgctgcct

SEQ ID NO: 6725255 - DNA, 14 bp, Homo sapiens
ccaggtcctgtctc

SEQ ID NO: 6725256 - DNA, 14 bp, Homo sapiens
ccaggtcctttcct

SEQ ID NO: 6725257 - DNA, 20 bp, Homo sapiens
ccaggtcctttctcctgata

SEQ ID NO: 6725258 - DNA, 17 bp, Homo sapiens
ccaggtcgggcagtgga

SEQ ID NO: 6725259 - DNA, 21 bp, Homo sapiens
ccaggtcgggctcagctctgg

SEQ ID NO: 6725260 - DNA, 22 bp, Homo sapiens
ccaggtctagaaggccaggcct

SEQ ID NO: 6725261 - DNA, 21 bp, Homo sapiens
ccaggtctcaaggttctcatt

SEQ ID NO: 6725262 - DNA, 20 bp, Homo sapiens
ccaggtctccctggatcaga

SEQ ID NO: 6725263 - DNA, 20 bp, Homo sapiens
ccaggtctcctgggcatctg

SEQ ID NO: 6725264 - DNA, 18 bp, Homo sapiens
ccaggtctctccactgct

SEQ ID NO: 6725265 - DNA, 21 bp, Homo sapiens
ccaggtctctccactgctctc

SEQ ID NO: 6725266 - DNA, 15 bp, Homo sapiens
ccaggtctgactcca

SEQ ID NO: 6725267 - DNA, 16 bp, Homo sapiens
ccaggtctgactccaa

SEQ ID NO: 6725268 - DNA, 17 bp, Homo sapiens
ccaggtctgactccaaa

SEQ ID NO: 6725269 - DNA, 21 bp, Homo sapiens
ccaggtctgactccaaagctg

SEQ ID NO: 6725270 - DNA, 20 bp, Homo sapiens
ccaggtctgatgccaaagct

SEQ ID NO: 6725271 - DNA, 16 bp, Homo sapiens
ccaggtctgcctggtt

SEQ ID NO: 6725272 - DNA, 22 bp, Homo sapiens
ccaggtctggcgccaggggcag

SEQ ID NO: 6725273 - DNA, 21 bp, Homo sapiens
ccaggtctgggtggggcccag

SEQ ID NO: 6725274 - DNA, 15 bp, Homo sapiens
ccaggtcttccagac

SEQ ID NO: 6725275 - DNA, 17 bp, Homo sapiens
ccaggtcttccagacct

SEQ ID NO: 6725276 - DNA, 20 bp, Homo sapiens
ccaggtcttcctgctttcca

SEQ ID NO: 6725277 - DNA, 20 bp, Homo sapiens
ccaggtcttgaggagagaga

SEQ ID NO: 6725278 - DNA, 21 bp, Homo sapiens
ccaggtcttgaggagagagac

SEQ ID NO: 6725279 - DNA, 23 bp, Homo sapiens
ccaggtcttgaggagagagacag

SEQ ID NO: 6725280 - DNA, 19 bp, Homo sapiens
ccaggtcttggagctgagc

SEQ ID NO: 6725281 - DNA, 19 bp, Homo sapiens
ccaggtcttgttcaagcag

SEQ ID NO: 6725282 - DNA, 21 bp, Homo sapiens
ccaggtgacacgcttctgagc

SEQ ID NO: 6725283 - DNA, 15 bp, Homo sapiens
ccaggtgagaattca

SEQ ID NO: 6725284 - DNA, 23 bp, Homo sapiens
ccaggtgagacagcggtcccagg

SEQ ID NO: 6725285 - DNA, 20 bp, Homo sapiens
ccaggtgaggaatttgaagc

SEQ ID NO: 6725286 - DNA, 15 bp, Homo sapiens
ccaggtgagggaagg

SEQ ID NO: 6725287 - DNA, 18 bp, Homo sapiens
ccaggtgagggaaggaga

SEQ ID NO: 6725288 - DNA, 19 bp, Homo sapiens
ccaggtgaggtcagcacat

SEQ ID NO: 6725289 - DNA, 20 bp, Homo sapiens
ccaggtgaggtcagcacatc

SEQ ID NO: 6725290 - DNA, 14 bp, Homo sapiens
ccaggtgaggtcca

SEQ ID NO: 6725291 - DNA, 14 bp, Homo sapiens
ccaggtgagtgtga

SEQ ID NO: 6725292 - DNA, 20 bp, Homo sapiens
ccaggtgagtgtgagggcag

SEQ ID NO: 6725293 - DNA, 21 bp, Homo sapiens
ccaggtgagtgtgagggcagc

SEQ ID NO: 6725294 - DNA, 20 bp, Homo sapiens
ccaggtgatctcctgtggct

SEQ ID NO: 6725295 - DNA, 15 bp, Homo sapiens
ccaggtgatttcctc

SEQ ID NO: 6725296 - DNA, 22 bp, Homo sapiens
ccaggtgatttcctctaaagaa

SEQ ID NO: 6725297 - DNA, 18 bp, Homo sapiens
ccaggtgcaaccagggag

SEQ ID NO: 6725298 - DNA, 19 bp, Homo sapiens
ccaggtgcacaagctccaa

SEQ ID NO: 6725299 - DNA, 19 bp, Homo sapiens
ccaggtgcacagacgtccc

SEQ ID NO: 6725300 - DNA, 22 bp, Homo sapiens
ccaggtgcagaggtaccctggg

SEQ ID NO: 6725301 - DNA, 15 bp, Homo sapiens
ccaggtgcagccaga

SEQ ID NO: 6725302 - DNA, 16 bp, Homo sapiens
ccaggtgccaccaata

SEQ ID NO: 6725303 - DNA, 18 bp, Homo sapiens
ccaggtgccaccaataaa

SEQ ID NO: 6725304 - DNA, 13 bp, Homo sapiens
ccaggtgccagtt

SEQ ID NO: 6725305 - DNA, 15 bp, Homo sapiens
ccaggtgcccagcta

SEQ ID NO: 6725306 - DNA, 17 bp, Homo sapiens
ccaggtgcccaggaaag

SEQ ID NO: 6725307 - DNA, 16 bp, Homo sapiens
ccaggtgccctgtggg

SEQ ID NO: 6725308 - DNA, 17 bp, Homo sapiens
ccaggtgccgacactga

SEQ ID NO: 6725309 - DNA, 20 bp, Homo sapiens
ccaggtgccgacactgagct

SEQ ID NO: 6725310 - DNA, 16 bp, Homo sapiens
ccaggtgcctttcaaa

SEQ ID NO: 6725311 - DNA, 18 bp, Homo sapiens
ccaggtgcctttcaaatt

SEQ ID NO: 6725312 - DNA, 21 bp, Homo sapiens
ccaggtgcctttcaaatttag

SEQ ID NO: 6725313 - DNA, 13 bp, Homo sapiens
ccaggtgcggcct

SEQ ID NO: 6725314 - DNA, 17 bp, Homo sapiens
ccaggtgcggcctgggg

SEQ ID NO: 6725315 - DNA, 22 bp, Homo sapiens
ccaggtgcgtgtgtctctgtct

SEQ ID NO: 6725316 - DNA, 23 bp, Homo sapiens
ccaggtgcgtgtgtctctgtctc

SEQ ID NO: 6725317 - DNA, 21 bp, Homo sapiens
ccaggtgctaggaacactcct

SEQ ID NO: 6725318 - DNA, 16 bp, Homo sapiens
ccaggtgctcagccca

SEQ ID NO: 6725319 - DNA, 21 bp, Homo sapiens
ccaggtgctcagcccaggcac

SEQ ID NO: 6725320 - DNA, 15 bp, Homo sapiens
ccaggtgctgtgaca

SEQ ID NO: 6725321 - DNA, 15 bp, Homo sapiens
ccaggtggaaggcag

SEQ ID NO: 6725322 - DNA, 22 bp, Homo sapiens
ccaggtggagggcacagccctc

SEQ ID NO: 6725323 - DNA, 23 bp, Homo sapiens
ccaggtggagggtttgcactcca

SEQ ID NO: 6725324 - DNA, 18 bp, Homo sapiens
ccaggtggaggtgccagg

SEQ ID NO: 6725325 - DNA, 14 bp, Homo sapiens
ccaggtggcacctg

SEQ ID NO: 6725326 - DNA, 16 bp, Homo sapiens
ccaggtggcacctgca

SEQ ID NO: 6725327 - DNA, 19 bp, Homo sapiens
ccaggtggcctcctggccc

SEQ ID NO: 6725328 - DNA, 12 bp, Homo sapiens
ccaggtggcctg

SEQ ID NO: 6725329 - DNA, 16 bp, Homo sapiens
ccaggtggcctgcgtc

SEQ ID NO: 6725330 - DNA, 17 bp, Homo sapiens
ccaggtggcctgcgtct

SEQ ID NO: 6725331 - DNA, 20 bp, Homo sapiens
ccaggtggcgtgagaggcaa

SEQ ID NO: 6725332 - DNA, 11 bp, Homo sapiens
ccaggtggcta

SEQ ID NO: 6725333 - DNA, 17 bp, Homo sapiens
ccaggtggctgacccag

SEQ ID NO: 6725334 - DNA, 21 bp, Homo sapiens
ccaggtggctgacccagtccc

SEQ ID NO: 6725335 - DNA, 22 bp, Homo sapiens
ccaggtggctgacccagtccct

SEQ ID NO: 6725336 - DNA, 23 bp, Homo sapiens
ccaggtggctgacccagtccctg

SEQ ID NO: 6725337 - DNA, 16 bp, Homo sapiens
ccaggtgggacttagc

SEQ ID NO: 6725338 - DNA, 14 bp, Homo sapiens
ccaggtgggagaga

SEQ ID NO: 6725339 - DNA, 18 bp, Homo sapiens
ccaggtgggagagacact

SEQ ID NO: 6725340 - DNA, 22 bp, Homo sapiens
ccaggtgggagagacactccca

SEQ ID NO: 6725341 - DNA, 22 bp, Homo sapiens
ccaggtgggcgggcagcacagc

SEQ ID NO: 6725342 - DNA, 23 bp, Homo sapiens
ccaggtgggcgggcagcacagca

SEQ ID NO: 6725343 - DNA, 22 bp, Homo sapiens
ccaggtgggtcccggctctgtg

SEQ ID NO: 6725344 - DNA, 22 bp, Homo sapiens
ccaggtggttgggttctgcctt

SEQ ID NO: 6725345 - DNA, 13 bp, Homo sapiens
ccaggtgtagcta

SEQ ID NO: 6725346 - DNA, 18 bp, Homo sapiens
ccaggtgtctagaggcaa

SEQ ID NO: 6725347 - DNA, 14 bp, Homo sapiens
ccaggtgtgcccct

SEQ ID NO: 6725348 - DNA, 21 bp, Homo sapiens
ccaggtgtgcccctccaagtc

SEQ ID NO: 6725349 - DNA, 19 bp, Homo sapiens
ccaggtgtgcctgtgctcc

SEQ ID NO: 6725350 - DNA, 23 bp, Homo sapiens
ccaggtgtgcctgtgctcctgcc

SEQ ID NO: 6725351 - DNA, 21 bp, Homo sapiens
ccaggtgtggaccggccgcag

SEQ ID NO: 6725352 - DNA, 23 bp, Homo sapiens
ccaggtgtggtggtacatgcctg

SEQ ID NO: 6725353 - DNA, 23 bp, Homo sapiens
ccaggtgtgtgctttaggcgtgg

SEQ ID NO: 6725354 - DNA, 15 bp, Homo sapiens
ccaggtgttgccatt

SEQ ID NO: 6725355 - DNA, 13 bp, Homo sapiens
ccaggtgtttata

SEQ ID NO: 6725356 - DNA, 24 bp, Homo sapiens
ccaggttagcctttgccctgtcac

SEQ ID NO: 6725357 - DNA, 22 bp, Homo sapiens
ccaggttcaagcgattctcctg

SEQ ID NO: 6725358 - DNA, 23 bp, Homo sapiens
ccaggttcaagcgattctcctgc

SEQ ID NO: 6725359 - DNA, 14 bp, Homo sapiens
ccaggttcagcttg

SEQ ID NO: 6725360 - DNA, 15 bp, Homo sapiens
ccaggttcagcttgt

SEQ ID NO: 6725361 - DNA, 19 bp, Homo sapiens
ccaggttccatccaccacc

SEQ ID NO: 6725362 - DNA, 17 bp, Homo sapiens
ccaggttcccccagcaa

SEQ ID NO: 6725363 - DNA, 14 bp, Homo sapiens
ccaggttccgaaga

SEQ ID NO: 6725364 - DNA, 14 bp, Homo sapiens
ccaggttcgagacc

SEQ ID NO: 6725365 - DNA, 22 bp, Homo sapiens
ccaggttctccgttagctcctg

SEQ ID NO: 6725366 - DNA, 21 bp, Homo sapiens
ccaggttctggttagctcagc

SEQ ID NO: 6725367 - DNA, 20 bp, Homo sapiens
ccaggttgacaccattctcc

SEQ ID NO: 6725368 - DNA, 19 bp, Homo sapiens
ccaggttgactaagaaatg

SEQ ID NO: 6725369 - DNA, 16 bp, Homo sapiens
ccaggttgatcttgaa

SEQ ID NO: 6725370 - DNA, 14 bp, Homo sapiens
ccaggttggaggcc

SEQ ID NO: 6725371 - DNA, 16 bp, Homo sapiens
ccaggttggaggccct

SEQ ID NO: 6725372 - DNA, 16 bp, Homo sapiens
ccaggttggctctgcc

SEQ ID NO: 6725373 - DNA, 17 bp, Homo sapiens
ccaggttggctctgcca

SEQ ID NO: 6725374 - DNA, 18 bp, Homo sapiens
ccaggttggctctgccag

SEQ ID NO: 6725375 - DNA, 13 bp, Homo sapiens
ccaggttggggag

SEQ ID NO: 6725376 - DNA, 14 bp, Homo sapiens
ccaggttggggaga

SEQ ID NO: 6725377 - DNA, 22 bp, Homo sapiens
ccaggttgttttatagaggttc

SEQ ID NO: 6725378 - DNA, 24 bp, Homo sapiens
ccaggttgttttatagaggttctt

SEQ ID NO: 6725379 - DNA, 16 bp, Homo sapiens
ccaggtttagacagta

SEQ ID NO: 6725380 - DNA, 15 bp, Homo sapiens
ccaggtttcattttg

SEQ ID NO: 6725381 - DNA, 18 bp, Homo sapiens
ccaggtttcccactgcgg

SEQ ID NO: 6725382 - DNA, 17 bp, Homo sapiens
ccaggtttctggtctct

SEQ ID NO: 6725383 - DNA, 22 bp, Homo sapiens
ccaggtttctggtctctaggct

SEQ ID NO: 6725384 - DNA, 17 bp, Homo sapiens
ccaggtttgatgcctgt

SEQ ID NO: 6725385 - DNA, 14 bp, Homo sapiens
ccaggtttgctgtg

SEQ ID NO: 6725386 - DNA, 18 bp, Homo sapiens
ccaggttttctgctctgt

SEQ ID NO: 6725387 - DNA, 18 bp, Homo sapiens
ccaggttttgcactcttg

SEQ ID NO: 6725388 - DNA, 16 bp, Homo sapiens
ccaggtttttcaatta

SEQ ID NO: 6725389 - DNA, 22 bp, Homo sapiens
ccaggtttttcatctgaaaagc

SEQ ID NO: 6725390 - DNA, 20 bp, Homo sapiens
ccagtaaaaaaaaaaaatgg

SEQ ID NO: 6725391 - DNA, 17 bp, Homo sapiens
ccagtaaacagaggagt

SEQ ID NO: 6725392 - DNA, 21 bp, Homo sapiens
ccagtaaatgggggtgcattt

SEQ ID NO: 6725393 - DNA, 20 bp, Homo sapiens
ccagtaacacaggccaccct

SEQ ID NO: 6725394 - DNA, 14 bp, Homo sapiens
ccagtaacaggctc

SEQ ID NO: 6725395 - DNA, 15 bp, Homo sapiens
ccagtaacctcggag

SEQ ID NO: 6725396 - DNA, 21 bp, Homo sapiens
ccagtaacgcgtcttcctgag

SEQ ID NO: 6725397 - DNA, 18 bp, Homo sapiens
ccagtaacgtgctgctca

SEQ ID NO: 6725398 - DNA, 13 bp, Homo sapiens
ccagtaactgtgc

SEQ ID NO: 6725399 - DNA, 13 bp, Homo sapiens
ccagtaacttttt

SEQ ID NO: 6725400 - DNA, 16 bp, Homo sapiens
ccagtaacttttttgt

SEQ ID NO: 6725401 - DNA, 20 bp, Homo sapiens
ccagtaacttttttgtgtat

SEQ ID NO: 6725402 - DNA, 12 bp, Homo sapiens
ccagtaagatca

SEQ ID NO: 6725403 - DNA, 14 bp, Homo sapiens
ccagtaagatcact

SEQ ID NO: 6725404 - DNA, 21 bp, Homo sapiens
ccagtaagcacatgtttattc

SEQ ID NO: 6725405 - DNA, 17 bp, Homo sapiens
ccagtaaggcagctctg

SEQ ID NO: 6725406 - DNA, 21 bp, Homo sapiens
ccagtaagggcgtggctctgg

SEQ ID NO: 6725407 - DNA, 23 bp, Homo sapiens
ccagtaagtttcccctctggctt

SEQ ID NO: 6725408 - DNA, 20 bp, Homo sapiens
ccagtaataaaaagccacca

SEQ ID NO: 6725409 - DNA, 13 bp, Homo sapiens
ccagtaatttttc

SEQ ID NO: 6725410 - DNA, 12 bp, Homo sapiens
ccagtacctcca

SEQ ID NO: 6725411 - DNA, 16 bp, Homo sapiens
ccagtacctccaagca

SEQ ID NO: 6725412 - DNA, 21 bp, Homo sapiens
ccagtaccttctgccagaaga

SEQ ID NO: 6725413 - DNA, 17 bp, Homo sapiens
ccagtacctttgtcaca

SEQ ID NO: 6725414 - DNA, 23 bp, Homo sapiens
ccagtacgtcccgctgctgtgct

SEQ ID NO: 6725415 - DNA, 13 bp, Homo sapiens
ccagtactgggaa

SEQ ID NO: 6725416 - DNA, 17 bp, Homo sapiens
ccagtactgggaaggag

SEQ ID NO: 6725417 - DNA, 15 bp, Homo sapiens
ccagtacttctaaga

SEQ ID NO: 6725418 - DNA, 14 bp, Homo sapiens
ccagtactttggaa

SEQ ID NO: 6725419 - DNA, 16 bp, Homo sapiens
ccagtagagatttccc

SEQ ID NO: 6725420 - DNA, 21 bp, Homo sapiens
ccagtagccattttgtaactg

SEQ ID NO: 6725421 - DNA, 13 bp, Homo sapiens
ccagtagccccaa

SEQ ID NO: 6725422 - DNA, 22 bp, Homo sapiens
ccagtagctacggttccctgcc

SEQ ID NO: 6725423 - DNA, 15 bp, Homo sapiens
ccagtagctcctgga

SEQ ID NO: 6725424 - DNA, 13 bp, Homo sapiens
ccagtagctgcca

SEQ ID NO: 6725425 - DNA, 14 bp, Homo sapiens
ccagtagcttccca

SEQ ID NO: 6725426 - DNA, 21 bp, Homo sapiens
ccagtaggaaattgattttga

SEQ ID NO: 6725427 - DNA, 20 bp, Homo sapiens
ccagtaggagaaatctcagc

SEQ ID NO: 6725428 - DNA, 12 bp, Homo sapiens
ccagtaggagac

SEQ ID NO: 6725429 - DNA, 16 bp, Homo sapiens
ccagtataaatttctg

SEQ ID NO: 6725430 - DNA, 16 bp, Homo sapiens
ccagtataagattttt

SEQ ID NO: 6725431 - DNA, 20 bp, Homo sapiens
ccagtatacctcatttttca

SEQ ID NO: 6725432 - DNA, 24 bp, Homo sapiens
ccagtatacctcatttttcatact

SEQ ID NO: 6725433 - DNA, 18 bp, Homo sapiens
ccagtatctatatatgtg

SEQ ID NO: 6725434 - DNA, 16 bp, Homo sapiens
ccagtatctcttcagt

SEQ ID NO: 6725435 - DNA, 18 bp, Homo sapiens
ccagtatctcttcagtct

SEQ ID NO: 6725436 - DNA, 13 bp, Homo sapiens
ccagtatcttgaa

SEQ ID NO: 6725437 - DNA, 19 bp, Homo sapiens
ccagtatcttgaagacttt

SEQ ID NO: 6725438 - DNA, 22 bp, Homo sapiens
ccagtatgaaaagctatcttaa

SEQ ID NO: 6725439 - DNA, 16 bp, Homo sapiens
ccagtatgacagagga

SEQ ID NO: 6725440 - DNA, 14 bp, Homo sapiens
ccagtatggaaggg

SEQ ID NO: 6725441 - DNA, 17 bp, Homo sapiens
ccagtatggaagggagg

SEQ ID NO: 6725442 - DNA, 20 bp, Homo sapiens
ccagtatggaagggaggggt

SEQ ID NO: 6725443 - DNA, 19 bp, Homo sapiens
ccagtattactgctgctgt

SEQ ID NO: 6725444 - DNA, 23 bp, Homo sapiens
ccagtattactgctgctgtgctt

SEQ ID NO: 6725445 - DNA, 22 bp, Homo sapiens
ccagtattctaggtagtgccct

SEQ ID NO: 6725446 - DNA, 13 bp, Homo sapiens
ccagtattgctga

SEQ ID NO: 6725447 - DNA, 14 bp, Homo sapiens
ccagtattgtacaa

SEQ ID NO: 6725448 - DNA, 17 bp, Homo sapiens
ccagtatttttgctgct

SEQ ID NO: 6725449 - DNA, 19 bp, Homo sapiens
ccagtatttttgctgcttc

SEQ ID NO: 6725450 - DNA, 20 bp, Homo sapiens
ccagtcaaagcggatgctgg

SEQ ID NO: 6725451 - DNA, 22 bp, Homo sapiens
ccagtcaaatctgggctcactc

SEQ ID NO: 6725452 - DNA, 14 bp, Homo sapiens
ccagtcaacagatt

SEQ ID NO: 6725453 - DNA, 16 bp, Homo sapiens
ccagtcaacagattca

SEQ ID NO: 6725454 - DNA, 15 bp, Homo sapiens
ccagtcacactcccc

SEQ ID NO: 6725455 - DNA, 16 bp, Homo sapiens
ccagtcacagtttttg

SEQ ID NO: 6725456 - DNA, 16 bp, Homo sapiens
ccagtcaccccggcca

SEQ ID NO: 6725457 - DNA, 18 bp, Homo sapiens
ccagtcaccccggccacc

SEQ ID NO: 6725458 - DNA, 21 bp, Homo sapiens
ccagtcaccccggccacctgc

SEQ ID NO: 6725459 - DNA, 15 bp, Homo sapiens
ccagtcacctaagca

SEQ ID NO: 6725460 - DNA, 13 bp, Homo sapiens
ccagtcacctccc

SEQ ID NO: 6725461 - DNA, 14 bp, Homo sapiens
ccagtcaccttctg

SEQ ID NO: 6725462 - DNA, 18 bp, Homo sapiens
ccagtcaccttctgggca

SEQ ID NO: 6725463 - DNA, 15 bp, Homo sapiens
ccagtcactcctctc

SEQ ID NO: 6725464 - DNA, 13 bp, Homo sapiens
ccagtcactgctg

SEQ ID NO: 6725465 - DNA, 22 bp, Homo sapiens
ccagtcacttctgggggtcact

SEQ ID NO: 6725466 - DNA, 15 bp, Homo sapiens
ccagtcagcagtcat

SEQ ID NO: 6725467 - DNA, 13 bp, Homo sapiens
ccagtcagcctct

SEQ ID NO: 6725468 - DNA, 20 bp, Homo sapiens
ccagtcagcctctctcccag

SEQ ID NO: 6725469 - DNA, 23 bp, Homo sapiens
ccagtcagcctctctcccagtct

SEQ ID NO: 6725470 - DNA, 15 bp, Homo sapiens
ccagtcagcctggct

SEQ ID NO: 6725471 - DNA, 18 bp, Homo sapiens
ccagtcagcctggctggg

SEQ ID NO: 6725472 - DNA, 19 bp, Homo sapiens
ccagtcaggatgaggcccc

SEQ ID NO: 6725473 - DNA, 21 bp, Homo sapiens
ccagtcaggctgcagaggcac

SEQ ID NO: 6725474 - DNA, 19 bp, Homo sapiens
ccagtcagggacagcagcc

SEQ ID NO: 6725475 - DNA, 22 bp, Homo sapiens
ccagtcagggacagcagcctcc

SEQ ID NO: 6725476 - DNA, 12 bp, Homo sapiens
ccagtcagggcc

SEQ ID NO: 6725477 - DNA, 19 bp, Homo sapiens
ccagtcataccaactttag

SEQ ID NO: 6725478 - DNA, 13 bp, Homo sapiens
ccagtcatcatct

SEQ ID NO: 6725479 - DNA, 15 bp, Homo sapiens
ccagtcatggctgtc

SEQ ID NO: 6725480 - DNA, 18 bp, Homo sapiens
ccagtcatggctgtcccc

SEQ ID NO: 6725481 - DNA, 12 bp, Homo sapiens
ccagtcatggta

SEQ ID NO: 6725482 - DNA, 20 bp, Homo sapiens
ccagtcatggtactacccca

SEQ ID NO: 6725483 - DNA, 14 bp, Homo sapiens
ccagtcatgtgctg

SEQ ID NO: 6725484 - DNA, 21 bp, Homo sapiens
ccagtcattatgttaatattt

SEQ ID NO: 6725485 - DNA, 13 bp, Homo sapiens
ccagtcattgtac

SEQ ID NO: 6725486 - DNA, 17 bp, Homo sapiens
ccagtccaattttccta

SEQ ID NO: 6725487 - DNA, 18 bp, Homo sapiens
ccagtccaccctgcctgc

SEQ ID NO: 6725488 - DNA, 17 bp, Homo sapiens
ccagtccacctgaggaa

SEQ ID NO: 6725489 - DNA, 14 bp, Homo sapiens
ccagtccactcctg

SEQ ID NO: 6725490 - DNA, 14 bp, Homo sapiens
ccagtccactgggg

SEQ ID NO: 6725491 - DNA, 21 bp, Homo sapiens
ccagtccactggggagtgctg

SEQ ID NO: 6725492 - DNA, 14 bp, Homo sapiens
ccagtccaggctgc

SEQ ID NO: 6725493 - DNA, 14 bp, Homo sapiens
ccagtccagtccta

SEQ ID NO: 6725494 - DNA, 17 bp, Homo sapiens
ccagtccatgctccagg

SEQ ID NO: 6725495 - DNA, 15 bp, Homo sapiens
ccagtccatttccaa

SEQ ID NO: 6725496 - DNA, 22 bp, Homo sapiens
ccagtcccaatggtcctgactt

SEQ ID NO: 6725497 - DNA, 15 bp, Homo sapiens
ccagtcccacggctc

SEQ ID NO: 6725498 - DNA, 16 bp, Homo sapiens
ccagtcccacggctct

SEQ ID NO: 6725499 - DNA, 15 bp, Homo sapiens
ccagtcccagcagcc

SEQ ID NO: 6725500 - DNA, 17 bp, Homo sapiens
ccagtcccagcagccag

SEQ ID NO: 6725501 - DNA, 14 bp, Homo sapiens
ccagtcccagcctc

SEQ ID NO: 6725502 - DNA, 16 bp, Homo sapiens
ccagtcccagcctctg

SEQ ID NO: 6725503 - DNA, 17 bp, Homo sapiens
ccagtcccagcctctgg

SEQ ID NO: 6725504 - DNA, 18 bp, Homo sapiens
ccagtcccagcctctggg

SEQ ID NO: 6725505 - DNA, 19 bp, Homo sapiens
ccagtcccagcctctgggg

SEQ ID NO: 6725506 - DNA, 16 bp, Homo sapiens
ccagtcccatgctggc

SEQ ID NO: 6725507 - DNA, 14 bp, Homo sapiens
ccagtcccattcct

SEQ ID NO: 6725508 - DNA, 20 bp, Homo sapiens
ccagtccccaacctgcactc

SEQ ID NO: 6725509 - DNA, 18 bp, Homo sapiens
ccagtccccacccctgcc

SEQ ID NO: 6725510 - DNA, 21 bp, Homo sapiens
ccagtccccacccgcctgcag

SEQ ID NO: 6725511 - DNA, 15 bp, Homo sapiens
ccagtccccagaact

SEQ ID NO: 6725512 - DNA, 17 bp, Homo sapiens
ccagtccccgaggagct

SEQ ID NO: 6725513 - DNA, 14 bp, Homo sapiens
ccagtccccgggaa

SEQ ID NO: 6725514 - DNA, 18 bp, Homo sapiens
ccagtccccttcccgtga

SEQ ID NO: 6725515 - DNA, 21 bp, Homo sapiens
ccagtccctcgccgtccctcc

SEQ ID NO: 6725516 - DNA, 17 bp, Homo sapiens
ccagtccctctgagtga

SEQ ID NO: 6725517 - DNA, 15 bp, Homo sapiens
ccagtccctgaggca

SEQ ID NO: 6725518 - DNA, 14 bp, Homo sapiens
ccagtccctggagc

SEQ ID NO: 6725519 - DNA, 15 bp, Homo sapiens
ccagtccctggagct

SEQ ID NO: 6725520 - DNA, 12 bp, Homo sapiens
ccagtccctggg

SEQ ID NO: 6725521 - DNA, 15 bp, Homo sapiens
ccagtccctggggga

SEQ ID NO: 6725522 - DNA, 13 bp, Homo sapiens
ccagtccgccccg

SEQ ID NO: 6725523 - DNA, 14 bp, Homo sapiens
ccagtccgccccgt

SEQ ID NO: 6725524 - DNA, 20 bp, Homo sapiens
ccagtccgccccgtgctcct

SEQ ID NO: 6725525 - DNA, 19 bp, Homo sapiens
ccagtccgccgctgcacat

SEQ ID NO: 6725526 - DNA, 23 bp, Homo sapiens
ccagtcctagagctcctgtccct

SEQ ID NO: 6725527 - DNA, 20 bp, Homo sapiens
ccagtcctcacatgcccgct

SEQ ID NO: 6725528 - DNA, 22 bp, Homo sapiens
ccagtcctcacatgcccgctgt

SEQ ID NO: 6725529 - DNA, 14 bp, Homo sapiens
ccagtcctcactgt

SEQ ID NO: 6725530 - DNA, 18 bp, Homo sapiens
ccagtcctcactgtcctg

SEQ ID NO: 6725531 - DNA, 18 bp, Homo sapiens
ccagtcctccagaccacc

SEQ ID NO: 6725532 - DNA, 17 bp, Homo sapiens
ccagtcctccctagctc

SEQ ID NO: 6725533 - DNA, 17 bp, Homo sapiens
ccagtcctcctgggagc

SEQ ID NO: 6725534 - DNA, 15 bp, Homo sapiens
ccagtcctctgcctc

SEQ ID NO: 6725535 - DNA, 15 bp, Homo sapiens
ccagtcctgcccgcc

SEQ ID NO: 6725536 - DNA, 16 bp, Homo sapiens
ccagtcctgcctgaac

SEQ ID NO: 6725537 - DNA, 16 bp, Homo sapiens
ccagtcctgcctggcc

SEQ ID NO: 6725538 - DNA, 22 bp, Homo sapiens
ccagtcctgcctggccaggcag

SEQ ID NO: 6725539 - DNA, 11 bp, Homo sapiens
ccagtcctgct

SEQ ID NO: 6725540 - DNA, 12 bp, Homo sapiens
ccagtcctgcta

SEQ ID NO: 6725541 - DNA, 15 bp, Homo sapiens
ccagtcctgctacct

SEQ ID NO: 6725542 - DNA, 14 bp, Homo sapiens
ccagtcctgctgcc

SEQ ID NO: 6725543 - DNA, 17 bp, Homo sapiens
ccagtcctgctgcctgg

SEQ ID NO: 6725544 - DNA, 13 bp, Homo sapiens
ccagtcctgctgg

SEQ ID NO: 6725545 - DNA, 15 bp, Homo sapiens
ccagtcctgctggcc

SEQ ID NO: 6725546 - DNA, 12 bp, Homo sapiens
ccagtcctgggt

SEQ ID NO: 6725547 - DNA, 13 bp, Homo sapiens
ccagtcctgggtt

SEQ ID NO: 6725548 - DNA, 23 bp, Homo sapiens
ccagtcctgggttgtttccagga

SEQ ID NO: 6725549 - DNA, 13 bp, Homo sapiens
ccagtcctggtcc

SEQ ID NO: 6725550 - DNA, 23 bp, Homo sapiens
ccagtcctggtcctggctgcact

SEQ ID NO: 6725551 - DNA, 14 bp, Homo sapiens
ccagtcctggttgt

SEQ ID NO: 6725552 - DNA, 13 bp, Homo sapiens
ccagtcgacccca

SEQ ID NO: 6725553 - DNA, 17 bp, Homo sapiens
ccagtcgccctctgtgc

SEQ ID NO: 6725554 - DNA, 20 bp, Homo sapiens
ccagtcgccctctgtgccta

SEQ ID NO: 6725555 - DNA, 14 bp, Homo sapiens
ccagtcgcgctgcc

SEQ ID NO: 6725556 - DNA, 15 bp, Homo sapiens
ccagtcgcgctgcct

SEQ ID NO: 6725557 - DNA, 17 bp, Homo sapiens
ccagtcgcgctgcctgt

SEQ ID NO: 6725558 - DNA, 19 bp, Homo sapiens
ccagtcgcgctgcctgtgt

SEQ ID NO: 6725559 - DNA, 21 bp, Homo sapiens
ccagtcgcgctgcctgtgtgg

SEQ ID NO: 6725560 - DNA, 17 bp, Homo sapiens
ccagtcggccccatctc

SEQ ID NO: 6725561 - DNA, 21 bp, Homo sapiens
ccagtcgtccgctcagccaag

SEQ ID NO: 6725562 - DNA, 16 bp, Homo sapiens
ccagtctagtccgtcc

SEQ ID NO: 6725563 - DNA, 22 bp, Homo sapiens
ccagtctagtccgtcctggcac

SEQ ID NO: 6725564 - DNA, 15 bp, Homo sapiens
ccagtctcacccact

SEQ ID NO: 6725565 - DNA, 16 bp, Homo sapiens
ccagtctcagagacca

SEQ ID NO: 6725566 - DNA, 19 bp, Homo sapiens
ccagtctcagagaccagca

SEQ ID NO: 6725567 - DNA, 23 bp, Homo sapiens
ccagtctcagagaccagcactca

SEQ ID NO: 6725568 - DNA, 17 bp, Homo sapiens
ccagtctccccactcca

SEQ ID NO: 6725569 - DNA, 17 bp, Homo sapiens
ccagtctcctataccca

SEQ ID NO: 6725570 - DNA, 20 bp, Homo sapiens
ccagtctcctatacccagca

SEQ ID NO: 6725571 - DNA, 13 bp, Homo sapiens
ccagtctcctcac

SEQ ID NO: 6725572 - DNA, 15 bp, Homo sapiens
ccagtctcctcactc

SEQ ID NO: 6725573 - DNA, 17 bp, Homo sapiens
ccagtctcctcactctg

SEQ ID NO: 6725574 - DNA, 22 bp, Homo sapiens
ccagtctcctcactctgtccct

SEQ ID NO: 6725575 - DNA, 23 bp, Homo sapiens
ccagtctctgtcgtggagccatt

SEQ ID NO: 6725576 - DNA, 15 bp, Homo sapiens
ccagtctgaacctga

SEQ ID NO: 6725577 - DNA, 19 bp, Homo sapiens
ccagtctgaagtgcctact

SEQ ID NO: 6725578 - DNA, 23 bp, Homo sapiens
ccagtctgaagtgcctactgggg

SEQ ID NO: 6725579 - DNA, 17 bp, Homo sapiens
ccagtctgaagtttcat

SEQ ID NO: 6725580 - DNA, 13 bp, Homo sapiens
ccagtctgaccct

SEQ ID NO: 6725581 - DNA, 14 bp, Homo sapiens
ccagtctgctctca

SEQ ID NO: 6725582 - DNA, 22 bp, Homo sapiens
ccagtctgctgccctccatccc

SEQ ID NO: 6725583 - DNA, 22 bp, Homo sapiens
ccagtctggaagaagaggagga

SEQ ID NO: 6725584 - DNA, 12 bp, Homo sapiens
ccagtctgtgga

SEQ ID NO: 6725585 - DNA, 13 bp, Homo sapiens
ccagtctgttctc

SEQ ID NO: 6725586 - DNA, 18 bp, Homo sapiens
ccagtcttccacctggaa

SEQ ID NO: 6725587 - DNA, 15 bp, Homo sapiens
ccagtcttcctctta

SEQ ID NO: 6725588 - DNA, 22 bp, Homo sapiens
ccagtcttcctgacactttaat

SEQ ID NO: 6725589 - DNA, 12 bp, Homo sapiens
ccagtcttcctt

SEQ ID NO: 6725590 - DNA, 17 bp, Homo sapiens
ccagtcttccttgtctc

SEQ ID NO: 6725591 - DNA, 19 bp, Homo sapiens
ccagtcttccttgtctctg

SEQ ID NO: 6725592 - DNA, 21 bp, Homo sapiens
ccagtcttgagtgggccccct

SEQ ID NO: 6725593 - DNA, 12 bp, Homo sapiens
ccagtcttgcct

SEQ ID NO: 6725594 - DNA, 16 bp, Homo sapiens
ccagtcttgcctaggc

SEQ ID NO: 6725595 - DNA, 12 bp, Homo sapiens
ccagtcttgtgt

SEQ ID NO: 6725596 - DNA, 22 bp, Homo sapiens
ccagtctttaaaggcccagccc

SEQ ID NO: 6725597 - DNA, 23 bp, Homo sapiens
ccagtctttaaaggcccagcccc

SEQ ID NO: 6725598 - DNA, 20 bp, Homo sapiens
ccagtctttgaactgcagca

SEQ ID NO: 6725599 - DNA, 13 bp, Homo sapiens
ccagtcttttgtc

SEQ ID NO: 6725600 - DNA, 14 bp, Homo sapiens
ccagtgaaaactag

SEQ ID NO: 6725601 - DNA, 15 bp, Homo sapiens
ccagtgaaaactaga

SEQ ID NO: 6725602 - DNA, 14 bp, Homo sapiens
ccagtgaaactttt

SEQ ID NO: 6725603 - DNA, 21 bp, Homo sapiens
ccagtgaacattcccagccca

SEQ ID NO: 6725604 - DNA, 15 bp, Homo sapiens
ccagtgaaccaaaga

SEQ ID NO: 6725605 - DNA, 14 bp, Homo sapiens
ccagtgaactcctg

SEQ ID NO: 6725606 - DNA, 17 bp, Homo sapiens
ccagtgaaggagccacg

SEQ ID NO: 6725607 - DNA, 14 bp, Homo sapiens
ccagtgaagggttt

SEQ ID NO: 6725608 - DNA, 23 bp, Homo sapiens
ccagtgaattcttgaaggaaaat

SEQ ID NO: 6725609 - DNA, 12 bp, Homo sapiens
ccagtgaatttt

SEQ ID NO: 6725610 - DNA, 17 bp, Homo sapiens
ccagtgaatttttgcaa

SEQ ID NO: 6725611 - DNA, 20 bp, Homo sapiens
ccagtgaatttttgcaataa

SEQ ID NO: 6725612 - DNA, 22 bp, Homo sapiens
ccagtgaatttttgcaataatg

SEQ ID NO: 6725613 - DNA, 22 bp, Homo sapiens
ccagtgacaaagactcctctgg

SEQ ID NO: 6725614 - DNA, 23 bp, Homo sapiens
ccagtgacaaagactcctctggg

SEQ ID NO: 6725615 - DNA, 20 bp, Homo sapiens
ccagtgacacttcagagagc

SEQ ID NO: 6725616 - DNA, 18 bp, Homo sapiens
ccagtgacagtcagggaa

SEQ ID NO: 6725617 - DNA, 11 bp, Homo sapiens
ccagtgacatg

SEQ ID NO: 6725618 - DNA, 15 bp, Homo sapiens
ccagtgaccctggag

SEQ ID NO: 6725619 - DNA, 16 bp, Homo sapiens
ccagtgaccctggagc

SEQ ID NO: 6725620 - DNA, 13 bp, Homo sapiens
ccagtgacctgac

SEQ ID NO: 6725621 - DNA, 14 bp, Homo sapiens
ccagtgacctgacc

SEQ ID NO: 6725622 - DNA, 18 bp, Homo sapiens
ccagtgacctgctgggta

SEQ ID NO: 6725623 - DNA, 22 bp, Homo sapiens
ccagtgacctgctgggtaaact

SEQ ID NO: 6725624 - DNA, 12 bp, Homo sapiens
ccagtgacctgg

SEQ ID NO: 6725625 - DNA, 13 bp, Homo sapiens
ccagtgacgctgc

SEQ ID NO: 6725626 - DNA, 14 bp, Homo sapiens
ccagtgactccagg

SEQ ID NO: 6725627 - DNA, 15 bp, Homo sapiens
ccagtgactgctgcg

SEQ ID NO: 6725628 - DNA, 23 bp, Homo sapiens
ccagtgactgctgcgctgtgctg

SEQ ID NO: 6725629 - DNA, 21 bp, Homo sapiens
ccagtgacttaggaggctgag

SEQ ID NO: 6725630 - DNA, 17 bp, Homo sapiens
ccagtgacttgcaatcc

SEQ ID NO: 6725631 - DNA, 19 bp, Homo sapiens
ccagtgacttgttctgagt

SEQ ID NO: 6725632 - DNA, 20 bp, Homo sapiens
ccagtgacttgttctgagta

SEQ ID NO: 6725633 - DNA, 21 bp, Homo sapiens
ccagtgacttgttctgagtaa

SEQ ID NO: 6725634 - DNA, 15 bp, Homo sapiens
ccagtgagaagctga

SEQ ID NO: 6725635 - DNA, 20 bp, Homo sapiens
ccagtgagaagctgaggcct

SEQ ID NO: 6725636 - DNA, 21 bp, Homo sapiens
ccagtgagaagggcctgctct

SEQ ID NO: 6725637 - DNA, 21 bp, Homo sapiens
ccagtgagactgccccacgga

SEQ ID NO: 6725638 - DNA, 16 bp, Homo sapiens
ccagtgagagtgaggc

SEQ ID NO: 6725639 - DNA, 17 bp, Homo sapiens
ccagtgagatcaatgtg

SEQ ID NO: 6725640 - DNA, 18 bp, Homo sapiens
ccagtgagatcaatgtga

SEQ ID NO: 6725641 - DNA, 21 bp, Homo sapiens
ccagtgagatgagggatgggc

SEQ ID NO: 6725642 - DNA, 19 bp, Homo sapiens
ccagtgagcactcccaagt

SEQ ID NO: 6725643 - DNA, 16 bp, Homo sapiens
ccagtgagccctgctc

SEQ ID NO: 6725644 - DNA, 18 bp, Homo sapiens
ccagtgagccctgctctt

SEQ ID NO: 6725645 - DNA, 18 bp, Homo sapiens
ccagtgagcctctgcgcc

SEQ ID NO: 6725646 - DNA, 17 bp, Homo sapiens
ccagtgaggaaatggca

SEQ ID NO: 6725647 - DNA, 14 bp, Homo sapiens
ccagtgaggacctc

SEQ ID NO: 6725648 - DNA, 17 bp, Homo sapiens
ccagtgaggatgacagt

SEQ ID NO: 6725649 - DNA, 18 bp, Homo sapiens
ccagtgaggatgacagtg

SEQ ID NO: 6725650 - DNA, 23 bp, Homo sapiens
ccagtgaggcatctctctgggat

SEQ ID NO: 6725651 - DNA, 16 bp, Homo sapiens
ccagtgaggctctgcc

SEQ ID NO: 6725652 - DNA, 18 bp, Homo sapiens
ccagtgaggctctgccct

SEQ ID NO: 6725653 - DNA, 15 bp, Homo sapiens
ccagtgagggctggg

SEQ ID NO: 6725654 - DNA, 16 bp, Homo sapiens
ccagtgagggctgggc

SEQ ID NO: 6725655 - DNA, 17 bp, Homo sapiens
ccagtgagtacctgcaa

SEQ ID NO: 6725656 - DNA, 19 bp, Homo sapiens
ccagtgagtctctggggca

SEQ ID NO: 6725657 - DNA, 21 bp, Homo sapiens
ccagtgataatgccccaagga

SEQ ID NO: 6725658 - DNA, 23 bp, Homo sapiens
ccagtgataatgccccaaggaca

SEQ ID NO: 6725659 - DNA, 17 bp, Homo sapiens
ccagtgatctcgactcc

SEQ ID NO: 6725660 - DNA, 17 bp, Homo sapiens
ccagtgatggcattact

SEQ ID NO: 6725661 - DNA, 23 bp, Homo sapiens
ccagtgatggcattactctgcac

SEQ ID NO: 6725662 - DNA, 16 bp, Homo sapiens
ccagtgatgtgctgga

SEQ ID NO: 6725663 - DNA, 15 bp, Homo sapiens
ccagtgcaacagcac

SEQ ID NO: 6725664 - DNA, 14 bp, Homo sapiens
ccagtgcaagtgac

SEQ ID NO: 6725665 - DNA, 16 bp, Homo sapiens
ccagtgcaatctgtcc

SEQ ID NO: 6725666 - DNA, 21 bp, Homo sapiens
ccagtgcacagggaagggctt

SEQ ID NO: 6725667 - DNA, 15 bp, Homo sapiens
ccagtgcagaatgta

SEQ ID NO: 6725668 - DNA, 13 bp, Homo sapiens
ccagtgcagccac

SEQ ID NO: 6725669 - DNA, 14 bp, Homo sapiens
ccagtgcagccact

SEQ ID NO: 6725670 - DNA, 17 bp, Homo sapiens
ccagtgcagccactggc

SEQ ID NO: 6725671 - DNA, 13 bp, Homo sapiens
ccagtgcaggctg

SEQ ID NO: 6725672 - DNA, 17 bp, Homo sapiens
ccagtgcaggctggcca

SEQ ID NO: 6725673 - DNA, 20 bp, Homo sapiens
ccagtgcaggctggccagcc

SEQ ID NO: 6725674 - DNA, 17 bp, Homo sapiens
ccagtgcagtagtgcca

SEQ ID NO: 6725675 - DNA, 11 bp, Homo sapiens
ccagtgcagtc

SEQ ID NO: 6725676 - DNA, 19 bp, Homo sapiens
ccagtgcagttgtgatttc

SEQ ID NO: 6725677 - DNA, 20 bp, Homo sapiens
ccagtgcagttgtgatttct

SEQ ID NO: 6725678 - DNA, 23 bp, Homo sapiens
ccagtgcagtttggtgtgtcctc

SEQ ID NO: 6725679 - DNA, 19 bp, Homo sapiens
ccagtgcatatgcaatgta

SEQ ID NO: 6725680 - DNA, 21 bp, Homo sapiens
ccagtgcatcacatctgcaca

SEQ ID NO: 6725681 - DNA, 15 bp, Homo sapiens
ccagtgcatggtggc

SEQ ID NO: 6725682 - DNA, 18 bp, Homo sapiens
ccagtgccaaacttgggc

SEQ ID NO: 6725683 - DNA, 15 bp, Homo sapiens
ccagtgccacagaga

SEQ ID NO: 6725684 - DNA, 15 bp, Homo sapiens
ccagtgccacgcaca

SEQ ID NO: 6725685 - DNA, 22 bp, Homo sapiens
ccagtgccacgcacaggtgctg

SEQ ID NO: 6725686 - DNA, 15 bp, Homo sapiens
ccagtgccagcaagt

SEQ ID NO: 6725687 - DNA, 13 bp, Homo sapiens
ccagtgccagctc

SEQ ID NO: 6725688 - DNA, 17 bp, Homo sapiens
ccagtgccagctccagt

SEQ ID NO: 6725689 - DNA, 11 bp, Homo sapiens
ccagtgccagg

SEQ ID NO: 6725690 - DNA, 14 bp, Homo sapiens
ccagtgccaggaca

SEQ ID NO: 6725691 - DNA, 22 bp, Homo sapiens
ccagtgccaggacagctggctg

SEQ ID NO: 6725692 - DNA, 15 bp, Homo sapiens
ccagtgccagggtgg

SEQ ID NO: 6725693 - DNA, 23 bp, Homo sapiens
ccagtgccattccactccactca

SEQ ID NO: 6725694 - DNA, 19 bp, Homo sapiens
ccagtgcccaaagtctgtg

SEQ ID NO: 6725695 - DNA, 18 bp, Homo sapiens
ccagtgcccattcctcac

SEQ ID NO: 6725696 - DNA, 14 bp, Homo sapiens
ccagtgcccccact

SEQ ID NO: 6725697 - DNA, 16 bp, Homo sapiens
ccagtgcccccactga

SEQ ID NO: 6725698 - DNA, 21 bp, Homo sapiens
ccagtgcccggtgcagggcct

SEQ ID NO: 6725699 - DNA, 17 bp, Homo sapiens
ccagtgccctgagccag

SEQ ID NO: 6725700 - DNA, 24 bp, Homo sapiens
ccagtgccctgatcccagagagcc

SEQ ID NO: 6725701 - DNA, 15 bp, Homo sapiens
ccagtgccgcctgtg

SEQ ID NO: 6725702 - DNA, 17 bp, Homo sapiens
ccagtgccgcctgtgcc

SEQ ID NO: 6725703 - DNA, 17 bp, Homo sapiens
ccagtgccgctcctgct

SEQ ID NO: 6725704 - DNA, 18 bp, Homo sapiens
ccagtgccgctcctgctt

SEQ ID NO: 6725705 - DNA, 12 bp, Homo sapiens
ccagtgcctcag

SEQ ID NO: 6725706 - DNA, 19 bp, Homo sapiens
ccagtgcctcagtgctgca

SEQ ID NO: 6725707 - DNA, 14 bp, Homo sapiens
ccagtgcctgccac

SEQ ID NO: 6725708 - DNA, 15 bp, Homo sapiens
ccagtgcctgccact

SEQ ID NO: 6725709 - DNA, 16 bp, Homo sapiens
ccagtgcctgccactc

SEQ ID NO: 6725710 - DNA, 17 bp, Homo sapiens
ccagtgcctgccactct

SEQ ID NO: 6725711 - DNA, 23 bp, Homo sapiens
ccagtgcctgccactctctggga

SEQ ID NO: 6725712 - DNA, 15 bp, Homo sapiens
ccagtgcctgtctgg

SEQ ID NO: 6725713 - DNA, 19 bp, Homo sapiens
ccagtgccttacctcctgc

SEQ ID NO: 6725714 - DNA, 20 bp, Homo sapiens
ccagtgccttacctcctgcc

SEQ ID NO: 6725715 - DNA, 16 bp, Homo sapiens
ccagtgcgattctgga

SEQ ID NO: 6725716 - DNA, 19 bp, Homo sapiens
ccagtgcgctcgttccggt

SEQ ID NO: 6725717 - DNA, 18 bp, Homo sapiens
ccagtgcggacccttccc

SEQ ID NO: 6725718 - DNA, 14 bp, Homo sapiens
ccagtgcggcaggt

SEQ ID NO: 6725719 - DNA, 20 bp, Homo sapiens
ccagtgcggctgccaggttc

SEQ ID NO: 6725720 - DNA, 21 bp, Homo sapiens
ccagtgcggttcctcatctga

SEQ ID NO: 6725721 - DNA, 17 bp, Homo sapiens
ccagtgctacctctctc

SEQ ID NO: 6725722 - DNA, 20 bp, Homo sapiens
ccagtgctcacacaatcaga

SEQ ID NO: 6725723 - DNA, 18 bp, Homo sapiens
ccagtgctcaccagccct

SEQ ID NO: 6725724 - DNA, 16 bp, Homo sapiens
ccagtgctcagctgtg

SEQ ID NO: 6725725 - DNA, 21 bp, Homo sapiens
ccagtgctccagtttcccggt

SEQ ID NO: 6725726 - DNA, 17 bp, Homo sapiens
ccagtgctcctggccct

SEQ ID NO: 6725727 - DNA, 20 bp, Homo sapiens
ccagtgctctgcctcagacg

SEQ ID NO: 6725728 - DNA, 13 bp, Homo sapiens
ccagtgctgcatg

SEQ ID NO: 6725729 - DNA, 15 bp, Homo sapiens
ccagtgctgccatgc

SEQ ID NO: 6725730 - DNA, 16 bp, Homo sapiens
ccagtgctgccatgcc

SEQ ID NO: 6725731 - DNA, 19 bp, Homo sapiens
ccagtgctgcccatgagca

SEQ ID NO: 6725732 - DNA, 12 bp, Homo sapiens
ccagtgctgctt

SEQ ID NO: 6725733 - DNA, 15 bp, Homo sapiens
ccagtgctgcttctt

SEQ ID NO: 6725734 - DNA, 16 bp, Homo sapiens
ccagtgctggccacac

SEQ ID NO: 6725735 - DNA, 14 bp, Homo sapiens
ccagtgctggctgc

SEQ ID NO: 6725736 - DNA, 17 bp, Homo sapiens
ccagtgctggctgctgg

SEQ ID NO: 6725737 - DNA, 18 bp, Homo sapiens
ccagtgctggctgctggc

SEQ ID NO: 6725738 - DNA, 21 bp, Homo sapiens
ccagtgctgtccatgcttctc

SEQ ID NO: 6725739 - DNA, 12 bp, Homo sapiens
ccagtgcttctc

SEQ ID NO: 6725740 - DNA, 22 bp, Homo sapiens
ccagtgcttctccaacactgaa

SEQ ID NO: 6725741 - DNA, 14 bp, Homo sapiens
ccagtgcttggctg

SEQ ID NO: 6725742 - DNA, 16 bp, Homo sapiens
ccagtgcttggctgcc

SEQ ID NO: 6725743 - DNA, 19 bp, Homo sapiens
ccagtgctttatccacatt

SEQ ID NO: 6725744 - DNA, 24 bp, Homo sapiens
ccagtggaaggacactcttggctc

SEQ ID NO: 6725745 - DNA, 23 bp, Homo sapiens
ccagtggaaggagaatttaataa

SEQ ID NO: 6725746 - DNA, 19 bp, Homo sapiens
ccagtggaagttcttcaag

SEQ ID NO: 6725747 - DNA, 16 bp, Homo sapiens
ccagtggacctagcct

SEQ ID NO: 6725748 - DNA, 18 bp, Homo sapiens
ccagtggacctagcctgg

SEQ ID NO: 6725749 - DNA, 21 bp, Homo sapiens
ccagtggactcgcgagagggt

SEQ ID NO: 6725750 - DNA, 14 bp, Homo sapiens
ccagtggagcctgc

SEQ ID NO: 6725751 - DNA, 18 bp, Homo sapiens
ccagtggagcctgccgcc

SEQ ID NO: 6725752 - DNA, 16 bp, Homo sapiens
ccagtggaggtttgtc

SEQ ID NO: 6725753 - DNA, 14 bp, Homo sapiens
ccagtggattccca

SEQ ID NO: 6725754 - DNA, 12 bp, Homo sapiens
ccagtggcacag

SEQ ID NO: 6725755 - DNA, 22 bp, Homo sapiens
ccagtggcagggcacagggcct

SEQ ID NO: 6725756 - DNA, 20 bp, Homo sapiens
ccagtggcccccgggcctgc

SEQ ID NO: 6725757 - DNA, 23 bp, Homo sapiens
ccagtggcctcaaccctccctca

SEQ ID NO: 6725758 - DNA, 17 bp, Homo sapiens
ccagtggccttccccag

SEQ ID NO: 6725759 - DNA, 22 bp, Homo sapiens
ccagtggcggaagtgaccgcac

SEQ ID NO: 6725760 - DNA, 22 bp, Homo sapiens
ccagtggcgggtgatggccagc

SEQ ID NO: 6725761 - DNA, 18 bp, Homo sapiens
ccagtggctatggcctgt

SEQ ID NO: 6725762 - DNA, 19 bp, Homo sapiens
ccagtggctgctgcccagg

SEQ ID NO: 6725763 - DNA, 13 bp, Homo sapiens
ccagtggctgggg

SEQ ID NO: 6725764 - DNA, 15 bp, Homo sapiens
ccagtgggaactgtg

SEQ ID NO: 6725765 - DNA, 17 bp, Homo sapiens
ccagtgggaccacatgc

SEQ ID NO: 6725766 - DNA, 16 bp, Homo sapiens
ccagtgggacccacag

SEQ ID NO: 6725767 - DNA, 16 bp, Homo sapiens
ccagtgggaccctctc

SEQ ID NO: 6725768 - DNA, 11 bp, Homo sapiens
ccagtgggagg

SEQ ID NO: 6725769 - DNA, 17 bp, Homo sapiens
ccagtgggaggacagag

SEQ ID NO: 6725770 - DNA, 21 bp, Homo sapiens
ccagtgggaggacagagccgg

SEQ ID NO: 6725771 - DNA, 14 bp, Homo sapiens
ccagtgggaggcgc

SEQ ID NO: 6725772 - DNA, 20 bp, Homo sapiens
ccagtgggaggggcaggctg

SEQ ID NO: 6725773 - DNA, 19 bp, Homo sapiens
ccagtgggatgggacaggg

SEQ ID NO: 6725774 - DNA, 15 bp, Homo sapiens
ccagtgggcccggag

SEQ ID NO: 6725775 - DNA, 21 bp, Homo sapiens
ccagtgggcctggtagcacat

SEQ ID NO: 6725776 - DNA, 19 bp, Homo sapiens
ccagtgggcgggccatgag

SEQ ID NO: 6725777 - DNA, 13 bp, Homo sapiens
ccagtgggctgca

SEQ ID NO: 6725778 - DNA, 17 bp, Homo sapiens
ccagtgggctgcacgct

SEQ ID NO: 6725779 - DNA, 12 bp, Homo sapiens
ccagtgggctgt

SEQ ID NO: 6725780 - DNA, 15 bp, Homo sapiens
ccagtgggctgtgtt

SEQ ID NO: 6725781 - DNA, 22 bp, Homo sapiens
ccagtgggctgtgttgactgct

SEQ ID NO: 6725782 - DNA, 17 bp, Homo sapiens
ccagtggggaaaaaaag

SEQ ID NO: 6725783 - DNA, 19 bp, Homo sapiens
ccagtggggaactgagggc

SEQ ID NO: 6725784 - DNA, 21 bp, Homo sapiens
ccagtggggcctgaggctcct

SEQ ID NO: 6725785 - DNA, 15 bp, Homo sapiens
ccagtggggcctgtg

SEQ ID NO: 6725786 - DNA, 18 bp, Homo sapiens
ccagtggggcctgtggaa

SEQ ID NO: 6725787 - DNA, 16 bp, Homo sapiens
ccagtgggtctgggat

SEQ ID NO: 6725788 - DNA, 21 bp, Homo sapiens
ccagtgggtctggtggtgctg

SEQ ID NO: 6725789 - DNA, 15 bp, Homo sapiens
ccagtggtatcctgt

SEQ ID NO: 6725790 - DNA, 17 bp, Homo sapiens
ccagtggtctcacatgg

SEQ ID NO: 6725791 - DNA, 16 bp, Homo sapiens
ccagtggtgcgggcca

SEQ ID NO: 6725792 - DNA, 18 bp, Homo sapiens
ccagtggtgcgggccagg

SEQ ID NO: 6725793 - DNA, 14 bp, Homo sapiens
ccagtggttgctgt

SEQ ID NO: 6725794 - DNA, 20 bp, Homo sapiens
ccagtgtaaacttccgttca

SEQ ID NO: 6725795 - DNA, 16 bp, Homo sapiens
ccagtgtaatccccca

SEQ ID NO: 6725796 - DNA, 22 bp, Homo sapiens
ccagtgtaatcccccaggagaa

SEQ ID NO: 6725797 - DNA, 12 bp, Homo sapiens
ccagtgtacagg

SEQ ID NO: 6725798 - DNA, 15 bp, Homo sapiens
ccagtgtactgcttt

SEQ ID NO: 6725799 - DNA, 19 bp, Homo sapiens
ccagtgtagcatcttcctc

SEQ ID NO: 6725800 - DNA, 15 bp, Homo sapiens
ccagtgtagccttgc

SEQ ID NO: 6725801 - DNA, 19 bp, Homo sapiens
ccagtgtattttgtccaag

SEQ ID NO: 6725802 - DNA, 18 bp, Homo sapiens
ccagtgtccatggactca

SEQ ID NO: 6725803 - DNA, 13 bp, Homo sapiens
ccagtgtccatgt

SEQ ID NO: 6725804 - DNA, 14 bp, Homo sapiens
ccagtgtccccagg

SEQ ID NO: 6725805 - DNA, 20 bp, Homo sapiens
ccagtgtccccaggggcaca

SEQ ID NO: 6725806 - DNA, 13 bp, Homo sapiens
ccagtgtcctcca

SEQ ID NO: 6725807 - DNA, 22 bp, Homo sapiens
ccagtgtcctccaagtgccccc

SEQ ID NO: 6725808 - DNA, 23 bp, Homo sapiens
ccagtgtcctccaagtgccccct

SEQ ID NO: 6725809 - DNA, 17 bp, Homo sapiens
ccagtgtcctcccctca

SEQ ID NO: 6725810 - DNA, 23 bp, Homo sapiens
ccagtgtcctgagccccagggag

SEQ ID NO: 6725811 - DNA, 18 bp, Homo sapiens
ccagtgtcctgagctcag

SEQ ID NO: 6725812 - DNA, 19 bp, Homo sapiens
ccagtgtcctgagctcagc

SEQ ID NO: 6725813 - DNA, 20 bp, Homo sapiens
ccagtgtcctgagctcagcg

SEQ ID NO: 6725814 - DNA, 22 bp, Homo sapiens
ccagtgtctaccttcattttct

SEQ ID NO: 6725815 - DNA, 22 bp, Homo sapiens
ccagtgtctaggcactgagcag

SEQ ID NO: 6725816 - DNA, 22 bp, Homo sapiens
ccagtgtctgaaccaccctgga

SEQ ID NO: 6725817 - DNA, 23 bp, Homo sapiens
ccagtgtctggcccagccatggc

SEQ ID NO: 6725818 - DNA, 18 bp, Homo sapiens
ccagtgtctgtcccgggg

SEQ ID NO: 6725819 - DNA, 15 bp, Homo sapiens
ccagtgtcttcctgt

SEQ ID NO: 6725820 - DNA, 16 bp, Homo sapiens
ccagtgtctttctttg

SEQ ID NO: 6725821 - DNA, 10 bp, Homo sapiens
ccagtgtgaa

SEQ ID NO: 6725822 - DNA, 20 bp, Homo sapiens
ccagtgtgacaggaaagatt

SEQ ID NO: 6725823 - DNA, 21 bp, Homo sapiens
ccagtgtgcacccctccccat

SEQ ID NO: 6725824 - DNA, 21 bp, Homo sapiens
ccagtgtgcccaaaagccatg

SEQ ID NO: 6725825 - DNA, 19 bp, Homo sapiens
ccagtgtgctgatgggcgt

SEQ ID NO: 6725826 - DNA, 13 bp, Homo sapiens
ccagtgtggcccc

SEQ ID NO: 6725827 - DNA, 17 bp, Homo sapiens
ccagtgtggctgtctgc

SEQ ID NO: 6725828 - DNA, 22 bp, Homo sapiens
ccagtgtgggaatgcggcaaga

SEQ ID NO: 6725829 - DNA, 20 bp, Homo sapiens
ccagtgtgggcttgaccagg

SEQ ID NO: 6725830 - DNA, 15 bp, Homo sapiens
ccagtgtgtgctcag

SEQ ID NO: 6725831 - DNA, 17 bp, Homo sapiens
ccagtgtgtgctcagca

SEQ ID NO: 6725832 - DNA, 20 bp, Homo sapiens
ccagtgtgtgctcagcagcc

SEQ ID NO: 6725833 - DNA, 23 bp, Homo sapiens
ccagtgtgtggctttcagagcct

SEQ ID NO: 6725834 - DNA, 16 bp, Homo sapiens
ccagtgtgtgggggag

SEQ ID NO: 6725835 - DNA, 12 bp, Homo sapiens
ccagtgttagct

SEQ ID NO: 6725836 - DNA, 17 bp, Homo sapiens
ccagtgttagggaaggg

SEQ ID NO: 6725837 - DNA, 20 bp, Homo sapiens
ccagtgttcctgaagctgct

SEQ ID NO: 6725838 - DNA, 18 bp, Homo sapiens
ccagtgttctatgaacaa

SEQ ID NO: 6725839 - DNA, 20 bp, Homo sapiens
ccagtgttctatttgcttta

SEQ ID NO: 6725840 - DNA, 19 bp, Homo sapiens
ccagtgttgcctcctccca

SEQ ID NO: 6725841 - DNA, 21 bp, Homo sapiens
ccagtgttggctgtgtgacag

SEQ ID NO: 6725842 - DNA, 18 bp, Homo sapiens
ccagtgttgtgggcttcc

SEQ ID NO: 6725843 - DNA, 15 bp, Homo sapiens
ccagtgttgtttgta

SEQ ID NO: 6725844 - DNA, 18 bp, Homo sapiens
ccagtgttgtttgtaaat

SEQ ID NO: 6725845 - DNA, 13 bp, Homo sapiens
ccagtgtttaaaa

SEQ ID NO: 6725846 - DNA, 19 bp, Homo sapiens
ccagtgtttagaagagcct

SEQ ID NO: 6725847 - DNA, 13 bp, Homo sapiens
ccagtgtttctga

SEQ ID NO: 6725848 - DNA, 12 bp, Homo sapiens
ccagtgttttct

SEQ ID NO: 6725849 - DNA, 23 bp, Homo sapiens
ccagtgtttttcttcatgtgcaa

SEQ ID NO: 6725850 - DNA, 13 bp, Homo sapiens
ccagttaaagcca

SEQ ID NO: 6725851 - DNA, 14 bp, Homo sapiens
ccagttaaagccac

SEQ ID NO: 6725852 - DNA, 22 bp, Homo sapiens
ccagttaacgtattagttgcca

SEQ ID NO: 6725853 - DNA, 21 bp, Homo sapiens
ccagttaaggaccgtggccct

SEQ ID NO: 6725854 - DNA, 21 bp, Homo sapiens
ccagttaatactccagagaca

SEQ ID NO: 6725855 - DNA, 17 bp, Homo sapiens
ccagttaatcttgcttt

SEQ ID NO: 6725856 - DNA, 22 bp, Homo sapiens
ccagttacaggggttgttttta

SEQ ID NO: 6725857 - DNA, 18 bp, Homo sapiens
ccagttacccaaaatctg

SEQ ID NO: 6725858 - DNA, 21 bp, Homo sapiens
ccagttacctttgctgtcact

SEQ ID NO: 6725859 - DNA, 16 bp, Homo sapiens
ccagttacttgggctt

SEQ ID NO: 6725860 - DNA, 17 bp, Homo sapiens
ccagttacttgggcttc

SEQ ID NO: 6725861 - DNA, 23 bp, Homo sapiens
ccagttactttccaattctcctt

SEQ ID NO: 6725862 - DNA, 21 bp, Homo sapiens
ccagttagactagtccccggt

SEQ ID NO: 6725863 - DNA, 23 bp, Homo sapiens
ccagttagagcccattaatcttg

SEQ ID NO: 6725864 - DNA, 19 bp, Homo sapiens
ccagttagcccggccaagg

SEQ ID NO: 6725865 - DNA, 21 bp, Homo sapiens
ccagttagcccggccaaggac

SEQ ID NO: 6725866 - DNA, 20 bp, Homo sapiens
ccagttagtaaacttcctat

SEQ ID NO: 6725867 - DNA, 22 bp, Homo sapiens
ccagttagttagaattggaaat

SEQ ID NO: 6725868 - DNA, 18 bp, Homo sapiens
ccagttatgtttgaatga

SEQ ID NO: 6725869 - DNA, 11 bp, Homo sapiens
ccagttatttt

SEQ ID NO: 6725870 - DNA, 20 bp, Homo sapiens
ccagttattttccgccctca

SEQ ID NO: 6725871 - DNA, 15 bp, Homo sapiens
ccagttcaaagtgta

SEQ ID NO: 6725872 - DNA, 19 bp, Homo sapiens
ccagttcaaagtgtatatt

SEQ ID NO: 6725873 - DNA, 21 bp, Homo sapiens
ccagttcacttctttgcagag

SEQ ID NO: 6725874 - DNA, 19 bp, Homo sapiens
ccagttcaggaatttttgt

SEQ ID NO: 6725875 - DNA, 18 bp, Homo sapiens
ccagttcaggagtcccaa

SEQ ID NO: 6725876 - DNA, 21 bp, Homo sapiens
ccagttcaggagtcccaagga

SEQ ID NO: 6725877 - DNA, 19 bp, Homo sapiens
ccagttcatcaccatttcc

SEQ ID NO: 6725878 - DNA, 18 bp, Homo sapiens
ccagttcatctctgctga

SEQ ID NO: 6725879 - DNA, 12 bp, Homo sapiens
ccagttcatctt

SEQ ID NO: 6725880 - DNA, 15 bp, Homo sapiens
ccagttccacagcag

SEQ ID NO: 6725881 - DNA, 18 bp, Homo sapiens
ccagttccagcttcatct

SEQ ID NO: 6725882 - DNA, 14 bp, Homo sapiens
ccagttccaggaca

SEQ ID NO: 6725883 - DNA, 16 bp, Homo sapiens
ccagttccagttccca

SEQ ID NO: 6725884 - DNA, 17 bp, Homo sapiens
ccagttccctccctcaa

SEQ ID NO: 6725885 - DNA, 17 bp, Homo sapiens
ccagttcctagcactgc

SEQ ID NO: 6725886 - DNA, 21 bp, Homo sapiens
ccagttcctagcactgcccca

SEQ ID NO: 6725887 - DNA, 19 bp, Homo sapiens
ccagttcctatgacacagt

SEQ ID NO: 6725888 - DNA, 20 bp, Homo sapiens
ccagttcctgctctctgctc

SEQ ID NO: 6725889 - DNA, 24 bp, Homo sapiens
ccagttcctgctctctgctcatgg

SEQ ID NO: 6725890 - DNA, 21 bp, Homo sapiens
ccagttcctttcaatggtttg

SEQ ID NO: 6725891 - DNA, 22 bp, Homo sapiens
ccagttcctttcaatggtttgc

SEQ ID NO: 6725892 - DNA, 23 bp, Homo sapiens
ccagttcctttcaatggtttgca

SEQ ID NO: 6725893 - DNA, 13 bp, Homo sapiens
ccagttctctttg

SEQ ID NO: 6725894 - DNA, 16 bp, Homo sapiens
ccagttctctttgtaa

SEQ ID NO: 6725895 - DNA, 18 bp, Homo sapiens
ccagttctgaataacttg

SEQ ID NO: 6725896 - DNA, 13 bp, Homo sapiens
ccagttctgatga

SEQ ID NO: 6725897 - DNA, 13 bp, Homo sapiens
ccagttctgctcc

SEQ ID NO: 6725898 - DNA, 17 bp, Homo sapiens
ccagttctgctcctctc

SEQ ID NO: 6725899 - DNA, 19 bp, Homo sapiens
ccagttctgctcctctcca

SEQ ID NO: 6725900 - DNA, 20 bp, Homo sapiens
ccagttctgctcctctccag

SEQ ID NO: 6725901 - DNA, 22 bp, Homo sapiens
ccagttctggccaggagctgga

SEQ ID NO: 6725902 - DNA, 23 bp, Homo sapiens
ccagttctggggcccgcctgcca

SEQ ID NO: 6725903 - DNA, 18 bp, Homo sapiens
ccagttcttcctgcaacc

SEQ ID NO: 6725904 - DNA, 21 bp, Homo sapiens
ccagttcttcctgcaaccact

SEQ ID NO: 6725905 - DNA, 16 bp, Homo sapiens
ccagttcttgcaataa

SEQ ID NO: 6725906 - DNA, 21 bp, Homo sapiens
ccagttcttgcaataagatat

SEQ ID NO: 6725907 - DNA, 21 bp, Homo sapiens
ccagttgaactgcaggaagag

SEQ ID NO: 6725908 - DNA, 17 bp, Homo sapiens
ccagttgaataaaagtg

SEQ ID NO: 6725909 - DNA, 18 bp, Homo sapiens
ccagttgaataaaagtgc

SEQ ID NO: 6725910 - DNA, 16 bp, Homo sapiens
ccagttgatctgctct

SEQ ID NO: 6725911 - DNA, 19 bp, Homo sapiens
ccagttgcagtcactctag

SEQ ID NO: 6725912 - DNA, 22 bp, Homo sapiens
ccagttgccaaagttttgctgt

SEQ ID NO: 6725913 - DNA, 13 bp, Homo sapiens
ccagttgcccaga

SEQ ID NO: 6725914 - DNA, 21 bp, Homo sapiens
ccagttgcccagatgaactgg

SEQ ID NO: 6725915 - DNA, 18 bp, Homo sapiens
ccagttgcgtgtctgttt

SEQ ID NO: 6725916 - DNA, 13 bp, Homo sapiens
ccagttgctgtca

SEQ ID NO: 6725917 - DNA, 13 bp, Homo sapiens
ccagttggaaaat

SEQ ID NO: 6725918 - DNA, 13 bp, Homo sapiens
ccagttggacaca

SEQ ID NO: 6725919 - DNA, 21 bp, Homo sapiens
ccagttggactgtggcctcag

SEQ ID NO: 6725920 - DNA, 23 bp, Homo sapiens
ccagttggactgtggcctcagga

SEQ ID NO: 6725921 - DNA, 17 bp, Homo sapiens
ccagttggatctctggt

SEQ ID NO: 6725922 - DNA, 15 bp, Homo sapiens
ccagttggcagacag

SEQ ID NO: 6725923 - DNA, 19 bp, Homo sapiens
ccagttggcagacagccgt

SEQ ID NO: 6725924 - DNA, 19 bp, Homo sapiens
ccagttggcttctgtgcct

SEQ ID NO: 6725925 - DNA, 14 bp, Homo sapiens
ccagttggggctgc

SEQ ID NO: 6725926 - DNA, 18 bp, Homo sapiens
ccagttggtcccccttcc

SEQ ID NO: 6725927 - DNA, 20 bp, Homo sapiens
ccagttggtcccccttccat

SEQ ID NO: 6725928 - DNA, 23 bp, Homo sapiens
ccagttggtcccccttccatgga

SEQ ID NO: 6725929 - DNA, 13 bp, Homo sapiens
ccagttggtgact

SEQ ID NO: 6725930 - DNA, 15 bp, Homo sapiens
ccagttggtggggcc

SEQ ID NO: 6725931 - DNA, 19 bp, Homo sapiens
ccagttggtggggccaggc

SEQ ID NO: 6725932 - DNA, 20 bp, Homo sapiens
ccagttggtggggccaggcc

SEQ ID NO: 6725933 - DNA, 18 bp, Homo sapiens
ccagttggttatctgaat

SEQ ID NO: 6725934 - DNA, 18 bp, Homo sapiens
ccagttgtatattattct

SEQ ID NO: 6725935 - DNA, 22 bp, Homo sapiens
ccagttgtcccgattgtaactc

SEQ ID NO: 6725936 - DNA, 12 bp, Homo sapiens
ccagttgtcctc

SEQ ID NO: 6725937 - DNA, 16 bp, Homo sapiens
ccagttgtcctccttc

SEQ ID NO: 6725938 - DNA, 18 bp, Homo sapiens
ccagtttaacctgatgca

SEQ ID NO: 6725939 - DNA, 21 bp, Homo sapiens
ccagtttaagccgcagacctg

SEQ ID NO: 6725940 - DNA, 18 bp, Homo sapiens
ccagtttattccagagct

SEQ ID NO: 6725941 - DNA, 17 bp, Homo sapiens
ccagtttattctgtggt

SEQ ID NO: 6725942 - DNA, 22 bp, Homo sapiens
ccagtttcagaagcaggcaggg

SEQ ID NO: 6725943 - DNA, 23 bp, Homo sapiens
ccagtttcccaaaaaccccagtg

SEQ ID NO: 6725944 - DNA, 22 bp, Homo sapiens
ccagtttccccatggggctgcg

SEQ ID NO: 6725945 - DNA, 12 bp, Homo sapiens
ccagtttctgcc

SEQ ID NO: 6725946 - DNA, 14 bp, Homo sapiens
ccagtttctgcctc

SEQ ID NO: 6725947 - DNA, 11 bp, Homo sapiens
ccagtttctta

SEQ ID NO: 6725948 - DNA, 20 bp, Homo sapiens
ccagtttcttttcttttgtt

SEQ ID NO: 6725949 - DNA, 23 bp, Homo sapiens
ccagtttgcagaaaagcacctgc

SEQ ID NO: 6725950 - DNA, 13 bp, Homo sapiens
ccagtttgcagag

SEQ ID NO: 6725951 - DNA, 15 bp, Homo sapiens
ccagtttgcatgatt

SEQ ID NO: 6725952 - DNA, 20 bp, Homo sapiens
ccagtttgggtaaaatactt

SEQ ID NO: 6725953 - DNA, 22 bp, Homo sapiens
ccagtttgggtaaaatactttt

SEQ ID NO: 6725954 - DNA, 18 bp, Homo sapiens
ccagttttatccataatg

SEQ ID NO: 6725955 - DNA, 12 bp, Homo sapiens
ccagttttcatt

SEQ ID NO: 6725956 - DNA, 15 bp, Homo sapiens
ccagttttccctgga

SEQ ID NO: 6725957 - DNA, 11 bp, Homo sapiens
ccagttttccg

SEQ ID NO: 6725958 - DNA, 21 bp, Homo sapiens
ccagttttccgaagtctctga

SEQ ID NO: 6725959 - DNA, 22 bp, Homo sapiens
ccagttttccgaagtctctgat

SEQ ID NO: 6725960 - DNA, 15 bp, Homo sapiens
ccagttttgcctgag

SEQ ID NO: 6725961 - DNA, 15 bp, Homo sapiens
ccagtttttgaggag

SEQ ID NO: 6725962 - DNA, 17 bp, Homo sapiens
ccagtttttgcagagaa

SEQ ID NO: 6725963 - DNA, 16 bp, Homo sapiens
ccagtttttgtttttg

SEQ ID NO: 6725964 - DNA, 21 bp, Homo sapiens
ccagtttttgtttttgcatga

SEQ ID NO: 6725965 - DNA, 23 bp, Homo sapiens
ccataaaaaggaacaagactgac

SEQ ID NO: 6725966 - DNA, 15 bp, Homo sapiens
ccataaaagaagttt

SEQ ID NO: 6725967 - DNA, 11 bp, Homo sapiens
ccataaaataa

SEQ ID NO: 6725968 - DNA, 15 bp, Homo sapiens
ccataaacagcacac

SEQ ID NO: 6725969 - DNA, 19 bp, Homo sapiens
ccataaaccaataaaacaa

SEQ ID NO: 6725970 - DNA, 14 bp, Homo sapiens
ccataaaccacctc

SEQ ID NO: 6725971 - DNA, 17 bp, Homo sapiens
ccataaacggttcctgg

SEQ ID NO: 6725972 - DNA, 18 bp, Homo sapiens
ccataaacggttcctggt

SEQ ID NO: 6725973 - DNA, 22 bp, Homo sapiens
ccataaacggttcctggtgact

SEQ ID NO: 6725974 - DNA, 20 bp, Homo sapiens
ccataaactaagagaaactg

SEQ ID NO: 6725975 - DNA, 14 bp, Homo sapiens
ccataaacttcatg

SEQ ID NO: 6725976 - DNA, 19 bp, Homo sapiens
ccataaagaagatgtttaa

SEQ ID NO: 6725977 - DNA, 19 bp, Homo sapiens
ccataaagacaatcactgc

SEQ ID NO: 6725978 - DNA, 14 bp, Homo sapiens
ccataaagccttta

SEQ ID NO: 6725979 - DNA, 23 bp, Homo sapiens
ccataaagggtgtaggggccacc

SEQ ID NO: 6725980 - DNA, 17 bp, Homo sapiens
ccataaagtctgagaaa

SEQ ID NO: 6725981 - DNA, 18 bp, Homo sapiens
ccataaagtctgagaaat

SEQ ID NO: 6725982 - DNA, 13 bp, Homo sapiens
ccataacacttga

SEQ ID NO: 6725983 - DNA, 13 bp, Homo sapiens
ccataacagccaa

SEQ ID NO: 6725984 - DNA, 15 bp, Homo sapiens
ccataacagccaaca

SEQ ID NO: 6725985 - DNA, 16 bp, Homo sapiens
ccataaccgctgattc

SEQ ID NO: 6725986 - DNA, 16 bp, Homo sapiens
ccataacgtgccccca

SEQ ID NO: 6725987 - DNA, 17 bp, Homo sapiens
ccataacgtgcccccag

SEQ ID NO: 6725988 - DNA, 15 bp, Homo sapiens
ccataactaccagga

SEQ ID NO: 6725989 - DNA, 17 bp, Homo sapiens
ccataactgacaagaga

SEQ ID NO: 6725990 - DNA, 21 bp, Homo sapiens
ccataacttacctctgcttct

SEQ ID NO: 6725991 - DNA, 20 bp, Homo sapiens
ccataagagaaacctgccaa

SEQ ID NO: 6725992 - DNA, 18 bp, Homo sapiens
ccataagaggagtaggcc

SEQ ID NO: 6725993 - DNA, 19 bp, Homo sapiens
ccataagcaacaattttca

SEQ ID NO: 6725994 - DNA, 15 bp, Homo sapiens
ccataagccctgaga

SEQ ID NO: 6725995 - DNA, 16 bp, Homo sapiens
ccataagccctgagac

SEQ ID NO: 6725996 - DNA, 19 bp, Homo sapiens
ccataagccctgagactcc

SEQ ID NO: 6725997 - DNA, 23 bp, Homo sapiens
ccataagtaatatttaaagatta

SEQ ID NO: 6725998 - DNA, 22 bp, Homo sapiens
ccataagtgacaccaataaatg

SEQ ID NO: 6725999 - DNA, 22 bp, Homo sapiens
ccataagtttaactttaaaact

SEQ ID NO: 6726000 - DNA, 12 bp, Homo sapiens
ccataataaagc

SEQ ID NO: 6726001 - DNA, 13 bp, Homo sapiens
ccataataaagca

SEQ ID NO: 6726002 - DNA, 14 bp, Homo sapiens
ccataataaaggtt

SEQ ID NO: 6726003 - DNA, 16 bp, Homo sapiens
ccataataaccctgcc

SEQ ID NO: 6726004 - DNA, 19 bp, Homo sapiens
ccataataaccctgccagt

SEQ ID NO: 6726005 - DNA, 20 bp, Homo sapiens
ccataataaccctgccagtg

SEQ ID NO: 6726006 - DNA, 18 bp, Homo sapiens
ccataatatgatgcaaac

SEQ ID NO: 6726007 - DNA, 14 bp, Homo sapiens
ccataatcctagcc

SEQ ID NO: 6726008 - DNA, 14 bp, Homo sapiens
ccataatctggact

SEQ ID NO: 6726009 - DNA, 14 bp, Homo sapiens
ccataatgatggat

SEQ ID NO: 6726010 - DNA, 13 bp, Homo sapiens
ccataatgccact

SEQ ID NO: 6726011 - DNA, 23 bp, Homo sapiens
ccataatgcttctttcctcttaa

SEQ ID NO: 6726012 - DNA, 13 bp, Homo sapiens
ccataatgtcttt

SEQ ID NO: 6726013 - DNA, 15 bp, Homo sapiens
ccataatgttcctta

SEQ ID NO: 6726014 - DNA, 20 bp, Homo sapiens
ccataattatgaaaactcat

SEQ ID NO: 6726015 - DNA, 20 bp, Homo sapiens
ccataattgctttgccaaaa

SEQ ID NO: 6726016 - DNA, 21 bp, Homo sapiens
ccatacaatgactagtcacct

SEQ ID NO: 6726017 - DNA, 23 bp, Homo sapiens
ccatacaatgactagtcacctgg

SEQ ID NO: 6726018 - DNA, 14 bp, Homo sapiens
ccatacaatgtatg

SEQ ID NO: 6726019 - DNA, 18 bp, Homo sapiens
ccatacaatgtatgtaca

SEQ ID NO: 6726020 - DNA, 15 bp, Homo sapiens
ccatacaatttcatc

SEQ ID NO: 6726021 - DNA, 13 bp, Homo sapiens
ccatacacacaca

SEQ ID NO: 6726022 - DNA, 15 bp, Homo sapiens
ccatacacacacaaa

SEQ ID NO: 6726023 - DNA, 18 bp, Homo sapiens
ccatacacacacaaacca

SEQ ID NO: 6726024 - DNA, 20 bp, Homo sapiens
ccatacacacgctgccttcg

SEQ ID NO: 6726025 - DNA, 12 bp, Homo sapiens
ccatacacagag

SEQ ID NO: 6726026 - DNA, 20 bp, Homo sapiens
ccatacactttgttgcaaga

SEQ ID NO: 6726027 - DNA, 14 bp, Homo sapiens
ccatacagacagca

SEQ ID NO: 6726028 - DNA, 15 bp, Homo sapiens
ccatacagagtaaat

SEQ ID NO: 6726029 - DNA, 13 bp, Homo sapiens
ccatacagcctct

SEQ ID NO: 6726030 - DNA, 14 bp, Homo sapiens
ccatacagcctcta

SEQ ID NO: 6726031 - DNA, 14 bp, Homo sapiens
ccatacatttgtgt

SEQ ID NO: 6726032 - DNA, 20 bp, Homo sapiens
ccataccatcactgagtggc

SEQ ID NO: 6726033 - DNA, 18 bp, Homo sapiens
ccataccccctgccccag

SEQ ID NO: 6726034 - DNA, 14 bp, Homo sapiens
ccatacccctgcct

SEQ ID NO: 6726035 - DNA, 18 bp, Homo sapiens
ccatacccctgcctgggt

SEQ ID NO: 6726036 - DNA, 20 bp, Homo sapiens
ccataccccttattgctgcc

SEQ ID NO: 6726037 - DNA, 16 bp, Homo sapiens
ccataccgaccatcgt

SEQ ID NO: 6726038 - DNA, 15 bp, Homo sapiens
ccataccgctgggga

SEQ ID NO: 6726039 - DNA, 20 bp, Homo sapiens
ccataccgctggggaacaga

SEQ ID NO: 6726040 - DNA, 23 bp, Homo sapiens
ccatacctgcccctgcctgacag

SEQ ID NO: 6726041 - DNA, 14 bp, Homo sapiens
ccataccttctccc

SEQ ID NO: 6726042 - DNA, 15 bp, Homo sapiens
ccataccttctccca

SEQ ID NO: 6726043 - DNA, 16 bp, Homo sapiens
ccataccttctcccag

SEQ ID NO: 6726044 - DNA, 17 bp, Homo sapiens
ccataccttctcccagg

SEQ ID NO: 6726045 - DNA, 18 bp, Homo sapiens
ccataccttctcccaggc

SEQ ID NO: 6726046 - DNA, 20 bp, Homo sapiens
ccataccttctcccaggcct

SEQ ID NO: 6726047 - DNA, 13 bp, Homo sapiens
ccataccttgaga

SEQ ID NO: 6726048 - DNA, 14 bp, Homo sapiens
ccatactcatttct

SEQ ID NO: 6726049 - DNA, 15 bp, Homo sapiens
ccatactcatttcta

SEQ ID NO: 6726050 - DNA, 17 bp, Homo sapiens
ccatactccactccaag

SEQ ID NO: 6726051 - DNA, 17 bp, Homo sapiens
ccatactgagcctgcca

SEQ ID NO: 6726052 - DNA, 13 bp, Homo sapiens
ccatactggcctc

SEQ ID NO: 6726053 - DNA, 14 bp, Homo sapiens
ccatactggcctcg

SEQ ID NO: 6726054 - DNA, 18 bp, Homo sapiens
ccatactggcctcgcctg

SEQ ID NO: 6726055 - DNA, 22 bp, Homo sapiens
ccatactggcctcgcctggcct

SEQ ID NO: 6726056 - DNA, 19 bp, Homo sapiens
ccatactgtctctggagtg

SEQ ID NO: 6726057 - DNA, 17 bp, Homo sapiens
ccatactgtttaatatt

SEQ ID NO: 6726058 - DNA, 13 bp, Homo sapiens
ccatacttcctgg

SEQ ID NO: 6726059 - DNA, 15 bp, Homo sapiens
ccatacttcctggga

SEQ ID NO: 6726060 - DNA, 13 bp, Homo sapiens
ccatacttctctc

SEQ ID NO: 6726061 - DNA, 23 bp, Homo sapiens
ccatacttgcatacaccactgca

SEQ ID NO: 6726062 - DNA, 14 bp, Homo sapiens
ccatacttgttctg

SEQ ID NO: 6726063 - DNA, 15 bp, Homo sapiens
ccatacttgttctgt

SEQ ID NO: 6726064 - DNA, 19 bp, Homo sapiens
ccatactttgtctgaaaaa

SEQ ID NO: 6726065 - DNA, 17 bp, Homo sapiens
ccatacttttgagaggg

SEQ ID NO: 6726066 - DNA, 22 bp, Homo sapiens
ccatacttttggctcctctagt

SEQ ID NO: 6726067 - DNA, 16 bp, Homo sapiens
ccatagaaacatgaca

SEQ ID NO: 6726068 - DNA, 17 bp, Homo sapiens
ccatagaaacatgacac

SEQ ID NO: 6726069 - DNA, 20 bp, Homo sapiens
ccatagaaacatgacactga

SEQ ID NO: 6726070 - DNA, 12 bp, Homo sapiens
ccatagaacaga

SEQ ID NO: 6726071 - DNA, 18 bp, Homo sapiens
ccatagaatggcacatgt

SEQ ID NO: 6726072 - DNA, 19 bp, Homo sapiens
ccatagaatggcacatgtc

SEQ ID NO: 6726073 - DNA, 12 bp, Homo sapiens
ccatagacacag

SEQ ID NO: 6726074 - DNA, 16 bp, Homo sapiens
ccatagagaccaggag

SEQ ID NO: 6726075 - DNA, 13 bp, Homo sapiens
ccatagaggccca

SEQ ID NO: 6726076 - DNA, 20 bp, Homo sapiens
ccatagagtacactgcctgc

SEQ ID NO: 6726077 - DNA, 16 bp, Homo sapiens
ccatagatataaagcc

SEQ ID NO: 6726078 - DNA, 15 bp, Homo sapiens
ccatagatcttctga

SEQ ID NO: 6726079 - DNA, 16 bp, Homo sapiens
ccatagatcttctgaa

SEQ ID NO: 6726080 - DNA, 17 bp, Homo sapiens
ccatagatcttctgaaa

SEQ ID NO: 6726081 - DNA, 14 bp, Homo sapiens
ccatagatgctggc

SEQ ID NO: 6726082 - DNA, 17 bp, Homo sapiens
ccatagatgctggctgg

SEQ ID NO: 6726083 - DNA, 21 bp, Homo sapiens
ccatagatgggtctggctgag

SEQ ID NO: 6726084 - DNA, 12 bp, Homo sapiens
ccatagatttat

SEQ ID NO: 6726085 - DNA, 17 bp, Homo sapiens
ccatagatttattttac

SEQ ID NO: 6726086 - DNA, 21 bp, Homo sapiens
ccatagatttattttacattt

SEQ ID NO: 6726087 - DNA, 18 bp, Homo sapiens
ccatagcacaagataaat

SEQ ID NO: 6726088 - DNA, 20 bp, Homo sapiens
ccatagcacaagataaattg

SEQ ID NO: 6726089 - DNA, 13 bp, Homo sapiens
ccatagcaccctg

SEQ ID NO: 6726090 - DNA, 17 bp, Homo sapiens
ccatagcataatatgaa

SEQ ID NO: 6726091 - DNA, 15 bp, Homo sapiens
ccatagcgctggctc

SEQ ID NO: 6726092 - DNA, 16 bp, Homo sapiens
ccatagcgctggctca

SEQ ID NO: 6726093 - DNA, 17 bp, Homo sapiens
ccatagcgctggctcag

SEQ ID NO: 6726094 - DNA, 15 bp, Homo sapiens
ccatagctactatat

SEQ ID NO: 6726095 - DNA, 17 bp, Homo sapiens
ccatagctcaataaaag

SEQ ID NO: 6726096 - DNA, 18 bp, Homo sapiens
ccatagctcttcacttcc

SEQ ID NO: 6726097 - DNA, 20 bp, Homo sapiens
ccatagctcttcacttcctc

SEQ ID NO: 6726098 - DNA, 22 bp, Homo sapiens
ccatagctcttcacttcctcca

SEQ ID NO: 6726099 - DNA, 16 bp, Homo sapiens
ccatagctgatcatgt

SEQ ID NO: 6726100 - DNA, 15 bp, Homo sapiens
ccatagctgtggtgt

SEQ ID NO: 6726101 - DNA, 21 bp, Homo sapiens
ccataggaagacataaaactt

SEQ ID NO: 6726102 - DNA, 20 bp, Homo sapiens
ccataggaaggctgtgataa

SEQ ID NO: 6726103 - DNA, 14 bp, Homo sapiens
ccataggacatact

SEQ ID NO: 6726104 - DNA, 17 bp, Homo sapiens
ccataggactaccgcag

SEQ ID NO: 6726105 - DNA, 18 bp, Homo sapiens
ccataggactaccgcagg

SEQ ID NO: 6726106 - DNA, 23 bp, Homo sapiens
ccataggcccacacacaggtggt

SEQ ID NO: 6726107 - DNA, 13 bp, Homo sapiens
ccataggcccagt

SEQ ID NO: 6726108 - DNA, 18 bp, Homo sapiens
ccataggctgtgtttaca

SEQ ID NO: 6726109 - DNA, 16 bp, Homo sapiens
ccatagggggctgcac

SEQ ID NO: 6726110 - DNA, 19 bp, Homo sapiens
ccatagggtcggaggtgct

SEQ ID NO: 6726111 - DNA, 16 bp, Homo sapiens
ccatagtaacaccaag

SEQ ID NO: 6726112 - DNA, 18 bp, Homo sapiens
ccatagtaactgacatga

SEQ ID NO: 6726113 - DNA, 15 bp, Homo sapiens
ccatagtaccattta

SEQ ID NO: 6726114 - DNA, 17 bp, Homo sapiens
ccatagtatattaaaaa

SEQ ID NO: 6726115 - DNA, 20 bp, Homo sapiens
ccatagtatattaaaaatgg

SEQ ID NO: 6726116 - DNA, 19 bp, Homo sapiens
ccatagtcattctgcctgc

SEQ ID NO: 6726117 - DNA, 21 bp, Homo sapiens
ccatagtcattctgcctgccc

SEQ ID NO: 6726118 - DNA, 23 bp, Homo sapiens
ccatagtcattctgcctgccctg

SEQ ID NO: 6726119 - DNA, 20 bp, Homo sapiens
ccatagtgcttcacaaaatg

SEQ ID NO: 6726120 - DNA, 13 bp, Homo sapiens
ccatagtggggcc

SEQ ID NO: 6726121 - DNA, 17 bp, Homo sapiens
ccatagtgtcacagaga

SEQ ID NO: 6726122 - DNA, 18 bp, Homo sapiens
ccatagttgacagttcca

SEQ ID NO: 6726123 - DNA, 18 bp, Homo sapiens
ccatagtttgaattcatg

SEQ ID NO: 6726124 - DNA, 21 bp, Homo sapiens
ccatagttttgtttaatttgc

SEQ ID NO: 6726125 - DNA, 14 bp, Homo sapiens
ccatataactggag

SEQ ID NO: 6726126 - DNA, 19 bp, Homo sapiens
ccatataagtttgaaggaa

SEQ ID NO: 6726127 - DNA, 23 bp, Homo sapiens
ccatataagtttgaaggaaacag

SEQ ID NO: 6726128 - DNA, 20 bp, Homo sapiens
ccatatagtttgttttcttt

SEQ ID NO: 6726129 - DNA, 19 bp, Homo sapiens
ccatatataaattattact

SEQ ID NO: 6726130 - DNA, 21 bp, Homo sapiens
ccatatataaattattacttt

SEQ ID NO: 6726131 - DNA, 21 bp, Homo sapiens
ccatatataacagatacattt

SEQ ID NO: 6726132 - DNA, 15 bp, Homo sapiens
ccatatatgctgtat

SEQ ID NO: 6726133 - DNA, 19 bp, Homo sapiens
ccatatatttaatatgtca

SEQ ID NO: 6726134 - DNA, 20 bp, Homo sapiens
ccatatatttaatatgtcaa

SEQ ID NO: 6726135 - DNA, 21 bp, Homo sapiens
ccatatcaaaagacacagggg

SEQ ID NO: 6726136 - DNA, 21 bp, Homo sapiens
ccatatcacacacattgctgt

SEQ ID NO: 6726137 - DNA, 19 bp, Homo sapiens
ccatatcagaactgtgcca

SEQ ID NO: 6726138 - DNA, 15 bp, Homo sapiens
ccatatcagacctct

SEQ ID NO: 6726139 - DNA, 16 bp, Homo sapiens
ccatatccctcccgtg

SEQ ID NO: 6726140 - DNA, 13 bp, Homo sapiens
ccatatccctgcc

SEQ ID NO: 6726141 - DNA, 19 bp, Homo sapiens
ccatatctccttcccctac

SEQ ID NO: 6726142 - DNA, 16 bp, Homo sapiens
ccatatctgtgcaatg

SEQ ID NO: 6726143 - DNA, 22 bp, Homo sapiens
ccatatctgtgcaatggaatat

SEQ ID NO: 6726144 - DNA, 13 bp, Homo sapiens
ccatatctgtgtg

SEQ ID NO: 6726145 - DNA, 16 bp, Homo sapiens
ccatatctgtgtgccc

SEQ ID NO: 6726146 - DNA, 21 bp, Homo sapiens
ccatatcttaaagaaacagct

SEQ ID NO: 6726147 - DNA, 21 bp, Homo sapiens
ccatatcttgcgaatccaagc

SEQ ID NO: 6726148 - DNA, 12 bp, Homo sapiens
ccatatgaattg

SEQ ID NO: 6726149 - DNA, 19 bp, Homo sapiens
ccatatgacctcatgcatc

SEQ ID NO: 6726150 - DNA, 14 bp, Homo sapiens
ccatatgcctacag

SEQ ID NO: 6726151 - DNA, 21 bp, Homo sapiens
ccatatgccttggggaggaca

SEQ ID NO: 6726152 - DNA, 22 bp, Homo sapiens
ccatatgccttggggaggacaa

SEQ ID NO: 6726153 - DNA, 21 bp, Homo sapiens
ccatatgctaccaccagctgt

SEQ ID NO: 6726154 - DNA, 12 bp, Homo sapiens
ccatatgctgtt

SEQ ID NO: 6726155 - DNA, 20 bp, Homo sapiens
ccatatggacactgtgacaa

SEQ ID NO: 6726156 - DNA, 13 bp, Homo sapiens
ccatatggatatt

SEQ ID NO: 6726157 - DNA, 16 bp, Homo sapiens
ccatatggatccactg

SEQ ID NO: 6726158 - DNA, 17 bp, Homo sapiens
ccatatgggaattatta

SEQ ID NO: 6726159 - DNA, 19 bp, Homo sapiens
ccatatgtagcattaaata

SEQ ID NO: 6726160 - DNA, 21 bp, Homo sapiens
ccatatgtagcattaaatata

SEQ ID NO: 6726161 - DNA, 20 bp, Homo sapiens
ccatatgtgctatggagagg

SEQ ID NO: 6726162 - DNA, 14 bp, Homo sapiens
ccatattaaaatca

SEQ ID NO: 6726163 - DNA, 12 bp, Homo sapiens
ccatattaaatt

SEQ ID NO: 6726164 - DNA, 20 bp, Homo sapiens
ccatattaaattttttgttg

SEQ ID NO: 6726165 - DNA, 22 bp, Homo sapiens
ccatattaagtaagtctcaagg

SEQ ID NO: 6726166 - DNA, 19 bp, Homo sapiens
ccatattaccacagacata

SEQ ID NO: 6726167 - DNA, 20 bp, Homo sapiens
ccatattagaaaactttgtt

SEQ ID NO: 6726168 - DNA, 15 bp, Homo sapiens
ccatattctgttggc

SEQ ID NO: 6726169 - DNA, 18 bp, Homo sapiens
ccatattctgttggccag

SEQ ID NO: 6726170 - DNA, 23 bp, Homo sapiens
ccatattctgttggccagtgtga

SEQ ID NO: 6726171 - DNA, 23 bp, Homo sapiens
ccatattgcacatgtcttaatga

SEQ ID NO: 6726172 - DNA, 14 bp, Homo sapiens
ccatattgtaaaac

SEQ ID NO: 6726173 - DNA, 18 bp, Homo sapiens
ccatattgtaaaacaggt

SEQ ID NO: 6726174 - DNA, 22 bp, Homo sapiens
ccatattgtcacctcagcactg

SEQ ID NO: 6726175 - DNA, 16 bp, Homo sapiens
ccatattgtgtaattt

SEQ ID NO: 6726176 - DNA, 21 bp, Homo sapiens
ccatatttaataatgctttaa

SEQ ID NO: 6726177 - DNA, 19 bp, Homo sapiens
ccatatttacattctagtt

SEQ ID NO: 6726178 - DNA, 16 bp, Homo sapiens
ccatatttacctcagc

SEQ ID NO: 6726179 - DNA, 18 bp, Homo sapiens
ccatatttactaccttat

SEQ ID NO: 6726180 - DNA, 14 bp, Homo sapiens
ccatatttagcagt

SEQ ID NO: 6726181 - DNA, 17 bp, Homo sapiens
ccatatttagcagtgca

SEQ ID NO: 6726182 - DNA, 21 bp, Homo sapiens
ccatatttatccatttgtaat

SEQ ID NO: 6726183 - DNA, 15 bp, Homo sapiens
ccatatttattttgt

SEQ ID NO: 6726184 - DNA, 16 bp, Homo sapiens
ccatatttctttttct

SEQ ID NO: 6726185 - DNA, 17 bp, Homo sapiens
ccatatttgaattggcc

SEQ ID NO: 6726186 - DNA, 19 bp, Homo sapiens
ccatatttgtaaaatgaca

SEQ ID NO: 6726187 - DNA, 20 bp, Homo sapiens
ccatatttgtaaaatgacaa

SEQ ID NO: 6726188 - DNA, 11 bp, Homo sapiens
ccatattttaa

SEQ ID NO: 6726189 - DNA, 18 bp, Homo sapiens
ccatattttacttggaaa

SEQ ID NO: 6726190 - DNA, 19 bp, Homo sapiens
ccatattttacttggaaat

SEQ ID NO: 6726191 - DNA, 20 bp, Homo sapiens
ccatattttattactgttta

SEQ ID NO: 6726192 - DNA, 20 bp, Homo sapiens
ccatattttattgtattttg

SEQ ID NO: 6726193 - DNA, 11 bp, Homo sapiens
ccatattttca

SEQ ID NO: 6726194 - DNA, 14 bp, Homo sapiens
ccatatttttctgt

SEQ ID NO: 6726195 - DNA, 17 bp, Homo sapiens
ccatatttttttcctta

SEQ ID NO: 6726196 - DNA, 14 bp, Homo sapiens
ccatatttttttct

SEQ ID NO: 6726197 - DNA, 20 bp, Homo sapiens
ccatatttttttctgtaaaa

SEQ ID NO: 6726198 - DNA, 19 bp, Homo sapiens
ccatcaaaatgctttttat

SEQ ID NO: 6726199 - DNA, 19 bp, Homo sapiens
ccatcaaacctcacatttg

SEQ ID NO: 6726200 - DNA, 20 bp, Homo sapiens
ccatcaaacctcacatttgt

SEQ ID NO: 6726201 - DNA, 18 bp, Homo sapiens
ccatcaaagagaaggaaa

SEQ ID NO: 6726202 - DNA, 23 bp, Homo sapiens
ccatcaaaggaatataagaaaag

SEQ ID NO: 6726203 - DNA, 17 bp, Homo sapiens
ccatcaacaaaaattgt

SEQ ID NO: 6726204 - DNA, 19 bp, Homo sapiens
ccatcaagcacttcccagg

SEQ ID NO: 6726205 - DNA, 18 bp, Homo sapiens
ccatcaagttgcacactc

SEQ ID NO: 6726206 - DNA, 19 bp, Homo sapiens
ccatcaatggaaacagggc

SEQ ID NO: 6726207 - DNA, 21 bp, Homo sapiens
ccatcaatggaaacagggcag

SEQ ID NO: 6726208 - DNA, 16 bp, Homo sapiens
ccatcacaaacttaaa

SEQ ID NO: 6726209 - DNA, 17 bp, Homo sapiens
ccatcacagccagccca

SEQ ID NO: 6726210 - DNA, 18 bp, Homo sapiens
ccatcacagccagcccag

SEQ ID NO: 6726211 - DNA, 20 bp, Homo sapiens
ccatcacagccagcccagct

SEQ ID NO: 6726212 - DNA, 14 bp, Homo sapiens
ccatcacagcttgt

SEQ ID NO: 6726213 - DNA, 15 bp, Homo sapiens
ccatcacagcttgtt

SEQ ID NO: 6726214 - DNA, 16 bp, Homo sapiens
ccatcacaggatgcca

SEQ ID NO: 6726215 - DNA, 15 bp, Homo sapiens
ccatcaccacagctg

SEQ ID NO: 6726216 - DNA, 13 bp, Homo sapiens
ccatcaccagaca

SEQ ID NO: 6726217 - DNA, 16 bp, Homo sapiens
ccatcaccccttcccc

SEQ ID NO: 6726218 - DNA, 12 bp, Homo sapiens
ccatcacccgct

SEQ ID NO: 6726219 - DNA, 19 bp, Homo sapiens
ccatcaccctcacccactc

SEQ ID NO: 6726220 - DNA, 13 bp, Homo sapiens
ccatcaccctctt

SEQ ID NO: 6726221 - DNA, 17 bp, Homo sapiens
ccatcaccgctgggtgg

SEQ ID NO: 6726222 - DNA, 14 bp, Homo sapiens
ccatcaccggagga

SEQ ID NO: 6726223 - DNA, 18 bp, Homo sapiens
ccatcacctgaaacactg

SEQ ID NO: 6726224 - DNA, 22 bp, Homo sapiens
ccatcacctgaaacactggacc

SEQ ID NO: 6726225 - DNA, 19 bp, Homo sapiens
ccatcaccttagaccacca

SEQ ID NO: 6726226 - DNA, 23 bp, Homo sapiens
ccatcaccttagaccaccaagcc

SEQ ID NO: 6726227 - DNA, 16 bp, Homo sapiens
ccatcacgcctgtgca

SEQ ID NO: 6726228 - DNA, 16 bp, Homo sapiens
ccatcactagaagaaa

SEQ ID NO: 6726229 - DNA, 16 bp, Homo sapiens
ccatcactcgcaggac

SEQ ID NO: 6726230 - DNA, 17 bp, Homo sapiens
ccatcactcgcaggacc

SEQ ID NO: 6726231 - DNA, 13 bp, Homo sapiens
ccatcactcggct

SEQ ID NO: 6726232 - DNA, 19 bp, Homo sapiens
ccatcactgagagcccgac

SEQ ID NO: 6726233 - DNA, 19 bp, Homo sapiens
ccatcactgcgccactgct

SEQ ID NO: 6726234 - DNA, 14 bp, Homo sapiens
ccatcactgtgtct

SEQ ID NO: 6726235 - DNA, 16 bp, Homo sapiens
ccatcacttctccccg

SEQ ID NO: 6726236 - DNA, 17 bp, Homo sapiens
ccatcacttctccccgc

SEQ ID NO: 6726237 - DNA, 22 bp, Homo sapiens
ccatcagaaacaccctcacact

SEQ ID NO: 6726238 - DNA, 23 bp, Homo sapiens
ccatcagaaacaccctcacactg

SEQ ID NO: 6726239 - DNA, 14 bp, Homo sapiens
ccatcagaaatttt

SEQ ID NO: 6726240 - DNA, 12 bp, Homo sapiens
ccatcagaggcc

SEQ ID NO: 6726241 - DNA, 13 bp, Homo sapiens
ccatcagatattt

SEQ ID NO: 6726242 - DNA, 15 bp, Homo sapiens
ccatcagcactctgt

SEQ ID NO: 6726243 - DNA, 21 bp, Homo sapiens
ccatcagcaggctccagttga

SEQ ID NO: 6726244 - DNA, 22 bp, Homo sapiens
ccatcagcaggctccagttgaa

SEQ ID NO: 6726245 - DNA, 17 bp, Homo sapiens
ccatcagccctgctaga

SEQ ID NO: 6726246 - DNA, 18 bp, Homo sapiens
ccatcagcgggtctcctc

SEQ ID NO: 6726247 - DNA, 12 bp, Homo sapiens
ccatcagctctg

SEQ ID NO: 6726248 - DNA, 15 bp, Homo sapiens
ccatcagctctgcct

SEQ ID NO: 6726249 - DNA, 19 bp, Homo sapiens
ccatcagctgtaagaagag

SEQ ID NO: 6726250 - DNA, 24 bp, Homo sapiens
ccatcagctgtaagaagagactgg

SEQ ID NO: 6726251 - DNA, 22 bp, Homo sapiens
ccatcagctttataataaactg

SEQ ID NO: 6726252 - DNA, 12 bp, Homo sapiens
ccatcagggccc

SEQ ID NO: 6726253 - DNA, 13 bp, Homo sapiens
ccatcagggccct

SEQ ID NO: 6726254 - DNA, 14 bp, Homo sapiens
ccatcagggccctg

SEQ ID NO: 6726255 - DNA, 16 bp, Homo sapiens
ccatcagggccctgcc

SEQ ID NO: 6726256 - DNA, 20 bp, Homo sapiens
ccatcagggccctgccccag

SEQ ID NO: 6726257 - DNA, 15 bp, Homo sapiens
ccatcaggggcagga

SEQ ID NO: 6726258 - DNA, 13 bp, Homo sapiens
ccatcaggtcacc

SEQ ID NO: 6726259 - DNA, 21 bp, Homo sapiens
ccatcaggtcaccgcgaggcc

SEQ ID NO: 6726260 - DNA, 16 bp, Homo sapiens
ccatcagtgaaagaaa

SEQ ID NO: 6726261 - DNA, 14 bp, Homo sapiens
ccatcagtgcatga

SEQ ID NO: 6726262 - DNA, 14 bp, Homo sapiens
ccatcagtgccagc

SEQ ID NO: 6726263 - DNA, 19 bp, Homo sapiens
ccatcagtgccagcccctg

SEQ ID NO: 6726264 - DNA, 21 bp, Homo sapiens
ccatcatacgcatggtcctgg

SEQ ID NO: 6726265 - DNA, 18 bp, Homo sapiens
ccatcatatcccctgtgc

SEQ ID NO: 6726266 - DNA, 18 bp, Homo sapiens
ccatcatatgcctgaccc

SEQ ID NO: 6726267 - DNA, 23 bp, Homo sapiens
ccatcatcaccgattcttccttg

SEQ ID NO: 6726268 - DNA, 15 bp, Homo sapiens
ccatcatcatagagg

SEQ ID NO: 6726269 - DNA, 14 bp, Homo sapiens
ccatcatcccagct

SEQ ID NO: 6726270 - DNA, 15 bp, Homo sapiens
ccatcatcccagctg

SEQ ID NO: 6726271 - DNA, 20 bp, Homo sapiens
ccatcatctatagaaagcta

SEQ ID NO: 6726272 - DNA, 15 bp, Homo sapiens
ccatcatctctgcct

SEQ ID NO: 6726273 - DNA, 18 bp, Homo sapiens
ccatcatctctgcctttg

SEQ ID NO: 6726274 - DNA, 19 bp, Homo sapiens
ccatcatctctgtaaacca

SEQ ID NO: 6726275 - DNA, 21 bp, Homo sapiens
ccatcatctcttttcccactc

SEQ ID NO: 6726276 - DNA, 18 bp, Homo sapiens
ccatcatctgctgcacat

SEQ ID NO: 6726277 - DNA, 13 bp, Homo sapiens
ccatcatgccaca

SEQ ID NO: 6726278 - DNA, 22 bp, Homo sapiens
ccatcatgcccggtcccacccc

SEQ ID NO: 6726279 - DNA, 13 bp, Homo sapiens
ccatcatgcctga

SEQ ID NO: 6726280 - DNA, 22 bp, Homo sapiens
ccatcatggggggagcaccctg

SEQ ID NO: 6726281 - DNA, 23 bp, Homo sapiens
ccatcatggggggagcaccctga

SEQ ID NO: 6726282 - DNA, 23 bp, Homo sapiens
ccatcatgtaccaagtgcttggc

SEQ ID NO: 6726283 - DNA, 12 bp, Homo sapiens
ccatcatgtctg

SEQ ID NO: 6726284 - DNA, 13 bp, Homo sapiens
ccatcatgtctgg

SEQ ID NO: 6726285 - DNA, 16 bp, Homo sapiens
ccatcatgtctggcta

SEQ ID NO: 6726286 - DNA, 18 bp, Homo sapiens
ccatcatgtgcctggaaa

SEQ ID NO: 6726287 - DNA, 19 bp, Homo sapiens
ccatcatgtgcctggaaat

SEQ ID NO: 6726288 - DNA, 15 bp, Homo sapiens
ccatcatgtggccca

SEQ ID NO: 6726289 - DNA, 18 bp, Homo sapiens
ccatcatgtgtagagccc

SEQ ID NO: 6726290 - DNA, 19 bp, Homo sapiens
ccatcatgtgtagagcccc

SEQ ID NO: 6726291 - DNA, 22 bp, Homo sapiens
ccatcatgtttacagaggacag

SEQ ID NO: 6726292 - DNA, 14 bp, Homo sapiens
ccatcatgtttcag

SEQ ID NO: 6726293 - DNA, 14 bp, Homo sapiens
ccatcattgaaatc

SEQ ID NO: 6726294 - DNA, 20 bp, Homo sapiens
ccatcattgcacctgcaggc

SEQ ID NO: 6726295 - DNA, 23 bp, Homo sapiens
ccatcatttctagtatattagga

SEQ ID NO: 6726296 - DNA, 13 bp, Homo sapiens
ccatcatttctgt

SEQ ID NO: 6726297 - DNA, 18 bp, Homo sapiens
ccatccaaacactgaggc

SEQ ID NO: 6726298 - DNA, 22 bp, Homo sapiens
ccatccaagaaagacagtgtat

SEQ ID NO: 6726299 - DNA, 15 bp, Homo sapiens
ccatccaaggccagg

SEQ ID NO: 6726300 - DNA, 17 bp, Homo sapiens
ccatccacatgggagcc

SEQ ID NO: 6726301 - DNA, 21 bp, Homo sapiens
ccatccacccctctggcacct

SEQ ID NO: 6726302 - DNA, 12 bp, Homo sapiens
ccatccaccctg

SEQ ID NO: 6726303 - DNA, 18 bp, Homo sapiens
ccatccaccctgaggagt

SEQ ID NO: 6726304 - DNA, 19 bp, Homo sapiens
ccatccaccgctgctccac

SEQ ID NO: 6726305 - DNA, 17 bp, Homo sapiens
ccatccacctttcccaa

SEQ ID NO: 6726306 - DNA, 18 bp, Homo sapiens
ccatccacgtggcctctc

SEQ ID NO: 6726307 - DNA, 20 bp, Homo sapiens
ccatccacgtggcctctctc

SEQ ID NO: 6726308 - DNA, 19 bp, Homo sapiens
ccatccagagaccaaataa

SEQ ID NO: 6726309 - DNA, 12 bp, Homo sapiens
ccatccagaggc

SEQ ID NO: 6726310 - DNA, 16 bp, Homo sapiens
ccatccagatgtgtgc

SEQ ID NO: 6726311 - DNA, 17 bp, Homo sapiens
ccatccagcatgtgtgt

SEQ ID NO: 6726312 - DNA, 18 bp, Homo sapiens
ccatccagcatgtgtgtg

SEQ ID NO: 6726313 - DNA, 12 bp, Homo sapiens
ccatccagccac

SEQ ID NO: 6726314 - DNA, 13 bp, Homo sapiens
ccatccagccaga

SEQ ID NO: 6726315 - DNA, 11 bp, Homo sapiens
ccatccagcct

SEQ ID NO: 6726316 - DNA, 17 bp, Homo sapiens
ccatccagctacaggag

SEQ ID NO: 6726317 - DNA, 19 bp, Homo sapiens
ccatccagctacaggagag

SEQ ID NO: 6726318 - DNA, 21 bp, Homo sapiens
ccatccagggatgccatctgt

SEQ ID NO: 6726319 - DNA, 13 bp, Homo sapiens
ccatccagggtct

SEQ ID NO: 6726320 - DNA, 15 bp, Homo sapiens
ccatccagggtctgg

SEQ ID NO: 6726321 - DNA, 16 bp, Homo sapiens
ccatccagtggactct

SEQ ID NO: 6726322 - DNA, 17 bp, Homo sapiens
ccatccagtggactctg

SEQ ID NO: 6726323 - DNA, 12 bp, Homo sapiens
ccatccagtggg

SEQ ID NO: 6726324 - DNA, 13 bp, Homo sapiens
ccatccagtgggc

SEQ ID NO: 6726325 - DNA, 19 bp, Homo sapiens
ccatccagtgtctcacagc

SEQ ID NO: 6726326 - DNA, 16 bp, Homo sapiens
ccatccatcagctccc

SEQ ID NO: 6726327 - DNA, 15 bp, Homo sapiens
ccatccatccctaga

SEQ ID NO: 6726328 - DNA, 24 bp, Homo sapiens
ccatccatgtgctagtcactggca

SEQ ID NO: 6726329 - DNA, 18 bp, Homo sapiens
ccatccattaggccagca

SEQ ID NO: 6726330 - DNA, 14 bp, Homo sapiens
ccatccattctcct

SEQ ID NO: 6726331 - DNA, 17 bp, Homo sapiens
ccatccattctcctcag

SEQ ID NO: 6726332 - DNA, 14 bp, Homo sapiens
ccatccattctgga

SEQ ID NO: 6726333 - DNA, 17 bp, Homo sapiens
ccatcccaaccagtgcc

SEQ ID NO: 6726334 - DNA, 18 bp, Homo sapiens
ccatcccaaccagtgcca

SEQ ID NO: 6726335 - DNA, 22 bp, Homo sapiens
ccatcccaaccagtgccaagga

SEQ ID NO: 6726336 - DNA, 18 bp, Homo sapiens
ccatcccaagcccagtga

SEQ ID NO: 6726337 - DNA, 14 bp, Homo sapiens
ccatcccacaccct

SEQ ID NO: 6726338 - DNA, 13 bp, Homo sapiens
ccatcccacattc

SEQ ID NO: 6726339 - DNA, 14 bp, Homo sapiens
ccatcccagcccca

SEQ ID NO: 6726340 - DNA, 14 bp, Homo sapiens
ccatcccagccttg

SEQ ID NO: 6726341 - DNA, 12 bp, Homo sapiens
ccatcccagggt

SEQ ID NO: 6726342 - DNA, 13 bp, Homo sapiens
ccatcccagggtc

SEQ ID NO: 6726343 - DNA, 12 bp, Homo sapiens
ccatcccatccc

SEQ ID NO: 6726344 - DNA, 13 bp, Homo sapiens
ccatcccatccca

SEQ ID NO: 6726345 - DNA, 15 bp, Homo sapiens
ccatcccatcccatc

SEQ ID NO: 6726346 - DNA, 18 bp, Homo sapiens
ccatcccatcccatccca

SEQ ID NO: 6726347 - DNA, 11 bp, Homo sapiens
ccatcccatga

SEQ ID NO: 6726348 - DNA, 19 bp, Homo sapiens
ccatcccatgaacacactg

SEQ ID NO: 6726349 - DNA, 13 bp, Homo sapiens
ccatcccatgctg

SEQ ID NO: 6726350 - DNA, 22 bp, Homo sapiens
ccatcccattttcatcctgagc

SEQ ID NO: 6726351 - DNA, 13 bp, Homo sapiens
ccatccccaccag

SEQ ID NO: 6726352 - DNA, 16 bp, Homo sapiens
ccatccccaccagctc

SEQ ID NO: 6726353 - DNA, 18 bp, Homo sapiens
ccatccccaccagctcgt

SEQ ID NO: 6726354 - DNA, 15 bp, Homo sapiens
ccatccccaccttca

SEQ ID NO: 6726355 - DNA, 12 bp, Homo sapiens
ccatccccaggt

SEQ ID NO: 6726356 - DNA, 19 bp, Homo sapiens
ccatccccaggtccccaaa

SEQ ID NO: 6726357 - DNA, 14 bp, Homo sapiens
ccatccccatcggc

SEQ ID NO: 6726358 - DNA, 22 bp, Homo sapiens
ccatcccccctcaccaggggca

SEQ ID NO: 6726359 - DNA, 16 bp, Homo sapiens
ccatccccctctgtct

SEQ ID NO: 6726360 - DNA, 13 bp, Homo sapiens
ccatccccctgcc

SEQ ID NO: 6726361 - DNA, 23 bp, Homo sapiens
ccatccccgtgttgggtggaccc

SEQ ID NO: 6726362 - DNA, 18 bp, Homo sapiens
ccatcccctagaaatcct

SEQ ID NO: 6726363 - DNA, 17 bp, Homo sapiens
ccatcccctatggacca

SEQ ID NO: 6726364 - DNA, 17 bp, Homo sapiens
ccatcccctccctgcct

SEQ ID NO: 6726365 - DNA, 18 bp, Homo sapiens
ccatcccctccctgcctg

SEQ ID NO: 6726366 - DNA, 19 bp, Homo sapiens
ccatcccctccctgcctgc

SEQ ID NO: 6726367 - DNA, 22 bp, Homo sapiens
ccatcccctccctgcctgctcc

SEQ ID NO: 6726368 - DNA, 14 bp, Homo sapiens
ccatcccctcctag

SEQ ID NO: 6726369 - DNA, 14 bp, Homo sapiens
ccatcccctgcctc

SEQ ID NO: 6726370 - DNA, 15 bp, Homo sapiens
ccatcccctggactg

SEQ ID NO: 6726371 - DNA, 14 bp, Homo sapiens
ccatccccttcccc

SEQ ID NO: 6726372 - DNA, 16 bp, Homo sapiens
ccatcccgaaaatctc

SEQ ID NO: 6726373 - DNA, 19 bp, Homo sapiens
ccatcccgaaaatctctcg

SEQ ID NO: 6726374 - DNA, 19 bp, Homo sapiens
ccatcccgctcttttccta

SEQ ID NO: 6726375 - DNA, 16 bp, Homo sapiens
ccatcccgcttagcct

SEQ ID NO: 6726376 - DNA, 19 bp, Homo sapiens
ccatcccgtttccctccag

SEQ ID NO: 6726377 - DNA, 16 bp, Homo sapiens
ccatccctaccactgt

SEQ ID NO: 6726378 - DNA, 17 bp, Homo sapiens
ccatccctaccactgtg

SEQ ID NO: 6726379 - DNA, 13 bp, Homo sapiens
ccatccctccctc

SEQ ID NO: 6726380 - DNA, 14 bp, Homo sapiens
ccatccctccctcc

SEQ ID NO: 6726381 - DNA, 23 bp, Homo sapiens
ccatccctcgggaagcagccagc

SEQ ID NO: 6726382 - DNA, 16 bp, Homo sapiens
ccatccctctcctctg

SEQ ID NO: 6726383 - DNA, 14 bp, Homo sapiens
ccatccctgccaca

SEQ ID NO: 6726384 - DNA, 15 bp, Homo sapiens
ccatccctgccacat

SEQ ID NO: 6726385 - DNA, 12 bp, Homo sapiens
ccatccctgcct

SEQ ID NO: 6726386 - DNA, 12 bp, Homo sapiens
ccatccctgcgt

SEQ ID NO: 6726387 - DNA, 23 bp, Homo sapiens
ccatccctgcttgcccgctccca

SEQ ID NO: 6726388 - DNA, 22 bp, Homo sapiens
ccatccctggccccctccctgg

SEQ ID NO: 6726389 - DNA, 14 bp, Homo sapiens
ccatccctgggccc

SEQ ID NO: 6726390 - DNA, 16 bp, Homo sapiens
ccatccctgggcccct

SEQ ID NO: 6726391 - DNA, 14 bp, Homo sapiens
ccatccctgggggc

SEQ ID NO: 6726392 - DNA, 20 bp, Homo sapiens
ccatccctggtgaaagagta

SEQ ID NO: 6726393 - DNA, 12 bp, Homo sapiens
ccatccctgtga

SEQ ID NO: 6726394 - DNA, 17 bp, Homo sapiens
ccatccctgtggtctac

SEQ ID NO: 6726395 - DNA, 20 bp, Homo sapiens
ccatcccttcaaccccactt

SEQ ID NO: 6726396 - DNA, 17 bp, Homo sapiens
ccatcccttcctcccca

SEQ ID NO: 6726397 - DNA, 16 bp, Homo sapiens
ccatcccttcggagcc

SEQ ID NO: 6726398 - DNA, 17 bp, Homo sapiens
ccatcccttttcctgtc

SEQ ID NO: 6726399 - DNA, 20 bp, Homo sapiens
ccatcccttttcctttctgg

SEQ ID NO: 6726400 - DNA, 18 bp, Homo sapiens
ccatccgactgcccctgc

SEQ ID NO: 6726401 - DNA, 23 bp, Homo sapiens
ccatccgactgcccctgctgtgc

SEQ ID NO: 6726402 - DNA, 23 bp, Homo sapiens
ccatccgcagactgcttggccag

SEQ ID NO: 6726403 - DNA, 15 bp, Homo sapiens
ccatccgccagggcc

SEQ ID NO: 6726404 - DNA, 13 bp, Homo sapiens
ccatccggctcct

SEQ ID NO: 6726405 - DNA, 23 bp, Homo sapiens
ccatccgggacgcttccagacca

SEQ ID NO: 6726406 - DNA, 15 bp, Homo sapiens
ccatccgtccagcca

SEQ ID NO: 6726407 - DNA, 15 bp, Homo sapiens
ccatccgttcattca

SEQ ID NO: 6726408 - DNA, 15 bp, Homo sapiens
ccatcctaaaagcca

SEQ ID NO: 6726409 - DNA, 19 bp, Homo sapiens
ccatcctaaggtgcttacc

SEQ ID NO: 6726410 - DNA, 20 bp, Homo sapiens
ccatcctaccaatgcatgca

SEQ ID NO: 6726411 - DNA, 17 bp, Homo sapiens
ccatcctaccccctgtg

SEQ ID NO: 6726412 - DNA, 15 bp, Homo sapiens
ccatcctaggaacca

SEQ ID NO: 6726413 - DNA, 17 bp, Homo sapiens
ccatcctaggctgacac

SEQ ID NO: 6726414 - DNA, 22 bp, Homo sapiens
ccatcctcaaacgacagaggag

SEQ ID NO: 6726415 - DNA, 14 bp, Homo sapiens
ccatcctcacccag

SEQ ID NO: 6726416 - DNA, 16 bp, Homo sapiens
ccatcctcagaggctg

SEQ ID NO: 6726417 - DNA, 13 bp, Homo sapiens
ccatcctcatctc

SEQ ID NO: 6726418 - DNA, 15 bp, Homo sapiens
ccatcctcatctctc

SEQ ID NO: 6726419 - DNA, 21 bp, Homo sapiens
ccatcctcatctctcttgggc

SEQ ID NO: 6726420 - DNA, 13 bp, Homo sapiens
ccatcctccagca

SEQ ID NO: 6726421 - DNA, 14 bp, Homo sapiens
ccatcctccagcag

SEQ ID NO: 6726422 - DNA, 13 bp, Homo sapiens
ccatcctccagcc

SEQ ID NO: 6726423 - DNA, 13 bp, Homo sapiens
ccatcctccagct

SEQ ID NO: 6726424 - DNA, 14 bp, Homo sapiens
ccatcctccagctt

SEQ ID NO: 6726425 - DNA, 17 bp, Homo sapiens
ccatcctccagcttctg

SEQ ID NO: 6726426 - DNA, 13 bp, Homo sapiens
ccatcctcccctt

SEQ ID NO: 6726427 - DNA, 14 bp, Homo sapiens
ccatcctccccttc

SEQ ID NO: 6726428 - DNA, 15 bp, Homo sapiens
ccatcctccccttcc

SEQ ID NO: 6726429 - DNA, 21 bp, Homo sapiens
ccatcctcccggctccctcct

SEQ ID NO: 6726430 - DNA, 18 bp, Homo sapiens
ccatcctctcccttctta

SEQ ID NO: 6726431 - DNA, 12 bp, Homo sapiens
ccatcctctgta

SEQ ID NO: 6726432 - DNA, 20 bp, Homo sapiens
ccatcctctgtacagagccc

SEQ ID NO: 6726433 - DNA, 12 bp, Homo sapiens
ccatcctctgtt

SEQ ID NO: 6726434 - DNA, 12 bp, Homo sapiens
ccatcctgactg

SEQ ID NO: 6726435 - DNA, 13 bp, Homo sapiens
ccatcctgagcca

SEQ ID NO: 6726436 - DNA, 16 bp, Homo sapiens
ccatcctgaggctcca

SEQ ID NO: 6726437 - DNA, 12 bp, Homo sapiens
ccatcctgccag

SEQ ID NO: 6726438 - DNA, 13 bp, Homo sapiens
ccatcctgccagg

SEQ ID NO: 6726439 - DNA, 14 bp, Homo sapiens
ccatcctgccagga

SEQ ID NO: 6726440 - DNA, 22 bp, Homo sapiens
ccatcctgccaggagcagcctc

SEQ ID NO: 6726441 - DNA, 17 bp, Homo sapiens
ccatcctgccatcctca

SEQ ID NO: 6726442 - DNA, 11 bp, Homo sapiens
ccatcctgcta

SEQ ID NO: 6726443 - DNA, 11 bp, Homo sapiens
ccatcctggcc

SEQ ID NO: 6726444 - DNA, 12 bp, Homo sapiens
ccatcctggccc

SEQ ID NO: 6726445 - DNA, 19 bp, Homo sapiens
ccatcctgggacggcggca

SEQ ID NO: 6726446 - DNA, 13 bp, Homo sapiens
ccatcctgggcct

SEQ ID NO: 6726447 - DNA, 20 bp, Homo sapiens
ccatcctggggttgccctgg

SEQ ID NO: 6726448 - DNA, 17 bp, Homo sapiens
ccatcctggtcagctgc

SEQ ID NO: 6726449 - DNA, 17 bp, Homo sapiens
ccatcctgtattcttca

SEQ ID NO: 6726450 - DNA, 13 bp, Homo sapiens
ccatcctgtgtgt

SEQ ID NO: 6726451 - DNA, 14 bp, Homo sapiens
ccatcctgtgtgtt

SEQ ID NO: 6726452 - DNA, 14 bp, Homo sapiens
ccatccttaactgt

SEQ ID NO: 6726453 - DNA, 15 bp, Homo sapiens
ccatccttccagcaa

SEQ ID NO: 6726454 - DNA, 15 bp, Homo sapiens
ccatccttccatcct

SEQ ID NO: 6726455 - DNA, 20 bp, Homo sapiens
ccatccttccatcctgagga

SEQ ID NO: 6726456 - DNA, 12 bp, Homo sapiens
ccatccttccca

SEQ ID NO: 6726457 - DNA, 17 bp, Homo sapiens
ccatccttcccgcagca

SEQ ID NO: 6726458 - DNA, 20 bp, Homo sapiens
ccatccttgactgaagcgaa

SEQ ID NO: 6726459 - DNA, 13 bp, Homo sapiens
ccatccttgctgc

SEQ ID NO: 6726460 - DNA, 20 bp, Homo sapiens
ccatccttggggccttgtgt

SEQ ID NO: 6726461 - DNA, 15 bp, Homo sapiens
ccatcctttgcattt

SEQ ID NO: 6726462 - DNA, 18 bp, Homo sapiens
ccatcctttgtcttggaa

SEQ ID NO: 6726463 - DNA, 14 bp, Homo sapiens
ccatcgatttgtat

SEQ ID NO: 6726464 - DNA, 19 bp, Homo sapiens
ccatcgccagctgatgact

SEQ ID NO: 6726465 - DNA, 21 bp, Homo sapiens
ccatcgccagctgatgactca

SEQ ID NO: 6726466 - DNA, 12 bp, Homo sapiens
ccatcgccggga

SEQ ID NO: 6726467 - DNA, 13 bp, Homo sapiens
ccatcgccttctg

SEQ ID NO: 6726468 - DNA, 16 bp, Homo sapiens
ccatcgctgtgtgtta

SEQ ID NO: 6726469 - DNA, 20 bp, Homo sapiens
ccatcgctgtgtgttagttc

SEQ ID NO: 6726470 - DNA, 13 bp, Homo sapiens
ccatcggccctgt

SEQ ID NO: 6726471 - DNA, 15 bp, Homo sapiens
ccatcggccctgtcc

SEQ ID NO: 6726472 - DNA, 20 bp, Homo sapiens
ccatcggtcctgtctcccct

SEQ ID NO: 6726473 - DNA, 18 bp, Homo sapiens
ccatcgtataaggaaatc

SEQ ID NO: 6726474 - DNA, 17 bp, Homo sapiens
ccatcgtattaaaaaac

SEQ ID NO: 6726475 - DNA, 15 bp, Homo sapiens
ccatcgtccagccct

SEQ ID NO: 6726476 - DNA, 15 bp, Homo sapiens
ccatcgtcctgggac

SEQ ID NO: 6726477 - DNA, 23 bp, Homo sapiens
ccatcgtctcatcctcctttcag

SEQ ID NO: 6726478 - DNA, 14 bp, Homo sapiens
ccatcgtcttcttg

SEQ ID NO: 6726479 - DNA, 21 bp, Homo sapiens
ccatcgttgcccccatttctg

SEQ ID NO: 6726480 - DNA, 15 bp, Homo sapiens
ccatctaaaaatata

SEQ ID NO: 6726481 - DNA, 14 bp, Homo sapiens
ccatctaaaatact

SEQ ID NO: 6726482 - DNA, 22 bp, Homo sapiens
ccatctaaactggagtgatgtt

SEQ ID NO: 6726483 - DNA, 16 bp, Homo sapiens
ccatctaagctgcagc

SEQ ID NO: 6726484 - DNA, 20 bp, Homo sapiens
ccatctaagctgcagcttcc

SEQ ID NO: 6726485 - DNA, 18 bp, Homo sapiens
ccatctacccctggatga

SEQ ID NO: 6726486 - DNA, 14 bp, Homo sapiens
ccatctactggata

SEQ ID NO: 6726487 - DNA, 21 bp, Homo sapiens
ccatctaggggagccttgatt

SEQ ID NO: 6726488 - DNA, 17 bp, Homo sapiens
ccatctagtggaaatga

SEQ ID NO: 6726489 - DNA, 10 bp, Homo sapiens
ccatctatca

SEQ ID NO: 6726490 - DNA, 15 bp, Homo sapiens
ccatctatcactgca

SEQ ID NO: 6726491 - DNA, 20 bp, Homo sapiens
ccatctatgtcccttgctgt

SEQ ID NO: 6726492 - DNA, 22 bp, Homo sapiens
ccatctatgtcccttgctgtga

SEQ ID NO: 6726493 - DNA, 17 bp, Homo sapiens
ccatctattctctgcct

SEQ ID NO: 6726494 - DNA, 21 bp, Homo sapiens
ccatctcaaaaaaaaaaaaga

SEQ ID NO: 6726495 - DNA, 17 bp, Homo sapiens
ccatctcaacctacctc

SEQ ID NO: 6726496 - DNA, 14 bp, Homo sapiens
ccatctcaagcaag

SEQ ID NO: 6726497 - DNA, 21 bp, Homo sapiens
ccatctcacacatgagcatca

SEQ ID NO: 6726498 - DNA, 19 bp, Homo sapiens
ccatctcacctcctgctgg

SEQ ID NO: 6726499 - DNA, 23 bp, Homo sapiens
ccatctcacctcctgctgggcag

SEQ ID NO: 6726500 - DNA, 21 bp, Homo sapiens
ccatctcagacctttactgat

SEQ ID NO: 6726501 - DNA, 16 bp, Homo sapiens
ccatctcagattctgt

SEQ ID NO: 6726502 - DNA, 12 bp, Homo sapiens
ccatctcagcct

SEQ ID NO: 6726503 - DNA, 15 bp, Homo sapiens
ccatctcagcctcct

SEQ ID NO: 6726504 - DNA, 22 bp, Homo sapiens
ccatctcagcctcctgagcctg

SEQ ID NO: 6726505 - DNA, 21 bp, Homo sapiens
ccatctcaggacacttccgta

SEQ ID NO: 6726506 - DNA, 17 bp, Homo sapiens
ccatctcaggccacctg

SEQ ID NO: 6726507 - DNA, 21 bp, Homo sapiens
ccatctcaggccacctgcccc

SEQ ID NO: 6726508 - DNA, 22 bp, Homo sapiens
ccatctcaggccacctgccccc

SEQ ID NO: 6726509 - DNA, 14 bp, Homo sapiens
ccatctcaggccag

SEQ ID NO: 6726510 - DNA, 14 bp, Homo sapiens
ccatctcaggtgcc

SEQ ID NO: 6726511 - DNA, 13 bp, Homo sapiens
ccatctcatcctg

SEQ ID NO: 6726512 - DNA, 14 bp, Homo sapiens
ccatctcatcctgg

SEQ ID NO: 6726513 - DNA, 19 bp, Homo sapiens
ccatctccaagaatgctga

SEQ ID NO: 6726514 - DNA, 14 bp, Homo sapiens
ccatctccaccctg

SEQ ID NO: 6726515 - DNA, 21 bp, Homo sapiens
ccatctccaccctgagcctga

SEQ ID NO: 6726516 - DNA, 14 bp, Homo sapiens
ccatctccagggaa

SEQ ID NO: 6726517 - DNA, 15 bp, Homo sapiens
ccatctccagggaag

SEQ ID NO: 6726518 - DNA, 12 bp, Homo sapiens
ccatctccattg

SEQ ID NO: 6726519 - DNA, 15 bp, Homo sapiens
ccatctccatttcac

SEQ ID NO: 6726520 - DNA, 17 bp, Homo sapiens
ccatctcccaaggctgc

SEQ ID NO: 6726521 - DNA, 18 bp, Homo sapiens
ccatctcccaaggctgcc

SEQ ID NO: 6726522 - DNA, 15 bp, Homo sapiens
ccatctcccaccctg

SEQ ID NO: 6726523 - DNA, 16 bp, Homo sapiens
ccatctcccaccctgt

SEQ ID NO: 6726524 - DNA, 12 bp, Homo sapiens
ccatctccccag

SEQ ID NO: 6726525 - DNA, 15 bp, Homo sapiens
ccatctccccaggcc

SEQ ID NO: 6726526 - DNA, 19 bp, Homo sapiens
ccatctccccaggcctcca

SEQ ID NO: 6726527 - DNA, 15 bp, Homo sapiens
ccatctcccctcagc

SEQ ID NO: 6726528 - DNA, 14 bp, Homo sapiens
ccatctccctccca

SEQ ID NO: 6726529 - DNA, 24 bp, Homo sapiens
ccatctccctcgaacccacactgc

SEQ ID NO: 6726530 - DNA, 12 bp, Homo sapiens
ccatctccctgg

SEQ ID NO: 6726531 - DNA, 17 bp, Homo sapiens
ccatctccctggtgctt

SEQ ID NO: 6726532 - DNA, 21 bp, Homo sapiens
ccatctcctataatctgtcaa

SEQ ID NO: 6726533 - DNA, 13 bp, Homo sapiens
ccatctcctccca

SEQ ID NO: 6726534 - DNA, 21 bp, Homo sapiens
ccatctcctcccaccagtggc

SEQ ID NO: 6726535 - DNA, 13 bp, Homo sapiens
ccatctcctgctc

SEQ ID NO: 6726536 - DNA, 16 bp, Homo sapiens
ccatctcctgctcacc

SEQ ID NO: 6726537 - DNA, 24 bp, Homo sapiens
ccatctcctgctcaccacctgcct

SEQ ID NO: 6726538 - DNA, 20 bp, Homo sapiens
ccatctccttcccccagccc

SEQ ID NO: 6726539 - DNA, 22 bp, Homo sapiens
ccatctccttcccccagcccaa

SEQ ID NO: 6726540 - DNA, 14 bp, Homo sapiens
ccatctcgccaccc

SEQ ID NO: 6726541 - DNA, 20 bp, Homo sapiens
ccatctcgccacccctcctt

SEQ ID NO: 6726542 - DNA, 22 bp, Homo sapiens
ccatctcgccacccctccttcc

SEQ ID NO: 6726543 - DNA, 23 bp, Homo sapiens
ccatctcgccacccctccttcct

SEQ ID NO: 6726544 - DNA, 20 bp, Homo sapiens
ccatctcggagcatcccgga

SEQ ID NO: 6726545 - DNA, 12 bp, Homo sapiens
ccatctctacaa

SEQ ID NO: 6726546 - DNA, 16 bp, Homo sapiens
ccatctctaccatcat

SEQ ID NO: 6726547 - DNA, 15 bp, Homo sapiens
ccatctctccagaga

SEQ ID NO: 6726548 - DNA, 17 bp, Homo sapiens
ccatctctccagagagc

SEQ ID NO: 6726549 - DNA, 18 bp, Homo sapiens
ccatctctccagagagca

SEQ ID NO: 6726550 - DNA, 12 bp, Homo sapiens
ccatctctccca

SEQ ID NO: 6726551 - DNA, 13 bp, Homo sapiens
ccatctctcccac

SEQ ID NO: 6726552 - DNA, 15 bp, Homo sapiens
ccatctctcccactt

SEQ ID NO: 6726553 - DNA, 19 bp, Homo sapiens
ccatctctcccacttcctc

SEQ ID NO: 6726554 - DNA, 22 bp, Homo sapiens
ccatctctcccacttcctccta

SEQ ID NO: 6726555 - DNA, 16 bp, Homo sapiens
ccatctctccctcctg

SEQ ID NO: 6726556 - DNA, 15 bp, Homo sapiens
ccatctctcctcctt

SEQ ID NO: 6726557 - DNA, 13 bp, Homo sapiens
ccatctctctccc

SEQ ID NO: 6726558 - DNA, 15 bp, Homo sapiens
ccatctctctccctt

SEQ ID NO: 6726559 - DNA, 12 bp, Homo sapiens
ccatctctctct

SEQ ID NO: 6726560 - DNA, 15 bp, Homo sapiens
ccatctctctcttgc

SEQ ID NO: 6726561 - DNA, 14 bp, Homo sapiens
ccatctctctggcc

SEQ ID NO: 6726562 - DNA, 18 bp, Homo sapiens
ccatctctgattttcaaa

SEQ ID NO: 6726563 - DNA, 23 bp, Homo sapiens
ccatctctgattttcaaagcttt

SEQ ID NO: 6726564 - DNA, 13 bp, Homo sapiens
ccatctctgcctg

SEQ ID NO: 6726565 - DNA, 17 bp, Homo sapiens
ccatctctgcctgtcaa

SEQ ID NO: 6726566 - DNA, 21 bp, Homo sapiens
ccatctctgctgcttctgggc

SEQ ID NO: 6726567 - DNA, 12 bp, Homo sapiens
ccatctctggat

SEQ ID NO: 6726568 - DNA, 15 bp, Homo sapiens
ccatctctggatgcc

SEQ ID NO: 6726569 - DNA, 22 bp, Homo sapiens
ccatctctggtaaagttacact

SEQ ID NO: 6726570 - DNA, 13 bp, Homo sapiens
ccatctctgtctg

SEQ ID NO: 6726571 - DNA, 17 bp, Homo sapiens
ccatctctgtctggggc

SEQ ID NO: 6726572 - DNA, 19 bp, Homo sapiens
ccatctctgtctggggcta

SEQ ID NO: 6726573 - DNA, 20 bp, Homo sapiens
ccatctctgtgattacctct

SEQ ID NO: 6726574 - DNA, 21 bp, Homo sapiens
ccatctcttcctacccaacca

SEQ ID NO: 6726575 - DNA, 15 bp, Homo sapiens
ccatctcttccttga

SEQ ID NO: 6726576 - DNA, 16 bp, Homo sapiens
ccatctcttcctttcc

SEQ ID NO: 6726577 - DNA, 17 bp, Homo sapiens
ccatctcttcctttcct

SEQ ID NO: 6726578 - DNA, 14 bp, Homo sapiens
ccatctcttctgca

SEQ ID NO: 6726579 - DNA, 21 bp, Homo sapiens
ccatctcttctgcaagcctca

SEQ ID NO: 6726580 - DNA, 20 bp, Homo sapiens
ccatctcttgtaccagccca

SEQ ID NO: 6726581 - DNA, 17 bp, Homo sapiens
ccatctgaaagtggtac

SEQ ID NO: 6726582 - DNA, 18 bp, Homo sapiens
ccatctgaagccacctct

SEQ ID NO: 6726583 - DNA, 22 bp, Homo sapiens
ccatctgatgtgatgtgaatac

SEQ ID NO: 6726584 - DNA, 19 bp, Homo sapiens
ccatctgatgtttcatatt

SEQ ID NO: 6726585 - DNA, 23 bp, Homo sapiens
ccatctgcacacacctccgagac

SEQ ID NO: 6726586 - DNA, 19 bp, Homo sapiens
ccatctgcacccccctggg

SEQ ID NO: 6726587 - DNA, 20 bp, Homo sapiens
ccatctgcacccccctgggc

SEQ ID NO: 6726588 - DNA, 24 bp, Homo sapiens
ccatctgccaatgccatgactgct

SEQ ID NO: 6726589 - DNA, 14 bp, Homo sapiens
ccatctgccacagg

SEQ ID NO: 6726590 - DNA, 20 bp, Homo sapiens
ccatctgcccaggggtgccc

SEQ ID NO: 6726591 - DNA, 22 bp, Homo sapiens
ccatctgcccaggggtgccccc

SEQ ID NO: 6726592 - DNA, 23 bp, Homo sapiens
ccatctgcccaggggtgccccct

SEQ ID NO: 6726593 - DNA, 14 bp, Homo sapiens
ccatctgcccgcct

SEQ ID NO: 6726594 - DNA, 17 bp, Homo sapiens
ccatctgcccgcctgcc

SEQ ID NO: 6726595 - DNA, 23 bp, Homo sapiens
ccatctgcccgcctgcccacctg

SEQ ID NO: 6726596 - DNA, 20 bp, Homo sapiens
ccatctgcctgaccccttca

SEQ ID NO: 6726597 - DNA, 11 bp, Homo sapiens
ccatctgctcc

SEQ ID NO: 6726598 - DNA, 14 bp, Homo sapiens
ccatctgctcctcc

SEQ ID NO: 6726599 - DNA, 16 bp, Homo sapiens
ccatctgctcctccca

SEQ ID NO: 6726600 - DNA, 13 bp, Homo sapiens
ccatctgctcctg

SEQ ID NO: 6726601 - DNA, 14 bp, Homo sapiens
ccatctgctcctgg

SEQ ID NO: 6726602 - DNA, 15 bp, Homo sapiens
ccatctgctcctgga

SEQ ID NO: 6726603 - DNA, 14 bp, Homo sapiens
ccatctgctgcagt

SEQ ID NO: 6726604 - DNA, 20 bp, Homo sapiens
ccatctgctgcagttaccac

SEQ ID NO: 6726605 - DNA, 19 bp, Homo sapiens
ccatctgcttggttggctg

SEQ ID NO: 6726606 - DNA, 12 bp, Homo sapiens
ccatctggaaat

SEQ ID NO: 6726607 - DNA, 19 bp, Homo sapiens
ccatctggaggctcccatg

SEQ ID NO: 6726608 - DNA, 12 bp, Homo sapiens
ccatctggatgt

SEQ ID NO: 6726609 - DNA, 19 bp, Homo sapiens
ccatctggatgtaaatcct

SEQ ID NO: 6726610 - DNA, 13 bp, Homo sapiens
ccatctggcctgg

SEQ ID NO: 6726611 - DNA, 15 bp, Homo sapiens
ccatctggcctggcc

SEQ ID NO: 6726612 - DNA, 22 bp, Homo sapiens
ccatctggcctggcctggccct

SEQ ID NO: 6726613 - DNA, 22 bp, Homo sapiens
ccatctgggtccttgcacccct

SEQ ID NO: 6726614 - DNA, 23 bp, Homo sapiens
ccatctgggtccttgcacccctc

SEQ ID NO: 6726615 - DNA, 20 bp, Homo sapiens
ccatctgtaaatatcccaga

SEQ ID NO: 6726616 - DNA, 22 bp, Homo sapiens
ccatctgtaaatatcccagaga

SEQ ID NO: 6726617 - DNA, 12 bp, Homo sapiens
ccatctgtaata

SEQ ID NO: 6726618 - DNA, 14 bp, Homo sapiens
ccatctgtacatat

SEQ ID NO: 6726619 - DNA, 12 bp, Homo sapiens
ccatctgtccag

SEQ ID NO: 6726620 - DNA, 12 bp, Homo sapiens
ccatctgtccat

SEQ ID NO: 6726621 - DNA, 21 bp, Homo sapiens
ccatctgtccgtccagagccg

SEQ ID NO: 6726622 - DNA, 15 bp, Homo sapiens
ccatctgtctgccaa

SEQ ID NO: 6726623 - DNA, 16 bp, Homo sapiens
ccatctgtctgtccta

SEQ ID NO: 6726624 - DNA, 17 bp, Homo sapiens
ccatctgtctgtcctac

SEQ ID NO: 6726625 - DNA, 15 bp, Homo sapiens
ccatctgtcttcagc

SEQ ID NO: 6726626 - DNA, 16 bp, Homo sapiens
ccatctgtcttcagca

SEQ ID NO: 6726627 - DNA, 21 bp, Homo sapiens
ccatctgtgcacactaagaaa

SEQ ID NO: 6726628 - DNA, 14 bp, Homo sapiens
ccatctgtgcattc

SEQ ID NO: 6726629 - DNA, 20 bp, Homo sapiens
ccatctgtggttttcctcta

SEQ ID NO: 6726630 - DNA, 20 bp, Homo sapiens
ccatctgtgtgtgaattcct

SEQ ID NO: 6726631 - DNA, 20 bp, Homo sapiens
ccatcttaaatgacagtgaa

SEQ ID NO: 6726632 - DNA, 12 bp, Homo sapiens
ccatcttaatct

SEQ ID NO: 6726633 - DNA, 14 bp, Homo sapiens
ccatcttaatcttt

SEQ ID NO: 6726634 - DNA, 20 bp, Homo sapiens
ccatcttcactggcttccat

SEQ ID NO: 6726635 - DNA, 15 bp, Homo sapiens
ccatcttcagcttct

SEQ ID NO: 6726636 - DNA, 22 bp, Homo sapiens
ccatcttccacctgtgccctca

SEQ ID NO: 6726637 - DNA, 15 bp, Homo sapiens
ccatcttccaggatg

SEQ ID NO: 6726638 - DNA, 20 bp, Homo sapiens
ccatcttccatatccgggtg

SEQ ID NO: 6726639 - DNA, 15 bp, Homo sapiens
ccatcttccattgcc

SEQ ID NO: 6726640 - DNA, 15 bp, Homo sapiens
ccatcttcctgctgc

SEQ ID NO: 6726641 - DNA, 18 bp, Homo sapiens
ccatcttctatcttcttt

SEQ ID NO: 6726642 - DNA, 18 bp, Homo sapiens
ccatcttctccccacagc

SEQ ID NO: 6726643 - DNA, 21 bp, Homo sapiens
ccatcttctccccacagcctc

SEQ ID NO: 6726644 - DNA, 22 bp, Homo sapiens
ccatcttcttcccttaactcca

SEQ ID NO: 6726645 - DNA, 17 bp, Homo sapiens
ccatcttctttcttcca

SEQ ID NO: 6726646 - DNA, 21 bp, Homo sapiens
ccatcttgatctttgagccca

SEQ ID NO: 6726647 - DNA, 13 bp, Homo sapiens
ccatcttgcctcc

SEQ ID NO: 6726648 - DNA, 23 bp, Homo sapiens
ccatcttgctaataaacactggc

SEQ ID NO: 6726649 - DNA, 11 bp, Homo sapiens
ccatcttgctt

SEQ ID NO: 6726650 - DNA, 19 bp, Homo sapiens
ccatcttgcttccaagacc

SEQ ID NO: 6726651 - DNA, 20 bp, Homo sapiens
ccatcttgcttccctaatct

SEQ ID NO: 6726652 - DNA, 21 bp, Homo sapiens
ccatcttgcttccctaatcta

SEQ ID NO: 6726653 - DNA, 13 bp, Homo sapiens
ccatcttgctttt

SEQ ID NO: 6726654 - DNA, 18 bp, Homo sapiens
ccatcttggcaaggttca

SEQ ID NO: 6726655 - DNA, 22 bp, Homo sapiens
ccatcttggcaaggttcagtct

SEQ ID NO: 6726656 - DNA, 18 bp, Homo sapiens
ccatcttggccaggctgg

SEQ ID NO: 6726657 - DNA, 23 bp, Homo sapiens
ccatcttgggattcctcccctgg

SEQ ID NO: 6726658 - DNA, 23 bp, Homo sapiens
ccatcttggtagttctgtgcctc

SEQ ID NO: 6726659 - DNA, 16 bp, Homo sapiens
ccatcttgtggggcca

SEQ ID NO: 6726660 - DNA, 15 bp, Homo sapiens
ccatctttactccca

SEQ ID NO: 6726661 - DNA, 20 bp, Homo sapiens
ccatctttactcccaagact

SEQ ID NO: 6726662 - DNA, 20 bp, Homo sapiens
ccatctttagcagtttcctc

SEQ ID NO: 6726663 - DNA, 16 bp, Homo sapiens
ccatctttgaggtgag

SEQ ID NO: 6726664 - DNA, 14 bp, Homo sapiens
ccatctttgatcct

SEQ ID NO: 6726665 - DNA, 23 bp, Homo sapiens
ccatcttttgttaagttcaccgt

SEQ ID NO: 6726666 - DNA, 22 bp, Homo sapiens
ccatcttttgttactcttggga

SEQ ID NO: 6726667 - DNA, 20 bp, Homo sapiens
ccatctttttaacctctgtt

SEQ ID NO: 6726668 - DNA, 23 bp, Homo sapiens
ccatctttttaacctctgttcag

SEQ ID NO: 6726669 - DNA, 17 bp, Homo sapiens
ccatctttttcttgggt

SEQ ID NO: 6726670 - DNA, 21 bp, Homo sapiens
ccatgaaaaaaatgatcccca

SEQ ID NO: 6726671 - DNA, 13 bp, Homo sapiens
ccatgaaaaacag

SEQ ID NO: 6726672 - DNA, 23 bp, Homo sapiens
ccatgaaaacgttttattgtgtt

SEQ ID NO: 6726673 - DNA, 14 bp, Homo sapiens
ccatgaaacagcag

SEQ ID NO: 6726674 - DNA, 15 bp, Homo sapiens
ccatgaaacagcagc

SEQ ID NO: 6726675 - DNA, 18 bp, Homo sapiens
ccatgaaacagcagctga

SEQ ID NO: 6726676 - DNA, 22 bp, Homo sapiens
ccatgaaacttgagcattcaaa

SEQ ID NO: 6726677 - DNA, 12 bp, Homo sapiens
ccatgaacacac

SEQ ID NO: 6726678 - DNA, 17 bp, Homo sapiens
ccatgaacacactgtgt

SEQ ID NO: 6726679 - DNA, 16 bp, Homo sapiens
ccatgaacagaaaaca

SEQ ID NO: 6726680 - DNA, 20 bp, Homo sapiens
ccatgaaccaaatggttctt

SEQ ID NO: 6726681 - DNA, 13 bp, Homo sapiens
ccatgaaccctgc

SEQ ID NO: 6726682 - DNA, 22 bp, Homo sapiens
ccatgaacttgatacgtccgtg

SEQ ID NO: 6726683 - DNA, 14 bp, Homo sapiens
ccatgaagaattcc

SEQ ID NO: 6726684 - DNA, 14 bp, Homo sapiens
ccatgaagacagga

SEQ ID NO: 6726685 - DNA, 18 bp, Homo sapiens
ccatgaagagatttttca

SEQ ID NO: 6726686 - DNA, 22 bp, Homo sapiens
ccatgaagagatttttcatgat

SEQ ID NO: 6726687 - DNA, 22 bp, Homo sapiens
ccatgaagaggagattggccag

SEQ ID NO: 6726688 - DNA, 12 bp, Homo sapiens
ccatgaagcctt

SEQ ID NO: 6726689 - DNA, 12 bp, Homo sapiens
ccatgaagctgg

SEQ ID NO: 6726690 - DNA, 21 bp, Homo sapiens
ccatgaagctggaagcactgc

SEQ ID NO: 6726691 - DNA, 21 bp, Homo sapiens
ccatgaagctggccctcagct

SEQ ID NO: 6726692 - DNA, 17 bp, Homo sapiens
ccatgaaggcacctgcc

SEQ ID NO: 6726693 - DNA, 23 bp, Homo sapiens
ccatgaaggcacctgcccccaca

SEQ ID NO: 6726694 - DNA, 18 bp, Homo sapiens
ccatgaagggaccctttg

SEQ ID NO: 6726695 - DNA, 18 bp, Homo sapiens
ccatgaatgaacccctgg

SEQ ID NO: 6726696 - DNA, 11 bp, Homo sapiens
ccatgaatgag

SEQ ID NO: 6726697 - DNA, 20 bp, Homo sapiens
ccatgaatgatatgctagaa

SEQ ID NO: 6726698 - DNA, 15 bp, Homo sapiens
ccatgaatgttcctg

SEQ ID NO: 6726699 - DNA, 14 bp, Homo sapiens
ccatgaattcttga

SEQ ID NO: 6726700 - DNA, 17 bp, Homo sapiens
ccatgacaaacctagct

SEQ ID NO: 6726701 - DNA, 18 bp, Homo sapiens
ccatgacaaacctagctt

SEQ ID NO: 6726702 - DNA, 22 bp, Homo sapiens
ccatgacaacttctaattgcca

SEQ ID NO: 6726703 - DNA, 13 bp, Homo sapiens
ccatgacacccaa

SEQ ID NO: 6726704 - DNA, 19 bp, Homo sapiens
ccatgacagaggctgcacc

SEQ ID NO: 6726705 - DNA, 16 bp, Homo sapiens
ccatgacagtagcata

SEQ ID NO: 6726706 - DNA, 15 bp, Homo sapiens
ccatgacatttcatc

SEQ ID NO: 6726707 - DNA, 19 bp, Homo sapiens
ccatgacatttcatctggg

SEQ ID NO: 6726708 - DNA, 13 bp, Homo sapiens
ccatgacattttt

SEQ ID NO: 6726709 - DNA, 16 bp, Homo sapiens
ccatgaccagaaacag

SEQ ID NO: 6726710 - DNA, 20 bp, Homo sapiens
ccatgaccagttctggccag

SEQ ID NO: 6726711 - DNA, 16 bp, Homo sapiens
ccatgacccacccctg

SEQ ID NO: 6726712 - DNA, 19 bp, Homo sapiens
ccatgacccacccctgtgc

SEQ ID NO: 6726713 - DNA, 15 bp, Homo sapiens
ccatgacccaggctg

SEQ ID NO: 6726714 - DNA, 14 bp, Homo sapiens
ccatgaccccttct

SEQ ID NO: 6726715 - DNA, 21 bp, Homo sapiens
ccatgaccctacataaggctg

SEQ ID NO: 6726716 - DNA, 16 bp, Homo sapiens
ccatgaccctgcctct

SEQ ID NO: 6726717 - DNA, 18 bp, Homo sapiens
ccatgaccctgcctctcc

SEQ ID NO: 6726718 - DNA, 20 bp, Homo sapiens
ccatgaccctgcctctccca

SEQ ID NO: 6726719 - DNA, 16 bp, Homo sapiens
ccatgacctcacccct

SEQ ID NO: 6726720 - DNA, 20 bp, Homo sapiens
ccatgacctcacccctcctt

SEQ ID NO: 6726721 - DNA, 12 bp, Homo sapiens
ccatgacctccc

SEQ ID NO: 6726722 - DNA, 21 bp, Homo sapiens
ccatgacctcccctccccagc

SEQ ID NO: 6726723 - DNA, 19 bp, Homo sapiens
ccatgaccttgacgtgtgt

SEQ ID NO: 6726724 - DNA, 19 bp, Homo sapiens
ccatgaccttggggtacaa

SEQ ID NO: 6726725 - DNA, 15 bp, Homo sapiens
ccatgacctttttca

SEQ ID NO: 6726726 - DNA, 16 bp, Homo sapiens
ccatgacgcaggagct

SEQ ID NO: 6726727 - DNA, 16 bp, Homo sapiens
ccatgactctgcctaa

SEQ ID NO: 6726728 - DNA, 19 bp, Homo sapiens
ccatgactcttggagcctc

SEQ ID NO: 6726729 - DNA, 20 bp, Homo sapiens
ccatgactgcacccagctcc

SEQ ID NO: 6726730 - DNA, 13 bp, Homo sapiens
ccatgactgctca

SEQ ID NO: 6726731 - DNA, 14 bp, Homo sapiens
ccatgactgctcag

SEQ ID NO: 6726732 - DNA, 16 bp, Homo sapiens
ccatgactgctcaggc

SEQ ID NO: 6726733 - DNA, 17 bp, Homo sapiens
ccatgactgctcaggcc

SEQ ID NO: 6726734 - DNA, 12 bp, Homo sapiens
ccatgactgctt

SEQ ID NO: 6726735 - DNA, 19 bp, Homo sapiens
ccatgactgcttgccctaa

SEQ ID NO: 6726736 - DNA, 13 bp, Homo sapiens
ccatgagaagagg

SEQ ID NO: 6726737 - DNA, 17 bp, Homo sapiens
ccatgagaagagggcct

SEQ ID NO: 6726738 - DNA, 15 bp, Homo sapiens
ccatgagaccctggt

SEQ ID NO: 6726739 - DNA, 20 bp, Homo sapiens
ccatgagaccctggtgcctg

SEQ ID NO: 6726740 - DNA, 15 bp, Homo sapiens
ccatgagactgccct

SEQ ID NO: 6726741 - DNA, 19 bp, Homo sapiens
ccatgagactgccctgccc

SEQ ID NO: 6726742 - DNA, 20 bp, Homo sapiens
ccatgagataaataaaaata

SEQ ID NO: 6726743 - DNA, 20 bp, Homo sapiens
ccatgagatagcattagctg

SEQ ID NO: 6726744 - DNA, 20 bp, Homo sapiens
ccatgagcactactctacca

SEQ ID NO: 6726745 - DNA, 13 bp, Homo sapiens
ccatgagcctcag

SEQ ID NO: 6726746 - DNA, 23 bp, Homo sapiens
ccatgagcctcagcatcctggca

SEQ ID NO: 6726747 - DNA, 23 bp, Homo sapiens
ccatgagcctgcccgctgcaatg

SEQ ID NO: 6726748 - DNA, 17 bp, Homo sapiens
ccatgagctccagaccc

SEQ ID NO: 6726749 - DNA, 18 bp, Homo sapiens
ccatgagctccagacccc

SEQ ID NO: 6726750 - DNA, 19 bp, Homo sapiens
ccatgagctccagaccccc

SEQ ID NO: 6726751 - DNA, 14 bp, Homo sapiens
ccatgagctcgggg

SEQ ID NO: 6726752 - DNA, 15 bp, Homo sapiens
ccatgagctcggggt

SEQ ID NO: 6726753 - DNA, 21 bp, Homo sapiens
ccatgagctcggggtccacca

SEQ ID NO: 6726754 - DNA, 21 bp, Homo sapiens
ccatgagctgcactgatcacc

SEQ ID NO: 6726755 - DNA, 23 bp, Homo sapiens
ccatgaggaacaaggcaaggctg

SEQ ID NO: 6726756 - DNA, 19 bp, Homo sapiens
ccatgaggagcgtggactc

SEQ ID NO: 6726757 - DNA, 14 bp, Homo sapiens
ccatgaggaggcag

SEQ ID NO: 6726758 - DNA, 18 bp, Homo sapiens
ccatgaggaggcagagag

SEQ ID NO: 6726759 - DNA, 18 bp, Homo sapiens
ccatgagggacagggtct

SEQ ID NO: 6726760 - DNA, 19 bp, Homo sapiens
ccatgagggacagggtctt

SEQ ID NO: 6726761 - DNA, 18 bp, Homo sapiens
ccatgagggagatgccat

SEQ ID NO: 6726762 - DNA, 23 bp, Homo sapiens
ccatgagggagatgccatgagcc

SEQ ID NO: 6726763 - DNA, 23 bp, Homo sapiens
ccatgaggggattcccttccttc

SEQ ID NO: 6726764 - DNA, 17 bp, Homo sapiens
ccatgaggtactggtcc

SEQ ID NO: 6726765 - DNA, 17 bp, Homo sapiens
ccatgagtccttgaaaa

SEQ ID NO: 6726766 - DNA, 23 bp, Homo sapiens
ccatgagtgctaagagcctctgg

SEQ ID NO: 6726767 - DNA, 13 bp, Homo sapiens
ccatgagttgagt

SEQ ID NO: 6726768 - DNA, 15 bp, Homo sapiens
ccatgagttgggggt

SEQ ID NO: 6726769 - DNA, 21 bp, Homo sapiens
ccatgagttggggtctggcag

SEQ ID NO: 6726770 - DNA, 22 bp, Homo sapiens
ccatgataataggtcatatgtt

SEQ ID NO: 6726771 - DNA, 14 bp, Homo sapiens
ccatgatacaaaga

SEQ ID NO: 6726772 - DNA, 14 bp, Homo sapiens
ccatgatcacacag

SEQ ID NO: 6726773 - DNA, 13 bp, Homo sapiens
ccatgatccagaa

SEQ ID NO: 6726774 - DNA, 17 bp, Homo sapiens
ccatgatccattccctt

SEQ ID NO: 6726775 - DNA, 17 bp, Homo sapiens
ccatgatccctgtgttg

SEQ ID NO: 6726776 - DNA, 23 bp, Homo sapiens
ccatgatctatacacataagcat

SEQ ID NO: 6726777 - DNA, 14 bp, Homo sapiens
ccatgatgcacagt

SEQ ID NO: 6726778 - DNA, 15 bp, Homo sapiens
ccatgatggcaacag

SEQ ID NO: 6726779 - DNA, 13 bp, Homo sapiens
ccatgatggccag

SEQ ID NO: 6726780 - DNA, 18 bp, Homo sapiens
ccatgatgtagtgcctct

SEQ ID NO: 6726781 - DNA, 19 bp, Homo sapiens
ccatgatgtcgttcatttt

SEQ ID NO: 6726782 - DNA, 13 bp, Homo sapiens
ccatgatgttaat

SEQ ID NO: 6726783 - DNA, 18 bp, Homo sapiens
ccatgatgttttccatga

SEQ ID NO: 6726784 - DNA, 19 bp, Homo sapiens
ccatgattaaccacttcag

SEQ ID NO: 6726785 - DNA, 22 bp, Homo sapiens
ccatgattccaagggcccagag

SEQ ID NO: 6726786 - DNA, 16 bp, Homo sapiens
ccatgatttagcaagc

SEQ ID NO: 6726787 - DNA, 18 bp, Homo sapiens
ccatgatttagcaagcaa

SEQ ID NO: 6726788 - DNA, 15 bp, Homo sapiens
ccatgatttcatgta

SEQ ID NO: 6726789 - DNA, 18 bp, Homo sapiens
ccatgattttggccactt

SEQ ID NO: 6726790 - DNA, 16 bp, Homo sapiens
ccatgcaactccatgc

SEQ ID NO: 6726791 - DNA, 22 bp, Homo sapiens
ccatgcaagaactcatcactgt

SEQ ID NO: 6726792 - DNA, 15 bp, Homo sapiens
ccatgcaagtagctg

SEQ ID NO: 6726793 - DNA, 16 bp, Homo sapiens
ccatgcaagtgctgtt

SEQ ID NO: 6726794 - DNA, 18 bp, Homo sapiens
ccatgcaatatttcctca

SEQ ID NO: 6726795 - DNA, 16 bp, Homo sapiens
ccatgcaattaaaagg

SEQ ID NO: 6726796 - DNA, 21 bp, Homo sapiens
ccatgcacacaaacacctcct

SEQ ID NO: 6726797 - DNA, 23 bp, Homo sapiens
ccatgcacactcatgcacacaga

SEQ ID NO: 6726798 - DNA, 20 bp, Homo sapiens
ccatgcacagtacaataatg

SEQ ID NO: 6726799 - DNA, 20 bp, Homo sapiens
ccatgcaccaggactggctg

SEQ ID NO: 6726800 - DNA, 13 bp, Homo sapiens
ccatgcacctccc

SEQ ID NO: 6726801 - DNA, 15 bp, Homo sapiens
ccatgcacctccctt

SEQ ID NO: 6726802 - DNA, 19 bp, Homo sapiens
ccatgcacctcccttccct

SEQ ID NO: 6726803 - DNA, 22 bp, Homo sapiens
ccatgcacctcccttccctccc

SEQ ID NO: 6726804 - DNA, 23 bp, Homo sapiens
ccatgcacgcaccccgcccctgc

SEQ ID NO: 6726805 - DNA, 21 bp, Homo sapiens
ccatgcactatatttgtatat

SEQ ID NO: 6726806 - DNA, 21 bp, Homo sapiens
ccatgcactgtgaaggaccct

SEQ ID NO: 6726807 - DNA, 11 bp, Homo sapiens
ccatgcagaaa

SEQ ID NO: 6726808 - DNA, 15 bp, Homo sapiens
ccatgcagaacacca

SEQ ID NO: 6726809 - DNA, 21 bp, Homo sapiens
ccatgcagacctcatgcccag

SEQ ID NO: 6726810 - DNA, 14 bp, Homo sapiens
ccatgcagcccctg

SEQ ID NO: 6726811 - DNA, 19 bp, Homo sapiens
ccatgcagccttggggcat

SEQ ID NO: 6726812 - DNA, 19 bp, Homo sapiens
ccatgcagcttcatcaatt

SEQ ID NO: 6726813 - DNA, 12 bp, Homo sapiens
ccatgcagcttt

SEQ ID NO: 6726814 - DNA, 16 bp, Homo sapiens
ccatgcaggaagaggc

SEQ ID NO: 6726815 - DNA, 18 bp, Homo sapiens
ccatgcaggaagaggccc

SEQ ID NO: 6726816 - DNA, 21 bp, Homo sapiens
ccatgcaggaagaggcccact

SEQ ID NO: 6726817 - DNA, 23 bp, Homo sapiens
ccatgcaggaagaggcccactag

SEQ ID NO: 6726818 - DNA, 14 bp, Homo sapiens
ccatgcaggaggtg

SEQ ID NO: 6726819 - DNA, 13 bp, Homo sapiens
ccatgcaggccct

SEQ ID NO: 6726820 - DNA, 21 bp, Homo sapiens
ccatgcagtgaccgcttcccc

SEQ ID NO: 6726821 - DNA, 21 bp, Homo sapiens
ccatgcatcttccactggaac

SEQ ID NO: 6726822 - DNA, 19 bp, Homo sapiens
ccatgcatggcctcccagc

SEQ ID NO: 6726823 - DNA, 20 bp, Homo sapiens
ccatgcatggcctcccagcc

SEQ ID NO: 6726824 - DNA, 21 bp, Homo sapiens
ccatgcatggcctcccagcca

SEQ ID NO: 6726825 - DNA, 15 bp, Homo sapiens
ccatgcattcagatc

SEQ ID NO: 6726826 - DNA, 21 bp, Homo sapiens
ccatgcattcagatctgaagt

SEQ ID NO: 6726827 - DNA, 16 bp, Homo sapiens
ccatgcatttaaagta

SEQ ID NO: 6726828 - DNA, 20 bp, Homo sapiens
ccatgccaaagctagggtgg

SEQ ID NO: 6726829 - DNA, 18 bp, Homo sapiens
ccatgccaataaagtgat

SEQ ID NO: 6726830 - DNA, 20 bp, Homo sapiens
ccatgccaccacccacccca

SEQ ID NO: 6726831 - DNA, 21 bp, Homo sapiens
ccatgccaccacccaccccaa

SEQ ID NO: 6726832 - DNA, 21 bp, Homo sapiens
ccatgccacgttccacagttg

SEQ ID NO: 6726833 - DNA, 14 bp, Homo sapiens
ccatgccactgcca

SEQ ID NO: 6726834 - DNA, 15 bp, Homo sapiens
ccatgccactgccag

SEQ ID NO: 6726835 - DNA, 16 bp, Homo sapiens
ccatgccactgccagg

SEQ ID NO: 6726836 - DNA, 18 bp, Homo sapiens
ccatgccactgccaggca

SEQ ID NO: 6726837 - DNA, 20 bp, Homo sapiens
ccatgccactgccaggcacc

SEQ ID NO: 6726838 - DNA, 14 bp, Homo sapiens
ccatgccagagagg

SEQ ID NO: 6726839 - DNA, 19 bp, Homo sapiens
ccatgccagattctgcctc

SEQ ID NO: 6726840 - DNA, 12 bp, Homo sapiens
ccatgccagccg

SEQ ID NO: 6726841 - DNA, 21 bp, Homo sapiens
ccatgccagcgcagcgccagg

SEQ ID NO: 6726842 - DNA, 12 bp, Homo sapiens
ccatgccaggct

SEQ ID NO: 6726843 - DNA, 14 bp, Homo sapiens
ccatgcccaaccta

SEQ ID NO: 6726844 - DNA, 13 bp, Homo sapiens
ccatgcccaccat

SEQ ID NO: 6726845 - DNA, 20 bp, Homo sapiens
ccatgcccaccgcccctgga

SEQ ID NO: 6726846 - DNA, 13 bp, Homo sapiens
ccatgcccacctg

SEQ ID NO: 6726847 - DNA, 19 bp, Homo sapiens
ccatgcccacgcccctccc

SEQ ID NO: 6726848 - DNA, 15 bp, Homo sapiens
ccatgcccactgctg

SEQ ID NO: 6726849 - DNA, 16 bp, Homo sapiens
ccatgcccactgctgg

SEQ ID NO: 6726850 - DNA, 21 bp, Homo sapiens
ccatgcccactgctggtgcca

SEQ ID NO: 6726851 - DNA, 13 bp, Homo sapiens
ccatgcccagcta

SEQ ID NO: 6726852 - DNA, 14 bp, Homo sapiens
ccatgcccaggacg

SEQ ID NO: 6726853 - DNA, 20 bp, Homo sapiens
ccatgccccacccccctcct

SEQ ID NO: 6726854 - DNA, 21 bp, Homo sapiens
ccatgccccacccccctcctc

SEQ ID NO: 6726855 - DNA, 18 bp, Homo sapiens
ccatgccccactctgctg

SEQ ID NO: 6726856 - DNA, 19 bp, Homo sapiens
ccatgccccactctgctga

SEQ ID NO: 6726857 - DNA, 24 bp, Homo sapiens
ccatgccccactctgctgaggcca

SEQ ID NO: 6726858 - DNA, 18 bp, Homo sapiens
ccatgccccagctctgga

SEQ ID NO: 6726859 - DNA, 18 bp, Homo sapiens
ccatgcccccgccacctc

SEQ ID NO: 6726860 - DNA, 20 bp, Homo sapiens
ccatgcccccgccacctccc

SEQ ID NO: 6726861 - DNA, 14 bp, Homo sapiens
ccatgcccctgaca

SEQ ID NO: 6726862 - DNA, 21 bp, Homo sapiens
ccatgcccggctaatttttgt

SEQ ID NO: 6726863 - DNA, 20 bp, Homo sapiens
ccatgccctcccaggaccct

SEQ ID NO: 6726864 - DNA, 18 bp, Homo sapiens
ccatgccctccgtcctgg

SEQ ID NO: 6726865 - DNA, 18 bp, Homo sapiens
ccatgcccttacacgtgc

SEQ ID NO: 6726866 - DNA, 22 bp, Homo sapiens
ccatgcctaaagcccattgctg

SEQ ID NO: 6726867 - DNA, 17 bp, Homo sapiens
ccatgcctacagataat

SEQ ID NO: 6726868 - DNA, 15 bp, Homo sapiens
ccatgcctagcagag

SEQ ID NO: 6726869 - DNA, 23 bp, Homo sapiens
ccatgcctagcagagtgctggca

SEQ ID NO: 6726870 - DNA, 13 bp, Homo sapiens
ccatgcctatggg

SEQ ID NO: 6726871 - DNA, 16 bp, Homo sapiens
ccatgcctcagccctg

SEQ ID NO: 6726872 - DNA, 15 bp, Homo sapiens
ccatgcctcatgcca

SEQ ID NO: 6726873 - DNA, 18 bp, Homo sapiens
ccatgcctcatgccacac

SEQ ID NO: 6726874 - DNA, 23 bp, Homo sapiens
ccatgcctcatgccacaccttct

SEQ ID NO: 6726875 - DNA, 14 bp, Homo sapiens
ccatgcctccagct

SEQ ID NO: 6726876 - DNA, 13 bp, Homo sapiens
ccatgcctccctg

SEQ ID NO: 6726877 - DNA, 12 bp, Homo sapiens
ccatgcctctgg

SEQ ID NO: 6726878 - DNA, 13 bp, Homo sapiens
ccatgcctctgga

SEQ ID NO: 6726879 - DNA, 12 bp, Homo sapiens
ccatgcctgagg

SEQ ID NO: 6726880 - DNA, 14 bp, Homo sapiens
ccatgcctgagggt

SEQ ID NO: 6726881 - DNA, 16 bp, Homo sapiens
ccatgcctgagggtgg

SEQ ID NO: 6726882 - DNA, 14 bp, Homo sapiens
ccatgcctgctccc

SEQ ID NO: 6726883 - DNA, 16 bp, Homo sapiens
ccatgcctgctccctg

SEQ ID NO: 6726884 - DNA, 17 bp, Homo sapiens
ccatgcctgctccctgt

SEQ ID NO: 6726885 - DNA, 21 bp, Homo sapiens
ccatgcctgctccctgtctgt

SEQ ID NO: 6726886 - DNA, 14 bp, Homo sapiens
ccatgcctggccct

SEQ ID NO: 6726887 - DNA, 17 bp, Homo sapiens
ccatgcctggcccttgc

SEQ ID NO: 6726888 - DNA, 22 bp, Homo sapiens
ccatgcctggcccttgccgggg

SEQ ID NO: 6726889 - DNA, 19 bp, Homo sapiens
ccatgcctggtcccaagac

SEQ ID NO: 6726890 - DNA, 23 bp, Homo sapiens
ccatgcctgtagctttcctggtc

SEQ ID NO: 6726891 - DNA, 13 bp, Homo sapiens
ccatgcctgtcca

SEQ ID NO: 6726892 - DNA, 19 bp, Homo sapiens
ccatgcctgtccagcctgg

SEQ ID NO: 6726893 - DNA, 15 bp, Homo sapiens
ccatgcctgtctctg

SEQ ID NO: 6726894 - DNA, 13 bp, Homo sapiens
ccatgcctgtggc

SEQ ID NO: 6726895 - DNA, 16 bp, Homo sapiens
ccatgcctgtggctgc

SEQ ID NO: 6726896 - DNA, 17 bp, Homo sapiens
ccatgcctgtggctgcg

SEQ ID NO: 6726897 - DNA, 19 bp, Homo sapiens
ccatgcgaggggccagcag

SEQ ID NO: 6726898 - DNA, 23 bp, Homo sapiens
ccatgcgccttcgtgcctgagac

SEQ ID NO: 6726899 - DNA, 16 bp, Homo sapiens
ccatgcgctcagggcc

SEQ ID NO: 6726900 - DNA, 18 bp, Homo sapiens
ccatgcgctgctcaacct

SEQ ID NO: 6726901 - DNA, 23 bp, Homo sapiens
ccatgcgctgctcaacctctctc

SEQ ID NO: 6726902 - DNA, 18 bp, Homo sapiens
ccatgcggccggcctggg

SEQ ID NO: 6726903 - DNA, 18 bp, Homo sapiens
ccatgcgtgccgcctgct

SEQ ID NO: 6726904 - DNA, 22 bp, Homo sapiens
ccatgctatctgttcctatctg

SEQ ID NO: 6726905 - DNA, 21 bp, Homo sapiens
ccatgctatgagttttctcct

SEQ ID NO: 6726906 - DNA, 16 bp, Homo sapiens
ccatgctcaaccactg

SEQ ID NO: 6726907 - DNA, 21 bp, Homo sapiens
ccatgctcaaccactgtggcg

SEQ ID NO: 6726908 - DNA, 17 bp, Homo sapiens
ccatgctcaacccccct

SEQ ID NO: 6726909 - DNA, 23 bp, Homo sapiens
ccatgctcaacccccctcccaga

SEQ ID NO: 6726910 - DNA, 13 bp, Homo sapiens
ccatgctcatctg

SEQ ID NO: 6726911 - DNA, 12 bp, Homo sapiens
ccatgctccacc

SEQ ID NO: 6726912 - DNA, 21 bp, Homo sapiens
ccatgctccagggtcaggcgg

SEQ ID NO: 6726913 - DNA, 19 bp, Homo sapiens
ccatgctcccaactccctt

SEQ ID NO: 6726914 - DNA, 21 bp, Homo sapiens
ccatgctcccaactcccttct

SEQ ID NO: 6726915 - DNA, 16 bp, Homo sapiens
ccatgctcctcacctg

SEQ ID NO: 6726916 - DNA, 15 bp, Homo sapiens
ccatgctcctcttcc

SEQ ID NO: 6726917 - DNA, 19 bp, Homo sapiens
ccatgctcctcttccccag

SEQ ID NO: 6726918 - DNA, 20 bp, Homo sapiens
ccatgctcctcttccccaga

SEQ ID NO: 6726919 - DNA, 24 bp, Homo sapiens
ccatgctcctcttccccagacgcc

SEQ ID NO: 6726920 - DNA, 15 bp, Homo sapiens
ccatgctcctggccc

SEQ ID NO: 6726921 - DNA, 18 bp, Homo sapiens
ccatgctcctggcccact

SEQ ID NO: 6726922 - DNA, 14 bp, Homo sapiens
ccatgctctctcac

SEQ ID NO: 6726923 - DNA, 19 bp, Homo sapiens
ccatgctctctcacctgct

SEQ ID NO: 6726924 - DNA, 21 bp, Homo sapiens
ccatgctctctcacctgctcc

SEQ ID NO: 6726925 - DNA, 13 bp, Homo sapiens
ccatgctctgccc

SEQ ID NO: 6726926 - DNA, 17 bp, Homo sapiens
ccatgctctgccccaag

SEQ ID NO: 6726927 - DNA, 23 bp, Homo sapiens
ccatgctctgccccaagccccca

SEQ ID NO: 6726928 - DNA, 13 bp, Homo sapiens
ccatgctgaaggg

SEQ ID NO: 6726929 - DNA, 16 bp, Homo sapiens
ccatgctgaattattt

SEQ ID NO: 6726930 - DNA, 17 bp, Homo sapiens
ccatgctgagacatccc

SEQ ID NO: 6726931 - DNA, 19 bp, Homo sapiens
ccatgctgagacatccctc

SEQ ID NO: 6726932 - DNA, 13 bp, Homo sapiens
ccatgctgagagc

SEQ ID NO: 6726933 - DNA, 19 bp, Homo sapiens
ccatgctgagagctgggct

SEQ ID NO: 6726934 - DNA, 15 bp, Homo sapiens
ccatgctgaggcctg

SEQ ID NO: 6726935 - DNA, 16 bp, Homo sapiens
ccatgctgaggcctgg

SEQ ID NO: 6726936 - DNA, 18 bp, Homo sapiens
ccatgctgaggcctgggc

SEQ ID NO: 6726937 - DNA, 20 bp, Homo sapiens
ccatgctgaggcctgggccg

SEQ ID NO: 6726938 - DNA, 19 bp, Homo sapiens
ccatgctgcaaaggagaag

SEQ ID NO: 6726939 - DNA, 11 bp, Homo sapiens
ccatgctgccc

SEQ ID NO: 6726940 - DNA, 15 bp, Homo sapiens
ccatgctgccctgtg

SEQ ID NO: 6726941 - DNA, 19 bp, Homo sapiens
ccatgctgccttcagggag

SEQ ID NO: 6726942 - DNA, 17 bp, Homo sapiens
ccatgctgctatgaaga

SEQ ID NO: 6726943 - DNA, 19 bp, Homo sapiens
ccatgctgctggggaagac

SEQ ID NO: 6726944 - DNA, 22 bp, Homo sapiens
ccatgctgctggggaagacagt

SEQ ID NO: 6726945 - DNA, 20 bp, Homo sapiens
ccatgctgctttttggcaca

SEQ ID NO: 6726946 - DNA, 12 bp, Homo sapiens
ccatgctggagc

SEQ ID NO: 6726947 - DNA, 16 bp, Homo sapiens
ccatgctggagcctgt

SEQ ID NO: 6726948 - DNA, 17 bp, Homo sapiens
ccatgctggccttgcca

SEQ ID NO: 6726949 - DNA, 20 bp, Homo sapiens
ccatgctggctgaagaggac

SEQ ID NO: 6726950 - DNA, 14 bp, Homo sapiens
ccatgctggctggg

SEQ ID NO: 6726951 - DNA, 11 bp, Homo sapiens
ccatgctgggc

SEQ ID NO: 6726952 - DNA, 17 bp, Homo sapiens
ccatgctgggccactgg

SEQ ID NO: 6726953 - DNA, 14 bp, Homo sapiens
ccatgctgggctca

SEQ ID NO: 6726954 - DNA, 16 bp, Homo sapiens
ccatgctgggctcact

SEQ ID NO: 6726955 - DNA, 13 bp, Homo sapiens
ccatgctggtcag

SEQ ID NO: 6726956 - DNA, 14 bp, Homo sapiens
ccatgctgtccggc

SEQ ID NO: 6726957 - DNA, 16 bp, Homo sapiens
ccatgctgtctggcac

SEQ ID NO: 6726958 - DNA, 22 bp, Homo sapiens
ccatgctgtctggcacagcctg

SEQ ID NO: 6726959 - DNA, 22 bp, Homo sapiens
ccatgctgtgcgcccagggctg

SEQ ID NO: 6726960 - DNA, 20 bp, Homo sapiens
ccatgctgttgattgctaaa

SEQ ID NO: 6726961 - DNA, 22 bp, Homo sapiens
ccatgctgttgattgctaaatg

SEQ ID NO: 6726962 - DNA, 24 bp, Homo sapiens
ccatgctgttgattgctaaatgta

SEQ ID NO: 6726963 - DNA, 17 bp, Homo sapiens
ccatgcttagtcactgc

SEQ ID NO: 6726964 - DNA, 18 bp, Homo sapiens
ccatgcttagtcactgcc

SEQ ID NO: 6726965 - DNA, 13 bp, Homo sapiens
ccatgcttcactc

SEQ ID NO: 6726966 - DNA, 14 bp, Homo sapiens
ccatgcttgcctga

SEQ ID NO: 6726967 - DNA, 17 bp, Homo sapiens
ccatgctttccttttct

SEQ ID NO: 6726968 - DNA, 15 bp, Homo sapiens
ccatgctttgagtcc

SEQ ID NO: 6726969 - DNA, 22 bp, Homo sapiens
ccatgctttgagtccacgccca

SEQ ID NO: 6726970 - DNA, 18 bp, Homo sapiens
ccatggaaataaaaagta

SEQ ID NO: 6726971 - DNA, 18 bp, Homo sapiens
ccatggaaccatggagga

SEQ ID NO: 6726972 - DNA, 21 bp, Homo sapiens
ccatggaagaggctacagggc

SEQ ID NO: 6726973 - DNA, 16 bp, Homo sapiens
ccatggaagctggcag

SEQ ID NO: 6726974 - DNA, 17 bp, Homo sapiens
ccatggaagctggcagg

SEQ ID NO: 6726975 - DNA, 21 bp, Homo sapiens
ccatggaagctggcaggagac

SEQ ID NO: 6726976 - DNA, 19 bp, Homo sapiens
ccatggaaggtgccagaag

SEQ ID NO: 6726977 - DNA, 23 bp, Homo sapiens
ccatggaaggtgccagaaggaag

SEQ ID NO: 6726978 - DNA, 19 bp, Homo sapiens
ccatggaatgaaccccccg

SEQ ID NO: 6726979 - DNA, 20 bp, Homo sapiens
ccatggacacattttctcct

SEQ ID NO: 6726980 - DNA, 19 bp, Homo sapiens
ccatggacactacacccag

SEQ ID NO: 6726981 - DNA, 20 bp, Homo sapiens
ccatggacactacacccagc

SEQ ID NO: 6726982 - DNA, 15 bp, Homo sapiens
ccatggacactccag

SEQ ID NO: 6726983 - DNA, 17 bp, Homo sapiens
ccatggacactccagtg

SEQ ID NO: 6726984 - DNA, 19 bp, Homo sapiens
ccatggacactccagtgcc

SEQ ID NO: 6726985 - DNA, 14 bp, Homo sapiens
ccatggacaggctg

SEQ ID NO: 6726986 - DNA, 18 bp, Homo sapiens
ccatggacaggctggctc

SEQ ID NO: 6726987 - DNA, 23 bp, Homo sapiens
ccatggacttcacataagctcag

SEQ ID NO: 6726988 - DNA, 13 bp, Homo sapiens
ccatggactttgt

SEQ ID NO: 6726989 - DNA, 14 bp, Homo sapiens
ccatggactttgtt

SEQ ID NO: 6726990 - DNA, 15 bp, Homo sapiens
ccatggagaaagctg

SEQ ID NO: 6726991 - DNA, 17 bp, Homo sapiens
ccatggagacaagaagg

SEQ ID NO: 6726992 - DNA, 21 bp, Homo sapiens
ccatggagacaataaacagct

SEQ ID NO: 6726993 - DNA, 22 bp, Homo sapiens
ccatggagacaataaacagctg

SEQ ID NO: 6726994 - DNA, 22 bp, Homo sapiens
ccatggagagctggagcctggt

SEQ ID NO: 6726995 - DNA, 18 bp, Homo sapiens
ccatggagccagctccct

SEQ ID NO: 6726996 - DNA, 22 bp, Homo sapiens
ccatggagccagctccctctat

SEQ ID NO: 6726997 - DNA, 14 bp, Homo sapiens
ccatggagccccag

SEQ ID NO: 6726998 - DNA, 20 bp, Homo sapiens
ccatggagccccagccccct

SEQ ID NO: 6726999 - DNA, 20 bp, Homo sapiens
ccatggagcccctccaccgg

SEQ ID NO: 6727000 - DNA, 12 bp, Homo sapiens
ccatggaggcag

SEQ ID NO: 6727001 - DNA, 20 bp, Homo sapiens
ccatggagtacggctggtgt

SEQ ID NO: 6727002 - DNA, 19 bp, Homo sapiens
ccatggagtggcagcccag

SEQ ID NO: 6727003 - DNA, 22 bp, Homo sapiens
ccatggagtggcagcccagcca

SEQ ID NO: 6727004 - DNA, 23 bp, Homo sapiens
ccatggagtggcagcccagccag

SEQ ID NO: 6727005 - DNA, 22 bp, Homo sapiens
ccatggagtgggtctggaggac

SEQ ID NO: 6727006 - DNA, 16 bp, Homo sapiens
ccatggatctgatctg

SEQ ID NO: 6727007 - DNA, 21 bp, Homo sapiens
ccatggatgtttcttctttga

SEQ ID NO: 6727008 - DNA, 20 bp, Homo sapiens
ccatggattcccctggacat

SEQ ID NO: 6727009 - DNA, 23 bp, Homo sapiens
ccatggatttttacaagatccat

SEQ ID NO: 6727010 - DNA, 15 bp, Homo sapiens
ccatggcaccagccc

SEQ ID NO: 6727011 - DNA, 23 bp, Homo sapiens
ccatggcaccctgcaccaggcca

SEQ ID NO: 6727012 - DNA, 21 bp, Homo sapiens
ccatggcacctttgagagagg

SEQ ID NO: 6727013 - DNA, 15 bp, Homo sapiens
ccatggcagcagcca

SEQ ID NO: 6727014 - DNA, 16 bp, Homo sapiens
ccatggcagcagccag

SEQ ID NO: 6727015 - DNA, 18 bp, Homo sapiens
ccatggcagcagccaggg

SEQ ID NO: 6727016 - DNA, 18 bp, Homo sapiens
ccatggcagcatggagag

SEQ ID NO: 6727017 - DNA, 19 bp, Homo sapiens
ccatggcagctcctgacct

SEQ ID NO: 6727018 - DNA, 20 bp, Homo sapiens
ccatggcagctcctgacctt

SEQ ID NO: 6727019 - DNA, 15 bp, Homo sapiens
ccatggcaggaaggc

SEQ ID NO: 6727020 - DNA, 11 bp, Homo sapiens
ccatggccacc

SEQ ID NO: 6727021 - DNA, 12 bp, Homo sapiens
ccatggccaccc

SEQ ID NO: 6727022 - DNA, 13 bp, Homo sapiens
ccatggccaggag

SEQ ID NO: 6727023 - DNA, 14 bp, Homo sapiens
ccatggccaggagt

SEQ ID NO: 6727024 - DNA, 16 bp, Homo sapiens
ccatggcccagcagct

SEQ ID NO: 6727025 - DNA, 22 bp, Homo sapiens
ccatggcccagcagcttggctg

SEQ ID NO: 6727026 - DNA, 14 bp, Homo sapiens
ccatggccccagct

SEQ ID NO: 6727027 - DNA, 15 bp, Homo sapiens
ccatggccccagctg

SEQ ID NO: 6727028 - DNA, 23 bp, Homo sapiens
ccatggcccccaataaaggcagc

SEQ ID NO: 6727029 - DNA, 13 bp, Homo sapiens
ccatggcccccca

SEQ ID NO: 6727030 - DNA, 15 bp, Homo sapiens
ccatggccccccact

SEQ ID NO: 6727031 - DNA, 22 bp, Homo sapiens
ccatggccgaagccccttggag

SEQ ID NO: 6727032 - DNA, 17 bp, Homo sapiens
ccatggcctcagccctg

SEQ ID NO: 6727033 - DNA, 19 bp, Homo sapiens
ccatggcctcagccctgct

SEQ ID NO: 6727034 - DNA, 21 bp, Homo sapiens
ccatggcctcagccctgctcc

SEQ ID NO: 6727035 - DNA, 18 bp, Homo sapiens
ccatggcctgcaaactgg

SEQ ID NO: 6727036 - DNA, 13 bp, Homo sapiens
ccatggcctgctg

SEQ ID NO: 6727037 - DNA, 13 bp, Homo sapiens
ccatggcctggca

SEQ ID NO: 6727038 - DNA, 15 bp, Homo sapiens
ccatggcctgtgctg

SEQ ID NO: 6727039 - DNA, 18 bp, Homo sapiens
ccatggcggcccctcagc

SEQ ID NO: 6727040 - DNA, 22 bp, Homo sapiens
ccatggcggcccctcagcctgc

SEQ ID NO: 6727041 - DNA, 16 bp, Homo sapiens
ccatggctcagggtgg

SEQ ID NO: 6727042 - DNA, 13 bp, Homo sapiens
ccatggctctatt

SEQ ID NO: 6727043 - DNA, 22 bp, Homo sapiens
ccatggctctatttcttcttca

SEQ ID NO: 6727044 - DNA, 13 bp, Homo sapiens
ccatggctctgtt

SEQ ID NO: 6727045 - DNA, 19 bp, Homo sapiens
ccatggctgaagctggagc

SEQ ID NO: 6727046 - DNA, 20 bp, Homo sapiens
ccatggctgaagctggagca

SEQ ID NO: 6727047 - DNA, 22 bp, Homo sapiens
ccatggctgaagctggagcagc

SEQ ID NO: 6727048 - DNA, 15 bp, Homo sapiens
ccatggctgctttgt

SEQ ID NO: 6727049 - DNA, 15 bp, Homo sapiens
ccatggctggcagag

SEQ ID NO: 6727050 - DNA, 21 bp, Homo sapiens
ccatggctggggggtctcagc

SEQ ID NO: 6727051 - DNA, 18 bp, Homo sapiens
ccatggcttaatgcttct

SEQ ID NO: 6727052 - DNA, 14 bp, Homo sapiens
ccatggcttcctga

SEQ ID NO: 6727053 - DNA, 13 bp, Homo sapiens
ccatggcttctgg

SEQ ID NO: 6727054 - DNA, 19 bp, Homo sapiens
ccatggctttcatcctgtg

SEQ ID NO: 6727055 - DNA, 20 bp, Homo sapiens
ccatggctttcatcctgtgt

SEQ ID NO: 6727056 - DNA, 14 bp, Homo sapiens
ccatggctttgtgc

SEQ ID NO: 6727057 - DNA, 18 bp, Homo sapiens
ccatggctttgtgctgct

SEQ ID NO: 6727058 - DNA, 18 bp, Homo sapiens
ccatgggaacctcatatg

SEQ ID NO: 6727059 - DNA, 16 bp, Homo sapiens
ccatgggacagggagg

SEQ ID NO: 6727060 - DNA, 20 bp, Homo sapiens
ccatgggacctcctccctca

SEQ ID NO: 6727061 - DNA, 17 bp, Homo sapiens
ccatgggagagtccagg

SEQ ID NO: 6727062 - DNA, 19 bp, Homo sapiens
ccatgggagagtccaggcc

SEQ ID NO: 6727063 - DNA, 22 bp, Homo sapiens
ccatgggagagtccaggcctgg

SEQ ID NO: 6727064 - DNA, 13 bp, Homo sapiens
ccatgggagccag

SEQ ID NO: 6727065 - DNA, 14 bp, Homo sapiens
ccatgggagccagc

SEQ ID NO: 6727066 - DNA, 14 bp, Homo sapiens
ccatgggaggcctt

SEQ ID NO: 6727067 - DNA, 13 bp, Homo sapiens
ccatgggagggag

SEQ ID NO: 6727068 - DNA, 14 bp, Homo sapiens
ccatgggagggagc

SEQ ID NO: 6727069 - DNA, 24 bp, Homo sapiens
ccatgggatacaacctccctcttg

SEQ ID NO: 6727070 - DNA, 14 bp, Homo sapiens
ccatgggatatgtg

SEQ ID NO: 6727071 - DNA, 14 bp, Homo sapiens
ccatgggcaccagg

SEQ ID NO: 6727072 - DNA, 14 bp, Homo sapiens
ccatgggcactgct

SEQ ID NO: 6727073 - DNA, 18 bp, Homo sapiens
ccatgggcactgtgggta

SEQ ID NO: 6727074 - DNA, 14 bp, Homo sapiens
ccatgggcagaaga

SEQ ID NO: 6727075 - DNA, 18 bp, Homo sapiens
ccatgggcagaagataga

SEQ ID NO: 6727076 - DNA, 12 bp, Homo sapiens
ccatgggcagga

SEQ ID NO: 6727077 - DNA, 22 bp, Homo sapiens
ccatgggcagtatgatggcagg

SEQ ID NO: 6727078 - DNA, 21 bp, Homo sapiens
ccatgggcataggtaagctgt

SEQ ID NO: 6727079 - DNA, 19 bp, Homo sapiens
ccatgggccagcctagccc

SEQ ID NO: 6727080 - DNA, 14 bp, Homo sapiens
ccatgggccctcag

SEQ ID NO: 6727081 - DNA, 16 bp, Homo sapiens
ccatgggccctcagcg

SEQ ID NO: 6727082 - DNA, 17 bp, Homo sapiens
ccatgggcctcctgtgt

SEQ ID NO: 6727083 - DNA, 12 bp, Homo sapiens
ccatgggcctgc

SEQ ID NO: 6727084 - DNA, 15 bp, Homo sapiens
ccatgggcctgggcc

SEQ ID NO: 6727085 - DNA, 19 bp, Homo sapiens
ccatgggcctgggcctgct

SEQ ID NO: 6727086 - DNA, 17 bp, Homo sapiens
ccatgggcgaccagggc

SEQ ID NO: 6727087 - DNA, 13 bp, Homo sapiens
ccatgggctcagg

SEQ ID NO: 6727088 - DNA, 17 bp, Homo sapiens
ccatgggctcagggcca

SEQ ID NO: 6727089 - DNA, 15 bp, Homo sapiens
ccatgggctcccact

SEQ ID NO: 6727090 - DNA, 13 bp, Homo sapiens
ccatgggctctgg

SEQ ID NO: 6727091 - DNA, 16 bp, Homo sapiens
ccatgggctctggccc

SEQ ID NO: 6727092 - DNA, 13 bp, Homo sapiens
ccatgggcttcac

SEQ ID NO: 6727093 - DNA, 16 bp, Homo sapiens
ccatgggcttcactgt

SEQ ID NO: 6727094 - DNA, 19 bp, Homo sapiens
ccatgggcttcactgtata

SEQ ID NO: 6727095 - DNA, 20 bp, Homo sapiens
ccatgggcttcactgtataa

SEQ ID NO: 6727096 - DNA, 22 bp, Homo sapiens
ccatgggcttggacttcctggg

SEQ ID NO: 6727097 - DNA, 22 bp, Homo sapiens
ccatggggaagtgctccccaca

SEQ ID NO: 6727098 - DNA, 23 bp, Homo sapiens
ccatggggaagtgctccccacac

SEQ ID NO: 6727099 - DNA, 17 bp, Homo sapiens
ccatggggaggagacct

SEQ ID NO: 6727100 - DNA, 24 bp, Homo sapiens
ccatggggcagcctccagtctgct

SEQ ID NO: 6727101 - DNA, 16 bp, Homo sapiens
ccatggggccctccca

SEQ ID NO: 6727102 - DNA, 19 bp, Homo sapiens
ccatggggccctcccagaa

SEQ ID NO: 6727103 - DNA, 13 bp, Homo sapiens
ccatggggctgcg

SEQ ID NO: 6727104 - DNA, 14 bp, Homo sapiens
ccatgggggcccct

SEQ ID NO: 6727105 - DNA, 18 bp, Homo sapiens
ccatgggggcccctcggc

SEQ ID NO: 6727106 - DNA, 18 bp, Homo sapiens
ccatgggggctcagccag

SEQ ID NO: 6727107 - DNA, 19 bp, Homo sapiens
ccatgggggctcagccagg

SEQ ID NO: 6727108 - DNA, 21 bp, Homo sapiens
ccatggggtcggctcctgatg

SEQ ID NO: 6727109 - DNA, 17 bp, Homo sapiens
ccatggggtctctcaca

SEQ ID NO: 6727110 - DNA, 14 bp, Homo sapiens
ccatggggtggggg

SEQ ID NO: 6727111 - DNA, 13 bp, Homo sapiens
ccatgggtctggc

SEQ ID NO: 6727112 - DNA, 16 bp, Homo sapiens
ccatgggtctggctag

SEQ ID NO: 6727113 - DNA, 17 bp, Homo sapiens
ccatggtaaaaactagt

SEQ ID NO: 6727114 - DNA, 16 bp, Homo sapiens
ccatggtagactgtga

SEQ ID NO: 6727115 - DNA, 17 bp, Homo sapiens
ccatggtagactgtgac

SEQ ID NO: 6727116 - DNA, 14 bp, Homo sapiens
ccatggtcacagag

SEQ ID NO: 6727117 - DNA, 17 bp, Homo sapiens
ccatggtcaccctcagg

SEQ ID NO: 6727118 - DNA, 20 bp, Homo sapiens
ccatggtcatcaccaccctt

SEQ ID NO: 6727119 - DNA, 15 bp, Homo sapiens
ccatggtcctgtctg

SEQ ID NO: 6727120 - DNA, 19 bp, Homo sapiens
ccatggtcctgtctgtcct

SEQ ID NO: 6727121 - DNA, 20 bp, Homo sapiens
ccatggtcctgtctgtcctt

SEQ ID NO: 6727122 - DNA, 20 bp, Homo sapiens
ccatggtcggaaaacatgct

SEQ ID NO: 6727123 - DNA, 14 bp, Homo sapiens
ccatggtgcagtga

SEQ ID NO: 6727124 - DNA, 22 bp, Homo sapiens
ccatggtgcagtgaagaaaatg

SEQ ID NO: 6727125 - DNA, 18 bp, Homo sapiens
ccatggtgcccgtgcctc

SEQ ID NO: 6727126 - DNA, 14 bp, Homo sapiens
ccatggtgcctctg

SEQ ID NO: 6727127 - DNA, 22 bp, Homo sapiens
ccatggtgctaggaagaggagt

SEQ ID NO: 6727128 - DNA, 14 bp, Homo sapiens
ccatggtgctgcat

SEQ ID NO: 6727129 - DNA, 14 bp, Homo sapiens
ccatggtggagggc

SEQ ID NO: 6727130 - DNA, 17 bp, Homo sapiens
ccatggtggagggcact

SEQ ID NO: 6727131 - DNA, 23 bp, Homo sapiens
ccatggtggcggcgaagaagaga

SEQ ID NO: 6727132 - DNA, 23 bp, Homo sapiens
ccatggtgggagagactgtgagg

SEQ ID NO: 6727133 - DNA, 17 bp, Homo sapiens
ccatggtggtttcagaa

SEQ ID NO: 6727134 - DNA, 14 bp, Homo sapiens
ccatggtgtatgtg

SEQ ID NO: 6727135 - DNA, 16 bp, Homo sapiens
ccatggtgtattcaga

SEQ ID NO: 6727136 - DNA, 14 bp, Homo sapiens
ccatggtgtgtcat

SEQ ID NO: 6727137 - DNA, 19 bp, Homo sapiens
ccatggtgtgtttgtaata

SEQ ID NO: 6727138 - DNA, 15 bp, Homo sapiens
ccatggttaagtcat

SEQ ID NO: 6727139 - DNA, 21 bp, Homo sapiens
ccatggttaccgaggaccctg

SEQ ID NO: 6727140 - DNA, 17 bp, Homo sapiens
ccatggttctgcctcct

SEQ ID NO: 6727141 - DNA, 22 bp, Homo sapiens
ccatggttttggctctcccacc

SEQ ID NO: 6727142 - DNA, 14 bp, Homo sapiens
ccatgtaaatacca

SEQ ID NO: 6727143 - DNA, 20 bp, Homo sapiens
ccatgtaaataccagactgc

SEQ ID NO: 6727144 - DNA, 16 bp, Homo sapiens
ccatgtaaccactgca

SEQ ID NO: 6727145 - DNA, 11 bp, Homo sapiens
ccatgtaactg

SEQ ID NO: 6727146 - DNA, 17 bp, Homo sapiens
ccatgtaactgcctaga

SEQ ID NO: 6727147 - DNA, 18 bp, Homo sapiens
ccatgtaactgcctagaa

SEQ ID NO: 6727148 - DNA, 19 bp, Homo sapiens
ccatgtaactgcctagaaa

SEQ ID NO: 6727149 - DNA, 22 bp, Homo sapiens
ccatgtaataagcacttgcctg

SEQ ID NO: 6727150 - DNA, 20 bp, Homo sapiens
ccatgtaatggcagttatat

SEQ ID NO: 6727151 - DNA, 18 bp, Homo sapiens
ccatgtaccagtgtactg

SEQ ID NO: 6727152 - DNA, 13 bp, Homo sapiens
ccatgtacctccc

SEQ ID NO: 6727153 - DNA, 17 bp, Homo sapiens
ccatgtacctcccctgc

SEQ ID NO: 6727154 - DNA, 20 bp, Homo sapiens
ccatgtacctcccctgcctt

SEQ ID NO: 6727155 - DNA, 14 bp, Homo sapiens
ccatgtactgtagt

SEQ ID NO: 6727156 - DNA, 22 bp, Homo sapiens
ccatgtactgtagtttttcttc

SEQ ID NO: 6727157 - DNA, 15 bp, Homo sapiens
ccatgtagaagctgc

SEQ ID NO: 6727158 - DNA, 18 bp, Homo sapiens
ccatgtagaagctgcatc

SEQ ID NO: 6727159 - DNA, 19 bp, Homo sapiens
ccatgtagaagctgcatct

SEQ ID NO: 6727160 - DNA, 11 bp, Homo sapiens
ccatgtagcca

SEQ ID NO: 6727161 - DNA, 16 bp, Homo sapiens
ccatgtagccacccaa

SEQ ID NO: 6727162 - DNA, 18 bp, Homo sapiens
ccatgtagttttaacaga

SEQ ID NO: 6727163 - DNA, 14 bp, Homo sapiens
ccatgtataatttt

SEQ ID NO: 6727164 - DNA, 23 bp, Homo sapiens
ccatgtatagctagctatttcta

SEQ ID NO: 6727165 - DNA, 11 bp, Homo sapiens
ccatgtatgca

SEQ ID NO: 6727166 - DNA, 15 bp, Homo sapiens
ccatgtatgcataat

SEQ ID NO: 6727167 - DNA, 23 bp, Homo sapiens
ccatgtatggaatcccactgtat

SEQ ID NO: 6727168 - DNA, 15 bp, Homo sapiens
ccatgtatggccagg

SEQ ID NO: 6727169 - DNA, 21 bp, Homo sapiens
ccatgtatggccaggaagtag

SEQ ID NO: 6727170 - DNA, 14 bp, Homo sapiens
ccatgtatgtggta

SEQ ID NO: 6727171 - DNA, 18 bp, Homo sapiens
ccatgtattatgaaaaag

SEQ ID NO: 6727172 - DNA, 20 bp, Homo sapiens
ccatgtattatgaaaaagat

SEQ ID NO: 6727173 - DNA, 16 bp, Homo sapiens
ccatgtattcacacac

SEQ ID NO: 6727174 - DNA, 18 bp, Homo sapiens
ccatgtattcacacaccc

SEQ ID NO: 6727175 - DNA, 19 bp, Homo sapiens
ccatgtattcacacacccc

SEQ ID NO: 6727176 - DNA, 23 bp, Homo sapiens
ccatgtatttatctctatttaat

SEQ ID NO: 6727177 - DNA, 18 bp, Homo sapiens
ccatgtatttgttatata

SEQ ID NO: 6727178 - DNA, 15 bp, Homo sapiens
ccatgtcaagattca

SEQ ID NO: 6727179 - DNA, 17 bp, Homo sapiens
ccatgtcaagattcagc

SEQ ID NO: 6727180 - DNA, 13 bp, Homo sapiens
ccatgtcacagca

SEQ ID NO: 6727181 - DNA, 22 bp, Homo sapiens
ccatgtcaccggatcctgggtg

SEQ ID NO: 6727182 - DNA, 19 bp, Homo sapiens
ccatgtcagatgggaaatc

SEQ ID NO: 6727183 - DNA, 11 bp, Homo sapiens
ccatgtcatcc

SEQ ID NO: 6727184 - DNA, 22 bp, Homo sapiens
ccatgtccaaacccatcttcat

SEQ ID NO: 6727185 - DNA, 19 bp, Homo sapiens
ccatgtccaaagaggctgc

SEQ ID NO: 6727186 - DNA, 20 bp, Homo sapiens
ccatgtccaagttcttcacc

SEQ ID NO: 6727187 - DNA, 14 bp, Homo sapiens
ccatgtccagaggg

SEQ ID NO: 6727188 - DNA, 18 bp, Homo sapiens
ccatgtccagagggactg

SEQ ID NO: 6727189 - DNA, 20 bp, Homo sapiens
ccatgtcccaccctccctag

SEQ ID NO: 6727190 - DNA, 20 bp, Homo sapiens
ccatgtcccagcctggcctg

SEQ ID NO: 6727191 - DNA, 11 bp, Homo sapiens
ccatgtccccc

SEQ ID NO: 6727192 - DNA, 16 bp, Homo sapiens
ccatgtcctatgtgtg

SEQ ID NO: 6727193 - DNA, 17 bp, Homo sapiens
ccatgtcctatgtgtga

SEQ ID NO: 6727194 - DNA, 15 bp, Homo sapiens
ccatgtcgcctctgc

SEQ ID NO: 6727195 - DNA, 19 bp, Homo sapiens
ccatgtcgcctctgcattc

SEQ ID NO: 6727196 - DNA, 20 bp, Homo sapiens
ccatgtctgcagtgtgcccc

SEQ ID NO: 6727197 - DNA, 11 bp, Homo sapiens
ccatgtctgta

SEQ ID NO: 6727198 - DNA, 21 bp, Homo sapiens
ccatgtctgtagttgctttgc

SEQ ID NO: 6727199 - DNA, 19 bp, Homo sapiens
ccatgtcttctccctggaa

SEQ ID NO: 6727200 - DNA, 20 bp, Homo sapiens
ccatgtcttctccctggaat

SEQ ID NO: 6727201 - DNA, 14 bp, Homo sapiens
ccatgtcttctgct

SEQ ID NO: 6727202 - DNA, 15 bp, Homo sapiens
ccatgtcttctgctg

SEQ ID NO: 6727203 - DNA, 16 bp, Homo sapiens
ccatgtcttctgctgt

SEQ ID NO: 6727204 - DNA, 20 bp, Homo sapiens
ccatgtgaaactcatctcat

SEQ ID NO: 6727205 - DNA, 18 bp, Homo sapiens
ccatgtgaccattctgcc

SEQ ID NO: 6727206 - DNA, 18 bp, Homo sapiens
ccatgtgactctggcttg

SEQ ID NO: 6727207 - DNA, 21 bp, Homo sapiens
ccatgtgatggacactccagg

SEQ ID NO: 6727208 - DNA, 18 bp, Homo sapiens
ccatgtgattaatgtttt

SEQ ID NO: 6727209 - DNA, 22 bp, Homo sapiens
ccatgtgattaatgttttcatt

SEQ ID NO: 6727210 - DNA, 16 bp, Homo sapiens
ccatgtgcacccggcc

SEQ ID NO: 6727211 - DNA, 17 bp, Homo sapiens
ccatgtgcacctatggc

SEQ ID NO: 6727212 - DNA, 20 bp, Homo sapiens
ccatgtgcacctatggccca

SEQ ID NO: 6727213 - DNA, 23 bp, Homo sapiens
ccatgtgcacctatggcccagcc

SEQ ID NO: 6727214 - DNA, 23 bp, Homo sapiens
ccatgtgcaggtggattccatgc

SEQ ID NO: 6727215 - DNA, 13 bp, Homo sapiens
ccatgtgcatata

SEQ ID NO: 6727216 - DNA, 13 bp, Homo sapiens
ccatgtgccaggt

SEQ ID NO: 6727217 - DNA, 21 bp, Homo sapiens
ccatgtgcctgatccagcctc

SEQ ID NO: 6727218 - DNA, 21 bp, Homo sapiens
ccatgtgccttgtccaggaac

SEQ ID NO: 6727219 - DNA, 13 bp, Homo sapiens
ccatgtgcctttc

SEQ ID NO: 6727220 - DNA, 18 bp, Homo sapiens
ccatgtgcctttctttgc

SEQ ID NO: 6727221 - DNA, 20 bp, Homo sapiens
ccatgtgcctttctttgcct

SEQ ID NO: 6727222 - DNA, 17 bp, Homo sapiens
ccatgtgcggagcagcc

SEQ ID NO: 6727223 - DNA, 18 bp, Homo sapiens
ccatgtgctacaggggcc

SEQ ID NO: 6727224 - DNA, 21 bp, Homo sapiens
ccatgtgctagtcactggcag

SEQ ID NO: 6727225 - DNA, 13 bp, Homo sapiens
ccatgtgctgccc

SEQ ID NO: 6727226 - DNA, 15 bp, Homo sapiens
ccatgtgctgccctg

SEQ ID NO: 6727227 - DNA, 23 bp, Homo sapiens
ccatgtgctgcggtcactcaggc

SEQ ID NO: 6727228 - DNA, 15 bp, Homo sapiens
ccatgtgctgctgtg

SEQ ID NO: 6727229 - DNA, 22 bp, Homo sapiens
ccatgtgctgggaaatgcagaa

SEQ ID NO: 6727230 - DNA, 14 bp, Homo sapiens
ccatgtgctgtgca

SEQ ID NO: 6727231 - DNA, 21 bp, Homo sapiens
ccatgtggaaggcaagccagg

SEQ ID NO: 6727232 - DNA, 21 bp, Homo sapiens
ccatgtggcagaagtgctctt

SEQ ID NO: 6727233 - DNA, 16 bp, Homo sapiens
ccatgtggcagcccat

SEQ ID NO: 6727234 - DNA, 12 bp, Homo sapiens
ccatgtggccac

SEQ ID NO: 6727235 - DNA, 17 bp, Homo sapiens
ccatgtggccccaggtg

SEQ ID NO: 6727236 - DNA, 13 bp, Homo sapiens
ccatgtggcctgc

SEQ ID NO: 6727237 - DNA, 15 bp, Homo sapiens
ccatgtggcctgccc

SEQ ID NO: 6727238 - DNA, 17 bp, Homo sapiens
ccatgtggcctgcccag

SEQ ID NO: 6727239 - DNA, 18 bp, Homo sapiens
ccatgtggcctgcccagc

SEQ ID NO: 6727240 - DNA, 20 bp, Homo sapiens
ccatgtggcctgcccagcct

SEQ ID NO: 6727241 - DNA, 21 bp, Homo sapiens
ccatgtggcctgcccagcctc

SEQ ID NO: 6727242 - DNA, 13 bp, Homo sapiens
ccatgtggccttg

SEQ ID NO: 6727243 - DNA, 14 bp, Homo sapiens
ccatgtggctgaag

SEQ ID NO: 6727244 - DNA, 11 bp, Homo sapiens
ccatgtgggcg

SEQ ID NO: 6727245 - DNA, 23 bp, Homo sapiens
ccatgtgggcgcccaccctgggc

SEQ ID NO: 6727246 - DNA, 17 bp, Homo sapiens
ccatgtggggttgctga

SEQ ID NO: 6727247 - DNA, 18 bp, Homo sapiens
ccatgtgggtgaccaggt

SEQ ID NO: 6727248 - DNA, 18 bp, Homo sapiens
ccatgtggtggcacaggc

SEQ ID NO: 6727249 - DNA, 16 bp, Homo sapiens
ccatgtgtacattctg

SEQ ID NO: 6727250 - DNA, 19 bp, Homo sapiens
ccatgtgtcccccctgtgg

SEQ ID NO: 6727251 - DNA, 22 bp, Homo sapiens
ccatgtgtcccctcactctgtc

SEQ ID NO: 6727252 - DNA, 14 bp, Homo sapiens
ccatgtgtcctggt

SEQ ID NO: 6727253 - DNA, 22 bp, Homo sapiens
ccatgtgtctttacacctcgct

SEQ ID NO: 6727254 - DNA, 23 bp, Homo sapiens
ccatgtgtctttacacctcgctg

SEQ ID NO: 6727255 - DNA, 18 bp, Homo sapiens
ccatgtgtgagtgtgtgc

SEQ ID NO: 6727256 - DNA, 16 bp, Homo sapiens
ccatgtgtgatgctga

SEQ ID NO: 6727257 - DNA, 18 bp, Homo sapiens
ccatgtgtgatgctgaca

SEQ ID NO: 6727258 - DNA, 14 bp, Homo sapiens
ccatgtgtgctaat

SEQ ID NO: 6727259 - DNA, 10 bp, Homo sapiens
ccatgtgtgt

SEQ ID NO: 6727260 - DNA, 17 bp, Homo sapiens
ccatgtgtgtcagccca

SEQ ID NO: 6727261 - DNA, 21 bp, Homo sapiens
ccatgtgtgtgccaagccctg

SEQ ID NO: 6727262 - DNA, 22 bp, Homo sapiens
ccatgtgtgtgccaagccctgg

SEQ ID NO: 6727263 - DNA, 20 bp, Homo sapiens
ccatgtgttccaaatttgct

SEQ ID NO: 6727264 - DNA, 16 bp, Homo sapiens
ccatgtgttttgcttt

SEQ ID NO: 6727265 - DNA, 18 bp, Homo sapiens
ccatgtgttttgctttta

SEQ ID NO: 6727266 - DNA, 19 bp, Homo sapiens
ccatgtgttttgcttttat

SEQ ID NO: 6727267 - DNA, 17 bp, Homo sapiens
ccatgttaaatgacttg

SEQ ID NO: 6727268 - DNA, 19 bp, Homo sapiens
ccatgttaatacatcattt

SEQ ID NO: 6727269 - DNA, 15 bp, Homo sapiens
ccatgttagccagga

SEQ ID NO: 6727270 - DNA, 20 bp, Homo sapiens
ccatgttagccgggatggtc

SEQ ID NO: 6727271 - DNA, 14 bp, Homo sapiens
ccatgttagcctta

SEQ ID NO: 6727272 - DNA, 18 bp, Homo sapiens
ccatgttagtttttactt

SEQ ID NO: 6727273 - DNA, 23 bp, Homo sapiens
ccatgttatattgcttcctgtgt

SEQ ID NO: 6727274 - DNA, 22 bp, Homo sapiens
ccatgttcacaccgctgcactc

SEQ ID NO: 6727275 - DNA, 16 bp, Homo sapiens
ccatgttcccagctca

SEQ ID NO: 6727276 - DNA, 17 bp, Homo sapiens
ccatgttcccagctcag

SEQ ID NO: 6727277 - DNA, 18 bp, Homo sapiens
ccatgttctgcccccagc

SEQ ID NO: 6727278 - DNA, 20 bp, Homo sapiens
ccatgttctgcccccagccc

SEQ ID NO: 6727279 - DNA, 22 bp, Homo sapiens
ccatgttctgcccccagcccaa

SEQ ID NO: 6727280 - DNA, 15 bp, Homo sapiens
ccatgttgctgccaa

SEQ ID NO: 6727281 - DNA, 16 bp, Homo sapiens
ccatgttggccaggct

SEQ ID NO: 6727282 - DNA, 17 bp, Homo sapiens
ccatgttggccaggctg

SEQ ID NO: 6727283 - DNA, 18 bp, Homo sapiens
ccatgttggccaggctgc

SEQ ID NO: 6727284 - DNA, 23 bp, Homo sapiens
ccatgttggccaggctgctctca

SEQ ID NO: 6727285 - DNA, 20 bp, Homo sapiens
ccatgttggccaggctggtc

SEQ ID NO: 6727286 - DNA, 23 bp, Homo sapiens
ccatgttggcctcttcaggcctg

SEQ ID NO: 6727287 - DNA, 15 bp, Homo sapiens
ccatgttgggaaaaa

SEQ ID NO: 6727288 - DNA, 22 bp, Homo sapiens
ccatgttgggaaaaactggctt

SEQ ID NO: 6727289 - DNA, 22 bp, Homo sapiens
ccatgttggttgcactttgtag

SEQ ID NO: 6727290 - DNA, 17 bp, Homo sapiens
ccatgttgtgcctccct

SEQ ID NO: 6727291 - DNA, 23 bp, Homo sapiens
ccatgtttaaactttgtgccttt

SEQ ID NO: 6727292 - DNA, 16 bp, Homo sapiens
ccatgtttaagattta

SEQ ID NO: 6727293 - DNA, 17 bp, Homo sapiens
ccatgtttaagatttaa

SEQ ID NO: 6727294 - DNA, 12 bp, Homo sapiens
ccatgtttattg

SEQ ID NO: 6727295 - DNA, 13 bp, Homo sapiens
ccatgtttctcac

SEQ ID NO: 6727296 - DNA, 14 bp, Homo sapiens
ccatgtttctctgg

SEQ ID NO: 6727297 - DNA, 15 bp, Homo sapiens
ccatgtttctctggc

SEQ ID NO: 6727298 - DNA, 17 bp, Homo sapiens
ccatgtttgagctcaga

SEQ ID NO: 6727299 - DNA, 20 bp, Homo sapiens
ccatgtttgctctaaattaa

SEQ ID NO: 6727300 - DNA, 15 bp, Homo sapiens
ccatgttttaaaatt

SEQ ID NO: 6727301 - DNA, 16 bp, Homo sapiens
ccatgttttaaaatta

SEQ ID NO: 6727302 - DNA, 16 bp, Homo sapiens
ccatgttttgttttct

SEQ ID NO: 6727303 - DNA, 22 bp, Homo sapiens
ccattaaaaaacagcttgttct

SEQ ID NO: 6727304 - DNA, 20 bp, Homo sapiens
ccattaaaaagttgttcttt

SEQ ID NO: 6727305 - DNA, 21 bp, Homo sapiens
ccattaaaaatgagatttctt

SEQ ID NO: 6727306 - DNA, 15 bp, Homo sapiens
ccattaaaactgaag

SEQ ID NO: 6727307 - DNA, 23 bp, Homo sapiens
ccattaaaactgaagtctgaaat

SEQ ID NO: 6727308 - DNA, 14 bp, Homo sapiens
ccattaaaactgct

SEQ ID NO: 6727309 - DNA, 15 bp, Homo sapiens
ccattaaaactgctt

SEQ ID NO: 6727310 - DNA, 16 bp, Homo sapiens
ccattaaaactgcttt

SEQ ID NO: 6727311 - DNA, 13 bp, Homo sapiens
ccattaaaataaa

SEQ ID NO: 6727312 - DNA, 17 bp, Homo sapiens
ccattaaaataaaacaa

SEQ ID NO: 6727313 - DNA, 18 bp, Homo sapiens
ccattaaaatatgcacta

SEQ ID NO: 6727314 - DNA, 13 bp, Homo sapiens
ccattaaagtctg

SEQ ID NO: 6727315 - DNA, 14 bp, Homo sapiens
ccattaaagtctga

SEQ ID NO: 6727316 - DNA, 14 bp, Homo sapiens
ccattaaatataaa

SEQ ID NO: 6727317 - DNA, 17 bp, Homo sapiens
ccattaaatataaagca

SEQ ID NO: 6727318 - DNA, 23 bp, Homo sapiens
ccattaaccagggcaccaagccc

SEQ ID NO: 6727319 - DNA, 15 bp, Homo sapiens
ccattaataactgaa

SEQ ID NO: 6727320 - DNA, 22 bp, Homo sapiens
ccattaataactgaataaaaaa

SEQ ID NO: 6727321 - DNA, 18 bp, Homo sapiens
ccattaatacttccttat

SEQ ID NO: 6727322 - DNA, 18 bp, Homo sapiens
ccattaatcatttcccca

SEQ ID NO: 6727323 - DNA, 13 bp, Homo sapiens
ccattaatcttga

SEQ ID NO: 6727324 - DNA, 18 bp, Homo sapiens
ccattaatcttgatcatt

SEQ ID NO: 6727325 - DNA, 15 bp, Homo sapiens
ccattaattaatgag

SEQ ID NO: 6727326 - DNA, 23 bp, Homo sapiens
ccattacagtgtaaaaattcaga

SEQ ID NO: 6727327 - DNA, 12 bp, Homo sapiens
ccattacatgtt

SEQ ID NO: 6727328 - DNA, 14 bp, Homo sapiens
ccattaccaaaata

SEQ ID NO: 6727329 - DNA, 19 bp, Homo sapiens
ccattacccagtgccgagg

SEQ ID NO: 6727330 - DNA, 16 bp, Homo sapiens
ccattaccccataccc

SEQ ID NO: 6727331 - DNA, 16 bp, Homo sapiens
ccattaccttaaaatt

SEQ ID NO: 6727332 - DNA, 16 bp, Homo sapiens
ccattacgtgcattta

SEQ ID NO: 6727333 - DNA, 22 bp, Homo sapiens
ccattacgtgcatttaaactct

SEQ ID NO: 6727334 - DNA, 17 bp, Homo sapiens
ccattacttgccagggg

SEQ ID NO: 6727335 - DNA, 18 bp, Homo sapiens
ccattacttgtataaata

SEQ ID NO: 6727336 - DNA, 19 bp, Homo sapiens
ccattagaaaattttgtaa

SEQ ID NO: 6727337 - DNA, 22 bp, Homo sapiens
ccattagaaaattttgtaaaac

SEQ ID NO: 6727338 - DNA, 23 bp, Homo sapiens
ccattagaagatattagtcttgg

SEQ ID NO: 6727339 - DNA, 19 bp, Homo sapiens
ccattagagcacagcttct

SEQ ID NO: 6727340 - DNA, 23 bp, Homo sapiens
ccattagagcacagcttcttctg

SEQ ID NO: 6727341 - DNA, 16 bp, Homo sapiens
ccattagagtcagcct

SEQ ID NO: 6727342 - DNA, 19 bp, Homo sapiens
ccattagataaacacaggc

SEQ ID NO: 6727343 - DNA, 22 bp, Homo sapiens
ccattagataaacacaggcagg

SEQ ID NO: 6727344 - DNA, 17 bp, Homo sapiens
ccattagccagatttgt

SEQ ID NO: 6727345 - DNA, 13 bp, Homo sapiens
ccattaggccagc

SEQ ID NO: 6727346 - DNA, 20 bp, Homo sapiens
ccattataatgaatttagtg

SEQ ID NO: 6727347 - DNA, 15 bp, Homo sapiens
ccattataattttga

SEQ ID NO: 6727348 - DNA, 15 bp, Homo sapiens
ccattatactttata

SEQ ID NO: 6727349 - DNA, 17 bp, Homo sapiens
ccattatactttatatc

SEQ ID NO: 6727350 - DNA, 15 bp, Homo sapiens
ccattatagcgcctg

SEQ ID NO: 6727351 - DNA, 20 bp, Homo sapiens
ccattatagcgcctgtataa

SEQ ID NO: 6727352 - DNA, 21 bp, Homo sapiens
ccattatagcgcctgtataag

SEQ ID NO: 6727353 - DNA, 17 bp, Homo sapiens
ccattatattgttttct

SEQ ID NO: 6727354 - DNA, 17 bp, Homo sapiens
ccattatatttattgtt

SEQ ID NO: 6727355 - DNA, 14 bp, Homo sapiens
ccattatcatgtgt

SEQ ID NO: 6727356 - DNA, 14 bp, Homo sapiens
ccattatccctgaa

SEQ ID NO: 6727357 - DNA, 18 bp, Homo sapiens
ccattatggctttgtgct

SEQ ID NO: 6727358 - DNA, 21 bp, Homo sapiens
ccattattatcaagtagacta

SEQ ID NO: 6727359 - DNA, 16 bp, Homo sapiens
ccattattatttctgt

SEQ ID NO: 6727360 - DNA, 17 bp, Homo sapiens
ccattattatttctgtt

SEQ ID NO: 6727361 - DNA, 11 bp, Homo sapiens
ccattattcat

SEQ ID NO: 6727362 - DNA, 14 bp, Homo sapiens
ccattattcctctc

SEQ ID NO: 6727363 - DNA, 13 bp, Homo sapiens
ccattatttaata

SEQ ID NO: 6727364 - DNA, 14 bp, Homo sapiens
ccattatttaataa

SEQ ID NO: 6727365 - DNA, 15 bp, Homo sapiens
ccattatttaataag

SEQ ID NO: 6727366 - DNA, 15 bp, Homo sapiens
ccattattttacagt

SEQ ID NO: 6727367 - DNA, 21 bp, Homo sapiens
ccattattttattttatagtc

SEQ ID NO: 6727368 - DNA, 17 bp, Homo sapiens
ccattattttctgtcag

SEQ ID NO: 6727369 - DNA, 14 bp, Homo sapiens
ccattcaacccagc

SEQ ID NO: 6727370 - DNA, 23 bp, Homo sapiens
ccattcacaagcctcctgtacct

SEQ ID NO: 6727371 - DNA, 16 bp, Homo sapiens
ccattcacagagcctt

SEQ ID NO: 6727372 - DNA, 22 bp, Homo sapiens
ccattcacatttgatgtacatg

SEQ ID NO: 6727373 - DNA, 17 bp, Homo sapiens
ccattcaccctgtgtaa

SEQ ID NO: 6727374 - DNA, 20 bp, Homo sapiens
ccattcacttcataatccag

SEQ ID NO: 6727375 - DNA, 20 bp, Homo sapiens
ccattcagagctatggtgct

SEQ ID NO: 6727376 - DNA, 17 bp, Homo sapiens
ccattcagcctcgtctc

SEQ ID NO: 6727377 - DNA, 23 bp, Homo sapiens
ccattcagtctatgctgtgtgca

SEQ ID NO: 6727378 - DNA, 12 bp, Homo sapiens
ccattcagtgac

SEQ ID NO: 6727379 - DNA, 13 bp, Homo sapiens
ccattcagtgaca

SEQ ID NO: 6727380 - DNA, 17 bp, Homo sapiens
ccattcagtgacatgtc

SEQ ID NO: 6727381 - DNA, 19 bp, Homo sapiens
ccattcatactaaataaaa

SEQ ID NO: 6727382 - DNA, 23 bp, Homo sapiens
ccattcatattaagacagtgtac

SEQ ID NO: 6727383 - DNA, 12 bp, Homo sapiens
ccattcatcctt

SEQ ID NO: 6727384 - DNA, 15 bp, Homo sapiens
ccattcatctgggct

SEQ ID NO: 6727385 - DNA, 21 bp, Homo sapiens
ccattcattaattagttccag

SEQ ID NO: 6727386 - DNA, 15 bp, Homo sapiens
ccattccactccact

SEQ ID NO: 6727387 - DNA, 23 bp, Homo sapiens
ccattccatggaaccatggagga

SEQ ID NO: 6727388 - DNA, 17 bp, Homo sapiens
ccattcccaaaataact

SEQ ID NO: 6727389 - DNA, 18 bp, Homo sapiens
ccattcccaagatgcctg

SEQ ID NO: 6727390 - DNA, 11 bp, Homo sapiens
ccattcccagc

SEQ ID NO: 6727391 - DNA, 14 bp, Homo sapiens
ccattcccccatgt

SEQ ID NO: 6727392 - DNA, 16 bp, Homo sapiens
ccattccctagtcatt

SEQ ID NO: 6727393 - DNA, 14 bp, Homo sapiens
ccattccctgcctg

SEQ ID NO: 6727394 - DNA, 20 bp, Homo sapiens
ccattccctgcctggggcgg

SEQ ID NO: 6727395 - DNA, 18 bp, Homo sapiens
ccattccctgccttgctg

SEQ ID NO: 6727396 - DNA, 15 bp, Homo sapiens
ccattccctgtagga

SEQ ID NO: 6727397 - DNA, 19 bp, Homo sapiens
ccattccctttcttttcat

SEQ ID NO: 6727398 - DNA, 12 bp, Homo sapiens
ccattcctcagg

SEQ ID NO: 6727399 - DNA, 13 bp, Homo sapiens
ccattcctcaggg

SEQ ID NO: 6727400 - DNA, 14 bp, Homo sapiens
ccattcctccactc

SEQ ID NO: 6727401 - DNA, 13 bp, Homo sapiens
ccattcctgaaga

SEQ ID NO: 6727402 - DNA, 11 bp, Homo sapiens
ccattcctgag

SEQ ID NO: 6727403 - DNA, 13 bp, Homo sapiens
ccattcctgctct

SEQ ID NO: 6727404 - DNA, 16 bp, Homo sapiens
ccattcctggagcccg

SEQ ID NO: 6727405 - DNA, 21 bp, Homo sapiens
ccattcctggtacccagccat

SEQ ID NO: 6727406 - DNA, 14 bp, Homo sapiens
ccattcctgttctc

SEQ ID NO: 6727407 - DNA, 11 bp, Homo sapiens
ccattccttca

SEQ ID NO: 6727408 - DNA, 16 bp, Homo sapiens
ccattccttcaaataa

SEQ ID NO: 6727409 - DNA, 13 bp, Homo sapiens
ccattccttccca

SEQ ID NO: 6727410 - DNA, 19 bp, Homo sapiens
ccattccttgcgcctcagc

SEQ ID NO: 6727411 - DNA, 21 bp, Homo sapiens
ccattcgtacataatactgaa

SEQ ID NO: 6727412 - DNA, 18 bp, Homo sapiens
ccattctacttgctctgg

SEQ ID NO: 6727413 - DNA, 19 bp, Homo sapiens
ccattctacttgctctgga

SEQ ID NO: 6727414 - DNA, 12 bp, Homo sapiens
ccattctagatc

SEQ ID NO: 6727415 - DNA, 15 bp, Homo sapiens
ccattctagatcctg

SEQ ID NO: 6727416 - DNA, 22 bp, Homo sapiens
ccattctagatcctgcacccca

SEQ ID NO: 6727417 - DNA, 16 bp, Homo sapiens
ccattctataaattca

SEQ ID NO: 6727418 - DNA, 16 bp, Homo sapiens
ccattctattctccag

SEQ ID NO: 6727419 - DNA, 17 bp, Homo sapiens
ccattctattctccaga

SEQ ID NO: 6727420 - DNA, 18 bp, Homo sapiens
ccattctattctccagac

SEQ ID NO: 6727421 - DNA, 20 bp, Homo sapiens
ccattctattctccagacat

SEQ ID NO: 6727422 - DNA, 18 bp, Homo sapiens
ccattctcaagccctgca

SEQ ID NO: 6727423 - DNA, 17 bp, Homo sapiens
ccattctccacctgcca

SEQ ID NO: 6727424 - DNA, 18 bp, Homo sapiens
ccattctccacctgccag

SEQ ID NO: 6727425 - DNA, 11 bp, Homo sapiens
ccattctccca

SEQ ID NO: 6727426 - DNA, 12 bp, Homo sapiens
ccattctcccag

SEQ ID NO: 6727427 - DNA, 22 bp, Homo sapiens
ccattctcccaggtaccagctg

SEQ ID NO: 6727428 - DNA, 16 bp, Homo sapiens
ccattctcccagtctc

SEQ ID NO: 6727429 - DNA, 17 bp, Homo sapiens
ccattctcccagtctct

SEQ ID NO: 6727430 - DNA, 12 bp, Homo sapiens
ccattctccctc

SEQ ID NO: 6727431 - DNA, 20 bp, Homo sapiens
ccattctccctccatggcag

SEQ ID NO: 6727432 - DNA, 18 bp, Homo sapiens
ccattctcccttctctct

SEQ ID NO: 6727433 - DNA, 13 bp, Homo sapiens
ccattctcctgag

SEQ ID NO: 6727434 - DNA, 19 bp, Homo sapiens
ccattctcctgcctcaccc

SEQ ID NO: 6727435 - DNA, 23 bp, Homo sapiens
ccattctcctgcctcagcctcct

SEQ ID NO: 6727436 - DNA, 22 bp, Homo sapiens
ccattctcctgcctcagccttc

SEQ ID NO: 6727437 - DNA, 17 bp, Homo sapiens
ccattctctccagtgtg

SEQ ID NO: 6727438 - DNA, 14 bp, Homo sapiens
ccattctctctcct

SEQ ID NO: 6727439 - DNA, 20 bp, Homo sapiens
ccattctctctcctgtccaa

SEQ ID NO: 6727440 - DNA, 12 bp, Homo sapiens
ccattctgactc

SEQ ID NO: 6727441 - DNA, 20 bp, Homo sapiens
ccattctgcactcagaaaat

SEQ ID NO: 6727442 - DNA, 15 bp, Homo sapiens
ccattctgcatgagc

SEQ ID NO: 6727443 - DNA, 18 bp, Homo sapiens
ccattctgcctctcctca

SEQ ID NO: 6727444 - DNA, 15 bp, Homo sapiens
ccattctgcctgccc

SEQ ID NO: 6727445 - DNA, 16 bp, Homo sapiens
ccattctgcctgccca

SEQ ID NO: 6727446 - DNA, 18 bp, Homo sapiens
ccattctgcctgcccagg

SEQ ID NO: 6727447 - DNA, 22 bp, Homo sapiens
ccattctgctttcttgccacac

SEQ ID NO: 6727448 - DNA, 24 bp, Homo sapiens
ccattctgctttcttgccacacag

SEQ ID NO: 6727449 - DNA, 15 bp, Homo sapiens
ccattctggaagtga

SEQ ID NO: 6727450 - DNA, 20 bp, Homo sapiens
ccattctggcactttaatga

SEQ ID NO: 6727451 - DNA, 14 bp, Homo sapiens
ccattctgtcccag

SEQ ID NO: 6727452 - DNA, 22 bp, Homo sapiens
ccattctgtgaccaaaatacct

SEQ ID NO: 6727453 - DNA, 12 bp, Homo sapiens
ccattctgtttt

SEQ ID NO: 6727454 - DNA, 19 bp, Homo sapiens
ccattctgttttcccccag

SEQ ID NO: 6727455 - DNA, 12 bp, Homo sapiens
ccattcttcagt

SEQ ID NO: 6727456 - DNA, 17 bp, Homo sapiens
ccattcttcagtgccta

SEQ ID NO: 6727457 - DNA, 21 bp, Homo sapiens
ccattcttcagtgtctctgtt

SEQ ID NO: 6727458 - DNA, 19 bp, Homo sapiens
ccattcttcctagttttct

SEQ ID NO: 6727459 - DNA, 15 bp, Homo sapiens
ccattcttctgggtg

SEQ ID NO: 6727460 - DNA, 14 bp, Homo sapiens
ccattcttcttttt

SEQ ID NO: 6727461 - DNA, 20 bp, Homo sapiens
ccattcttgagttttgataa

SEQ ID NO: 6727462 - DNA, 16 bp, Homo sapiens
ccattcttggcccagg

SEQ ID NO: 6727463 - DNA, 12 bp, Homo sapiens
ccattctttctt

SEQ ID NO: 6727464 - DNA, 13 bp, Homo sapiens
ccattctttgctt

SEQ ID NO: 6727465 - DNA, 22 bp, Homo sapiens
ccattctttgcttgaacacagt

SEQ ID NO: 6727466 - DNA, 20 bp, Homo sapiens
ccattcttttcacttcctct

SEQ ID NO: 6727467 - DNA, 18 bp, Homo sapiens
ccattgaacagctgtgag

SEQ ID NO: 6727468 - DNA, 17 bp, Homo sapiens
ccattgaaggcttaaac

SEQ ID NO: 6727469 - DNA, 23 bp, Homo sapiens
ccattgacaaggtgtttctctgt

SEQ ID NO: 6727470 - DNA, 16 bp, Homo sapiens
ccattgacatgtacag

SEQ ID NO: 6727471 - DNA, 14 bp, Homo sapiens
ccattgaccagctc

SEQ ID NO: 6727472 - DNA, 18 bp, Homo sapiens
ccattgaccctcacctga

SEQ ID NO: 6727473 - DNA, 14 bp, Homo sapiens
ccattgacctcagc

SEQ ID NO: 6727474 - DNA, 22 bp, Homo sapiens
ccattgacttagaggcaacagg

SEQ ID NO: 6727475 - DNA, 23 bp, Homo sapiens
ccattgacttgcacatctctgca

SEQ ID NO: 6727476 - DNA, 19 bp, Homo sapiens
ccattgagatcttcctgct

SEQ ID NO: 6727477 - DNA, 17 bp, Homo sapiens
ccattgagctgtttcct

SEQ ID NO: 6727478 - DNA, 16 bp, Homo sapiens
ccattgagtccctgct

SEQ ID NO: 6727479 - DNA, 23 bp, Homo sapiens
ccattgatctgccaaatcgttat

SEQ ID NO: 6727480 - DNA, 13 bp, Homo sapiens
ccattgatttttt

SEQ ID NO: 6727481 - DNA, 22 bp, Homo sapiens
ccattgattttttttttcttct

SEQ ID NO: 6727482 - DNA, 22 bp, Homo sapiens
ccattgcaaaaggttaagccat

SEQ ID NO: 6727483 - DNA, 17 bp, Homo sapiens
ccattgcactccagcct

SEQ ID NO: 6727484 - DNA, 23 bp, Homo sapiens
ccattgcacttcggataattttc

SEQ ID NO: 6727485 - DNA, 14 bp, Homo sapiens
ccattgcagaccct

SEQ ID NO: 6727486 - DNA, 13 bp, Homo sapiens
ccattgccttctg

SEQ ID NO: 6727487 - DNA, 16 bp, Homo sapiens
ccattgccttctgggg

SEQ ID NO: 6727488 - DNA, 14 bp, Homo sapiens
ccattgcggcccca

SEQ ID NO: 6727489 - DNA, 17 bp, Homo sapiens
ccattgcggccccagga

SEQ ID NO: 6727490 - DNA, 21 bp, Homo sapiens
ccattgctatctattgataat

SEQ ID NO: 6727491 - DNA, 15 bp, Homo sapiens
ccattgctgacgatt

SEQ ID NO: 6727492 - DNA, 15 bp, Homo sapiens
ccattgctgcaaatg

SEQ ID NO: 6727493 - DNA, 14 bp, Homo sapiens
ccattgctgccaag

SEQ ID NO: 6727494 - DNA, 11 bp, Homo sapiens
ccattgctgct

SEQ ID NO: 6727495 - DNA, 18 bp, Homo sapiens
ccattgctggcaatgagt

SEQ ID NO: 6727496 - DNA, 14 bp, Homo sapiens
ccattgcttcacta

SEQ ID NO: 6727497 - DNA, 11 bp, Homo sapiens
ccattggaaat

SEQ ID NO: 6727498 - DNA, 19 bp, Homo sapiens
ccattggacagtctccctg

SEQ ID NO: 6727499 - DNA, 13 bp, Homo sapiens
ccattggcctctt

SEQ ID NO: 6727500 - DNA, 22 bp, Homo sapiens
ccattggccttaactggccctc

SEQ ID NO: 6727501 - DNA, 19 bp, Homo sapiens
ccattggctatttaaaact

SEQ ID NO: 6727502 - DNA, 17 bp, Homo sapiens
ccattgggaccctccag

SEQ ID NO: 6727503 - DNA, 21 bp, Homo sapiens
ccattggggaggactaggacc

SEQ ID NO: 6727504 - DNA, 17 bp, Homo sapiens
ccattggggctcccagc

SEQ ID NO: 6727505 - DNA, 20 bp, Homo sapiens
ccattggggctcccagccag

SEQ ID NO: 6727506 - DNA, 21 bp, Homo sapiens
ccattggggctcccagccagg

SEQ ID NO: 6727507 - DNA, 14 bp, Homo sapiens
ccattggtccaaga

SEQ ID NO: 6727508 - DNA, 16 bp, Homo sapiens
ccattggtccaccctt

SEQ ID NO: 6727509 - DNA, 16 bp, Homo sapiens
ccattggtctgcatgt

SEQ ID NO: 6727510 - DNA, 20 bp, Homo sapiens
ccattggttaatctggactt

SEQ ID NO: 6727511 - DNA, 17 bp, Homo sapiens
ccattggttcacctgtg

SEQ ID NO: 6727512 - DNA, 22 bp, Homo sapiens
ccattggttcacctgtgactcc

SEQ ID NO: 6727513 - DNA, 20 bp, Homo sapiens
ccattggttcttcctttccc

SEQ ID NO: 6727514 - DNA, 17 bp, Homo sapiens
ccattggtttttgtagt

SEQ ID NO: 6727515 - DNA, 16 bp, Homo sapiens
ccattgtaactattaa

SEQ ID NO: 6727516 - DNA, 21 bp, Homo sapiens
ccattgtaactattaaccttt

SEQ ID NO: 6727517 - DNA, 15 bp, Homo sapiens
ccattgtactccagc

SEQ ID NO: 6727518 - DNA, 17 bp, Homo sapiens
ccattgtactccagcct

SEQ ID NO: 6727519 - DNA, 14 bp, Homo sapiens
ccattgtattttgt

SEQ ID NO: 6727520 - DNA, 15 bp, Homo sapiens
ccattgtccctctgc

SEQ ID NO: 6727521 - DNA, 15 bp, Homo sapiens
ccattgtcctccttt

SEQ ID NO: 6727522 - DNA, 17 bp, Homo sapiens
ccattgtcctccttttc

SEQ ID NO: 6727523 - DNA, 17 bp, Homo sapiens
ccattgtcttccaaccc

SEQ ID NO: 6727524 - DNA, 20 bp, Homo sapiens
ccattgtcttccaaccccag

SEQ ID NO: 6727525 - DNA, 20 bp, Homo sapiens
ccattgtcttgttctgtgat

SEQ ID NO: 6727526 - DNA, 22 bp, Homo sapiens
ccattgtctttatatgaacata

SEQ ID NO: 6727527 - DNA, 22 bp, Homo sapiens
ccattgtgaatgttgtcctgtg

SEQ ID NO: 6727528 - DNA, 12 bp, Homo sapiens
ccattgtggaaa

SEQ ID NO: 6727529 - DNA, 18 bp, Homo sapiens
ccattgtggaattgagca

SEQ ID NO: 6727530 - DNA, 22 bp, Homo sapiens
ccattgtggtcacaggaagtag

SEQ ID NO: 6727531 - DNA, 23 bp, Homo sapiens
ccattgtgtgatccagccctggt

SEQ ID NO: 6727532 - DNA, 15 bp, Homo sapiens
ccattgtgtggcctg

SEQ ID NO: 6727533 - DNA, 16 bp, Homo sapiens
ccattgtgtggcctgg

SEQ ID NO: 6727534 - DNA, 15 bp, Homo sapiens
ccattgttcagaaga

SEQ ID NO: 6727535 - DNA, 14 bp, Homo sapiens
ccattgttcccttc

SEQ ID NO: 6727536 - DNA, 21 bp, Homo sapiens
ccattgttcccttcctcttcc

SEQ ID NO: 6727537 - DNA, 18 bp, Homo sapiens
ccattgttccttaccttt

SEQ ID NO: 6727538 - DNA, 19 bp, Homo sapiens
ccattgttccttaccttta

SEQ ID NO: 6727539 - DNA, 23 bp, Homo sapiens
ccatttaaaaatatctgaatata

SEQ ID NO: 6727540 - DNA, 23 bp, Homo sapiens
ccatttaaaacaagctgatagtg

SEQ ID NO: 6727541 - DNA, 20 bp, Homo sapiens
ccatttaaacagatgtccat

SEQ ID NO: 6727542 - DNA, 18 bp, Homo sapiens
ccatttaaactaaccttt

SEQ ID NO: 6727543 - DNA, 20 bp, Homo sapiens
ccatttaagaactgaggaac

SEQ ID NO: 6727544 - DNA, 21 bp, Homo sapiens
ccatttaagtatcttgtgctt

SEQ ID NO: 6727545 - DNA, 21 bp, Homo sapiens
ccatttaataaagaaatattt

SEQ ID NO: 6727546 - DNA, 16 bp, Homo sapiens
ccatttaatcatttcc

SEQ ID NO: 6727547 - DNA, 15 bp, Homo sapiens
ccatttaatgattga

SEQ ID NO: 6727548 - DNA, 20 bp, Homo sapiens
ccatttaatttcatgtatat

SEQ ID NO: 6727549 - DNA, 13 bp, Homo sapiens
ccatttacacttt

SEQ ID NO: 6727550 - DNA, 22 bp, Homo sapiens
ccatttacagtctctttcttcc

SEQ ID NO: 6727551 - DNA, 22 bp, Homo sapiens
ccatttacatgttttaaagaaa

SEQ ID NO: 6727552 - DNA, 14 bp, Homo sapiens
ccatttactaacag

SEQ ID NO: 6727553 - DNA, 22 bp, Homo sapiens
ccatttactgacacttcctgtc

SEQ ID NO: 6727554 - DNA, 22 bp, Homo sapiens
ccatttagaatggtgattttaa

SEQ ID NO: 6727555 - DNA, 20 bp, Homo sapiens
ccatttagaggatgtggctg

SEQ ID NO: 6727556 - DNA, 16 bp, Homo sapiens
ccatttaggtttctga

SEQ ID NO: 6727557 - DNA, 18 bp, Homo sapiens
ccatttatatatgaaaac

SEQ ID NO: 6727558 - DNA, 11 bp, Homo sapiens
ccatttattgt

SEQ ID NO: 6727559 - DNA, 21 bp, Homo sapiens
ccatttattgtttgaaatgtc

SEQ ID NO: 6727560 - DNA, 15 bp, Homo sapiens
ccatttcaactccag

SEQ ID NO: 6727561 - DNA, 23 bp, Homo sapiens
ccatttcaagacagattgtgaag

SEQ ID NO: 6727562 - DNA, 12 bp, Homo sapiens
ccatttcacaca

SEQ ID NO: 6727563 - DNA, 17 bp, Homo sapiens
ccatttcacacctgaaa

SEQ ID NO: 6727564 - DNA, 21 bp, Homo sapiens
ccatttcagtaaacctgtctg

SEQ ID NO: 6727565 - DNA, 22 bp, Homo sapiens
ccatttcagtaaacctgtctga

SEQ ID NO: 6727566 - DNA, 17 bp, Homo sapiens
ccatttcagtggcttcc

SEQ ID NO: 6727567 - DNA, 15 bp, Homo sapiens
ccatttcatgtccat

SEQ ID NO: 6727568 - DNA, 20 bp, Homo sapiens
ccatttcattgagggaaaac

SEQ ID NO: 6727569 - DNA, 21 bp, Homo sapiens
ccatttcatttgtgccagaat

SEQ ID NO: 6727570 - DNA, 17 bp, Homo sapiens
ccatttccactgtatat

SEQ ID NO: 6727571 - DNA, 14 bp, Homo sapiens
ccatttccagttca

SEQ ID NO: 6727572 - DNA, 22 bp, Homo sapiens
ccatttccatgtcccctcccag

SEQ ID NO: 6727573 - DNA, 18 bp, Homo sapiens
ccatttcccacatctttc

SEQ ID NO: 6727574 - DNA, 15 bp, Homo sapiens
ccatttcccacttcc

SEQ ID NO: 6727575 - DNA, 14 bp, Homo sapiens
ccatttccctgaac

SEQ ID NO: 6727576 - DNA, 16 bp, Homo sapiens
ccatttcctcacgtgc

SEQ ID NO: 6727577 - DNA, 19 bp, Homo sapiens
ccatttcctcacgtgcagg

SEQ ID NO: 6727578 - DNA, 18 bp, Homo sapiens
ccatttcctcttccttct

SEQ ID NO: 6727579 - DNA, 16 bp, Homo sapiens
ccatttcctgatctag

SEQ ID NO: 6727580 - DNA, 12 bp, Homo sapiens
ccatttcctgta

SEQ ID NO: 6727581 - DNA, 12 bp, Homo sapiens
ccatttccttgg

SEQ ID NO: 6727582 - DNA, 21 bp, Homo sapiens
ccatttcgtgagccccatctt

SEQ ID NO: 6727583 - DNA, 22 bp, Homo sapiens
ccatttcgtgagccccatcttc

SEQ ID NO: 6727584 - DNA, 13 bp, Homo sapiens
ccatttctactct

SEQ ID NO: 6727585 - DNA, 15 bp, Homo sapiens
ccatttctactgtat

SEQ ID NO: 6727586 - DNA, 17 bp, Homo sapiens
ccatttctatttattta

SEQ ID NO: 6727587 - DNA, 23 bp, Homo sapiens
ccatttctcaatcagtgcagtga

SEQ ID NO: 6727588 - DNA, 20 bp, Homo sapiens
ccatttctcactagtgtcag

SEQ ID NO: 6727589 - DNA, 13 bp, Homo sapiens
ccatttctcactg

SEQ ID NO: 6727590 - DNA, 14 bp, Homo sapiens
ccatttctcactga

SEQ ID NO: 6727591 - DNA, 16 bp, Homo sapiens
ccatttctcactgaga

SEQ ID NO: 6727592 - DNA, 12 bp, Homo sapiens
ccatttctcatg

SEQ ID NO: 6727593 - DNA, 13 bp, Homo sapiens
ccatttctccaga

SEQ ID NO: 6727594 - DNA, 13 bp, Homo sapiens
ccatttctccgtt

SEQ ID NO: 6727595 - DNA, 14 bp, Homo sapiens
ccatttctctacac

SEQ ID NO: 6727596 - DNA, 17 bp, Homo sapiens
ccatttctctacactaa

SEQ ID NO: 6727597 - DNA, 11 bp, Homo sapiens
ccatttctctc

SEQ ID NO: 6727598 - DNA, 15 bp, Homo sapiens
ccatttctgtggagg

SEQ ID NO: 6727599 - DNA, 13 bp, Homo sapiens
ccatttcttccca

SEQ ID NO: 6727600 - DNA, 16 bp, Homo sapiens
ccatttcttcctcact

SEQ ID NO: 6727601 - DNA, 15 bp, Homo sapiens
ccatttcttctctct

SEQ ID NO: 6727602 - DNA, 20 bp, Homo sapiens
ccatttcttctgcacaaaga

SEQ ID NO: 6727603 - DNA, 19 bp, Homo sapiens
ccatttcttggttttgtat

SEQ ID NO: 6727604 - DNA, 13 bp, Homo sapiens
ccatttctttctt

SEQ ID NO: 6727605 - DNA, 17 bp, Homo sapiens
ccatttgaacacattat

SEQ ID NO: 6727606 - DNA, 18 bp, Homo sapiens
ccatttgcaacaggaaga

SEQ ID NO: 6727607 - DNA, 20 bp, Homo sapiens
ccatttgcagagtcctgcac

SEQ ID NO: 6727608 - DNA, 12 bp, Homo sapiens
ccatttgcattt

SEQ ID NO: 6727609 - DNA, 15 bp, Homo sapiens
ccatttgcatttgtt

SEQ ID NO: 6727610 - DNA, 18 bp, Homo sapiens
ccatttgccatgctgcta

SEQ ID NO: 6727611 - DNA, 22 bp, Homo sapiens
ccatttgctagttctgctgccc

SEQ ID NO: 6727612 - DNA, 20 bp, Homo sapiens
ccatttgctgagtttccctt

SEQ ID NO: 6727613 - DNA, 15 bp, Homo sapiens
ccatttgctgccctg

SEQ ID NO: 6727614 - DNA, 16 bp, Homo sapiens
ccatttgctgccctgg

SEQ ID NO: 6727615 - DNA, 17 bp, Homo sapiens
ccatttgctgccctggg

SEQ ID NO: 6727616 - DNA, 19 bp, Homo sapiens
ccatttgctgccctggggc

SEQ ID NO: 6727617 - DNA, 13 bp, Homo sapiens
ccatttggaaatc

SEQ ID NO: 6727618 - DNA, 22 bp, Homo sapiens
ccatttggattttaaacaaaat

SEQ ID NO: 6727619 - DNA, 21 bp, Homo sapiens
ccatttggcagaactgctggg

SEQ ID NO: 6727620 - DNA, 23 bp, Homo sapiens
ccatttggcagaactgctggggc

SEQ ID NO: 6727621 - DNA, 16 bp, Homo sapiens
ccatttggcatccctg

SEQ ID NO: 6727622 - DNA, 18 bp, Homo sapiens
ccatttggcatccctggg

SEQ ID NO: 6727623 - DNA, 13 bp, Homo sapiens
ccatttgtaaaac

SEQ ID NO: 6727624 - DNA, 15 bp, Homo sapiens
ccatttgtaataaag

SEQ ID NO: 6727625 - DNA, 20 bp, Homo sapiens
ccatttgtaattaaattatg

SEQ ID NO: 6727626 - DNA, 20 bp, Homo sapiens
ccatttgtattaccattact

SEQ ID NO: 6727627 - DNA, 12 bp, Homo sapiens
ccatttgtattc

SEQ ID NO: 6727628 - DNA, 20 bp, Homo sapiens
ccatttgtattcaaatttgt

SEQ ID NO: 6727629 - DNA, 17 bp, Homo sapiens
ccatttgtcaaaaagta

SEQ ID NO: 6727630 - DNA, 13 bp, Homo sapiens
ccatttgtcccaa

SEQ ID NO: 6727631 - DNA, 17 bp, Homo sapiens
ccatttgtcttttgtaa

SEQ ID NO: 6727632 - DNA, 20 bp, Homo sapiens
ccatttgtgatcagcattgt

SEQ ID NO: 6727633 - DNA, 15 bp, Homo sapiens
ccatttgtgcaaaat

SEQ ID NO: 6727634 - DNA, 14 bp, Homo sapiens
ccatttgtgccaga

SEQ ID NO: 6727635 - DNA, 16 bp, Homo sapiens
ccatttgtgccagagg

SEQ ID NO: 6727636 - DNA, 14 bp, Homo sapiens
ccatttgtgtttat

SEQ ID NO: 6727637 - DNA, 22 bp, Homo sapiens
ccatttgtgttttgaaagccca

SEQ ID NO: 6727638 - DNA, 15 bp, Homo sapiens
ccatttgttaactgt

SEQ ID NO: 6727639 - DNA, 15 bp, Homo sapiens
ccatttgttaatatc

SEQ ID NO: 6727640 - DNA, 14 bp, Homo sapiens
ccatttgttatctg

SEQ ID NO: 6727641 - DNA, 13 bp, Homo sapiens
ccatttgttcata

SEQ ID NO: 6727642 - DNA, 16 bp, Homo sapiens
ccatttgttcctgctt

SEQ ID NO: 6727643 - DNA, 18 bp, Homo sapiens
ccatttgttgagccccag

SEQ ID NO: 6727644 - DNA, 17 bp, Homo sapiens
ccatttgttgctgctgc

SEQ ID NO: 6727645 - DNA, 22 bp, Homo sapiens
ccatttgttgctgctgctgctc

SEQ ID NO: 6727646 - DNA, 13 bp, Homo sapiens
ccatttgtttatt

SEQ ID NO: 6727647 - DNA, 15 bp, Homo sapiens
ccattttaaatttta

SEQ ID NO: 6727648 - DNA, 19 bp, Homo sapiens
ccattttaaattttatttt

SEQ ID NO: 6727649 - DNA, 18 bp, Homo sapiens
ccattttaacgctgccta

SEQ ID NO: 6727650 - DNA, 12 bp, Homo sapiens
ccattttagaag

SEQ ID NO: 6727651 - DNA, 21 bp, Homo sapiens
ccattttatctttgaatggtc

SEQ ID NO: 6727652 - DNA, 22 bp, Homo sapiens
ccattttattaataatatttat

SEQ ID NO: 6727653 - DNA, 20 bp, Homo sapiens
ccattttattttttgggcca

SEQ ID NO: 6727654 - DNA, 21 bp, Homo sapiens
ccattttattttttgggccat

SEQ ID NO: 6727655 - DNA, 19 bp, Homo sapiens
ccattttcaactgctttga

SEQ ID NO: 6727656 - DNA, 11 bp, Homo sapiens
ccattttccag

SEQ ID NO: 6727657 - DNA, 21 bp, Homo sapiens
ccattttcccatcatcctttg

SEQ ID NO: 6727658 - DNA, 13 bp, Homo sapiens
ccattttcccctt

SEQ ID NO: 6727659 - DNA, 18 bp, Homo sapiens
ccattttcctacaggcag

SEQ ID NO: 6727660 - DNA, 13 bp, Homo sapiens
ccattttcctgca

SEQ ID NO: 6727661 - DNA, 10 bp, Homo sapiens
ccattttcta

SEQ ID NO: 6727662 - DNA, 19 bp, Homo sapiens
ccattttctataagaaaaa

SEQ ID NO: 6727663 - DNA, 20 bp, Homo sapiens
ccattttctataagaaaaag

SEQ ID NO: 6727664 - DNA, 17 bp, Homo sapiens
ccattttctatcatgga

SEQ ID NO: 6727665 - DNA, 18 bp, Homo sapiens
ccattttctctattcttt

SEQ ID NO: 6727666 - DNA, 19 bp, Homo sapiens
ccattttctctattctttc

SEQ ID NO: 6727667 - DNA, 16 bp, Homo sapiens
ccattttcttgcctga

SEQ ID NO: 6727668 - DNA, 16 bp, Homo sapiens
ccattttgaggccaga

SEQ ID NO: 6727669 - DNA, 14 bp, Homo sapiens
ccattttgcaaaat

SEQ ID NO: 6727670 - DNA, 19 bp, Homo sapiens
ccattttgcccttccatag

SEQ ID NO: 6727671 - DNA, 14 bp, Homo sapiens
ccattttgcctctg

SEQ ID NO: 6727672 - DNA, 21 bp, Homo sapiens
ccattttgcctgacaattgca

SEQ ID NO: 6727673 - DNA, 22 bp, Homo sapiens
ccattttggggtacccactgct

SEQ ID NO: 6727674 - DNA, 19 bp, Homo sapiens
ccattttggtgtctttctc

SEQ ID NO: 6727675 - DNA, 18 bp, Homo sapiens
ccattttgtaactgccta

SEQ ID NO: 6727676 - DNA, 18 bp, Homo sapiens
ccattttgtctggctgtg

SEQ ID NO: 6727677 - DNA, 12 bp, Homo sapiens
ccattttgtgaa

SEQ ID NO: 6727678 - DNA, 16 bp, Homo sapiens
ccattttgtgaagccc

SEQ ID NO: 6727679 - DNA, 13 bp, Homo sapiens
ccattttgtgaat

SEQ ID NO: 6727680 - DNA, 22 bp, Homo sapiens
ccattttgttattgactaacag

SEQ ID NO: 6727681 - DNA, 15 bp, Homo sapiens
ccatttttaatgaga

SEQ ID NO: 6727682 - DNA, 16 bp, Homo sapiens
ccatttttactaaagc

SEQ ID NO: 6727683 - DNA, 18 bp, Homo sapiens
ccatttttcaaagcaatt

SEQ ID NO: 6727684 - DNA, 15 bp, Homo sapiens
ccatttttcccagga

SEQ ID NO: 6727685 - DNA, 17 bp, Homo sapiens
ccatttttcccaggaca

SEQ ID NO: 6727686 - DNA, 14 bp, Homo sapiens
ccatttttctcttg

SEQ ID NO: 6727687 - DNA, 21 bp, Homo sapiens
ccatttttgagccaagcttca

SEQ ID NO: 6727688 - DNA, 17 bp, Homo sapiens
ccatttttgctgaattc

SEQ ID NO: 6727689 - DNA, 18 bp, Homo sapiens
ccatttttgctgaattca

SEQ ID NO: 6727690 - DNA, 18 bp, Homo sapiens
ccatttttgtcagtctga

SEQ ID NO: 6727691 - DNA, 14 bp, Homo sapiens
ccattttttatatt

SEQ ID NO: 6727692 - DNA, 17 bp, Homo sapiens
ccattttttcttccctt

SEQ ID NO: 6727693 - DNA, 13 bp, Homo sapiens
cccaaaaaagaac

SEQ ID NO: 6727694 - DNA, 23 bp, Homo sapiens
cccaaaaacagcccccctgctgc

SEQ ID NO: 6727695 - DNA, 14 bp, Homo sapiens
cccaaaaatttgaa

SEQ ID NO: 6727696 - DNA, 14 bp, Homo sapiens
cccaaaacaaagtc

SEQ ID NO: 6727697 - DNA, 21 bp, Homo sapiens
cccaaaacaatctatttaaaa

SEQ ID NO: 6727698 - DNA, 19 bp, Homo sapiens
cccaaaacaccgggttcca

SEQ ID NO: 6727699 - DNA, 15 bp, Homo sapiens
cccaaaacactgtct

SEQ ID NO: 6727700 - DNA, 14 bp, Homo sapiens
cccaaaaccacagc

SEQ ID NO: 6727701 - DNA, 14 bp, Homo sapiens
cccaaaacccaggg

SEQ ID NO: 6727702 - DNA, 15 bp, Homo sapiens
cccaaaacccagggc

SEQ ID NO: 6727703 - DNA, 17 bp, Homo sapiens
cccaaaacccagggcaa

SEQ ID NO: 6727704 - DNA, 22 bp, Homo sapiens
cccaaaacctttccccagacac

SEQ ID NO: 6727705 - DNA, 19 bp, Homo sapiens
cccaaaagaggtgtcatgc

SEQ ID NO: 6727706 - DNA, 22 bp, Homo sapiens
cccaaaagtcaaaaggtgcctg

SEQ ID NO: 6727707 - DNA, 11 bp, Homo sapiens
cccaaaatata

SEQ ID NO: 6727708 - DNA, 19 bp, Homo sapiens
cccaaaatctgattagaag

SEQ ID NO: 6727709 - DNA, 20 bp, Homo sapiens
cccaaaatctgattagaagt

SEQ ID NO: 6727710 - DNA, 15 bp, Homo sapiens
cccaaaatgaagatt

SEQ ID NO: 6727711 - DNA, 22 bp, Homo sapiens
cccaaacaaatggaagagaaga

SEQ ID NO: 6727712 - DNA, 16 bp, Homo sapiens
cccaaacaggacagca

SEQ ID NO: 6727713 - DNA, 23 bp, Homo sapiens
cccaaacattaatcaccaaagta

SEQ ID NO: 6727714 - DNA, 15 bp, Homo sapiens
cccaaaccaagtgcc

SEQ ID NO: 6727715 - DNA, 22 bp, Homo sapiens
cccaaaccaccagaagcccaga

SEQ ID NO: 6727716 - DNA, 15 bp, Homo sapiens
cccaaaccagcccag

SEQ ID NO: 6727717 - DNA, 23 bp, Homo sapiens
cccaaaccagggggaagcaccag

SEQ ID NO: 6727718 - DNA, 18 bp, Homo sapiens
cccaaaccatgagaattt

SEQ ID NO: 6727719 - DNA, 13 bp, Homo sapiens
cccaaaccccctg

SEQ ID NO: 6727720 - DNA, 15 bp, Homo sapiens
cccaaaccccctgca

SEQ ID NO: 6727721 - DNA, 18 bp, Homo sapiens
cccaaaccctgcttctgc

SEQ ID NO: 6727722 - DNA, 19 bp, Homo sapiens
cccaaacccttaactgaca

SEQ ID NO: 6727723 - DNA, 12 bp, Homo sapiens
cccaaacccttc

SEQ ID NO: 6727724 - DNA, 15 bp, Homo sapiens
cccaaacctggagat

SEQ ID NO: 6727725 - DNA, 19 bp, Homo sapiens
cccaaacctgggaaggcca

SEQ ID NO: 6727726 - DNA, 15 bp, Homo sapiens
cccaaacctttcccc

SEQ ID NO: 6727727 - DNA, 16 bp, Homo sapiens
cccaaacgccctttcc

SEQ ID NO: 6727728 - DNA, 18 bp, Homo sapiens
cccaaactcccaggacct

SEQ ID NO: 6727729 - DNA, 15 bp, Homo sapiens
cccaaactccccttc

SEQ ID NO: 6727730 - DNA, 18 bp, Homo sapiens
cccaaactccccttccct

SEQ ID NO: 6727731 - DNA, 19 bp, Homo sapiens
cccaaactcctttcttatc

SEQ ID NO: 6727732 - DNA, 23 bp, Homo sapiens
cccaaactgtagtaattgttaca

SEQ ID NO: 6727733 - DNA, 22 bp, Homo sapiens
cccaaacttatggacactgcct

SEQ ID NO: 6727734 - DNA, 21 bp, Homo sapiens
cccaaagaatgtttatagcaa

SEQ ID NO: 6727735 - DNA, 20 bp, Homo sapiens
cccaaagacctccacttgct

SEQ ID NO: 6727736 - DNA, 12 bp, Homo sapiens
cccaaagagctg

SEQ ID NO: 6727737 - DNA, 16 bp, Homo sapiens
cccaaagagctgtggc

SEQ ID NO: 6727738 - DNA, 20 bp, Homo sapiens
cccaaagagctgtggctggg

SEQ ID NO: 6727739 - DNA, 12 bp, Homo sapiens
cccaaagatgca

SEQ ID NO: 6727740 - DNA, 13 bp, Homo sapiens
cccaaagcacatg

SEQ ID NO: 6727741 - DNA, 17 bp, Homo sapiens
cccaaagccactggaag

SEQ ID NO: 6727742 - DNA, 20 bp, Homo sapiens
cccaaagccactggaaggag

SEQ ID NO: 6727743 - DNA, 14 bp, Homo sapiens
cccaaagccagaca

SEQ ID NO: 6727744 - DNA, 14 bp, Homo sapiens
cccaaagcccagcc

SEQ ID NO: 6727745 - DNA, 17 bp, Homo sapiens
cccaaagcctgtcccag

SEQ ID NO: 6727746 - DNA, 21 bp, Homo sapiens
cccaaagcggccgatgggagt

SEQ ID NO: 6727747 - DNA, 13 bp, Homo sapiens
cccaaagctctaa

SEQ ID NO: 6727748 - DNA, 13 bp, Homo sapiens
cccaaagctgagc

SEQ ID NO: 6727749 - DNA, 16 bp, Homo sapiens
cccaaagctgagcctg

SEQ ID NO: 6727750 - DNA, 15 bp, Homo sapiens
cccaaagctttcctg

SEQ ID NO: 6727751 - DNA, 17 bp, Homo sapiens
cccaaagctttcctgcc

SEQ ID NO: 6727752 - DNA, 19 bp, Homo sapiens
cccaaaggaaccgcccagt

SEQ ID NO: 6727753 - DNA, 18 bp, Homo sapiens
cccaaaggacgcactgag

SEQ ID NO: 6727754 - DNA, 22 bp, Homo sapiens
cccaaaggcatcccagcctggg

SEQ ID NO: 6727755 - DNA, 18 bp, Homo sapiens
cccaaaggcccagggagg

SEQ ID NO: 6727756 - DNA, 22 bp, Homo sapiens
cccaaaggcccagggaggcagc

SEQ ID NO: 6727757 - DNA, 19 bp, Homo sapiens
cccaaaggctttgccctgc

SEQ ID NO: 6727758 - DNA, 13 bp, Homo sapiens
cccaaagggaggg

SEQ ID NO: 6727759 - DNA, 15 bp, Homo sapiens
cccaaagggcctcct

SEQ ID NO: 6727760 - DNA, 13 bp, Homo sapiens
cccaaagggtgtg

SEQ ID NO: 6727761 - DNA, 15 bp, Homo sapiens
cccaaaggtggcctg

SEQ ID NO: 6727762 - DNA, 13 bp, Homo sapiens
cccaaagtccagg

SEQ ID NO: 6727763 - DNA, 15 bp, Homo sapiens
cccaaagtccaggct

SEQ ID NO: 6727764 - DNA, 18 bp, Homo sapiens
cccaaagtcctctgctcc

SEQ ID NO: 6727765 - DNA, 13 bp, Homo sapiens
cccaaagtgctgg

SEQ ID NO: 6727766 - DNA, 14 bp, Homo sapiens
cccaaagtgctggg

SEQ ID NO: 6727767 - DNA, 15 bp, Homo sapiens
cccaaagtgctggga

SEQ ID NO: 6727768 - DNA, 16 bp, Homo sapiens
cccaaagtgctgggat

SEQ ID NO: 6727769 - DNA, 19 bp, Homo sapiens
cccaaataaatgtgtaaat

SEQ ID NO: 6727770 - DNA, 18 bp, Homo sapiens
cccaaataacttcagtcc

SEQ ID NO: 6727771 - DNA, 17 bp, Homo sapiens
cccaaataagaagggat

SEQ ID NO: 6727772 - DNA, 21 bp, Homo sapiens
cccaaataattgttgtgtgta

SEQ ID NO: 6727773 - DNA, 20 bp, Homo sapiens
cccaaatatgtattttccta

SEQ ID NO: 6727774 - DNA, 18 bp, Homo sapiens
cccaaatcaaaataaaag

SEQ ID NO: 6727775 - DNA, 16 bp, Homo sapiens
cccaaatcaatacact

SEQ ID NO: 6727776 - DNA, 14 bp, Homo sapiens
cccaaatcacaaac

SEQ ID NO: 6727777 - DNA, 18 bp, Homo sapiens
cccaaatccgccagtgtt

SEQ ID NO: 6727778 - DNA, 14 bp, Homo sapiens
cccaaatctatagc

SEQ ID NO: 6727779 - DNA, 14 bp, Homo sapiens
cccaaatcttcctc

SEQ ID NO: 6727780 - DNA, 18 bp, Homo sapiens
cccaaatggccattttaa

SEQ ID NO: 6727781 - DNA, 14 bp, Homo sapiens
cccaaatggccctg

SEQ ID NO: 6727782 - DNA, 17 bp, Homo sapiens
cccaaatgtgtgcccag

SEQ ID NO: 6727783 - DNA, 18 bp, Homo sapiens
cccaaatgtgtgcccagc

SEQ ID NO: 6727784 - DNA, 19 bp, Homo sapiens
cccaaatgtgtgcccagct

SEQ ID NO: 6727785 - DNA, 20 bp, Homo sapiens
cccaaattataagggccctg

SEQ ID NO: 6727786 - DNA, 16 bp, Homo sapiens
cccaaattgccttcag

SEQ ID NO: 6727787 - DNA, 17 bp, Homo sapiens
cccaaattgccttcagc

SEQ ID NO: 6727788 - DNA, 16 bp, Homo sapiens
cccaaatttgattgat

SEQ ID NO: 6727789 - DNA, 19 bp, Homo sapiens
cccaaatttgattgatttg

SEQ ID NO: 6727790 - DNA, 12 bp, Homo sapiens
cccaaattttaa

SEQ ID NO: 6727791 - DNA, 15 bp, Homo sapiens
cccaacaacatccat

SEQ ID NO: 6727792 - DNA, 23 bp, Homo sapiens
cccaacaacatgaaactgcctat

SEQ ID NO: 6727793 - DNA, 13 bp, Homo sapiens
cccaacaagcaag

SEQ ID NO: 6727794 - DNA, 17 bp, Homo sapiens
cccaacacaatctttcc

SEQ ID NO: 6727795 - DNA, 17 bp, Homo sapiens
cccaacaccagcccctg

SEQ ID NO: 6727796 - DNA, 13 bp, Homo sapiens
cccaacactccag

SEQ ID NO: 6727797 - DNA, 13 bp, Homo sapiens
cccaacactgagc

SEQ ID NO: 6727798 - DNA, 14 bp, Homo sapiens
cccaacactgccag

SEQ ID NO: 6727799 - DNA, 15 bp, Homo sapiens
cccaacactgtgccc

SEQ ID NO: 6727800 - DNA, 11 bp, Homo sapiens
cccaacagcac

SEQ ID NO: 6727801 - DNA, 15 bp, Homo sapiens
cccaacagcaccaat

SEQ ID NO: 6727802 - DNA, 15 bp, Homo sapiens
cccaacagccttagc

SEQ ID NO: 6727803 - DNA, 16 bp, Homo sapiens
cccaacagccttagct

SEQ ID NO: 6727804 - DNA, 23 bp, Homo sapiens
cccaacagcgacatagcccatcc

SEQ ID NO: 6727805 - DNA, 11 bp, Homo sapiens
cccaacagctc

SEQ ID NO: 6727806 - DNA, 15 bp, Homo sapiens
cccaacagctggacc

SEQ ID NO: 6727807 - DNA, 16 bp, Homo sapiens
cccaacaggaggacaa

SEQ ID NO: 6727808 - DNA, 18 bp, Homo sapiens
cccaacaggaggacaatt

SEQ ID NO: 6727809 - DNA, 22 bp, Homo sapiens
cccaacaggtgctgaactgtgc

SEQ ID NO: 6727810 - DNA, 16 bp, Homo sapiens
cccaacatgggaggga

SEQ ID NO: 6727811 - DNA, 22 bp, Homo sapiens
cccaacatgggagggatcagcc

SEQ ID NO: 6727812 - DNA, 23 bp, Homo sapiens
cccaacatgggagggatcagccc

SEQ ID NO: 6727813 - DNA, 12 bp, Homo sapiens
cccaacattctg

SEQ ID NO: 6727814 - DNA, 13 bp, Homo sapiens
cccaacattctgc

SEQ ID NO: 6727815 - DNA, 14 bp, Homo sapiens
cccaacattctgca

SEQ ID NO: 6727816 - DNA, 17 bp, Homo sapiens
cccaaccaaccagcagg

SEQ ID NO: 6727817 - DNA, 20 bp, Homo sapiens
cccaaccaaccagcagggta

SEQ ID NO: 6727818 - DNA, 18 bp, Homo sapiens
cccaaccaactttccccc

SEQ ID NO: 6727819 - DNA, 17 bp, Homo sapiens
cccaaccaaggaaggag

SEQ ID NO: 6727820 - DNA, 13 bp, Homo sapiens
cccaaccactctt

SEQ ID NO: 6727821 - DNA, 18 bp, Homo sapiens
cccaaccagaactttctg

SEQ ID NO: 6727822 - DNA, 20 bp, Homo sapiens
cccaaccaggcacctcttcc

SEQ ID NO: 6727823 - DNA, 14 bp, Homo sapiens
cccaaccaggccct

SEQ ID NO: 6727824 - DNA, 17 bp, Homo sapiens
cccaaccagtgccaagg

SEQ ID NO: 6727825 - DNA, 17 bp, Homo sapiens
cccaacccaaaccatga

SEQ ID NO: 6727826 - DNA, 14 bp, Homo sapiens
cccaacccaatccc

SEQ ID NO: 6727827 - DNA, 15 bp, Homo sapiens
cccaacccaatccct

SEQ ID NO: 6727828 - DNA, 16 bp, Homo sapiens
cccaacccacctctgg

SEQ ID NO: 6727829 - DNA, 18 bp, Homo sapiens
cccaacccatgcccctga

SEQ ID NO: 6727830 - DNA, 20 bp, Homo sapiens
cccaacccattcactacagg

SEQ ID NO: 6727831 - DNA, 13 bp, Homo sapiens
cccaaccccaaga

SEQ ID NO: 6727832 - DNA, 17 bp, Homo sapiens
cccaaccccagatgccc

SEQ ID NO: 6727833 - DNA, 12 bp, Homo sapiens
cccaaccccagc

SEQ ID NO: 6727834 - DNA, 22 bp, Homo sapiens
cccaaccccagccgctcggagg

SEQ ID NO: 6727835 - DNA, 18 bp, Homo sapiens
cccaacccccacctcccg

SEQ ID NO: 6727836 - DNA, 12 bp, Homo sapiens
cccaacccccag

SEQ ID NO: 6727837 - DNA, 23 bp, Homo sapiens
cccaacccccagaggtggccctt

SEQ ID NO: 6727838 - DNA, 13 bp, Homo sapiens
cccaacccccctc

SEQ ID NO: 6727839 - DNA, 19 bp, Homo sapiens
cccaacccccctcctgctc

SEQ ID NO: 6727840 - DNA, 21 bp, Homo sapiens
cccaacccccctcctgctcct

SEQ ID NO: 6727841 - DNA, 22 bp, Homo sapiens
cccaacccccctcctgctcctc

SEQ ID NO: 6727842 - DNA, 22 bp, Homo sapiens
cccaaccccgcggtgctctggc

SEQ ID NO: 6727843 - DNA, 17 bp, Homo sapiens
cccaaccccgtgtcctg

SEQ ID NO: 6727844 - DNA, 17 bp, Homo sapiens
cccaacccctcctccct

SEQ ID NO: 6727845 - DNA, 21 bp, Homo sapiens
cccaacccctcctccctcaga

SEQ ID NO: 6727846 - DNA, 17 bp, Homo sapiens
cccaacccctccttccc

SEQ ID NO: 6727847 - DNA, 12 bp, Homo sapiens
cccaacccctga

SEQ ID NO: 6727848 - DNA, 16 bp, Homo sapiens
cccaacccctgaggaa

SEQ ID NO: 6727849 - DNA, 23 bp, Homo sapiens
cccaaccccttaagccctggccc

SEQ ID NO: 6727850 - DNA, 14 bp, Homo sapiens
cccaacccggaaac

SEQ ID NO: 6727851 - DNA, 13 bp, Homo sapiens
cccaacccgtgga

SEQ ID NO: 6727852 - DNA, 17 bp, Homo sapiens
cccaacccgtggaggct

SEQ ID NO: 6727853 - DNA, 21 bp, Homo sapiens
cccaacccgtggaggctgctc

SEQ ID NO: 6727854 - DNA, 22 bp, Homo sapiens
cccaacccgtggaggctgctcg

SEQ ID NO: 6727855 - DNA, 16 bp, Homo sapiens
cccaaccctgcccctg

SEQ ID NO: 6727856 - DNA, 23 bp, Homo sapiens
cccaaccctgggctggggaggag

SEQ ID NO: 6727857 - DNA, 21 bp, Homo sapiens
cccaacctacattccaccctg

SEQ ID NO: 6727858 - DNA, 13 bp, Homo sapiens
cccaacctcaatg

SEQ ID NO: 6727859 - DNA, 13 bp, Homo sapiens
cccaacctcagag

SEQ ID NO: 6727860 - DNA, 13 bp, Homo sapiens
cccaacctcagca

SEQ ID NO: 6727861 - DNA, 20 bp, Homo sapiens
cccaacctcgccctctctca

SEQ ID NO: 6727862 - DNA, 21 bp, Homo sapiens
cccaacctctgttccccaccc

SEQ ID NO: 6727863 - DNA, 18 bp, Homo sapiens
cccaacctcttcctcctg

SEQ ID NO: 6727864 - DNA, 23 bp, Homo sapiens
cccaacctcttcctcctgacacc

SEQ ID NO: 6727865 - DNA, 21 bp, Homo sapiens
cccaacctgctctcctcttct

SEQ ID NO: 6727866 - DNA, 20 bp, Homo sapiens
cccaacctggctccctccca

SEQ ID NO: 6727867 - DNA, 23 bp, Homo sapiens
cccaacctggctccctcccaccc

SEQ ID NO: 6727868 - DNA, 13 bp, Homo sapiens
cccaacctgtcct

SEQ ID NO: 6727869 - DNA, 17 bp, Homo sapiens
cccaacctgtccttact

SEQ ID NO: 6727870 - DNA, 16 bp, Homo sapiens
cccaacgaaaagcaca

SEQ ID NO: 6727871 - DNA, 18 bp, Homo sapiens
cccaacgagcctcctcag

SEQ ID NO: 6727872 - DNA, 20 bp, Homo sapiens
cccaacgagcctcctcaggg

SEQ ID NO: 6727873 - DNA, 16 bp, Homo sapiens
cccaacggccctgcag

SEQ ID NO: 6727874 - DNA, 22 bp, Homo sapiens
cccaacggccctgcagccagct

SEQ ID NO: 6727875 - DNA, 20 bp, Homo sapiens
cccaacggggtggggagggt

SEQ ID NO: 6727876 - DNA, 19 bp, Homo sapiens
cccaacgtactcctcagac

SEQ ID NO: 6727877 - DNA, 14 bp, Homo sapiens
cccaacgtcccctc

SEQ ID NO: 6727878 - DNA, 17 bp, Homo sapiens
cccaacgtcccctccgc

SEQ ID NO: 6727879 - DNA, 23 bp, Homo sapiens
cccaacgtcccctccgccgtgcc

SEQ ID NO: 6727880 - DNA, 20 bp, Homo sapiens
cccaactaatttttgtattt

SEQ ID NO: 6727881 - DNA, 18 bp, Homo sapiens
cccaactagaagcctagt

SEQ ID NO: 6727882 - DNA, 16 bp, Homo sapiens
cccaactcaccccagc

SEQ ID NO: 6727883 - DNA, 17 bp, Homo sapiens
cccaactcaccccagcc

SEQ ID NO: 6727884 - DNA, 13 bp, Homo sapiens
cccaactcagcct

SEQ ID NO: 6727885 - DNA, 16 bp, Homo sapiens
cccaactccacagggc

SEQ ID NO: 6727886 - DNA, 14 bp, Homo sapiens
cccaactcccttct

SEQ ID NO: 6727887 - DNA, 16 bp, Homo sapiens
cccaactccgcccagc

SEQ ID NO: 6727888 - DNA, 13 bp, Homo sapiens
cccaactcctgga

SEQ ID NO: 6727889 - DNA, 15 bp, Homo sapiens
cccaactcctggaag

SEQ ID NO: 6727890 - DNA, 15 bp, Homo sapiens
cccaactccttccag

SEQ ID NO: 6727891 - DNA, 20 bp, Homo sapiens
cccaactcgggctcccgggt

SEQ ID NO: 6727892 - DNA, 16 bp, Homo sapiens
cccaactctagctggg

SEQ ID NO: 6727893 - DNA, 12 bp, Homo sapiens
cccaactctccc

SEQ ID NO: 6727894 - DNA, 15 bp, Homo sapiens
cccaactctccccag

SEQ ID NO: 6727895 - DNA, 23 bp, Homo sapiens
cccaactctccccagtgcctgcc

SEQ ID NO: 6727896 - DNA, 12 bp, Homo sapiens
cccaactctcct

SEQ ID NO: 6727897 - DNA, 17 bp, Homo sapiens
cccaactctgagcccat

SEQ ID NO: 6727898 - DNA, 18 bp, Homo sapiens
cccaactctgagcccatg

SEQ ID NO: 6727899 - DNA, 14 bp, Homo sapiens
cccaactctggcct

SEQ ID NO: 6727900 - DNA, 12 bp, Homo sapiens
cccaactgacca

SEQ ID NO: 6727901 - DNA, 17 bp, Homo sapiens
cccaactgacttctgct

SEQ ID NO: 6727902 - DNA, 23 bp, Homo sapiens
cccaactgagtcatcttgtgagt

SEQ ID NO: 6727903 - DNA, 18 bp, Homo sapiens
cccaactgatcctgctcc

SEQ ID NO: 6727904 - DNA, 21 bp, Homo sapiens
cccaactgcaagtcacaaagg

SEQ ID NO: 6727905 - DNA, 20 bp, Homo sapiens
cccaactgctccagcctctg

SEQ ID NO: 6727906 - DNA, 23 bp, Homo sapiens
cccaactgctccagcctctgccg

SEQ ID NO: 6727907 - DNA, 13 bp, Homo sapiens
cccaactgctctg

SEQ ID NO: 6727908 - DNA, 16 bp, Homo sapiens
cccaactgctctgccc

SEQ ID NO: 6727909 - DNA, 19 bp, Homo sapiens
cccaactggttcaggctca

SEQ ID NO: 6727910 - DNA, 20 bp, Homo sapiens
cccaactggttcaggctcaa

SEQ ID NO: 6727911 - DNA, 24 bp, Homo sapiens
cccaactgtgggtccgagagggaa

SEQ ID NO: 6727912 - DNA, 22 bp, Homo sapiens
cccaactgtggtagctccagcg

SEQ ID NO: 6727913 - DNA, 12 bp, Homo sapiens
cccaactgttat

SEQ ID NO: 6727914 - DNA, 16 bp, Homo sapiens
cccaacttcaccaccc

SEQ ID NO: 6727915 - DNA, 19 bp, Homo sapiens
cccaacttcaccaccccct

SEQ ID NO: 6727916 - DNA, 17 bp, Homo sapiens
cccaacttcatctggaa

SEQ ID NO: 6727917 - DNA, 17 bp, Homo sapiens
cccaacttccagaggac

SEQ ID NO: 6727918 - DNA, 12 bp, Homo sapiens
cccaacttgcca

SEQ ID NO: 6727919 - DNA, 19 bp, Homo sapiens
cccaacttgccaaaatgtt

SEQ ID NO: 6727920 - DNA, 22 bp, Homo sapiens
cccaacttggcagctttttctg

SEQ ID NO: 6727921 - DNA, 21 bp, Homo sapiens
cccaactttctcactgctgtc

SEQ ID NO: 6727922 - DNA, 22 bp, Homo sapiens
cccaactttctcactgctgtca

SEQ ID NO: 6727923 - DNA, 17 bp, Homo sapiens
cccaagaaaccaaagtc

SEQ ID NO: 6727924 - DNA, 20 bp, Homo sapiens
cccaagaaacctccatcctg

SEQ ID NO: 6727925 - DNA, 19 bp, Homo sapiens
cccaagaaaggaaaccttt

SEQ ID NO: 6727926 - DNA, 22 bp, Homo sapiens
cccaagaacagcaggcccacct

SEQ ID NO: 6727927 - DNA, 23 bp, Homo sapiens
cccaagaacagcaggcccaccta

SEQ ID NO: 6727928 - DNA, 23 bp, Homo sapiens
cccaagaactgcagatagcccag

SEQ ID NO: 6727929 - DNA, 16 bp, Homo sapiens
cccaagaaggctgggg

SEQ ID NO: 6727930 - DNA, 20 bp, Homo sapiens
cccaagaatagatgctgact

SEQ ID NO: 6727931 - DNA, 13 bp, Homo sapiens
cccaagacaccat

SEQ ID NO: 6727932 - DNA, 18 bp, Homo sapiens
cccaagacagatgcccca

SEQ ID NO: 6727933 - DNA, 21 bp, Homo sapiens
cccaagacagatgccccagag

SEQ ID NO: 6727934 - DNA, 12 bp, Homo sapiens
cccaagacagtc

SEQ ID NO: 6727935 - DNA, 23 bp, Homo sapiens
cccaagaccctgccccctgccag

SEQ ID NO: 6727936 - DNA, 18 bp, Homo sapiens
cccaagacctcagggcac

SEQ ID NO: 6727937 - DNA, 20 bp, Homo sapiens
cccaagacctcatctgcctg

SEQ ID NO: 6727938 - DNA, 20 bp, Homo sapiens
cccaagactcccatgaggga

SEQ ID NO: 6727939 - DNA, 15 bp, Homo sapiens
cccaagactctgctc

SEQ ID NO: 6727940 - DNA, 19 bp, Homo sapiens
cccaagactctgctctcct

SEQ ID NO: 6727941 - DNA, 15 bp, Homo sapiens
cccaagactgggctg

SEQ ID NO: 6727942 - DNA, 11 bp, Homo sapiens
cccaagagaga

SEQ ID NO: 6727943 - DNA, 15 bp, Homo sapiens
cccaagagaggaagg

SEQ ID NO: 6727944 - DNA, 16 bp, Homo sapiens
cccaagagaggaagga

SEQ ID NO: 6727945 - DNA, 22 bp, Homo sapiens
cccaagagaggaaggacccctc

SEQ ID NO: 6727946 - DNA, 22 bp, Homo sapiens
cccaagagcagagtctgggcct

SEQ ID NO: 6727947 - DNA, 18 bp, Homo sapiens
cccaagagcatcatgcct

SEQ ID NO: 6727948 - DNA, 23 bp, Homo sapiens
cccaagagctacgtatttaatag

SEQ ID NO: 6727949 - DNA, 13 bp, Homo sapiens
cccaagagggctg

SEQ ID NO: 6727950 - DNA, 14 bp, Homo sapiens
cccaagaggtctga

SEQ ID NO: 6727951 - DNA, 20 bp, Homo sapiens
cccaagaggtctgagccctg

SEQ ID NO: 6727952 - DNA, 22 bp, Homo sapiens
cccaagaggtctgagccctggt

SEQ ID NO: 6727953 - DNA, 16 bp, Homo sapiens
cccaagagtggtggca

SEQ ID NO: 6727954 - DNA, 22 bp, Homo sapiens
cccaagatcattctacaagtaa

SEQ ID NO: 6727955 - DNA, 15 bp, Homo sapiens
cccaagatctgccag

SEQ ID NO: 6727956 - DNA, 14 bp, Homo sapiens
cccaagatgcctga

SEQ ID NO: 6727957 - DNA, 15 bp, Homo sapiens
cccaagatgcctgat

SEQ ID NO: 6727958 - DNA, 19 bp, Homo sapiens
cccaagatggagaggaaga

SEQ ID NO: 6727959 - DNA, 22 bp, Homo sapiens
cccaagatgggcatcttttgta

SEQ ID NO: 6727960 - DNA, 23 bp, Homo sapiens
cccaagattcacacctgactctg

SEQ ID NO: 6727961 - DNA, 14 bp, Homo sapiens
cccaagattcttca

SEQ ID NO: 6727962 - DNA, 17 bp, Homo sapiens
cccaagattgagctctc

SEQ ID NO: 6727963 - DNA, 21 bp, Homo sapiens
cccaagattgagctctctgcc

SEQ ID NO: 6727964 - DNA, 13 bp, Homo sapiens
cccaagcagccag

SEQ ID NO: 6727965 - DNA, 12 bp, Homo sapiens
cccaagcagccg

SEQ ID NO: 6727966 - DNA, 12 bp, Homo sapiens
cccaagcagctg

SEQ ID NO: 6727967 - DNA, 20 bp, Homo sapiens
cccaagcatgccccacccac

SEQ ID NO: 6727968 - DNA, 23 bp, Homo sapiens
cccaagcatgggggaccccttcc

SEQ ID NO: 6727969 - DNA, 16 bp, Homo sapiens
cccaagccagaggctg

SEQ ID NO: 6727970 - DNA, 16 bp, Homo sapiens
cccaagcccaccaggt

SEQ ID NO: 6727971 - DNA, 23 bp, Homo sapiens
cccaagcccacgtcaggcctggc

SEQ ID NO: 6727972 - DNA, 15 bp, Homo sapiens
cccaagccccatctc

SEQ ID NO: 6727973 - DNA, 20 bp, Homo sapiens
cccaagccccatctcatcct

SEQ ID NO: 6727974 - DNA, 18 bp, Homo sapiens
cccaagcccgacttgctg

SEQ ID NO: 6727975 - DNA, 16 bp, Homo sapiens
cccaagccctggtgac

SEQ ID NO: 6727976 - DNA, 23 bp, Homo sapiens
cccaagcctacttttgccattga

SEQ ID NO: 6727977 - DNA, 19 bp, Homo sapiens
cccaagcctgatccagcct

SEQ ID NO: 6727978 - DNA, 17 bp, Homo sapiens
cccaagcctgctggctg

SEQ ID NO: 6727979 - DNA, 16 bp, Homo sapiens
cccaagcctggcaggg

SEQ ID NO: 6727980 - DNA, 18 bp, Homo sapiens
cccaagcctggtctcctc

SEQ ID NO: 6727981 - DNA, 22 bp, Homo sapiens
cccaagctaagctgcaggcaca

SEQ ID NO: 6727982 - DNA, 12 bp, Homo sapiens
cccaagctagac

SEQ ID NO: 6727983 - DNA, 14 bp, Homo sapiens
cccaagctcctcct

SEQ ID NO: 6727984 - DNA, 19 bp, Homo sapiens
cccaagctcggatcacatg

SEQ ID NO: 6727985 - DNA, 14 bp, Homo sapiens
cccaagctctgctc

SEQ ID NO: 6727986 - DNA, 17 bp, Homo sapiens
cccaagctgattttatt

SEQ ID NO: 6727987 - DNA, 19 bp, Homo sapiens
cccaagctggagtgcagtg

SEQ ID NO: 6727988 - DNA, 11 bp, Homo sapiens
cccaagctggc

SEQ ID NO: 6727989 - DNA, 12 bp, Homo sapiens
cccaagctgtgc

SEQ ID NO: 6727990 - DNA, 19 bp, Homo sapiens
cccaagctgttttcttcta

SEQ ID NO: 6727991 - DNA, 20 bp, Homo sapiens
cccaagcttaatagccctcc

SEQ ID NO: 6727992 - DNA, 13 bp, Homo sapiens
cccaagcttccca

SEQ ID NO: 6727993 - DNA, 14 bp, Homo sapiens
cccaagcttcccaa

SEQ ID NO: 6727994 - DNA, 13 bp, Homo sapiens
cccaagcttctga

SEQ ID NO: 6727995 - DNA, 22 bp, Homo sapiens
cccaagcttggcagccgagctc

SEQ ID NO: 6727996 - DNA, 16 bp, Homo sapiens
cccaaggacaaggggc

SEQ ID NO: 6727997 - DNA, 19 bp, Homo sapiens
cccaaggacagttcagaga

SEQ ID NO: 6727998 - DNA, 20 bp, Homo sapiens
cccaaggacccagccctcgc

SEQ ID NO: 6727999 - DNA, 14 bp, Homo sapiens
cccaaggactctgg

SEQ ID NO: 6728000 - DNA, 15 bp, Homo sapiens
cccaaggactgaggg

SEQ ID NO: 6728001 - DNA, 21 bp, Homo sapiens
cccaaggactgagggactctg

SEQ ID NO: 6728002 - DNA, 16 bp, Homo sapiens
cccaaggactgagggc

SEQ ID NO: 6728003 - DNA, 20 bp, Homo sapiens
cccaaggactgagggcagtg

SEQ ID NO: 6728004 - DNA, 23 bp, Homo sapiens
cccaaggactgagggcagtgccc

SEQ ID NO: 6728005 - DNA, 17 bp, Homo sapiens
cccaaggacttccacat

SEQ ID NO: 6728006 - DNA, 20 bp, Homo sapiens
cccaaggacttccacatttt

SEQ ID NO: 6728007 - DNA, 12 bp, Homo sapiens
cccaaggagaac

SEQ ID NO: 6728008 - DNA, 22 bp, Homo sapiens
cccaaggagcacaggtcccacc

SEQ ID NO: 6728009 - DNA, 14 bp, Homo sapiens
cccaaggagctgat

SEQ ID NO: 6728010 - DNA, 12 bp, Homo sapiens
cccaaggaggaa

SEQ ID NO: 6728011 - DNA, 15 bp, Homo sapiens
cccaaggaggaaaaa

SEQ ID NO: 6728012 - DNA, 20 bp, Homo sapiens
cccaaggagggtccaggcgg

SEQ ID NO: 6728013 - DNA, 19 bp, Homo sapiens
cccaaggatttttaaaact

SEQ ID NO: 6728014 - DNA, 13 bp, Homo sapiens
cccaaggcagctg

SEQ ID NO: 6728015 - DNA, 20 bp, Homo sapiens
cccaaggcagtgttcctcac

SEQ ID NO: 6728016 - DNA, 17 bp, Homo sapiens
cccaaggcattctccca

SEQ ID NO: 6728017 - DNA, 18 bp, Homo sapiens
cccaaggcattctcccag

SEQ ID NO: 6728018 - DNA, 18 bp, Homo sapiens
cccaaggcattgattgca

SEQ ID NO: 6728019 - DNA, 15 bp, Homo sapiens
cccaaggccagtctg

SEQ ID NO: 6728020 - DNA, 19 bp, Homo sapiens
cccaaggccccagggacag

SEQ ID NO: 6728021 - DNA, 21 bp, Homo sapiens
cccaaggccccagggacagag

SEQ ID NO: 6728022 - DNA, 22 bp, Homo sapiens
cccaaggccccctgcctgccct

SEQ ID NO: 6728023 - DNA, 21 bp, Homo sapiens
cccaaggcctaccccagttcc

SEQ ID NO: 6728024 - DNA, 21 bp, Homo sapiens
cccaaggcctctcaccccact

SEQ ID NO: 6728025 - DNA, 22 bp, Homo sapiens
cccaaggcctctctctgcctga

SEQ ID NO: 6728026 - DNA, 23 bp, Homo sapiens
cccaaggccttcccctggcactg

SEQ ID NO: 6728027 - DNA, 15 bp, Homo sapiens
cccaaggcggcccct

SEQ ID NO: 6728028 - DNA, 22 bp, Homo sapiens
cccaaggcgtccgcgcgccagc

SEQ ID NO: 6728029 - DNA, 17 bp, Homo sapiens
cccaaggctcactgcag

SEQ ID NO: 6728030 - DNA, 19 bp, Homo sapiens
cccaaggctcactgcagcg

SEQ ID NO: 6728031 - DNA, 19 bp, Homo sapiens
cccaaggctgcgtctggag

SEQ ID NO: 6728032 - DNA, 20 bp, Homo sapiens
cccaaggctgcgtctggagg

SEQ ID NO: 6728033 - DNA, 17 bp, Homo sapiens
cccaagggaaagaaaag

SEQ ID NO: 6728034 - DNA, 13 bp, Homo sapiens
cccaagggatctg

SEQ ID NO: 6728035 - DNA, 23 bp, Homo sapiens
cccaagggatctggtcctaccca

SEQ ID NO: 6728036 - DNA, 18 bp, Homo sapiens
cccaagggatggcaccac

SEQ ID NO: 6728037 - DNA, 14 bp, Homo sapiens
cccaagggccctgg

SEQ ID NO: 6728038 - DNA, 16 bp, Homo sapiens
cccaagggcctcccac

SEQ ID NO: 6728039 - DNA, 19 bp, Homo sapiens
cccaagggcctcccaccag

SEQ ID NO: 6728040 - DNA, 16 bp, Homo sapiens
cccaagggcctggcct

SEQ ID NO: 6728041 - DNA, 20 bp, Homo sapiens
cccaaggggacttgtgccag

SEQ ID NO: 6728042 - DNA, 18 bp, Homo sapiens
cccaagggttattagaaa

SEQ ID NO: 6728043 - DNA, 17 bp, Homo sapiens
cccaaggtaccatccta

SEQ ID NO: 6728044 - DNA, 23 bp, Homo sapiens
cccaaggtgaaatgaagcaacag

SEQ ID NO: 6728045 - DNA, 23 bp, Homo sapiens
cccaaggtgaggtgaactccagg

SEQ ID NO: 6728046 - DNA, 13 bp, Homo sapiens
cccaaggttccag

SEQ ID NO: 6728047 - DNA, 22 bp, Homo sapiens
cccaaggttctgggtgcaggag

SEQ ID NO: 6728048 - DNA, 15 bp, Homo sapiens
cccaaggttgcacag

SEQ ID NO: 6728049 - DNA, 17 bp, Homo sapiens
cccaaggttgcacagca

SEQ ID NO: 6728050 - DNA, 19 bp, Homo sapiens
cccaaggttggagcccagg

SEQ ID NO: 6728051 - DNA, 20 bp, Homo sapiens
cccaagtaagaggctggagt

SEQ ID NO: 6728052 - DNA, 22 bp, Homo sapiens
cccaagtagctgctaccttctt

SEQ ID NO: 6728053 - DNA, 15 bp, Homo sapiens
cccaagtagctggga

SEQ ID NO: 6728054 - DNA, 14 bp, Homo sapiens
cccaagtcacacag

SEQ ID NO: 6728055 - DNA, 21 bp, Homo sapiens
cccaagtcacacccactccct

SEQ ID NO: 6728056 - DNA, 22 bp, Homo sapiens
cccaagtcagacagatgtcagc

SEQ ID NO: 6728057 - DNA, 16 bp, Homo sapiens
cccaagtcattcctaa

SEQ ID NO: 6728058 - DNA, 17 bp, Homo sapiens
cccaagtcattcctaat

SEQ ID NO: 6728059 - DNA, 14 bp, Homo sapiens
cccaagtcatttcc

SEQ ID NO: 6728060 - DNA, 22 bp, Homo sapiens
cccaagtcatttccgtcccccc

SEQ ID NO: 6728061 - DNA, 20 bp, Homo sapiens
cccaagtccaaatgtttaca

SEQ ID NO: 6728062 - DNA, 16 bp, Homo sapiens
cccaagtcctcgcccc

SEQ ID NO: 6728063 - DNA, 21 bp, Homo sapiens
cccaagtcctcgccccccgcc

SEQ ID NO: 6728064 - DNA, 14 bp, Homo sapiens
cccaagtgaccagg

SEQ ID NO: 6728065 - DNA, 19 bp, Homo sapiens
cccaagtgaccagggaagt

SEQ ID NO: 6728066 - DNA, 17 bp, Homo sapiens
cccaagtgccatcccac

SEQ ID NO: 6728067 - DNA, 13 bp, Homo sapiens
cccaagtgcctca

SEQ ID NO: 6728068 - DNA, 13 bp, Homo sapiens
cccaagtgcctgc

SEQ ID NO: 6728069 - DNA, 18 bp, Homo sapiens
cccaagtggcccccaccc

SEQ ID NO: 6728070 - DNA, 16 bp, Homo sapiens
cccaagtggctcttgg

SEQ ID NO: 6728071 - DNA, 18 bp, Homo sapiens
cccaagtggctcttggga

SEQ ID NO: 6728072 - DNA, 17 bp, Homo sapiens
cccaagtgggcagtcac

SEQ ID NO: 6728073 - DNA, 18 bp, Homo sapiens
cccaagtggtgaatgaca

SEQ ID NO: 6728074 - DNA, 20 bp, Homo sapiens
cccaagtggtttccacatgc

SEQ ID NO: 6728075 - DNA, 24 bp, Homo sapiens
cccaagtggtttccacatgctctg

SEQ ID NO: 6728076 - DNA, 16 bp, Homo sapiens
cccaagtgtgaacaaa

SEQ ID NO: 6728077 - DNA, 16 bp, Homo sapiens
cccaagttagttcaat

SEQ ID NO: 6728078 - DNA, 21 bp, Homo sapiens
cccaagttctaggccccccag

SEQ ID NO: 6728079 - DNA, 21 bp, Homo sapiens
cccaagttggaagggacccca

SEQ ID NO: 6728080 - DNA, 12 bp, Homo sapiens
cccaataaaagt

SEQ ID NO: 6728081 - DNA, 19 bp, Homo sapiens
cccaataaaagtgactctc

SEQ ID NO: 6728082 - DNA, 13 bp, Homo sapiens
cccaataaaccag

SEQ ID NO: 6728083 - DNA, 15 bp, Homo sapiens
cccaataaaccagtg

SEQ ID NO: 6728084 - DNA, 23 bp, Homo sapiens
cccaataaagcgaatggaccatc

SEQ ID NO: 6728085 - DNA, 13 bp, Homo sapiens
cccaataaaggca

SEQ ID NO: 6728086 - DNA, 14 bp, Homo sapiens
cccaataaaggcag

SEQ ID NO: 6728087 - DNA, 16 bp, Homo sapiens
cccaataaaggcagct

SEQ ID NO: 6728088 - DNA, 17 bp, Homo sapiens
cccaataaaggcagctg

SEQ ID NO: 6728089 - DNA, 23 bp, Homo sapiens
cccaataaaggcagctgcctctg

SEQ ID NO: 6728090 - DNA, 13 bp, Homo sapiens
cccaataaaggtc

SEQ ID NO: 6728091 - DNA, 18 bp, Homo sapiens
cccaataaagtcctcttc

SEQ ID NO: 6728092 - DNA, 19 bp, Homo sapiens
cccaataagatacatcaca

SEQ ID NO: 6728093 - DNA, 16 bp, Homo sapiens
cccaataccccatgga

SEQ ID NO: 6728094 - DNA, 17 bp, Homo sapiens
cccaataccccatggac

SEQ ID NO: 6728095 - DNA, 19 bp, Homo sapiens
cccaatagctagtgacagc

SEQ ID NO: 6728096 - DNA, 15 bp, Homo sapiens
cccaatagctctact

SEQ ID NO: 6728097 - DNA, 16 bp, Homo sapiens
cccaatagctctactg

SEQ ID NO: 6728098 - DNA, 22 bp, Homo sapiens
cccaatatcctcgctcccggga

SEQ ID NO: 6728099 - DNA, 17 bp, Homo sapiens
cccaatattataatttt

SEQ ID NO: 6728100 - DNA, 12 bp, Homo sapiens
cccaatattgag

SEQ ID NO: 6728101 - DNA, 15 bp, Homo sapiens
cccaatcaaagaatt

SEQ ID NO: 6728102 - DNA, 12 bp, Homo sapiens
cccaatcacccc

SEQ ID NO: 6728103 - DNA, 23 bp, Homo sapiens
cccaatcacgagatcttccttcc

SEQ ID NO: 6728104 - DNA, 15 bp, Homo sapiens
cccaatcagcactga

SEQ ID NO: 6728105 - DNA, 20 bp, Homo sapiens
cccaatcagcttttgttcta

SEQ ID NO: 6728106 - DNA, 21 bp, Homo sapiens
cccaatcagcttttgttctag

SEQ ID NO: 6728107 - DNA, 13 bp, Homo sapiens
cccaatcatttgc

SEQ ID NO: 6728108 - DNA, 22 bp, Homo sapiens
cccaatccaacccatgcatggc

SEQ ID NO: 6728109 - DNA, 18 bp, Homo sapiens
cccaatccatttggcaga

SEQ ID NO: 6728110 - DNA, 19 bp, Homo sapiens
cccaatccatttggcagaa

SEQ ID NO: 6728111 - DNA, 23 bp, Homo sapiens
cccaatcccagctacctcaacca

SEQ ID NO: 6728112 - DNA, 14 bp, Homo sapiens
cccaatcccagttc

SEQ ID NO: 6728113 - DNA, 16 bp, Homo sapiens
cccaatcccagttctt

SEQ ID NO: 6728114 - DNA, 22 bp, Homo sapiens
cccaatcccagttcttcctgca

SEQ ID NO: 6728115 - DNA, 17 bp, Homo sapiens
cccaatccctgccactg

SEQ ID NO: 6728116 - DNA, 22 bp, Homo sapiens
cccaatccctgccactgggctc

SEQ ID NO: 6728117 - DNA, 17 bp, Homo sapiens
cccaatcctcccagaaa

SEQ ID NO: 6728118 - DNA, 14 bp, Homo sapiens
cccaatcctccctg

SEQ ID NO: 6728119 - DNA, 15 bp, Homo sapiens
cccaatcctccctgg

SEQ ID NO: 6728120 - DNA, 12 bp, Homo sapiens
cccaatcctctc

SEQ ID NO: 6728121 - DNA, 15 bp, Homo sapiens
cccaatcctctctcc

SEQ ID NO: 6728122 - DNA, 16 bp, Homo sapiens
cccaatcggactgcca

SEQ ID NO: 6728123 - DNA, 19 bp, Homo sapiens
cccaatcggactgccaaat

SEQ ID NO: 6728124 - DNA, 19 bp, Homo sapiens
cccaatcgggtccagagac

SEQ ID NO: 6728125 - DNA, 12 bp, Homo sapiens
cccaatctggct

SEQ ID NO: 6728126 - DNA, 14 bp, Homo sapiens
cccaatctggctgg

SEQ ID NO: 6728127 - DNA, 20 bp, Homo sapiens
cccaatcttaccagatgcta

SEQ ID NO: 6728128 - DNA, 16 bp, Homo sapiens
cccaatcttctttttc

SEQ ID NO: 6728129 - DNA, 17 bp, Homo sapiens
cccaatcttgacacggt

SEQ ID NO: 6728130 - DNA, 12 bp, Homo sapiens
cccaatcttgcc

SEQ ID NO: 6728131 - DNA, 20 bp, Homo sapiens
cccaatcttgcccactggcc

SEQ ID NO: 6728132 - DNA, 23 bp, Homo sapiens
cccaatctttctatataaaatgt

SEQ ID NO: 6728133 - DNA, 12 bp, Homo sapiens
cccaatgaatta

SEQ ID NO: 6728134 - DNA, 18 bp, Homo sapiens
cccaatgacacccatgcc

SEQ ID NO: 6728135 - DNA, 17 bp, Homo sapiens
cccaatgagacttgcct

SEQ ID NO: 6728136 - DNA, 19 bp, Homo sapiens
cccaatgagacttgccttc

SEQ ID NO: 6728137 - DNA, 17 bp, Homo sapiens
cccaatgaggtggctca

SEQ ID NO: 6728138 - DNA, 16 bp, Homo sapiens
cccaatgcacatccat

SEQ ID NO: 6728139 - DNA, 20 bp, Homo sapiens
cccaatgcactttgttctgg

SEQ ID NO: 6728140 - DNA, 19 bp, Homo sapiens
cccaatgcatagagccctg

SEQ ID NO: 6728141 - DNA, 20 bp, Homo sapiens
cccaatgcatagagccctgg

SEQ ID NO: 6728142 - DNA, 14 bp, Homo sapiens
cccaatgctcctgg

SEQ ID NO: 6728143 - DNA, 17 bp, Homo sapiens
cccaatgctcctggagg

SEQ ID NO: 6728144 - DNA, 12 bp, Homo sapiens
cccaatgctgct

SEQ ID NO: 6728145 - DNA, 21 bp, Homo sapiens
cccaatgctgctccaccctcc

SEQ ID NO: 6728146 - DNA, 19 bp, Homo sapiens
cccaatgctgtacctggct

SEQ ID NO: 6728147 - DNA, 13 bp, Homo sapiens
cccaatggtgctt

SEQ ID NO: 6728148 - DNA, 15 bp, Homo sapiens
cccaatggtgcttgg

SEQ ID NO: 6728149 - DNA, 17 bp, Homo sapiens
cccaatggtgtttttct

SEQ ID NO: 6728150 - DNA, 20 bp, Homo sapiens
cccaatgtatgtgtggctgt

SEQ ID NO: 6728151 - DNA, 19 bp, Homo sapiens
cccaatgtcaagtggcagc

SEQ ID NO: 6728152 - DNA, 19 bp, Homo sapiens
cccaatgtctcccacaccc

SEQ ID NO: 6728153 - DNA, 18 bp, Homo sapiens
cccaattaaacccagaac

SEQ ID NO: 6728154 - DNA, 19 bp, Homo sapiens
cccaattacagggtgactc

SEQ ID NO: 6728155 - DNA, 14 bp, Homo sapiens
cccaattagcttgg

SEQ ID NO: 6728156 - DNA, 15 bp, Homo sapiens
cccaattaggaagtg

SEQ ID NO: 6728157 - DNA, 19 bp, Homo sapiens
cccaattatcaaaaaacag

SEQ ID NO: 6728158 - DNA, 18 bp, Homo sapiens
cccaattcggggcctgct

SEQ ID NO: 6728159 - DNA, 14 bp, Homo sapiens
cccaattggaggaa

SEQ ID NO: 6728160 - DNA, 22 bp, Homo sapiens
cccaatttaagagtcctgaggc

SEQ ID NO: 6728161 - DNA, 11 bp, Homo sapiens
cccaatttccc

SEQ ID NO: 6728162 - DNA, 21 bp, Homo sapiens
cccaattttaaaaaataacat

SEQ ID NO: 6728163 - DNA, 22 bp, Homo sapiens
cccaattttaatctgaaaattt

SEQ ID NO: 6728164 - DNA, 18 bp, Homo sapiens
cccacaaaagacagaccc

SEQ ID NO: 6728165 - DNA, 19 bp, Homo sapiens
cccacaaaatatttctaag

SEQ ID NO: 6728166 - DNA, 15 bp, Homo sapiens
cccacaaactccagg

SEQ ID NO: 6728167 - DNA, 17 bp, Homo sapiens
cccacaaactccaggct

SEQ ID NO: 6728168 - DNA, 20 bp, Homo sapiens
cccacaaactgcctgttaag

SEQ ID NO: 6728169 - DNA, 14 bp, Homo sapiens
cccacaaaggggag

SEQ ID NO: 6728170 - DNA, 20 bp, Homo sapiens
cccacaaaggggagaagggc

SEQ ID NO: 6728171 - DNA, 23 bp, Homo sapiens
cccacaaaggggagaagggccag

SEQ ID NO: 6728172 - DNA, 20 bp, Homo sapiens
cccacaaataatgaacagca

SEQ ID NO: 6728173 - DNA, 22 bp, Homo sapiens
cccacaaataatgaacagcaga

SEQ ID NO: 6728174 - DNA, 21 bp, Homo sapiens
cccacaacacaagcaccccag

SEQ ID NO: 6728175 - DNA, 17 bp, Homo sapiens
cccacaaccctctggaa

SEQ ID NO: 6728176 - DNA, 22 bp, Homo sapiens
cccacaacgtcccctcaagccc

SEQ ID NO: 6728177 - DNA, 11 bp, Homo sapiens
cccacaagccc

SEQ ID NO: 6728178 - DNA, 14 bp, Homo sapiens
cccacaagcctgcc

SEQ ID NO: 6728179 - DNA, 17 bp, Homo sapiens
cccacaagctgtccctg

SEQ ID NO: 6728180 - DNA, 20 bp, Homo sapiens
cccacaagctgtccctgcag

SEQ ID NO: 6728181 - DNA, 21 bp, Homo sapiens
cccacaagctgtccctgcagg

SEQ ID NO: 6728182 - DNA, 22 bp, Homo sapiens
cccacaagctgtccctgcaggg

SEQ ID NO: 6728183 - DNA, 21 bp, Homo sapiens
cccacaaggcccagccctggg

SEQ ID NO: 6728184 - DNA, 12 bp, Homo sapiens
cccacaaggcct

SEQ ID NO: 6728185 - DNA, 18 bp, Homo sapiens
cccacaaggcctggtctg

SEQ ID NO: 6728186 - DNA, 21 bp, Homo sapiens
cccacaagtgccctccaggct

SEQ ID NO: 6728187 - DNA, 22 bp, Homo sapiens
cccacaagtggtggtaaccctg

SEQ ID NO: 6728188 - DNA, 18 bp, Homo sapiens
cccacaataatgaataat

SEQ ID NO: 6728189 - DNA, 20 bp, Homo sapiens
cccacaatcacaagaagatt

SEQ ID NO: 6728190 - DNA, 22 bp, Homo sapiens
cccacaatcttaaggggcagct

SEQ ID NO: 6728191 - DNA, 14 bp, Homo sapiens
cccacaatgccaga

SEQ ID NO: 6728192 - DNA, 14 bp, Homo sapiens
cccacaatggctgg

SEQ ID NO: 6728193 - DNA, 22 bp, Homo sapiens
cccacaattaaaccgcatgtga

SEQ ID NO: 6728194 - DNA, 11 bp, Homo sapiens
cccacacacac

SEQ ID NO: 6728195 - DNA, 18 bp, Homo sapiens
cccacacacacacacatg

SEQ ID NO: 6728196 - DNA, 14 bp, Homo sapiens
cccacacacactcc

SEQ ID NO: 6728197 - DNA, 13 bp, Homo sapiens
cccacacacagat

SEQ ID NO: 6728198 - DNA, 20 bp, Homo sapiens
cccacacacaggccttctgt

SEQ ID NO: 6728199 - DNA, 13 bp, Homo sapiens
cccacacacaggt

SEQ ID NO: 6728200 - DNA, 15 bp, Homo sapiens
cccacacacaggtgg

SEQ ID NO: 6728201 - DNA, 14 bp, Homo sapiens
cccacacaccccaa

SEQ ID NO: 6728202 - DNA, 16 bp, Homo sapiens
cccacacagctgccct

SEQ ID NO: 6728203 - DNA, 22 bp, Homo sapiens
cccacacagctgccctagctga

SEQ ID NO: 6728204 - DNA, 16 bp, Homo sapiens
cccacacaggcctggc

SEQ ID NO: 6728205 - DNA, 21 bp, Homo sapiens
cccacacaggtggccatcaca

SEQ ID NO: 6728206 - DNA, 18 bp, Homo sapiens
cccacacattccagggct

SEQ ID NO: 6728207 - DNA, 19 bp, Homo sapiens
cccacacattccagggctg

SEQ ID NO: 6728208 - DNA, 20 bp, Homo sapiens
cccacacattccagggctgg

SEQ ID NO: 6728209 - DNA, 13 bp, Homo sapiens
cccacaccagcct

SEQ ID NO: 6728210 - DNA, 14 bp, Homo sapiens
cccacaccagcctt

SEQ ID NO: 6728211 - DNA, 21 bp, Homo sapiens
cccacaccataagctactgcc

SEQ ID NO: 6728212 - DNA, 20 bp, Homo sapiens
cccacaccatctggcccagg

SEQ ID NO: 6728213 - DNA, 14 bp, Homo sapiens
cccacacccacctc

SEQ ID NO: 6728214 - DNA, 13 bp, Homo sapiens
cccacacccagcc

SEQ ID NO: 6728215 - DNA, 23 bp, Homo sapiens
cccacacccagccagctcctttc

SEQ ID NO: 6728216 - DNA, 14 bp, Homo sapiens
cccacaccccagcc

SEQ ID NO: 6728217 - DNA, 17 bp, Homo sapiens
cccacaccccagcccac

SEQ ID NO: 6728218 - DNA, 15 bp, Homo sapiens
cccacaccccgtctg

SEQ ID NO: 6728219 - DNA, 14 bp, Homo sapiens
cccacacccctcca

SEQ ID NO: 6728220 - DNA, 19 bp, Homo sapiens
cccacaccctacagcagat

SEQ ID NO: 6728221 - DNA, 12 bp, Homo sapiens
cccacaccctcg

SEQ ID NO: 6728222 - DNA, 12 bp, Homo sapiens
cccacaccctgg

SEQ ID NO: 6728223 - DNA, 13 bp, Homo sapiens
cccacaccgctgg

SEQ ID NO: 6728224 - DNA, 15 bp, Homo sapiens
cccacaccgctggtc

SEQ ID NO: 6728225 - DNA, 17 bp, Homo sapiens
cccacaccgctggtccc

SEQ ID NO: 6728226 - DNA, 22 bp, Homo sapiens
cccacaccgctggtccctgccc

SEQ ID NO: 6728227 - DNA, 20 bp, Homo sapiens
cccacaccgtcttccttcag

SEQ ID NO: 6728228 - DNA, 15 bp, Homo sapiens
cccacacctccacag

SEQ ID NO: 6728229 - DNA, 18 bp, Homo sapiens
cccacacctccctactcc

SEQ ID NO: 6728230 - DNA, 14 bp, Homo sapiens
cccacacctcctct

SEQ ID NO: 6728231 - DNA, 19 bp, Homo sapiens
cccacacctgcagtgccag

SEQ ID NO: 6728232 - DNA, 14 bp, Homo sapiens
cccacacctgcctc

SEQ ID NO: 6728233 - DNA, 12 bp, Homo sapiens
cccacacctggc

SEQ ID NO: 6728234 - DNA, 19 bp, Homo sapiens
cccacacctggccctgggg

SEQ ID NO: 6728235 - DNA, 13 bp, Homo sapiens
cccacacctggtg

SEQ ID NO: 6728236 - DNA, 22 bp, Homo sapiens
cccacaccttccagggccctag

SEQ ID NO: 6728237 - DNA, 20 bp, Homo sapiens
cccacacgattagctttatt

SEQ ID NO: 6728238 - DNA, 16 bp, Homo sapiens
cccacacgccggggct

SEQ ID NO: 6728239 - DNA, 17 bp, Homo sapiens
cccacacgccggggctg

SEQ ID NO: 6728240 - DNA, 20 bp, Homo sapiens
cccacacgccggggctggcc

SEQ ID NO: 6728241 - DNA, 15 bp, Homo sapiens
cccacacggcagccc

SEQ ID NO: 6728242 - DNA, 16 bp, Homo sapiens
cccacacggcagcccc

SEQ ID NO: 6728243 - DNA, 13 bp, Homo sapiens
cccacacgtgctc

SEQ ID NO: 6728244 - DNA, 16 bp, Homo sapiens
cccacactcactcctg

SEQ ID NO: 6728245 - DNA, 20 bp, Homo sapiens
cccacactccccgccttaga

SEQ ID NO: 6728246 - DNA, 11 bp, Homo sapiens
cccacactcct

SEQ ID NO: 6728247 - DNA, 13 bp, Homo sapiens
cccacactgaggc

SEQ ID NO: 6728248 - DNA, 15 bp, Homo sapiens
cccacactgctacac

SEQ ID NO: 6728249 - DNA, 19 bp, Homo sapiens
cccacactgtgcagaccca

SEQ ID NO: 6728250 - DNA, 21 bp, Homo sapiens
cccacacttgcagagctgctg

SEQ ID NO: 6728251 - DNA, 17 bp, Homo sapiens
cccacacttgtgccagc

SEQ ID NO: 6728252 - DNA, 21 bp, Homo sapiens
cccacagaaagactgagctca

SEQ ID NO: 6728253 - DNA, 13 bp, Homo sapiens
cccacagaaagag

SEQ ID NO: 6728254 - DNA, 13 bp, Homo sapiens
cccacagaacctt

SEQ ID NO: 6728255 - DNA, 12 bp, Homo sapiens
cccacagaactg

SEQ ID NO: 6728256 - DNA, 15 bp, Homo sapiens
cccacagaactgctt

SEQ ID NO: 6728257 - DNA, 23 bp, Homo sapiens
cccacagacaaaagcgcttttcc

SEQ ID NO: 6728258 - DNA, 18 bp, Homo sapiens
cccacagacagatcccat

SEQ ID NO: 6728259 - DNA, 17 bp, Homo sapiens
cccacagacctgcagtg

SEQ ID NO: 6728260 - DNA, 13 bp, Homo sapiens
cccacagagcctg

SEQ ID NO: 6728261 - DNA, 16 bp, Homo sapiens
cccacagagcctgaat

SEQ ID NO: 6728262 - DNA, 15 bp, Homo sapiens
cccacagagcctggc

SEQ ID NO: 6728263 - DNA, 19 bp, Homo sapiens
cccacagaggtgctgtaga

SEQ ID NO: 6728264 - DNA, 19 bp, Homo sapiens
cccacagagtgctggactg

SEQ ID NO: 6728265 - DNA, 19 bp, Homo sapiens
cccacagcacagctccctg

SEQ ID NO: 6728266 - DNA, 22 bp, Homo sapiens
cccacagcacagctccctgcca

SEQ ID NO: 6728267 - DNA, 19 bp, Homo sapiens
cccacagcacccaggctcc

SEQ ID NO: 6728268 - DNA, 12 bp, Homo sapiens
cccacagcaggc

SEQ ID NO: 6728269 - DNA, 11 bp, Homo sapiens
cccacagccca

SEQ ID NO: 6728270 - DNA, 18 bp, Homo sapiens
cccacagcccacgtcctg

SEQ ID NO: 6728271 - DNA, 19 bp, Homo sapiens
cccacagcccacgtcctgt

SEQ ID NO: 6728272 - DNA, 16 bp, Homo sapiens
cccacagccccatctg

SEQ ID NO: 6728273 - DNA, 16 bp, Homo sapiens
cccacagcccccaccc

SEQ ID NO: 6728274 - DNA, 14 bp, Homo sapiens
cccacagcccgcat

SEQ ID NO: 6728275 - DNA, 11 bp, Homo sapiens
cccacagccct

SEQ ID NO: 6728276 - DNA, 12 bp, Homo sapiens
cccacagccctg

SEQ ID NO: 6728277 - DNA, 12 bp, Homo sapiens
cccacagcctcc

SEQ ID NO: 6728278 - DNA, 14 bp, Homo sapiens
cccacagcctctgc

SEQ ID NO: 6728279 - DNA, 20 bp, Homo sapiens
cccacagcctttgcttccag

SEQ ID NO: 6728280 - DNA, 19 bp, Homo sapiens
cccacagcgagcctgtgcc

SEQ ID NO: 6728281 - DNA, 19 bp, Homo sapiens
cccacagctacctgagacg

SEQ ID NO: 6728282 - DNA, 17 bp, Homo sapiens
cccacagctcagctgcc

SEQ ID NO: 6728283 - DNA, 17 bp, Homo sapiens
cccacagctccaggaca

SEQ ID NO: 6728284 - DNA, 15 bp, Homo sapiens
cccacagctcccacc

SEQ ID NO: 6728285 - DNA, 17 bp, Homo sapiens
cccacagctcccacccc

SEQ ID NO: 6728286 - DNA, 19 bp, Homo sapiens
cccacagctcccaccccac

SEQ ID NO: 6728287 - DNA, 16 bp, Homo sapiens
cccacagctccttgca

SEQ ID NO: 6728288 - DNA, 20 bp, Homo sapiens
cccacagctctgctggaaga

SEQ ID NO: 6728289 - DNA, 15 bp, Homo sapiens
cccacagcttcctga

SEQ ID NO: 6728290 - DNA, 19 bp, Homo sapiens
cccacagcttcctgagggc

SEQ ID NO: 6728291 - DNA, 19 bp, Homo sapiens
cccacaggacatttctcta

SEQ ID NO: 6728292 - DNA, 20 bp, Homo sapiens
cccacaggacatttctctaa

SEQ ID NO: 6728293 - DNA, 17 bp, Homo sapiens
cccacaggagcatgtcc

SEQ ID NO: 6728294 - DNA, 17 bp, Homo sapiens
cccacaggagcgtgtcc

SEQ ID NO: 6728295 - DNA, 19 bp, Homo sapiens
cccacaggagctccctttt

SEQ ID NO: 6728296 - DNA, 16 bp, Homo sapiens
cccacaggaggcaagc

SEQ ID NO: 6728297 - DNA, 17 bp, Homo sapiens
cccacaggagggccagc

SEQ ID NO: 6728298 - DNA, 16 bp, Homo sapiens
cccacaggaggtggtc

SEQ ID NO: 6728299 - DNA, 16 bp, Homo sapiens
cccacaggcccttcct

SEQ ID NO: 6728300 - DNA, 15 bp, Homo sapiens
cccacaggcctgttc

SEQ ID NO: 6728301 - DNA, 19 bp, Homo sapiens
cccacaggctgtgtacttt

SEQ ID NO: 6728302 - DNA, 13 bp, Homo sapiens
cccacagggcctg

SEQ ID NO: 6728303 - DNA, 18 bp, Homo sapiens
cccacagggcctgacttt

SEQ ID NO: 6728304 - DNA, 22 bp, Homo sapiens
cccacaggggccatgtcctctc

SEQ ID NO: 6728305 - DNA, 21 bp, Homo sapiens
cccacaggtcttcactgccca

SEQ ID NO: 6728306 - DNA, 23 bp, Homo sapiens
cccacaggtcttcactgcccagg

SEQ ID NO: 6728307 - DNA, 13 bp, Homo sapiens
cccacaggtgagg

SEQ ID NO: 6728308 - DNA, 22 bp, Homo sapiens
cccacaggtgtccccagcccac

SEQ ID NO: 6728309 - DNA, 20 bp, Homo sapiens
cccacagtagaggggtctca

SEQ ID NO: 6728310 - DNA, 20 bp, Homo sapiens
cccacagtcacacagagcgc

SEQ ID NO: 6728311 - DNA, 22 bp, Homo sapiens
cccacagtcctcacagcctctc

SEQ ID NO: 6728312 - DNA, 22 bp, Homo sapiens
cccacagtgactcgggctcctg

SEQ ID NO: 6728313 - DNA, 23 bp, Homo sapiens
cccacagtgactcgggctcctgt

SEQ ID NO: 6728314 - DNA, 20 bp, Homo sapiens
cccacagtgagaggggaggg

SEQ ID NO: 6728315 - DNA, 21 bp, Homo sapiens
cccacagtgagaggggagggc

SEQ ID NO: 6728316 - DNA, 14 bp, Homo sapiens
cccacagtgccacc

SEQ ID NO: 6728317 - DNA, 22 bp, Homo sapiens
cccacagtgctcagttgtactt

SEQ ID NO: 6728318 - DNA, 20 bp, Homo sapiens
cccacagtggagagggctac

SEQ ID NO: 6728319 - DNA, 22 bp, Homo sapiens
cccacagttgtgttcatgctga

SEQ ID NO: 6728320 - DNA, 13 bp, Homo sapiens
cccacataaacac

SEQ ID NO: 6728321 - DNA, 14 bp, Homo sapiens
cccacataaacact

SEQ ID NO: 6728322 - DNA, 19 bp, Homo sapiens
cccacatagtgatggttcc

SEQ ID NO: 6728323 - DNA, 23 bp, Homo sapiens
cccacatcagggcggcctcccag

SEQ ID NO: 6728324 - DNA, 18 bp, Homo sapiens
cccacatccaactccagc

SEQ ID NO: 6728325 - DNA, 19 bp, Homo sapiens
cccacatccaactccagca

SEQ ID NO: 6728326 - DNA, 19 bp, Homo sapiens
cccacatcccactggatct

SEQ ID NO: 6728327 - DNA, 14 bp, Homo sapiens
cccacatcccaggc

SEQ ID NO: 6728328 - DNA, 17 bp, Homo sapiens
cccacatcccatcgtct

SEQ ID NO: 6728329 - DNA, 14 bp, Homo sapiens
cccacatccccaat

SEQ ID NO: 6728330 - DNA, 14 bp, Homo sapiens
cccacatccctggg

SEQ ID NO: 6728331 - DNA, 17 bp, Homo sapiens
cccacatccctgggcct

SEQ ID NO: 6728332 - DNA, 21 bp, Homo sapiens
cccacatccctgggcctgctg

SEQ ID NO: 6728333 - DNA, 22 bp, Homo sapiens
cccacatccggggccagctccg

SEQ ID NO: 6728334 - DNA, 16 bp, Homo sapiens
cccacatcgcacactg

SEQ ID NO: 6728335 - DNA, 18 bp, Homo sapiens
cccacatcgggctcacct

SEQ ID NO: 6728336 - DNA, 16 bp, Homo sapiens
cccacatctttcctca

SEQ ID NO: 6728337 - DNA, 22 bp, Homo sapiens
cccacatgaggccatctcagga

SEQ ID NO: 6728338 - DNA, 23 bp, Homo sapiens
cccacatgaggccatctcaggag

SEQ ID NO: 6728339 - DNA, 18 bp, Homo sapiens
cccacatgcatgtctgcc

SEQ ID NO: 6728340 - DNA, 18 bp, Homo sapiens
cccacatgccaggggcct

SEQ ID NO: 6728341 - DNA, 13 bp, Homo sapiens
cccacatgcctgc

SEQ ID NO: 6728342 - DNA, 15 bp, Homo sapiens
cccacatggccgggc

SEQ ID NO: 6728343 - DNA, 19 bp, Homo sapiens
cccacatggtgatgttgac

SEQ ID NO: 6728344 - DNA, 15 bp, Homo sapiens
cccacatgtccagca

SEQ ID NO: 6728345 - DNA, 14 bp, Homo sapiens
cccacattaaagaa

SEQ ID NO: 6728346 - DNA, 21 bp, Homo sapiens
cccacattccaaaagggggcc

SEQ ID NO: 6728347 - DNA, 18 bp, Homo sapiens
cccacattctgatgagca

SEQ ID NO: 6728348 - DNA, 15 bp, Homo sapiens
cccacattctggctc

SEQ ID NO: 6728349 - DNA, 20 bp, Homo sapiens
cccacattgcccacacctgc

SEQ ID NO: 6728350 - DNA, 22 bp, Homo sapiens
cccacattggaagagcagcacc

SEQ ID NO: 6728351 - DNA, 19 bp, Homo sapiens
cccacatttacctcgaggc

SEQ ID NO: 6728352 - DNA, 13 bp, Homo sapiens
cccacatttgatg

SEQ ID NO: 6728353 - DNA, 19 bp, Homo sapiens
cccacatttgggctcaggg

SEQ ID NO: 6728354 - DNA, 22 bp, Homo sapiens
cccaccaaatgcctctgccttg

SEQ ID NO: 6728355 - DNA, 21 bp, Homo sapiens
cccaccaacatcccattgccc

SEQ ID NO: 6728356 - DNA, 18 bp, Homo sapiens
cccaccaaccctcagggc

SEQ ID NO: 6728357 - DNA, 19 bp, Homo sapiens
cccaccaaccctcagggca

SEQ ID NO: 6728358 - DNA, 17 bp, Homo sapiens
cccaccaactctgcact

SEQ ID NO: 6728359 - DNA, 18 bp, Homo sapiens
cccaccaaggtctcacac

SEQ ID NO: 6728360 - DNA, 20 bp, Homo sapiens
cccaccacaactaacaatgc

SEQ ID NO: 6728361 - DNA, 15 bp, Homo sapiens
cccaccacacatccc

SEQ ID NO: 6728362 - DNA, 14 bp, Homo sapiens
cccaccacactgaa

SEQ ID NO: 6728363 - DNA, 18 bp, Homo sapiens
cccaccaccccagctgct

SEQ ID NO: 6728364 - DNA, 22 bp, Homo sapiens
cccaccacctaggccactcctc

SEQ ID NO: 6728365 - DNA, 22 bp, Homo sapiens
cccaccaccttggactcctccc

SEQ ID NO: 6728366 - DNA, 19 bp, Homo sapiens
cccaccacgatgtggccct

SEQ ID NO: 6728367 - DNA, 16 bp, Homo sapiens
cccaccacgcatgctc

SEQ ID NO: 6728368 - DNA, 14 bp, Homo sapiens
cccaccacggccac

SEQ ID NO: 6728369 - DNA, 20 bp, Homo sapiens
cccaccacggccactggcca

SEQ ID NO: 6728370 - DNA, 16 bp, Homo sapiens
cccaccacgtctggct

SEQ ID NO: 6728371 - DNA, 20 bp, Homo sapiens
cccaccacgtgctcaatcat

SEQ ID NO: 6728372 - DNA, 13 bp, Homo sapiens
cccaccactcagg

SEQ ID NO: 6728373 - DNA, 19 bp, Homo sapiens
cccaccactctcaggacca

SEQ ID NO: 6728374 - DNA, 16 bp, Homo sapiens
cccaccagacatcacc

SEQ ID NO: 6728375 - DNA, 21 bp, Homo sapiens
cccaccagacgtcaggccctg

SEQ ID NO: 6728376 - DNA, 12 bp, Homo sapiens
cccaccagagct

SEQ ID NO: 6728377 - DNA, 15 bp, Homo sapiens
cccaccagagctgcc

SEQ ID NO: 6728378 - DNA, 23 bp, Homo sapiens
cccaccagagctgcctccccaat

SEQ ID NO: 6728379 - DNA, 16 bp, Homo sapiens
cccaccagatgctgaa

SEQ ID NO: 6728380 - DNA, 13 bp, Homo sapiens
cccaccagcagaa

SEQ ID NO: 6728381 - DNA, 14 bp, Homo sapiens
cccaccagcagcac

SEQ ID NO: 6728382 - DNA, 17 bp, Homo sapiens
cccaccagcatgtcact

SEQ ID NO: 6728383 - DNA, 16 bp, Homo sapiens
cccaccagccagccct

SEQ ID NO: 6728384 - DNA, 22 bp, Homo sapiens
cccaccagccagccctggccca

SEQ ID NO: 6728385 - DNA, 16 bp, Homo sapiens
cccaccagcctaagaa

SEQ ID NO: 6728386 - DNA, 20 bp, Homo sapiens
cccaccagcctaagaagctc

SEQ ID NO: 6728387 - DNA, 12 bp, Homo sapiens
cccaccagcctt

SEQ ID NO: 6728388 - DNA, 13 bp, Homo sapiens
cccaccagccttg

SEQ ID NO: 6728389 - DNA, 14 bp, Homo sapiens
cccaccagccttgc

SEQ ID NO: 6728390 - DNA, 17 bp, Homo sapiens
cccaccagccttgctct

SEQ ID NO: 6728391 - DNA, 20 bp, Homo sapiens
cccaccagccttgctctctt

SEQ ID NO: 6728392 - DNA, 13 bp, Homo sapiens
cccaccagctcca

SEQ ID NO: 6728393 - DNA, 14 bp, Homo sapiens
cccaccagctccca

SEQ ID NO: 6728394 - DNA, 19 bp, Homo sapiens
cccaccagctgcagcccct

SEQ ID NO: 6728395 - DNA, 21 bp, Homo sapiens
cccaccagctggctctgcagc

SEQ ID NO: 6728396 - DNA, 13 bp, Homo sapiens
cccaccaggccag

SEQ ID NO: 6728397 - DNA, 20 bp, Homo sapiens
cccaccaggccagctcagga

SEQ ID NO: 6728398 - DNA, 22 bp, Homo sapiens
cccaccaggctgctcagggctg

SEQ ID NO: 6728399 - DNA, 21 bp, Homo sapiens
cccaccaggggaaggaaggag

SEQ ID NO: 6728400 - DNA, 20 bp, Homo sapiens
cccaccagtcagggacagca

SEQ ID NO: 6728401 - DNA, 11 bp, Homo sapiens
cccaccagtgc

SEQ ID NO: 6728402 - DNA, 13 bp, Homo sapiens
cccaccagtgcct

SEQ ID NO: 6728403 - DNA, 23 bp, Homo sapiens
cccaccagtgtagcatcttcctc

SEQ ID NO: 6728404 - DNA, 18 bp, Homo sapiens
cccaccagttgctgctgc

SEQ ID NO: 6728405 - DNA, 16 bp, Homo sapiens
cccaccatatgaattg

SEQ ID NO: 6728406 - DNA, 15 bp, Homo sapiens
cccaccatccttcca

SEQ ID NO: 6728407 - DNA, 19 bp, Homo sapiens
cccaccatccttccatcct

SEQ ID NO: 6728408 - DNA, 12 bp, Homo sapiens
cccaccatctgc

SEQ ID NO: 6728409 - DNA, 13 bp, Homo sapiens
cccaccatctgct

SEQ ID NO: 6728410 - DNA, 19 bp, Homo sapiens
cccaccatctgctgtcttt

SEQ ID NO: 6728411 - DNA, 21 bp, Homo sapiens
cccaccatgcagcccctgggc

SEQ ID NO: 6728412 - DNA, 20 bp, Homo sapiens
cccaccatggaccagcccat

SEQ ID NO: 6728413 - DNA, 13 bp, Homo sapiens
cccaccattccct

SEQ ID NO: 6728414 - DNA, 12 bp, Homo sapiens
cccaccattcct

SEQ ID NO: 6728415 - DNA, 16 bp, Homo sapiens
cccaccattctacctg

SEQ ID NO: 6728416 - DNA, 15 bp, Homo sapiens
cccacccaagcttgg

SEQ ID NO: 6728417 - DNA, 16 bp, Homo sapiens
cccacccaagcttggc

SEQ ID NO: 6728418 - DNA, 22 bp, Homo sapiens
cccacccaagcttggcagccga

SEQ ID NO: 6728419 - DNA, 14 bp, Homo sapiens
cccacccacacagc

SEQ ID NO: 6728420 - DNA, 13 bp, Homo sapiens
cccacccacaccc

SEQ ID NO: 6728421 - DNA, 14 bp, Homo sapiens
cccacccacatgtg

SEQ ID NO: 6728422 - DNA, 13 bp, Homo sapiens
cccacccaccacc

SEQ ID NO: 6728423 - DNA, 11 bp, Homo sapiens
cccacccaccc

SEQ ID NO: 6728424 - DNA, 14 bp, Homo sapiens
cccacccaccccac

SEQ ID NO: 6728425 - DNA, 16 bp, Homo sapiens
cccacccaccccacag

SEQ ID NO: 6728426 - DNA, 14 bp, Homo sapiens
cccacccaccccca

SEQ ID NO: 6728427 - DNA, 16 bp, Homo sapiens
cccacccacccccagg

SEQ ID NO: 6728428 - DNA, 14 bp, Homo sapiens
cccacccacccctc

SEQ ID NO: 6728429 - DNA, 14 bp, Homo sapiens
cccacccacccgcc

SEQ ID NO: 6728430 - DNA, 11 bp, Homo sapiens
cccacccacct

SEQ ID NO: 6728431 - DNA, 15 bp, Homo sapiens
cccacccacctcctg

SEQ ID NO: 6728432 - DNA, 16 bp, Homo sapiens
cccacccacctttgca

SEQ ID NO: 6728433 - DNA, 16 bp, Homo sapiens
cccacccacttctgca

SEQ ID NO: 6728434 - DNA, 13 bp, Homo sapiens
cccacccagaggt

SEQ ID NO: 6728435 - DNA, 16 bp, Homo sapiens
cccacccagaggtggc

SEQ ID NO: 6728436 - DNA, 22 bp, Homo sapiens
cccacccagaggtggccctccc

SEQ ID NO: 6728437 - DNA, 21 bp, Homo sapiens
cccacccagcacccagcaact

SEQ ID NO: 6728438 - DNA, 17 bp, Homo sapiens
cccacccagcagcgccc

SEQ ID NO: 6728439 - DNA, 15 bp, Homo sapiens
cccacccagctccag

SEQ ID NO: 6728440 - DNA, 16 bp, Homo sapiens
cccacccagctccagg

SEQ ID NO: 6728441 - DNA, 12 bp, Homo sapiens
cccacccaggaa

SEQ ID NO: 6728442 - DNA, 17 bp, Homo sapiens
cccacccaggccaggca

SEQ ID NO: 6728443 - DNA, 14 bp, Homo sapiens
cccacccagggagc

SEQ ID NO: 6728444 - DNA, 19 bp, Homo sapiens
cccacccagggcccggcac

SEQ ID NO: 6728445 - DNA, 13 bp, Homo sapiens
cccacccagtcca

SEQ ID NO: 6728446 - DNA, 20 bp, Homo sapiens
cccacccagtccatgctcca

SEQ ID NO: 6728447 - DNA, 20 bp, Homo sapiens
cccacccagtctctgctcca

SEQ ID NO: 6728448 - DNA, 16 bp, Homo sapiens
cccacccatcttcctg

SEQ ID NO: 6728449 - DNA, 13 bp, Homo sapiens
cccacccatgcca

SEQ ID NO: 6728450 - DNA, 14 bp, Homo sapiens
cccaccccaactct

SEQ ID NO: 6728451 - DNA, 17 bp, Homo sapiens
cccaccccaccccaccc

SEQ ID NO: 6728452 - DNA, 17 bp, Homo sapiens
cccaccccacccccacc

SEQ ID NO: 6728453 - DNA, 13 bp, Homo sapiens
cccaccccactca

SEQ ID NO: 6728454 - DNA, 14 bp, Homo sapiens
cccaccccactcca

SEQ ID NO: 6728455 - DNA, 20 bp, Homo sapiens
cccaccccactccagccctg

SEQ ID NO: 6728456 - DNA, 16 bp, Homo sapiens
cccaccccagaaatca

SEQ ID NO: 6728457 - DNA, 13 bp, Homo sapiens
cccaccccagcac

SEQ ID NO: 6728458 - DNA, 14 bp, Homo sapiens
cccaccccagcaca

SEQ ID NO: 6728459 - DNA, 19 bp, Homo sapiens
cccaccccagcacagccac

SEQ ID NO: 6728460 - DNA, 18 bp, Homo sapiens
cccaccccagcacagctc

SEQ ID NO: 6728461 - DNA, 21 bp, Homo sapiens
cccaccccagcacagctcctc

SEQ ID NO: 6728462 - DNA, 13 bp, Homo sapiens
cccaccccaggcc

SEQ ID NO: 6728463 - DNA, 14 bp, Homo sapiens
cccaccccaggctg

SEQ ID NO: 6728464 - DNA, 21 bp, Homo sapiens
cccaccccataagccctgaga

SEQ ID NO: 6728465 - DNA, 22 bp, Homo sapiens
cccaccccatccagccagaccc

SEQ ID NO: 6728466 - DNA, 13 bp, Homo sapiens
cccaccccatcct

SEQ ID NO: 6728467 - DNA, 14 bp, Homo sapiens
cccacccccaaccc

SEQ ID NO: 6728468 - DNA, 21 bp, Homo sapiens
cccacccccaacccccagagg

SEQ ID NO: 6728469 - DNA, 17 bp, Homo sapiens
cccacccccacccaagg

SEQ ID NO: 6728470 - DNA, 15 bp, Homo sapiens
cccacccccaccccc

SEQ ID NO: 6728471 - DNA, 18 bp, Homo sapiens
cccacccccagcagctca

SEQ ID NO: 6728472 - DNA, 16 bp, Homo sapiens
cccacccccagccccg

SEQ ID NO: 6728473 - DNA, 15 bp, Homo sapiens
cccacccccaggcct

SEQ ID NO: 6728474 - DNA, 16 bp, Homo sapiens
cccacccccaggcctc

SEQ ID NO: 6728475 - DNA, 17 bp, Homo sapiens
cccacccccaggcctcc

SEQ ID NO: 6728476 - DNA, 19 bp, Homo sapiens
cccacccccaggcctccta

SEQ ID NO: 6728477 - DNA, 20 bp, Homo sapiens
cccacccccaggcctcctag

SEQ ID NO: 6728478 - DNA, 22 bp, Homo sapiens
cccacccccctctctttctctg

SEQ ID NO: 6728479 - DNA, 20 bp, Homo sapiens
cccacccccgaccctgccct

SEQ ID NO: 6728480 - DNA, 17 bp, Homo sapiens
cccacccccgccatgca

SEQ ID NO: 6728481 - DNA, 21 bp, Homo sapiens
cccacccccgggtgcctgtga

SEQ ID NO: 6728482 - DNA, 12 bp, Homo sapiens
cccaccccctca

SEQ ID NO: 6728483 - DNA, 13 bp, Homo sapiens
cccaccccctcaa

SEQ ID NO: 6728484 - DNA, 19 bp, Homo sapiens
cccaccccctccccaaagc

SEQ ID NO: 6728485 - DNA, 13 bp, Homo sapiens
cccaccccctcct

SEQ ID NO: 6728486 - DNA, 14 bp, Homo sapiens
cccaccccctgccc

SEQ ID NO: 6728487 - DNA, 16 bp, Homo sapiens
cccaccccctgcctgg

SEQ ID NO: 6728488 - DNA, 17 bp, Homo sapiens
cccaccccctgcctggt

SEQ ID NO: 6728489 - DNA, 14 bp, Homo sapiens
cccaccccctgctg

SEQ ID NO: 6728490 - DNA, 15 bp, Homo sapiens
cccaccccctgggca

SEQ ID NO: 6728491 - DNA, 19 bp, Homo sapiens
cccacccccttcagtgccc

SEQ ID NO: 6728492 - DNA, 16 bp, Homo sapiens
cccaccccgccgttcc

SEQ ID NO: 6728493 - DNA, 21 bp, Homo sapiens
cccaccccgccgttccctgcg

SEQ ID NO: 6728494 - DNA, 15 bp, Homo sapiens
cccaccccgctctgc

SEQ ID NO: 6728495 - DNA, 13 bp, Homo sapiens
cccaccccgggga

SEQ ID NO: 6728496 - DNA, 22 bp, Homo sapiens
cccaccccgtccatggtgctaa

SEQ ID NO: 6728497 - DNA, 15 bp, Homo sapiens
cccaccccgtcctga

SEQ ID NO: 6728498 - DNA, 20 bp, Homo sapiens
cccacccctaagtgcccaaa

SEQ ID NO: 6728499 - DNA, 21 bp, Homo sapiens
cccacccctacagcctgcaca

SEQ ID NO: 6728500 - DNA, 12 bp, Homo sapiens
cccacccctcac

SEQ ID NO: 6728501 - DNA, 21 bp, Homo sapiens
cccacccctcactccccaggg

SEQ ID NO: 6728502 - DNA, 15 bp, Homo sapiens
cccacccctccatga

SEQ ID NO: 6728503 - DNA, 22 bp, Homo sapiens
cccacccctcctgggcccaggc

SEQ ID NO: 6728504 - DNA, 13 bp, Homo sapiens
cccacccctgccc

SEQ ID NO: 6728505 - DNA, 16 bp, Homo sapiens
cccacccctgccccca

SEQ ID NO: 6728506 - DNA, 21 bp, Homo sapiens
cccacccctgtacccagccac

SEQ ID NO: 6728507 - DNA, 13 bp, Homo sapiens
cccacccctgtgc

SEQ ID NO: 6728508 - DNA, 16 bp, Homo sapiens
cccacccctgtgctcc

SEQ ID NO: 6728509 - DNA, 21 bp, Homo sapiens
cccacccctgtgctccgtgcc

SEQ ID NO: 6728510 - DNA, 13 bp, Homo sapiens
cccaccccttccc

SEQ ID NO: 6728511 - DNA, 17 bp, Homo sapiens
cccaccccttccccact

SEQ ID NO: 6728512 - DNA, 13 bp, Homo sapiens
cccaccccttcct

SEQ ID NO: 6728513 - DNA, 18 bp, Homo sapiens
cccacccgacctggctgc

SEQ ID NO: 6728514 - DNA, 19 bp, Homo sapiens
cccacccggccacagctgc

SEQ ID NO: 6728515 - DNA, 16 bp, Homo sapiens
cccacccggcccggct

SEQ ID NO: 6728516 - DNA, 21 bp, Homo sapiens
cccacccggtggttcttcctg

SEQ ID NO: 6728517 - DNA, 19 bp, Homo sapiens
cccaccctaagggcagccc

SEQ ID NO: 6728518 - DNA, 21 bp, Homo sapiens
cccaccctaagggcagccctc

SEQ ID NO: 6728519 - DNA, 18 bp, Homo sapiens
cccaccctaatttgccct

SEQ ID NO: 6728520 - DNA, 20 bp, Homo sapiens
cccaccctaatttgcccttc

SEQ ID NO: 6728521 - DNA, 21 bp, Homo sapiens
cccaccctcaaaccctgtggg

SEQ ID NO: 6728522 - DNA, 12 bp, Homo sapiens
cccaccctcagc

SEQ ID NO: 6728523 - DNA, 13 bp, Homo sapiens
cccaccctcagca

SEQ ID NO: 6728524 - DNA, 21 bp, Homo sapiens
cccaccctcagcaccccttcc

SEQ ID NO: 6728525 - DNA, 13 bp, Homo sapiens
cccaccctcagcc

SEQ ID NO: 6728526 - DNA, 17 bp, Homo sapiens
cccaccctcagcccgct

SEQ ID NO: 6728527 - DNA, 16 bp, Homo sapiens
cccaccctcagccgct

SEQ ID NO: 6728528 - DNA, 15 bp, Homo sapiens
cccaccctccccttc

SEQ ID NO: 6728529 - DNA, 18 bp, Homo sapiens
cccaccctccctggagtg

SEQ ID NO: 6728530 - DNA, 23 bp, Homo sapiens
cccaccctccggcgggtgacagc

SEQ ID NO: 6728531 - DNA, 16 bp, Homo sapiens
cccaccctcgaccacc

SEQ ID NO: 6728532 - DNA, 18 bp, Homo sapiens
cccaccctcgaccacccc

SEQ ID NO: 6728533 - DNA, 21 bp, Homo sapiens
cccaccctcggggatgtgtcc

SEQ ID NO: 6728534 - DNA, 21 bp, Homo sapiens
cccaccctctggtccttctga

SEQ ID NO: 6728535 - DNA, 15 bp, Homo sapiens
cccaccctcttccta

SEQ ID NO: 6728536 - DNA, 22 bp, Homo sapiens
cccaccctgcactttcctccac

SEQ ID NO: 6728537 - DNA, 22 bp, Homo sapiens
cccaccctgcccctttcttccc

SEQ ID NO: 6728538 - DNA, 18 bp, Homo sapiens
cccaccctgcgggccagg

SEQ ID NO: 6728539 - DNA, 22 bp, Homo sapiens
cccaccctgctcctcctgccct

SEQ ID NO: 6728540 - DNA, 21 bp, Homo sapiens
cccaccctgcttctgctgcct

SEQ ID NO: 6728541 - DNA, 22 bp, Homo sapiens
cccaccctgcttctgctgcctg

SEQ ID NO: 6728542 - DNA, 20 bp, Homo sapiens
cccaccctgcttggcccagg

SEQ ID NO: 6728543 - DNA, 13 bp, Homo sapiens
cccaccctggcct

SEQ ID NO: 6728544 - DNA, 14 bp, Homo sapiens
cccaccctgggacc

SEQ ID NO: 6728545 - DNA, 14 bp, Homo sapiens
cccaccctgggctc

SEQ ID NO: 6728546 - DNA, 15 bp, Homo sapiens
cccaccctgggctct

SEQ ID NO: 6728547 - DNA, 12 bp, Homo sapiens
cccaccctgggt

SEQ ID NO: 6728548 - DNA, 21 bp, Homo sapiens
cccaccctgggtttggcccct

SEQ ID NO: 6728549 - DNA, 23 bp, Homo sapiens
cccaccctgggtttggcccctgg

SEQ ID NO: 6728550 - DNA, 13 bp, Homo sapiens
cccaccctgtccc

SEQ ID NO: 6728551 - DNA, 20 bp, Homo sapiens
cccaccctgtgccccttttc

SEQ ID NO: 6728552 - DNA, 12 bp, Homo sapiens
cccaccctgttc

SEQ ID NO: 6728553 - DNA, 20 bp, Homo sapiens
cccaccctgttcctgctgct

SEQ ID NO: 6728554 - DNA, 22 bp, Homo sapiens
cccacccttacttcctggcctc

SEQ ID NO: 6728555 - DNA, 17 bp, Homo sapiens
cccacccttctcccctg

SEQ ID NO: 6728556 - DNA, 19 bp, Homo sapiens
cccacccttctcccctgcc

SEQ ID NO: 6728557 - DNA, 22 bp, Homo sapiens
cccacccttctcccctgccccg

SEQ ID NO: 6728558 - DNA, 12 bp, Homo sapiens
cccacccttggg

SEQ ID NO: 6728559 - DNA, 13 bp, Homo sapiens
cccacccttgtcc

SEQ ID NO: 6728560 - DNA, 18 bp, Homo sapiens
cccaccgaagagccctga

SEQ ID NO: 6728561 - DNA, 21 bp, Homo sapiens
cccaccgaagagccctgagct

SEQ ID NO: 6728562 - DNA, 18 bp, Homo sapiens
cccaccgacccttcctgg

SEQ ID NO: 6728563 - DNA, 14 bp, Homo sapiens
cccaccgaggagcc

SEQ ID NO: 6728564 - DNA, 15 bp, Homo sapiens
cccaccgaggagccc

SEQ ID NO: 6728565 - DNA, 19 bp, Homo sapiens
cccaccgcagacaggacca

SEQ ID NO: 6728566 - DNA, 13 bp, Homo sapiens
cccaccgcagcgt

SEQ ID NO: 6728567 - DNA, 14 bp, Homo sapiens
cccaccgcatgccc

SEQ ID NO: 6728568 - DNA, 14 bp, Homo sapiens
cccaccgccctcct

SEQ ID NO: 6728569 - DNA, 17 bp, Homo sapiens
cccaccgccctcctcca

SEQ ID NO: 6728570 - DNA, 16 bp, Homo sapiens
cccaccgccctgcctc

SEQ ID NO: 6728571 - DNA, 18 bp, Homo sapiens
cccaccgccctgcctctt

SEQ ID NO: 6728572 - DNA, 13 bp, Homo sapiens
cccaccgccgggg

SEQ ID NO: 6728573 - DNA, 20 bp, Homo sapiens
cccaccgccggggtcctggg

SEQ ID NO: 6728574 - DNA, 18 bp, Homo sapiens
cccaccgctcagtgtcag

SEQ ID NO: 6728575 - DNA, 17 bp, Homo sapiens
cccaccgctgagaggct

SEQ ID NO: 6728576 - DNA, 18 bp, Homo sapiens
cccaccggaactgggctg

SEQ ID NO: 6728577 - DNA, 19 bp, Homo sapiens
cccaccggatgctgtgcct

SEQ ID NO: 6728578 - DNA, 23 bp, Homo sapiens
cccaccgggagcctccccctcag

SEQ ID NO: 6728579 - DNA, 22 bp, Homo sapiens
cccaccgggccactccttcctg

SEQ ID NO: 6728580 - DNA, 23 bp, Homo sapiens
cccaccgggccactccttcctgc

SEQ ID NO: 6728581 - DNA, 17 bp, Homo sapiens
cccaccggtccagctgg

SEQ ID NO: 6728582 - DNA, 15 bp, Homo sapiens
cccaccggtgccaaa

SEQ ID NO: 6728583 - DNA, 19 bp, Homo sapiens
cccaccggttgcttctggg

SEQ ID NO: 6728584 - DNA, 13 bp, Homo sapiens
cccaccgtctcgg

SEQ ID NO: 6728585 - DNA, 18 bp, Homo sapiens
cccaccgtctcggccctg

SEQ ID NO: 6728586 - DNA, 20 bp, Homo sapiens
cccaccgtctcggccctgaa

SEQ ID NO: 6728587 - DNA, 20 bp, Homo sapiens
cccaccgtgggcagtgccac

SEQ ID NO: 6728588 - DNA, 16 bp, Homo sapiens
cccacctactctcagg

SEQ ID NO: 6728589 - DNA, 15 bp, Homo sapiens
cccacctactgcact

SEQ ID NO: 6728590 - DNA, 21 bp, Homo sapiens
cccacctagaacactaactca

SEQ ID NO: 6728591 - DNA, 16 bp, Homo sapiens
cccacctagcccagga

SEQ ID NO: 6728592 - DNA, 19 bp, Homo sapiens
cccacctagtgccccagac

SEQ ID NO: 6728593 - DNA, 21 bp, Homo sapiens
cccacctcaaatgggtctggg

SEQ ID NO: 6728594 - DNA, 22 bp, Homo sapiens
cccacctcacagctactcagtg

SEQ ID NO: 6728595 - DNA, 13 bp, Homo sapiens
cccacctcagcct

SEQ ID NO: 6728596 - DNA, 21 bp, Homo sapiens
cccacctccacccagcccctg

SEQ ID NO: 6728597 - DNA, 17 bp, Homo sapiens
cccacctccacctgtga

SEQ ID NO: 6728598 - DNA, 13 bp, Homo sapiens
cccacctccagcc

SEQ ID NO: 6728599 - DNA, 14 bp, Homo sapiens
cccacctccagccc

SEQ ID NO: 6728600 - DNA, 18 bp, Homo sapiens
cccacctccagcccggga

SEQ ID NO: 6728601 - DNA, 12 bp, Homo sapiens
cccacctcccat

SEQ ID NO: 6728602 - DNA, 20 bp, Homo sapiens
cccacctcccatttctgttg

SEQ ID NO: 6728603 - DNA, 16 bp, Homo sapiens
cccacctccccagagc

SEQ ID NO: 6728604 - DNA, 19 bp, Homo sapiens
cccacctcccccactccca

SEQ ID NO: 6728605 - DNA, 18 bp, Homo sapiens
cccacctcccgccctcac

SEQ ID NO: 6728606 - DNA, 14 bp, Homo sapiens
cccacctcccggtg

SEQ ID NO: 6728607 - DNA, 15 bp, Homo sapiens
cccacctcccggtgt

SEQ ID NO: 6728608 - DNA, 12 bp, Homo sapiens
cccacctccctg

SEQ ID NO: 6728609 - DNA, 14 bp, Homo sapiens
cccacctccctgcc

SEQ ID NO: 6728610 - DNA, 17 bp, Homo sapiens
cccacctccctgcctcc

SEQ ID NO: 6728611 - DNA, 15 bp, Homo sapiens
cccacctccctgcgc

SEQ ID NO: 6728612 - DNA, 16 bp, Homo sapiens
cccacctccgctggga

SEQ ID NO: 6728613 - DNA, 14 bp, Homo sapiens
cccacctcctccag

SEQ ID NO: 6728614 - DNA, 21 bp, Homo sapiens
cccacctcgctcccctctgga

SEQ ID NO: 6728615 - DNA, 14 bp, Homo sapiens
cccacctcggcctc

SEQ ID NO: 6728616 - DNA, 14 bp, Homo sapiens
cccacctctccctg

SEQ ID NO: 6728617 - DNA, 21 bp, Homo sapiens
cccacctctccctgcatcctg

SEQ ID NO: 6728618 - DNA, 22 bp, Homo sapiens
cccacctctccctgcatcctga

SEQ ID NO: 6728619 - DNA, 16 bp, Homo sapiens
cccacctctcctgccc

SEQ ID NO: 6728620 - DNA, 21 bp, Homo sapiens
cccacctctcctgccctgtga

SEQ ID NO: 6728621 - DNA, 14 bp, Homo sapiens
cccacctctctcac

SEQ ID NO: 6728622 - DNA, 13 bp, Homo sapiens
cccacctctgctg

SEQ ID NO: 6728623 - DNA, 14 bp, Homo sapiens
cccacctctgctgc

SEQ ID NO: 6728624 - DNA, 17 bp, Homo sapiens
cccacctctgctgccca

SEQ ID NO: 6728625 - DNA, 18 bp, Homo sapiens
cccacctctgctgcccac

SEQ ID NO: 6728626 - DNA, 14 bp, Homo sapiens
cccacctctggccc

SEQ ID NO: 6728627 - DNA, 20 bp, Homo sapiens
cccacctctggccctgtgta

SEQ ID NO: 6728628 - DNA, 15 bp, Homo sapiens
cccacctctgtgacc

SEQ ID NO: 6728629 - DNA, 18 bp, Homo sapiens
cccacctctgtgacctca

SEQ ID NO: 6728630 - DNA, 22 bp, Homo sapiens
cccacctgaaagcctgtctctt

SEQ ID NO: 6728631 - DNA, 17 bp, Homo sapiens
cccacctgacaatggca

SEQ ID NO: 6728632 - DNA, 18 bp, Homo sapiens
cccacctgacacaccagg

SEQ ID NO: 6728633 - DNA, 13 bp, Homo sapiens
cccacctgagctt

SEQ ID NO: 6728634 - DNA, 20 bp, Homo sapiens
cccacctgaggctcagccct

SEQ ID NO: 6728635 - DNA, 12 bp, Homo sapiens
cccacctgcagg

SEQ ID NO: 6728636 - DNA, 19 bp, Homo sapiens
cccacctgcatcagcctct

SEQ ID NO: 6728637 - DNA, 15 bp, Homo sapiens
cccacctgccagcgg

SEQ ID NO: 6728638 - DNA, 12 bp, Homo sapiens
cccacctgccca

SEQ ID NO: 6728639 - DNA, 16 bp, Homo sapiens
cccacctgcccagtta

SEQ ID NO: 6728640 - DNA, 13 bp, Homo sapiens
cccacctgcccat

SEQ ID NO: 6728641 - DNA, 14 bp, Homo sapiens
cccacctgcctggc

SEQ ID NO: 6728642 - DNA, 18 bp, Homo sapiens
cccacctgcctggccggc

SEQ ID NO: 6728643 - DNA, 15 bp, Homo sapiens
cccacctgcctggtg

SEQ ID NO: 6728644 - DNA, 12 bp, Homo sapiens
cccacctgcgct

SEQ ID NO: 6728645 - DNA, 15 bp, Homo sapiens
cccacctgctcccag

SEQ ID NO: 6728646 - DNA, 16 bp, Homo sapiens
cccacctggagcccgc

SEQ ID NO: 6728647 - DNA, 17 bp, Homo sapiens
cccacctggccacctga

SEQ ID NO: 6728648 - DNA, 12 bp, Homo sapiens
cccacctggcct

SEQ ID NO: 6728649 - DNA, 14 bp, Homo sapiens
cccacctggctccc

SEQ ID NO: 6728650 - DNA, 12 bp, Homo sapiens
cccacctggctg

SEQ ID NO: 6728651 - DNA, 17 bp, Homo sapiens
cccacctgggccaagga

SEQ ID NO: 6728652 - DNA, 14 bp, Homo sapiens
cccacctgggctgg

SEQ ID NO: 6728653 - DNA, 20 bp, Homo sapiens
cccacctggggagtttacta

SEQ ID NO: 6728654 - DNA, 22 bp, Homo sapiens
cccacctgtcaaacaaagccag

SEQ ID NO: 6728655 - DNA, 12 bp, Homo sapiens
cccacctgtctt

SEQ ID NO: 6728656 - DNA, 17 bp, Homo sapiens
cccacctgtttctggaa

SEQ ID NO: 6728657 - DNA, 22 bp, Homo sapiens
cccaccttccttgcgaccacca

SEQ ID NO: 6728658 - DNA, 23 bp, Homo sapiens
cccaccttcttgggactgctgtg

SEQ ID NO: 6728659 - DNA, 14 bp, Homo sapiens
cccaccttgccagg

SEQ ID NO: 6728660 - DNA, 22 bp, Homo sapiens
cccaccttgccagggcagggtc

SEQ ID NO: 6728661 - DNA, 19 bp, Homo sapiens
cccaccttggctgcaggga

SEQ ID NO: 6728662 - DNA, 19 bp, Homo sapiens
cccaccttggtccctctca

SEQ ID NO: 6728663 - DNA, 21 bp, Homo sapiens
cccaccttggtccctctcaga

SEQ ID NO: 6728664 - DNA, 17 bp, Homo sapiens
cccaccttgtcgctgaa

SEQ ID NO: 6728665 - DNA, 18 bp, Homo sapiens
cccaccttgttggagcct

SEQ ID NO: 6728666 - DNA, 19 bp, Homo sapiens
cccaccttgttggagcctg

SEQ ID NO: 6728667 - DNA, 17 bp, Homo sapiens
cccacctttaagtcctc

SEQ ID NO: 6728668 - DNA, 21 bp, Homo sapiens
cccacctttattaaaatctta

SEQ ID NO: 6728669 - DNA, 15 bp, Homo sapiens
cccacctttctcgct

SEQ ID NO: 6728670 - DNA, 21 bp, Homo sapiens
cccacctttgggatcagcctc

SEQ ID NO: 6728671 - DNA, 17 bp, Homo sapiens
cccacgaaactgccctg

SEQ ID NO: 6728672 - DNA, 18 bp, Homo sapiens
cccacgaaactgccctgg

SEQ ID NO: 6728673 - DNA, 17 bp, Homo sapiens
cccacgaacgctcttag

SEQ ID NO: 6728674 - DNA, 17 bp, Homo sapiens
cccacgaatggaccctc

SEQ ID NO: 6728675 - DNA, 13 bp, Homo sapiens
cccacgacccctg

SEQ ID NO: 6728676 - DNA, 16 bp, Homo sapiens
cccacgacccctgcct

SEQ ID NO: 6728677 - DNA, 21 bp, Homo sapiens
cccacgacctgtcctgtcttt

SEQ ID NO: 6728678 - DNA, 20 bp, Homo sapiens
cccacgactgcccggcaggg

SEQ ID NO: 6728679 - DNA, 21 bp, Homo sapiens
cccacgactgcccggcagggt

SEQ ID NO: 6728680 - DNA, 23 bp, Homo sapiens
cccacgagggagttgggacagga

SEQ ID NO: 6728681 - DNA, 18 bp, Homo sapiens
cccacgagtcacctgcaa

SEQ ID NO: 6728682 - DNA, 19 bp, Homo sapiens
cccacgagtcacctgcaag

SEQ ID NO: 6728683 - DNA, 16 bp, Homo sapiens
cccacgatcccctccc

SEQ ID NO: 6728684 - DNA, 19 bp, Homo sapiens
cccacgatcccctccccca

SEQ ID NO: 6728685 - DNA, 22 bp, Homo sapiens
cccacgattttctccagctcag

SEQ ID NO: 6728686 - DNA, 13 bp, Homo sapiens
cccacgcagagcc

SEQ ID NO: 6728687 - DNA, 14 bp, Homo sapiens
cccacgcagagccc

SEQ ID NO: 6728688 - DNA, 17 bp, Homo sapiens
cccacgcagagccccgg

SEQ ID NO: 6728689 - DNA, 18 bp, Homo sapiens
cccacgcagagccccgga

SEQ ID NO: 6728690 - DNA, 21 bp, Homo sapiens
cccacgcagagccccggagca

SEQ ID NO: 6728691 - DNA, 13 bp, Homo sapiens
cccacgcagagga

SEQ ID NO: 6728692 - DNA, 14 bp, Homo sapiens
cccacgccagctgg

SEQ ID NO: 6728693 - DNA, 15 bp, Homo sapiens
cccacgccagctggc

SEQ ID NO: 6728694 - DNA, 13 bp, Homo sapiens
cccacgccaggcc

SEQ ID NO: 6728695 - DNA, 15 bp, Homo sapiens
cccacgccaggccag

SEQ ID NO: 6728696 - DNA, 17 bp, Homo sapiens
cccacgcccccactggt

SEQ ID NO: 6728697 - DNA, 12 bp, Homo sapiens
cccacgccctcc

SEQ ID NO: 6728698 - DNA, 17 bp, Homo sapiens
cccacgccctcctccct

SEQ ID NO: 6728699 - DNA, 23 bp, Homo sapiens
cccacgccgatataagccatagc

SEQ ID NO: 6728700 - DNA, 18 bp, Homo sapiens
cccacgccggcctctgct

SEQ ID NO: 6728701 - DNA, 20 bp, Homo sapiens
cccacgccggcctctgctgc

SEQ ID NO: 6728702 - DNA, 17 bp, Homo sapiens
cccacgcctcaccagcc

SEQ ID NO: 6728703 - DNA, 22 bp, Homo sapiens
cccacgcctgtcctcctggaag

SEQ ID NO: 6728704 - DNA, 14 bp, Homo sapiens
cccacgctgaccat

SEQ ID NO: 6728705 - DNA, 19 bp, Homo sapiens
cccacgctgaccatgcgtc

SEQ ID NO: 6728706 - DNA, 16 bp, Homo sapiens
cccacgctgactacag

SEQ ID NO: 6728707 - DNA, 14 bp, Homo sapiens
cccacgctggagtg

SEQ ID NO: 6728708 - DNA, 20 bp, Homo sapiens
cccacgctgggacacagacc

SEQ ID NO: 6728709 - DNA, 17 bp, Homo sapiens
cccacgcttctggaggt

SEQ ID NO: 6728710 - DNA, 20 bp, Homo sapiens
cccacggacgacgcgagggc

SEQ ID NO: 6728711 - DNA, 15 bp, Homo sapiens
cccacggagacagag

SEQ ID NO: 6728712 - DNA, 14 bp, Homo sapiens
cccacggagccctc

SEQ ID NO: 6728713 - DNA, 19 bp, Homo sapiens
cccacggcacctcggggac

SEQ ID NO: 6728714 - DNA, 19 bp, Homo sapiens
cccacggccacccaccctt

SEQ ID NO: 6728715 - DNA, 14 bp, Homo sapiens
cccacggccactgc

SEQ ID NO: 6728716 - DNA, 18 bp, Homo sapiens
cccacggccactgcagtc

SEQ ID NO: 6728717 - DNA, 21 bp, Homo sapiens
cccacggccgctccaggggtg

SEQ ID NO: 6728718 - DNA, 18 bp, Homo sapiens
cccacggctaagaggctg

SEQ ID NO: 6728719 - DNA, 13 bp, Homo sapiens
cccacggctctgt

SEQ ID NO: 6728720 - DNA, 18 bp, Homo sapiens
cccacggctctgtgcccg

SEQ ID NO: 6728721 - DNA, 19 bp, Homo sapiens
cccacggggaccactgggc

SEQ ID NO: 6728722 - DNA, 17 bp, Homo sapiens
cccacggggatcacagc

SEQ ID NO: 6728723 - DNA, 19 bp, Homo sapiens
cccacggggcctcgggacc

SEQ ID NO: 6728724 - DNA, 15 bp, Homo sapiens
cccacggggtccccg

SEQ ID NO: 6728725 - DNA, 20 bp, Homo sapiens
cccacggttcggggcttctg

SEQ ID NO: 6728726 - DNA, 17 bp, Homo sapiens
cccacggtttcagctag

SEQ ID NO: 6728727 - DNA, 17 bp, Homo sapiens
cccacgtcacgtgtagt

SEQ ID NO: 6728728 - DNA, 15 bp, Homo sapiens
cccacgtcagctggg

SEQ ID NO: 6728729 - DNA, 14 bp, Homo sapiens
cccacgtccctgcg

SEQ ID NO: 6728730 - DNA, 14 bp, Homo sapiens
cccacgtcctgggt

SEQ ID NO: 6728731 - DNA, 15 bp, Homo sapiens
cccacgtcctgtcag

SEQ ID NO: 6728732 - DNA, 22 bp, Homo sapiens
cccacgtcctgtcagtgccgcc

SEQ ID NO: 6728733 - DNA, 16 bp, Homo sapiens
cccacgtctcctcctc

SEQ ID NO: 6728734 - DNA, 14 bp, Homo sapiens
cccacgtctctctg

SEQ ID NO: 6728735 - DNA, 23 bp, Homo sapiens
cccacgtgagagaatctgcctgt

SEQ ID NO: 6728736 - DNA, 18 bp, Homo sapiens
cccacgtgcagcacctgt

SEQ ID NO: 6728737 - DNA, 21 bp, Homo sapiens
cccacgtggactctgtgctca

SEQ ID NO: 6728738 - DNA, 22 bp, Homo sapiens
cccacgtggactctgtgctcac

SEQ ID NO: 6728739 - DNA, 18 bp, Homo sapiens
cccacgtgtcttccactt

SEQ ID NO: 6728740 - DNA, 15 bp, Homo sapiens
cccacgttctcacac

SEQ ID NO: 6728741 - DNA, 17 bp, Homo sapiens
cccacgttctcacaccc

SEQ ID NO: 6728742 - DNA, 20 bp, Homo sapiens
cccacgttctcacacccacc

SEQ ID NO: 6728743 - DNA, 21 bp, Homo sapiens
cccacgttctcacacccaccg

SEQ ID NO: 6728744 - DNA, 23 bp, Homo sapiens
cccacgttctctctgcctgtgag

SEQ ID NO: 6728745 - DNA, 22 bp, Homo sapiens
cccacgtttgttcgcttcctga

SEQ ID NO: 6728746 - DNA, 16 bp, Homo sapiens
cccactaagctttctc

SEQ ID NO: 6728747 - DNA, 20 bp, Homo sapiens
cccactaagctttctccttt

SEQ ID NO: 6728748 - DNA, 22 bp, Homo sapiens
cccactaagctttctcctttga

SEQ ID NO: 6728749 - DNA, 18 bp, Homo sapiens
cccactacccttctcctt

SEQ ID NO: 6728750 - DNA, 17 bp, Homo sapiens
cccactacgtgccaggc

SEQ ID NO: 6728751 - DNA, 14 bp, Homo sapiens
cccactactcaata

SEQ ID NO: 6728752 - DNA, 21 bp, Homo sapiens
cccactactcaatactacctc

SEQ ID NO: 6728753 - DNA, 18 bp, Homo sapiens
cccactactgcagcacct

SEQ ID NO: 6728754 - DNA, 13 bp, Homo sapiens
cccactagccctc

SEQ ID NO: 6728755 - DNA, 18 bp, Homo sapiens
cccactagccctctttct

SEQ ID NO: 6728756 - DNA, 19 bp, Homo sapiens
cccactaggataggaactg

SEQ ID NO: 6728757 - DNA, 17 bp, Homo sapiens
cccactatcctcactcc

SEQ ID NO: 6728758 - DNA, 15 bp, Homo sapiens
cccactcacacttgg

SEQ ID NO: 6728759 - DNA, 15 bp, Homo sapiens
cccactcaccagccc

SEQ ID NO: 6728760 - DNA, 15 bp, Homo sapiens
cccactcaccagggt

SEQ ID NO: 6728761 - DNA, 19 bp, Homo sapiens
cccactcagaactctccag

SEQ ID NO: 6728762 - DNA, 13 bp, Homo sapiens
cccactcagcatt

SEQ ID NO: 6728763 - DNA, 21 bp, Homo sapiens
cccactcagccattctctacc

SEQ ID NO: 6728764 - DNA, 18 bp, Homo sapiens
cccactcagctccgtgaa

SEQ ID NO: 6728765 - DNA, 15 bp, Homo sapiens
cccactcaggggacc

SEQ ID NO: 6728766 - DNA, 15 bp, Homo sapiens
cccactcattccttc

SEQ ID NO: 6728767 - DNA, 14 bp, Homo sapiens
cccactccaccctg

SEQ ID NO: 6728768 - DNA, 16 bp, Homo sapiens
cccactccaccctgtt

SEQ ID NO: 6728769 - DNA, 14 bp, Homo sapiens
cccactccactact

SEQ ID NO: 6728770 - DNA, 15 bp, Homo sapiens
cccactccactactc

SEQ ID NO: 6728771 - DNA, 13 bp, Homo sapiens
cccactccagccc

SEQ ID NO: 6728772 - DNA, 18 bp, Homo sapiens
cccactccagccctgtcc

SEQ ID NO: 6728773 - DNA, 13 bp, Homo sapiens
cccactccagcct

SEQ ID NO: 6728774 - DNA, 15 bp, Homo sapiens
cccactccagcctgg

SEQ ID NO: 6728775 - DNA, 17 bp, Homo sapiens
cccactccccaccttca

SEQ ID NO: 6728776 - DNA, 14 bp, Homo sapiens
cccactccccagcc

SEQ ID NO: 6728777 - DNA, 16 bp, Homo sapiens
cccactcccccaccca

SEQ ID NO: 6728778 - DNA, 17 bp, Homo sapiens
cccactcccccacccat

SEQ ID NO: 6728779 - DNA, 15 bp, Homo sapiens
cccactcccccagga

SEQ ID NO: 6728780 - DNA, 21 bp, Homo sapiens
cccactcccccgtttctcctt

SEQ ID NO: 6728781 - DNA, 15 bp, Homo sapiens
cccactcccctcaca

SEQ ID NO: 6728782 - DNA, 15 bp, Homo sapiens
cccactccctatctc

SEQ ID NO: 6728783 - DNA, 14 bp, Homo sapiens
cccactccctcaca

SEQ ID NO: 6728784 - DNA, 12 bp, Homo sapiens
cccactccctgc

SEQ ID NO: 6728785 - DNA, 13 bp, Homo sapiens
cccactccctggg

SEQ ID NO: 6728786 - DNA, 19 bp, Homo sapiens
cccactcccttgctggccc

SEQ ID NO: 6728787 - DNA, 17 bp, Homo sapiens
cccactccctttccaac

SEQ ID NO: 6728788 - DNA, 19 bp, Homo sapiens
cccactccgactccccctc

SEQ ID NO: 6728789 - DNA, 21 bp, Homo sapiens
cccactccgccagccacagga

SEQ ID NO: 6728790 - DNA, 22 bp, Homo sapiens
cccactccgccagccacaggac

SEQ ID NO: 6728791 - DNA, 14 bp, Homo sapiens
cccactccggccct

SEQ ID NO: 6728792 - DNA, 19 bp, Homo sapiens
cccactccggccctccaga

SEQ ID NO: 6728793 - DNA, 12 bp, Homo sapiens
cccactcctaat

SEQ ID NO: 6728794 - DNA, 23 bp, Homo sapiens
cccactcctcactgccccaccag

SEQ ID NO: 6728795 - DNA, 12 bp, Homo sapiens
cccactcctcta

SEQ ID NO: 6728796 - DNA, 17 bp, Homo sapiens
cccactcctctcccaca

SEQ ID NO: 6728797 - DNA, 23 bp, Homo sapiens
cccactcctctgctgacctgctg

SEQ ID NO: 6728798 - DNA, 12 bp, Homo sapiens
cccactcctgct

SEQ ID NO: 6728799 - DNA, 22 bp, Homo sapiens
cccactcgggtctgcagacctg

SEQ ID NO: 6728800 - DNA, 21 bp, Homo sapiens
cccactcgtgataagtcaaca

SEQ ID NO: 6728801 - DNA, 12 bp, Homo sapiens
cccactctacct

SEQ ID NO: 6728802 - DNA, 13 bp, Homo sapiens
cccactctacctc

SEQ ID NO: 6728803 - DNA, 14 bp, Homo sapiens
cccactctacctcc

SEQ ID NO: 6728804 - DNA, 21 bp, Homo sapiens
cccactctaggggtcaggctc

SEQ ID NO: 6728805 - DNA, 15 bp, Homo sapiens
cccactctcagaggc

SEQ ID NO: 6728806 - DNA, 19 bp, Homo sapiens
cccactctcattccccagg

SEQ ID NO: 6728807 - DNA, 13 bp, Homo sapiens
cccactctctcac

SEQ ID NO: 6728808 - DNA, 14 bp, Homo sapiens
cccactctctcacc

SEQ ID NO: 6728809 - DNA, 15 bp, Homo sapiens
cccactctgcggccc

SEQ ID NO: 6728810 - DNA, 13 bp, Homo sapiens
cccactctgctcc

SEQ ID NO: 6728811 - DNA, 17 bp, Homo sapiens
cccactctgctcccagc

SEQ ID NO: 6728812 - DNA, 21 bp, Homo sapiens
cccactctgctcccagcccct

SEQ ID NO: 6728813 - DNA, 15 bp, Homo sapiens
cccactctgctctga

SEQ ID NO: 6728814 - DNA, 17 bp, Homo sapiens
cccactctgctctgatg

SEQ ID NO: 6728815 - DNA, 15 bp, Homo sapiens
cccactctgcttctt

SEQ ID NO: 6728816 - DNA, 11 bp, Homo sapiens
cccactctggg

SEQ ID NO: 6728817 - DNA, 19 bp, Homo sapiens
cccactctgggcaaagccc

SEQ ID NO: 6728818 - DNA, 21 bp, Homo sapiens
cccactctgtaatagttcagt

SEQ ID NO: 6728819 - DNA, 12 bp, Homo sapiens
cccactctgtgc

SEQ ID NO: 6728820 - DNA, 19 bp, Homo sapiens
cccactgaaatgaccaaga

SEQ ID NO: 6728821 - DNA, 13 bp, Homo sapiens
cccactgaaatgg

SEQ ID NO: 6728822 - DNA, 14 bp, Homo sapiens
cccactgaaatgga

SEQ ID NO: 6728823 - DNA, 13 bp, Homo sapiens
cccactgacctgc

SEQ ID NO: 6728824 - DNA, 14 bp, Homo sapiens
cccactgacctgcc

SEQ ID NO: 6728825 - DNA, 22 bp, Homo sapiens
cccactgatgctgttctcttct

SEQ ID NO: 6728826 - DNA, 10 bp, Homo sapiens
cccactgcac

SEQ ID NO: 6728827 - DNA, 16 bp, Homo sapiens
cccactgcaccccctc

SEQ ID NO: 6728828 - DNA, 17 bp, Homo sapiens
cccactgcaccgcctca

SEQ ID NO: 6728829 - DNA, 16 bp, Homo sapiens
cccactgcactccagc

SEQ ID NO: 6728830 - DNA, 15 bp, Homo sapiens
cccactgcaggcccc

SEQ ID NO: 6728831 - DNA, 23 bp, Homo sapiens
cccactgcaggccccgcttgtcc

SEQ ID NO: 6728832 - DNA, 17 bp, Homo sapiens
cccactgccacaccctc

SEQ ID NO: 6728833 - DNA, 18 bp, Homo sapiens
cccactgccacaccctcc

SEQ ID NO: 6728834 - DNA, 17 bp, Homo sapiens
cccactgccataaaaca

SEQ ID NO: 6728835 - DNA, 12 bp, Homo sapiens
cccactgcccac

SEQ ID NO: 6728836 - DNA, 17 bp, Homo sapiens
cccactgcccaccccct

SEQ ID NO: 6728837 - DNA, 21 bp, Homo sapiens
cccactgccccgtgtgaatgt

SEQ ID NO: 6728838 - DNA, 16 bp, Homo sapiens
cccactgccctccagg

SEQ ID NO: 6728839 - DNA, 18 bp, Homo sapiens
cccactgcctactgcatc

SEQ ID NO: 6728840 - DNA, 20 bp, Homo sapiens
cccactgcctcctgcctggg

SEQ ID NO: 6728841 - DNA, 14 bp, Homo sapiens
cccactgcctgccc

SEQ ID NO: 6728842 - DNA, 15 bp, Homo sapiens
cccactgcctgccca

SEQ ID NO: 6728843 - DNA, 21 bp, Homo sapiens
cccactgctaaggctgctggc

SEQ ID NO: 6728844 - DNA, 13 bp, Homo sapiens
cccactgctcccc

SEQ ID NO: 6728845 - DNA, 13 bp, Homo sapiens
cccactgctgact

SEQ ID NO: 6728846 - DNA, 13 bp, Homo sapiens
cccactgctgagc

SEQ ID NO: 6728847 - DNA, 14 bp, Homo sapiens
cccactgctgagct

SEQ ID NO: 6728848 - DNA, 14 bp, Homo sapiens
cccactgctggtgc

SEQ ID NO: 6728849 - DNA, 19 bp, Homo sapiens
cccactgcttttggtctgt

SEQ ID NO: 6728850 - DNA, 22 bp, Homo sapiens
cccactgcttttggtctgtgtg

SEQ ID NO: 6728851 - DNA, 12 bp, Homo sapiens
cccactggaaga

SEQ ID NO: 6728852 - DNA, 24 bp, Homo sapiens
cccactggaagatcccctctcctg

SEQ ID NO: 6728853 - DNA, 15 bp, Homo sapiens
cccactggacaacac

SEQ ID NO: 6728854 - DNA, 16 bp, Homo sapiens
cccactggacaacact

SEQ ID NO: 6728855 - DNA, 17 bp, Homo sapiens
cccactggacaacactg

SEQ ID NO: 6728856 - DNA, 16 bp, Homo sapiens
cccactggactgggtt

SEQ ID NO: 6728857 - DNA, 18 bp, Homo sapiens
cccactggagtctctctc

SEQ ID NO: 6728858 - DNA, 14 bp, Homo sapiens
cccactggccagtc

SEQ ID NO: 6728859 - DNA, 16 bp, Homo sapiens
cccactggccagtcct

SEQ ID NO: 6728860 - DNA, 17 bp, Homo sapiens
cccactggccgctgagc

SEQ ID NO: 6728861 - DNA, 16 bp, Homo sapiens
cccactggctcctccc

SEQ ID NO: 6728862 - DNA, 19 bp, Homo sapiens
cccactggctcctcccagc

SEQ ID NO: 6728863 - DNA, 12 bp, Homo sapiens
cccactggctgt

SEQ ID NO: 6728864 - DNA, 15 bp, Homo sapiens
cccactggctgtggg

SEQ ID NO: 6728865 - DNA, 22 bp, Homo sapiens
cccactggctgtgggctccctt

SEQ ID NO: 6728866 - DNA, 20 bp, Homo sapiens
cccactgggccagccctgca

SEQ ID NO: 6728867 - DNA, 23 bp, Homo sapiens
cccactgggccagccctgcagcc

SEQ ID NO: 6728868 - DNA, 18 bp, Homo sapiens
cccactgggccctggggc

SEQ ID NO: 6728869 - DNA, 23 bp, Homo sapiens
cccactggggttggaagtgcaga

SEQ ID NO: 6728870 - DNA, 16 bp, Homo sapiens
cccactggttagatgt

SEQ ID NO: 6728871 - DNA, 18 bp, Homo sapiens
cccactgtacttgctctt

SEQ ID NO: 6728872 - DNA, 16 bp, Homo sapiens
cccactgtcaggcctc

SEQ ID NO: 6728873 - DNA, 21 bp, Homo sapiens
cccactgtccccctacccacc

SEQ ID NO: 6728874 - DNA, 13 bp, Homo sapiens
cccactgtcctgg

SEQ ID NO: 6728875 - DNA, 22 bp, Homo sapiens
cccactgtcctgggcctgcaga

SEQ ID NO: 6728876 - DNA, 22 bp, Homo sapiens
cccactgtcctgggcgccctgg

SEQ ID NO: 6728877 - DNA, 21 bp, Homo sapiens
cccactgtcctttctccaggc

SEQ ID NO: 6728878 - DNA, 15 bp, Homo sapiens
cccactgtcttgcag

SEQ ID NO: 6728879 - DNA, 21 bp, Homo sapiens
cccactgtggggcaagcctga

SEQ ID NO: 6728880 - DNA, 22 bp, Homo sapiens
cccactgtggggcaagcctgag

SEQ ID NO: 6728881 - DNA, 22 bp, Homo sapiens
cccacttagcagggacaggaga

SEQ ID NO: 6728882 - DNA, 14 bp, Homo sapiens
cccacttagccgca

SEQ ID NO: 6728883 - DNA, 18 bp, Homo sapiens
cccacttagccgcaccct

SEQ ID NO: 6728884 - DNA, 19 bp, Homo sapiens
cccacttagccgcaccctg

SEQ ID NO: 6728885 - DNA, 20 bp, Homo sapiens
cccacttagccgtccatggc

SEQ ID NO: 6728886 - DNA, 23 bp, Homo sapiens
cccacttagccgtccatggcacc

SEQ ID NO: 6728887 - DNA, 18 bp, Homo sapiens
cccacttagtgctggtcc

SEQ ID NO: 6728888 - DNA, 16 bp, Homo sapiens
cccacttatgctgctg

SEQ ID NO: 6728889 - DNA, 20 bp, Homo sapiens
cccacttatgctgctgtgaa

SEQ ID NO: 6728890 - DNA, 22 bp, Homo sapiens
cccacttatgctgctgtgaatt

SEQ ID NO: 6728891 - DNA, 18 bp, Homo sapiens
cccacttcactttcttca

SEQ ID NO: 6728892 - DNA, 13 bp, Homo sapiens
cccacttcagcct

SEQ ID NO: 6728893 - DNA, 15 bp, Homo sapiens
cccacttcaggcact

SEQ ID NO: 6728894 - DNA, 21 bp, Homo sapiens
cccacttcatgcccactgccg

SEQ ID NO: 6728895 - DNA, 15 bp, Homo sapiens
cccacttccaccccc

SEQ ID NO: 6728896 - DNA, 15 bp, Homo sapiens
cccacttcccatctc

SEQ ID NO: 6728897 - DNA, 20 bp, Homo sapiens
cccacttccccatctgtgtg

SEQ ID NO: 6728898 - DNA, 21 bp, Homo sapiens
cccacttccccatctgtgtgt

SEQ ID NO: 6728899 - DNA, 23 bp, Homo sapiens
cccacttcccctcctacccctcc

SEQ ID NO: 6728900 - DNA, 12 bp, Homo sapiens
cccacttcctcc

SEQ ID NO: 6728901 - DNA, 13 bp, Homo sapiens
cccacttcctttc

SEQ ID NO: 6728902 - DNA, 18 bp, Homo sapiens
cccacttcggcgcagaaa

SEQ ID NO: 6728903 - DNA, 20 bp, Homo sapiens
cccacttctcatcacacaca

SEQ ID NO: 6728904 - DNA, 18 bp, Homo sapiens
cccacttctctctaagga

SEQ ID NO: 6728905 - DNA, 12 bp, Homo sapiens
cccacttctgca

SEQ ID NO: 6728906 - DNA, 16 bp, Homo sapiens
cccacttctgcacttg

SEQ ID NO: 6728907 - DNA, 12 bp, Homo sapiens
cccacttctgcc

SEQ ID NO: 6728908 - DNA, 22 bp, Homo sapiens
cccacttctggccacatcagcc

SEQ ID NO: 6728909 - DNA, 14 bp, Homo sapiens
cccacttctggcct

SEQ ID NO: 6728910 - DNA, 16 bp, Homo sapiens
cccacttctgtgccac

SEQ ID NO: 6728911 - DNA, 19 bp, Homo sapiens
cccacttctgtgtagacat

SEQ ID NO: 6728912 - DNA, 17 bp, Homo sapiens
cccacttgattgagaaa

SEQ ID NO: 6728913 - DNA, 20 bp, Homo sapiens
cccacttgattgagaaagat

SEQ ID NO: 6728914 - DNA, 14 bp, Homo sapiens
cccacttgcctctt

SEQ ID NO: 6728915 - DNA, 15 bp, Homo sapiens
cccacttgcctcttc

SEQ ID NO: 6728916 - DNA, 23 bp, Homo sapiens
cccacttgtcactgacacaaagg

SEQ ID NO: 6728917 - DNA, 13 bp, Homo sapiens
cccacttgtcatc

SEQ ID NO: 6728918 - DNA, 23 bp, Homo sapiens
cccactttcaagaatcagacagc

SEQ ID NO: 6728919 - DNA, 21 bp, Homo sapiens
cccactttcaagacagatgag

SEQ ID NO: 6728920 - DNA, 14 bp, Homo sapiens
cccactttcgcctc

SEQ ID NO: 6728921 - DNA, 13 bp, Homo sapiens
cccactttctgtt

SEQ ID NO: 6728922 - DNA, 21 bp, Homo sapiens
cccactttgctgttccttact

SEQ ID NO: 6728923 - DNA, 15 bp, Homo sapiens
cccactttggcctcc

SEQ ID NO: 6728924 - DNA, 15 bp, Homo sapiens
cccactttggcttat

SEQ ID NO: 6728925 - DNA, 16 bp, Homo sapiens
cccactttgtctgtac

SEQ ID NO: 6728926 - DNA, 23 bp, Homo sapiens
cccacttttacgttgtgtccctc

SEQ ID NO: 6728927 - DNA, 22 bp, Homo sapiens
cccactttttttttttctgcct

SEQ ID NO: 6728928 - DNA, 20 bp, Homo sapiens
cccagaaaaaaaaaaactta

SEQ ID NO: 6728929 - DNA, 18 bp, Homo sapiens
cccagaaaaactggctct

SEQ ID NO: 6728930 - DNA, 17 bp, Homo sapiens
cccagaaacatctctgg

SEQ ID NO: 6728931 - DNA, 16 bp, Homo sapiens
cccagaaagattttct

SEQ ID NO: 6728932 - DNA, 22 bp, Homo sapiens
cccagaaagcctcctgccccct

SEQ ID NO: 6728933 - DNA, 21 bp, Homo sapiens
cccagaaagcctctctctccc

SEQ ID NO: 6728934 - DNA, 16 bp, Homo sapiens
cccagaaagctgccag

SEQ ID NO: 6728935 - DNA, 16 bp, Homo sapiens
cccagaaagctgcgga

SEQ ID NO: 6728936 - DNA, 21 bp, Homo sapiens
cccagaaataggacaattcac

SEQ ID NO: 6728937 - DNA, 16 bp, Homo sapiens
cccagaaatgccgctg

SEQ ID NO: 6728938 - DNA, 19 bp, Homo sapiens
cccagaaatgccgctgtgt

SEQ ID NO: 6728939 - DNA, 21 bp, Homo sapiens
cccagaaattccttcccactc

SEQ ID NO: 6728940 - DNA, 22 bp, Homo sapiens
cccagaacaaaaagaaatcttg

SEQ ID NO: 6728941 - DNA, 21 bp, Homo sapiens
cccagaacacggcagctgctg

SEQ ID NO: 6728942 - DNA, 18 bp, Homo sapiens
cccagaaccccaactccc

SEQ ID NO: 6728943 - DNA, 24 bp, Homo sapiens
cccagaaccccaactcccagccta

SEQ ID NO: 6728944 - DNA, 23 bp, Homo sapiens
cccagaacgcatgcagggccccc

SEQ ID NO: 6728945 - DNA, 13 bp, Homo sapiens
cccagaacgggcc

SEQ ID NO: 6728946 - DNA, 23 bp, Homo sapiens
cccagaactattctgggggcccg

SEQ ID NO: 6728947 - DNA, 21 bp, Homo sapiens
cccagaactctgcctgccctt

SEQ ID NO: 6728948 - DNA, 17 bp, Homo sapiens
cccagaactgcccccac

SEQ ID NO: 6728949 - DNA, 20 bp, Homo sapiens
cccagaactggactcaggat

SEQ ID NO: 6728950 - DNA, 19 bp, Homo sapiens
cccagaactggctgggccc

SEQ ID NO: 6728951 - DNA, 20 bp, Homo sapiens
cccagaactggctgggcccc

SEQ ID NO: 6728952 - DNA, 16 bp, Homo sapiens
cccagaagaaaattct

SEQ ID NO: 6728953 - DNA, 20 bp, Homo sapiens
cccagaaggaacccggtccc

SEQ ID NO: 6728954 - DNA, 13 bp, Homo sapiens
cccagaaggccag

SEQ ID NO: 6728955 - DNA, 13 bp, Homo sapiens
cccagaaggctgg

SEQ ID NO: 6728956 - DNA, 12 bp, Homo sapiens
cccagaagggag

SEQ ID NO: 6728957 - DNA, 15 bp, Homo sapiens
cccagaagggagttg

SEQ ID NO: 6728958 - DNA, 22 bp, Homo sapiens
cccagaataaactggcagctca

SEQ ID NO: 6728959 - DNA, 19 bp, Homo sapiens
cccagaatccataaatgtg

SEQ ID NO: 6728960 - DNA, 20 bp, Homo sapiens
cccagaatcccagccggcca

SEQ ID NO: 6728961 - DNA, 18 bp, Homo sapiens
cccagaatcccctgggga

SEQ ID NO: 6728962 - DNA, 18 bp, Homo sapiens
cccagaatccctctaacc

SEQ ID NO: 6728963 - DNA, 21 bp, Homo sapiens
cccagaatccctctaacccct

SEQ ID NO: 6728964 - DNA, 16 bp, Homo sapiens
cccagaatgaggctgc

SEQ ID NO: 6728965 - DNA, 17 bp, Homo sapiens
cccagaatggagcctgc

SEQ ID NO: 6728966 - DNA, 18 bp, Homo sapiens
cccagaatgtagcatctg

SEQ ID NO: 6728967 - DNA, 18 bp, Homo sapiens
cccagaatgtcagattcc

SEQ ID NO: 6728968 - DNA, 11 bp, Homo sapiens
cccagaattca

SEQ ID NO: 6728969 - DNA, 22 bp, Homo sapiens
cccagaatttaccatcatctct

SEQ ID NO: 6728970 - DNA, 15 bp, Homo sapiens
cccagaatttcatac

SEQ ID NO: 6728971 - DNA, 16 bp, Homo sapiens
cccagacaacagccca

SEQ ID NO: 6728972 - DNA, 20 bp, Homo sapiens
cccagacaacagcccaggca

SEQ ID NO: 6728973 - DNA, 14 bp, Homo sapiens
cccagacaaccaaa

SEQ ID NO: 6728974 - DNA, 19 bp, Homo sapiens
cccagacacaccccccagt

SEQ ID NO: 6728975 - DNA, 15 bp, Homo sapiens
cccagacacagaaga

SEQ ID NO: 6728976 - DNA, 19 bp, Homo sapiens
cccagacacagactggcaa

SEQ ID NO: 6728977 - DNA, 19 bp, Homo sapiens
cccagacagcaaggtgtgg

SEQ ID NO: 6728978 - DNA, 20 bp, Homo sapiens
cccagacagcagtgtgaggg

SEQ ID NO: 6728979 - DNA, 14 bp, Homo sapiens
cccagacagcctgt

SEQ ID NO: 6728980 - DNA, 20 bp, Homo sapiens
cccagacagctccctctgcc

SEQ ID NO: 6728981 - DNA, 15 bp, Homo sapiens
cccagacagctgctc

SEQ ID NO: 6728982 - DNA, 14 bp, Homo sapiens
cccagacaggccct

SEQ ID NO: 6728983 - DNA, 20 bp, Homo sapiens
cccagacaggccctccctgt

SEQ ID NO: 6728984 - DNA, 14 bp, Homo sapiens
cccagacagggctc

SEQ ID NO: 6728985 - DNA, 22 bp, Homo sapiens
cccagacagggctccagcctgt

SEQ ID NO: 6728986 - DNA, 20 bp, Homo sapiens
cccagacagggtgggcttcc

SEQ ID NO: 6728987 - DNA, 22 bp, Homo sapiens
cccagacagggtgggcttcctg

SEQ ID NO: 6728988 - DNA, 19 bp, Homo sapiens
cccagacagttcttttcta

SEQ ID NO: 6728989 - DNA, 17 bp, Homo sapiens
cccagacataaaggaaa

SEQ ID NO: 6728990 - DNA, 19 bp, Homo sapiens
cccagacataaaggaaaag

SEQ ID NO: 6728991 - DNA, 14 bp, Homo sapiens
cccagacatgctgc

SEQ ID NO: 6728992 - DNA, 15 bp, Homo sapiens
cccagacatgctgcc

SEQ ID NO: 6728993 - DNA, 16 bp, Homo sapiens
cccagacatgctgccc

SEQ ID NO: 6728994 - DNA, 18 bp, Homo sapiens
cccagacatgctgcccac

SEQ ID NO: 6728995 - DNA, 17 bp, Homo sapiens
cccagaccaaccctggg

SEQ ID NO: 6728996 - DNA, 19 bp, Homo sapiens
cccagaccaaccctgggac

SEQ ID NO: 6728997 - DNA, 13 bp, Homo sapiens
cccagaccactgt

SEQ ID NO: 6728998 - DNA, 19 bp, Homo sapiens
cccagaccaggaaaggctt

SEQ ID NO: 6728999 - DNA, 18 bp, Homo sapiens
cccagaccagtagtgacc

SEQ ID NO: 6729000 - DNA, 15 bp, Homo sapiens
cccagacccagaggt

SEQ ID NO: 6729001 - DNA, 16 bp, Homo sapiens
cccagacccagaggtc

SEQ ID NO: 6729002 - DNA, 18 bp, Homo sapiens
cccagacccagaggtcca

SEQ ID NO: 6729003 - DNA, 16 bp, Homo sapiens
cccagaccccagggca

SEQ ID NO: 6729004 - DNA, 22 bp, Homo sapiens
cccagacccccattctgacatc

SEQ ID NO: 6729005 - DNA, 17 bp, Homo sapiens
cccagacccccttgccc

SEQ ID NO: 6729006 - DNA, 13 bp, Homo sapiens
cccagaccccgac

SEQ ID NO: 6729007 - DNA, 13 bp, Homo sapiens
cccagaccccgca

SEQ ID NO: 6729008 - DNA, 22 bp, Homo sapiens
cccagaccccgcagcacgcctc

SEQ ID NO: 6729009 - DNA, 14 bp, Homo sapiens
cccagaccccgccc

SEQ ID NO: 6729010 - DNA, 21 bp, Homo sapiens
cccagaccccgcccctgggga

SEQ ID NO: 6729011 - DNA, 20 bp, Homo sapiens
cccagacccttcttgcctgc

SEQ ID NO: 6729012 - DNA, 22 bp, Homo sapiens
cccagacccttcttgcctgctg

SEQ ID NO: 6729013 - DNA, 14 bp, Homo sapiens
cccagaccgctggc

SEQ ID NO: 6729014 - DNA, 23 bp, Homo sapiens
cccagacctcccctcttcctgga

SEQ ID NO: 6729015 - DNA, 17 bp, Homo sapiens
cccagacctgcgaagga

SEQ ID NO: 6729016 - DNA, 20 bp, Homo sapiens
cccagacctgcgaaggatga

SEQ ID NO: 6729017 - DNA, 16 bp, Homo sapiens
cccagacctggcctct

SEQ ID NO: 6729018 - DNA, 18 bp, Homo sapiens
cccagacctggcctctgc

SEQ ID NO: 6729019 - DNA, 21 bp, Homo sapiens
cccagacctggcctctgccat

SEQ ID NO: 6729020 - DNA, 22 bp, Homo sapiens
cccagacctgttagcagacagg

SEQ ID NO: 6729021 - DNA, 18 bp, Homo sapiens
cccagacgcatagactga

SEQ ID NO: 6729022 - DNA, 15 bp, Homo sapiens
cccagactacagggc

SEQ ID NO: 6729023 - DNA, 20 bp, Homo sapiens
cccagactagatgtagtatt

SEQ ID NO: 6729024 - DNA, 12 bp, Homo sapiens
cccagactcaga

SEQ ID NO: 6729025 - DNA, 13 bp, Homo sapiens
cccagactcagac

SEQ ID NO: 6729026 - DNA, 16 bp, Homo sapiens
cccagactcagctcca

SEQ ID NO: 6729027 - DNA, 19 bp, Homo sapiens
cccagactccaggcccccg

SEQ ID NO: 6729028 - DNA, 13 bp, Homo sapiens
cccagactctcag

SEQ ID NO: 6729029 - DNA, 13 bp, Homo sapiens
cccagactctttt

SEQ ID NO: 6729030 - DNA, 16 bp, Homo sapiens
cccagactgagctctc

SEQ ID NO: 6729031 - DNA, 23 bp, Homo sapiens
cccagactgagctctccaggcca

SEQ ID NO: 6729032 - DNA, 13 bp, Homo sapiens
cccagactgatga

SEQ ID NO: 6729033 - DNA, 13 bp, Homo sapiens
cccagactgggcc

SEQ ID NO: 6729034 - DNA, 18 bp, Homo sapiens
cccagactgggcccaggc

SEQ ID NO: 6729035 - DNA, 22 bp, Homo sapiens
cccagactgggcccaggcaggt

SEQ ID NO: 6729036 - DNA, 21 bp, Homo sapiens
cccagactgtagagattttta

SEQ ID NO: 6729037 - DNA, 21 bp, Homo sapiens
cccagactgtctccacggcct

SEQ ID NO: 6729038 - DNA, 15 bp, Homo sapiens
cccagacttgtttcc

SEQ ID NO: 6729039 - DNA, 20 bp, Homo sapiens
cccagacttgtttcctgtgc

SEQ ID NO: 6729040 - DNA, 22 bp, Homo sapiens
cccagagaaaggggagcccact

SEQ ID NO: 6729041 - DNA, 21 bp, Homo sapiens
cccagagaacaatcactattc

SEQ ID NO: 6729042 - DNA, 22 bp, Homo sapiens
cccagagaacaatcactattct

SEQ ID NO: 6729043 - DNA, 14 bp, Homo sapiens
cccagagaagcccc

SEQ ID NO: 6729044 - DNA, 18 bp, Homo sapiens
cccagagaagcctcagtc

SEQ ID NO: 6729045 - DNA, 23 bp, Homo sapiens
cccagagacacggtcccaccatg

SEQ ID NO: 6729046 - DNA, 14 bp, Homo sapiens
cccagagacaggaa

SEQ ID NO: 6729047 - DNA, 23 bp, Homo sapiens
cccagagacatacttgaagggcc

SEQ ID NO: 6729048 - DNA, 15 bp, Homo sapiens
cccagagacccagcg

SEQ ID NO: 6729049 - DNA, 21 bp, Homo sapiens
cccagagaccccttcctttcc

SEQ ID NO: 6729050 - DNA, 11 bp, Homo sapiens
cccagagacct

SEQ ID NO: 6729051 - DNA, 19 bp, Homo sapiens
cccagagacctttgcccac

SEQ ID NO: 6729052 - DNA, 15 bp, Homo sapiens
cccagagactgccca

SEQ ID NO: 6729053 - DNA, 16 bp, Homo sapiens
cccagagactgcccac

SEQ ID NO: 6729054 - DNA, 18 bp, Homo sapiens
cccagagactgcccaccc

SEQ ID NO: 6729055 - DNA, 11 bp, Homo sapiens
cccagagactt

SEQ ID NO: 6729056 - DNA, 21 bp, Homo sapiens
cccagagactttgtagatcct

SEQ ID NO: 6729057 - DNA, 11 bp, Homo sapiens
cccagagagaa

SEQ ID NO: 6729058 - DNA, 14 bp, Homo sapiens
cccagagagaccct

SEQ ID NO: 6729059 - DNA, 18 bp, Homo sapiens
cccagagagaccctgcaa

SEQ ID NO: 6729060 - DNA, 18 bp, Homo sapiens
cccagagagaccctgcca

SEQ ID NO: 6729061 - DNA, 14 bp, Homo sapiens
cccagagagaggag

SEQ ID NO: 6729062 - DNA, 19 bp, Homo sapiens
cccagagagaggggcctgc

SEQ ID NO: 6729063 - DNA, 16 bp, Homo sapiens
cccagagagcaggcag

SEQ ID NO: 6729064 - DNA, 15 bp, Homo sapiens
cccagagagcccgag

SEQ ID NO: 6729065 - DNA, 21 bp, Homo sapiens
cccagagagctgaagtactgc

SEQ ID NO: 6729066 - DNA, 15 bp, Homo sapiens
cccagagaggaatca

SEQ ID NO: 6729067 - DNA, 19 bp, Homo sapiens
cccagagaggaatcagact

SEQ ID NO: 6729068 - DNA, 21 bp, Homo sapiens
cccagagaggaatcagacttc

SEQ ID NO: 6729069 - DNA, 21 bp, Homo sapiens
cccagagaggggacatttccc

SEQ ID NO: 6729070 - DNA, 23 bp, Homo sapiens
cccagagaggggacatttccctc

SEQ ID NO: 6729071 - DNA, 21 bp, Homo sapiens
cccagagatgccagcccttca

SEQ ID NO: 6729072 - DNA, 19 bp, Homo sapiens
cccagagatgcctccaccg

SEQ ID NO: 6729073 - DNA, 23 bp, Homo sapiens
cccagagatgcctccaccgctgc

SEQ ID NO: 6729074 - DNA, 16 bp, Homo sapiens
cccagagatgcctgat

SEQ ID NO: 6729075 - DNA, 20 bp, Homo sapiens
cccagagatggctccttggg

SEQ ID NO: 6729076 - DNA, 17 bp, Homo sapiens
cccagagattcccaagc

SEQ ID NO: 6729077 - DNA, 22 bp, Homo sapiens
cccagagattgcttctcatccc

SEQ ID NO: 6729078 - DNA, 22 bp, Homo sapiens
cccagagcacaagaaggccagc

SEQ ID NO: 6729079 - DNA, 14 bp, Homo sapiens
cccagagcaccccc

SEQ ID NO: 6729080 - DNA, 16 bp, Homo sapiens
cccagagcacccccaa

SEQ ID NO: 6729081 - DNA, 19 bp, Homo sapiens
cccagagcaccccctgctc

SEQ ID NO: 6729082 - DNA, 12 bp, Homo sapiens
cccagagcactg

SEQ ID NO: 6729083 - DNA, 13 bp, Homo sapiens
cccagagcacttt

SEQ ID NO: 6729084 - DNA, 15 bp, Homo sapiens
cccagagcatctgcc

SEQ ID NO: 6729085 - DNA, 16 bp, Homo sapiens
cccagagccacacatg

SEQ ID NO: 6729086 - DNA, 17 bp, Homo sapiens
cccagagccacacatgg

SEQ ID NO: 6729087 - DNA, 19 bp, Homo sapiens
cccagagccacacatgggc

SEQ ID NO: 6729088 - DNA, 21 bp, Homo sapiens
cccagagccacacatgggcat

SEQ ID NO: 6729089 - DNA, 16 bp, Homo sapiens
cccagagccacctgga

SEQ ID NO: 6729090 - DNA, 18 bp, Homo sapiens
cccagagccactaccttt

SEQ ID NO: 6729091 - DNA, 12 bp, Homo sapiens
cccagagcccag

SEQ ID NO: 6729092 - DNA, 14 bp, Homo sapiens
cccagagcccagct

SEQ ID NO: 6729093 - DNA, 16 bp, Homo sapiens
cccagagcccagctcc

SEQ ID NO: 6729094 - DNA, 16 bp, Homo sapiens
cccagagcccagctct

SEQ ID NO: 6729095 - DNA, 19 bp, Homo sapiens
cccagagcccagctcttgc

SEQ ID NO: 6729096 - DNA, 15 bp, Homo sapiens
cccagagcccaggct

SEQ ID NO: 6729097 - DNA, 16 bp, Homo sapiens
cccagagcccaggctc

SEQ ID NO: 6729098 - DNA, 19 bp, Homo sapiens
cccagagcccaggctcggc

SEQ ID NO: 6729099 - DNA, 14 bp, Homo sapiens
cccagagccccact

SEQ ID NO: 6729100 - DNA, 16 bp, Homo sapiens
cccagagcccctcctc

SEQ ID NO: 6729101 - DNA, 19 bp, Homo sapiens
cccagagcccgcttttgtt

SEQ ID NO: 6729102 - DNA, 17 bp, Homo sapiens
cccagagccctctgagc

SEQ ID NO: 6729103 - DNA, 18 bp, Homo sapiens
cccagagccctctgagcc

SEQ ID NO: 6729104 - DNA, 22 bp, Homo sapiens
cccagagcccttgactgtacag

SEQ ID NO: 6729105 - DNA, 20 bp, Homo sapiens
cccagagccttctcctgcct

SEQ ID NO: 6729106 - DNA, 9 bp, Homo sapiens
cccagagct

SEQ ID NO: 6729107 - DNA, 15 bp, Homo sapiens
cccagagctgcctgc

SEQ ID NO: 6729108 - DNA, 13 bp, Homo sapiens
cccagagctggcc

SEQ ID NO: 6729109 - DNA, 15 bp, Homo sapiens
cccagagctggcctc

SEQ ID NO: 6729110 - DNA, 16 bp, Homo sapiens
cccagagctggcctcc

SEQ ID NO: 6729111 - DNA, 20 bp, Homo sapiens
cccagagctggcgctcagca

SEQ ID NO: 6729112 - DNA, 20 bp, Homo sapiens
cccagagctggtggacccag

SEQ ID NO: 6729113 - DNA, 23 bp, Homo sapiens
cccagagctggtggacccaggga

SEQ ID NO: 6729114 - DNA, 14 bp, Homo sapiens
cccagagctgtgcc

SEQ ID NO: 6729115 - DNA, 22 bp, Homo sapiens
cccagagcttattggccactgg

SEQ ID NO: 6729116 - DNA, 23 bp, Homo sapiens
cccagagcttattggccactggg

SEQ ID NO: 6729117 - DNA, 22 bp, Homo sapiens
cccagagctttcctccgccttt

SEQ ID NO: 6729118 - DNA, 22 bp, Homo sapiens
cccagaggaaggggccagaggc

SEQ ID NO: 6729119 - DNA, 24 bp, Homo sapiens
cccagaggaaggggccagaggctc

SEQ ID NO: 6729120 - DNA, 16 bp, Homo sapiens
cccagaggagaggaga

SEQ ID NO: 6729121 - DNA, 23 bp, Homo sapiens
cccagaggagaggagacagacac

SEQ ID NO: 6729122 - DNA, 18 bp, Homo sapiens
cccagaggagcccagcgg

SEQ ID NO: 6729123 - DNA, 20 bp, Homo sapiens
cccagaggagctgggagccg

SEQ ID NO: 6729124 - DNA, 15 bp, Homo sapiens
cccagaggagggcag

SEQ ID NO: 6729125 - DNA, 16 bp, Homo sapiens
cccagaggattgctgc

SEQ ID NO: 6729126 - DNA, 16 bp, Homo sapiens
cccagaggcacagccg

SEQ ID NO: 6729127 - DNA, 22 bp, Homo sapiens
cccagaggccaggaatctgcca

SEQ ID NO: 6729128 - DNA, 12 bp, Homo sapiens
cccagaggccct

SEQ ID NO: 6729129 - DNA, 15 bp, Homo sapiens
cccagaggccctgaa

SEQ ID NO: 6729130 - DNA, 19 bp, Homo sapiens
cccagaggccctgaagcct

SEQ ID NO: 6729131 - DNA, 15 bp, Homo sapiens
cccagaggccctgga

SEQ ID NO: 6729132 - DNA, 18 bp, Homo sapiens
cccagaggccgctgcccc

SEQ ID NO: 6729133 - DNA, 22 bp, Homo sapiens
cccagaggccgctgcccctgag

SEQ ID NO: 6729134 - DNA, 23 bp, Homo sapiens
cccagaggcgtcccgcacctgtc

SEQ ID NO: 6729135 - DNA, 14 bp, Homo sapiens
cccagaggctccca

SEQ ID NO: 6729136 - DNA, 23 bp, Homo sapiens
cccagaggctcccaatcagcttt

SEQ ID NO: 6729137 - DNA, 12 bp, Homo sapiens
cccagagggacc

SEQ ID NO: 6729138 - DNA, 13 bp, Homo sapiens
cccagagggagca

SEQ ID NO: 6729139 - DNA, 13 bp, Homo sapiens
cccagagggccca

SEQ ID NO: 6729140 - DNA, 16 bp, Homo sapiens
cccagagggcccaggc

SEQ ID NO: 6729141 - DNA, 14 bp, Homo sapiens
cccagagggcctgc

SEQ ID NO: 6729142 - DNA, 15 bp, Homo sapiens
cccagagggcctgca

SEQ ID NO: 6729143 - DNA, 20 bp, Homo sapiens
cccagagggcctgcaaggga

SEQ ID NO: 6729144 - DNA, 23 bp, Homo sapiens
cccagaggggaatgagggctgag

SEQ ID NO: 6729145 - DNA, 13 bp, Homo sapiens
cccagaggggcct

SEQ ID NO: 6729146 - DNA, 18 bp, Homo sapiens
cccagaggggcctgccac

SEQ ID NO: 6729147 - DNA, 21 bp, Homo sapiens
cccagaggggcctgccacctg

SEQ ID NO: 6729148 - DNA, 23 bp, Homo sapiens
cccagaggggcggggccaggatg

SEQ ID NO: 6729149 - DNA, 18 bp, Homo sapiens
cccagagggttgctggtc

SEQ ID NO: 6729150 - DNA, 22 bp, Homo sapiens
cccagaggtaacagaacagctt

SEQ ID NO: 6729151 - DNA, 23 bp, Homo sapiens
cccagaggtaacagaacagcttc

SEQ ID NO: 6729152 - DNA, 13 bp, Homo sapiens
cccagaggtccag

SEQ ID NO: 6729153 - DNA, 15 bp, Homo sapiens
cccagaggtccagcc

SEQ ID NO: 6729154 - DNA, 18 bp, Homo sapiens
cccagaggtccagcccat

SEQ ID NO: 6729155 - DNA, 19 bp, Homo sapiens
cccagaggtccagcccatc

SEQ ID NO: 6729156 - DNA, 17 bp, Homo sapiens
cccagaggtcgcagcta

SEQ ID NO: 6729157 - DNA, 23 bp, Homo sapiens
cccagaggtctcatctcccaggc

SEQ ID NO: 6729158 - DNA, 15 bp, Homo sapiens
cccagaggtctccct

SEQ ID NO: 6729159 - DNA, 22 bp, Homo sapiens
cccagaggtggatactgggggg

SEQ ID NO: 6729160 - DNA, 15 bp, Homo sapiens
cccagaggtggccct

SEQ ID NO: 6729161 - DNA, 17 bp, Homo sapiens
cccagaggtggcccttg

SEQ ID NO: 6729162 - DNA, 20 bp, Homo sapiens
cccagaggtgggatcctccc

SEQ ID NO: 6729163 - DNA, 15 bp, Homo sapiens
cccagaggtggggaa

SEQ ID NO: 6729164 - DNA, 22 bp, Homo sapiens
cccagaggtggggaagagagcc

SEQ ID NO: 6729165 - DNA, 21 bp, Homo sapiens
cccagaggttatctgcctggc

SEQ ID NO: 6729166 - DNA, 22 bp, Homo sapiens
cccagaggttatctgcctggcc

SEQ ID NO: 6729167 - DNA, 22 bp, Homo sapiens
cccagagtagagccaggtgctt

SEQ ID NO: 6729168 - DNA, 21 bp, Homo sapiens
cccagagtatgggcactcagg

SEQ ID NO: 6729169 - DNA, 13 bp, Homo sapiens
cccagagtcagag

SEQ ID NO: 6729170 - DNA, 20 bp, Homo sapiens
cccagagtcagaggagaaga

SEQ ID NO: 6729171 - DNA, 15 bp, Homo sapiens
cccagagtcccccca

SEQ ID NO: 6729172 - DNA, 21 bp, Homo sapiens
cccagagtgactgacggctgt

SEQ ID NO: 6729173 - DNA, 14 bp, Homo sapiens
cccagagtgctgtc

SEQ ID NO: 6729174 - DNA, 22 bp, Homo sapiens
cccagagtgctgtcgggaccac

SEQ ID NO: 6729175 - DNA, 17 bp, Homo sapiens
cccagagtggagtctga

SEQ ID NO: 6729176 - DNA, 15 bp, Homo sapiens
cccagagtggcccac

SEQ ID NO: 6729177 - DNA, 14 bp, Homo sapiens
cccagagtgggaga

SEQ ID NO: 6729178 - DNA, 16 bp, Homo sapiens
cccagataaggcttta

SEQ ID NO: 6729179 - DNA, 14 bp, Homo sapiens
cccagataccagcc

SEQ ID NO: 6729180 - DNA, 17 bp, Homo sapiens
cccagatacctgtgagg

SEQ ID NO: 6729181 - DNA, 15 bp, Homo sapiens
cccagatagagctgg

SEQ ID NO: 6729182 - DNA, 19 bp, Homo sapiens
cccagatagagctgggtgg

SEQ ID NO: 6729183 - DNA, 16 bp, Homo sapiens
cccagatagtcccagc

SEQ ID NO: 6729184 - DNA, 17 bp, Homo sapiens
cccagatagtcccagca

SEQ ID NO: 6729185 - DNA, 18 bp, Homo sapiens
cccagatatggaaacaga

SEQ ID NO: 6729186 - DNA, 16 bp, Homo sapiens
cccagatcaggaacca

SEQ ID NO: 6729187 - DNA, 21 bp, Homo sapiens
cccagatcaggaaccagggcc

SEQ ID NO: 6729188 - DNA, 20 bp, Homo sapiens
cccagatcatgttttggtga

SEQ ID NO: 6729189 - DNA, 11 bp, Homo sapiens
cccagatccag

SEQ ID NO: 6729190 - DNA, 19 bp, Homo sapiens
cccagatccaggaacacat

SEQ ID NO: 6729191 - DNA, 17 bp, Homo sapiens
cccagatcccaagagat

SEQ ID NO: 6729192 - DNA, 21 bp, Homo sapiens
cccagatcctctgctgactcc

SEQ ID NO: 6729193 - DNA, 14 bp, Homo sapiens
cccagatcctggaa

SEQ ID NO: 6729194 - DNA, 20 bp, Homo sapiens
cccagatcgctcccttggct

SEQ ID NO: 6729195 - DNA, 12 bp, Homo sapiens
cccagatctcat

SEQ ID NO: 6729196 - DNA, 17 bp, Homo sapiens
cccagatctcccactgc

SEQ ID NO: 6729197 - DNA, 13 bp, Homo sapiens
cccagatctgcct

SEQ ID NO: 6729198 - DNA, 15 bp, Homo sapiens
cccagatctgcctgg

SEQ ID NO: 6729199 - DNA, 20 bp, Homo sapiens
cccagatctgcctgggcctg

SEQ ID NO: 6729200 - DNA, 18 bp, Homo sapiens
cccagatctggtcccttg

SEQ ID NO: 6729201 - DNA, 20 bp, Homo sapiens
cccagatctggtcccttgca

SEQ ID NO: 6729202 - DNA, 19 bp, Homo sapiens
cccagatctgtcctggggg

SEQ ID NO: 6729203 - DNA, 21 bp, Homo sapiens
cccagatgcctcctctgtcct

SEQ ID NO: 6729204 - DNA, 15 bp, Homo sapiens
cccagatgctgggga

SEQ ID NO: 6729205 - DNA, 18 bp, Homo sapiens
cccagatggccctggaca

SEQ ID NO: 6729206 - DNA, 19 bp, Homo sapiens
cccagatggccctggacag

SEQ ID NO: 6729207 - DNA, 16 bp, Homo sapiens
cccagatggctccctg

SEQ ID NO: 6729208 - DNA, 20 bp, Homo sapiens
cccagatggctccctgggct

SEQ ID NO: 6729209 - DNA, 22 bp, Homo sapiens
cccagatggctccctgggctgg

SEQ ID NO: 6729210 - DNA, 15 bp, Homo sapiens
cccagatgtaaagaa

SEQ ID NO: 6729211 - DNA, 23 bp, Homo sapiens
cccagatgttgcttttgaaaagt

SEQ ID NO: 6729212 - DNA, 21 bp, Homo sapiens
cccagatgttttacgtctggg

SEQ ID NO: 6729213 - DNA, 22 bp, Homo sapiens
cccagatgttttacgtctggga

SEQ ID NO: 6729214 - DNA, 21 bp, Homo sapiens
cccagatgttttagagataaa

SEQ ID NO: 6729215 - DNA, 12 bp, Homo sapiens
cccagattccca

SEQ ID NO: 6729216 - DNA, 21 bp, Homo sapiens
cccagattgcaacaggctggg

SEQ ID NO: 6729217 - DNA, 20 bp, Homo sapiens
cccagattggctcacactga

SEQ ID NO: 6729218 - DNA, 23 bp, Homo sapiens
cccagattgtgtacatagagcaa

SEQ ID NO: 6729219 - DNA, 21 bp, Homo sapiens
cccagattttatttatatctt

SEQ ID NO: 6729220 - DNA, 23 bp, Homo sapiens
cccagcaaagcccccagagccca

SEQ ID NO: 6729221 - DNA, 22 bp, Homo sapiens
cccagcaacacaagctggaagc

SEQ ID NO: 6729222 - DNA, 17 bp, Homo sapiens
cccagcaacgcccctcc

SEQ ID NO: 6729223 - DNA, 23 bp, Homo sapiens
cccagcaacgcccctccaaacct

SEQ ID NO: 6729224 - DNA, 20 bp, Homo sapiens
cccagcaagagcacaagagg

SEQ ID NO: 6729225 - DNA, 14 bp, Homo sapiens
cccagcaaggcaga

SEQ ID NO: 6729226 - DNA, 19 bp, Homo sapiens
cccagcaagtgagagctgg

SEQ ID NO: 6729227 - DNA, 20 bp, Homo sapiens
cccagcaagtgagagctggg

SEQ ID NO: 6729228 - DNA, 23 bp, Homo sapiens
cccagcaagtgagagctgggtgt

SEQ ID NO: 6729229 - DNA, 17 bp, Homo sapiens
cccagcacaattcattg

SEQ ID NO: 6729230 - DNA, 14 bp, Homo sapiens
cccagcacactgct

SEQ ID NO: 6729231 - DNA, 14 bp, Homo sapiens
cccagcacagccac

SEQ ID NO: 6729232 - DNA, 21 bp, Homo sapiens
cccagcacagctcctcccctg

SEQ ID NO: 6729233 - DNA, 19 bp, Homo sapiens
cccagcacagcttgacctg

SEQ ID NO: 6729234 - DNA, 16 bp, Homo sapiens
cccagcacaggcacct

SEQ ID NO: 6729235 - DNA, 22 bp, Homo sapiens
cccagcacagggggattctgag

SEQ ID NO: 6729236 - DNA, 18 bp, Homo sapiens
cccagcacatgaaacctt

SEQ ID NO: 6729237 - DNA, 16 bp, Homo sapiens
cccagcacatggccat

SEQ ID NO: 6729238 - DNA, 19 bp, Homo sapiens
cccagcacatggccataga

SEQ ID NO: 6729239 - DNA, 23 bp, Homo sapiens
cccagcacatggccatagaggcc

SEQ ID NO: 6729240 - DNA, 19 bp, Homo sapiens
cccagcacatgtgctgccc

SEQ ID NO: 6729241 - DNA, 17 bp, Homo sapiens
cccagcaccaccaggtc

SEQ ID NO: 6729242 - DNA, 18 bp, Homo sapiens
cccagcaccaccaggtct

SEQ ID NO: 6729243 - DNA, 15 bp, Homo sapiens
cccagcacccagcaa

SEQ ID NO: 6729244 - DNA, 15 bp, Homo sapiens
cccagcacccatgcc

SEQ ID NO: 6729245 - DNA, 21 bp, Homo sapiens
cccagcacccatgccccactc

SEQ ID NO: 6729246 - DNA, 21 bp, Homo sapiens
cccagcaccccctctcctgga

SEQ ID NO: 6729247 - DNA, 19 bp, Homo sapiens
cccagcacccgggctcagg

SEQ ID NO: 6729248 - DNA, 14 bp, Homo sapiens
cccagcaccctctg

SEQ ID NO: 6729249 - DNA, 22 bp, Homo sapiens
cccagcacctcagcctgcacag

SEQ ID NO: 6729250 - DNA, 13 bp, Homo sapiens
cccagcacctgcc

SEQ ID NO: 6729251 - DNA, 14 bp, Homo sapiens
cccagcacctgcca

SEQ ID NO: 6729252 - DNA, 15 bp, Homo sapiens
cccagcacctgccag

SEQ ID NO: 6729253 - DNA, 21 bp, Homo sapiens
cccagcacctgccagggcccg

SEQ ID NO: 6729254 - DNA, 13 bp, Homo sapiens
cccagcacctgct

SEQ ID NO: 6729255 - DNA, 23 bp, Homo sapiens
cccagcaccttgcagattttctt

SEQ ID NO: 6729256 - DNA, 21 bp, Homo sapiens
cccagcactaaggccgtgtct

SEQ ID NO: 6729257 - DNA, 12 bp, Homo sapiens
cccagcactccc

SEQ ID NO: 6729258 - DNA, 14 bp, Homo sapiens
cccagcactcccct

SEQ ID NO: 6729259 - DNA, 20 bp, Homo sapiens
cccagcactccccttgcctt

SEQ ID NO: 6729260 - DNA, 22 bp, Homo sapiens
cccagcactccccttgccttcc

SEQ ID NO: 6729261 - DNA, 12 bp, Homo sapiens
cccagcactcct

SEQ ID NO: 6729262 - DNA, 14 bp, Homo sapiens
cccagcactgagga

SEQ ID NO: 6729263 - DNA, 15 bp, Homo sapiens
cccagcactgaggaa

SEQ ID NO: 6729264 - DNA, 16 bp, Homo sapiens
cccagcactgcctcct

SEQ ID NO: 6729265 - DNA, 12 bp, Homo sapiens
cccagcactgtg

SEQ ID NO: 6729266 - DNA, 16 bp, Homo sapiens
cccagcacttggagag

SEQ ID NO: 6729267 - DNA, 23 bp, Homo sapiens
cccagcactttgagaggctgagg

SEQ ID NO: 6729268 - DNA, 18 bp, Homo sapiens
cccagcactttgggaagc

SEQ ID NO: 6729269 - DNA, 18 bp, Homo sapiens
cccagcactttgggaggc

SEQ ID NO: 6729270 - DNA, 22 bp, Homo sapiens
cccagcactttgggaggcaggg

SEQ ID NO: 6729271 - DNA, 20 bp, Homo sapiens
cccagcactttgggaggcca

SEQ ID NO: 6729272 - DNA, 23 bp, Homo sapiens
cccagcactttgggaggccgagg

SEQ ID NO: 6729273 - DNA, 23 bp, Homo sapiens
cccagcactttgggaggctgaag

SEQ ID NO: 6729274 - DNA, 23 bp, Homo sapiens
cccagcacttttggaggccaagg

SEQ ID NO: 6729275 - DNA, 18 bp, Homo sapiens
cccagcagacatcctcat

SEQ ID NO: 6729276 - DNA, 13 bp, Homo sapiens
cccagcagagccc

SEQ ID NO: 6729277 - DNA, 14 bp, Homo sapiens
cccagcagagccca

SEQ ID NO: 6729278 - DNA, 23 bp, Homo sapiens
cccagcagagcccaccagccagc

SEQ ID NO: 6729279 - DNA, 20 bp, Homo sapiens
cccagcagagccgttcctgg

SEQ ID NO: 6729280 - DNA, 19 bp, Homo sapiens
cccagcagaggcaggctgg

SEQ ID NO: 6729281 - DNA, 19 bp, Homo sapiens
cccagcagatctcatgtcc

SEQ ID NO: 6729282 - DNA, 13 bp, Homo sapiens
cccagcagcagag

SEQ ID NO: 6729283 - DNA, 22 bp, Homo sapiens
cccagcagccctaaggatctct

SEQ ID NO: 6729284 - DNA, 14 bp, Homo sapiens
cccagcagcctgcc

SEQ ID NO: 6729285 - DNA, 15 bp, Homo sapiens
cccagcagcctgcca

SEQ ID NO: 6729286 - DNA, 18 bp, Homo sapiens
cccagcagcggcccagat

SEQ ID NO: 6729287 - DNA, 12 bp, Homo sapiens
cccagcagctca

SEQ ID NO: 6729288 - DNA, 15 bp, Homo sapiens
cccagcagctgccag

SEQ ID NO: 6729289 - DNA, 15 bp, Homo sapiens
cccagcagctgggcc

SEQ ID NO: 6729290 - DNA, 23 bp, Homo sapiens
cccagcagctgggccggccagcc

SEQ ID NO: 6729291 - DNA, 17 bp, Homo sapiens
cccagcagcttggctga

SEQ ID NO: 6729292 - DNA, 13 bp, Homo sapiens
cccagcaggaagc

SEQ ID NO: 6729293 - DNA, 15 bp, Homo sapiens
cccagcaggaagcca

SEQ ID NO: 6729294 - DNA, 20 bp, Homo sapiens
cccagcaggaagccaggctg

SEQ ID NO: 6729295 - DNA, 21 bp, Homo sapiens
cccagcaggaagccaggctga

SEQ ID NO: 6729296 - DNA, 13 bp, Homo sapiens
cccagcaggccca

SEQ ID NO: 6729297 - DNA, 14 bp, Homo sapiens
cccagcaggcccag

SEQ ID NO: 6729298 - DNA, 15 bp, Homo sapiens
cccagcaggcccagc

SEQ ID NO: 6729299 - DNA, 13 bp, Homo sapiens
cccagcaggcggg

SEQ ID NO: 6729300 - DNA, 13 bp, Homo sapiens
cccagcagggcct

SEQ ID NO: 6729301 - DNA, 14 bp, Homo sapiens
cccagcaggggcag

SEQ ID NO: 6729302 - DNA, 21 bp, Homo sapiens
cccagcaggggccctcactct

SEQ ID NO: 6729303 - DNA, 13 bp, Homo sapiens
cccagcagtcctg

SEQ ID NO: 6729304 - DNA, 14 bp, Homo sapiens
cccagcagtcctgg

SEQ ID NO: 6729305 - DNA, 16 bp, Homo sapiens
cccagcagtcctgggc

SEQ ID NO: 6729306 - DNA, 17 bp, Homo sapiens
cccagcagtggcttgct

SEQ ID NO: 6729307 - DNA, 17 bp, Homo sapiens
cccagcagtttcccaga

SEQ ID NO: 6729308 - DNA, 16 bp, Homo sapiens
cccagcagtttgggag

SEQ ID NO: 6729309 - DNA, 17 bp, Homo sapiens
cccagcatatgggggcc

SEQ ID NO: 6729310 - DNA, 19 bp, Homo sapiens
cccagcatcactccccaag

SEQ ID NO: 6729311 - DNA, 15 bp, Homo sapiens
cccagcatccctgga

SEQ ID NO: 6729312 - DNA, 13 bp, Homo sapiens
cccagcatctccc

SEQ ID NO: 6729313 - DNA, 15 bp, Homo sapiens
cccagcatctcccag

SEQ ID NO: 6729314 - DNA, 13 bp, Homo sapiens
cccagcatctctg

SEQ ID NO: 6729315 - DNA, 17 bp, Homo sapiens
cccagcatgcaggtggt

SEQ ID NO: 6729316 - DNA, 22 bp, Homo sapiens
cccagcattccagcccctctgg

SEQ ID NO: 6729317 - DNA, 21 bp, Homo sapiens
cccagcattccagctctgccc

SEQ ID NO: 6729318 - DNA, 19 bp, Homo sapiens
cccagcattctcaggcacc

SEQ ID NO: 6729319 - DNA, 18 bp, Homo sapiens
cccagcattgcagtatgg

SEQ ID NO: 6729320 - DNA, 20 bp, Homo sapiens
cccagcattttactgattca

SEQ ID NO: 6729321 - DNA, 18 bp, Homo sapiens
cccagccaagtgccttcc

SEQ ID NO: 6729322 - DNA, 10 bp, Homo sapiens
cccagccaca

SEQ ID NO: 6729323 - DNA, 11 bp, Homo sapiens
cccagccacag

SEQ ID NO: 6729324 - DNA, 20 bp, Homo sapiens
cccagccaccaccactgtcc

SEQ ID NO: 6729325 - DNA, 23 bp, Homo sapiens
cccagccacccggatctccaggc

SEQ ID NO: 6729326 - DNA, 20 bp, Homo sapiens
cccagccacctcccaaggac

SEQ ID NO: 6729327 - DNA, 18 bp, Homo sapiens
cccagccacgcagggcca

SEQ ID NO: 6729328 - DNA, 10 bp, Homo sapiens
cccagccact

SEQ ID NO: 6729329 - DNA, 15 bp, Homo sapiens
cccagccactccaag

SEQ ID NO: 6729330 - DNA, 14 bp, Homo sapiens
cccagccactcccc

SEQ ID NO: 6729331 - DNA, 15 bp, Homo sapiens
cccagccactcccca

SEQ ID NO: 6729332 - DNA, 12 bp, Homo sapiens
cccagccactgc

SEQ ID NO: 6729333 - DNA, 16 bp, Homo sapiens
cccagccactgcagca

SEQ ID NO: 6729334 - DNA, 22 bp, Homo sapiens
cccagccagagttcctgcggag

SEQ ID NO: 6729335 - DNA, 21 bp, Homo sapiens
cccagccagagtttgcctccc

SEQ ID NO: 6729336 - DNA, 22 bp, Homo sapiens
cccagccagatggactccagcc

SEQ ID NO: 6729337 - DNA, 12 bp, Homo sapiens
cccagccagcca

SEQ ID NO: 6729338 - DNA, 16 bp, Homo sapiens
cccagccagccacccc

SEQ ID NO: 6729339 - DNA, 23 bp, Homo sapiens
cccagccagccacccctgccact

SEQ ID NO: 6729340 - DNA, 22 bp, Homo sapiens
cccagccagccatcggaagaga

SEQ ID NO: 6729341 - DNA, 12 bp, Homo sapiens
cccagccagccc

SEQ ID NO: 6729342 - DNA, 21 bp, Homo sapiens
cccagccagcccttcccaggc

SEQ ID NO: 6729343 - DNA, 23 bp, Homo sapiens
cccagccagcgtcggtctgtgcc

SEQ ID NO: 6729344 - DNA, 17 bp, Homo sapiens
cccagccagctgcaggg

SEQ ID NO: 6729345 - DNA, 18 bp, Homo sapiens
cccagccagctgcagggc

SEQ ID NO: 6729346 - DNA, 15 bp, Homo sapiens
cccagccaggagcag

SEQ ID NO: 6729347 - DNA, 14 bp, Homo sapiens
cccagccaggccaa

SEQ ID NO: 6729348 - DNA, 14 bp, Homo sapiens
cccagccaggccca

SEQ ID NO: 6729349 - DNA, 16 bp, Homo sapiens
cccagccaggcccagc

SEQ ID NO: 6729350 - DNA, 14 bp, Homo sapiens
cccagccaggccct

SEQ ID NO: 6729351 - DNA, 12 bp, Homo sapiens
cccagccaggct

SEQ ID NO: 6729352 - DNA, 18 bp, Homo sapiens
cccagccagggagcttgc

SEQ ID NO: 6729353 - DNA, 16 bp, Homo sapiens
cccagccagggctcaa

SEQ ID NO: 6729354 - DNA, 21 bp, Homo sapiens
cccagccagggctcaatctct

SEQ ID NO: 6729355 - DNA, 22 bp, Homo sapiens
cccagccagggctcaatctctg

SEQ ID NO: 6729356 - DNA, 24 bp, Homo sapiens
cccagccaggggaactcgccacct

SEQ ID NO: 6729357 - DNA, 13 bp, Homo sapiens
cccagccagggtg

SEQ ID NO: 6729358 - DNA, 13 bp, Homo sapiens
cccagccatccag

SEQ ID NO: 6729359 - DNA, 13 bp, Homo sapiens
cccagccatctgc

SEQ ID NO: 6729360 - DNA, 15 bp, Homo sapiens
cccagccatgccagc

SEQ ID NO: 6729361 - DNA, 19 bp, Homo sapiens
cccagccatgcccaggacg

SEQ ID NO: 6729362 - DNA, 16 bp, Homo sapiens
cccagccatggctgga

SEQ ID NO: 6729363 - DNA, 19 bp, Homo sapiens
cccagccatggctggatgt

SEQ ID NO: 6729364 - DNA, 19 bp, Homo sapiens
cccagccattaccatggag

SEQ ID NO: 6729365 - DNA, 22 bp, Homo sapiens
cccagccattaccatggagaca

SEQ ID NO: 6729366 - DNA, 14 bp, Homo sapiens
cccagcccaagcac

SEQ ID NO: 6729367 - DNA, 15 bp, Homo sapiens
cccagcccaagcacg

SEQ ID NO: 6729368 - DNA, 13 bp, Homo sapiens
cccagcccaataa

SEQ ID NO: 6729369 - DNA, 15 bp, Homo sapiens
cccagcccaataaag

SEQ ID NO: 6729370 - DNA, 15 bp, Homo sapiens
cccagcccacagagc

SEQ ID NO: 6729371 - DNA, 17 bp, Homo sapiens
cccagcccacagagcct

SEQ ID NO: 6729372 - DNA, 12 bp, Homo sapiens
cccagcccaccc

SEQ ID NO: 6729373 - DNA, 16 bp, Homo sapiens
cccagcccaccccatg

SEQ ID NO: 6729374 - DNA, 15 bp, Homo sapiens
cccagcccaccctgc

SEQ ID NO: 6729375 - DNA, 15 bp, Homo sapiens
cccagcccacctcaa

SEQ ID NO: 6729376 - DNA, 14 bp, Homo sapiens
cccagcccagacaa

SEQ ID NO: 6729377 - DNA, 15 bp, Homo sapiens
cccagcccagacagc

SEQ ID NO: 6729378 - DNA, 13 bp, Homo sapiens
cccagcccagaga

SEQ ID NO: 6729379 - DNA, 14 bp, Homo sapiens
cccagcccagagac

SEQ ID NO: 6729380 - DNA, 12 bp, Homo sapiens
cccagcccagat

SEQ ID NO: 6729381 - DNA, 21 bp, Homo sapiens
cccagcccagattcccctgtg

SEQ ID NO: 6729382 - DNA, 14 bp, Homo sapiens
cccagcccagcacc

SEQ ID NO: 6729383 - DNA, 15 bp, Homo sapiens
cccagcccagcaccc

SEQ ID NO: 6729384 - DNA, 17 bp, Homo sapiens
cccagcccagcccagct

SEQ ID NO: 6729385 - DNA, 12 bp, Homo sapiens
cccagcccagct

SEQ ID NO: 6729386 - DNA, 13 bp, Homo sapiens
cccagcccagctg

SEQ ID NO: 6729387 - DNA, 16 bp, Homo sapiens
cccagcccagctgctc

SEQ ID NO: 6729388 - DNA, 11 bp, Homo sapiens
cccagcccagg

SEQ ID NO: 6729389 - DNA, 12 bp, Homo sapiens
cccagcccaggc

SEQ ID NO: 6729390 - DNA, 18 bp, Homo sapiens
cccagcccaggcctggtg

SEQ ID NO: 6729391 - DNA, 21 bp, Homo sapiens
cccagcccagggttcccccag

SEQ ID NO: 6729392 - DNA, 16 bp, Homo sapiens
cccagcccatcttgcc

SEQ ID NO: 6729393 - DNA, 21 bp, Homo sapiens
cccagcccatcttgcctccat

SEQ ID NO: 6729394 - DNA, 15 bp, Homo sapiens
cccagccccaactcc

SEQ ID NO: 6729395 - DNA, 16 bp, Homo sapiens
cccagccccaaggggt

SEQ ID NO: 6729396 - DNA, 20 bp, Homo sapiens
cccagccccaaggggtggcc

SEQ ID NO: 6729397 - DNA, 18 bp, Homo sapiens
cccagccccaatccagag

SEQ ID NO: 6729398 - DNA, 13 bp, Homo sapiens
cccagccccaatg

SEQ ID NO: 6729399 - DNA, 17 bp, Homo sapiens
cccagccccaatgaaca

SEQ ID NO: 6729400 - DNA, 16 bp, Homo sapiens
cccagccccactcctc

SEQ ID NO: 6729401 - DNA, 17 bp, Homo sapiens
cccagccccactgccct

SEQ ID NO: 6729402 - DNA, 13 bp, Homo sapiens
cccagccccactt

SEQ ID NO: 6729403 - DNA, 15 bp, Homo sapiens
cccagccccagcccc

SEQ ID NO: 6729404 - DNA, 16 bp, Homo sapiens
cccagccccagcccct

SEQ ID NO: 6729405 - DNA, 18 bp, Homo sapiens
cccagccccatcctctgt

SEQ ID NO: 6729406 - DNA, 20 bp, Homo sapiens
cccagcccccaaccccaaga

SEQ ID NO: 6729407 - DNA, 12 bp, Homo sapiens
cccagcccccac

SEQ ID NO: 6729408 - DNA, 16 bp, Homo sapiens
cccagcccccacagcc

SEQ ID NO: 6729409 - DNA, 17 bp, Homo sapiens
cccagcccccacagccc

SEQ ID NO: 6729410 - DNA, 18 bp, Homo sapiens
cccagcccccacccatgc

SEQ ID NO: 6729411 - DNA, 20 bp, Homo sapiens
cccagcccccacccccgtca

SEQ ID NO: 6729412 - DNA, 22 bp, Homo sapiens
cccagcccccagggcccccctc

SEQ ID NO: 6729413 - DNA, 22 bp, Homo sapiens
cccagcccccccccggagctgc

SEQ ID NO: 6729414 - DNA, 22 bp, Homo sapiens
cccagccccctttgggcccagg

SEQ ID NO: 6729415 - DNA, 19 bp, Homo sapiens
cccagccccgactccagcc

SEQ ID NO: 6729416 - DNA, 22 bp, Homo sapiens
cccagccccgccccgttgtgag

SEQ ID NO: 6729417 - DNA, 15 bp, Homo sapiens
cccagcccctacctt

SEQ ID NO: 6729418 - DNA, 18 bp, Homo sapiens
cccagcccctactgctgt

SEQ ID NO: 6729419 - DNA, 14 bp, Homo sapiens
cccagcccctagaa

SEQ ID NO: 6729420 - DNA, 19 bp, Homo sapiens
cccagcccctagaaaccca

SEQ ID NO: 6729421 - DNA, 14 bp, Homo sapiens
cccagcccctagcc

SEQ ID NO: 6729422 - DNA, 18 bp, Homo sapiens
cccagcccctagcccagg

SEQ ID NO: 6729423 - DNA, 21 bp, Homo sapiens
cccagcccctccagcaccact

SEQ ID NO: 6729424 - DNA, 16 bp, Homo sapiens
cccagcccctccccca

SEQ ID NO: 6729425 - DNA, 16 bp, Homo sapiens
cccagcccctcctccc

SEQ ID NO: 6729426 - DNA, 22 bp, Homo sapiens
cccagcccctcctccccttcct

SEQ ID NO: 6729427 - DNA, 21 bp, Homo sapiens
cccagcccctcctccctcagg

SEQ ID NO: 6729428 - DNA, 23 bp, Homo sapiens
cccagcccctctcccctctctgc

SEQ ID NO: 6729429 - DNA, 20 bp, Homo sapiens
cccagcccctgcccctcatg

SEQ ID NO: 6729430 - DNA, 18 bp, Homo sapiens
cccagccccttcccctgg

SEQ ID NO: 6729431 - DNA, 15 bp, Homo sapiens
cccagccccttctcc

SEQ ID NO: 6729432 - DNA, 18 bp, Homo sapiens
cccagccccttctcccag

SEQ ID NO: 6729433 - DNA, 18 bp, Homo sapiens
cccagccccttctgaccc

SEQ ID NO: 6729434 - DNA, 15 bp, Homo sapiens
cccagccccttttct

SEQ ID NO: 6729435 - DNA, 18 bp, Homo sapiens
cccagcccgcggcctgga

SEQ ID NO: 6729436 - DNA, 20 bp, Homo sapiens
cccagcccggaccttggcag

SEQ ID NO: 6729437 - DNA, 12 bp, Homo sapiens
cccagccctcag

SEQ ID NO: 6729438 - DNA, 13 bp, Homo sapiens
cccagccctcaga

SEQ ID NO: 6729439 - DNA, 15 bp, Homo sapiens
cccagccctcagtca

SEQ ID NO: 6729440 - DNA, 16 bp, Homo sapiens
cccagccctcatcccg

SEQ ID NO: 6729441 - DNA, 18 bp, Homo sapiens
cccagccctccagtacct

SEQ ID NO: 6729442 - DNA, 14 bp, Homo sapiens
cccagccctcccag

SEQ ID NO: 6729443 - DNA, 22 bp, Homo sapiens
cccagccctccccacctgctca

SEQ ID NO: 6729444 - DNA, 21 bp, Homo sapiens
cccagccctcgcctctgcgag

SEQ ID NO: 6729445 - DNA, 10 bp, Homo sapiens
cccagccctg

SEQ ID NO: 6729446 - DNA, 14 bp, Homo sapiens
cccagccctgaggg

SEQ ID NO: 6729447 - DNA, 17 bp, Homo sapiens
cccagccctgaggggtg

SEQ ID NO: 6729448 - DNA, 18 bp, Homo sapiens
cccagccctgccaggagg

SEQ ID NO: 6729449 - DNA, 17 bp, Homo sapiens
cccagccctgcccagag

SEQ ID NO: 6729450 - DNA, 14 bp, Homo sapiens
cccagccctgctgg

SEQ ID NO: 6729451 - DNA, 16 bp, Homo sapiens
cccagccctgctggcc

SEQ ID NO: 6729452 - DNA, 11 bp, Homo sapiens
cccagccctgg

SEQ ID NO: 6729453 - DNA, 17 bp, Homo sapiens
cccagccctggcccagg

SEQ ID NO: 6729454 - DNA, 19 bp, Homo sapiens
cccagccctggcccaggtg

SEQ ID NO: 6729455 - DNA, 20 bp, Homo sapiens
cccagccctggcccaggtgc

SEQ ID NO: 6729456 - DNA, 15 bp, Homo sapiens
cccagccctggctct

SEQ ID NO: 6729457 - DNA, 16 bp, Homo sapiens
cccagccctggctctg

SEQ ID NO: 6729458 - DNA, 13 bp, Homo sapiens
cccagccctggga

SEQ ID NO: 6729459 - DNA, 15 bp, Homo sapiens
cccagccctggggga

SEQ ID NO: 6729460 - DNA, 20 bp, Homo sapiens
cccagccctgggggattcct

SEQ ID NO: 6729461 - DNA, 16 bp, Homo sapiens
cccagccctgtcctgg

SEQ ID NO: 6729462 - DNA, 16 bp, Homo sapiens
cccagccctgtggaag

SEQ ID NO: 6729463 - DNA, 20 bp, Homo sapiens
cccagcccttagcacagaga

SEQ ID NO: 6729464 - DNA, 22 bp, Homo sapiens
cccagcccttagcacagagagg

SEQ ID NO: 6729465 - DNA, 23 bp, Homo sapiens
cccagcccttagcacagagaggg

SEQ ID NO: 6729466 - DNA, 15 bp, Homo sapiens
cccagcccttccttg

SEQ ID NO: 6729467 - DNA, 17 bp, Homo sapiens
cccagcccttccttggg

SEQ ID NO: 6729468 - DNA, 17 bp, Homo sapiens
cccagcccttctgcctt

SEQ ID NO: 6729469 - DNA, 15 bp, Homo sapiens
cccagccctttccag

SEQ ID NO: 6729470 - DNA, 22 bp, Homo sapiens
cccagccgaccccctctccctg

SEQ ID NO: 6729471 - DNA, 13 bp, Homo sapiens
cccagccgcagga

SEQ ID NO: 6729472 - DNA, 14 bp, Homo sapiens
cccagccgctgccc

SEQ ID NO: 6729473 - DNA, 14 bp, Homo sapiens
cccagccggaggga

SEQ ID NO: 6729474 - DNA, 16 bp, Homo sapiens
cccagccggcctctct

SEQ ID NO: 6729475 - DNA, 18 bp, Homo sapiens
cccagccggcctctctgg

SEQ ID NO: 6729476 - DNA, 20 bp, Homo sapiens
cccagccggcctctctggcc

SEQ ID NO: 6729477 - DNA, 23 bp, Homo sapiens
cccagccggcctctctggcctcc

SEQ ID NO: 6729478 - DNA, 23 bp, Homo sapiens
cccagcctaagggagacaggcct

SEQ ID NO: 6729479 - DNA, 21 bp, Homo sapiens
cccagcctacccctcctgcgc

SEQ ID NO: 6729480 - DNA, 22 bp, Homo sapiens
cccagcctacccctcctgcgct

SEQ ID NO: 6729481 - DNA, 18 bp, Homo sapiens
cccagcctacccttcctg

SEQ ID NO: 6729482 - DNA, 22 bp, Homo sapiens
cccagcctaggtggaggcaagt

SEQ ID NO: 6729483 - DNA, 12 bp, Homo sapiens
cccagcctatga

SEQ ID NO: 6729484 - DNA, 23 bp, Homo sapiens
cccagcctatgagcatcctgagc

SEQ ID NO: 6729485 - DNA, 19 bp, Homo sapiens
cccagcctcaatgtcactt

SEQ ID NO: 6729486 - DNA, 21 bp, Homo sapiens
cccagcctcactccatttccc

SEQ ID NO: 6729487 - DNA, 16 bp, Homo sapiens
cccagcctcacttcct

SEQ ID NO: 6729488 - DNA, 15 bp, Homo sapiens
cccagcctcagaagc

SEQ ID NO: 6729489 - DNA, 13 bp, Homo sapiens
cccagcctcagcg

SEQ ID NO: 6729490 - DNA, 22 bp, Homo sapiens
cccagcctcagtcctcccctca

SEQ ID NO: 6729491 - DNA, 12 bp, Homo sapiens
cccagcctcatt

SEQ ID NO: 6729492 - DNA, 20 bp, Homo sapiens
cccagcctccaagctccatc

SEQ ID NO: 6729493 - DNA, 22 bp, Homo sapiens
cccagcctccagagaagccccg

SEQ ID NO: 6729494 - DNA, 12 bp, Homo sapiens
cccagcctcccc

SEQ ID NO: 6729495 - DNA, 16 bp, Homo sapiens
cccagcctcccccagg

SEQ ID NO: 6729496 - DNA, 18 bp, Homo sapiens
cccagcctcctcccacca

SEQ ID NO: 6729497 - DNA, 13 bp, Homo sapiens
cccagcctcctga

SEQ ID NO: 6729498 - DNA, 16 bp, Homo sapiens
cccagcctcctgaggg

SEQ ID NO: 6729499 - DNA, 22 bp, Homo sapiens
cccagcctcctgagggctccat

SEQ ID NO: 6729500 - DNA, 17 bp, Homo sapiens
cccagcctcgcatgcca

SEQ ID NO: 6729501 - DNA, 15 bp, Homo sapiens
cccagcctctaggga

SEQ ID NO: 6729502 - DNA, 16 bp, Homo sapiens
cccagcctctcctcct

SEQ ID NO: 6729503 - DNA, 15 bp, Homo sapiens
cccagcctctctggc

SEQ ID NO: 6729504 - DNA, 13 bp, Homo sapiens
cccagcctctgcc

SEQ ID NO: 6729505 - DNA, 14 bp, Homo sapiens
cccagcctctgccc

SEQ ID NO: 6729506 - DNA, 12 bp, Homo sapiens
cccagcctctgg

SEQ ID NO: 6729507 - DNA, 15 bp, Homo sapiens
cccagcctctggcat

SEQ ID NO: 6729508 - DNA, 13 bp, Homo sapiens
cccagcctctggg

SEQ ID NO: 6729509 - DNA, 14 bp, Homo sapiens
cccagcctctgggg

SEQ ID NO: 6729510 - DNA, 20 bp, Homo sapiens
cccagcctctggggcagagc

SEQ ID NO: 6729511 - DNA, 19 bp, Homo sapiens
cccagcctcttccattccc

SEQ ID NO: 6729512 - DNA, 15 bp, Homo sapiens
cccagcctctttccc

SEQ ID NO: 6729513 - DNA, 15 bp, Homo sapiens
cccagcctgacctga

SEQ ID NO: 6729514 - DNA, 18 bp, Homo sapiens
cccagcctgacctgagac

SEQ ID NO: 6729515 - DNA, 13 bp, Homo sapiens
cccagcctgagtg

SEQ ID NO: 6729516 - DNA, 12 bp, Homo sapiens
cccagcctgcat

SEQ ID NO: 6729517 - DNA, 11 bp, Homo sapiens
cccagcctgcc

SEQ ID NO: 6729518 - DNA, 15 bp, Homo sapiens
cccagcctgccccag

SEQ ID NO: 6729519 - DNA, 16 bp, Homo sapiens
cccagcctgccccagc

SEQ ID NO: 6729520 - DNA, 22 bp, Homo sapiens
cccagcctgccccagcctccca

SEQ ID NO: 6729521 - DNA, 15 bp, Homo sapiens
cccagcctgccccct

SEQ ID NO: 6729522 - DNA, 18 bp, Homo sapiens
cccagcctgcgcctgctg

SEQ ID NO: 6729523 - DNA, 11 bp, Homo sapiens
cccagcctgct

SEQ ID NO: 6729524 - DNA, 15 bp, Homo sapiens
cccagcctgctagct

SEQ ID NO: 6729525 - DNA, 16 bp, Homo sapiens
cccagcctgctctccc

SEQ ID NO: 6729526 - DNA, 12 bp, Homo sapiens
cccagcctgctg

SEQ ID NO: 6729527 - DNA, 13 bp, Homo sapiens
cccagcctggagc

SEQ ID NO: 6729528 - DNA, 15 bp, Homo sapiens
cccagcctggagccg

SEQ ID NO: 6729529 - DNA, 11 bp, Homo sapiens
cccagcctggc

SEQ ID NO: 6729530 - DNA, 15 bp, Homo sapiens
cccagcctggccaga

SEQ ID NO: 6729531 - DNA, 17 bp, Homo sapiens
cccagcctggccagaca

SEQ ID NO: 6729532 - DNA, 14 bp, Homo sapiens
cccagcctggcccc

SEQ ID NO: 6729533 - DNA, 21 bp, Homo sapiens
cccagcctggccccaaatgtt

SEQ ID NO: 6729534 - DNA, 15 bp, Homo sapiens
cccagcctggccccg

SEQ ID NO: 6729535 - DNA, 14 bp, Homo sapiens
cccagcctgggcca

SEQ ID NO: 6729536 - DNA, 15 bp, Homo sapiens
cccagcctgggccat

SEQ ID NO: 6729537 - DNA, 18 bp, Homo sapiens
cccagcctgggccatctc

SEQ ID NO: 6729538 - DNA, 21 bp, Homo sapiens
cccagcctgggcccatctccc

SEQ ID NO: 6729539 - DNA, 14 bp, Homo sapiens
cccagcctgggcct

SEQ ID NO: 6729540 - DNA, 16 bp, Homo sapiens
cccagcctgggcctat

SEQ ID NO: 6729541 - DNA, 14 bp, Homo sapiens
cccagcctgggctc

SEQ ID NO: 6729542 - DNA, 12 bp, Homo sapiens
cccagcctgggg

SEQ ID NO: 6729543 - DNA, 19 bp, Homo sapiens
cccagcctggggctccctc

SEQ ID NO: 6729544 - DNA, 23 bp, Homo sapiens
cccagcctggggctccctctctg

SEQ ID NO: 6729545 - DNA, 16 bp, Homo sapiens
cccagcctggtctcaa

SEQ ID NO: 6729546 - DNA, 11 bp, Homo sapiens
cccagcctgtc

SEQ ID NO: 6729547 - DNA, 12 bp, Homo sapiens
cccagcctgtca

SEQ ID NO: 6729548 - DNA, 19 bp, Homo sapiens
cccagcctgtcagatccag

SEQ ID NO: 6729549 - DNA, 14 bp, Homo sapiens
cccagcctgtccca

SEQ ID NO: 6729550 - DNA, 23 bp, Homo sapiens
cccagcctgtcccactggctcct

SEQ ID NO: 6729551 - DNA, 14 bp, Homo sapiens
cccagcctgtcctg

SEQ ID NO: 6729552 - DNA, 20 bp, Homo sapiens
cccagcctgtggcctcagca

SEQ ID NO: 6729553 - DNA, 19 bp, Homo sapiens
cccagcctgtggttacagt

SEQ ID NO: 6729554 - DNA, 15 bp, Homo sapiens
cccagccttagatgc

SEQ ID NO: 6729555 - DNA, 21 bp, Homo sapiens
cccagccttggcatctagagc

SEQ ID NO: 6729556 - DNA, 20 bp, Homo sapiens
cccagccttggtgggggagc

SEQ ID NO: 6729557 - DNA, 19 bp, Homo sapiens
cccagcgagccacaggaac

SEQ ID NO: 6729558 - DNA, 20 bp, Homo sapiens
cccagcgagccacaggaacg

SEQ ID NO: 6729559 - DNA, 21 bp, Homo sapiens
cccagcgagccacaggaacgg

SEQ ID NO: 6729560 - DNA, 15 bp, Homo sapiens
cccagcgagtctgga

SEQ ID NO: 6729561 - DNA, 21 bp, Homo sapiens
cccagcgagtctggagaccag

SEQ ID NO: 6729562 - DNA, 17 bp, Homo sapiens
cccagcgccatcctgag

SEQ ID NO: 6729563 - DNA, 18 bp, Homo sapiens
cccagcgccggggggagg

SEQ ID NO: 6729564 - DNA, 16 bp, Homo sapiens
cccagcgcggccagcg

SEQ ID NO: 6729565 - DNA, 14 bp, Homo sapiens
cccagcgctcgcca

SEQ ID NO: 6729566 - DNA, 22 bp, Homo sapiens
cccagcgctcgccacgctcagt

SEQ ID NO: 6729567 - DNA, 17 bp, Homo sapiens
cccagcgctctcctgga

SEQ ID NO: 6729568 - DNA, 19 bp, Homo sapiens
cccagcgctctcctggacg

SEQ ID NO: 6729569 - DNA, 14 bp, Homo sapiens
cccagcggacacac

SEQ ID NO: 6729570 - DNA, 23 bp, Homo sapiens
cccagcggacagtggcaggacag

SEQ ID NO: 6729571 - DNA, 18 bp, Homo sapiens
cccagcggcccctcccac

SEQ ID NO: 6729572 - DNA, 13 bp, Homo sapiens
cccagcggcctca

SEQ ID NO: 6729573 - DNA, 15 bp, Homo sapiens
cccagcggcctcagg

SEQ ID NO: 6729574 - DNA, 17 bp, Homo sapiens
cccagcggcctcagggt

SEQ ID NO: 6729575 - DNA, 19 bp, Homo sapiens
cccagcggctcttcctgga

SEQ ID NO: 6729576 - DNA, 20 bp, Homo sapiens
cccagcggcttagccaagcc

SEQ ID NO: 6729577 - DNA, 19 bp, Homo sapiens
cccagcgtcaggcctacct

SEQ ID NO: 6729578 - DNA, 21 bp, Homo sapiens
cccagcgtcaggcctacctca

SEQ ID NO: 6729579 - DNA, 16 bp, Homo sapiens
cccagcgtctgcaggg

SEQ ID NO: 6729580 - DNA, 17 bp, Homo sapiens
cccagcgtggcccaggc

SEQ ID NO: 6729581 - DNA, 23 bp, Homo sapiens
cccagcgtgggggtggccactcc

SEQ ID NO: 6729582 - DNA, 14 bp, Homo sapiens
cccagcgttcttca

SEQ ID NO: 6729583 - DNA, 22 bp, Homo sapiens
cccagctaaagcagtcctccag

SEQ ID NO: 6729584 - DNA, 19 bp, Homo sapiens
cccagctaagaacctggaa

SEQ ID NO: 6729585 - DNA, 18 bp, Homo sapiens
cccagctaataaaccaga

SEQ ID NO: 6729586 - DNA, 21 bp, Homo sapiens
cccagctaatacccagagcac

SEQ ID NO: 6729587 - DNA, 19 bp, Homo sapiens
cccagctaatctgtagggc

SEQ ID NO: 6729588 - DNA, 20 bp, Homo sapiens
cccagctaatctgtagggct

SEQ ID NO: 6729589 - DNA, 21 bp, Homo sapiens
cccagctaatttttgtatttt

SEQ ID NO: 6729590 - DNA, 24 bp, Homo sapiens
cccagctacattcctcagctgcca

SEQ ID NO: 6729591 - DNA, 15 bp, Homo sapiens
cccagctacccagga

SEQ ID NO: 6729592 - DNA, 19 bp, Homo sapiens
cccagctacccaggaggct

SEQ ID NO: 6729593 - DNA, 22 bp, Homo sapiens
cccagctaccctttttctccag

SEQ ID NO: 6729594 - DNA, 22 bp, Homo sapiens
cccagctacctcaaccaatgcc

SEQ ID NO: 6729595 - DNA, 22 bp, Homo sapiens
cccagctactcagaagcctgag

SEQ ID NO: 6729596 - DNA, 15 bp, Homo sapiens
cccagctactcagga

SEQ ID NO: 6729597 - DNA, 19 bp, Homo sapiens
cccagctactcgggaagct

SEQ ID NO: 6729598 - DNA, 16 bp, Homo sapiens
cccagctactctgtcc

SEQ ID NO: 6729599 - DNA, 17 bp, Homo sapiens
cccagctactctgtcca

SEQ ID NO: 6729600 - DNA, 18 bp, Homo sapiens
cccagctactctgtccag

SEQ ID NO: 6729601 - DNA, 22 bp, Homo sapiens
cccagctactctgtccaggcca

SEQ ID NO: 6729602 - DNA, 23 bp, Homo sapiens
cccagctactctgtccaggccac

SEQ ID NO: 6729603 - DNA, 21 bp, Homo sapiens
cccagctactggggaggctga

SEQ ID NO: 6729604 - DNA, 15 bp, Homo sapiens
cccagctacttggga

SEQ ID NO: 6729605 - DNA, 19 bp, Homo sapiens
cccagctacttgggagcct

SEQ ID NO: 6729606 - DNA, 17 bp, Homo sapiens
cccagctacttgggagg

SEQ ID NO: 6729607 - DNA, 18 bp, Homo sapiens
cccagctaggaagagcag

SEQ ID NO: 6729608 - DNA, 16 bp, Homo sapiens
cccagctagggggcgt

SEQ ID NO: 6729609 - DNA, 23 bp, Homo sapiens
cccagctagggggcgttatttat

SEQ ID NO: 6729610 - DNA, 21 bp, Homo sapiens
cccagctattttctgaccaaa

SEQ ID NO: 6729611 - DNA, 22 bp, Homo sapiens
cccagctattttctgaccaaaa

SEQ ID NO: 6729612 - DNA, 16 bp, Homo sapiens
cccagctcactgcagc

SEQ ID NO: 6729613 - DNA, 17 bp, Homo sapiens
cccagctcagagccccg

SEQ ID NO: 6729614 - DNA, 12 bp, Homo sapiens
cccagctcaggg

SEQ ID NO: 6729615 - DNA, 17 bp, Homo sapiens
cccagctcaggggcagc

SEQ ID NO: 6729616 - DNA, 18 bp, Homo sapiens
cccagctcagtcttccct

SEQ ID NO: 6729617 - DNA, 15 bp, Homo sapiens
cccagctcagtgcca

SEQ ID NO: 6729618 - DNA, 16 bp, Homo sapiens
cccagctcagtgccaa

SEQ ID NO: 6729619 - DNA, 22 bp, Homo sapiens
cccagctcatgtaggtgagcct

SEQ ID NO: 6729620 - DNA, 17 bp, Homo sapiens
cccagctccactcaggg

SEQ ID NO: 6729621 - DNA, 11 bp, Homo sapiens
cccagctccag

SEQ ID NO: 6729622 - DNA, 12 bp, Homo sapiens
cccagctccagc

SEQ ID NO: 6729623 - DNA, 15 bp, Homo sapiens
cccagctccagggcc

SEQ ID NO: 6729624 - DNA, 16 bp, Homo sapiens
cccagctccagggcca

SEQ ID NO: 6729625 - DNA, 17 bp, Homo sapiens
cccagctccagggccag

SEQ ID NO: 6729626 - DNA, 14 bp, Homo sapiens
cccagctccagggg

SEQ ID NO: 6729627 - DNA, 10 bp, Homo sapiens
cccagctccc

SEQ ID NO: 6729628 - DNA, 17 bp, Homo sapiens
cccagctcccacaccgc

SEQ ID NO: 6729629 - DNA, 13 bp, Homo sapiens
cccagctcccagg

SEQ ID NO: 6729630 - DNA, 14 bp, Homo sapiens
cccagctcccagga

SEQ ID NO: 6729631 - DNA, 15 bp, Homo sapiens
cccagctccccaaga

SEQ ID NO: 6729632 - DNA, 16 bp, Homo sapiens
cccagctccccaggac

SEQ ID NO: 6729633 - DNA, 18 bp, Homo sapiens
cccagctccccaggactc

SEQ ID NO: 6729634 - DNA, 18 bp, Homo sapiens
cccagctcccccaggcag

SEQ ID NO: 6729635 - DNA, 21 bp, Homo sapiens
cccagctccccccgcccaccc

SEQ ID NO: 6729636 - DNA, 16 bp, Homo sapiens
cccagctcccccggga

SEQ ID NO: 6729637 - DNA, 20 bp, Homo sapiens
cccagctcccctcttttgta

SEQ ID NO: 6729638 - DNA, 23 bp, Homo sapiens
cccagctcccgtgtaaataattt

SEQ ID NO: 6729639 - DNA, 16 bp, Homo sapiens
cccagctccctgcacc

SEQ ID NO: 6729640 - DNA, 22 bp, Homo sapiens
cccagctcccttgggaaggaca

SEQ ID NO: 6729641 - DNA, 17 bp, Homo sapiens
cccagctccgcctgctg

SEQ ID NO: 6729642 - DNA, 19 bp, Homo sapiens
cccagctccgcctgctggg

SEQ ID NO: 6729643 - DNA, 13 bp, Homo sapiens
cccagctcctcac

SEQ ID NO: 6729644 - DNA, 12 bp, Homo sapiens
cccagctcctcc

SEQ ID NO: 6729645 - DNA, 12 bp, Homo sapiens
cccagctcctct

SEQ ID NO: 6729646 - DNA, 14 bp, Homo sapiens
cccagctcctctga

SEQ ID NO: 6729647 - DNA, 17 bp, Homo sapiens
cccagctcctctgagcc

SEQ ID NO: 6729648 - DNA, 12 bp, Homo sapiens
cccagctcctga

SEQ ID NO: 6729649 - DNA, 14 bp, Homo sapiens
cccagctccttggc

SEQ ID NO: 6729650 - DNA, 21 bp, Homo sapiens
cccagctccttttgtccccag

SEQ ID NO: 6729651 - DNA, 22 bp, Homo sapiens
cccagctccttttgtccccagg

SEQ ID NO: 6729652 - DNA, 23 bp, Homo sapiens
cccagctccttttgtccccaggg

SEQ ID NO: 6729653 - DNA, 13 bp, Homo sapiens
cccagctcgctgg

SEQ ID NO: 6729654 - DNA, 21 bp, Homo sapiens
cccagctcgctggctttctct

SEQ ID NO: 6729655 - DNA, 9 bp, Homo sapiens
cccagctct

SEQ ID NO: 6729656 - DNA, 20 bp, Homo sapiens
cccagctctaagcagccagg

SEQ ID NO: 6729657 - DNA, 23 bp, Homo sapiens
cccagctctaagcagccaggagg

SEQ ID NO: 6729658 - DNA, 24 bp, Homo sapiens
cccagctctacattctgctctgcc

SEQ ID NO: 6729659 - DNA, 16 bp, Homo sapiens
cccagctctcagggct

SEQ ID NO: 6729660 - DNA, 15 bp, Homo sapiens
cccagctctccctct

SEQ ID NO: 6729661 - DNA, 18 bp, Homo sapiens
cccagctctccctctggc

SEQ ID NO: 6729662 - DNA, 23 bp, Homo sapiens
cccagctctccctctggccctgc

SEQ ID NO: 6729663 - DNA, 18 bp, Homo sapiens
cccagctctctctcctgg

SEQ ID NO: 6729664 - DNA, 12 bp, Homo sapiens
cccagctctgaa

SEQ ID NO: 6729665 - DNA, 14 bp, Homo sapiens
cccagctctgaggc

SEQ ID NO: 6729666 - DNA, 13 bp, Homo sapiens
cccagctctgctt

SEQ ID NO: 6729667 - DNA, 13 bp, Homo sapiens
cccagctctggat

SEQ ID NO: 6729668 - DNA, 13 bp, Homo sapiens
cccagctctggct

SEQ ID NO: 6729669 - DNA, 15 bp, Homo sapiens
cccagctctggtcca

SEQ ID NO: 6729670 - DNA, 13 bp, Homo sapiens
cccagctctggtg

SEQ ID NO: 6729671 - DNA, 15 bp, Homo sapiens
cccagctctggtgag

SEQ ID NO: 6729672 - DNA, 18 bp, Homo sapiens
cccagctcttctcttcct

SEQ ID NO: 6729673 - DNA, 20 bp, Homo sapiens
cccagctcttgctctcttgt

SEQ ID NO: 6729674 - DNA, 22 bp, Homo sapiens
cccagctgacagtcctctccac

SEQ ID NO: 6729675 - DNA, 15 bp, Homo sapiens
cccagctgacatgga

SEQ ID NO: 6729676 - DNA, 17 bp, Homo sapiens
cccagctgacatggaaa

SEQ ID NO: 6729677 - DNA, 21 bp, Homo sapiens
cccagctgactgtggccccct

SEQ ID NO: 6729678 - DNA, 22 bp, Homo sapiens
cccagctgagtctatgtaggtg

SEQ ID NO: 6729679 - DNA, 19 bp, Homo sapiens
cccagctgattagtgtcta

SEQ ID NO: 6729680 - DNA, 20 bp, Homo sapiens
cccagctgattagtgtctaa

SEQ ID NO: 6729681 - DNA, 9 bp, Homo sapiens
cccagctgc

SEQ ID NO: 6729682 - DNA, 20 bp, Homo sapiens
cccagctgcaccccttcctg

SEQ ID NO: 6729683 - DNA, 18 bp, Homo sapiens
cccagctgcacctgccag

SEQ ID NO: 6729684 - DNA, 23 bp, Homo sapiens
cccagctgcacctgccagcctgg

SEQ ID NO: 6729685 - DNA, 14 bp, Homo sapiens
cccagctgccaggg

SEQ ID NO: 6729686 - DNA, 12 bp, Homo sapiens
cccagctgcccc

SEQ ID NO: 6729687 - DNA, 18 bp, Homo sapiens
cccagctgccggcagtgc

SEQ ID NO: 6729688 - DNA, 13 bp, Homo sapiens
cccagctgcggca

SEQ ID NO: 6729689 - DNA, 10 bp, Homo sapiens
cccagctgct

SEQ ID NO: 6729690 - DNA, 14 bp, Homo sapiens
cccagctgctcccc

SEQ ID NO: 6729691 - DNA, 21 bp, Homo sapiens
cccagctgctcccctccctcc

SEQ ID NO: 6729692 - DNA, 17 bp, Homo sapiens
cccagctgctcccctgc

SEQ ID NO: 6729693 - DNA, 20 bp, Homo sapiens
cccagctgctctaagcccag

SEQ ID NO: 6729694 - DNA, 17 bp, Homo sapiens
cccagctgctctgccca

SEQ ID NO: 6729695 - DNA, 18 bp, Homo sapiens
cccagctgctctgcccag

SEQ ID NO: 6729696 - DNA, 16 bp, Homo sapiens
cccagctgctgaggcg

SEQ ID NO: 6729697 - DNA, 16 bp, Homo sapiens
cccagctggcagcgcc

SEQ ID NO: 6729698 - DNA, 18 bp, Homo sapiens
cccagctggcagcgcctc

SEQ ID NO: 6729699 - DNA, 13 bp, Homo sapiens
cccagctggccac

SEQ ID NO: 6729700 - DNA, 20 bp, Homo sapiens
cccagctggcccgtgacaga

SEQ ID NO: 6729701 - DNA, 16 bp, Homo sapiens
cccagctggccggaag

SEQ ID NO: 6729702 - DNA, 13 bp, Homo sapiens
cccagctggcctc

SEQ ID NO: 6729703 - DNA, 14 bp, Homo sapiens
cccagctggcctct

SEQ ID NO: 6729704 - DNA, 22 bp, Homo sapiens
cccagctggcctggcccccagc

SEQ ID NO: 6729705 - DNA, 16 bp, Homo sapiens
cccagctggctgggtc

SEQ ID NO: 6729706 - DNA, 17 bp, Homo sapiens
cccagctgggaggcaag

SEQ ID NO: 6729707 - DNA, 20 bp, Homo sapiens
cccagctgggctctgccacc

SEQ ID NO: 6729708 - DNA, 13 bp, Homo sapiens
cccagctgggctg

SEQ ID NO: 6729709 - DNA, 20 bp, Homo sapiens
cccagctggggccaggctgg

SEQ ID NO: 6729710 - DNA, 20 bp, Homo sapiens
cccagctggtcctgtggatg

SEQ ID NO: 6729711 - DNA, 16 bp, Homo sapiens
cccagctggtgtcact

SEQ ID NO: 6729712 - DNA, 22 bp, Homo sapiens
cccagctggtgtcactctgcct

SEQ ID NO: 6729713 - DNA, 13 bp, Homo sapiens
cccagctgtagcc

SEQ ID NO: 6729714 - DNA, 15 bp, Homo sapiens
cccagctgtagccat

SEQ ID NO: 6729715 - DNA, 16 bp, Homo sapiens
cccagctgtagccatg

SEQ ID NO: 6729716 - DNA, 21 bp, Homo sapiens
cccagctgtagccatggctca

SEQ ID NO: 6729717 - DNA, 16 bp, Homo sapiens
cccagctgtctgtgtc

SEQ ID NO: 6729718 - DNA, 17 bp, Homo sapiens
cccagctgtgactgagg

SEQ ID NO: 6729719 - DNA, 21 bp, Homo sapiens
cccagcttaaatcctagcagg

SEQ ID NO: 6729720 - DNA, 17 bp, Homo sapiens
cccagcttatctcctcc

SEQ ID NO: 6729721 - DNA, 18 bp, Homo sapiens
cccagcttatctcctcct

SEQ ID NO: 6729722 - DNA, 15 bp, Homo sapiens
cccagcttccagcag

SEQ ID NO: 6729723 - DNA, 18 bp, Homo sapiens
cccagcttccagcaggag

SEQ ID NO: 6729724 - DNA, 12 bp, Homo sapiens
cccagcttcccg

SEQ ID NO: 6729725 - DNA, 12 bp, Homo sapiens
cccagcttcctg

SEQ ID NO: 6729726 - DNA, 16 bp, Homo sapiens
cccagcttcctggtgt

SEQ ID NO: 6729727 - DNA, 23 bp, Homo sapiens
cccagcttctctctccctgtcac

SEQ ID NO: 6729728 - DNA, 13 bp, Homo sapiens
cccagcttgcccc

SEQ ID NO: 6729729 - DNA, 23 bp, Homo sapiens
cccagcttgctgaggggcaggga

SEQ ID NO: 6729730 - DNA, 13 bp, Homo sapiens
cccagcttggagt

SEQ ID NO: 6729731 - DNA, 15 bp, Homo sapiens
cccagcttggctcac

SEQ ID NO: 6729732 - DNA, 23 bp, Homo sapiens
cccagcttggctcacaaggccca

SEQ ID NO: 6729733 - DNA, 19 bp, Homo sapiens
cccagcttgggcccagctg

SEQ ID NO: 6729734 - DNA, 20 bp, Homo sapiens
cccagcttgggcccagctgg

SEQ ID NO: 6729735 - DNA, 21 bp, Homo sapiens
cccagctttatctgtcacaca

SEQ ID NO: 6729736 - DNA, 21 bp, Homo sapiens
cccagctttccatctgaggac

SEQ ID NO: 6729737 - DNA, 17 bp, Homo sapiens
cccagctttctcctctg

SEQ ID NO: 6729738 - DNA, 22 bp, Homo sapiens
cccagctttgcccaacaccagc

SEQ ID NO: 6729739 - DNA, 24 bp, Homo sapiens
cccagcttttcttgccagctcagc

SEQ ID NO: 6729740 - DNA, 12 bp, Homo sapiens
cccaggaaaaac

SEQ ID NO: 6729741 - DNA, 23 bp, Homo sapiens
cccaggaaaggacggctgagcat

SEQ ID NO: 6729742 - DNA, 17 bp, Homo sapiens
cccaggaaaggaggacc

SEQ ID NO: 6729743 - DNA, 22 bp, Homo sapiens
cccaggaaaggctccaggagca

SEQ ID NO: 6729744 - DNA, 11 bp, Homo sapiens
cccaggaaccg

SEQ ID NO: 6729745 - DNA, 22 bp, Homo sapiens
cccaggaactcgcacctgtgct

SEQ ID NO: 6729746 - DNA, 10 bp, Homo sapiens
cccaggaagc

SEQ ID NO: 6729747 - DNA, 17 bp, Homo sapiens
cccaggaagcccactgc

SEQ ID NO: 6729748 - DNA, 21 bp, Homo sapiens
cccaggaagcccactgcctcc

SEQ ID NO: 6729749 - DNA, 14 bp, Homo sapiens
cccaggaagcccag

SEQ ID NO: 6729750 - DNA, 15 bp, Homo sapiens
cccaggaagcccagg

SEQ ID NO: 6729751 - DNA, 21 bp, Homo sapiens
cccaggaagcccaggagggca

SEQ ID NO: 6729752 - DNA, 13 bp, Homo sapiens
cccaggaagccgg

SEQ ID NO: 6729753 - DNA, 17 bp, Homo sapiens
cccaggaaggaaacaga

SEQ ID NO: 6729754 - DNA, 11 bp, Homo sapiens
cccaggaaggc

SEQ ID NO: 6729755 - DNA, 19 bp, Homo sapiens
cccaggaaggcggcaggca

SEQ ID NO: 6729756 - DNA, 23 bp, Homo sapiens
cccaggaaggcggcaggcagaga

SEQ ID NO: 6729757 - DNA, 19 bp, Homo sapiens
cccaggaagggagggagct

SEQ ID NO: 6729758 - DNA, 24 bp, Homo sapiens
cccaggaagggagggagctgaggc

SEQ ID NO: 6729759 - DNA, 19 bp, Homo sapiens
cccaggaagtcatcctgca

SEQ ID NO: 6729760 - DNA, 12 bp, Homo sapiens
cccaggaagtcc

SEQ ID NO: 6729761 - DNA, 14 bp, Homo sapiens
cccaggaagtccag

SEQ ID NO: 6729762 - DNA, 22 bp, Homo sapiens
cccaggaagtggctcagacccc

SEQ ID NO: 6729763 - DNA, 22 bp, Homo sapiens
cccaggaatgaagataccatca

SEQ ID NO: 6729764 - DNA, 18 bp, Homo sapiens
cccaggaatggagcctgc

SEQ ID NO: 6729765 - DNA, 23 bp, Homo sapiens
cccaggacaccacacccagcctc

SEQ ID NO: 6729766 - DNA, 18 bp, Homo sapiens
cccaggacactgcctttg

SEQ ID NO: 6729767 - DNA, 21 bp, Homo sapiens
cccaggacactgcctttgctg

SEQ ID NO: 6729768 - DNA, 22 bp, Homo sapiens
cccaggacactgcctttgctgc

SEQ ID NO: 6729769 - DNA, 18 bp, Homo sapiens
cccaggacagcacacggt

SEQ ID NO: 6729770 - DNA, 17 bp, Homo sapiens
cccaggacaggatccag

SEQ ID NO: 6729771 - DNA, 15 bp, Homo sapiens
cccaggacagtttat

SEQ ID NO: 6729772 - DNA, 15 bp, Homo sapiens
cccaggacatctcct

SEQ ID NO: 6729773 - DNA, 17 bp, Homo sapiens
cccaggacatctcctgg

SEQ ID NO: 6729774 - DNA, 12 bp, Homo sapiens
cccaggaccaag

SEQ ID NO: 6729775 - DNA, 22 bp, Homo sapiens
cccaggaccacaggctcaggca

SEQ ID NO: 6729776 - DNA, 23 bp, Homo sapiens
cccaggaccacaggctcaggcag

SEQ ID NO: 6729777 - DNA, 15 bp, Homo sapiens
cccaggaccagaagc

SEQ ID NO: 6729778 - DNA, 23 bp, Homo sapiens
cccaggaccagaagctcccccag

SEQ ID NO: 6729779 - DNA, 15 bp, Homo sapiens
cccaggaccagctca

SEQ ID NO: 6729780 - DNA, 16 bp, Homo sapiens
cccaggaccagctggg

SEQ ID NO: 6729781 - DNA, 17 bp, Homo sapiens
cccaggaccagctgggg

SEQ ID NO: 6729782 - DNA, 18 bp, Homo sapiens
cccaggaccagctggggc

SEQ ID NO: 6729783 - DNA, 20 bp, Homo sapiens
cccaggaccatcctggaggg

SEQ ID NO: 6729784 - DNA, 23 bp, Homo sapiens
cccaggacccatctttctcacac

SEQ ID NO: 6729785 - DNA, 17 bp, Homo sapiens
cccaggacccctcagct

SEQ ID NO: 6729786 - DNA, 16 bp, Homo sapiens
cccaggacccctgagt

SEQ ID NO: 6729787 - DNA, 11 bp, Homo sapiens
cccaggaccct

SEQ ID NO: 6729788 - DNA, 23 bp, Homo sapiens
cccaggaccctgaaggggccatg

SEQ ID NO: 6729789 - DNA, 23 bp, Homo sapiens
cccaggaccctggacccagccag

SEQ ID NO: 6729790 - DNA, 17 bp, Homo sapiens
cccaggaccctgggtca

SEQ ID NO: 6729791 - DNA, 11 bp, Homo sapiens
cccaggacctc

SEQ ID NO: 6729792 - DNA, 22 bp, Homo sapiens
cccaggacctcttcagctgctg

SEQ ID NO: 6729793 - DNA, 23 bp, Homo sapiens
cccaggacctcttcagctgctga

SEQ ID NO: 6729794 - DNA, 14 bp, Homo sapiens
cccaggacctgagc

SEQ ID NO: 6729795 - DNA, 16 bp, Homo sapiens
cccaggacctgagcct

SEQ ID NO: 6729796 - DNA, 18 bp, Homo sapiens
cccaggacctgagcctgg

SEQ ID NO: 6729797 - DNA, 18 bp, Homo sapiens
cccaggacctggagacag

SEQ ID NO: 6729798 - DNA, 17 bp, Homo sapiens
cccaggacgcatgcagg

SEQ ID NO: 6729799 - DNA, 20 bp, Homo sapiens
cccaggacgcatgcagggcc

SEQ ID NO: 6729800 - DNA, 23 bp, Homo sapiens
cccaggacgccactcatttcatc

SEQ ID NO: 6729801 - DNA, 15 bp, Homo sapiens
cccaggacgcttctg

SEQ ID NO: 6729802 - DNA, 17 bp, Homo sapiens
cccaggacgcttctgaa

SEQ ID NO: 6729803 - DNA, 18 bp, Homo sapiens
cccaggacgcttctgaat

SEQ ID NO: 6729804 - DNA, 19 bp, Homo sapiens
cccaggacgcttctgaatg

SEQ ID NO: 6729805 - DNA, 20 bp, Homo sapiens
cccaggacgcttctgaatgc

SEQ ID NO: 6729806 - DNA, 20 bp, Homo sapiens
cccaggacggtctgtgcccg

SEQ ID NO: 6729807 - DNA, 16 bp, Homo sapiens
cccaggactcaccctc

SEQ ID NO: 6729808 - DNA, 13 bp, Homo sapiens
cccaggactcctc

SEQ ID NO: 6729809 - DNA, 15 bp, Homo sapiens
cccaggactctgacc

SEQ ID NO: 6729810 - DNA, 15 bp, Homo sapiens
cccaggactctggca

SEQ ID NO: 6729811 - DNA, 18 bp, Homo sapiens
cccaggactctggcttct

SEQ ID NO: 6729812 - DNA, 18 bp, Homo sapiens
cccaggactggctgcccc

SEQ ID NO: 6729813 - DNA, 12 bp, Homo sapiens
cccaggactggg

SEQ ID NO: 6729814 - DNA, 14 bp, Homo sapiens
cccaggactgggcc

SEQ ID NO: 6729815 - DNA, 23 bp, Homo sapiens
cccaggactgtcattttggcatc

SEQ ID NO: 6729816 - DNA, 12 bp, Homo sapiens
cccaggagaaag

SEQ ID NO: 6729817 - DNA, 16 bp, Homo sapiens
cccaggagacagacca

SEQ ID NO: 6729818 - DNA, 14 bp, Homo sapiens
cccaggagagagaa

SEQ ID NO: 6729819 - DNA, 18 bp, Homo sapiens
cccaggagagccagccct

SEQ ID NO: 6729820 - DNA, 19 bp, Homo sapiens
cccaggagagccagccctc

SEQ ID NO: 6729821 - DNA, 23 bp, Homo sapiens
cccaggagagccagccctccctg

SEQ ID NO: 6729822 - DNA, 18 bp, Homo sapiens
cccaggagagcccccacc

SEQ ID NO: 6729823 - DNA, 20 bp, Homo sapiens
cccaggagagcccccaccag

SEQ ID NO: 6729824 - DNA, 23 bp, Homo sapiens
cccaggagagcccccaccagcag

SEQ ID NO: 6729825 - DNA, 15 bp, Homo sapiens
cccaggagcaacagc

SEQ ID NO: 6729826 - DNA, 15 bp, Homo sapiens
cccaggagcagctgg

SEQ ID NO: 6729827 - DNA, 16 bp, Homo sapiens
cccaggagcagctggc

SEQ ID NO: 6729828 - DNA, 22 bp, Homo sapiens
cccaggagcagctggcactgac

SEQ ID NO: 6729829 - DNA, 23 bp, Homo sapiens
cccaggagcagcttttggtctcc

SEQ ID NO: 6729830 - DNA, 24 bp, Homo sapiens
cccaggagcagcttttggtctcct

SEQ ID NO: 6729831 - DNA, 16 bp, Homo sapiens
cccaggagcccatttg

SEQ ID NO: 6729832 - DNA, 13 bp, Homo sapiens
cccaggagccccg

SEQ ID NO: 6729833 - DNA, 14 bp, Homo sapiens
cccaggagccccga

SEQ ID NO: 6729834 - DNA, 21 bp, Homo sapiens
cccaggagccccgaggccttc

SEQ ID NO: 6729835 - DNA, 12 bp, Homo sapiens
cccaggagcgca

SEQ ID NO: 6729836 - DNA, 16 bp, Homo sapiens
cccaggagcgcagctg

SEQ ID NO: 6729837 - DNA, 12 bp, Homo sapiens
cccaggagctcc

SEQ ID NO: 6729838 - DNA, 17 bp, Homo sapiens
cccaggagctctctgct

SEQ ID NO: 6729839 - DNA, 19 bp, Homo sapiens
cccaggagctctctgctga

SEQ ID NO: 6729840 - DNA, 14 bp, Homo sapiens
cccaggagctctgc

SEQ ID NO: 6729841 - DNA, 15 bp, Homo sapiens
cccaggagctctgcg

SEQ ID NO: 6729842 - DNA, 21 bp, Homo sapiens
cccaggagctctgcgccaggc

SEQ ID NO: 6729843 - DNA, 22 bp, Homo sapiens
cccaggagctgagtcacctcct

SEQ ID NO: 6729844 - DNA, 20 bp, Homo sapiens
cccaggaggaccgcctgccc

SEQ ID NO: 6729845 - DNA, 22 bp, Homo sapiens
cccaggaggaccgcctgccctg

SEQ ID NO: 6729846 - DNA, 23 bp, Homo sapiens
cccaggaggaccgcctgccctgc

SEQ ID NO: 6729847 - DNA, 19 bp, Homo sapiens
cccaggaggacctgggggg

SEQ ID NO: 6729848 - DNA, 19 bp, Homo sapiens
cccaggaggactccctgct

SEQ ID NO: 6729849 - DNA, 23 bp, Homo sapiens
cccaggaggagaccctcccctgc

SEQ ID NO: 6729850 - DNA, 16 bp, Homo sapiens
cccaggaggagagaga

SEQ ID NO: 6729851 - DNA, 20 bp, Homo sapiens
cccaggaggaggattgtgct

SEQ ID NO: 6729852 - DNA, 17 bp, Homo sapiens
cccaggaggcagctcag

SEQ ID NO: 6729853 - DNA, 17 bp, Homo sapiens
cccaggaggcagggagg

SEQ ID NO: 6729854 - DNA, 13 bp, Homo sapiens
cccaggaggccag

SEQ ID NO: 6729855 - DNA, 16 bp, Homo sapiens
cccaggaggcctgggc

SEQ ID NO: 6729856 - DNA, 10 bp, Homo sapiens
cccaggaggg

SEQ ID NO: 6729857 - DNA, 22 bp, Homo sapiens
cccaggaggggaacactgccct

SEQ ID NO: 6729858 - DNA, 14 bp, Homo sapiens
cccaggaggggcct

SEQ ID NO: 6729859 - DNA, 17 bp, Homo sapiens
cccaggaggggcctctg

SEQ ID NO: 6729860 - DNA, 23 bp, Homo sapiens
cccaggaggtcaagcctgcagcg

SEQ ID NO: 6729861 - DNA, 20 bp, Homo sapiens
cccaggaggtgcagtggagg

SEQ ID NO: 6729862 - DNA, 21 bp, Homo sapiens
cccaggaggtgcagtggaggg

SEQ ID NO: 6729863 - DNA, 12 bp, Homo sapiens
cccaggagtcca

SEQ ID NO: 6729864 - DNA, 14 bp, Homo sapiens
cccaggagtccagg

SEQ ID NO: 6729865 - DNA, 17 bp, Homo sapiens
cccaggagttcaagacc

SEQ ID NO: 6729866 - DNA, 15 bp, Homo sapiens
cccaggagttctgct

SEQ ID NO: 6729867 - DNA, 23 bp, Homo sapiens
cccaggagttctgctcattctaa

SEQ ID NO: 6729868 - DNA, 19 bp, Homo sapiens
cccaggagtttgaggctgc

SEQ ID NO: 6729869 - DNA, 20 bp, Homo sapiens
cccaggagtttgaggctgca

SEQ ID NO: 6729870 - DNA, 22 bp, Homo sapiens
cccaggagtttgaggctgcagc

SEQ ID NO: 6729871 - DNA, 23 bp, Homo sapiens
cccaggagtttgaggctgcagcg

SEQ ID NO: 6729872 - DNA, 18 bp, Homo sapiens
cccaggagtttggccaga

SEQ ID NO: 6729873 - DNA, 19 bp, Homo sapiens
cccaggatactggcacaga

SEQ ID NO: 6729874 - DNA, 15 bp, Homo sapiens
cccaggatatatttt

SEQ ID NO: 6729875 - DNA, 15 bp, Homo sapiens
cccaggatcactctc

SEQ ID NO: 6729876 - DNA, 22 bp, Homo sapiens
cccaggatcactctctgctggc

SEQ ID NO: 6729877 - DNA, 16 bp, Homo sapiens
cccaggatcccagagc

SEQ ID NO: 6729878 - DNA, 15 bp, Homo sapiens
cccaggatgcatgca

SEQ ID NO: 6729879 - DNA, 17 bp, Homo sapiens
cccaggatgcatgcagg

SEQ ID NO: 6729880 - DNA, 23 bp, Homo sapiens
cccaggatgccacgcctggaagg

SEQ ID NO: 6729881 - DNA, 16 bp, Homo sapiens
cccaggatggtcccag

SEQ ID NO: 6729882 - DNA, 15 bp, Homo sapiens
cccaggattcccaga

SEQ ID NO: 6729883 - DNA, 18 bp, Homo sapiens
cccaggattcccagagag

SEQ ID NO: 6729884 - DNA, 19 bp, Homo sapiens
cccaggattcccccagcca

SEQ ID NO: 6729885 - DNA, 23 bp, Homo sapiens
cccaggattgtacgtgggagagg

SEQ ID NO: 6729886 - DNA, 23 bp, Homo sapiens
cccaggattgtgcaatagtcaga

SEQ ID NO: 6729887 - DNA, 14 bp, Homo sapiens
cccaggatttgact

SEQ ID NO: 6729888 - DNA, 21 bp, Homo sapiens
cccaggcaagcagctggtcag

SEQ ID NO: 6729889 - DNA, 17 bp, Homo sapiens
cccaggcaaggaacaga

SEQ ID NO: 6729890 - DNA, 13 bp, Homo sapiens
cccaggcaaggct

SEQ ID NO: 6729891 - DNA, 19 bp, Homo sapiens
cccaggcaaggctgtggac

SEQ ID NO: 6729892 - DNA, 22 bp, Homo sapiens
cccaggcaatagtgttgaggag

SEQ ID NO: 6729893 - DNA, 17 bp, Homo sapiens
cccaggcaccaccagga

SEQ ID NO: 6729894 - DNA, 21 bp, Homo sapiens
cccaggcaccaccaggagcag

SEQ ID NO: 6729895 - DNA, 14 bp, Homo sapiens
cccaggcaccgcca

SEQ ID NO: 6729896 - DNA, 22 bp, Homo sapiens
cccaggcagcacagtgtgtgaa

SEQ ID NO: 6729897 - DNA, 13 bp, Homo sapiens
cccaggcagcacc

SEQ ID NO: 6729898 - DNA, 19 bp, Homo sapiens
cccaggcagcacctggagc

SEQ ID NO: 6729899 - DNA, 11 bp, Homo sapiens
cccaggcagcc

SEQ ID NO: 6729900 - DNA, 17 bp, Homo sapiens
cccaggcagcctcaagg

SEQ ID NO: 6729901 - DNA, 20 bp, Homo sapiens
cccaggcagcgccactgtcc

SEQ ID NO: 6729902 - DNA, 11 bp, Homo sapiens
cccaggcagct

SEQ ID NO: 6729903 - DNA, 13 bp, Homo sapiens
cccaggcagctat

SEQ ID NO: 6729904 - DNA, 20 bp, Homo sapiens
cccaggcagctatttcagcc

SEQ ID NO: 6729905 - DNA, 16 bp, Homo sapiens
cccaggcagctcctgt

SEQ ID NO: 6729906 - DNA, 12 bp, Homo sapiens
cccaggcagctg

SEQ ID NO: 6729907 - DNA, 14 bp, Homo sapiens
cccaggcagctggc

SEQ ID NO: 6729908 - DNA, 16 bp, Homo sapiens
cccaggcagctggcag

SEQ ID NO: 6729909 - DNA, 11 bp, Homo sapiens
cccaggcaggg

SEQ ID NO: 6729910 - DNA, 13 bp, Homo sapiens
cccaggcagggag

SEQ ID NO: 6729911 - DNA, 13 bp, Homo sapiens
cccaggcagggct

SEQ ID NO: 6729912 - DNA, 14 bp, Homo sapiens
cccaggcagggcta

SEQ ID NO: 6729913 - DNA, 14 bp, Homo sapiens
cccaggcaggtctg

SEQ ID NO: 6729914 - DNA, 20 bp, Homo sapiens
cccaggcaggtctgcaaggg

SEQ ID NO: 6729915 - DNA, 21 bp, Homo sapiens
cccaggcaggtgcagggaagt

SEQ ID NO: 6729916 - DNA, 13 bp, Homo sapiens
cccaggcagtctt

SEQ ID NO: 6729917 - DNA, 14 bp, Homo sapiens
cccaggcagtcttt

SEQ ID NO: 6729918 - DNA, 12 bp, Homo sapiens
cccaggcatgca

SEQ ID NO: 6729919 - DNA, 21 bp, Homo sapiens
cccaggcattccccaggaggc

SEQ ID NO: 6729920 - DNA, 15 bp, Homo sapiens
cccaggccacagaga

SEQ ID NO: 6729921 - DNA, 16 bp, Homo sapiens
cccaggccacagagaa

SEQ ID NO: 6729922 - DNA, 24 bp, Homo sapiens
cccaggccacctcagtctcacctg

SEQ ID NO: 6729923 - DNA, 16 bp, Homo sapiens
cccaggccactgacct

SEQ ID NO: 6729924 - DNA, 13 bp, Homo sapiens
cccaggccagccc

SEQ ID NO: 6729925 - DNA, 19 bp, Homo sapiens
cccaggccagcccccccac

SEQ ID NO: 6729926 - DNA, 20 bp, Homo sapiens
cccaggccagcccccccacc

SEQ ID NO: 6729927 - DNA, 21 bp, Homo sapiens
cccaggccagcccccccaccc

SEQ ID NO: 6729928 - DNA, 22 bp, Homo sapiens
cccaggccagcccccccaccca

SEQ ID NO: 6729929 - DNA, 16 bp, Homo sapiens
cccaggccagcgaggc

SEQ ID NO: 6729930 - DNA, 13 bp, Homo sapiens
cccaggccagctg

SEQ ID NO: 6729931 - DNA, 18 bp, Homo sapiens
cccaggccaggactctgc

SEQ ID NO: 6729932 - DNA, 12 bp, Homo sapiens
cccaggccaggg

SEQ ID NO: 6729933 - DNA, 18 bp, Homo sapiens
cccaggccagggctgggt

SEQ ID NO: 6729934 - DNA, 13 bp, Homo sapiens
cccaggccaggta

SEQ ID NO: 6729935 - DNA, 16 bp, Homo sapiens
cccaggccaggtccct

SEQ ID NO: 6729936 - DNA, 18 bp, Homo sapiens
cccaggccaggtgcccag

SEQ ID NO: 6729937 - DNA, 18 bp, Homo sapiens
cccaggccagtcagacgc

SEQ ID NO: 6729938 - DNA, 14 bp, Homo sapiens
cccaggccatcttc

SEQ ID NO: 6729939 - DNA, 20 bp, Homo sapiens
cccaggccatcttccaggtg

SEQ ID NO: 6729940 - DNA, 16 bp, Homo sapiens
cccaggccatgtggcc

SEQ ID NO: 6729941 - DNA, 19 bp, Homo sapiens
cccaggccatgtggcctgc

SEQ ID NO: 6729942 - DNA, 22 bp, Homo sapiens
cccaggccatgtggcctgccca

SEQ ID NO: 6729943 - DNA, 18 bp, Homo sapiens
cccaggcccaccatcacc

SEQ ID NO: 6729944 - DNA, 23 bp, Homo sapiens
cccaggcccaccatcaccaccgc

SEQ ID NO: 6729945 - DNA, 13 bp, Homo sapiens
cccaggcccactc

SEQ ID NO: 6729946 - DNA, 15 bp, Homo sapiens
cccaggcccactcag

SEQ ID NO: 6729947 - DNA, 12 bp, Homo sapiens
cccaggcccagc

SEQ ID NO: 6729948 - DNA, 13 bp, Homo sapiens
cccaggcccagcc

SEQ ID NO: 6729949 - DNA, 17 bp, Homo sapiens
cccaggcccagcctctt

SEQ ID NO: 6729950 - DNA, 17 bp, Homo sapiens
cccaggccccagacagg

SEQ ID NO: 6729951 - DNA, 13 bp, Homo sapiens
cccaggccccagc

SEQ ID NO: 6729952 - DNA, 18 bp, Homo sapiens
cccaggccccaggaagcc

SEQ ID NO: 6729953 - DNA, 16 bp, Homo sapiens
cccaggccccaggcct

SEQ ID NO: 6729954 - DNA, 14 bp, Homo sapiens
cccaggccccatga

SEQ ID NO: 6729955 - DNA, 17 bp, Homo sapiens
cccaggccccatgacct

SEQ ID NO: 6729956 - DNA, 21 bp, Homo sapiens
cccaggccccatgacctccag

SEQ ID NO: 6729957 - DNA, 11 bp, Homo sapiens
cccaggccccc

SEQ ID NO: 6729958 - DNA, 20 bp, Homo sapiens
cccaggcccccggctttcct

SEQ ID NO: 6729959 - DNA, 15 bp, Homo sapiens
cccaggccccctgca

SEQ ID NO: 6729960 - DNA, 18 bp, Homo sapiens
cccaggcccctgccaccc

SEQ ID NO: 6729961 - DNA, 20 bp, Homo sapiens
cccaggcccgccctgcccgc

SEQ ID NO: 6729962 - DNA, 22 bp, Homo sapiens
cccaggcccggatgcagaggcc

SEQ ID NO: 6729963 - DNA, 14 bp, Homo sapiens
cccaggccctacaa

SEQ ID NO: 6729964 - DNA, 23 bp, Homo sapiens
cccaggccctagaccctccccca

SEQ ID NO: 6729965 - DNA, 18 bp, Homo sapiens
cccaggccctccatgggc

SEQ ID NO: 6729966 - DNA, 14 bp, Homo sapiens
cccaggccctccca

SEQ ID NO: 6729967 - DNA, 15 bp, Homo sapiens
cccaggccctcccac

SEQ ID NO: 6729968 - DNA, 17 bp, Homo sapiens
cccaggccctcccacca

SEQ ID NO: 6729969 - DNA, 15 bp, Homo sapiens
cccaggccctccctg

SEQ ID NO: 6729970 - DNA, 14 bp, Homo sapiens
cccaggcccttcag

SEQ ID NO: 6729971 - DNA, 19 bp, Homo sapiens
cccaggcccttcaggaact

SEQ ID NO: 6729972 - DNA, 16 bp, Homo sapiens
cccaggcccttggctg

SEQ ID NO: 6729973 - DNA, 19 bp, Homo sapiens
cccaggccctttggcttct

SEQ ID NO: 6729974 - DNA, 18 bp, Homo sapiens
cccaggccgcagctcttg

SEQ ID NO: 6729975 - DNA, 16 bp, Homo sapiens
cccaggccgcctgcca

SEQ ID NO: 6729976 - DNA, 17 bp, Homo sapiens
cccaggccggccagcct

SEQ ID NO: 6729977 - DNA, 21 bp, Homo sapiens
cccaggccggccagcctcacc

SEQ ID NO: 6729978 - DNA, 15 bp, Homo sapiens
cccaggccggcccag

SEQ ID NO: 6729979 - DNA, 22 bp, Homo sapiens
cccaggccgggaagagccacct

SEQ ID NO: 6729980 - DNA, 21 bp, Homo sapiens
cccaggccggggtggagcatg

SEQ ID NO: 6729981 - DNA, 20 bp, Homo sapiens
cccaggcctacctcactctc

SEQ ID NO: 6729982 - DNA, 14 bp, Homo sapiens
cccaggcctatgtt

SEQ ID NO: 6729983 - DNA, 21 bp, Homo sapiens
cccaggcctatgttgatccat

SEQ ID NO: 6729984 - DNA, 14 bp, Homo sapiens
cccaggcctcacca

SEQ ID NO: 6729985 - DNA, 16 bp, Homo sapiens
cccaggcctcaccacc

SEQ ID NO: 6729986 - DNA, 12 bp, Homo sapiens
cccaggcctcca

SEQ ID NO: 6729987 - DNA, 13 bp, Homo sapiens
cccaggcctccag

SEQ ID NO: 6729988 - DNA, 18 bp, Homo sapiens
cccaggcctccagaacct

SEQ ID NO: 6729989 - DNA, 17 bp, Homo sapiens
cccaggcctccagctca

SEQ ID NO: 6729990 - DNA, 18 bp, Homo sapiens
cccaggcctccagctcag

SEQ ID NO: 6729991 - DNA, 13 bp, Homo sapiens
cccaggcctccct

SEQ ID NO: 6729992 - DNA, 18 bp, Homo sapiens
cccaggcctcctacagct

SEQ ID NO: 6729993 - DNA, 20 bp, Homo sapiens
cccaggcctcctaggggaag

SEQ ID NO: 6729994 - DNA, 21 bp, Homo sapiens
cccaggcctctcggtgctcca

SEQ ID NO: 6729995 - DNA, 13 bp, Homo sapiens
cccaggcctctgc

SEQ ID NO: 6729996 - DNA, 13 bp, Homo sapiens
cccaggcctctgt

SEQ ID NO: 6729997 - DNA, 16 bp, Homo sapiens
cccaggcctgagctgc

SEQ ID NO: 6729998 - DNA, 22 bp, Homo sapiens
cccaggcctgattcactggcct

SEQ ID NO: 6729999 - DNA, 15 bp, Homo sapiens
cccaggcctgccctc

SEQ ID NO: 6730000 - DNA, 18 bp, Homo sapiens
cccaggcctgccctgcta

SEQ ID NO: 6730001 - DNA, 17 bp, Homo sapiens
cccaggcctgcctgcat

SEQ ID NO: 6730002 - DNA, 18 bp, Homo sapiens
cccaggcctgctggcatc

SEQ ID NO: 6730003 - DNA, 12 bp, Homo sapiens
cccaggcctgga

SEQ ID NO: 6730004 - DNA, 13 bp, Homo sapiens
cccaggcctggac

SEQ ID NO: 6730005 - DNA, 15 bp, Homo sapiens
cccaggcctggagcg

SEQ ID NO: 6730006 - DNA, 12 bp, Homo sapiens
cccaggcctggc

SEQ ID NO: 6730007 - DNA, 15 bp, Homo sapiens
cccaggcctggctcc

SEQ ID NO: 6730008 - DNA, 19 bp, Homo sapiens
cccaggcctgggatgcagt

SEQ ID NO: 6730009 - DNA, 14 bp, Homo sapiens
cccaggcctgtcca

SEQ ID NO: 6730010 - DNA, 19 bp, Homo sapiens
cccaggcctgtggctccct

SEQ ID NO: 6730011 - DNA, 10 bp, Homo sapiens
cccaggcctt

SEQ ID NO: 6730012 - DNA, 17 bp, Homo sapiens
cccaggccttgctgact

SEQ ID NO: 6730013 - DNA, 20 bp, Homo sapiens
cccaggccttgctgactctc

SEQ ID NO: 6730014 - DNA, 14 bp, Homo sapiens
cccaggcctttgga

SEQ ID NO: 6730015 - DNA, 18 bp, Homo sapiens
cccaggcctttggagggg

SEQ ID NO: 6730016 - DNA, 19 bp, Homo sapiens
cccaggcctttggagggga

SEQ ID NO: 6730017 - DNA, 15 bp, Homo sapiens
cccaggcgcctgcgc

SEQ ID NO: 6730018 - DNA, 19 bp, Homo sapiens
cccaggcgctgcatacagg

SEQ ID NO: 6730019 - DNA, 23 bp, Homo sapiens
cccaggcggaggggcttggagca

SEQ ID NO: 6730020 - DNA, 22 bp, Homo sapiens
cccaggcgggagcggtggccct

SEQ ID NO: 6730021 - DNA, 23 bp, Homo sapiens
cccaggcgggagcggtggccctg

SEQ ID NO: 6730022 - DNA, 18 bp, Homo sapiens
cccaggctagagtgcaat

SEQ ID NO: 6730023 - DNA, 22 bp, Homo sapiens
cccaggctccatggggaagtgc

SEQ ID NO: 6730024 - DNA, 16 bp, Homo sapiens
cccaggctcccagcct

SEQ ID NO: 6730025 - DNA, 15 bp, Homo sapiens
cccaggctcccctgc

SEQ ID NO: 6730026 - DNA, 18 bp, Homo sapiens
cccaggctcccctggtct

SEQ ID NO: 6730027 - DNA, 13 bp, Homo sapiens
cccaggctctgct

SEQ ID NO: 6730028 - DNA, 19 bp, Homo sapiens
cccaggctctgctgacttc

SEQ ID NO: 6730029 - DNA, 13 bp, Homo sapiens
cccaggctctggg

SEQ ID NO: 6730030 - DNA, 15 bp, Homo sapiens
cccaggctgagagcc

SEQ ID NO: 6730031 - DNA, 18 bp, Homo sapiens
cccaggctgagagccaga

SEQ ID NO: 6730032 - DNA, 16 bp, Homo sapiens
cccaggctgagcctca

SEQ ID NO: 6730033 - DNA, 20 bp, Homo sapiens
cccaggctgcactgcagtga

SEQ ID NO: 6730034 - DNA, 14 bp, Homo sapiens
cccaggctgccgtc

SEQ ID NO: 6730035 - DNA, 22 bp, Homo sapiens
cccaggctgccgtcccctagag

SEQ ID NO: 6730036 - DNA, 18 bp, Homo sapiens
cccaggctgcctgagcac

SEQ ID NO: 6730037 - DNA, 14 bp, Homo sapiens
cccaggctggaatg

SEQ ID NO: 6730038 - DNA, 19 bp, Homo sapiens
cccaggctggaatgcagtg

SEQ ID NO: 6730039 - DNA, 22 bp, Homo sapiens
cccaggctggacatgctgactg

SEQ ID NO: 6730040 - DNA, 21 bp, Homo sapiens
cccaggctggactgcagtggc

SEQ ID NO: 6730041 - DNA, 22 bp, Homo sapiens
cccaggctggactgcagtggcc

SEQ ID NO: 6730042 - DNA, 20 bp, Homo sapiens
cccaggctggagtgcaatga

SEQ ID NO: 6730043 - DNA, 18 bp, Homo sapiens
cccaggctggagtgcagt

SEQ ID NO: 6730044 - DNA, 20 bp, Homo sapiens
cccaggctggagtgcagtgg

SEQ ID NO: 6730045 - DNA, 20 bp, Homo sapiens
cccaggctggagtgtagtgg

SEQ ID NO: 6730046 - DNA, 14 bp, Homo sapiens
cccaggctggatgc

SEQ ID NO: 6730047 - DNA, 17 bp, Homo sapiens
cccaggctggatgctgg

SEQ ID NO: 6730048 - DNA, 18 bp, Homo sapiens
cccaggctggatgctggg

SEQ ID NO: 6730049 - DNA, 17 bp, Homo sapiens
cccaggctggccagccc

SEQ ID NO: 6730050 - DNA, 19 bp, Homo sapiens
cccaggctggccagcccca

SEQ ID NO: 6730051 - DNA, 21 bp, Homo sapiens
cccaggctggcccccacccac

SEQ ID NO: 6730052 - DNA, 14 bp, Homo sapiens
cccaggctgggaac

SEQ ID NO: 6730053 - DNA, 21 bp, Homo sapiens
cccaggctgggaactcatctg

SEQ ID NO: 6730054 - DNA, 15 bp, Homo sapiens
cccaggctgttctcc

SEQ ID NO: 6730055 - DNA, 19 bp, Homo sapiens
cccaggctgttctccaggc

SEQ ID NO: 6730056 - DNA, 20 bp, Homo sapiens
cccaggcttagtcactgaga

SEQ ID NO: 6730057 - DNA, 22 bp, Homo sapiens
cccaggcttagtcactgagaca

SEQ ID NO: 6730058 - DNA, 18 bp, Homo sapiens
cccaggcttcctgggtcc

SEQ ID NO: 6730059 - DNA, 22 bp, Homo sapiens
cccaggcttcctgggtcctgcc

SEQ ID NO: 6730060 - DNA, 17 bp, Homo sapiens
cccagggaaggaaaaat

SEQ ID NO: 6730061 - DNA, 13 bp, Homo sapiens
cccagggaagtgc

SEQ ID NO: 6730062 - DNA, 15 bp, Homo sapiens
cccagggaatcaggg

SEQ ID NO: 6730063 - DNA, 18 bp, Homo sapiens
cccagggaatcagggacc

SEQ ID NO: 6730064 - DNA, 23 bp, Homo sapiens
cccagggaatcagggaccagctt

SEQ ID NO: 6730065 - DNA, 23 bp, Homo sapiens
cccagggacaaaacactgtgtcc

SEQ ID NO: 6730066 - DNA, 19 bp, Homo sapiens
cccagggacaagggaagga

SEQ ID NO: 6730067 - DNA, 18 bp, Homo sapiens
cccagggacaccagccag

SEQ ID NO: 6730068 - DNA, 19 bp, Homo sapiens
cccagggacaccagccagg

SEQ ID NO: 6730069 - DNA, 18 bp, Homo sapiens
cccagggacacctgggag

SEQ ID NO: 6730070 - DNA, 20 bp, Homo sapiens
cccagggacagaggccaagg

SEQ ID NO: 6730071 - DNA, 20 bp, Homo sapiens
cccagggagactccgctgtg

SEQ ID NO: 6730072 - DNA, 18 bp, Homo sapiens
cccagggagaggctgtgt

SEQ ID NO: 6730073 - DNA, 19 bp, Homo sapiens
cccagggagcaatgggagg

SEQ ID NO: 6730074 - DNA, 20 bp, Homo sapiens
cccagggagcaatgggaggg

SEQ ID NO: 6730075 - DNA, 15 bp, Homo sapiens
cccagggagcggaaa

SEQ ID NO: 6730076 - DNA, 20 bp, Homo sapiens
cccagggagcggaaagcagc

SEQ ID NO: 6730077 - DNA, 16 bp, Homo sapiens
cccagggagctctgca

SEQ ID NO: 6730078 - DNA, 13 bp, Homo sapiens
cccagggagctga

SEQ ID NO: 6730079 - DNA, 10 bp, Homo sapiens
cccagggagg

SEQ ID NO: 6730080 - DNA, 16 bp, Homo sapiens
cccagggaggcagcgt

SEQ ID NO: 6730081 - DNA, 22 bp, Homo sapiens
cccagggagggaagtgtgagcg

SEQ ID NO: 6730082 - DNA, 14 bp, Homo sapiens
cccagggagggtga

SEQ ID NO: 6730083 - DNA, 19 bp, Homo sapiens
cccagggaggtggcaggga

SEQ ID NO: 6730084 - DNA, 14 bp, Homo sapiens
cccagggagtgagc

SEQ ID NO: 6730085 - DNA, 18 bp, Homo sapiens
cccagggagtgagcagct

SEQ ID NO: 6730086 - DNA, 9 bp, Homo sapiens
cccagggat

SEQ ID NO: 6730087 - DNA, 17 bp, Homo sapiens
cccagggcacaggagct

SEQ ID NO: 6730088 - DNA, 20 bp, Homo sapiens
cccagggcaccatccagctc

SEQ ID NO: 6730089 - DNA, 15 bp, Homo sapiens
cccagggcacccagg

SEQ ID NO: 6730090 - DNA, 18 bp, Homo sapiens
cccagggcacccaggcag

SEQ ID NO: 6730091 - DNA, 13 bp, Homo sapiens
cccagggcaccct

SEQ ID NO: 6730092 - DNA, 14 bp, Homo sapiens
cccagggcacgtgg

SEQ ID NO: 6730093 - DNA, 20 bp, Homo sapiens
cccagggcactgccagccca

SEQ ID NO: 6730094 - DNA, 18 bp, Homo sapiens
cccagggcacttcacaga

SEQ ID NO: 6730095 - DNA, 12 bp, Homo sapiens
cccagggcagcc

SEQ ID NO: 6730096 - DNA, 18 bp, Homo sapiens
cccagggcagccagggag

SEQ ID NO: 6730097 - DNA, 19 bp, Homo sapiens
cccagggcagtgtggtggg

SEQ ID NO: 6730098 - DNA, 14 bp, Homo sapiens
cccagggcatccca

SEQ ID NO: 6730099 - DNA, 21 bp, Homo sapiens
cccagggcatcccatgggggt

SEQ ID NO: 6730100 - DNA, 17 bp, Homo sapiens
cccagggcatcttgctg

SEQ ID NO: 6730101 - DNA, 21 bp, Homo sapiens
cccagggcatcttgctggcta

SEQ ID NO: 6730102 - DNA, 18 bp, Homo sapiens
cccagggccactctgcct

SEQ ID NO: 6730103 - DNA, 17 bp, Homo sapiens
cccagggccagggccct

SEQ ID NO: 6730104 - DNA, 18 bp, Homo sapiens
cccagggccagggccctg

SEQ ID NO: 6730105 - DNA, 21 bp, Homo sapiens
cccagggccagggccctgcag

SEQ ID NO: 6730106 - DNA, 16 bp, Homo sapiens
cccagggcccagagcc

SEQ ID NO: 6730107 - DNA, 20 bp, Homo sapiens
cccagggcccccacaggccc

SEQ ID NO: 6730108 - DNA, 22 bp, Homo sapiens
cccagggcccctccctctgccc

SEQ ID NO: 6730109 - DNA, 14 bp, Homo sapiens
cccagggcccgagc

SEQ ID NO: 6730110 - DNA, 19 bp, Homo sapiens
cccagggcccgggcaccca

SEQ ID NO: 6730111 - DNA, 23 bp, Homo sapiens
cccagggccctcggtgggagcca

SEQ ID NO: 6730112 - DNA, 12 bp, Homo sapiens
cccagggccctg

SEQ ID NO: 6730113 - DNA, 17 bp, Homo sapiens
cccagggccctgctcag

SEQ ID NO: 6730114 - DNA, 18 bp, Homo sapiens
cccagggccctgctcagg

SEQ ID NO: 6730115 - DNA, 20 bp, Homo sapiens
cccagggccctgctcaggcc

SEQ ID NO: 6730116 - DNA, 14 bp, Homo sapiens
cccagggccctggc

SEQ ID NO: 6730117 - DNA, 20 bp, Homo sapiens
cccagggccctggccagccg

SEQ ID NO: 6730118 - DNA, 21 bp, Homo sapiens
cccagggcctagaggtaaccg

SEQ ID NO: 6730119 - DNA, 15 bp, Homo sapiens
cccagggcctccagg

SEQ ID NO: 6730120 - DNA, 16 bp, Homo sapiens
cccagggcctccagga

SEQ ID NO: 6730121 - DNA, 16 bp, Homo sapiens
cccagggcctcctggg

SEQ ID NO: 6730122 - DNA, 16 bp, Homo sapiens
cccagggcctctggct

SEQ ID NO: 6730123 - DNA, 23 bp, Homo sapiens
cccagggcctctggcttccctgc

SEQ ID NO: 6730124 - DNA, 15 bp, Homo sapiens
cccagggcctgactt

SEQ ID NO: 6730125 - DNA, 20 bp, Homo sapiens
cccagggcctgacttgagcc

SEQ ID NO: 6730126 - DNA, 13 bp, Homo sapiens
cccagggcctgag

SEQ ID NO: 6730127 - DNA, 14 bp, Homo sapiens
cccagggcctgcag

SEQ ID NO: 6730128 - DNA, 14 bp, Homo sapiens
cccagggcctgggg

SEQ ID NO: 6730129 - DNA, 20 bp, Homo sapiens
cccagggcctgggggcagtg

SEQ ID NO: 6730130 - DNA, 15 bp, Homo sapiens
cccagggcctgtctc

SEQ ID NO: 6730131 - DNA, 16 bp, Homo sapiens
cccagggcctgtctcc

SEQ ID NO: 6730132 - DNA, 21 bp, Homo sapiens
cccagggcctgtctcccttct

SEQ ID NO: 6730133 - DNA, 18 bp, Homo sapiens
cccagggctacacagacc

SEQ ID NO: 6730134 - DNA, 21 bp, Homo sapiens
cccagggctaccctcccccag

SEQ ID NO: 6730135 - DNA, 21 bp, Homo sapiens
cccagggctagtgaagtggcc

SEQ ID NO: 6730136 - DNA, 18 bp, Homo sapiens
cccagggctcagcctggt

SEQ ID NO: 6730137 - DNA, 20 bp, Homo sapiens
cccagggctcagcctggtgg

SEQ ID NO: 6730138 - DNA, 19 bp, Homo sapiens
cccagggctccctcctgga

SEQ ID NO: 6730139 - DNA, 13 bp, Homo sapiens
cccagggctctct

SEQ ID NO: 6730140 - DNA, 15 bp, Homo sapiens
cccagggctctctgg

SEQ ID NO: 6730141 - DNA, 17 bp, Homo sapiens
cccagggctctctggac

SEQ ID NO: 6730142 - DNA, 20 bp, Homo sapiens
cccagggctctctggaccat

SEQ ID NO: 6730143 - DNA, 12 bp, Homo sapiens
cccagggctctg

SEQ ID NO: 6730144 - DNA, 17 bp, Homo sapiens
cccagggctctgcccca

SEQ ID NO: 6730145 - DNA, 11 bp, Homo sapiens
cccagggctgg

SEQ ID NO: 6730146 - DNA, 14 bp, Homo sapiens
cccagggctggaga

SEQ ID NO: 6730147 - DNA, 16 bp, Homo sapiens
cccagggctggcccta

SEQ ID NO: 6730148 - DNA, 15 bp, Homo sapiens
cccagggctggctct

SEQ ID NO: 6730149 - DNA, 18 bp, Homo sapiens
cccagggctggctctgca

SEQ ID NO: 6730150 - DNA, 20 bp, Homo sapiens
cccagggctgggaggaagga

SEQ ID NO: 6730151 - DNA, 17 bp, Homo sapiens
cccaggggaaggccctg

SEQ ID NO: 6730152 - DNA, 18 bp, Homo sapiens
cccaggggacaagggatt

SEQ ID NO: 6730153 - DNA, 17 bp, Homo sapiens
cccaggggaccacacct

SEQ ID NO: 6730154 - DNA, 15 bp, Homo sapiens
cccaggggacgtggg

SEQ ID NO: 6730155 - DNA, 20 bp, Homo sapiens
cccaggggacgtgggccctg

SEQ ID NO: 6730156 - DNA, 19 bp, Homo sapiens
cccaggggagaatgcagcc

SEQ ID NO: 6730157 - DNA, 21 bp, Homo sapiens
cccaggggagaatgcagccca

SEQ ID NO: 6730158 - DNA, 23 bp, Homo sapiens
cccaggggagagggtctggagaa

SEQ ID NO: 6730159 - DNA, 14 bp, Homo sapiens
cccaggggagccag

SEQ ID NO: 6730160 - DNA, 15 bp, Homo sapiens
cccaggggagccagc

SEQ ID NO: 6730161 - DNA, 14 bp, Homo sapiens
cccaggggagccct

SEQ ID NO: 6730162 - DNA, 16 bp, Homo sapiens
cccaggggaggtgtat

SEQ ID NO: 6730163 - DNA, 15 bp, Homo sapiens
cccaggggcagcaag

SEQ ID NO: 6730164 - DNA, 18 bp, Homo sapiens
cccaggggcagcaaggcc

SEQ ID NO: 6730165 - DNA, 23 bp, Homo sapiens
cccaggggcgagttcctcgctct

SEQ ID NO: 6730166 - DNA, 14 bp, Homo sapiens
cccaggggctccct

SEQ ID NO: 6730167 - DNA, 16 bp, Homo sapiens
cccaggggctccctcc

SEQ ID NO: 6730168 - DNA, 17 bp, Homo sapiens
cccaggggctccctccg

SEQ ID NO: 6730169 - DNA, 12 bp, Homo sapiens
cccagggggcct

SEQ ID NO: 6730170 - DNA, 14 bp, Homo sapiens
cccaggggggcctc

SEQ ID NO: 6730171 - DNA, 22 bp, Homo sapiens
cccagggggtctcacccatgca

SEQ ID NO: 6730172 - DNA, 15 bp, Homo sapiens
cccaggggtcagcag

SEQ ID NO: 6730173 - DNA, 18 bp, Homo sapiens
cccaggggtccaggcccc

SEQ ID NO: 6730174 - DNA, 19 bp, Homo sapiens
cccaggggtcccagccacc

SEQ ID NO: 6730175 - DNA, 21 bp, Homo sapiens
cccaggggtctccctggctcc

SEQ ID NO: 6730176 - DNA, 23 bp, Homo sapiens
cccaggggtctccctggctccct

SEQ ID NO: 6730177 - DNA, 18 bp, Homo sapiens
cccaggggtgccccctcc

SEQ ID NO: 6730178 - DNA, 22 bp, Homo sapiens
cccaggggtgccccctcctctc

SEQ ID NO: 6730179 - DNA, 20 bp, Homo sapiens
cccaggggtggggcccatgg

SEQ ID NO: 6730180 - DNA, 22 bp, Homo sapiens
cccaggggtggggcccatgggg

SEQ ID NO: 6730181 - DNA, 15 bp, Homo sapiens
cccagggtagcccgc

SEQ ID NO: 6730182 - DNA, 19 bp, Homo sapiens
cccagggtagcccgcctgc

SEQ ID NO: 6730183 - DNA, 23 bp, Homo sapiens
cccagggtagcccgcctgccagt

SEQ ID NO: 6730184 - DNA, 16 bp, Homo sapiens
cccagggtcccacccc

SEQ ID NO: 6730185 - DNA, 19 bp, Homo sapiens
cccagggtcccacccccaa

SEQ ID NO: 6730186 - DNA, 21 bp, Homo sapiens
cccagggtcccctgcatggct

SEQ ID NO: 6730187 - DNA, 17 bp, Homo sapiens
cccagggtcctgtgcct

SEQ ID NO: 6730188 - DNA, 11 bp, Homo sapiens
cccagggtctg

SEQ ID NO: 6730189 - DNA, 13 bp, Homo sapiens
cccagggtggcca

SEQ ID NO: 6730190 - DNA, 16 bp, Homo sapiens
cccagggtggctgcca

SEQ ID NO: 6730191 - DNA, 19 bp, Homo sapiens
cccagggtgggaagggcta

SEQ ID NO: 6730192 - DNA, 17 bp, Homo sapiens
cccaggtaagcaggagg

SEQ ID NO: 6730193 - DNA, 16 bp, Homo sapiens
cccaggtaccagctgc

SEQ ID NO: 6730194 - DNA, 17 bp, Homo sapiens
cccaggtaggggcccct

SEQ ID NO: 6730195 - DNA, 20 bp, Homo sapiens
cccaggtaggggcccctctc

SEQ ID NO: 6730196 - DNA, 23 bp, Homo sapiens
cccaggtaggggcccctctcagc

SEQ ID NO: 6730197 - DNA, 15 bp, Homo sapiens
cccaggtataaaacc

SEQ ID NO: 6730198 - DNA, 19 bp, Homo sapiens
cccaggtcagctgttactt

SEQ ID NO: 6730199 - DNA, 14 bp, Homo sapiens
cccaggtcatggaa

SEQ ID NO: 6730200 - DNA, 16 bp, Homo sapiens
cccaggtcccagtgcc

SEQ ID NO: 6730201 - DNA, 17 bp, Homo sapiens
cccaggtccccaaactt

SEQ ID NO: 6730202 - DNA, 20 bp, Homo sapiens
cccaggtcccccgactgcct

SEQ ID NO: 6730203 - DNA, 18 bp, Homo sapiens
cccaggtcgggcagtgga

SEQ ID NO: 6730204 - DNA, 21 bp, Homo sapiens
cccaggtctccctggatcaga

SEQ ID NO: 6730205 - DNA, 14 bp, Homo sapiens
cccaggtctcttcc

SEQ ID NO: 6730206 - DNA, 15 bp, Homo sapiens
cccaggtctgatgcc

SEQ ID NO: 6730207 - DNA, 15 bp, Homo sapiens
cccaggtcttccaga

SEQ ID NO: 6730208 - DNA, 19 bp, Homo sapiens
cccaggtcttccagacctg

SEQ ID NO: 6730209 - DNA, 13 bp, Homo sapiens
cccaggtcttcct

SEQ ID NO: 6730210 - DNA, 16 bp, Homo sapiens
cccaggtcttcctgct

SEQ ID NO: 6730211 - DNA, 19 bp, Homo sapiens
cccaggtcttcctgctttc

SEQ ID NO: 6730212 - DNA, 15 bp, Homo sapiens
cccaggtcttttctt

SEQ ID NO: 6730213 - DNA, 15 bp, Homo sapiens
cccaggtgagacctc

SEQ ID NO: 6730214 - DNA, 15 bp, Homo sapiens
cccaggtgatttcct

SEQ ID NO: 6730215 - DNA, 21 bp, Homo sapiens
cccaggtgcagccccagggcc

SEQ ID NO: 6730216 - DNA, 22 bp, Homo sapiens
cccaggtgcagccccagggcct

SEQ ID NO: 6730217 - DNA, 20 bp, Homo sapiens
cccaggtgccaccaataaaa

SEQ ID NO: 6730218 - DNA, 13 bp, Homo sapiens
cccaggtgccagt

SEQ ID NO: 6730219 - DNA, 13 bp, Homo sapiens
cccaggtgccccg

SEQ ID NO: 6730220 - DNA, 23 bp, Homo sapiens
cccaggtgctaggaacactcctt

SEQ ID NO: 6730221 - DNA, 19 bp, Homo sapiens
cccaggtggagggcacagc

SEQ ID NO: 6730222 - DNA, 23 bp, Homo sapiens
cccaggtggaggtgccaggaagc

SEQ ID NO: 6730223 - DNA, 22 bp, Homo sapiens
cccaggtggctgacccagtccc

SEQ ID NO: 6730224 - DNA, 15 bp, Homo sapiens
cccaggtgggtcccg

SEQ ID NO: 6730225 - DNA, 18 bp, Homo sapiens
cccaggtgtgcctgtgct

SEQ ID NO: 6730226 - DNA, 22 bp, Homo sapiens
cccaggtgttaacattccaaga

SEQ ID NO: 6730227 - DNA, 15 bp, Homo sapiens
cccaggttcagtgcg

SEQ ID NO: 6730228 - DNA, 17 bp, Homo sapiens
cccaggttcccccagca

SEQ ID NO: 6730229 - DNA, 13 bp, Homo sapiens
cccaggttggagg

SEQ ID NO: 6730230 - DNA, 13 bp, Homo sapiens
cccaggtttctat

SEQ ID NO: 6730231 - DNA, 13 bp, Homo sapiens
cccaggtttctgg

SEQ ID NO: 6730232 - DNA, 18 bp, Homo sapiens
cccaggtttcttctctgg

SEQ ID NO: 6730233 - DNA, 18 bp, Homo sapiens
cccaggtttttcatctga

SEQ ID NO: 6730234 - DNA, 21 bp, Homo sapiens
cccaggtttttgcccatcctc

SEQ ID NO: 6730235 - DNA, 17 bp, Homo sapiens
cccagtaaaattgccat

SEQ ID NO: 6730236 - DNA, 13 bp, Homo sapiens
cccagtaaaattt

SEQ ID NO: 6730237 - DNA, 16 bp, Homo sapiens
cccagtaaaatttcag

SEQ ID NO: 6730238 - DNA, 14 bp, Homo sapiens
cccagtaagggcgt

SEQ ID NO: 6730239 - DNA, 21 bp, Homo sapiens
cccagtacctagctggctctg

SEQ ID NO: 6730240 - DNA, 16 bp, Homo sapiens
cccagtacctccaagc

SEQ ID NO: 6730241 - DNA, 20 bp, Homo sapiens
cccagtacctcctgtctctg

SEQ ID NO: 6730242 - DNA, 22 bp, Homo sapiens
cccagtacctcctgtctctggc

SEQ ID NO: 6730243 - DNA, 16 bp, Homo sapiens
cccagtatacctcatt

SEQ ID NO: 6730244 - DNA, 16 bp, Homo sapiens
cccagtattactgctg

SEQ ID NO: 6730245 - DNA, 17 bp, Homo sapiens
cccagtattactgctgc

SEQ ID NO: 6730246 - DNA, 19 bp, Homo sapiens
cccagtattactgctgctg

SEQ ID NO: 6730247 - DNA, 12 bp, Homo sapiens
cccagtcacctc

SEQ ID NO: 6730248 - DNA, 13 bp, Homo sapiens
cccagtcacctcc

SEQ ID NO: 6730249 - DNA, 14 bp, Homo sapiens
cccagtcacctccc

SEQ ID NO: 6730250 - DNA, 19 bp, Homo sapiens
cccagtcacctccccacat

SEQ ID NO: 6730251 - DNA, 21 bp, Homo sapiens
cccagtcacctcttctgccag

SEQ ID NO: 6730252 - DNA, 13 bp, Homo sapiens
cccagtcacttcc

SEQ ID NO: 6730253 - DNA, 14 bp, Homo sapiens
cccagtcagaaata

SEQ ID NO: 6730254 - DNA, 14 bp, Homo sapiens
cccagtcagcctct

SEQ ID NO: 6730255 - DNA, 16 bp, Homo sapiens
cccagtcagcctctct

SEQ ID NO: 6730256 - DNA, 19 bp, Homo sapiens
cccagtcagcctctctccc

SEQ ID NO: 6730257 - DNA, 20 bp, Homo sapiens
cccagtcagcctctctccca

SEQ ID NO: 6730258 - DNA, 22 bp, Homo sapiens
cccagtcagcctggctgggctc

SEQ ID NO: 6730259 - DNA, 21 bp, Homo sapiens
cccagtcatgacatttctcaa

SEQ ID NO: 6730260 - DNA, 23 bp, Homo sapiens
cccagtccaaatgtcctccagaa

SEQ ID NO: 6730261 - DNA, 17 bp, Homo sapiens
cccagtccactggggag

SEQ ID NO: 6730262 - DNA, 18 bp, Homo sapiens
cccagtccatgctccagg

SEQ ID NO: 6730263 - DNA, 15 bp, Homo sapiens
cccagtcccacactg

SEQ ID NO: 6730264 - DNA, 17 bp, Homo sapiens
cccagtcccagcagcca

SEQ ID NO: 6730265 - DNA, 13 bp, Homo sapiens
cccagtcccagcc

SEQ ID NO: 6730266 - DNA, 15 bp, Homo sapiens
cccagtcccagcctc

SEQ ID NO: 6730267 - DNA, 14 bp, Homo sapiens
cccagtccccaccc

SEQ ID NO: 6730268 - DNA, 13 bp, Homo sapiens
cccagtccccagc

SEQ ID NO: 6730269 - DNA, 15 bp, Homo sapiens
cccagtccccagccc

SEQ ID NO: 6730270 - DNA, 17 bp, Homo sapiens
cccagtccccagccctg

SEQ ID NO: 6730271 - DNA, 19 bp, Homo sapiens
cccagtccccagccctggg

SEQ ID NO: 6730272 - DNA, 20 bp, Homo sapiens
cccagtcccccaaccccagc

SEQ ID NO: 6730273 - DNA, 12 bp, Homo sapiens
cccagtccctgg

SEQ ID NO: 6730274 - DNA, 14 bp, Homo sapiens
cccagtccctggag

SEQ ID NO: 6730275 - DNA, 16 bp, Homo sapiens
cccagtccgccccgtg

SEQ ID NO: 6730276 - DNA, 16 bp, Homo sapiens
cccagtccggtgcctt

SEQ ID NO: 6730277 - DNA, 17 bp, Homo sapiens
cccagtccggtgccttc

SEQ ID NO: 6730278 - DNA, 18 bp, Homo sapiens
cccagtcctctgcctcca

SEQ ID NO: 6730279 - DNA, 19 bp, Homo sapiens
cccagtcctgatggccgct

SEQ ID NO: 6730280 - DNA, 15 bp, Homo sapiens
cccagtcctgcccgc

SEQ ID NO: 6730281 - DNA, 14 bp, Homo sapiens
cccagtcctgcctg

SEQ ID NO: 6730282 - DNA, 15 bp, Homo sapiens
cccagtcctggccat

SEQ ID NO: 6730283 - DNA, 15 bp, Homo sapiens
cccagtcctggcctg

SEQ ID NO: 6730284 - DNA, 12 bp, Homo sapiens
cccagtcctggg

SEQ ID NO: 6730285 - DNA, 13 bp, Homo sapiens
cccagtcctgggt

SEQ ID NO: 6730286 - DNA, 14 bp, Homo sapiens
cccagtcctgggtt

SEQ ID NO: 6730287 - DNA, 15 bp, Homo sapiens
cccagtcctgggttg

SEQ ID NO: 6730288 - DNA, 16 bp, Homo sapiens
cccagtcctgggttgt

SEQ ID NO: 6730289 - DNA, 17 bp, Homo sapiens
cccagtccttccacctc

SEQ ID NO: 6730290 - DNA, 18 bp, Homo sapiens
cccagtcgaccccaaagg

SEQ ID NO: 6730291 - DNA, 16 bp, Homo sapiens
cccagtcgagccctgc

SEQ ID NO: 6730292 - DNA, 15 bp, Homo sapiens
cccagtcgaggctgg

SEQ ID NO: 6730293 - DNA, 18 bp, Homo sapiens
cccagtcggccccatctc

SEQ ID NO: 6730294 - DNA, 13 bp, Homo sapiens
cccagtctcatct

SEQ ID NO: 6730295 - DNA, 20 bp, Homo sapiens
cccagtctctggcagttctg

SEQ ID NO: 6730296 - DNA, 14 bp, Homo sapiens
cccagtctgatatt

SEQ ID NO: 6730297 - DNA, 10 bp, Homo sapiens
cccagtctgg

SEQ ID NO: 6730298 - DNA, 17 bp, Homo sapiens
cccagtctggaagaaga

SEQ ID NO: 6730299 - DNA, 19 bp, Homo sapiens
cccagtctggaatgcagtg

SEQ ID NO: 6730300 - DNA, 15 bp, Homo sapiens
cccagtctttcttca

SEQ ID NO: 6730301 - DNA, 20 bp, Homo sapiens
cccagtctttggagagctca

SEQ ID NO: 6730302 - DNA, 18 bp, Homo sapiens
cccagtgaactcctgcca

SEQ ID NO: 6730303 - DNA, 20 bp, Homo sapiens
cccagtgaactcctgccagg

SEQ ID NO: 6730304 - DNA, 19 bp, Homo sapiens
cccagtgaatccctgggag

SEQ ID NO: 6730305 - DNA, 20 bp, Homo sapiens
cccagtgaatccctgggagc

SEQ ID NO: 6730306 - DNA, 20 bp, Homo sapiens
cccagtgacaaagactcctc

SEQ ID NO: 6730307 - DNA, 23 bp, Homo sapiens
cccagtgacaaagactcctctgg

SEQ ID NO: 6730308 - DNA, 12 bp, Homo sapiens
cccagtgacact

SEQ ID NO: 6730309 - DNA, 19 bp, Homo sapiens
cccagtgacacttcagaga

SEQ ID NO: 6730310 - DNA, 22 bp, Homo sapiens
cccagtgacacttcagagagct

SEQ ID NO: 6730311 - DNA, 20 bp, Homo sapiens
cccagtgagaagggcctgct

SEQ ID NO: 6730312 - DNA, 16 bp, Homo sapiens
cccagtgagagtgagg

SEQ ID NO: 6730313 - DNA, 19 bp, Homo sapiens
cccagtgagattacagagg

SEQ ID NO: 6730314 - DNA, 15 bp, Homo sapiens
cccagtgagccctgc

SEQ ID NO: 6730315 - DNA, 18 bp, Homo sapiens
cccagtgagccctgctct

SEQ ID NO: 6730316 - DNA, 12 bp, Homo sapiens
cccagtgagcct

SEQ ID NO: 6730317 - DNA, 13 bp, Homo sapiens
cccagtgagcctc

SEQ ID NO: 6730318 - DNA, 17 bp, Homo sapiens
cccagtgagcctctgcg

SEQ ID NO: 6730319 - DNA, 15 bp, Homo sapiens
cccagtgatggcatt

SEQ ID NO: 6730320 - DNA, 19 bp, Homo sapiens
cccagtgatttacatgctg

SEQ ID NO: 6730321 - DNA, 22 bp, Homo sapiens
cccagtgcaatctgtccagaca

SEQ ID NO: 6730322 - DNA, 17 bp, Homo sapiens
cccagtgcagaatgtaa

SEQ ID NO: 6730323 - DNA, 22 bp, Homo sapiens
cccagtgccaagcacagtgcct

SEQ ID NO: 6730324 - DNA, 13 bp, Homo sapiens
cccagtgccacag

SEQ ID NO: 6730325 - DNA, 19 bp, Homo sapiens
cccagtgccagctccagtg

SEQ ID NO: 6730326 - DNA, 13 bp, Homo sapiens
cccagtgcccaca

SEQ ID NO: 6730327 - DNA, 15 bp, Homo sapiens
cccagtgcccacagg

SEQ ID NO: 6730328 - DNA, 14 bp, Homo sapiens
cccagtgcccccac

SEQ ID NO: 6730329 - DNA, 22 bp, Homo sapiens
cccagtgcccggtgcagggcct

SEQ ID NO: 6730330 - DNA, 18 bp, Homo sapiens
cccagtgccgagaaggaa

SEQ ID NO: 6730331 - DNA, 20 bp, Homo sapiens
cccagtgcctcaccttccaa

SEQ ID NO: 6730332 - DNA, 13 bp, Homo sapiens
cccagtgcctgcc

SEQ ID NO: 6730333 - DNA, 19 bp, Homo sapiens
cccagtgcctgccactctc

SEQ ID NO: 6730334 - DNA, 11 bp, Homo sapiens
cccagtgcctt

SEQ ID NO: 6730335 - DNA, 21 bp, Homo sapiens
cccagtgcggttcctcatctg

SEQ ID NO: 6730336 - DNA, 21 bp, Homo sapiens
cccagtgctcacacaatcaga

SEQ ID NO: 6730337 - DNA, 15 bp, Homo sapiens
cccagtgctcctggc

SEQ ID NO: 6730338 - DNA, 15 bp, Homo sapiens
cccagtgctcctgtg

SEQ ID NO: 6730339 - DNA, 12 bp, Homo sapiens
cccagtgctgcc

SEQ ID NO: 6730340 - DNA, 22 bp, Homo sapiens
cccagtgctgccatgccactgc

SEQ ID NO: 6730341 - DNA, 15 bp, Homo sapiens
cccagtgctgctgta

SEQ ID NO: 6730342 - DNA, 12 bp, Homo sapiens
cccagtgctgga

SEQ ID NO: 6730343 - DNA, 13 bp, Homo sapiens
cccagtgctggcc

SEQ ID NO: 6730344 - DNA, 15 bp, Homo sapiens
cccagtgctggccac

SEQ ID NO: 6730345 - DNA, 13 bp, Homo sapiens
cccagtgcttctc

SEQ ID NO: 6730346 - DNA, 23 bp, Homo sapiens
cccagtggaattccaacttgaag

SEQ ID NO: 6730347 - DNA, 15 bp, Homo sapiens
cccagtggcagggca

SEQ ID NO: 6730348 - DNA, 20 bp, Homo sapiens
cccagtggcagggcacaggg

SEQ ID NO: 6730349 - DNA, 17 bp, Homo sapiens
cccagtggccactcagc

SEQ ID NO: 6730350 - DNA, 22 bp, Homo sapiens
cccagtggccactcagcttcct

SEQ ID NO: 6730351 - DNA, 13 bp, Homo sapiens
cccagtggcctca

SEQ ID NO: 6730352 - DNA, 14 bp, Homo sapiens
cccagtggctgctg

SEQ ID NO: 6730353 - DNA, 18 bp, Homo sapiens
cccagtgggacccacagt

SEQ ID NO: 6730354 - DNA, 17 bp, Homo sapiens
cccagtgggagcttccc

SEQ ID NO: 6730355 - DNA, 15 bp, Homo sapiens
cccagtgggaggcgc

SEQ ID NO: 6730356 - DNA, 19 bp, Homo sapiens
cccagtgggaggggcaggc

SEQ ID NO: 6730357 - DNA, 20 bp, Homo sapiens
cccagtgggaggggcaggct

SEQ ID NO: 6730358 - DNA, 21 bp, Homo sapiens
cccagtgggaggggcaggctg

SEQ ID NO: 6730359 - DNA, 15 bp, Homo sapiens
cccagtgggatggga

SEQ ID NO: 6730360 - DNA, 18 bp, Homo sapiens
cccagtgggctgcacgct

SEQ ID NO: 6730361 - DNA, 15 bp, Homo sapiens
cccagtggggacagg

SEQ ID NO: 6730362 - DNA, 19 bp, Homo sapiens
cccagtggggacagggagg

SEQ ID NO: 6730363 - DNA, 21 bp, Homo sapiens
cccagtggggacagggagggg

SEQ ID NO: 6730364 - DNA, 16 bp, Homo sapiens
cccagtgggtctggga

SEQ ID NO: 6730365 - DNA, 21 bp, Homo sapiens
cccagtgggtgatgcttttgc

SEQ ID NO: 6730366 - DNA, 13 bp, Homo sapiens
cccagtggtgcgg

SEQ ID NO: 6730367 - DNA, 19 bp, Homo sapiens
cccagtgtaaagaataaat

SEQ ID NO: 6730368 - DNA, 16 bp, Homo sapiens
cccagtgtccccaggg

SEQ ID NO: 6730369 - DNA, 20 bp, Homo sapiens
cccagtgtctggcccagcca

SEQ ID NO: 6730370 - DNA, 21 bp, Homo sapiens
cccagtgtctggcccagccat

SEQ ID NO: 6730371 - DNA, 18 bp, Homo sapiens
cccagtgtcttcctgtgg

SEQ ID NO: 6730372 - DNA, 20 bp, Homo sapiens
cccagtgtgagaccccaaag

SEQ ID NO: 6730373 - DNA, 15 bp, Homo sapiens
cccagtgtggcccca

SEQ ID NO: 6730374 - DNA, 13 bp, Homo sapiens
cccagtgtgtgct

SEQ ID NO: 6730375 - DNA, 21 bp, Homo sapiens
cccagtgtgtgctcagcagcc

SEQ ID NO: 6730376 - DNA, 18 bp, Homo sapiens
cccagtgttgtttgtaaa

SEQ ID NO: 6730377 - DNA, 14 bp, Homo sapiens
cccagttaaatatg

SEQ ID NO: 6730378 - DNA, 14 bp, Homo sapiens
cccagttagcccgg

SEQ ID NO: 6730379 - DNA, 17 bp, Homo sapiens
cccagttagcccggcca

SEQ ID NO: 6730380 - DNA, 22 bp, Homo sapiens
cccagttcaactcatggagatg

SEQ ID NO: 6730381 - DNA, 22 bp, Homo sapiens
cccagttcaggagtcccaagga

SEQ ID NO: 6730382 - DNA, 21 bp, Homo sapiens
cccagttcatcaccatttcct

SEQ ID NO: 6730383 - DNA, 14 bp, Homo sapiens
cccagttcatctct

SEQ ID NO: 6730384 - DNA, 20 bp, Homo sapiens
cccagttcatctctgctgaa

SEQ ID NO: 6730385 - DNA, 14 bp, Homo sapiens
cccagttccacagc

SEQ ID NO: 6730386 - DNA, 15 bp, Homo sapiens
cccagttccacagca

SEQ ID NO: 6730387 - DNA, 16 bp, Homo sapiens
cccagttcctgtggct

SEQ ID NO: 6730388 - DNA, 18 bp, Homo sapiens
cccagttcctgtggctcc

SEQ ID NO: 6730389 - DNA, 22 bp, Homo sapiens
cccagttccttaggagatgtca

SEQ ID NO: 6730390 - DNA, 15 bp, Homo sapiens
cccagttcctttaga

SEQ ID NO: 6730391 - DNA, 22 bp, Homo sapiens
cccagttctgaataacttgaag

SEQ ID NO: 6730392 - DNA, 14 bp, Homo sapiens
cccagttctgctcc

SEQ ID NO: 6730393 - DNA, 22 bp, Homo sapiens
cccagttctgctcctctccagg

SEQ ID NO: 6730394 - DNA, 17 bp, Homo sapiens
cccagttcttcctgcaa

SEQ ID NO: 6730395 - DNA, 18 bp, Homo sapiens
cccagttcttcctgcaac

SEQ ID NO: 6730396 - DNA, 21 bp, Homo sapiens
cccagttggagctccagcctg

SEQ ID NO: 6730397 - DNA, 15 bp, Homo sapiens
cccagttggaggaga

SEQ ID NO: 6730398 - DNA, 20 bp, Homo sapiens
cccagttggaggagactggg

SEQ ID NO: 6730399 - DNA, 23 bp, Homo sapiens
cccagttggaggagactgggcac

SEQ ID NO: 6730400 - DNA, 21 bp, Homo sapiens
cccagttggcccttctgccct

SEQ ID NO: 6730401 - DNA, 21 bp, Homo sapiens
cccagttggggaagccaggtg

SEQ ID NO: 6730402 - DNA, 17 bp, Homo sapiens
cccagttgtccatgaca

SEQ ID NO: 6730403 - DNA, 19 bp, Homo sapiens
cccagttgtccgtgaagag

SEQ ID NO: 6730404 - DNA, 16 bp, Homo sapiens
cccagtttcccactct

SEQ ID NO: 6730405 - DNA, 22 bp, Homo sapiens
cccagtttcccttctatgcagt

SEQ ID NO: 6730406 - DNA, 23 bp, Homo sapiens
cccagtttctaaactggagactg

SEQ ID NO: 6730407 - DNA, 17 bp, Homo sapiens
cccagtttctgcctctg

SEQ ID NO: 6730408 - DNA, 20 bp, Homo sapiens
cccataaacagcacacctgt

SEQ ID NO: 6730409 - DNA, 23 bp, Homo sapiens
cccataacaattcccccatcctt

SEQ ID NO: 6730410 - DNA, 14 bp, Homo sapiens
cccataactaccag

SEQ ID NO: 6730411 - DNA, 14 bp, Homo sapiens
cccataactcaatg

SEQ ID NO: 6730412 - DNA, 15 bp, Homo sapiens
cccataagacaaaca

SEQ ID NO: 6730413 - DNA, 19 bp, Homo sapiens
cccataagacaaacactgc

SEQ ID NO: 6730414 - DNA, 23 bp, Homo sapiens
cccataaggggtcaaaatttgct

SEQ ID NO: 6730415 - DNA, 23 bp, Homo sapiens
cccataataaccctgccagtgcc

SEQ ID NO: 6730416 - DNA, 21 bp, Homo sapiens
cccataatagttagccctcag

SEQ ID NO: 6730417 - DNA, 23 bp, Homo sapiens
cccataatagttagccctcagtc

SEQ ID NO: 6730418 - DNA, 21 bp, Homo sapiens
cccataatgcttctttcctct

SEQ ID NO: 6730419 - DNA, 19 bp, Homo sapiens
cccataattttcttcatgc

SEQ ID NO: 6730420 - DNA, 15 bp, Homo sapiens
cccatacacacacaa

SEQ ID NO: 6730421 - DNA, 19 bp, Homo sapiens
cccataccagtcacctcct

SEQ ID NO: 6730422 - DNA, 23 bp, Homo sapiens
cccataccagtcacctcctgctc

SEQ ID NO: 6730423 - DNA, 15 bp, Homo sapiens
cccatacctttccag

SEQ ID NO: 6730424 - DNA, 15 bp, Homo sapiens
cccatactcagcctg

SEQ ID NO: 6730425 - DNA, 16 bp, Homo sapiens
cccatactcagcctgc

SEQ ID NO: 6730426 - DNA, 15 bp, Homo sapiens
cccatacttcctggg

SEQ ID NO: 6730427 - DNA, 17 bp, Homo sapiens
cccatacttcctgggat

SEQ ID NO: 6730428 - DNA, 20 bp, Homo sapiens
cccatacttgcatacaccac

SEQ ID NO: 6730429 - DNA, 12 bp, Homo sapiens
cccatagaaaac

SEQ ID NO: 6730430 - DNA, 23 bp, Homo sapiens
cccatagaaaacaatctgcccac

SEQ ID NO: 6730431 - DNA, 15 bp, Homo sapiens
cccatagaaacatga

SEQ ID NO: 6730432 - DNA, 21 bp, Homo sapiens
cccatagaaacatgacactga

SEQ ID NO: 6730433 - DNA, 22 bp, Homo sapiens
cccatagaaacatgacactgac

SEQ ID NO: 6730434 - DNA, 18 bp, Homo sapiens
cccatagagaccaggagg

SEQ ID NO: 6730435 - DNA, 20 bp, Homo sapiens
cccatagatactctcttctt

SEQ ID NO: 6730436 - DNA, 14 bp, Homo sapiens
cccatagcagcttt

SEQ ID NO: 6730437 - DNA, 14 bp, Homo sapiens
cccatagccttggg

SEQ ID NO: 6730438 - DNA, 15 bp, Homo sapiens
cccatagccttgggg

SEQ ID NO: 6730439 - DNA, 20 bp, Homo sapiens
cccatagcgctggctcagga

SEQ ID NO: 6730440 - DNA, 17 bp, Homo sapiens
cccatagctattttcct

SEQ ID NO: 6730441 - DNA, 18 bp, Homo sapiens
cccatagctattttcctt

SEQ ID NO: 6730442 - DNA, 13 bp, Homo sapiens
cccatagctggga

SEQ ID NO: 6730443 - DNA, 16 bp, Homo sapiens
cccatagcttccatga

SEQ ID NO: 6730444 - DNA, 17 bp, Homo sapiens
cccataggcccacacac

SEQ ID NO: 6730445 - DNA, 19 bp, Homo sapiens
cccataggcccacacacag

SEQ ID NO: 6730446 - DNA, 20 bp, Homo sapiens
cccataggcccacacacagg

SEQ ID NO: 6730447 - DNA, 13 bp, Homo sapiens
cccataggtcttg

SEQ ID NO: 6730448 - DNA, 20 bp, Homo sapiens
cccatagtggggcctgggag

SEQ ID NO: 6730449 - DNA, 18 bp, Homo sapiens
cccatagtttatttttct

SEQ ID NO: 6730450 - DNA, 12 bp, Homo sapiens
cccatatataaa

SEQ ID NO: 6730451 - DNA, 15 bp, Homo sapiens
cccatatataaatta

SEQ ID NO: 6730452 - DNA, 19 bp, Homo sapiens
cccatatataaattattac

SEQ ID NO: 6730453 - DNA, 12 bp, Homo sapiens
cccatatattac

SEQ ID NO: 6730454 - DNA, 22 bp, Homo sapiens
cccatatattaccccttcatgt

SEQ ID NO: 6730455 - DNA, 11 bp, Homo sapiens
cccatatcatg

SEQ ID NO: 6730456 - DNA, 22 bp, Homo sapiens
cccatatctcctttaatgacat

SEQ ID NO: 6730457 - DNA, 23 bp, Homo sapiens
cccatatctgtgtgccctagggc

SEQ ID NO: 6730458 - DNA, 20 bp, Homo sapiens
cccatatgctaccaccagct

SEQ ID NO: 6730459 - DNA, 23 bp, Homo sapiens
cccatattaacaaattgcatttg

SEQ ID NO: 6730460 - DNA, 23 bp, Homo sapiens
cccatattggcatggatttctgt

SEQ ID NO: 6730461 - DNA, 16 bp, Homo sapiens
cccatatttgtgttca

SEQ ID NO: 6730462 - DNA, 16 bp, Homo sapiens
cccatattttccccct

SEQ ID NO: 6730463 - DNA, 15 bp, Homo sapiens
cccatcaccagagtc

SEQ ID NO: 6730464 - DNA, 14 bp, Homo sapiens
cccatcacccaagc

SEQ ID NO: 6730465 - DNA, 15 bp, Homo sapiens
cccatcaccccttcc

SEQ ID NO: 6730466 - DNA, 17 bp, Homo sapiens
cccatcacctactccag

SEQ ID NO: 6730467 - DNA, 15 bp, Homo sapiens
cccatcactgcgcca

SEQ ID NO: 6730468 - DNA, 22 bp, Homo sapiens
cccatcactgcgccactgctcc

SEQ ID NO: 6730469 - DNA, 13 bp, Homo sapiens
cccatcactggag

SEQ ID NO: 6730470 - DNA, 18 bp, Homo sapiens
cccatcagaggctggggg

SEQ ID NO: 6730471 - DNA, 18 bp, Homo sapiens
cccatcagcccaatccct

SEQ ID NO: 6730472 - DNA, 15 bp, Homo sapiens
cccatcaggcagtgt

SEQ ID NO: 6730473 - DNA, 19 bp, Homo sapiens
cccatcaggctgttattat

SEQ ID NO: 6730474 - DNA, 17 bp, Homo sapiens
cccatcaggtagctgtc

SEQ ID NO: 6730475 - DNA, 13 bp, Homo sapiens
cccatcagtgcca

SEQ ID NO: 6730476 - DNA, 19 bp, Homo sapiens
cccatcagtgccagcccct

SEQ ID NO: 6730477 - DNA, 22 bp, Homo sapiens
cccatcatatcctttgccccaa

SEQ ID NO: 6730478 - DNA, 22 bp, Homo sapiens
cccatcatcaccgattcttcct

SEQ ID NO: 6730479 - DNA, 12 bp, Homo sapiens
cccatcatccca

SEQ ID NO: 6730480 - DNA, 17 bp, Homo sapiens
cccatcatctctgcctt

SEQ ID NO: 6730481 - DNA, 18 bp, Homo sapiens
cccatcatctctgccttt

SEQ ID NO: 6730482 - DNA, 12 bp, Homo sapiens
cccatcatgtgg

SEQ ID NO: 6730483 - DNA, 19 bp, Homo sapiens
cccatcatgtggccccacc

SEQ ID NO: 6730484 - DNA, 12 bp, Homo sapiens
cccatcattcat

SEQ ID NO: 6730485 - DNA, 15 bp, Homo sapiens
cccatcattcatgct

SEQ ID NO: 6730486 - DNA, 14 bp, Homo sapiens
cccatcattccttc

SEQ ID NO: 6730487 - DNA, 20 bp, Homo sapiens
cccatcattgcacctgcagg

SEQ ID NO: 6730488 - DNA, 20 bp, Homo sapiens
cccatccaaccactgtacac

SEQ ID NO: 6730489 - DNA, 17 bp, Homo sapiens
cccatccaactcctcta

SEQ ID NO: 6730490 - DNA, 17 bp, Homo sapiens
cccatccagacctggct

SEQ ID NO: 6730491 - DNA, 22 bp, Homo sapiens
cccatccagacctggctccact

SEQ ID NO: 6730492 - DNA, 16 bp, Homo sapiens
cccatccagcatgtgt

SEQ ID NO: 6730493 - DNA, 22 bp, Homo sapiens
cccatccagcatgtgtgtgtct

SEQ ID NO: 6730494 - DNA, 13 bp, Homo sapiens
cccatccagccac

SEQ ID NO: 6730495 - DNA, 15 bp, Homo sapiens
cccatccagccacgg

SEQ ID NO: 6730496 - DNA, 23 bp, Homo sapiens
cccatccagccacggagggaggc

SEQ ID NO: 6730497 - DNA, 14 bp, Homo sapiens
cccatccagccaga

SEQ ID NO: 6730498 - DNA, 16 bp, Homo sapiens
cccatccagcctccag

SEQ ID NO: 6730499 - DNA, 17 bp, Homo sapiens
cccatccagcctccagg

SEQ ID NO: 6730500 - DNA, 14 bp, Homo sapiens
cccatccatcagct

SEQ ID NO: 6730501 - DNA, 15 bp, Homo sapiens
cccatccatcagctc

SEQ ID NO: 6730502 - DNA, 15 bp, Homo sapiens
cccatcccaccagcc

SEQ ID NO: 6730503 - DNA, 17 bp, Homo sapiens
cccatcccaggatgggt

SEQ ID NO: 6730504 - DNA, 13 bp, Homo sapiens
cccatcccagggt

SEQ ID NO: 6730505 - DNA, 20 bp, Homo sapiens
cccatcccagggtcccaccc

SEQ ID NO: 6730506 - DNA, 12 bp, Homo sapiens
cccatcccagtc

SEQ ID NO: 6730507 - DNA, 12 bp, Homo sapiens
cccatcccatcc

SEQ ID NO: 6730508 - DNA, 13 bp, Homo sapiens
cccatcccatccc

SEQ ID NO: 6730509 - DNA, 14 bp, Homo sapiens
cccatcccatccca

SEQ ID NO: 6730510 - DNA, 15 bp, Homo sapiens
cccatcccatcccat

SEQ ID NO: 6730511 - DNA, 14 bp, Homo sapiens
cccatcccatgctg

SEQ ID NO: 6730512 - DNA, 21 bp, Homo sapiens
cccatcccattttcatcctga

SEQ ID NO: 6730513 - DNA, 15 bp, Homo sapiens
cccatcccccacctg

SEQ ID NO: 6730514 - DNA, 15 bp, Homo sapiens
cccatcccccactgc

SEQ ID NO: 6730515 - DNA, 19 bp, Homo sapiens
cccatcccccactgccaca

SEQ ID NO: 6730516 - DNA, 16 bp, Homo sapiens
cccatcccccctcacc

SEQ ID NO: 6730517 - DNA, 22 bp, Homo sapiens
cccatcccccctcaccaggggc

SEQ ID NO: 6730518 - DNA, 12 bp, Homo sapiens
cccatccccctg

SEQ ID NO: 6730519 - DNA, 16 bp, Homo sapiens
cccatccccctgccct

SEQ ID NO: 6730520 - DNA, 16 bp, Homo sapiens
cccatcccctcaacac

SEQ ID NO: 6730521 - DNA, 17 bp, Homo sapiens
cccatcccctgcctcta

SEQ ID NO: 6730522 - DNA, 16 bp, Homo sapiens
cccatcccctgtggga

SEQ ID NO: 6730523 - DNA, 12 bp, Homo sapiens
cccatccccttt

SEQ ID NO: 6730524 - DNA, 19 bp, Homo sapiens
cccatcccctttcctcccc

SEQ ID NO: 6730525 - DNA, 17 bp, Homo sapiens
cccatcccgaagccatc

SEQ ID NO: 6730526 - DNA, 20 bp, Homo sapiens
cccatcccgatgaacctgca

SEQ ID NO: 6730527 - DNA, 22 bp, Homo sapiens
cccatcccgcttagcgctctgg

SEQ ID NO: 6730528 - DNA, 18 bp, Homo sapiens
cccatcccgtttccctcc

SEQ ID NO: 6730529 - DNA, 15 bp, Homo sapiens
cccatccctccccag

SEQ ID NO: 6730530 - DNA, 15 bp, Homo sapiens
cccatccctgcctgg

SEQ ID NO: 6730531 - DNA, 16 bp, Homo sapiens
cccatccctgcctgga

SEQ ID NO: 6730532 - DNA, 16 bp, Homo sapiens
cccatccctgcttgcc

SEQ ID NO: 6730533 - DNA, 17 bp, Homo sapiens
cccatccctgtcatttt

SEQ ID NO: 6730534 - DNA, 19 bp, Homo sapiens
cccatccctttctaagcag

SEQ ID NO: 6730535 - DNA, 16 bp, Homo sapiens
cccatcccttttcctt

SEQ ID NO: 6730536 - DNA, 21 bp, Homo sapiens
cccatcctaccaatgcatgca

SEQ ID NO: 6730537 - DNA, 23 bp, Homo sapiens
cccatcctaccctcgggcccacc

SEQ ID NO: 6730538 - DNA, 14 bp, Homo sapiens
cccatcctagaggc

SEQ ID NO: 6730539 - DNA, 17 bp, Homo sapiens
cccatcctaggaaccag

SEQ ID NO: 6730540 - DNA, 18 bp, Homo sapiens
cccatcctaggaaccagc

SEQ ID NO: 6730541 - DNA, 16 bp, Homo sapiens
cccatcctccagcagg

SEQ ID NO: 6730542 - DNA, 15 bp, Homo sapiens
cccatcctccagccc

SEQ ID NO: 6730543 - DNA, 19 bp, Homo sapiens
cccatcctccagcttctgg

SEQ ID NO: 6730544 - DNA, 12 bp, Homo sapiens
cccatcctccca

SEQ ID NO: 6730545 - DNA, 22 bp, Homo sapiens
cccatcctcccggctccctcct

SEQ ID NO: 6730546 - DNA, 20 bp, Homo sapiens
cccatcctcctgcccccacc

SEQ ID NO: 6730547 - DNA, 13 bp, Homo sapiens
cccatcctctgta

SEQ ID NO: 6730548 - DNA, 20 bp, Homo sapiens
cccatcctctgtacagagcc

SEQ ID NO: 6730549 - DNA, 13 bp, Homo sapiens
cccatcctggccc

SEQ ID NO: 6730550 - DNA, 17 bp, Homo sapiens
cccatcctggcccatca

SEQ ID NO: 6730551 - DNA, 14 bp, Homo sapiens
cccatcctgggcct

SEQ ID NO: 6730552 - DNA, 22 bp, Homo sapiens
cccatcgccagctgatgactca

SEQ ID NO: 6730553 - DNA, 13 bp, Homo sapiens
cccatcgccccac

SEQ ID NO: 6730554 - DNA, 17 bp, Homo sapiens
cccatcggccctgtccc

SEQ ID NO: 6730555 - DNA, 21 bp, Homo sapiens
cccatcggccctgtcccctgg

SEQ ID NO: 6730556 - DNA, 17 bp, Homo sapiens
cccatcgtccaccccag

SEQ ID NO: 6730557 - DNA, 16 bp, Homo sapiens
cccatctaagctgcag

SEQ ID NO: 6730558 - DNA, 10 bp, Homo sapiens
cccatctagg

SEQ ID NO: 6730559 - DNA, 21 bp, Homo sapiens
cccatctatgtcccttgctgt

SEQ ID NO: 6730560 - DNA, 16 bp, Homo sapiens
cccatctcactcttag

SEQ ID NO: 6730561 - DNA, 14 bp, Homo sapiens
cccatctcagcctc

SEQ ID NO: 6730562 - DNA, 18 bp, Homo sapiens
cccatctcaggtgccact

SEQ ID NO: 6730563 - DNA, 23 bp, Homo sapiens
cccatctcaggtgccactccctg

SEQ ID NO: 6730564 - DNA, 14 bp, Homo sapiens
cccatctcatcctg

SEQ ID NO: 6730565 - DNA, 22 bp, Homo sapiens
cccatctcatcctggcacgccc

SEQ ID NO: 6730566 - DNA, 22 bp, Homo sapiens
cccatctccaagataagcctga

SEQ ID NO: 6730567 - DNA, 14 bp, Homo sapiens
cccatctccaggga

SEQ ID NO: 6730568 - DNA, 19 bp, Homo sapiens
cccatctccccaggcctcc

SEQ ID NO: 6730569 - DNA, 22 bp, Homo sapiens
cccatctccccaggcctccagc

SEQ ID NO: 6730570 - DNA, 23 bp, Homo sapiens
cccatctccctcccatttgcaga

SEQ ID NO: 6730571 - DNA, 12 bp, Homo sapiens
cccatctccctg

SEQ ID NO: 6730572 - DNA, 15 bp, Homo sapiens
cccatctccctgctt

SEQ ID NO: 6730573 - DNA, 17 bp, Homo sapiens
cccatctccctgctttg

SEQ ID NO: 6730574 - DNA, 15 bp, Homo sapiens
cccatctcctcccat

SEQ ID NO: 6730575 - DNA, 23 bp, Homo sapiens
cccatctccttacctctggaacc

SEQ ID NO: 6730576 - DNA, 21 bp, Homo sapiens
cccatctccttcccccagccc

SEQ ID NO: 6730577 - DNA, 13 bp, Homo sapiens
cccatctctacaa

SEQ ID NO: 6730578 - DNA, 15 bp, Homo sapiens
cccatctctcccact

SEQ ID NO: 6730579 - DNA, 19 bp, Homo sapiens
cccatctctcccacttcct

SEQ ID NO: 6730580 - DNA, 13 bp, Homo sapiens
cccatctctccct

SEQ ID NO: 6730581 - DNA, 14 bp, Homo sapiens
cccatctctccctt

SEQ ID NO: 6730582 - DNA, 15 bp, Homo sapiens
cccatctctgagtgg

SEQ ID NO: 6730583 - DNA, 13 bp, Homo sapiens
cccatctctgctg

SEQ ID NO: 6730584 - DNA, 21 bp, Homo sapiens
cccatctgcacccccctgggc

SEQ ID NO: 6730585 - DNA, 18 bp, Homo sapiens
cccatctgccccacagtc

SEQ ID NO: 6730586 - DNA, 12 bp, Homo sapiens
cccatctgccct

SEQ ID NO: 6730587 - DNA, 14 bp, Homo sapiens
cccatctggctgtg

SEQ ID NO: 6730588 - DNA, 17 bp, Homo sapiens
cccatctggctttttct

SEQ ID NO: 6730589 - DNA, 21 bp, Homo sapiens
cccatctggctttttctgcca

SEQ ID NO: 6730590 - DNA, 23 bp, Homo sapiens
cccatctgggagtccccttttct

SEQ ID NO: 6730591 - DNA, 18 bp, Homo sapiens
cccatctgggtccttgca

SEQ ID NO: 6730592 - DNA, 16 bp, Homo sapiens
cccatctggtcatttg

SEQ ID NO: 6730593 - DNA, 11 bp, Homo sapiens
cccatctgtcc

SEQ ID NO: 6730594 - DNA, 13 bp, Homo sapiens
cccatctgtccag

SEQ ID NO: 6730595 - DNA, 22 bp, Homo sapiens
cccatctgtccagctggggcca

SEQ ID NO: 6730596 - DNA, 13 bp, Homo sapiens
cccatctgtccat

SEQ ID NO: 6730597 - DNA, 17 bp, Homo sapiens
cccatctgtccatcctc

SEQ ID NO: 6730598 - DNA, 20 bp, Homo sapiens
cccatctgtccatcctcctc

SEQ ID NO: 6730599 - DNA, 21 bp, Homo sapiens
cccatctgtccatcctcctct

SEQ ID NO: 6730600 - DNA, 13 bp, Homo sapiens
cccatctgtgttc

SEQ ID NO: 6730601 - DNA, 15 bp, Homo sapiens
cccatcttactggaa

SEQ ID NO: 6730602 - DNA, 20 bp, Homo sapiens
cccatcttcatggatagctc

SEQ ID NO: 6730603 - DNA, 14 bp, Homo sapiens
cccatcttccacct

SEQ ID NO: 6730604 - DNA, 15 bp, Homo sapiens
cccatcttccacctg

SEQ ID NO: 6730605 - DNA, 12 bp, Homo sapiens
cccatcttcctg

SEQ ID NO: 6730606 - DNA, 15 bp, Homo sapiens
cccatcttcctgctg

SEQ ID NO: 6730607 - DNA, 19 bp, Homo sapiens
cccatcttcctgctgctgt

SEQ ID NO: 6730608 - DNA, 15 bp, Homo sapiens
cccatcttcgggacc

SEQ ID NO: 6730609 - DNA, 18 bp, Homo sapiens
cccatcttcgggaccagg

SEQ ID NO: 6730610 - DNA, 23 bp, Homo sapiens
cccatcttgatctttgagcccat

SEQ ID NO: 6730611 - DNA, 15 bp, Homo sapiens
cccatcttgcctcca

SEQ ID NO: 6730612 - DNA, 24 bp, Homo sapiens
cccatctttgatccttctgagctc

SEQ ID NO: 6730613 - DNA, 15 bp, Homo sapiens
cccatgaaacagcag

SEQ ID NO: 6730614 - DNA, 20 bp, Homo sapiens
cccatgaaacagcagctgaa

SEQ ID NO: 6730615 - DNA, 14 bp, Homo sapiens
cccatgaaccctgc

SEQ ID NO: 6730616 - DNA, 17 bp, Homo sapiens
cccatgaaccctgccct

SEQ ID NO: 6730617 - DNA, 18 bp, Homo sapiens
cccatgaaccctgccctg

SEQ ID NO: 6730618 - DNA, 18 bp, Homo sapiens
cccatgaagaaagcccct

SEQ ID NO: 6730619 - DNA, 22 bp, Homo sapiens
cccatgaagaaagcccctcgtt

SEQ ID NO: 6730620 - DNA, 19 bp, Homo sapiens
cccatgaagacaggacagt

SEQ ID NO: 6730621 - DNA, 22 bp, Homo sapiens
cccatgaagacaggacagtgct

SEQ ID NO: 6730622 - DNA, 13 bp, Homo sapiens
cccatgaagcctt

SEQ ID NO: 6730623 - DNA, 17 bp, Homo sapiens
cccatgaagccttttga

SEQ ID NO: 6730624 - DNA, 15 bp, Homo sapiens
cccatgaagctggcc

SEQ ID NO: 6730625 - DNA, 21 bp, Homo sapiens
cccatgaatatcaagaatagt

SEQ ID NO: 6730626 - DNA, 18 bp, Homo sapiens
cccatgacaatgttgtag

SEQ ID NO: 6730627 - DNA, 13 bp, Homo sapiens
cccatgacccacc

SEQ ID NO: 6730628 - DNA, 23 bp, Homo sapiens
cccatgacccacccctgtgctcc

SEQ ID NO: 6730629 - DNA, 17 bp, Homo sapiens
cccatgacccaggctgg

SEQ ID NO: 6730630 - DNA, 15 bp, Homo sapiens
cccatgactcttgga

SEQ ID NO: 6730631 - DNA, 17 bp, Homo sapiens
cccatgactgcacccag

SEQ ID NO: 6730632 - DNA, 20 bp, Homo sapiens
cccatgactgcacccagctc

SEQ ID NO: 6730633 - DNA, 22 bp, Homo sapiens
cccatgactgcacccagctcca

SEQ ID NO: 6730634 - DNA, 22 bp, Homo sapiens
cccatgactttatatggatgat

SEQ ID NO: 6730635 - DNA, 22 bp, Homo sapiens
cccatgagactgccctgcccag

SEQ ID NO: 6730636 - DNA, 22 bp, Homo sapiens
cccatgagcctcagcatcctgg

SEQ ID NO: 6730637 - DNA, 14 bp, Homo sapiens
cccatgagcctgcc

SEQ ID NO: 6730638 - DNA, 16 bp, Homo sapiens
cccatgagcctgcccg

SEQ ID NO: 6730639 - DNA, 21 bp, Homo sapiens
cccatgagcctgcccgctgca

SEQ ID NO: 6730640 - DNA, 20 bp, Homo sapiens
cccatgagcgtccaggtgat

SEQ ID NO: 6730641 - DNA, 18 bp, Homo sapiens
cccatgaggctcactcat

SEQ ID NO: 6730642 - DNA, 23 bp, Homo sapiens
cccatgatacctattaaaggaaa

SEQ ID NO: 6730643 - DNA, 22 bp, Homo sapiens
cccatgatactccactcccagc

SEQ ID NO: 6730644 - DNA, 15 bp, Homo sapiens
cccatgatccctgtg

SEQ ID NO: 6730645 - DNA, 20 bp, Homo sapiens
cccatgatgccgctcttctg

SEQ ID NO: 6730646 - DNA, 16 bp, Homo sapiens
cccatgattccctcct

SEQ ID NO: 6730647 - DNA, 16 bp, Homo sapiens
cccatgcaagcagagg

SEQ ID NO: 6730648 - DNA, 17 bp, Homo sapiens
cccatgcaagcagagga

SEQ ID NO: 6730649 - DNA, 22 bp, Homo sapiens
cccatgcacagtacaataatgt

SEQ ID NO: 6730650 - DNA, 17 bp, Homo sapiens
cccatgcacctcagggc

SEQ ID NO: 6730651 - DNA, 19 bp, Homo sapiens
cccatgcacctcagggcca

SEQ ID NO: 6730652 - DNA, 21 bp, Homo sapiens
cccatgcacctcagggccaag

SEQ ID NO: 6730653 - DNA, 12 bp, Homo sapiens
cccatgcactgt

SEQ ID NO: 6730654 - DNA, 15 bp, Homo sapiens
cccatgcagctgctc

SEQ ID NO: 6730655 - DNA, 17 bp, Homo sapiens
cccatgcaggcagcctg

SEQ ID NO: 6730656 - DNA, 17 bp, Homo sapiens
cccatgcaggtggtgtc

SEQ ID NO: 6730657 - DNA, 14 bp, Homo sapiens
cccatgcatcttcc

SEQ ID NO: 6730658 - DNA, 21 bp, Homo sapiens
cccatgccaaagctagggtgg

SEQ ID NO: 6730659 - DNA, 15 bp, Homo sapiens
cccatgccaatgtcc

SEQ ID NO: 6730660 - DNA, 18 bp, Homo sapiens
cccatgccaccacccacc

SEQ ID NO: 6730661 - DNA, 18 bp, Homo sapiens
cccatgccacgttccaca

SEQ ID NO: 6730662 - DNA, 15 bp, Homo sapiens
cccatgcccacctgc

SEQ ID NO: 6730663 - DNA, 18 bp, Homo sapiens
cccatgcccacctgccca

SEQ ID NO: 6730664 - DNA, 22 bp, Homo sapiens
cccatgccccactctgctgagg

SEQ ID NO: 6730665 - DNA, 23 bp, Homo sapiens
cccatgccccactctgctgaggc

SEQ ID NO: 6730666 - DNA, 12 bp, Homo sapiens
cccatgccctcc

SEQ ID NO: 6730667 - DNA, 20 bp, Homo sapiens
cccatgccggtacacagcca

SEQ ID NO: 6730668 - DNA, 18 bp, Homo sapiens
cccatgcctaaagcccat

SEQ ID NO: 6730669 - DNA, 12 bp, Homo sapiens
cccatgcctgtc

SEQ ID NO: 6730670 - DNA, 13 bp, Homo sapiens
cccatgcctgtcc

SEQ ID NO: 6730671 - DNA, 19 bp, Homo sapiens
cccatgcctgtccagcctg

SEQ ID NO: 6730672 - DNA, 13 bp, Homo sapiens
cccatgcctgtct

SEQ ID NO: 6730673 - DNA, 14 bp, Homo sapiens
cccatgcctgtggc

SEQ ID NO: 6730674 - DNA, 18 bp, Homo sapiens
cccatgcctgtggctgcg

SEQ ID NO: 6730675 - DNA, 22 bp, Homo sapiens
cccatgcgccttcgtgcctgag

SEQ ID NO: 6730676 - DNA, 20 bp, Homo sapiens
cccatgcgtgccgcctgctc

SEQ ID NO: 6730677 - DNA, 20 bp, Homo sapiens
cccatgctcaaccactgtgg

SEQ ID NO: 6730678 - DNA, 21 bp, Homo sapiens
cccatgctcaaccactgtggc

SEQ ID NO: 6730679 - DNA, 13 bp, Homo sapiens
cccatgctccacc

SEQ ID NO: 6730680 - DNA, 13 bp, Homo sapiens
cccatgctctgcc

SEQ ID NO: 6730681 - DNA, 14 bp, Homo sapiens
cccatgctctgccc

SEQ ID NO: 6730682 - DNA, 20 bp, Homo sapiens
cccatgctctgccccaagcc

SEQ ID NO: 6730683 - DNA, 21 bp, Homo sapiens
cccatgctgaattattttgtt

SEQ ID NO: 6730684 - DNA, 13 bp, Homo sapiens
cccatgctgccct

SEQ ID NO: 6730685 - DNA, 17 bp, Homo sapiens
cccatgctgccctgtga

SEQ ID NO: 6730686 - DNA, 13 bp, Homo sapiens
cccatgctggagc

SEQ ID NO: 6730687 - DNA, 23 bp, Homo sapiens
cccatgctggccttgccacactc

SEQ ID NO: 6730688 - DNA, 17 bp, Homo sapiens
cccatgctggctggggc

SEQ ID NO: 6730689 - DNA, 18 bp, Homo sapiens
cccatgctgggctcccgt

SEQ ID NO: 6730690 - DNA, 21 bp, Homo sapiens
cccatgctgttgattgctaaa

SEQ ID NO: 6730691 - DNA, 22 bp, Homo sapiens
cccatgctgttgattgctaaat

SEQ ID NO: 6730692 - DNA, 20 bp, Homo sapiens
cccatgcttacgtgatcctc

SEQ ID NO: 6730693 - DNA, 15 bp, Homo sapiens
cccatggacactcca

SEQ ID NO: 6730694 - DNA, 20 bp, Homo sapiens
cccatggacaggctggctcc

SEQ ID NO: 6730695 - DNA, 20 bp, Homo sapiens
cccatggagacaataaacag

SEQ ID NO: 6730696 - DNA, 22 bp, Homo sapiens
cccatggagacaataaacagct

SEQ ID NO: 6730697 - DNA, 16 bp, Homo sapiens
cccatggagccccagc

SEQ ID NO: 6730698 - DNA, 21 bp, Homo sapiens
cccatggagccccagccccct

SEQ ID NO: 6730699 - DNA, 22 bp, Homo sapiens
cccatggaggagacaggaagcc

SEQ ID NO: 6730700 - DNA, 20 bp, Homo sapiens
cccatggcatgggggcctca

SEQ ID NO: 6730701 - DNA, 13 bp, Homo sapiens
cccatggccacat

SEQ ID NO: 6730702 - DNA, 14 bp, Homo sapiens
cccatggccatttc

SEQ ID NO: 6730703 - DNA, 20 bp, Homo sapiens
cccatggcccagcagcttgg

SEQ ID NO: 6730704 - DNA, 15 bp, Homo sapiens
cccatggccccagct

SEQ ID NO: 6730705 - DNA, 18 bp, Homo sapiens
cccatggccccagctggc

SEQ ID NO: 6730706 - DNA, 13 bp, Homo sapiens
cccatggccccca

SEQ ID NO: 6730707 - DNA, 16 bp, Homo sapiens
cccatggcccccaata

SEQ ID NO: 6730708 - DNA, 20 bp, Homo sapiens
cccatggcccccaataaagg

SEQ ID NO: 6730709 - DNA, 12 bp, Homo sapiens
cccatggcctca

SEQ ID NO: 6730710 - DNA, 17 bp, Homo sapiens
cccatggcctcagccct

SEQ ID NO: 6730711 - DNA, 22 bp, Homo sapiens
cccatggcctcagccctgctcc

SEQ ID NO: 6730712 - DNA, 24 bp, Homo sapiens
cccatggcctcagccctgctccct

SEQ ID NO: 6730713 - DNA, 20 bp, Homo sapiens
cccatggccttccctcccca

SEQ ID NO: 6730714 - DNA, 20 bp, Homo sapiens
cccatggctctatttcttct

SEQ ID NO: 6730715 - DNA, 15 bp, Homo sapiens
cccatggctctgggc

SEQ ID NO: 6730716 - DNA, 18 bp, Homo sapiens
cccatggctgaagctgga

SEQ ID NO: 6730717 - DNA, 17 bp, Homo sapiens
cccatggcttaatgctt

SEQ ID NO: 6730718 - DNA, 13 bp, Homo sapiens
cccatgggaggga

SEQ ID NO: 6730719 - DNA, 21 bp, Homo sapiens
cccatgggagggagctgagaa

SEQ ID NO: 6730720 - DNA, 20 bp, Homo sapiens
cccatgggatatgtggtgta

SEQ ID NO: 6730721 - DNA, 15 bp, Homo sapiens
cccatgggcactgct

SEQ ID NO: 6730722 - DNA, 16 bp, Homo sapiens
cccatgggcactgctg

SEQ ID NO: 6730723 - DNA, 20 bp, Homo sapiens
cccatgggcactgctgggtg

SEQ ID NO: 6730724 - DNA, 16 bp, Homo sapiens
cccatgggccctcagc

SEQ ID NO: 6730725 - DNA, 20 bp, Homo sapiens
cccatgggcctcatgaataa

SEQ ID NO: 6730726 - DNA, 22 bp, Homo sapiens
cccatgggcctcatgaataaat

SEQ ID NO: 6730727 - DNA, 20 bp, Homo sapiens
cccatgggctcctgcccctt

SEQ ID NO: 6730728 - DNA, 14 bp, Homo sapiens
cccatgggctctga

SEQ ID NO: 6730729 - DNA, 16 bp, Homo sapiens
cccatgggctctgaca

SEQ ID NO: 6730730 - DNA, 17 bp, Homo sapiens
cccatgggctctgacag

SEQ ID NO: 6730731 - DNA, 15 bp, Homo sapiens
cccatgggctctggc

SEQ ID NO: 6730732 - DNA, 22 bp, Homo sapiens
cccatgggctctggccccaaga

SEQ ID NO: 6730733 - DNA, 11 bp, Homo sapiens
cccatgggctg

SEQ ID NO: 6730734 - DNA, 21 bp, Homo sapiens
cccatgggctgagtggggagc

SEQ ID NO: 6730735 - DNA, 22 bp, Homo sapiens
cccatgggttgtgtgtttattt

SEQ ID NO: 6730736 - DNA, 17 bp, Homo sapiens
cccatggtaatgtaact

SEQ ID NO: 6730737 - DNA, 16 bp, Homo sapiens
cccatggtcacagacc

SEQ ID NO: 6730738 - DNA, 20 bp, Homo sapiens
cccatggtcacagacccctg

SEQ ID NO: 6730739 - DNA, 18 bp, Homo sapiens
cccatggtcatctctgtt

SEQ ID NO: 6730740 - DNA, 14 bp, Homo sapiens
cccatggtccatcc

SEQ ID NO: 6730741 - DNA, 15 bp, Homo sapiens
cccatggtccctagc

SEQ ID NO: 6730742 - DNA, 14 bp, Homo sapiens
cccatggtgcagtg

SEQ ID NO: 6730743 - DNA, 17 bp, Homo sapiens
cccatggtgctaggaag

SEQ ID NO: 6730744 - DNA, 21 bp, Homo sapiens
cccatggtgggtaggtggttc

SEQ ID NO: 6730745 - DNA, 20 bp, Homo sapiens
cccatggtgtatgtggtttt

SEQ ID NO: 6730746 - DNA, 15 bp, Homo sapiens
cccatgtaaatacca

SEQ ID NO: 6730747 - DNA, 17 bp, Homo sapiens
cccatgtaacagaaagg

SEQ ID NO: 6730748 - DNA, 14 bp, Homo sapiens
cccatgtaaccact

SEQ ID NO: 6730749 - DNA, 21 bp, Homo sapiens
cccatgtaatccttttgttta

SEQ ID NO: 6730750 - DNA, 15 bp, Homo sapiens
cccatgtagccccct

SEQ ID NO: 6730751 - DNA, 21 bp, Homo sapiens
cccatgtagccccctggcctc

SEQ ID NO: 6730752 - DNA, 23 bp, Homo sapiens
cccatgtagccccctggcctctg

SEQ ID NO: 6730753 - DNA, 20 bp, Homo sapiens
cccatgtagctggcaagctg

SEQ ID NO: 6730754 - DNA, 19 bp, Homo sapiens
cccatgtatggccaggaag

SEQ ID NO: 6730755 - DNA, 20 bp, Homo sapiens
cccatgtatggccaggaagt

SEQ ID NO: 6730756 - DNA, 17 bp, Homo sapiens
cccatgtctacacagat

SEQ ID NO: 6730757 - DNA, 16 bp, Homo sapiens
cccatgtctcgactca

SEQ ID NO: 6730758 - DNA, 16 bp, Homo sapiens
cccatgtctctcagaa

SEQ ID NO: 6730759 - DNA, 19 bp, Homo sapiens
cccatgtgactgtggcatt

SEQ ID NO: 6730760 - DNA, 17 bp, Homo sapiens
cccatgtgacttttatc

SEQ ID NO: 6730761 - DNA, 23 bp, Homo sapiens
cccatgtgcatggaaatgtcctc

SEQ ID NO: 6730762 - DNA, 13 bp, Homo sapiens
cccatgtgccaag

SEQ ID NO: 6730763 - DNA, 17 bp, Homo sapiens
cccatgtgccttgtcca

SEQ ID NO: 6730764 - DNA, 19 bp, Homo sapiens
cccatgtggcagcccatgg

SEQ ID NO: 6730765 - DNA, 15 bp, Homo sapiens
cccatgtggctgaag

SEQ ID NO: 6730766 - DNA, 19 bp, Homo sapiens
cccatgtgggcgcccaccc

SEQ ID NO: 6730767 - DNA, 18 bp, Homo sapiens
cccatgtgggctgaagga

SEQ ID NO: 6730768 - DNA, 11 bp, Homo sapiens
cccatgtgtat

SEQ ID NO: 6730769 - DNA, 23 bp, Homo sapiens
cccatgtgtcccctcactctgtc

SEQ ID NO: 6730770 - DNA, 23 bp, Homo sapiens
cccatgtgtgatgctgacaccag

SEQ ID NO: 6730771 - DNA, 20 bp, Homo sapiens
cccatgttacttctctgagt

SEQ ID NO: 6730772 - DNA, 19 bp, Homo sapiens
cccatgttctgcccccagc

SEQ ID NO: 6730773 - DNA, 16 bp, Homo sapiens
cccatgttgactgtct

SEQ ID NO: 6730774 - DNA, 16 bp, Homo sapiens
cccatgttgcatgcct

SEQ ID NO: 6730775 - DNA, 22 bp, Homo sapiens
cccatgttgggtttgagacaga

SEQ ID NO: 6730776 - DNA, 19 bp, Homo sapiens
cccatgttggtcaggctgg

SEQ ID NO: 6730777 - DNA, 19 bp, Homo sapiens
cccatgttgtaatgctgca

SEQ ID NO: 6730778 - DNA, 20 bp, Homo sapiens
cccatgtttaaactttgtgc

SEQ ID NO: 6730779 - DNA, 15 bp, Homo sapiens
cccatgtttctctgg

SEQ ID NO: 6730780 - DNA, 21 bp, Homo sapiens
cccattactcaaaatgcagga

SEQ ID NO: 6730781 - DNA, 18 bp, Homo sapiens
cccattagaccaagcttg

SEQ ID NO: 6730782 - DNA, 14 bp, Homo sapiens
cccattagagaagt

SEQ ID NO: 6730783 - DNA, 23 bp, Homo sapiens
cccattattcaaagttgcctaaa

SEQ ID NO: 6730784 - DNA, 13 bp, Homo sapiens
cccattcacagag

SEQ ID NO: 6730785 - DNA, 16 bp, Homo sapiens
cccattcacagagcct

SEQ ID NO: 6730786 - DNA, 14 bp, Homo sapiens
cccattcacatttt

SEQ ID NO: 6730787 - DNA, 15 bp, Homo sapiens
cccattcaccctgtg

SEQ ID NO: 6730788 - DNA, 17 bp, Homo sapiens
cccattcacggcctggc

SEQ ID NO: 6730789 - DNA, 19 bp, Homo sapiens
cccattcagaactctcaga

SEQ ID NO: 6730790 - DNA, 13 bp, Homo sapiens
cccattcagacac

SEQ ID NO: 6730791 - DNA, 14 bp, Homo sapiens
cccattcagtgaca

SEQ ID NO: 6730792 - DNA, 20 bp, Homo sapiens
cccattcatattaagacagt

SEQ ID NO: 6730793 - DNA, 20 bp, Homo sapiens
cccattccagctctcccatg

SEQ ID NO: 6730794 - DNA, 12 bp, Homo sapiens
cccattccaggc

SEQ ID NO: 6730795 - DNA, 15 bp, Homo sapiens
cccattcccagcctg

SEQ ID NO: 6730796 - DNA, 16 bp, Homo sapiens
cccattcccagcctga

SEQ ID NO: 6730797 - DNA, 17 bp, Homo sapiens
cccattcccagcctgac

SEQ ID NO: 6730798 - DNA, 12 bp, Homo sapiens
cccattcccgca

SEQ ID NO: 6730799 - DNA, 13 bp, Homo sapiens
cccattccctggg

SEQ ID NO: 6730800 - DNA, 14 bp, Homo sapiens
cccattccctggga

SEQ ID NO: 6730801 - DNA, 17 bp, Homo sapiens
cccattccctgggatct

SEQ ID NO: 6730802 - DNA, 19 bp, Homo sapiens
cccattccctgggatctgg

SEQ ID NO: 6730803 - DNA, 12 bp, Homo sapiens
cccattcctgaa

SEQ ID NO: 6730804 - DNA, 19 bp, Homo sapiens
cccattcctgatcccatgg

SEQ ID NO: 6730805 - DNA, 15 bp, Homo sapiens
cccattcctgcctgg

SEQ ID NO: 6730806 - DNA, 13 bp, Homo sapiens
cccattccttagc

SEQ ID NO: 6730807 - DNA, 18 bp, Homo sapiens
cccattccttgcgcctca

SEQ ID NO: 6730808 - DNA, 21 bp, Homo sapiens
cccattccttgcgcctcagcc

SEQ ID NO: 6730809 - DNA, 20 bp, Homo sapiens
cccattcggggctgacgatg

SEQ ID NO: 6730810 - DNA, 17 bp, Homo sapiens
cccattcgtctgtccca

SEQ ID NO: 6730811 - DNA, 19 bp, Homo sapiens
cccattcgtctgtcccaga

SEQ ID NO: 6730812 - DNA, 13 bp, Homo sapiens
cccattctacttg

SEQ ID NO: 6730813 - DNA, 14 bp, Homo sapiens
cccattctacttgc

SEQ ID NO: 6730814 - DNA, 15 bp, Homo sapiens
cccattctacttgct

SEQ ID NO: 6730815 - DNA, 20 bp, Homo sapiens
cccattctcccagtctctgt

SEQ ID NO: 6730816 - DNA, 13 bp, Homo sapiens
cccattctccctc

SEQ ID NO: 6730817 - DNA, 20 bp, Homo sapiens
cccattctctctcctgtcca

SEQ ID NO: 6730818 - DNA, 20 bp, Homo sapiens
cccattctgccccagagtgg

SEQ ID NO: 6730819 - DNA, 15 bp, Homo sapiens
cccattctgcctgcc

SEQ ID NO: 6730820 - DNA, 20 bp, Homo sapiens
cccattctgcctgcccaggc

SEQ ID NO: 6730821 - DNA, 14 bp, Homo sapiens
cccattctgtgtcc

SEQ ID NO: 6730822 - DNA, 19 bp, Homo sapiens
cccattcttcagtgcctag

SEQ ID NO: 6730823 - DNA, 21 bp, Homo sapiens
cccattcttctgggtgtgctt

SEQ ID NO: 6730824 - DNA, 12 bp, Homo sapiens
cccattcttgag

SEQ ID NO: 6730825 - DNA, 20 bp, Homo sapiens
cccattctttgcttgaacac

SEQ ID NO: 6730826 - DNA, 21 bp, Homo sapiens
cccattctttgcttgaacaca

SEQ ID NO: 6730827 - DNA, 17 bp, Homo sapiens
cccattcttttgtaatt

SEQ ID NO: 6730828 - DNA, 22 bp, Homo sapiens
cccattcttttgtaatttaaat

SEQ ID NO: 6730829 - DNA, 16 bp, Homo sapiens
cccattgacttgcaca

SEQ ID NO: 6730830 - DNA, 21 bp, Homo sapiens
cccattgcatcacctctgtaa

SEQ ID NO: 6730831 - DNA, 13 bp, Homo sapiens
cccattgcccagt

SEQ ID NO: 6730832 - DNA, 16 bp, Homo sapiens
cccattgccttctggg

SEQ ID NO: 6730833 - DNA, 15 bp, Homo sapiens
cccattgctccattc

SEQ ID NO: 6730834 - DNA, 21 bp, Homo sapiens
cccattgctccattcactccc

SEQ ID NO: 6730835 - DNA, 23 bp, Homo sapiens
cccattgctgccaaggtggaggg

SEQ ID NO: 6730836 - DNA, 22 bp, Homo sapiens
cccattggagcaagcttgccct

SEQ ID NO: 6730837 - DNA, 19 bp, Homo sapiens
cccattggagcacctgggc

SEQ ID NO: 6730838 - DNA, 13 bp, Homo sapiens
cccattgtattta

SEQ ID NO: 6730839 - DNA, 23 bp, Homo sapiens
cccattgtcctccttttcacttt

SEQ ID NO: 6730840 - DNA, 19 bp, Homo sapiens
cccattgttgtcaaggaag

SEQ ID NO: 6730841 - DNA, 14 bp, Homo sapiens
cccatttacttagg

SEQ ID NO: 6730842 - DNA, 18 bp, Homo sapiens
cccatttatccacctcca

SEQ ID NO: 6730843 - DNA, 15 bp, Homo sapiens
cccatttattatttt

SEQ ID NO: 6730844 - DNA, 13 bp, Homo sapiens
cccatttcacaca

SEQ ID NO: 6730845 - DNA, 18 bp, Homo sapiens
cccatttcacacctgaaa

SEQ ID NO: 6730846 - DNA, 12 bp, Homo sapiens
cccatttcagct

SEQ ID NO: 6730847 - DNA, 16 bp, Homo sapiens
cccatttcccatctgc

SEQ ID NO: 6730848 - DNA, 20 bp, Homo sapiens
cccatttcctcttccttctc

SEQ ID NO: 6730849 - DNA, 18 bp, Homo sapiens
cccatttccttgtctaaa

SEQ ID NO: 6730850 - DNA, 19 bp, Homo sapiens
cccatttcgtgagccccat

SEQ ID NO: 6730851 - DNA, 21 bp, Homo sapiens
cccatttctaaaggcctcttc

SEQ ID NO: 6730852 - DNA, 14 bp, Homo sapiens
cccatttctccaga

SEQ ID NO: 6730853 - DNA, 15 bp, Homo sapiens
cccatttctgcctcg

SEQ ID NO: 6730854 - DNA, 23 bp, Homo sapiens
cccatttctgcctcgctcaccgc

SEQ ID NO: 6730855 - DNA, 22 bp, Homo sapiens
cccatttgcagaccaggaagga

SEQ ID NO: 6730856 - DNA, 15 bp, Homo sapiens
cccatttgctccttt

SEQ ID NO: 6730857 - DNA, 14 bp, Homo sapiens
cccatttggagggc

SEQ ID NO: 6730858 - DNA, 13 bp, Homo sapiens
cccatttgggcag

SEQ ID NO: 6730859 - DNA, 12 bp, Homo sapiens
cccatttgtaat

SEQ ID NO: 6730860 - DNA, 24 bp, Homo sapiens
cccatttgtcctgactgtctgcta

SEQ ID NO: 6730861 - DNA, 18 bp, Homo sapiens
cccatttgtgccagagga

SEQ ID NO: 6730862 - DNA, 16 bp, Homo sapiens
cccatttgttgctgct

SEQ ID NO: 6730863 - DNA, 17 bp, Homo sapiens
cccatttgttgctgctg

SEQ ID NO: 6730864 - DNA, 18 bp, Homo sapiens
cccatttgttgctgctgc

SEQ ID NO: 6730865 - DNA, 12 bp, Homo sapiens
cccattttaaat

SEQ ID NO: 6730866 - DNA, 14 bp, Homo sapiens
cccattttagtcac

SEQ ID NO: 6730867 - DNA, 18 bp, Homo sapiens
cccattttagtcactttt

SEQ ID NO: 6730868 - DNA, 16 bp, Homo sapiens
cccattttcatcctga

SEQ ID NO: 6730869 - DNA, 22 bp, Homo sapiens
cccattttcatcctgagcccaa

SEQ ID NO: 6730870 - DNA, 15 bp, Homo sapiens
cccattttccccctg

SEQ ID NO: 6730871 - DNA, 17 bp, Homo sapiens
cccattttccccctgtg

SEQ ID NO: 6730872 - DNA, 19 bp, Homo sapiens
cccattttccccttcctca

SEQ ID NO: 6730873 - DNA, 20 bp, Homo sapiens
cccattttccccttcctcat

SEQ ID NO: 6730874 - DNA, 15 bp, Homo sapiens
cccattttcctctga

SEQ ID NO: 6730875 - DNA, 21 bp, Homo sapiens
cccattttctctattctttcc

SEQ ID NO: 6730876 - DNA, 22 bp, Homo sapiens
cccattttctctattctttcca

SEQ ID NO: 6730877 - DNA, 17 bp, Homo sapiens
cccattttgaatcacat

SEQ ID NO: 6730878 - DNA, 22 bp, Homo sapiens
cccattttggaagttttcagga

SEQ ID NO: 6730879 - DNA, 14 bp, Homo sapiens
cccattttggtgca

SEQ ID NO: 6730880 - DNA, 13 bp, Homo sapiens
cccatttttcctt

SEQ ID NO: 6730881 - DNA, 22 bp, Homo sapiens
cccatttttgagccaagcttca

SEQ ID NO: 6730882 - DNA, 17 bp, Homo sapiens
cccatttttgctaatta

SEQ ID NO: 6730883 - DNA, 22 bp, Homo sapiens
cccatttttgctaattatcaat

SEQ ID NO: 6730884 - DNA, 15 bp, Homo sapiens
cccatttttgtaata

SEQ ID NO: 6730885 - DNA, 16 bp, Homo sapiens
cccatttttgtaatat

SEQ ID NO: 6730886 - DNA, 22 bp, Homo sapiens
cccatttttgtaatataagaca

SEQ ID NO: 6730887 - DNA, 21 bp, Homo sapiens
cccattttttaaaaaagcaag

SEQ ID NO: 6730888 - DNA, 20 bp, Homo sapiens
ccccaaaaacctcacccgag

SEQ ID NO: 6730889 - DNA, 22 bp, Homo sapiens
ccccaaaaccacagccctgtca

SEQ ID NO: 6730890 - DNA, 18 bp, Homo sapiens
ccccaaaactctcctctg

SEQ ID NO: 6730891 - DNA, 22 bp, Homo sapiens
ccccaaaactctcctctgctgc

SEQ ID NO: 6730892 - DNA, 17 bp, Homo sapiens
ccccaaaatccaaaact

SEQ ID NO: 6730893 - DNA, 16 bp, Homo sapiens
ccccaaaattatcagt

SEQ ID NO: 6730894 - DNA, 15 bp, Homo sapiens
ccccaaacacaaaac

SEQ ID NO: 6730895 - DNA, 15 bp, Homo sapiens
ccccaaacagactcg

SEQ ID NO: 6730896 - DNA, 17 bp, Homo sapiens
ccccaaacagcatgtgc

SEQ ID NO: 6730897 - DNA, 15 bp, Homo sapiens
ccccaaacaggacag

SEQ ID NO: 6730898 - DNA, 14 bp, Homo sapiens
ccccaaaccccagc

SEQ ID NO: 6730899 - DNA, 14 bp, Homo sapiens
ccccaaaccctgct

SEQ ID NO: 6730900 - DNA, 19 bp, Homo sapiens
ccccaaacctgcaagggct

SEQ ID NO: 6730901 - DNA, 19 bp, Homo sapiens
ccccaaacgggctgccctg

SEQ ID NO: 6730902 - DNA, 13 bp, Homo sapiens
ccccaaagcccag

SEQ ID NO: 6730903 - DNA, 21 bp, Homo sapiens
ccccaaagctttcctgcccca

SEQ ID NO: 6730904 - DNA, 15 bp, Homo sapiens
ccccaaaggaacact

SEQ ID NO: 6730905 - DNA, 11 bp, Homo sapiens
ccccaaagtgg

SEQ ID NO: 6730906 - DNA, 13 bp, Homo sapiens
ccccaaagttgct

SEQ ID NO: 6730907 - DNA, 17 bp, Homo sapiens
ccccaaataagaaggga

SEQ ID NO: 6730908 - DNA, 12 bp, Homo sapiens
ccccaaatatag

SEQ ID NO: 6730909 - DNA, 11 bp, Homo sapiens
ccccaaatccg

SEQ ID NO: 6730910 - DNA, 19 bp, Homo sapiens
ccccaaatccgaacctcct

SEQ ID NO: 6730911 - DNA, 23 bp, Homo sapiens
ccccaaatccgaacctcctctgt

SEQ ID NO: 6730912 - DNA, 17 bp, Homo sapiens
ccccaaatctactgagc

SEQ ID NO: 6730913 - DNA, 19 bp, Homo sapiens
ccccaaatgctctctcttc

SEQ ID NO: 6730914 - DNA, 21 bp, Homo sapiens
ccccaaatggaaatgggcaga

SEQ ID NO: 6730915 - DNA, 18 bp, Homo sapiens
ccccaaatgttctttcct

SEQ ID NO: 6730916 - DNA, 15 bp, Homo sapiens
ccccaacacctgctg

SEQ ID NO: 6730917 - DNA, 19 bp, Homo sapiens
ccccaacactgtccttccc

SEQ ID NO: 6730918 - DNA, 15 bp, Homo sapiens
ccccaacagcgccca

SEQ ID NO: 6730919 - DNA, 21 bp, Homo sapiens
ccccaacagctggaccctgac

SEQ ID NO: 6730920 - DNA, 19 bp, Homo sapiens
ccccaacatctccctccca

SEQ ID NO: 6730921 - DNA, 16 bp, Homo sapiens
ccccaacatgttcaga

SEQ ID NO: 6730922 - DNA, 22 bp, Homo sapiens
ccccaaccaaggaaggagcccc

SEQ ID NO: 6730923 - DNA, 14 bp, Homo sapiens
ccccaaccacagag

SEQ ID NO: 6730924 - DNA, 18 bp, Homo sapiens
ccccaacccaaacctgga

SEQ ID NO: 6730925 - DNA, 21 bp, Homo sapiens
ccccaacccaataaaactgat

SEQ ID NO: 6730926 - DNA, 13 bp, Homo sapiens
ccccaacccccac

SEQ ID NO: 6730927 - DNA, 23 bp, Homo sapiens
ccccaacccccgcaccaagcaga

SEQ ID NO: 6730928 - DNA, 15 bp, Homo sapiens
ccccaaccccctgca

SEQ ID NO: 6730929 - DNA, 12 bp, Homo sapiens
ccccaaccccgt

SEQ ID NO: 6730930 - DNA, 20 bp, Homo sapiens
ccccaacccctcctccctca

SEQ ID NO: 6730931 - DNA, 17 bp, Homo sapiens
ccccaacccctccttcc

SEQ ID NO: 6730932 - DNA, 16 bp, Homo sapiens
ccccaacccctctcca

SEQ ID NO: 6730933 - DNA, 19 bp, Homo sapiens
ccccaacccctctccaggc

SEQ ID NO: 6730934 - DNA, 16 bp, Homo sapiens
ccccaacccctgagga

SEQ ID NO: 6730935 - DNA, 22 bp, Homo sapiens
ccccaacccgtgcccctgggat

SEQ ID NO: 6730936 - DNA, 23 bp, Homo sapiens
ccccaacccgtgcccctgggatc

SEQ ID NO: 6730937 - DNA, 15 bp, Homo sapiens
ccccaaccctgcccc

SEQ ID NO: 6730938 - DNA, 18 bp, Homo sapiens
ccccaaccctgcccctgc

SEQ ID NO: 6730939 - DNA, 23 bp, Homo sapiens
ccccaaccctgcccctgccccgt

SEQ ID NO: 6730940 - DNA, 13 bp, Homo sapiens
ccccaacccttct

SEQ ID NO: 6730941 - DNA, 16 bp, Homo sapiens
ccccaacctgctctcc

SEQ ID NO: 6730942 - DNA, 20 bp, Homo sapiens
ccccaacctgctctcctctt

SEQ ID NO: 6730943 - DNA, 15 bp, Homo sapiens
ccccaacctttccct

SEQ ID NO: 6730944 - DNA, 16 bp, Homo sapiens
ccccaacggggtgggg

SEQ ID NO: 6730945 - DNA, 16 bp, Homo sapiens
ccccaacgtcccctcc

SEQ ID NO: 6730946 - DNA, 21 bp, Homo sapiens
ccccaactattaaagtgccat

SEQ ID NO: 6730947 - DNA, 17 bp, Homo sapiens
ccccaactccaggaaag

SEQ ID NO: 6730948 - DNA, 14 bp, Homo sapiens
ccccaactccatgg

SEQ ID NO: 6730949 - DNA, 15 bp, Homo sapiens
ccccaactcctggaa

SEQ ID NO: 6730950 - DNA, 22 bp, Homo sapiens
ccccaactccttccagctagtg

SEQ ID NO: 6730951 - DNA, 18 bp, Homo sapiens
ccccaactctgagcccat

SEQ ID NO: 6730952 - DNA, 12 bp, Homo sapiens
ccccaactgctc

SEQ ID NO: 6730953 - DNA, 17 bp, Homo sapiens
ccccaactgctccagcc

SEQ ID NO: 6730954 - DNA, 20 bp, Homo sapiens
ccccaactgctccagcctct

SEQ ID NO: 6730955 - DNA, 22 bp, Homo sapiens
ccccaactgtggtagctccagc

SEQ ID NO: 6730956 - DNA, 19 bp, Homo sapiens
ccccaacttaagtttagaa

SEQ ID NO: 6730957 - DNA, 23 bp, Homo sapiens
ccccaacttggcagctttttctg

SEQ ID NO: 6730958 - DNA, 18 bp, Homo sapiens
ccccaagaaggctggggc

SEQ ID NO: 6730959 - DNA, 14 bp, Homo sapiens
ccccaagacacttc

SEQ ID NO: 6730960 - DNA, 17 bp, Homo sapiens
ccccaagactctgctct

SEQ ID NO: 6730961 - DNA, 20 bp, Homo sapiens
ccccaagaggaagttcagat

SEQ ID NO: 6730962 - DNA, 20 bp, Homo sapiens
ccccaagaggctagccccag

SEQ ID NO: 6730963 - DNA, 18 bp, Homo sapiens
ccccaagaggggcgggct

SEQ ID NO: 6730964 - DNA, 21 bp, Homo sapiens
ccccaagatgagctgcagccc

SEQ ID NO: 6730965 - DNA, 22 bp, Homo sapiens
ccccaagattgagctctctgcc

SEQ ID NO: 6730966 - DNA, 20 bp, Homo sapiens
ccccaagcagcattcagcac

SEQ ID NO: 6730967 - DNA, 14 bp, Homo sapiens
ccccaagcagccag

SEQ ID NO: 6730968 - DNA, 23 bp, Homo sapiens
ccccaagcatgggggaccccttc

SEQ ID NO: 6730969 - DNA, 14 bp, Homo sapiens
ccccaagcctctgc

SEQ ID NO: 6730970 - DNA, 16 bp, Homo sapiens
ccccaagcctctgccc

SEQ ID NO: 6730971 - DNA, 13 bp, Homo sapiens
ccccaagcgccct

SEQ ID NO: 6730972 - DNA, 17 bp, Homo sapiens
ccccaagcgccctggcc

SEQ ID NO: 6730973 - DNA, 11 bp, Homo sapiens
ccccaagctgg

SEQ ID NO: 6730974 - DNA, 17 bp, Homo sapiens
ccccaaggatgaccaca

SEQ ID NO: 6730975 - DNA, 14 bp, Homo sapiens
ccccaaggcactga

SEQ ID NO: 6730976 - DNA, 16 bp, Homo sapiens
ccccaaggccccaggg

SEQ ID NO: 6730977 - DNA, 21 bp, Homo sapiens
ccccaaggcctctctctgcct

SEQ ID NO: 6730978 - DNA, 12 bp, Homo sapiens
ccccaagggaca

SEQ ID NO: 6730979 - DNA, 20 bp, Homo sapiens
ccccaagggacaaccccatc

SEQ ID NO: 6730980 - DNA, 20 bp, Homo sapiens
ccccaagggccaaacccact

SEQ ID NO: 6730981 - DNA, 15 bp, Homo sapiens
ccccaagggcccaga

SEQ ID NO: 6730982 - DNA, 15 bp, Homo sapiens
ccccaaggggcagtc

SEQ ID NO: 6730983 - DNA, 16 bp, Homo sapiens
ccccaaggggcccaca

SEQ ID NO: 6730984 - DNA, 14 bp, Homo sapiens
ccccaaggggtggc

SEQ ID NO: 6730985 - DNA, 18 bp, Homo sapiens
ccccaaggttctggttcc

SEQ ID NO: 6730986 - DNA, 19 bp, Homo sapiens
ccccaagtagtctgctcac

SEQ ID NO: 6730987 - DNA, 13 bp, Homo sapiens
ccccaataaacca

SEQ ID NO: 6730988 - DNA, 12 bp, Homo sapiens
ccccaataaagg

SEQ ID NO: 6730989 - DNA, 13 bp, Homo sapiens
ccccaataaaggc

SEQ ID NO: 6730990 - DNA, 16 bp, Homo sapiens
ccccaataccccatgg

SEQ ID NO: 6730991 - DNA, 19 bp, Homo sapiens
ccccaatatctcccttttt

SEQ ID NO: 6730992 - DNA, 18 bp, Homo sapiens
ccccaatatttttggact

SEQ ID NO: 6730993 - DNA, 21 bp, Homo sapiens
ccccaatcacgagatcttcct

SEQ ID NO: 6730994 - DNA, 13 bp, Homo sapiens
ccccaatcccagc

SEQ ID NO: 6730995 - DNA, 13 bp, Homo sapiens
ccccaatccctgc

SEQ ID NO: 6730996 - DNA, 16 bp, Homo sapiens
ccccaatccctgccac

SEQ ID NO: 6730997 - DNA, 18 bp, Homo sapiens
ccccaatcggactgccaa

SEQ ID NO: 6730998 - DNA, 18 bp, Homo sapiens
ccccaatcgggtccagag

SEQ ID NO: 6730999 - DNA, 19 bp, Homo sapiens
ccccaatgaccttagcccc

SEQ ID NO: 6731000 - DNA, 21 bp, Homo sapiens
ccccaatgtatgtgtggctgt

SEQ ID NO: 6731001 - DNA, 18 bp, Homo sapiens
ccccaattaactgaagca

SEQ ID NO: 6731002 - DNA, 14 bp, Homo sapiens
ccccaattccttgt

SEQ ID NO: 6731003 - DNA, 15 bp, Homo sapiens
ccccaattccttgta

SEQ ID NO: 6731004 - DNA, 16 bp, Homo sapiens
ccccacaagcaccact

SEQ ID NO: 6731005 - DNA, 12 bp, Homo sapiens
ccccacaaggcc

SEQ ID NO: 6731006 - DNA, 13 bp, Homo sapiens
ccccacaaggcct

SEQ ID NO: 6731007 - DNA, 23 bp, Homo sapiens
ccccacaatttctttaaaaaaga

SEQ ID NO: 6731008 - DNA, 19 bp, Homo sapiens
ccccacacacaggccttct

SEQ ID NO: 6731009 - DNA, 21 bp, Homo sapiens
ccccacacacaggccttctgt

SEQ ID NO: 6731010 - DNA, 12 bp, Homo sapiens
ccccacacagct

SEQ ID NO: 6731011 - DNA, 17 bp, Homo sapiens
ccccacaccagccttgg

SEQ ID NO: 6731012 - DNA, 12 bp, Homo sapiens
ccccacacccag

SEQ ID NO: 6731013 - DNA, 15 bp, Homo sapiens
ccccacacccagggc

SEQ ID NO: 6731014 - DNA, 16 bp, Homo sapiens
ccccacaccccagccc

SEQ ID NO: 6731015 - DNA, 17 bp, Homo sapiens
ccccacaccccagccca

SEQ ID NO: 6731016 - DNA, 14 bp, Homo sapiens
ccccacacctcagt

SEQ ID NO: 6731017 - DNA, 14 bp, Homo sapiens
ccccacacctgcag

SEQ ID NO: 6731018 - DNA, 17 bp, Homo sapiens
ccccacacctggccctg

SEQ ID NO: 6731019 - DNA, 19 bp, Homo sapiens
ccccacaccttccagggcc

SEQ ID NO: 6731020 - DNA, 20 bp, Homo sapiens
ccccacaccttccagggccc

SEQ ID NO: 6731021 - DNA, 21 bp, Homo sapiens
ccccacacgccggggctggcc

SEQ ID NO: 6731022 - DNA, 23 bp, Homo sapiens
ccccacacgtgctcgcagcctgg

SEQ ID NO: 6731023 - DNA, 14 bp, Homo sapiens
ccccacactccact

SEQ ID NO: 6731024 - DNA, 16 bp, Homo sapiens
ccccacactccactct

SEQ ID NO: 6731025 - DNA, 14 bp, Homo sapiens
ccccacacttccct

SEQ ID NO: 6731026 - DNA, 16 bp, Homo sapiens
ccccacacttccctgg

SEQ ID NO: 6731027 - DNA, 18 bp, Homo sapiens
ccccacacttccctggcg

SEQ ID NO: 6731028 - DNA, 23 bp, Homo sapiens
ccccacacttgttccagctcttt

SEQ ID NO: 6731029 - DNA, 13 bp, Homo sapiens
ccccacagaacct

SEQ ID NO: 6731030 - DNA, 22 bp, Homo sapiens
ccccacagaaccttcaacccag

SEQ ID NO: 6731031 - DNA, 13 bp, Homo sapiens
ccccacagaactg

SEQ ID NO: 6731032 - DNA, 19 bp, Homo sapiens
ccccacagcacccaggctc

SEQ ID NO: 6731033 - DNA, 15 bp, Homo sapiens
ccccacagcccacgt

SEQ ID NO: 6731034 - DNA, 14 bp, Homo sapiens
ccccacagccctgg

SEQ ID NO: 6731035 - DNA, 17 bp, Homo sapiens
ccccacagccctggaat

SEQ ID NO: 6731036 - DNA, 18 bp, Homo sapiens
ccccacagctacctgaga

SEQ ID NO: 6731037 - DNA, 14 bp, Homo sapiens
ccccacagctcctt

SEQ ID NO: 6731038 - DNA, 15 bp, Homo sapiens
ccccacagctccttg

SEQ ID NO: 6731039 - DNA, 19 bp, Homo sapiens
ccccacagctggggccggt

SEQ ID NO: 6731040 - DNA, 21 bp, Homo sapiens
ccccacaggcacattaactgt

SEQ ID NO: 6731041 - DNA, 23 bp, Homo sapiens
ccccacaggccacacgctgccca

SEQ ID NO: 6731042 - DNA, 14 bp, Homo sapiens
ccccacagtcttgg

SEQ ID NO: 6731043 - DNA, 16 bp, Homo sapiens
ccccacagttgtgttc

SEQ ID NO: 6731044 - DNA, 17 bp, Homo sapiens
ccccacagttgtgttca

SEQ ID NO: 6731045 - DNA, 23 bp, Homo sapiens
ccccacagttgtgttcatgctga

SEQ ID NO: 6731046 - DNA, 15 bp, Homo sapiens
ccccacagttttaat

SEQ ID NO: 6731047 - DNA, 18 bp, Homo sapiens
ccccacatgcatgtctgc

SEQ ID NO: 6731048 - DNA, 13 bp, Homo sapiens
ccccaccacacat

SEQ ID NO: 6731049 - DNA, 14 bp, Homo sapiens
ccccaccaccccag

SEQ ID NO: 6731050 - DNA, 23 bp, Homo sapiens
ccccaccacgatgtggccctggc

SEQ ID NO: 6731051 - DNA, 17 bp, Homo sapiens
ccccaccactcaggcca

SEQ ID NO: 6731052 - DNA, 16 bp, Homo sapiens
ccccaccactcttgac

SEQ ID NO: 6731053 - DNA, 17 bp, Homo sapiens
ccccaccacttctttta

SEQ ID NO: 6731054 - DNA, 13 bp, Homo sapiens
ccccaccagagct

SEQ ID NO: 6731055 - DNA, 15 bp, Homo sapiens
ccccaccagagctgc

SEQ ID NO: 6731056 - DNA, 22 bp, Homo sapiens
ccccaccagagctgcctcccca

SEQ ID NO: 6731057 - DNA, 15 bp, Homo sapiens
ccccaccagctgcag

SEQ ID NO: 6731058 - DNA, 18 bp, Homo sapiens
ccccaccagtgcctctcc

SEQ ID NO: 6731059 - DNA, 18 bp, Homo sapiens
ccccaccatctgctgtct

SEQ ID NO: 6731060 - DNA, 19 bp, Homo sapiens
ccccaccattccacatccc

SEQ ID NO: 6731061 - DNA, 21 bp, Homo sapiens
ccccacccaagggcctggcct

SEQ ID NO: 6731062 - DNA, 11 bp, Homo sapiens
ccccacccacc

SEQ ID NO: 6731063 - DNA, 22 bp, Homo sapiens
ccccacccaccaaccctcaggg

SEQ ID NO: 6731064 - DNA, 13 bp, Homo sapiens
ccccacccaccac

SEQ ID NO: 6731065 - DNA, 22 bp, Homo sapiens
ccccacccaccaccgctcccgc

SEQ ID NO: 6731066 - DNA, 21 bp, Homo sapiens
ccccacccaccctctggtcct

SEQ ID NO: 6731067 - DNA, 13 bp, Homo sapiens
ccccacccatggg

SEQ ID NO: 6731068 - DNA, 16 bp, Homo sapiens
ccccacccatggggag

SEQ ID NO: 6731069 - DNA, 23 bp, Homo sapiens
ccccacccattttcccccgtcct

SEQ ID NO: 6731070 - DNA, 14 bp, Homo sapiens
ccccaccccacact

SEQ ID NO: 6731071 - DNA, 15 bp, Homo sapiens
ccccaccccacagat

SEQ ID NO: 6731072 - DNA, 17 bp, Homo sapiens
ccccaccccaccctgcc

SEQ ID NO: 6731073 - DNA, 12 bp, Homo sapiens
ccccaccccaga

SEQ ID NO: 6731074 - DNA, 13 bp, Homo sapiens
ccccaccccagca

SEQ ID NO: 6731075 - DNA, 18 bp, Homo sapiens
ccccaccccagcacagct

SEQ ID NO: 6731076 - DNA, 16 bp, Homo sapiens
ccccaccccagggcag

SEQ ID NO: 6731077 - DNA, 18 bp, Homo sapiens
ccccaccccagtgggaac

SEQ ID NO: 6731078 - DNA, 14 bp, Homo sapiens
ccccaccccatcca

SEQ ID NO: 6731079 - DNA, 16 bp, Homo sapiens
ccccacccccagccag

SEQ ID NO: 6731080 - DNA, 17 bp, Homo sapiens
ccccacccccagccagg

SEQ ID NO: 6731081 - DNA, 19 bp, Homo sapiens
ccccacccccagccaggct

SEQ ID NO: 6731082 - DNA, 16 bp, Homo sapiens
ccccacccccagctca

SEQ ID NO: 6731083 - DNA, 17 bp, Homo sapiens
ccccaccccccaggcct

SEQ ID NO: 6731084 - DNA, 17 bp, Homo sapiens
ccccacccccctcctcc

SEQ ID NO: 6731085 - DNA, 18 bp, Homo sapiens
ccccacccccgccatgca

SEQ ID NO: 6731086 - DNA, 17 bp, Homo sapiens
ccccaccccctccccag

SEQ ID NO: 6731087 - DNA, 23 bp, Homo sapiens
ccccaccccctccccaggggaga

SEQ ID NO: 6731088 - DNA, 21 bp, Homo sapiens
ccccacccccttcagtgccca

SEQ ID NO: 6731089 - DNA, 22 bp, Homo sapiens
ccccaccccggggaccctgtga

SEQ ID NO: 6731090 - DNA, 15 bp, Homo sapiens
ccccaccccgtcctg

SEQ ID NO: 6731091 - DNA, 23 bp, Homo sapiens
ccccacccctacagcctgcacac

SEQ ID NO: 6731092 - DNA, 12 bp, Homo sapiens
ccccacccctca

SEQ ID NO: 6731093 - DNA, 16 bp, Homo sapiens
ccccacccctccacgt

SEQ ID NO: 6731094 - DNA, 19 bp, Homo sapiens
ccccacccctgggggctct

SEQ ID NO: 6731095 - DNA, 12 bp, Homo sapiens
ccccacccctgt

SEQ ID NO: 6731096 - DNA, 14 bp, Homo sapiens
ccccacccctgtaa

SEQ ID NO: 6731097 - DNA, 22 bp, Homo sapiens
ccccaccccttccccactgcct

SEQ ID NO: 6731098 - DNA, 22 bp, Homo sapiens
ccccaccccttccccaggccca

SEQ ID NO: 6731099 - DNA, 15 bp, Homo sapiens
ccccaccccttccct

SEQ ID NO: 6731100 - DNA, 18 bp, Homo sapiens
ccccacccggtggttctt

SEQ ID NO: 6731101 - DNA, 22 bp, Homo sapiens
ccccacccggtggttcttcctg

SEQ ID NO: 6731102 - DNA, 13 bp, Homo sapiens
ccccaccctcagc

SEQ ID NO: 6731103 - DNA, 14 bp, Homo sapiens
ccccaccctcccct

SEQ ID NO: 6731104 - DNA, 18 bp, Homo sapiens
ccccaccctccctggagt

SEQ ID NO: 6731105 - DNA, 15 bp, Homo sapiens
ccccaccctcctctt

SEQ ID NO: 6731106 - DNA, 15 bp, Homo sapiens
ccccaccctcctggc

SEQ ID NO: 6731107 - DNA, 16 bp, Homo sapiens
ccccaccctcgaccac

SEQ ID NO: 6731108 - DNA, 23 bp, Homo sapiens
ccccaccctcggggatgtgtcct

SEQ ID NO: 6731109 - DNA, 21 bp, Homo sapiens
ccccaccctcgtggacacctg

SEQ ID NO: 6731110 - DNA, 22 bp, Homo sapiens
ccccaccctcgtggacacctgc

SEQ ID NO: 6731111 - DNA, 10 bp, Homo sapiens
ccccaccctg

SEQ ID NO: 6731112 - DNA, 12 bp, Homo sapiens
ccccaccctgct

SEQ ID NO: 6731113 - DNA, 22 bp, Homo sapiens
ccccaccctgcttctgctgcct

SEQ ID NO: 6731114 - DNA, 14 bp, Homo sapiens
ccccaccctggcct

SEQ ID NO: 6731115 - DNA, 13 bp, Homo sapiens
ccccaccctgggt

SEQ ID NO: 6731116 - DNA, 19 bp, Homo sapiens
ccccaccctgttcctgctg

SEQ ID NO: 6731117 - DNA, 21 bp, Homo sapiens
ccccaccctgttcctgctgct

SEQ ID NO: 6731118 - DNA, 13 bp, Homo sapiens
ccccacccttggg

SEQ ID NO: 6731119 - DNA, 15 bp, Homo sapiens
ccccaccgcccactc

SEQ ID NO: 6731120 - DNA, 19 bp, Homo sapiens
ccccaccgccggggtcctg

SEQ ID NO: 6731121 - DNA, 17 bp, Homo sapiens
ccccaccgccgtggagt

SEQ ID NO: 6731122 - DNA, 14 bp, Homo sapiens
ccccaccgctgaga

SEQ ID NO: 6731123 - DNA, 18 bp, Homo sapiens
ccccaccggtccagctgg

SEQ ID NO: 6731124 - DNA, 19 bp, Homo sapiens
ccccaccggtccagctggc

SEQ ID NO: 6731125 - DNA, 22 bp, Homo sapiens
ccccaccgttgtctcatgccag

SEQ ID NO: 6731126 - DNA, 22 bp, Homo sapiens
ccccacctacccagctgatggg

SEQ ID NO: 6731127 - DNA, 12 bp, Homo sapiens
ccccacctccac

SEQ ID NO: 6731128 - DNA, 18 bp, Homo sapiens
ccccacctccacctgtga

SEQ ID NO: 6731129 - DNA, 12 bp, Homo sapiens
ccccacctccca

SEQ ID NO: 6731130 - DNA, 13 bp, Homo sapiens
ccccacctcccat

SEQ ID NO: 6731131 - DNA, 18 bp, Homo sapiens
ccccacctcccatttctg

SEQ ID NO: 6731132 - DNA, 17 bp, Homo sapiens
ccccacctccctgcagc

SEQ ID NO: 6731133 - DNA, 22 bp, Homo sapiens
ccccacctccgccccagacaca

SEQ ID NO: 6731134 - DNA, 14 bp, Homo sapiens
ccccacctctccaa

SEQ ID NO: 6731135 - DNA, 11 bp, Homo sapiens
ccccacctctg

SEQ ID NO: 6731136 - DNA, 23 bp, Homo sapiens
ccccacctcttgtttctgggtcc

SEQ ID NO: 6731137 - DNA, 14 bp, Homo sapiens
ccccacctcttttc

SEQ ID NO: 6731138 - DNA, 12 bp, Homo sapiens
ccccacctgaag

SEQ ID NO: 6731139 - DNA, 17 bp, Homo sapiens
ccccacctgaagggtgg

SEQ ID NO: 6731140 - DNA, 18 bp, Homo sapiens
ccccacctgacctctgca

SEQ ID NO: 6731141 - DNA, 16 bp, Homo sapiens
ccccacctgcactcca

SEQ ID NO: 6731142 - DNA, 13 bp, Homo sapiens
ccccacctgcagg

SEQ ID NO: 6731143 - DNA, 14 bp, Homo sapiens
ccccacctgcctgg

SEQ ID NO: 6731144 - DNA, 13 bp, Homo sapiens
ccccacctggaca

SEQ ID NO: 6731145 - DNA, 14 bp, Homo sapiens
ccccacctggctca

SEQ ID NO: 6731146 - DNA, 10 bp, Homo sapiens
ccccacctgt

SEQ ID NO: 6731147 - DNA, 11 bp, Homo sapiens
ccccacctgta

SEQ ID NO: 6731148 - DNA, 16 bp, Homo sapiens
ccccaccttccccaga

SEQ ID NO: 6731149 - DNA, 15 bp, Homo sapiens
ccccaccttccctcc

SEQ ID NO: 6731150 - DNA, 23 bp, Homo sapiens
ccccaccttccctccacctgctt

SEQ ID NO: 6731151 - DNA, 22 bp, Homo sapiens
ccccaccttcttgggactgctg

SEQ ID NO: 6731152 - DNA, 19 bp, Homo sapiens
ccccaccttgccaagcttt

SEQ ID NO: 6731153 - DNA, 19 bp, Homo sapiens
ccccaccttggtccctctc

SEQ ID NO: 6731154 - DNA, 22 bp, Homo sapiens
ccccaccttggtccctctcaga

SEQ ID NO: 6731155 - DNA, 22 bp, Homo sapiens
ccccacgacccctgcctcgagg

SEQ ID NO: 6731156 - DNA, 18 bp, Homo sapiens
ccccacgagggctggctg

SEQ ID NO: 6731157 - DNA, 23 bp, Homo sapiens
ccccacgagtcacctgcaagccc

SEQ ID NO: 6731158 - DNA, 18 bp, Homo sapiens
ccccacgccctctcctcc

SEQ ID NO: 6731159 - DNA, 16 bp, Homo sapiens
ccccacgctgaccatg

SEQ ID NO: 6731160 - DNA, 15 bp, Homo sapiens
ccccacgcttctgga

SEQ ID NO: 6731161 - DNA, 22 bp, Homo sapiens
ccccacggccgctccaggggtg

SEQ ID NO: 6731162 - DNA, 18 bp, Homo sapiens
ccccacggccgtccctga

SEQ ID NO: 6731163 - DNA, 19 bp, Homo sapiens
ccccacgtgacagtgcctg

SEQ ID NO: 6731164 - DNA, 19 bp, Homo sapiens
ccccacgtggactctgtgc

SEQ ID NO: 6731165 - DNA, 21 bp, Homo sapiens
ccccacgtggactctgtgctc

SEQ ID NO: 6731166 - DNA, 14 bp, Homo sapiens
ccccactactgcag

SEQ ID NO: 6731167 - DNA, 21 bp, Homo sapiens
ccccactactgcagcacctcc

SEQ ID NO: 6731168 - DNA, 18 bp, Homo sapiens
ccccactcaccagtgtcc

SEQ ID NO: 6731169 - DNA, 13 bp, Homo sapiens
ccccactcacccc

SEQ ID NO: 6731170 - DNA, 22 bp, Homo sapiens
ccccactcagtgcctccacatg

SEQ ID NO: 6731171 - DNA, 10 bp, Homo sapiens
ccccactcca

SEQ ID NO: 6731172 - DNA, 11 bp, Homo sapiens
ccccactccag

SEQ ID NO: 6731173 - DNA, 17 bp, Homo sapiens
ccccactccagcccgca

SEQ ID NO: 6731174 - DNA, 16 bp, Homo sapiens
ccccactccagccctg

SEQ ID NO: 6731175 - DNA, 17 bp, Homo sapiens
ccccactccagccctgt

SEQ ID NO: 6731176 - DNA, 18 bp, Homo sapiens
ccccactccccccatcct

SEQ ID NO: 6731177 - DNA, 22 bp, Homo sapiens
ccccactcccccgtttctcctt

SEQ ID NO: 6731178 - DNA, 17 bp, Homo sapiens
ccccactcccctcacac

SEQ ID NO: 6731179 - DNA, 13 bp, Homo sapiens
ccccactccctca

SEQ ID NO: 6731180 - DNA, 12 bp, Homo sapiens
ccccactccctg

SEQ ID NO: 6731181 - DNA, 17 bp, Homo sapiens
ccccactccctgccacc

SEQ ID NO: 6731182 - DNA, 16 bp, Homo sapiens
ccccactccctgtcca

SEQ ID NO: 6731183 - DNA, 21 bp, Homo sapiens
ccccactcccttgctggcccc

SEQ ID NO: 6731184 - DNA, 23 bp, Homo sapiens
ccccactcccttgctggccccag

SEQ ID NO: 6731185 - DNA, 16 bp, Homo sapiens
ccccactccggccctc

SEQ ID NO: 6731186 - DNA, 13 bp, Homo sapiens
ccccactcctcag

SEQ ID NO: 6731187 - DNA, 15 bp, Homo sapiens
ccccactcctcctcc

SEQ ID NO: 6731188 - DNA, 19 bp, Homo sapiens
ccccactcctcctcctttc

SEQ ID NO: 6731189 - DNA, 21 bp, Homo sapiens
ccccactcctctgctgacctg

SEQ ID NO: 6731190 - DNA, 14 bp, Homo sapiens
ccccactcctgtca

SEQ ID NO: 6731191 - DNA, 12 bp, Homo sapiens
ccccactctcag

SEQ ID NO: 6731192 - DNA, 17 bp, Homo sapiens
ccccactctcagaggcc

SEQ ID NO: 6731193 - DNA, 12 bp, Homo sapiens
ccccactctccc

SEQ ID NO: 6731194 - DNA, 15 bp, Homo sapiens
ccccactctccccac

SEQ ID NO: 6731195 - DNA, 18 bp, Homo sapiens
ccccactctccccacact

SEQ ID NO: 6731196 - DNA, 13 bp, Homo sapiens
ccccactctctca

SEQ ID NO: 6731197 - DNA, 14 bp, Homo sapiens
ccccactctctcac

SEQ ID NO: 6731198 - DNA, 18 bp, Homo sapiens
ccccactctctcacccac

SEQ ID NO: 6731199 - DNA, 22 bp, Homo sapiens
ccccactctctcacccaccagc

SEQ ID NO: 6731200 - DNA, 20 bp, Homo sapiens
ccccactctgctcccagccc

SEQ ID NO: 6731201 - DNA, 13 bp, Homo sapiens
ccccactctgtgc

SEQ ID NO: 6731202 - DNA, 21 bp, Homo sapiens
ccccactgacagcctcccacc

SEQ ID NO: 6731203 - DNA, 11 bp, Homo sapiens
ccccactgacc

SEQ ID NO: 6731204 - DNA, 14 bp, Homo sapiens
ccccactgacctgc

SEQ ID NO: 6731205 - DNA, 11 bp, Homo sapiens
ccccactgatg

SEQ ID NO: 6731206 - DNA, 14 bp, Homo sapiens
ccccactgatgctg

SEQ ID NO: 6731207 - DNA, 12 bp, Homo sapiens
ccccactgcagg

SEQ ID NO: 6731208 - DNA, 18 bp, Homo sapiens
ccccactgcaggccccgc

SEQ ID NO: 6731209 - DNA, 23 bp, Homo sapiens
ccccactgccaagtggggatggg

SEQ ID NO: 6731210 - DNA, 13 bp, Homo sapiens
ccccactgcccca

SEQ ID NO: 6731211 - DNA, 13 bp, Homo sapiens
ccccactgccctc

SEQ ID NO: 6731212 - DNA, 21 bp, Homo sapiens
ccccactgccctccagggcca

SEQ ID NO: 6731213 - DNA, 18 bp, Homo sapiens
ccccactgccgcctcctt

SEQ ID NO: 6731214 - DNA, 16 bp, Homo sapiens
ccccactgcctactgc

SEQ ID NO: 6731215 - DNA, 13 bp, Homo sapiens
ccccactggacaa

SEQ ID NO: 6731216 - DNA, 12 bp, Homo sapiens
ccccactggagc

SEQ ID NO: 6731217 - DNA, 14 bp, Homo sapiens
ccccactggctgtg

SEQ ID NO: 6731218 - DNA, 21 bp, Homo sapiens
ccccactggctgtgggctccc

SEQ ID NO: 6731219 - DNA, 17 bp, Homo sapiens
ccccactgggagagctg

SEQ ID NO: 6731220 - DNA, 13 bp, Homo sapiens
ccccactgggcca

SEQ ID NO: 6731221 - DNA, 12 bp, Homo sapiens
ccccactggtga

SEQ ID NO: 6731222 - DNA, 21 bp, Homo sapiens
ccccactgtccccctacccac

SEQ ID NO: 6731223 - DNA, 18 bp, Homo sapiens
ccccacttatccctctcc

SEQ ID NO: 6731224 - DNA, 12 bp, Homo sapiens
ccccacttcact

SEQ ID NO: 6731225 - DNA, 13 bp, Homo sapiens
ccccacttcctac

SEQ ID NO: 6731226 - DNA, 15 bp, Homo sapiens
ccccacttcctactg

SEQ ID NO: 6731227 - DNA, 19 bp, Homo sapiens
ccccacttctctactctgg

SEQ ID NO: 6731228 - DNA, 14 bp, Homo sapiens
ccccacttctggca

SEQ ID NO: 6731229 - DNA, 13 bp, Homo sapiens
ccccacttgcctc

SEQ ID NO: 6731230 - DNA, 21 bp, Homo sapiens
ccccacttgcctcttccttga

SEQ ID NO: 6731231 - DNA, 19 bp, Homo sapiens
ccccacttgtccttagcct

SEQ ID NO: 6731232 - DNA, 22 bp, Homo sapiens
ccccactttcaagacagatgag

SEQ ID NO: 6731233 - DNA, 21 bp, Homo sapiens
ccccactttcctacaaaatgg

SEQ ID NO: 6731234 - DNA, 18 bp, Homo sapiens
ccccactttcgcctcctc

SEQ ID NO: 6731235 - DNA, 23 bp, Homo sapiens
ccccactttcgcctcctccagct

SEQ ID NO: 6731236 - DNA, 16 bp, Homo sapiens
ccccagaaagcctcct

SEQ ID NO: 6731237 - DNA, 19 bp, Homo sapiens
ccccagaaagcctcctgcc

SEQ ID NO: 6731238 - DNA, 16 bp, Homo sapiens
ccccagaaatcactgt

SEQ ID NO: 6731239 - DNA, 17 bp, Homo sapiens
ccccagaaatcactgtg

SEQ ID NO: 6731240 - DNA, 18 bp, Homo sapiens
ccccagaaatcactgtga

SEQ ID NO: 6731241 - DNA, 22 bp, Homo sapiens
ccccagaaatcactgtgaaatt

SEQ ID NO: 6731242 - DNA, 23 bp, Homo sapiens
ccccagaaatcactgtgaaattt

SEQ ID NO: 6731243 - DNA, 15 bp, Homo sapiens
ccccagaaccccaac

SEQ ID NO: 6731244 - DNA, 19 bp, Homo sapiens
ccccagaaccccaactccc

SEQ ID NO: 6731245 - DNA, 15 bp, Homo sapiens
ccccagaacctgtcc

SEQ ID NO: 6731246 - DNA, 20 bp, Homo sapiens
ccccagaacctgtccttgca

SEQ ID NO: 6731247 - DNA, 21 bp, Homo sapiens
ccccagaacctgtccttgcac

SEQ ID NO: 6731248 - DNA, 18 bp, Homo sapiens
ccccagaactggctgggc

SEQ ID NO: 6731249 - DNA, 19 bp, Homo sapiens
ccccagaactggctgggcc

SEQ ID NO: 6731250 - DNA, 17 bp, Homo sapiens
ccccagaagacacagga

SEQ ID NO: 6731251 - DNA, 24 bp, Homo sapiens
ccccagacaacagcccaggcatct

SEQ ID NO: 6731252 - DNA, 16 bp, Homo sapiens
ccccagacacagccca

SEQ ID NO: 6731253 - DNA, 22 bp, Homo sapiens
ccccagacagggctccagcctg

SEQ ID NO: 6731254 - DNA, 18 bp, Homo sapiens
ccccagaccaaccctggg

SEQ ID NO: 6731255 - DNA, 19 bp, Homo sapiens
ccccagaccaaccctggga

SEQ ID NO: 6731256 - DNA, 21 bp, Homo sapiens
ccccagaccaaccctgggacc

SEQ ID NO: 6731257 - DNA, 18 bp, Homo sapiens
ccccagaccagtagtgac

SEQ ID NO: 6731258 - DNA, 20 bp, Homo sapiens
ccccagaccagtagtgacca

SEQ ID NO: 6731259 - DNA, 17 bp, Homo sapiens
ccccagacccatgtgct

SEQ ID NO: 6731260 - DNA, 14 bp, Homo sapiens
ccccagaccccgcc

SEQ ID NO: 6731261 - DNA, 19 bp, Homo sapiens
ccccagacccttcttgcct

SEQ ID NO: 6731262 - DNA, 14 bp, Homo sapiens
ccccagacctctga

SEQ ID NO: 6731263 - DNA, 19 bp, Homo sapiens
ccccagacctgagctcccc

SEQ ID NO: 6731264 - DNA, 20 bp, Homo sapiens
ccccagacctgcgaaggatg

SEQ ID NO: 6731265 - DNA, 15 bp, Homo sapiens
ccccagactagatgt

SEQ ID NO: 6731266 - DNA, 18 bp, Homo sapiens
ccccagactagatgtagt

SEQ ID NO: 6731267 - DNA, 20 bp, Homo sapiens
ccccagactccaccaagcct

SEQ ID NO: 6731268 - DNA, 16 bp, Homo sapiens
ccccagactccaggcc

SEQ ID NO: 6731269 - DNA, 17 bp, Homo sapiens
ccccagactccaggccc

SEQ ID NO: 6731270 - DNA, 15 bp, Homo sapiens
ccccagactctgcct

SEQ ID NO: 6731271 - DNA, 19 bp, Homo sapiens
ccccagactgagctctcca

SEQ ID NO: 6731272 - DNA, 22 bp, Homo sapiens
ccccagactgagctctccaggc

SEQ ID NO: 6731273 - DNA, 16 bp, Homo sapiens
ccccagactgggccca

SEQ ID NO: 6731274 - DNA, 20 bp, Homo sapiens
ccccagactgggcccaggca

SEQ ID NO: 6731275 - DNA, 16 bp, Homo sapiens
ccccagactgtagaga

SEQ ID NO: 6731276 - DNA, 23 bp, Homo sapiens
ccccagactgtagagatttttat

SEQ ID NO: 6731277 - DNA, 13 bp, Homo sapiens
ccccagacttctc

SEQ ID NO: 6731278 - DNA, 10 bp, Homo sapiens
ccccagagac

SEQ ID NO: 6731279 - DNA, 11 bp, Homo sapiens
ccccagagacc

SEQ ID NO: 6731280 - DNA, 22 bp, Homo sapiens
ccccagagacctttgcccacac

SEQ ID NO: 6731281 - DNA, 23 bp, Homo sapiens
ccccagagaccttttctctccca

SEQ ID NO: 6731282 - DNA, 22 bp, Homo sapiens
ccccagagactgcccaccctgg

SEQ ID NO: 6731283 - DNA, 23 bp, Homo sapiens
ccccagagagaccctgcaagacc

SEQ ID NO: 6731284 - DNA, 22 bp, Homo sapiens
ccccagagagagctctgcacgt

SEQ ID NO: 6731285 - DNA, 21 bp, Homo sapiens
ccccagagagaggatgtggaa

SEQ ID NO: 6731286 - DNA, 20 bp, Homo sapiens
ccccagagagcaggcagggg

SEQ ID NO: 6731287 - DNA, 16 bp, Homo sapiens
ccccagagatgccagc

SEQ ID NO: 6731288 - DNA, 17 bp, Homo sapiens
ccccagagatgccagcc

SEQ ID NO: 6731289 - DNA, 18 bp, Homo sapiens
ccccagagatgccagccc

SEQ ID NO: 6731290 - DNA, 21 bp, Homo sapiens
ccccagagatgccagcccttc

SEQ ID NO: 6731291 - DNA, 19 bp, Homo sapiens
ccccagagcacaagttcca

SEQ ID NO: 6731292 - DNA, 23 bp, Homo sapiens
ccccagagcacccccaagcctgg

SEQ ID NO: 6731293 - DNA, 21 bp, Homo sapiens
ccccagagcatctgccccagg

SEQ ID NO: 6731294 - DNA, 13 bp, Homo sapiens
ccccagagccaca

SEQ ID NO: 6731295 - DNA, 15 bp, Homo sapiens
ccccagagccactac

SEQ ID NO: 6731296 - DNA, 21 bp, Homo sapiens
ccccagagccactacctttgt

SEQ ID NO: 6731297 - DNA, 17 bp, Homo sapiens
ccccagagccagggctg

SEQ ID NO: 6731298 - DNA, 18 bp, Homo sapiens
ccccagagcccagctctt

SEQ ID NO: 6731299 - DNA, 21 bp, Homo sapiens
ccccagagcccagctcttgct

SEQ ID NO: 6731300 - DNA, 15 bp, Homo sapiens
ccccagagccccact

SEQ ID NO: 6731301 - DNA, 19 bp, Homo sapiens
ccccagagccccactcccg

SEQ ID NO: 6731302 - DNA, 16 bp, Homo sapiens
ccccagagcccccggg

SEQ ID NO: 6731303 - DNA, 14 bp, Homo sapiens
ccccagagctgcct

SEQ ID NO: 6731304 - DNA, 14 bp, Homo sapiens
ccccagagctgtgc

SEQ ID NO: 6731305 - DNA, 16 bp, Homo sapiens
ccccagaggacacagg

SEQ ID NO: 6731306 - DNA, 15 bp, Homo sapiens
ccccagaggccctgg

SEQ ID NO: 6731307 - DNA, 13 bp, Homo sapiens
ccccagaggctgg

SEQ ID NO: 6731308 - DNA, 17 bp, Homo sapiens
ccccagaggctgggtga

SEQ ID NO: 6731309 - DNA, 22 bp, Homo sapiens
ccccagaggtcgcagctaccct

SEQ ID NO: 6731310 - DNA, 13 bp, Homo sapiens
ccccagaggtggc

SEQ ID NO: 6731311 - DNA, 17 bp, Homo sapiens
ccccagaggtggccctt

SEQ ID NO: 6731312 - DNA, 22 bp, Homo sapiens
ccccagagtgctttaaaaaatt

SEQ ID NO: 6731313 - DNA, 23 bp, Homo sapiens
ccccagagtgggagaggctggga

SEQ ID NO: 6731314 - DNA, 21 bp, Homo sapiens
ccccagagtgggatccacttc

SEQ ID NO: 6731315 - DNA, 20 bp, Homo sapiens
ccccagagtgtagggggcct

SEQ ID NO: 6731316 - DNA, 11 bp, Homo sapiens
ccccagatatc

SEQ ID NO: 6731317 - DNA, 18 bp, Homo sapiens
ccccagatcaccagcccg

SEQ ID NO: 6731318 - DNA, 15 bp, Homo sapiens
ccccagatctgcctg

SEQ ID NO: 6731319 - DNA, 21 bp, Homo sapiens
ccccagatctgcctgggcctg

SEQ ID NO: 6731320 - DNA, 18 bp, Homo sapiens
ccccagatctgtcctggg

SEQ ID NO: 6731321 - DNA, 19 bp, Homo sapiens
ccccagattcttcagcttg

SEQ ID NO: 6731322 - DNA, 15 bp, Homo sapiens
ccccagattgcaaca

SEQ ID NO: 6731323 - DNA, 16 bp, Homo sapiens
ccccagcaacacgtca

SEQ ID NO: 6731324 - DNA, 19 bp, Homo sapiens
ccccagcaacgcccctcca

SEQ ID NO: 6731325 - DNA, 20 bp, Homo sapiens
ccccagcaacgcccctccaa

SEQ ID NO: 6731326 - DNA, 12 bp, Homo sapiens
ccccagcaagag

SEQ ID NO: 6731327 - DNA, 17 bp, Homo sapiens
ccccagcaagcgggagc

SEQ ID NO: 6731328 - DNA, 17 bp, Homo sapiens
ccccagcacagccacct

SEQ ID NO: 6731329 - DNA, 18 bp, Homo sapiens
ccccagcacagccacctc

SEQ ID NO: 6731330 - DNA, 19 bp, Homo sapiens
ccccagcacagccacctcc

SEQ ID NO: 6731331 - DNA, 19 bp, Homo sapiens
ccccagcacagctcctccc

SEQ ID NO: 6731332 - DNA, 19 bp, Homo sapiens
ccccagcactaaagcagtg

SEQ ID NO: 6731333 - DNA, 14 bp, Homo sapiens
ccccagcagaatgg

SEQ ID NO: 6731334 - DNA, 23 bp, Homo sapiens
ccccagcagttgaatgacaacag

SEQ ID NO: 6731335 - DNA, 18 bp, Homo sapiens
ccccagcatcgggggcct

SEQ ID NO: 6731336 - DNA, 19 bp, Homo sapiens
ccccagcatcgggggcctg

SEQ ID NO: 6731337 - DNA, 14 bp, Homo sapiens
ccccagcattccag

SEQ ID NO: 6731338 - DNA, 18 bp, Homo sapiens
ccccagcattccagctct

SEQ ID NO: 6731339 - DNA, 22 bp, Homo sapiens
ccccagcattccagctctgccc

SEQ ID NO: 6731340 - DNA, 18 bp, Homo sapiens
ccccagcattctcaggca

SEQ ID NO: 6731341 - DNA, 19 bp, Homo sapiens
ccccagcatttccagagca

SEQ ID NO: 6731342 - DNA, 16 bp, Homo sapiens
ccccagccacaggcca

SEQ ID NO: 6731343 - DNA, 13 bp, Homo sapiens
ccccagccagaag

SEQ ID NO: 6731344 - DNA, 13 bp, Homo sapiens
ccccagccagccc

SEQ ID NO: 6731345 - DNA, 23 bp, Homo sapiens
ccccagccagcccttcccaggcc

SEQ ID NO: 6731346 - DNA, 16 bp, Homo sapiens
ccccagccagcctggc

SEQ ID NO: 6731347 - DNA, 18 bp, Homo sapiens
ccccagccagcctggctg

SEQ ID NO: 6731348 - DNA, 13 bp, Homo sapiens
ccccagccaggct

SEQ ID NO: 6731349 - DNA, 16 bp, Homo sapiens
ccccagccagggctca

SEQ ID NO: 6731350 - DNA, 19 bp, Homo sapiens
ccccagccatgccagctgg

SEQ ID NO: 6731351 - DNA, 19 bp, Homo sapiens
ccccagccatggtgaggaa

SEQ ID NO: 6731352 - DNA, 14 bp, Homo sapiens
ccccagcccaaagg

SEQ ID NO: 6731353 - DNA, 22 bp, Homo sapiens
ccccagcccaaaggggacaggc

SEQ ID NO: 6731354 - DNA, 13 bp, Homo sapiens
ccccagcccaagt

SEQ ID NO: 6731355 - DNA, 14 bp, Homo sapiens
ccccagcccaagtc

SEQ ID NO: 6731356 - DNA, 15 bp, Homo sapiens
ccccagcccaagtcc

SEQ ID NO: 6731357 - DNA, 18 bp, Homo sapiens
ccccagcccacagagcct

SEQ ID NO: 6731358 - DNA, 22 bp, Homo sapiens
ccccagcccaccctcctgtctt

SEQ ID NO: 6731359 - DNA, 18 bp, Homo sapiens
ccccagcccactggatca

SEQ ID NO: 6731360 - DNA, 11 bp, Homo sapiens
ccccagcccag

SEQ ID NO: 6731361 - DNA, 12 bp, Homo sapiens
ccccagcccaga

SEQ ID NO: 6731362 - DNA, 14 bp, Homo sapiens
ccccagcccagaca

SEQ ID NO: 6731363 - DNA, 16 bp, Homo sapiens
ccccagcccagagaca

SEQ ID NO: 6731364 - DNA, 13 bp, Homo sapiens
ccccagcccagca

SEQ ID NO: 6731365 - DNA, 17 bp, Homo sapiens
ccccagcccagcccagc

SEQ ID NO: 6731366 - DNA, 20 bp, Homo sapiens
ccccagcccagggctcctgc

SEQ ID NO: 6731367 - DNA, 21 bp, Homo sapiens
ccccagcccagggctcctgca

SEQ ID NO: 6731368 - DNA, 23 bp, Homo sapiens
ccccagcccatccattaggccag

SEQ ID NO: 6731369 - DNA, 14 bp, Homo sapiens
ccccagccccaaaa

SEQ ID NO: 6731370 - DNA, 16 bp, Homo sapiens
ccccagccccatccca

SEQ ID NO: 6731371 - DNA, 11 bp, Homo sapiens
ccccagccccc

SEQ ID NO: 6731372 - DNA, 17 bp, Homo sapiens
ccccagccccctggccc

SEQ ID NO: 6731373 - DNA, 18 bp, Homo sapiens
ccccagccccctggcccc

SEQ ID NO: 6731374 - DNA, 17 bp, Homo sapiens
ccccagccccctttggg

SEQ ID NO: 6731375 - DNA, 23 bp, Homo sapiens
ccccagccccctttgggcccagg

SEQ ID NO: 6731376 - DNA, 23 bp, Homo sapiens
ccccagccccgactccagccagc

SEQ ID NO: 6731377 - DNA, 13 bp, Homo sapiens
ccccagccccggg

SEQ ID NO: 6731378 - DNA, 19 bp, Homo sapiens
ccccagccccgtcccagag

SEQ ID NO: 6731379 - DNA, 20 bp, Homo sapiens
ccccagccccgtcccagagg

SEQ ID NO: 6731380 - DNA, 15 bp, Homo sapiens
ccccagcccctagcc

SEQ ID NO: 6731381 - DNA, 15 bp, Homo sapiens
ccccagcccctcctc

SEQ ID NO: 6731382 - DNA, 21 bp, Homo sapiens
ccccagccccttctcccagca

SEQ ID NO: 6731383 - DNA, 15 bp, Homo sapiens
ccccagccctcaggc

SEQ ID NO: 6731384 - DNA, 18 bp, Homo sapiens
ccccagccctcaggccag

SEQ ID NO: 6731385 - DNA, 19 bp, Homo sapiens
ccccagccctcaggccagt

SEQ ID NO: 6731386 - DNA, 15 bp, Homo sapiens
ccccagccctccagt

SEQ ID NO: 6731387 - DNA, 16 bp, Homo sapiens
ccccagccctccccac

SEQ ID NO: 6731388 - DNA, 19 bp, Homo sapiens
ccccagccctccttatcaa

SEQ ID NO: 6731389 - DNA, 11 bp, Homo sapiens
ccccagccctg

SEQ ID NO: 6731390 - DNA, 16 bp, Homo sapiens
ccccagccctgctggg

SEQ ID NO: 6731391 - DNA, 15 bp, Homo sapiens
ccccagccctgggaa

SEQ ID NO: 6731392 - DNA, 14 bp, Homo sapiens
ccccagccctgggc

SEQ ID NO: 6731393 - DNA, 15 bp, Homo sapiens
ccccagccctgggct

SEQ ID NO: 6731394 - DNA, 16 bp, Homo sapiens
ccccagccctgggctt

SEQ ID NO: 6731395 - DNA, 15 bp, Homo sapiens
ccccagccctgtcct

SEQ ID NO: 6731396 - DNA, 15 bp, Homo sapiens
ccccagccctgtgga

SEQ ID NO: 6731397 - DNA, 19 bp, Homo sapiens
ccccagcccttagcacaga

SEQ ID NO: 6731398 - DNA, 16 bp, Homo sapiens
ccccagccgctcggag

SEQ ID NO: 6731399 - DNA, 19 bp, Homo sapiens
ccccagcctaagatgaaga

SEQ ID NO: 6731400 - DNA, 18 bp, Homo sapiens
ccccagcctcactccatt

SEQ ID NO: 6731401 - DNA, 12 bp, Homo sapiens
ccccagcctcag

SEQ ID NO: 6731402 - DNA, 15 bp, Homo sapiens
ccccagcctcagccc

SEQ ID NO: 6731403 - DNA, 17 bp, Homo sapiens
ccccagcctcagcccaa

SEQ ID NO: 6731404 - DNA, 13 bp, Homo sapiens
ccccagcctcatt

SEQ ID NO: 6731405 - DNA, 12 bp, Homo sapiens
ccccagcctcca

SEQ ID NO: 6731406 - DNA, 12 bp, Homo sapiens
ccccagcctccc

SEQ ID NO: 6731407 - DNA, 18 bp, Homo sapiens
ccccagcctcccccaggc

SEQ ID NO: 6731408 - DNA, 16 bp, Homo sapiens
ccccagcctctcttcc

SEQ ID NO: 6731409 - DNA, 14 bp, Homo sapiens
ccccagcctctggc

SEQ ID NO: 6731410 - DNA, 15 bp, Homo sapiens
ccccagcctctggca

SEQ ID NO: 6731411 - DNA, 17 bp, Homo sapiens
ccccagcctgacctgag

SEQ ID NO: 6731412 - DNA, 20 bp, Homo sapiens
ccccagcctgctagctagct

SEQ ID NO: 6731413 - DNA, 23 bp, Homo sapiens
ccccagcctggccacgcagccag

SEQ ID NO: 6731414 - DNA, 17 bp, Homo sapiens
ccccagcctggcccagc

SEQ ID NO: 6731415 - DNA, 21 bp, Homo sapiens
ccccagcctgggcccatctcc

SEQ ID NO: 6731416 - DNA, 23 bp, Homo sapiens
ccccagccttggtgggggagcct

SEQ ID NO: 6731417 - DNA, 20 bp, Homo sapiens
ccccagcgctgacgtgtcag

SEQ ID NO: 6731418 - DNA, 19 bp, Homo sapiens
ccccagcggtttccacttg

SEQ ID NO: 6731419 - DNA, 16 bp, Homo sapiens
ccccagcgtcaggcct

SEQ ID NO: 6731420 - DNA, 23 bp, Homo sapiens
ccccagcgtcccagtctctggca

SEQ ID NO: 6731421 - DNA, 18 bp, Homo sapiens
ccccagcgtctgcagggt

SEQ ID NO: 6731422 - DNA, 20 bp, Homo sapiens
ccccagcgtctgcagggtga

SEQ ID NO: 6731423 - DNA, 17 bp, Homo sapiens
ccccagctaagaacctg

SEQ ID NO: 6731424 - DNA, 17 bp, Homo sapiens
ccccagctaataaacca

SEQ ID NO: 6731425 - DNA, 22 bp, Homo sapiens
ccccagctaccctttttctcca

SEQ ID NO: 6731426 - DNA, 22 bp, Homo sapiens
ccccagctattttctgaccaaa

SEQ ID NO: 6731427 - DNA, 14 bp, Homo sapiens
ccccagctcaatgg

SEQ ID NO: 6731428 - DNA, 13 bp, Homo sapiens
ccccagctcaggg

SEQ ID NO: 6731429 - DNA, 10 bp, Homo sapiens
ccccagctcc

SEQ ID NO: 6731430 - DNA, 14 bp, Homo sapiens
ccccagctccacct

SEQ ID NO: 6731431 - DNA, 16 bp, Homo sapiens
ccccagctccaggcag

SEQ ID NO: 6731432 - DNA, 18 bp, Homo sapiens
ccccagctccaggcagga

SEQ ID NO: 6731433 - DNA, 15 bp, Homo sapiens
ccccagctcccacac

SEQ ID NO: 6731434 - DNA, 14 bp, Homo sapiens
ccccagctcccacc

SEQ ID NO: 6731435 - DNA, 13 bp, Homo sapiens
ccccagctcccag

SEQ ID NO: 6731436 - DNA, 17 bp, Homo sapiens
ccccagctcccccaggc

SEQ ID NO: 6731437 - DNA, 16 bp, Homo sapiens
ccccagctccctgcac

SEQ ID NO: 6731438 - DNA, 14 bp, Homo sapiens
ccccagctcccttg

SEQ ID NO: 6731439 - DNA, 21 bp, Homo sapiens
ccccagctctaagcagccagg

SEQ ID NO: 6731440 - DNA, 16 bp, Homo sapiens
ccccagctctcagtag

SEQ ID NO: 6731441 - DNA, 20 bp, Homo sapiens
ccccagctctcttctggctt

SEQ ID NO: 6731442 - DNA, 13 bp, Homo sapiens
ccccagctctgct

SEQ ID NO: 6731443 - DNA, 14 bp, Homo sapiens
ccccagctctgctt

SEQ ID NO: 6731444 - DNA, 16 bp, Homo sapiens
ccccagctctgcttgc

SEQ ID NO: 6731445 - DNA, 12 bp, Homo sapiens
ccccagctctgg

SEQ ID NO: 6731446 - DNA, 13 bp, Homo sapiens
ccccagctctgga

SEQ ID NO: 6731447 - DNA, 20 bp, Homo sapiens
ccccagctcttctcttccta

SEQ ID NO: 6731448 - DNA, 18 bp, Homo sapiens
ccccagctgactgtggcc

SEQ ID NO: 6731449 - DNA, 22 bp, Homo sapiens
ccccagctgactgttggctctc

SEQ ID NO: 6731450 - DNA, 15 bp, Homo sapiens
ccccagctgccaaag

SEQ ID NO: 6731451 - DNA, 15 bp, Homo sapiens
ccccagctgccaggc

SEQ ID NO: 6731452 - DNA, 18 bp, Homo sapiens
ccccagctgccggcagtg

SEQ ID NO: 6731453 - DNA, 14 bp, Homo sapiens
ccccagctgcggca

SEQ ID NO: 6731454 - DNA, 16 bp, Homo sapiens
ccccagctgctctaag

SEQ ID NO: 6731455 - DNA, 10 bp, Homo sapiens
ccccagctgg

SEQ ID NO: 6731456 - DNA, 12 bp, Homo sapiens
ccccagctggcc

SEQ ID NO: 6731457 - DNA, 14 bp, Homo sapiens
ccccagctgggctg

SEQ ID NO: 6731458 - DNA, 21 bp, Homo sapiens
ccccagctggggccaggctgg

SEQ ID NO: 6731459 - DNA, 17 bp, Homo sapiens
ccccagctggtccaggg

SEQ ID NO: 6731460 - DNA, 20 bp, Homo sapiens
ccccagctgtatgaggagag

SEQ ID NO: 6731461 - DNA, 22 bp, Homo sapiens
ccccagctgtcatcaattaaag

SEQ ID NO: 6731462 - DNA, 16 bp, Homo sapiens
ccccagctgtgagcct

SEQ ID NO: 6731463 - DNA, 21 bp, Homo sapiens
ccccagctgtgagccttggct

SEQ ID NO: 6731464 - DNA, 14 bp, Homo sapiens
ccccagcttcctgt

SEQ ID NO: 6731465 - DNA, 23 bp, Homo sapiens
ccccagcttctctctccctgtca

SEQ ID NO: 6731466 - DNA, 24 bp, Homo sapiens
ccccagctttgcccaacaccagcc

SEQ ID NO: 6731467 - DNA, 18 bp, Homo sapiens
ccccagcttttcttgcca

SEQ ID NO: 6731468 - DNA, 20 bp, Homo sapiens
ccccagcttttcttgccagc

SEQ ID NO: 6731469 - DNA, 17 bp, Homo sapiens
ccccaggaaaagcacaa

SEQ ID NO: 6731470 - DNA, 23 bp, Homo sapiens
ccccaggaagcccactgcctcct

SEQ ID NO: 6731471 - DNA, 11 bp, Homo sapiens
ccccaggaagg

SEQ ID NO: 6731472 - DNA, 19 bp, Homo sapiens
ccccaggaagtggctcaga

SEQ ID NO: 6731473 - DNA, 17 bp, Homo sapiens
ccccaggacagcacacg

SEQ ID NO: 6731474 - DNA, 14 bp, Homo sapiens
ccccaggacaggct

SEQ ID NO: 6731475 - DNA, 18 bp, Homo sapiens
ccccaggaccagaagctc

SEQ ID NO: 6731476 - DNA, 18 bp, Homo sapiens
ccccaggaccagctcagg

SEQ ID NO: 6731477 - DNA, 19 bp, Homo sapiens
ccccaggaccagctcagga

SEQ ID NO: 6731478 - DNA, 19 bp, Homo sapiens
ccccaggacgcatgcaggg

SEQ ID NO: 6731479 - DNA, 12 bp, Homo sapiens
ccccaggacgcc

SEQ ID NO: 6731480 - DNA, 13 bp, Homo sapiens
ccccaggactggg

SEQ ID NO: 6731481 - DNA, 12 bp, Homo sapiens
ccccaggagcag

SEQ ID NO: 6731482 - DNA, 22 bp, Homo sapiens
ccccaggagctctctgctgagc

SEQ ID NO: 6731483 - DNA, 13 bp, Homo sapiens
ccccaggaggcca

SEQ ID NO: 6731484 - DNA, 14 bp, Homo sapiens
ccccaggaggccag

SEQ ID NO: 6731485 - DNA, 21 bp, Homo sapiens
ccccaggaggccagccttgac

SEQ ID NO: 6731486 - DNA, 22 bp, Homo sapiens
ccccaggatgccacgcctggaa

SEQ ID NO: 6731487 - DNA, 23 bp, Homo sapiens
ccccaggatgccacgcctggaag

SEQ ID NO: 6731488 - DNA, 17 bp, Homo sapiens
ccccaggcagccaccag

SEQ ID NO: 6731489 - DNA, 18 bp, Homo sapiens
ccccaggcagctcctgtt

SEQ ID NO: 6731490 - DNA, 11 bp, Homo sapiens
ccccaggcagg

SEQ ID NO: 6731491 - DNA, 23 bp, Homo sapiens
ccccaggcaggctgtgcgctgac

SEQ ID NO: 6731492 - DNA, 12 bp, Homo sapiens
ccccaggccagg

SEQ ID NO: 6731493 - DNA, 13 bp, Homo sapiens
ccccaggccaggc

SEQ ID NO: 6731494 - DNA, 16 bp, Homo sapiens
ccccaggccaggtagc

SEQ ID NO: 6731495 - DNA, 14 bp, Homo sapiens
ccccaggccaggtc

SEQ ID NO: 6731496 - DNA, 23 bp, Homo sapiens
ccccaggccaggtccctggacca

SEQ ID NO: 6731497 - DNA, 17 bp, Homo sapiens
ccccaggcccactcagg

SEQ ID NO: 6731498 - DNA, 21 bp, Homo sapiens
ccccaggcccactcaggggtc

SEQ ID NO: 6731499 - DNA, 16 bp, Homo sapiens
ccccaggcccagccct

SEQ ID NO: 6731500 - DNA, 17 bp, Homo sapiens
ccccaggcccagccctc

SEQ ID NO: 6731501 - DNA, 19 bp, Homo sapiens
ccccaggcccagccctcct

SEQ ID NO: 6731502 - DNA, 17 bp, Homo sapiens
ccccaggcccgccctgc

SEQ ID NO: 6731503 - DNA, 18 bp, Homo sapiens
ccccaggcccgccctgcc

SEQ ID NO: 6731504 - DNA, 20 bp, Homo sapiens
ccccaggcccgcgggcacag

SEQ ID NO: 6731505 - DNA, 14 bp, Homo sapiens
ccccaggccctact

SEQ ID NO: 6731506 - DNA, 15 bp, Homo sapiens
ccccaggccctccca

SEQ ID NO: 6731507 - DNA, 17 bp, Homo sapiens
ccccaggccctcccacc

SEQ ID NO: 6731508 - DNA, 23 bp, Homo sapiens
ccccaggccctgcagcggtggtt

SEQ ID NO: 6731509 - DNA, 19 bp, Homo sapiens
ccccaggccggagcccaga

SEQ ID NO: 6731510 - DNA, 14 bp, Homo sapiens
ccccaggcctccta

SEQ ID NO: 6731511 - DNA, 15 bp, Homo sapiens
ccccaggcctctgtg

SEQ ID NO: 6731512 - DNA, 17 bp, Homo sapiens
ccccaggcctctgtgtc

SEQ ID NO: 6731513 - DNA, 16 bp, Homo sapiens
ccccaggcctgagctg

SEQ ID NO: 6731514 - DNA, 21 bp, Homo sapiens
ccccaggcctgagctgcttca

SEQ ID NO: 6731515 - DNA, 17 bp, Homo sapiens
ccccaggcctgccctgc

SEQ ID NO: 6731516 - DNA, 12 bp, Homo sapiens
ccccaggcctgg

SEQ ID NO: 6731517 - DNA, 16 bp, Homo sapiens
ccccaggctcccctgg

SEQ ID NO: 6731518 - DNA, 17 bp, Homo sapiens
ccccaggctgagagcca

SEQ ID NO: 6731519 - DNA, 15 bp, Homo sapiens
ccccaggctgcccac

SEQ ID NO: 6731520 - DNA, 18 bp, Homo sapiens
ccccaggctgcccagagc

SEQ ID NO: 6731521 - DNA, 19 bp, Homo sapiens
ccccaggctgcgcctgccc

SEQ ID NO: 6731522 - DNA, 15 bp, Homo sapiens
ccccaggctggagac

SEQ ID NO: 6731523 - DNA, 14 bp, Homo sapiens
ccccaggctgttct

SEQ ID NO: 6731524 - DNA, 22 bp, Homo sapiens
ccccaggcttccgcgcccagcg

SEQ ID NO: 6731525 - DNA, 20 bp, Homo sapiens
ccccagggaagcagcagcct

SEQ ID NO: 6731526 - DNA, 17 bp, Homo sapiens
ccccagggaatcaggga

SEQ ID NO: 6731527 - DNA, 21 bp, Homo sapiens
ccccagggacagaggccaagg

SEQ ID NO: 6731528 - DNA, 11 bp, Homo sapiens
ccccagggagt

SEQ ID NO: 6731529 - DNA, 15 bp, Homo sapiens
ccccagggcacagga

SEQ ID NO: 6731530 - DNA, 17 bp, Homo sapiens
ccccagggcacaggagc

SEQ ID NO: 6731531 - DNA, 18 bp, Homo sapiens
ccccagggcacaggagct

SEQ ID NO: 6731532 - DNA, 22 bp, Homo sapiens
ccccagggcacaggagctacct

SEQ ID NO: 6731533 - DNA, 19 bp, Homo sapiens
ccccagggcactgccagcc

SEQ ID NO: 6731534 - DNA, 21 bp, Homo sapiens
ccccagggcactgccagccca

SEQ ID NO: 6731535 - DNA, 22 bp, Homo sapiens
ccccagggcacttcacagagtg

SEQ ID NO: 6731536 - DNA, 16 bp, Homo sapiens
ccccagggcagccagg

SEQ ID NO: 6731537 - DNA, 16 bp, Homo sapiens
ccccagggcagcctcg

SEQ ID NO: 6731538 - DNA, 22 bp, Homo sapiens
ccccagggcagggaaactggct

SEQ ID NO: 6731539 - DNA, 14 bp, Homo sapiens
ccccagggcagggt

SEQ ID NO: 6731540 - DNA, 17 bp, Homo sapiens
ccccagggcccccacag

SEQ ID NO: 6731541 - DNA, 19 bp, Homo sapiens
ccccagggcccccacaggc

SEQ ID NO: 6731542 - DNA, 12 bp, Homo sapiens
ccccagggccct

SEQ ID NO: 6731543 - DNA, 17 bp, Homo sapiens
ccccagggccctgctca

SEQ ID NO: 6731544 - DNA, 24 bp, Homo sapiens
ccccagggccctgctcaggcctca

SEQ ID NO: 6731545 - DNA, 16 bp, Homo sapiens
ccccagggccctggcc

SEQ ID NO: 6731546 - DNA, 17 bp, Homo sapiens
ccccagggccctggcca

SEQ ID NO: 6731547 - DNA, 19 bp, Homo sapiens
ccccagggccctggccagc

SEQ ID NO: 6731548 - DNA, 17 bp, Homo sapiens
ccccagggcctccaggg

SEQ ID NO: 6731549 - DNA, 19 bp, Homo sapiens
ccccagggcctccagggcc

SEQ ID NO: 6731550 - DNA, 13 bp, Homo sapiens
ccccagggcctgg

SEQ ID NO: 6731551 - DNA, 14 bp, Homo sapiens
ccccagggcctggg

SEQ ID NO: 6731552 - DNA, 20 bp, Homo sapiens
ccccagggcctgtctccctt

SEQ ID NO: 6731553 - DNA, 21 bp, Homo sapiens
ccccagggctcccttatgtcc

SEQ ID NO: 6731554 - DNA, 16 bp, Homo sapiens
ccccaggggaaaatga

SEQ ID NO: 6731555 - DNA, 20 bp, Homo sapiens
ccccaggggaactggcagcg

SEQ ID NO: 6731556 - DNA, 22 bp, Homo sapiens
ccccaggggacgtgggccctgc

SEQ ID NO: 6731557 - DNA, 13 bp, Homo sapiens
ccccaggggagaa

SEQ ID NO: 6731558 - DNA, 15 bp, Homo sapiens
ccccaggggagaaag

SEQ ID NO: 6731559 - DNA, 11 bp, Homo sapiens
ccccaggggca

SEQ ID NO: 6731560 - DNA, 17 bp, Homo sapiens
ccccaggggcatgactg

SEQ ID NO: 6731561 - DNA, 23 bp, Homo sapiens
ccccagggggcggggtgcagaag

SEQ ID NO: 6731562 - DNA, 15 bp, Homo sapiens
ccccaggggggcctc

SEQ ID NO: 6731563 - DNA, 22 bp, Homo sapiens
ccccagggggtctcacccatgc

SEQ ID NO: 6731564 - DNA, 17 bp, Homo sapiens
ccccaggggtcccagcc

SEQ ID NO: 6731565 - DNA, 19 bp, Homo sapiens
ccccaggggtcccagccac

SEQ ID NO: 6731566 - DNA, 20 bp, Homo sapiens
ccccaggggtgcctgtgggg

SEQ ID NO: 6731567 - DNA, 17 bp, Homo sapiens
ccccagggtcctgggag

SEQ ID NO: 6731568 - DNA, 19 bp, Homo sapiens
ccccagggtcttccctacc

SEQ ID NO: 6731569 - DNA, 16 bp, Homo sapiens
ccccagggttctgtat

SEQ ID NO: 6731570 - DNA, 23 bp, Homo sapiens
ccccagggtttacatgaagcaga

SEQ ID NO: 6731571 - DNA, 16 bp, Homo sapiens
ccccaggtacacctcc

SEQ ID NO: 6731572 - DNA, 23 bp, Homo sapiens
ccccaggtacacctccccctgcg

SEQ ID NO: 6731573 - DNA, 20 bp, Homo sapiens
ccccaggtaggggcccctct

SEQ ID NO: 6731574 - DNA, 23 bp, Homo sapiens
ccccaggtaggggcccctctcag

SEQ ID NO: 6731575 - DNA, 16 bp, Homo sapiens
ccccaggtcagccctg

SEQ ID NO: 6731576 - DNA, 23 bp, Homo sapiens
ccccaggtcaggggctccctaca

SEQ ID NO: 6731577 - DNA, 23 bp, Homo sapiens
ccccaggtcatgctgctgttgct

SEQ ID NO: 6731578 - DNA, 17 bp, Homo sapiens
ccccaggtccagctctg

SEQ ID NO: 6731579 - DNA, 16 bp, Homo sapiens
ccccaggtccccaaac

SEQ ID NO: 6731580 - DNA, 18 bp, Homo sapiens
ccccaggtctctccactg

SEQ ID NO: 6731581 - DNA, 23 bp, Homo sapiens
ccccaggtcttcctgctttccat

SEQ ID NO: 6731582 - DNA, 19 bp, Homo sapiens
ccccaggtcttttcatgtg

SEQ ID NO: 6731583 - DNA, 15 bp, Homo sapiens
ccccaggtcttttct

SEQ ID NO: 6731584 - DNA, 21 bp, Homo sapiens
ccccaggtgccaccaataaaa

SEQ ID NO: 6731585 - DNA, 20 bp, Homo sapiens
ccccaggtggctgacccagt

SEQ ID NO: 6731586 - DNA, 23 bp, Homo sapiens
ccccaggtgtgttggggccttgg

SEQ ID NO: 6731587 - DNA, 13 bp, Homo sapiens
ccccagtaaaatt

SEQ ID NO: 6731588 - DNA, 14 bp, Homo sapiens
ccccagtacctcca

SEQ ID NO: 6731589 - DNA, 14 bp, Homo sapiens
ccccagtagagaaa

SEQ ID NO: 6731590 - DNA, 13 bp, Homo sapiens
ccccagtcacttc

SEQ ID NO: 6731591 - DNA, 19 bp, Homo sapiens
ccccagtccccacccctgc

SEQ ID NO: 6731592 - DNA, 19 bp, Homo sapiens
ccccagtccccagccctgg

SEQ ID NO: 6731593 - DNA, 13 bp, Homo sapiens
ccccagtccgccc

SEQ ID NO: 6731594 - DNA, 14 bp, Homo sapiens
ccccagtccgcccc

SEQ ID NO: 6731595 - DNA, 14 bp, Homo sapiens
ccccagtcctcact

SEQ ID NO: 6731596 - DNA, 19 bp, Homo sapiens
ccccagtcctcactgtcct

SEQ ID NO: 6731597 - DNA, 15 bp, Homo sapiens
ccccagtcctcaggc

SEQ ID NO: 6731598 - DNA, 16 bp, Homo sapiens
ccccagtcctggttca

SEQ ID NO: 6731599 - DNA, 14 bp, Homo sapiens
ccccagtcgagccc

SEQ ID NO: 6731600 - DNA, 19 bp, Homo sapiens
ccccagtcgagccctgcag

SEQ ID NO: 6731601 - DNA, 14 bp, Homo sapiens
ccccagtctccagg

SEQ ID NO: 6731602 - DNA, 15 bp, Homo sapiens
ccccagtgacagcta

SEQ ID NO: 6731603 - DNA, 20 bp, Homo sapiens
ccccagtgactccagggtga

SEQ ID NO: 6731604 - DNA, 17 bp, Homo sapiens
ccccagtgccagctggt

SEQ ID NO: 6731605 - DNA, 11 bp, Homo sapiens
ccccagtgccc

SEQ ID NO: 6731606 - DNA, 18 bp, Homo sapiens
ccccagtgcccggtgcag

SEQ ID NO: 6731607 - DNA, 22 bp, Homo sapiens
ccccagtgcggttcctcatctg

SEQ ID NO: 6731608 - DNA, 18 bp, Homo sapiens
ccccagtgctacctctct

SEQ ID NO: 6731609 - DNA, 16 bp, Homo sapiens
ccccagtgctcacaca

SEQ ID NO: 6731610 - DNA, 21 bp, Homo sapiens
ccccagtgggaccacatgcca

SEQ ID NO: 6731611 - DNA, 18 bp, Homo sapiens
ccccagtgggatgggaca

SEQ ID NO: 6731612 - DNA, 13 bp, Homo sapiens
ccccagtggggac

SEQ ID NO: 6731613 - DNA, 15 bp, Homo sapiens
ccccagtggggacag

SEQ ID NO: 6731614 - DNA, 21 bp, Homo sapiens
ccccagtggggacagggaggg

SEQ ID NO: 6731615 - DNA, 16 bp, Homo sapiens
ccccagtgtattttgt

SEQ ID NO: 6731616 - DNA, 16 bp, Homo sapiens
ccccagtgtccccagg

SEQ ID NO: 6731617 - DNA, 18 bp, Homo sapiens
ccccagtgtccccagggg

SEQ ID NO: 6731618 - DNA, 23 bp, Homo sapiens
ccccagtgtggactctggactgg

SEQ ID NO: 6731619 - DNA, 19 bp, Homo sapiens
ccccagttaatgtgccaaa

SEQ ID NO: 6731620 - DNA, 18 bp, Homo sapiens
ccccagttacaaaaatag

SEQ ID NO: 6731621 - DNA, 16 bp, Homo sapiens
ccccagttcagaaatt

SEQ ID NO: 6731622 - DNA, 18 bp, Homo sapiens
ccccagttccgtccaagt

SEQ ID NO: 6731623 - DNA, 21 bp, Homo sapiens
ccccagttcctcccaggaagc

SEQ ID NO: 6731624 - DNA, 22 bp, Homo sapiens
ccccagttcctgtggctccctc

SEQ ID NO: 6731625 - DNA, 23 bp, Homo sapiens
ccccagttctaggggagaagagc

SEQ ID NO: 6731626 - DNA, 23 bp, Homo sapiens
ccccagttctgctcctctccagg

SEQ ID NO: 6731627 - DNA, 13 bp, Homo sapiens
ccccagtttcttc

SEQ ID NO: 6731628 - DNA, 21 bp, Homo sapiens
ccccataagccctgagactcc

SEQ ID NO: 6731629 - DNA, 13 bp, Homo sapiens
ccccatacccctt

SEQ ID NO: 6731630 - DNA, 23 bp, Homo sapiens
ccccataccccttattgctgcca

SEQ ID NO: 6731631 - DNA, 22 bp, Homo sapiens
ccccatacttggctgcttcctg

SEQ ID NO: 6731632 - DNA, 22 bp, Homo sapiens
ccccatagaaaacaatctgccc

SEQ ID NO: 6731633 - DNA, 17 bp, Homo sapiens
ccccatatataaattat

SEQ ID NO: 6731634 - DNA, 14 bp, Homo sapiens
ccccatatggtcat

SEQ ID NO: 6731635 - DNA, 14 bp, Homo sapiens
ccccatcaccatgg

SEQ ID NO: 6731636 - DNA, 22 bp, Homo sapiens
ccccatcacctctactgtctcc

SEQ ID NO: 6731637 - DNA, 13 bp, Homo sapiens
ccccatcactgcg

SEQ ID NO: 6731638 - DNA, 16 bp, Homo sapiens
ccccatcagcaccatg

SEQ ID NO: 6731639 - DNA, 16 bp, Homo sapiens
ccccatcagccctgct

SEQ ID NO: 6731640 - DNA, 17 bp, Homo sapiens
ccccatcagccctgcta

SEQ ID NO: 6731641 - DNA, 19 bp, Homo sapiens
ccccatcaggactcttgtg

SEQ ID NO: 6731642 - DNA, 22 bp, Homo sapiens
ccccatcattactggtaaagcc

SEQ ID NO: 6731643 - DNA, 17 bp, Homo sapiens
ccccatcattggtaccc

SEQ ID NO: 6731644 - DNA, 14 bp, Homo sapiens
ccccatccagccac

SEQ ID NO: 6731645 - DNA, 15 bp, Homo sapiens
ccccatccagccacg

SEQ ID NO: 6731646 - DNA, 16 bp, Homo sapiens
ccccatccagcctcca

SEQ ID NO: 6731647 - DNA, 16 bp, Homo sapiens
ccccatcccacaccct

SEQ ID NO: 6731648 - DNA, 22 bp, Homo sapiens
ccccatcccagggtcccacccc

SEQ ID NO: 6731649 - DNA, 21 bp, Homo sapiens
ccccatcccattttcatcctg

SEQ ID NO: 6731650 - DNA, 19 bp, Homo sapiens
ccccatccccttcctaaat

SEQ ID NO: 6731651 - DNA, 23 bp, Homo sapiens
ccccatcccgtttccctccaggt

SEQ ID NO: 6731652 - DNA, 23 bp, Homo sapiens
ccccatccctggctgacctgctg

SEQ ID NO: 6731653 - DNA, 13 bp, Homo sapiens
ccccatccctggg

SEQ ID NO: 6731654 - DNA, 16 bp, Homo sapiens
ccccatcctcatccct

SEQ ID NO: 6731655 - DNA, 12 bp, Homo sapiens
ccccatcctcca

SEQ ID NO: 6731656 - DNA, 17 bp, Homo sapiens
ccccatcctccagcttc

SEQ ID NO: 6731657 - DNA, 18 bp, Homo sapiens
ccccatcctccccttccc

SEQ ID NO: 6731658 - DNA, 17 bp, Homo sapiens
ccccatcctctgtacag

SEQ ID NO: 6731659 - DNA, 14 bp, Homo sapiens
ccccatcctggccc

SEQ ID NO: 6731660 - DNA, 15 bp, Homo sapiens
ccccatcctggccca

SEQ ID NO: 6731661 - DNA, 22 bp, Homo sapiens
ccccatcgccagctgatgactc

SEQ ID NO: 6731662 - DNA, 19 bp, Homo sapiens
ccccatcgccccaactcca

SEQ ID NO: 6731663 - DNA, 17 bp, Homo sapiens
ccccatcgccttctggc

SEQ ID NO: 6731664 - DNA, 17 bp, Homo sapiens
ccccatcgccttctggg

SEQ ID NO: 6731665 - DNA, 17 bp, Homo sapiens
ccccatcggccctgtcc

SEQ ID NO: 6731666 - DNA, 18 bp, Homo sapiens
ccccatcggccctgtccc

SEQ ID NO: 6731667 - DNA, 19 bp, Homo sapiens
ccccatcggccctgtcccc

SEQ ID NO: 6731668 - DNA, 13 bp, Homo sapiens
ccccatctcactc

SEQ ID NO: 6731669 - DNA, 13 bp, Homo sapiens
ccccatctcaggc

SEQ ID NO: 6731670 - DNA, 21 bp, Homo sapiens
ccccatctccaagataagcct

SEQ ID NO: 6731671 - DNA, 17 bp, Homo sapiens
ccccatctccccaggcc

SEQ ID NO: 6731672 - DNA, 13 bp, Homo sapiens
ccccatctccctg

SEQ ID NO: 6731673 - DNA, 17 bp, Homo sapiens
ccccatctccctgcctg

SEQ ID NO: 6731674 - DNA, 19 bp, Homo sapiens
ccccatctccctgcctggc

SEQ ID NO: 6731675 - DNA, 21 bp, Homo sapiens
ccccatctcctcccatggcct

SEQ ID NO: 6731676 - DNA, 22 bp, Homo sapiens
ccccatctcgctccctcccagg

SEQ ID NO: 6731677 - DNA, 16 bp, Homo sapiens
ccccatctcggggctg

SEQ ID NO: 6731678 - DNA, 14 bp, Homo sapiens
ccccatctctacta

SEQ ID NO: 6731679 - DNA, 12 bp, Homo sapiens
ccccatctctcc

SEQ ID NO: 6731680 - DNA, 11 bp, Homo sapiens
ccccatctctg

SEQ ID NO: 6731681 - DNA, 14 bp, Homo sapiens
ccccatctctgctg

SEQ ID NO: 6731682 - DNA, 20 bp, Homo sapiens
ccccatctctgtctggggct

SEQ ID NO: 6731683 - DNA, 14 bp, Homo sapiens
ccccatctgcccag

SEQ ID NO: 6731684 - DNA, 17 bp, Homo sapiens
ccccatctgcccaggac

SEQ ID NO: 6731685 - DNA, 18 bp, Homo sapiens
ccccatctgcccaggacg

SEQ ID NO: 6731686 - DNA, 11 bp, Homo sapiens
ccccatctgct

SEQ ID NO: 6731687 - DNA, 12 bp, Homo sapiens
ccccatctgctg

SEQ ID NO: 6731688 - DNA, 19 bp, Homo sapiens
ccccatctgtccagctggg

SEQ ID NO: 6731689 - DNA, 13 bp, Homo sapiens
ccccatctgtctt

SEQ ID NO: 6731690 - DNA, 12 bp, Homo sapiens
ccccatctgtga

SEQ ID NO: 6731691 - DNA, 21 bp, Homo sapiens
ccccatctgtgcattctcctg

SEQ ID NO: 6731692 - DNA, 14 bp, Homo sapiens
ccccatctgtgtgt

SEQ ID NO: 6731693 - DNA, 16 bp, Homo sapiens
ccccatctgtgttcta

SEQ ID NO: 6731694 - DNA, 16 bp, Homo sapiens
ccccatcttcacccag

SEQ ID NO: 6731695 - DNA, 14 bp, Homo sapiens
ccccatcttgcttc

SEQ ID NO: 6731696 - DNA, 20 bp, Homo sapiens
ccccatgacttgatgcagtt

SEQ ID NO: 6731697 - DNA, 17 bp, Homo sapiens
ccccatgagctcggggt

SEQ ID NO: 6731698 - DNA, 22 bp, Homo sapiens
ccccatgaggctcactcattgc

SEQ ID NO: 6731699 - DNA, 15 bp, Homo sapiens
ccccatgatgtaagt

SEQ ID NO: 6731700 - DNA, 14 bp, Homo sapiens
ccccatgattccct

SEQ ID NO: 6731701 - DNA, 13 bp, Homo sapiens
ccccatgcactgt

SEQ ID NO: 6731702 - DNA, 22 bp, Homo sapiens
ccccatgccaaagctagggtgg

SEQ ID NO: 6731703 - DNA, 16 bp, Homo sapiens
ccccatgccacgttcc

SEQ ID NO: 6731704 - DNA, 13 bp, Homo sapiens
ccccatgcccctc

SEQ ID NO: 6731705 - DNA, 12 bp, Homo sapiens
ccccatgcctgt

SEQ ID NO: 6731706 - DNA, 21 bp, Homo sapiens
ccccatgcctgtccagcctgg

SEQ ID NO: 6731707 - DNA, 18 bp, Homo sapiens
ccccatgcctgtggctgc

SEQ ID NO: 6731708 - DNA, 14 bp, Homo sapiens
ccccatgctgcctt

SEQ ID NO: 6731709 - DNA, 16 bp, Homo sapiens
ccccatgctggagcct

SEQ ID NO: 6731710 - DNA, 17 bp, Homo sapiens
ccccatgctggagcctg

SEQ ID NO: 6731711 - DNA, 18 bp, Homo sapiens
ccccatgctggccttgcc

SEQ ID NO: 6731712 - DNA, 15 bp, Homo sapiens
ccccatgctgggctc

SEQ ID NO: 6731713 - DNA, 14 bp, Homo sapiens
ccccatgctgttga

SEQ ID NO: 6731714 - DNA, 18 bp, Homo sapiens
ccccatggaacagccctg

SEQ ID NO: 6731715 - DNA, 22 bp, Homo sapiens
ccccatggaacagccctgcacg

SEQ ID NO: 6731716 - DNA, 23 bp, Homo sapiens
ccccatggaacagccctgcacgc

SEQ ID NO: 6731717 - DNA, 21 bp, Homo sapiens
ccccatggagacaataaacag

SEQ ID NO: 6731718 - DNA, 17 bp, Homo sapiens
ccccatggcagctcctg

SEQ ID NO: 6731719 - DNA, 14 bp, Homo sapiens
ccccatgggcacag

SEQ ID NO: 6731720 - DNA, 13 bp, Homo sapiens
ccccatgggcttg

SEQ ID NO: 6731721 - DNA, 15 bp, Homo sapiens
ccccatgggcttgga

SEQ ID NO: 6731722 - DNA, 23 bp, Homo sapiens
ccccatggggctgcgggacagag

SEQ ID NO: 6731723 - DNA, 14 bp, Homo sapiens
ccccatgtgcctgc

SEQ ID NO: 6731724 - DNA, 18 bp, Homo sapiens
ccccatgtgcctgcacca

SEQ ID NO: 6731725 - DNA, 14 bp, Homo sapiens
ccccatgtgcctgt

SEQ ID NO: 6731726 - DNA, 13 bp, Homo sapiens
ccccatgtgcctt

SEQ ID NO: 6731727 - DNA, 20 bp, Homo sapiens
ccccatgtgccttgtccagg

SEQ ID NO: 6731728 - DNA, 22 bp, Homo sapiens
ccccatgtgggtgaccaggtcc

SEQ ID NO: 6731729 - DNA, 16 bp, Homo sapiens
ccccatgtgtcctggt

SEQ ID NO: 6731730 - DNA, 19 bp, Homo sapiens
ccccatgttgtaatgctgc

SEQ ID NO: 6731731 - DNA, 22 bp, Homo sapiens
ccccattaaattcactttcaat

SEQ ID NO: 6731732 - DNA, 23 bp, Homo sapiens
ccccattagctttcaattccgta

SEQ ID NO: 6731733 - DNA, 14 bp, Homo sapiens
ccccattcacagag

SEQ ID NO: 6731734 - DNA, 19 bp, Homo sapiens
ccccattcacggcctggca

SEQ ID NO: 6731735 - DNA, 20 bp, Homo sapiens
ccccattcacggcctggcat

SEQ ID NO: 6731736 - DNA, 14 bp, Homo sapiens
ccccattcagtgac

SEQ ID NO: 6731737 - DNA, 15 bp, Homo sapiens
ccccattccagctct

SEQ ID NO: 6731738 - DNA, 22 bp, Homo sapiens
ccccattccagtccaattttcc

SEQ ID NO: 6731739 - DNA, 15 bp, Homo sapiens
ccccattccctctct

SEQ ID NO: 6731740 - DNA, 19 bp, Homo sapiens
ccccattcctgatcccatg

SEQ ID NO: 6731741 - DNA, 22 bp, Homo sapiens
ccccattccttgcgcctcagcc

SEQ ID NO: 6731742 - DNA, 13 bp, Homo sapiens
ccccattctcatc

SEQ ID NO: 6731743 - DNA, 12 bp, Homo sapiens
ccccattctccc

SEQ ID NO: 6731744 - DNA, 15 bp, Homo sapiens
ccccattctgcctgc

SEQ ID NO: 6731745 - DNA, 21 bp, Homo sapiens
ccccattctgcctgcccaggc

SEQ ID NO: 6731746 - DNA, 16 bp, Homo sapiens
ccccattcttcctagt

SEQ ID NO: 6731747 - DNA, 15 bp, Homo sapiens
ccccattcttttgta

SEQ ID NO: 6731748 - DNA, 17 bp, Homo sapiens
ccccattgcctcctcct

SEQ ID NO: 6731749 - DNA, 21 bp, Homo sapiens
ccccatttatccacctccatc

SEQ ID NO: 6731750 - DNA, 16 bp, Homo sapiens
ccccatttcccatctg

SEQ ID NO: 6731751 - DNA, 14 bp, Homo sapiens
ccccatttcccgca

SEQ ID NO: 6731752 - DNA, 13 bp, Homo sapiens
ccccatttcctca

SEQ ID NO: 6731753 - DNA, 21 bp, Homo sapiens
ccccatttcctgtacaatcat

SEQ ID NO: 6731754 - DNA, 15 bp, Homo sapiens
ccccatttctgcctc

SEQ ID NO: 6731755 - DNA, 18 bp, Homo sapiens
ccccatttctgcctcgct

SEQ ID NO: 6731756 - DNA, 20 bp, Homo sapiens
ccccatttgctttcttttct

SEQ ID NO: 6731757 - DNA, 15 bp, Homo sapiens
ccccatttgtcccag

SEQ ID NO: 6731758 - DNA, 18 bp, Homo sapiens
ccccattttctttacagt

SEQ ID NO: 6731759 - DNA, 22 bp, Homo sapiens
cccccaaacatagcccctgccc

SEQ ID NO: 6731760 - DNA, 21 bp, Homo sapiens
cccccaaacatctggcatggc

SEQ ID NO: 6731761 - DNA, 17 bp, Homo sapiens
cccccaaagtgctggga

SEQ ID NO: 6731762 - DNA, 21 bp, Homo sapiens
cccccaaatctactgagccac

SEQ ID NO: 6731763 - DNA, 16 bp, Homo sapiens
cccccaaatcttcctc

SEQ ID NO: 6731764 - DNA, 14 bp, Homo sapiens
cccccaaatttaat

SEQ ID NO: 6731765 - DNA, 13 bp, Homo sapiens
cccccaacacagg

SEQ ID NO: 6731766 - DNA, 17 bp, Homo sapiens
cccccaacactccaggc

SEQ ID NO: 6731767 - DNA, 23 bp, Homo sapiens
cccccaacactgtgccctggtgg

SEQ ID NO: 6731768 - DNA, 16 bp, Homo sapiens
cccccaaccaaggaag

SEQ ID NO: 6731769 - DNA, 19 bp, Homo sapiens
cccccaaccatcttcactg

SEQ ID NO: 6731770 - DNA, 12 bp, Homo sapiens
cccccaacccac

SEQ ID NO: 6731771 - DNA, 22 bp, Homo sapiens
cccccaacccacctctggccct

SEQ ID NO: 6731772 - DNA, 14 bp, Homo sapiens
cccccaaccccagc

SEQ ID NO: 6731773 - DNA, 14 bp, Homo sapiens
cccccaacccccag

SEQ ID NO: 6731774 - DNA, 23 bp, Homo sapiens
cccccaacccctcctccctcaga

SEQ ID NO: 6731775 - DNA, 16 bp, Homo sapiens
cccccaacccctcctt

SEQ ID NO: 6731776 - DNA, 14 bp, Homo sapiens
cccccaacccctga

SEQ ID NO: 6731777 - DNA, 16 bp, Homo sapiens
cccccaacccctgagg

SEQ ID NO: 6731778 - DNA, 21 bp, Homo sapiens
cccccaacttgagatgtatga

SEQ ID NO: 6731779 - DNA, 22 bp, Homo sapiens
cccccaagaaacctccatcctg

SEQ ID NO: 6731780 - DNA, 13 bp, Homo sapiens
cccccaagcctct

SEQ ID NO: 6731781 - DNA, 13 bp, Homo sapiens
cccccaagcctgc

SEQ ID NO: 6731782 - DNA, 18 bp, Homo sapiens
cccccaagggaggctgct

SEQ ID NO: 6731783 - DNA, 19 bp, Homo sapiens
cccccaataaaccagtgtg

SEQ ID NO: 6731784 - DNA, 23 bp, Homo sapiens
cccccaataaaccagtgtgaacc

SEQ ID NO: 6731785 - DNA, 18 bp, Homo sapiens
cccccaataaaggcagct

SEQ ID NO: 6731786 - DNA, 20 bp, Homo sapiens
cccccaataaaggcagctgc

SEQ ID NO: 6731787 - DNA, 22 bp, Homo sapiens
cccccaataaaggcagctgcct

SEQ ID NO: 6731788 - DNA, 20 bp, Homo sapiens
cccccacaagctgtccctgc

SEQ ID NO: 6731789 - DNA, 22 bp, Homo sapiens
cccccacaagctgtccctgcag

SEQ ID NO: 6731790 - DNA, 23 bp, Homo sapiens
cccccacaagctgtccctgcagg

SEQ ID NO: 6731791 - DNA, 19 bp, Homo sapiens
cccccacacacacacacat

SEQ ID NO: 6731792 - DNA, 15 bp, Homo sapiens
cccccacacacacta

SEQ ID NO: 6731793 - DNA, 14 bp, Homo sapiens
cccccacacccact

SEQ ID NO: 6731794 - DNA, 14 bp, Homo sapiens
cccccacacctggc

SEQ ID NO: 6731795 - DNA, 16 bp, Homo sapiens
cccccacacctggccc

SEQ ID NO: 6731796 - DNA, 20 bp, Homo sapiens
cccccacacttccctggcgg

SEQ ID NO: 6731797 - DNA, 16 bp, Homo sapiens
cccccacagtgctgtc

SEQ ID NO: 6731798 - DNA, 13 bp, Homo sapiens
cccccacattctg

SEQ ID NO: 6731799 - DNA, 11 bp, Homo sapiens
cccccacccac

SEQ ID NO: 6731800 - DNA, 13 bp, Homo sapiens
cccccacccaccc

SEQ ID NO: 6731801 - DNA, 16 bp, Homo sapiens
cccccacccaccccca

SEQ ID NO: 6731802 - DNA, 20 bp, Homo sapiens
cccccacccacccccaggcc

SEQ ID NO: 6731803 - DNA, 13 bp, Homo sapiens
cccccacccacct

SEQ ID NO: 6731804 - DNA, 18 bp, Homo sapiens
cccccacccacctcctgc

SEQ ID NO: 6731805 - DNA, 13 bp, Homo sapiens
cccccacccactt

SEQ ID NO: 6731806 - DNA, 13 bp, Homo sapiens
cccccacccatgc

SEQ ID NO: 6731807 - DNA, 18 bp, Homo sapiens
cccccacccatgccagcg

SEQ ID NO: 6731808 - DNA, 13 bp, Homo sapiens
cccccaccccagg

SEQ ID NO: 6731809 - DNA, 13 bp, Homo sapiens
cccccacccctac

SEQ ID NO: 6731810 - DNA, 22 bp, Homo sapiens
cccccacccctacagcctgcac

SEQ ID NO: 6731811 - DNA, 18 bp, Homo sapiens
cccccacccctccccacc

SEQ ID NO: 6731812 - DNA, 12 bp, Homo sapiens
cccccacccctg

SEQ ID NO: 6731813 - DNA, 13 bp, Homo sapiens
cccccacccctgg

SEQ ID NO: 6731814 - DNA, 21 bp, Homo sapiens
cccccacccctggctaccttg

SEQ ID NO: 6731815 - DNA, 20 bp, Homo sapiens
cccccaccctagcctccacc

SEQ ID NO: 6731816 - DNA, 13 bp, Homo sapiens
cccccaccctgtg

SEQ ID NO: 6731817 - DNA, 15 bp, Homo sapiens
cccccaccctgtgcc

SEQ ID NO: 6731818 - DNA, 11 bp, Homo sapiens
cccccaccctt

SEQ ID NO: 6731819 - DNA, 12 bp, Homo sapiens
cccccacccttg

SEQ ID NO: 6731820 - DNA, 13 bp, Homo sapiens
cccccacccttgg

SEQ ID NO: 6731821 - DNA, 17 bp, Homo sapiens
cccccaccgccggggtc

SEQ ID NO: 6731822 - DNA, 16 bp, Homo sapiens
cccccaccggtccagc

SEQ ID NO: 6731823 - DNA, 13 bp, Homo sapiens
cccccacctgaca

SEQ ID NO: 6731824 - DNA, 22 bp, Homo sapiens
cccccacctgacaatggcagct

SEQ ID NO: 6731825 - DNA, 14 bp, Homo sapiens
cccccacctgcagc

SEQ ID NO: 6731826 - DNA, 15 bp, Homo sapiens
cccccacctgcctga

SEQ ID NO: 6731827 - DNA, 21 bp, Homo sapiens
cccccaccttggtccctctca

SEQ ID NO: 6731828 - DNA, 12 bp, Homo sapiens
cccccacggccg

SEQ ID NO: 6731829 - DNA, 21 bp, Homo sapiens
cccccacgtggactctgtgct

SEQ ID NO: 6731830 - DNA, 18 bp, Homo sapiens
cccccactcagtgcctcc

SEQ ID NO: 6731831 - DNA, 14 bp, Homo sapiens
cccccactccagct

SEQ ID NO: 6731832 - DNA, 14 bp, Homo sapiens
cccccactccctca

SEQ ID NO: 6731833 - DNA, 22 bp, Homo sapiens
cccccactctctcacccaccag

SEQ ID NO: 6731834 - DNA, 19 bp, Homo sapiens
cccccactgaatccctgta

SEQ ID NO: 6731835 - DNA, 13 bp, Homo sapiens
cccccactgccac

SEQ ID NO: 6731836 - DNA, 13 bp, Homo sapiens
cccccactggtga

SEQ ID NO: 6731837 - DNA, 22 bp, Homo sapiens
cccccacttgcctcttccttga

SEQ ID NO: 6731838 - DNA, 22 bp, Homo sapiens
cccccactttcgcctcctccag

SEQ ID NO: 6731839 - DNA, 16 bp, Homo sapiens
cccccagaaagcctcc

SEQ ID NO: 6731840 - DNA, 19 bp, Homo sapiens
cccccagaaagcctcctgc

SEQ ID NO: 6731841 - DNA, 20 bp, Homo sapiens
cccccagaacctcaagtcta

SEQ ID NO: 6731842 - DNA, 15 bp, Homo sapiens
cccccagaacctgtc

SEQ ID NO: 6731843 - DNA, 12 bp, Homo sapiens
cccccagacaga

SEQ ID NO: 6731844 - DNA, 17 bp, Homo sapiens
cccccagacagctgctc

SEQ ID NO: 6731845 - DNA, 23 bp, Homo sapiens
cccccagagcacccccaagcctg

SEQ ID NO: 6731846 - DNA, 16 bp, Homo sapiens
cccccagagcatctgc

SEQ ID NO: 6731847 - DNA, 20 bp, Homo sapiens
cccccagagcatctgcccca

SEQ ID NO: 6731848 - DNA, 12 bp, Homo sapiens
cccccagagcca

SEQ ID NO: 6731849 - DNA, 15 bp, Homo sapiens
cccccagagccacag

SEQ ID NO: 6731850 - DNA, 16 bp, Homo sapiens
cccccagaggtggccc

SEQ ID NO: 6731851 - DNA, 17 bp, Homo sapiens
cccccagaggtggccct

SEQ ID NO: 6731852 - DNA, 22 bp, Homo sapiens
cccccagagtgctgtcgggacc

SEQ ID NO: 6731853 - DNA, 20 bp, Homo sapiens
cccccagcaaagcccccaga

SEQ ID NO: 6731854 - DNA, 13 bp, Homo sapiens
cccccagcaccct

SEQ ID NO: 6731855 - DNA, 11 bp, Homo sapiens
cccccagcact

SEQ ID NO: 6731856 - DNA, 12 bp, Homo sapiens
cccccagcactt

SEQ ID NO: 6731857 - DNA, 20 bp, Homo sapiens
cccccagcagaaccagcctc

SEQ ID NO: 6731858 - DNA, 22 bp, Homo sapiens
cccccagcagaggcaggctggg

SEQ ID NO: 6731859 - DNA, 12 bp, Homo sapiens
cccccagccagg

SEQ ID NO: 6731860 - DNA, 13 bp, Homo sapiens
cccccagccagga

SEQ ID NO: 6731861 - DNA, 15 bp, Homo sapiens
cccccagccaggcta

SEQ ID NO: 6731862 - DNA, 12 bp, Homo sapiens
cccccagcccaa

SEQ ID NO: 6731863 - DNA, 15 bp, Homo sapiens
cccccagcccaataa

SEQ ID NO: 6731864 - DNA, 21 bp, Homo sapiens
cccccagcccagggctcctgc

SEQ ID NO: 6731865 - DNA, 23 bp, Homo sapiens
cccccagccccgactccagccag

SEQ ID NO: 6731866 - DNA, 17 bp, Homo sapiens
cccccagcccctccatg

SEQ ID NO: 6731867 - DNA, 21 bp, Homo sapiens
cccccagcccctcctccctca

SEQ ID NO: 6731868 - DNA, 14 bp, Homo sapiens
cccccagccctcag

SEQ ID NO: 6731869 - DNA, 13 bp, Homo sapiens
cccccagccctgt

SEQ ID NO: 6731870 - DNA, 13 bp, Homo sapiens
cccccagcctatg

SEQ ID NO: 6731871 - DNA, 20 bp, Homo sapiens
cccccagcctatgagcatcc

SEQ ID NO: 6731872 - DNA, 23 bp, Homo sapiens
cccccagcctatgagcatcctga

SEQ ID NO: 6731873 - DNA, 12 bp, Homo sapiens
cccccagcctcc

SEQ ID NO: 6731874 - DNA, 19 bp, Homo sapiens
cccccagcctccagagaag

SEQ ID NO: 6731875 - DNA, 22 bp, Homo sapiens
cccccagcctcccccaggctgc

SEQ ID NO: 6731876 - DNA, 12 bp, Homo sapiens
cccccagcctct

SEQ ID NO: 6731877 - DNA, 11 bp, Homo sapiens
cccccagcctg

SEQ ID NO: 6731878 - DNA, 12 bp, Homo sapiens
cccccagcctgc

SEQ ID NO: 6731879 - DNA, 13 bp, Homo sapiens
cccccagcctggc

SEQ ID NO: 6731880 - DNA, 16 bp, Homo sapiens
cccccagcctgggcct

SEQ ID NO: 6731881 - DNA, 13 bp, Homo sapiens
cccccagcctgtc

SEQ ID NO: 6731882 - DNA, 15 bp, Homo sapiens
cccccagccttgttt

SEQ ID NO: 6731883 - DNA, 18 bp, Homo sapiens
cccccagccttgtttctg

SEQ ID NO: 6731884 - DNA, 14 bp, Homo sapiens
cccccagctcccac

SEQ ID NO: 6731885 - DNA, 12 bp, Homo sapiens
cccccagctctg

SEQ ID NO: 6731886 - DNA, 23 bp, Homo sapiens
cccccagctgactgttggctctc

SEQ ID NO: 6731887 - DNA, 11 bp, Homo sapiens
cccccagctgt

SEQ ID NO: 6731888 - DNA, 14 bp, Homo sapiens
cccccagctgtggg

SEQ ID NO: 6731889 - DNA, 23 bp, Homo sapiens
cccccagcttctctctccctgtc

SEQ ID NO: 6731890 - DNA, 18 bp, Homo sapiens
cccccagctttgcccaac

SEQ ID NO: 6731891 - DNA, 21 bp, Homo sapiens
cccccaggacaggctgcggcc

SEQ ID NO: 6731892 - DNA, 15 bp, Homo sapiens
cccccaggactgggc

SEQ ID NO: 6731893 - DNA, 16 bp, Homo sapiens
cccccaggagcagctg

SEQ ID NO: 6731894 - DNA, 17 bp, Homo sapiens
cccccaggagcagctgg

SEQ ID NO: 6731895 - DNA, 16 bp, Homo sapiens
cccccaggaggagaga

SEQ ID NO: 6731896 - DNA, 18 bp, Homo sapiens
cccccaggattcccagag

SEQ ID NO: 6731897 - DNA, 20 bp, Homo sapiens
cccccaggattcccagagag

SEQ ID NO: 6731898 - DNA, 11 bp, Homo sapiens
cccccaggcag

SEQ ID NO: 6731899 - DNA, 13 bp, Homo sapiens
cccccaggcagcc

SEQ ID NO: 6731900 - DNA, 12 bp, Homo sapiens
cccccaggccag

SEQ ID NO: 6731901 - DNA, 13 bp, Homo sapiens
cccccaggccctc

SEQ ID NO: 6731902 - DNA, 11 bp, Homo sapiens
cccccaggcct

SEQ ID NO: 6731903 - DNA, 19 bp, Homo sapiens
cccccaggcctccagaacc

SEQ ID NO: 6731904 - DNA, 16 bp, Homo sapiens
cccccaggcctgagct

SEQ ID NO: 6731905 - DNA, 18 bp, Homo sapiens
cccccaggcctgagctgc

SEQ ID NO: 6731906 - DNA, 19 bp, Homo sapiens
cccccaggcctgagctgct

SEQ ID NO: 6731907 - DNA, 14 bp, Homo sapiens
cccccaggcctgcc

SEQ ID NO: 6731908 - DNA, 17 bp, Homo sapiens
cccccaggctgcccaga

SEQ ID NO: 6731909 - DNA, 20 bp, Homo sapiens
cccccaggctgcccagagct

SEQ ID NO: 6731910 - DNA, 20 bp, Homo sapiens
cccccaggctggagtgcagt

SEQ ID NO: 6731911 - DNA, 15 bp, Homo sapiens
cccccagggcctcca

SEQ ID NO: 6731912 - DNA, 16 bp, Homo sapiens
cccccagggcctccag

SEQ ID NO: 6731913 - DNA, 19 bp, Homo sapiens
cccccagggcctccagggc

SEQ ID NO: 6731914 - DNA, 20 bp, Homo sapiens
cccccaggggaaagatgagc

SEQ ID NO: 6731915 - DNA, 19 bp, Homo sapiens
cccccaggggtgagccccg

SEQ ID NO: 6731916 - DNA, 20 bp, Homo sapiens
cccccaggtcttcctgcttt

SEQ ID NO: 6731917 - DNA, 22 bp, Homo sapiens
cccccaggtgctggaggcagac

SEQ ID NO: 6731918 - DNA, 19 bp, Homo sapiens
cccccaggtggcctgcgtc

SEQ ID NO: 6731919 - DNA, 18 bp, Homo sapiens
cccccaggtgttgccatt

SEQ ID NO: 6731920 - DNA, 22 bp, Homo sapiens
cccccagtgcctcaccttccaa

SEQ ID NO: 6731921 - DNA, 17 bp, Homo sapiens
cccccagtgggaccaca

SEQ ID NO: 6731922 - DNA, 17 bp, Homo sapiens
cccccatcaccagagtc

SEQ ID NO: 6731923 - DNA, 14 bp, Homo sapiens
cccccatcagccct

SEQ ID NO: 6731924 - DNA, 15 bp, Homo sapiens
cccccatcagccctg

SEQ ID NO: 6731925 - DNA, 15 bp, Homo sapiens
cccccatcatgtggc

SEQ ID NO: 6731926 - DNA, 14 bp, Homo sapiens
cccccatccagcct

SEQ ID NO: 6731927 - DNA, 16 bp, Homo sapiens
cccccatcccagggtc

SEQ ID NO: 6731928 - DNA, 13 bp, Homo sapiens
cccccatcctggc

SEQ ID NO: 6731929 - DNA, 14 bp, Homo sapiens
cccccatccttcag

SEQ ID NO: 6731930 - DNA, 11 bp, Homo sapiens
cccccatctcc

SEQ ID NO: 6731931 - DNA, 12 bp, Homo sapiens
cccccatctcca

SEQ ID NO: 6731932 - DNA, 17 bp, Homo sapiens
cccccatctccccaggc

SEQ ID NO: 6731933 - DNA, 19 bp, Homo sapiens
cccccatctgtcttcagca

SEQ ID NO: 6731934 - DNA, 17 bp, Homo sapiens
cccccatcttccacctg

SEQ ID NO: 6731935 - DNA, 18 bp, Homo sapiens
cccccatgcactgtgaag

SEQ ID NO: 6731936 - DNA, 24 bp, Homo sapiens
cccccatgcatacgtacattcctg

SEQ ID NO: 6731937 - DNA, 20 bp, Homo sapiens
cccccatgccaccacccacc

SEQ ID NO: 6731938 - DNA, 15 bp, Homo sapiens
cccccatgcccctcc

SEQ ID NO: 6731939 - DNA, 18 bp, Homo sapiens
cccccatgccctccctgc

SEQ ID NO: 6731940 - DNA, 11 bp, Homo sapiens
cccccatgctg

SEQ ID NO: 6731941 - DNA, 15 bp, Homo sapiens
cccccatgctgcctt

SEQ ID NO: 6731942 - DNA, 14 bp, Homo sapiens
cccccatgggctcc

SEQ ID NO: 6731943 - DNA, 15 bp, Homo sapiens
cccccatgggctcct

SEQ ID NO: 6731944 - DNA, 21 bp, Homo sapiens
cccccatgggctcctgcccct

SEQ ID NO: 6731945 - DNA, 19 bp, Homo sapiens
cccccatggggtccttgga

SEQ ID NO: 6731946 - DNA, 23 bp, Homo sapiens
cccccatggggtccttggagtga

SEQ ID NO: 6731947 - DNA, 14 bp, Homo sapiens
cccccatgtggctg

SEQ ID NO: 6731948 - DNA, 13 bp, Homo sapiens
cccccattctccc

SEQ ID NO: 6731949 - DNA, 14 bp, Homo sapiens
cccccattctccca

SEQ ID NO: 6731950 - DNA, 20 bp, Homo sapiens
cccccattctcccagtctct

SEQ ID NO: 6731951 - DNA, 22 bp, Homo sapiens
cccccattctcccagtctctgt

SEQ ID NO: 6731952 - DNA, 15 bp, Homo sapiens
cccccatttcccgca

SEQ ID NO: 6731953 - DNA, 21 bp, Homo sapiens
ccccccaagatgagctgcagc

SEQ ID NO: 6731954 - DNA, 21 bp, Homo sapiens
ccccccaagggaggctgctgc

SEQ ID NO: 6731955 - DNA, 12 bp, Homo sapiens
ccccccactctc

SEQ ID NO: 6731956 - DNA, 12 bp, Homo sapiens
ccccccactgca

SEQ ID NO: 6731957 - DNA, 22 bp, Homo sapiens
ccccccagactctttttttgag

SEQ ID NO: 6731958 - DNA, 13 bp, Homo sapiens
ccccccagagcca

SEQ ID NO: 6731959 - DNA, 11 bp, Homo sapiens
ccccccagcac

SEQ ID NO: 6731960 - DNA, 13 bp, Homo sapiens
ccccccagcactg

SEQ ID NO: 6731961 - DNA, 13 bp, Homo sapiens
ccccccagcccct

SEQ ID NO: 6731962 - DNA, 14 bp, Homo sapiens
ccccccatgcactg

SEQ ID NO: 6731963 - DNA, 11 bp, Homo sapiens
cccccccagcc

SEQ ID NO: 6731964 - DNA, 12 bp, Homo sapiens
ccccccccaggc

SEQ ID NO: 6731965 - DNA, 13 bp, Homo sapiens
cccccctccccaa

SEQ ID NO: 6731966 - DNA, 12 bp, Homo sapiens
cccccctcctcc

SEQ ID NO: 6731967 - DNA, 12 bp, Homo sapiens
cccccctcctgc

SEQ ID NO: 6731968 - DNA, 21 bp, Homo sapiens
cccccctctcctcccagctgc

SEQ ID NO: 6731969 - DNA, 12 bp, Homo sapiens
cccccctctgcc

SEQ ID NO: 6731970 - DNA, 12 bp, Homo sapiens
cccccctctgtc

SEQ ID NO: 6731971 - DNA, 11 bp, Homo sapiens
cccccctgaga

SEQ ID NO: 6731972 - DNA, 12 bp, Homo sapiens
cccccctgagtg

SEQ ID NO: 6731973 - DNA, 12 bp, Homo sapiens
cccccctgtcac

SEQ ID NO: 6731974 - DNA, 12 bp, Homo sapiens
ccccccttccac

SEQ ID NO: 6731975 - DNA, 13 bp, Homo sapiens
ccccccttccact

SEQ ID NO: 6731976 - DNA, 22 bp, Homo sapiens
ccccccttgaagcaataactcc

SEQ ID NO: 6731977 - DNA, 20 bp, Homo sapiens
ccccccttgaatctgcaggg

SEQ ID NO: 6731978 - DNA, 14 bp, Homo sapiens
cccccgacggcctc

SEQ ID NO: 6731979 - DNA, 16 bp, Homo sapiens
cccccgacggcctcca

SEQ ID NO: 6731980 - DNA, 16 bp, Homo sapiens
cccccgactgcctgtc

SEQ ID NO: 6731981 - DNA, 14 bp, Homo sapiens
cccccgagccctga

SEQ ID NO: 6731982 - DNA, 16 bp, Homo sapiens
cccccgagccctgact

SEQ ID NO: 6731983 - DNA, 13 bp, Homo sapiens
cccccgagctggg

SEQ ID NO: 6731984 - DNA, 21 bp, Homo sapiens
cccccgagctgggggccatga

SEQ ID NO: 6731985 - DNA, 21 bp, Homo sapiens
cccccgagcttgcctcagggc

SEQ ID NO: 6731986 - DNA, 13 bp, Homo sapiens
cccccgaggcccc

SEQ ID NO: 6731987 - DNA, 13 bp, Homo sapiens
cccccgcagcacc

SEQ ID NO: 6731988 - DNA, 22 bp, Homo sapiens
cccccgcagtccccagcccttc

SEQ ID NO: 6731989 - DNA, 23 bp, Homo sapiens
cccccgcagtccccagcccttct

SEQ ID NO: 6731990 - DNA, 12 bp, Homo sapiens
cccccgccactc

SEQ ID NO: 6731991 - DNA, 14 bp, Homo sapiens
cccccgccatcctt

SEQ ID NO: 6731992 - DNA, 17 bp, Homo sapiens
cccccgccatccttcac

SEQ ID NO: 6731993 - DNA, 12 bp, Homo sapiens
cccccgcccacc

SEQ ID NO: 6731994 - DNA, 13 bp, Homo sapiens
cccccgcccaggc

SEQ ID NO: 6731995 - DNA, 15 bp, Homo sapiens
cccccgccccatcct

SEQ ID NO: 6731996 - DNA, 14 bp, Homo sapiens
cccccgccccctgc

SEQ ID NO: 6731997 - DNA, 16 bp, Homo sapiens
cccccgccccctgccc

SEQ ID NO: 6731998 - DNA, 18 bp, Homo sapiens
cccccgcccctcgcccgc

SEQ ID NO: 6731999 - DNA, 13 bp, Homo sapiens
cccccgccgcgcc

SEQ ID NO: 6732000 - DNA, 12 bp, Homo sapiens
cccccgccggca

SEQ ID NO: 6732001 - DNA, 22 bp, Homo sapiens
cccccgcgccctccctccgcct

SEQ ID NO: 6732002 - DNA, 19 bp, Homo sapiens
cccccgcgctcgcccagca

SEQ ID NO: 6732003 - DNA, 20 bp, Homo sapiens
cccccgcgctcgcccagcag

SEQ ID NO: 6732004 - DNA, 20 bp, Homo sapiens
cccccggaggcgcccacctg

SEQ ID NO: 6732005 - DNA, 23 bp, Homo sapiens
cccccggaggcgcccacctgccc

SEQ ID NO: 6732006 - DNA, 14 bp, Homo sapiens
cccccggcagcagc

SEQ ID NO: 6732007 - DNA, 17 bp, Homo sapiens
cccccggcccagtgccc

SEQ ID NO: 6732008 - DNA, 20 bp, Homo sapiens
cccccggcccagtgccccct

SEQ ID NO: 6732009 - DNA, 21 bp, Homo sapiens
cccccggctgggcctccttct

SEQ ID NO: 6732010 - DNA, 20 bp, Homo sapiens
cccccgggatcctgccccca

SEQ ID NO: 6732011 - DNA, 15 bp, Homo sapiens
cccccggggctgggt

SEQ ID NO: 6732012 - DNA, 22 bp, Homo sapiens
cccccgtctaaccacagctcct

SEQ ID NO: 6732013 - DNA, 15 bp, Homo sapiens
cccccgtctcctgcc

SEQ ID NO: 6732014 - DNA, 17 bp, Homo sapiens
cccccgtggtgcctgca

SEQ ID NO: 6732015 - DNA, 15 bp, Homo sapiens
cccccgttccagctg

SEQ ID NO: 6732016 - DNA, 22 bp, Homo sapiens
ccccctaacctctaaccctcat

SEQ ID NO: 6732017 - DNA, 16 bp, Homo sapiens
ccccctaactttcttg

SEQ ID NO: 6732018 - DNA, 19 bp, Homo sapiens
ccccctaactttcttgctt

SEQ ID NO: 6732019 - DNA, 23 bp, Homo sapiens
ccccctaagcttctagaggctca

SEQ ID NO: 6732020 - DNA, 24 bp, Homo sapiens
ccccctacagatcctccgcggagg

SEQ ID NO: 6732021 - DNA, 19 bp, Homo sapiens
ccccctagaataatctcat

SEQ ID NO: 6732022 - DNA, 21 bp, Homo sapiens
ccccctatctcttcctgtcta

SEQ ID NO: 6732023 - DNA, 22 bp, Homo sapiens
ccccctcaaaccctgccctcct

SEQ ID NO: 6732024 - DNA, 21 bp, Homo sapiens
ccccctcaaggggcagggagg

SEQ ID NO: 6732025 - DNA, 12 bp, Homo sapiens
ccccctcacctc

SEQ ID NO: 6732026 - DNA, 20 bp, Homo sapiens
ccccctcactccacactggc

SEQ ID NO: 6732027 - DNA, 13 bp, Homo sapiens
ccccctcagctct

SEQ ID NO: 6732028 - DNA, 18 bp, Homo sapiens
ccccctcaggaccctcgc

SEQ ID NO: 6732029 - DNA, 22 bp, Homo sapiens
ccccctcaggaccctcgctggc

SEQ ID NO: 6732030 - DNA, 15 bp, Homo sapiens
ccccctccaatcctg

SEQ ID NO: 6732031 - DNA, 13 bp, Homo sapiens
ccccctccagctc

SEQ ID NO: 6732032 - DNA, 22 bp, Homo sapiens
ccccctccaggagagagccagg

SEQ ID NO: 6732033 - DNA, 16 bp, Homo sapiens
ccccctccaggcatgc

SEQ ID NO: 6732034 - DNA, 12 bp, Homo sapiens
ccccctccattc

SEQ ID NO: 6732035 - DNA, 16 bp, Homo sapiens
ccccctcccaccccca

SEQ ID NO: 6732036 - DNA, 12 bp, Homo sapiens
ccccctcccaga

SEQ ID NO: 6732037 - DNA, 13 bp, Homo sapiens
ccccctccccagg

SEQ ID NO: 6732038 - DNA, 13 bp, Homo sapiens
ccccctcccccac

SEQ ID NO: 6732039 - DNA, 18 bp, Homo sapiens
ccccctcccccagccact

SEQ ID NO: 6732040 - DNA, 19 bp, Homo sapiens
ccccctcccccagccactc

SEQ ID NO: 6732041 - DNA, 15 bp, Homo sapiens
ccccctccccccaga

SEQ ID NO: 6732042 - DNA, 12 bp, Homo sapiens
ccccctccccgg

SEQ ID NO: 6732043 - DNA, 17 bp, Homo sapiens
ccccctccccgggcagc

SEQ ID NO: 6732044 - DNA, 16 bp, Homo sapiens
ccccctcctagggggt

SEQ ID NO: 6732045 - DNA, 13 bp, Homo sapiens
ccccctcctcaga

SEQ ID NO: 6732046 - DNA, 14 bp, Homo sapiens
ccccctcctcagcc

SEQ ID NO: 6732047 - DNA, 12 bp, Homo sapiens
ccccctcctcca

SEQ ID NO: 6732048 - DNA, 13 bp, Homo sapiens
ccccctcctccag

SEQ ID NO: 6732049 - DNA, 12 bp, Homo sapiens
ccccctcctctc

SEQ ID NO: 6732050 - DNA, 12 bp, Homo sapiens
ccccctcctgac

SEQ ID NO: 6732051 - DNA, 23 bp, Homo sapiens
ccccctcctgctcctccctgccc

SEQ ID NO: 6732052 - DNA, 14 bp, Homo sapiens
ccccctcctggcaa

SEQ ID NO: 6732053 - DNA, 17 bp, Homo sapiens
ccccctcgcgcccctgt

SEQ ID NO: 6732054 - DNA, 14 bp, Homo sapiens
ccccctcggagcct

SEQ ID NO: 6732055 - DNA, 19 bp, Homo sapiens
ccccctcggagcctgtgtt

SEQ ID NO: 6732056 - DNA, 18 bp, Homo sapiens
ccccctctccctgcatgg

SEQ ID NO: 6732057 - DNA, 17 bp, Homo sapiens
ccccctctcctcccagc

SEQ ID NO: 6732058 - DNA, 21 bp, Homo sapiens
ccccctctcttaccccgtccc

SEQ ID NO: 6732059 - DNA, 14 bp, Homo sapiens
ccccctctgccctg

SEQ ID NO: 6732060 - DNA, 16 bp, Homo sapiens
ccccctctgccctgcg

SEQ ID NO: 6732061 - DNA, 13 bp, Homo sapiens
ccccctctgccgc

SEQ ID NO: 6732062 - DNA, 15 bp, Homo sapiens
ccccctctgcctttg

SEQ ID NO: 6732063 - DNA, 12 bp, Homo sapiens
ccccctctgtct

SEQ ID NO: 6732064 - DNA, 16 bp, Homo sapiens
ccccctctgtcttgtg

SEQ ID NO: 6732065 - DNA, 14 bp, Homo sapiens
ccccctcttcaaag

SEQ ID NO: 6732066 - DNA, 14 bp, Homo sapiens
ccccctcttccctg

SEQ ID NO: 6732067 - DNA, 19 bp, Homo sapiens
ccccctcttcctccctggg

SEQ ID NO: 6732068 - DNA, 19 bp, Homo sapiens
ccccctcttcttctgaaga

SEQ ID NO: 6732069 - DNA, 17 bp, Homo sapiens
ccccctgacaacactca

SEQ ID NO: 6732070 - DNA, 19 bp, Homo sapiens
ccccctgacaacactcatt

SEQ ID NO: 6732071 - DNA, 17 bp, Homo sapiens
ccccctgaccactcaga

SEQ ID NO: 6732072 - DNA, 20 bp, Homo sapiens
ccccctgagttcccaaaggg

SEQ ID NO: 6732073 - DNA, 18 bp, Homo sapiens
ccccctgcaaagcccagc

SEQ ID NO: 6732074 - DNA, 20 bp, Homo sapiens
ccccctgcaacttccgctga

SEQ ID NO: 6732075 - DNA, 11 bp, Homo sapiens
ccccctgcacc

SEQ ID NO: 6732076 - DNA, 12 bp, Homo sapiens
ccccctgcaccc

SEQ ID NO: 6732077 - DNA, 14 bp, Homo sapiens
ccccctgcagccca

SEQ ID NO: 6732078 - DNA, 12 bp, Homo sapiens
ccccctgcagct

SEQ ID NO: 6732079 - DNA, 13 bp, Homo sapiens
ccccctgcagcta

SEQ ID NO: 6732080 - DNA, 12 bp, Homo sapiens
ccccctgcagga

SEQ ID NO: 6732081 - DNA, 12 bp, Homo sapiens
ccccctgcatct

SEQ ID NO: 6732082 - DNA, 15 bp, Homo sapiens
ccccctgccccagag

SEQ ID NO: 6732083 - DNA, 13 bp, Homo sapiens
ccccctgccctcc

SEQ ID NO: 6732084 - DNA, 20 bp, Homo sapiens
ccccctgccctcgtggccag

SEQ ID NO: 6732085 - DNA, 13 bp, Homo sapiens
ccccctgccctgc

SEQ ID NO: 6732086 - DNA, 12 bp, Homo sapiens
ccccctgcctgg

SEQ ID NO: 6732087 - DNA, 12 bp, Homo sapiens
ccccctgctgcc

SEQ ID NO: 6732088 - DNA, 17 bp, Homo sapiens
ccccctgctgctcatcc

SEQ ID NO: 6732089 - DNA, 15 bp, Homo sapiens
ccccctgctggctct

SEQ ID NO: 6732090 - DNA, 18 bp, Homo sapiens
ccccctggcagctgcccc

SEQ ID NO: 6732091 - DNA, 18 bp, Homo sapiens
ccccctggcccctcccac

SEQ ID NO: 6732092 - DNA, 15 bp, Homo sapiens
ccccctggccctgcc

SEQ ID NO: 6732093 - DNA, 15 bp, Homo sapiens
ccccctggcctctgt

SEQ ID NO: 6732094 - DNA, 12 bp, Homo sapiens
ccccctggcggc

SEQ ID NO: 6732095 - DNA, 19 bp, Homo sapiens
ccccctggctgactggcca

SEQ ID NO: 6732096 - DNA, 11 bp, Homo sapiens
ccccctgggct

SEQ ID NO: 6732097 - DNA, 13 bp, Homo sapiens
ccccctgggctct

SEQ ID NO: 6732098 - DNA, 20 bp, Homo sapiens
ccccctggtggacagtcctg

SEQ ID NO: 6732099 - DNA, 18 bp, Homo sapiens
ccccctgtacacaactca

SEQ ID NO: 6732100 - DNA, 20 bp, Homo sapiens
ccccctgtagcagcattaca

SEQ ID NO: 6732101 - DNA, 17 bp, Homo sapiens
ccccctgtcccattcta

SEQ ID NO: 6732102 - DNA, 19 bp, Homo sapiens
ccccctgtcccattctaga

SEQ ID NO: 6732103 - DNA, 12 bp, Homo sapiens
ccccctgtcccc

SEQ ID NO: 6732104 - DNA, 17 bp, Homo sapiens
ccccctgtccccaagac

SEQ ID NO: 6732105 - DNA, 18 bp, Homo sapiens
ccccctgtcccctcagct

SEQ ID NO: 6732106 - DNA, 19 bp, Homo sapiens
ccccctgtcccctcagctc

SEQ ID NO: 6732107 - DNA, 10 bp, Homo sapiens
ccccctgtgc

SEQ ID NO: 6732108 - DNA, 12 bp, Homo sapiens
ccccctgtgcat

SEQ ID NO: 6732109 - DNA, 19 bp, Homo sapiens
ccccctgtgccagctcagg

SEQ ID NO: 6732110 - DNA, 16 bp, Homo sapiens
ccccctgtgcctgctg

SEQ ID NO: 6732111 - DNA, 17 bp, Homo sapiens
ccccctgtgcctgctgg

SEQ ID NO: 6732112 - DNA, 11 bp, Homo sapiens
ccccctgtggc

SEQ ID NO: 6732113 - DNA, 21 bp, Homo sapiens
ccccctgtgtggccctggaca

SEQ ID NO: 6732114 - DNA, 15 bp, Homo sapiens
cccccttaaagaaaa

SEQ ID NO: 6732115 - DNA, 16 bp, Homo sapiens
cccccttcaagcctgt

SEQ ID NO: 6732116 - DNA, 14 bp, Homo sapiens
cccccttcagctcc

SEQ ID NO: 6732117 - DNA, 15 bp, Homo sapiens
cccccttcagctcct

SEQ ID NO: 6732118 - DNA, 12 bp, Homo sapiens
cccccttcagga

SEQ ID NO: 6732119 - DNA, 15 bp, Homo sapiens
cccccttcaggagcc

SEQ ID NO: 6732120 - DNA, 22 bp, Homo sapiens
cccccttcaggagcctggccag

SEQ ID NO: 6732121 - DNA, 14 bp, Homo sapiens
cccccttcagtgcc

SEQ ID NO: 6732122 - DNA, 23 bp, Homo sapiens
cccccttcagtgcccaccaacat

SEQ ID NO: 6732123 - DNA, 19 bp, Homo sapiens
cccccttcccctgcgccct

SEQ ID NO: 6732124 - DNA, 14 bp, Homo sapiens
cccccttccctggg

SEQ ID NO: 6732125 - DNA, 15 bp, Homo sapiens
cccccttccctggga

SEQ ID NO: 6732126 - DNA, 18 bp, Homo sapiens
cccccttcctgtccccaa

SEQ ID NO: 6732127 - DNA, 16 bp, Homo sapiens
cccccttctctgctcc

SEQ ID NO: 6732128 - DNA, 17 bp, Homo sapiens
cccccttctctgctcca

SEQ ID NO: 6732129 - DNA, 22 bp, Homo sapiens
cccccttctgggcatctgttct

SEQ ID NO: 6732130 - DNA, 14 bp, Homo sapiens
cccccttcttcctc

SEQ ID NO: 6732131 - DNA, 15 bp, Homo sapiens
cccccttcttcctcc

SEQ ID NO: 6732132 - DNA, 18 bp, Homo sapiens
cccccttgaatctgcagg

SEQ ID NO: 6732133 - DNA, 17 bp, Homo sapiens
cccccttgcccaggcct

SEQ ID NO: 6732134 - DNA, 22 bp, Homo sapiens
cccccttgcccatgcctccagc

SEQ ID NO: 6732135 - DNA, 23 bp, Homo sapiens
cccccttgcccatgcctccagct

SEQ ID NO: 6732136 - DNA, 19 bp, Homo sapiens
cccccttgccctccgcctg

SEQ ID NO: 6732137 - DNA, 22 bp, Homo sapiens
cccccttgccctccgcctggga

SEQ ID NO: 6732138 - DNA, 15 bp, Homo sapiens
ccccctttcacactg

SEQ ID NO: 6732139 - DNA, 18 bp, Homo sapiens
ccccctttcacactggat

SEQ ID NO: 6732140 - DNA, 22 bp, Homo sapiens
ccccctttcacaggcagccagt

SEQ ID NO: 6732141 - DNA, 18 bp, Homo sapiens
ccccctttcagatgtctt

SEQ ID NO: 6732142 - DNA, 19 bp, Homo sapiens
ccccctttctctgcctggc

SEQ ID NO: 6732143 - DNA, 21 bp, Homo sapiens
ccccctttctctgcctggcaa

SEQ ID NO: 6732144 - DNA, 16 bp, Homo sapiens
ccccctttgaccttcc

SEQ ID NO: 6732145 - DNA, 16 bp, Homo sapiens
ccccgaacgctctgca

SEQ ID NO: 6732146 - DNA, 11 bp, Homo sapiens
ccccgaagagt

SEQ ID NO: 6732147 - DNA, 16 bp, Homo sapiens
ccccgacagcccagcc

SEQ ID NO: 6732148 - DNA, 15 bp, Homo sapiens
ccccgacccagctct

SEQ ID NO: 6732149 - DNA, 22 bp, Homo sapiens
ccccgaccccacctgaggcagg

SEQ ID NO: 6732150 - DNA, 19 bp, Homo sapiens
ccccgacggcctccaggag

SEQ ID NO: 6732151 - DNA, 13 bp, Homo sapiens
ccccgacggctgt

SEQ ID NO: 6732152 - DNA, 17 bp, Homo sapiens
ccccgactatccctgca

SEQ ID NO: 6732153 - DNA, 14 bp, Homo sapiens
ccccgactccagcc

SEQ ID NO: 6732154 - DNA, 17 bp, Homo sapiens
ccccgactccagccagc

SEQ ID NO: 6732155 - DNA, 22 bp, Homo sapiens
ccccgactccctccccagatct

SEQ ID NO: 6732156 - DNA, 13 bp, Homo sapiens
ccccgactggggc

SEQ ID NO: 6732157 - DNA, 16 bp, Homo sapiens
ccccgagaaccctgag

SEQ ID NO: 6732158 - DNA, 18 bp, Homo sapiens
ccccgagaagtgctcttg

SEQ ID NO: 6732159 - DNA, 16 bp, Homo sapiens
ccccgagacaccatcc

SEQ ID NO: 6732160 - DNA, 20 bp, Homo sapiens
ccccgaggcccccctctgcc

SEQ ID NO: 6732161 - DNA, 12 bp, Homo sapiens
ccccgaggccct

SEQ ID NO: 6732162 - DNA, 15 bp, Homo sapiens
ccccgaggccctgca

SEQ ID NO: 6732163 - DNA, 17 bp, Homo sapiens
ccccgaggccctgcatg

SEQ ID NO: 6732164 - DNA, 19 bp, Homo sapiens
ccccgagggatgatgccac

SEQ ID NO: 6732165 - DNA, 20 bp, Homo sapiens
ccccgagggatgatgccaca

SEQ ID NO: 6732166 - DNA, 17 bp, Homo sapiens
ccccgagggcgaaggcc

SEQ ID NO: 6732167 - DNA, 24 bp, Homo sapiens
ccccgagggcgaaggccattgggt

SEQ ID NO: 6732168 - DNA, 17 bp, Homo sapiens
ccccgaggtaggggtgg

SEQ ID NO: 6732169 - DNA, 15 bp, Homo sapiens
ccccgagtcctcagg

SEQ ID NO: 6732170 - DNA, 14 bp, Homo sapiens
ccccgagtctccgg

SEQ ID NO: 6732171 - DNA, 16 bp, Homo sapiens
ccccgagtgactctgg

SEQ ID NO: 6732172 - DNA, 14 bp, Homo sapiens
ccccgagtgaggac

SEQ ID NO: 6732173 - DNA, 14 bp, Homo sapiens
ccccgatggactcc

SEQ ID NO: 6732174 - DNA, 15 bp, Homo sapiens
ccccgatggactcct

SEQ ID NO: 6732175 - DNA, 19 bp, Homo sapiens
ccccgatgtgagccgcctc

SEQ ID NO: 6732176 - DNA, 13 bp, Homo sapiens
ccccgcacagcca

SEQ ID NO: 6732177 - DNA, 16 bp, Homo sapiens
ccccgcacagccaccc

SEQ ID NO: 6732178 - DNA, 16 bp, Homo sapiens
ccccgcaccaagcaga

SEQ ID NO: 6732179 - DNA, 15 bp, Homo sapiens
ccccgcacccccgcc

SEQ ID NO: 6732180 - DNA, 14 bp, Homo sapiens
ccccgcacccctcc

SEQ ID NO: 6732181 - DNA, 21 bp, Homo sapiens
ccccgcacgcaagcctcagcc

SEQ ID NO: 6732182 - DNA, 14 bp, Homo sapiens
ccccgcacgggctg

SEQ ID NO: 6732183 - DNA, 16 bp, Homo sapiens
ccccgcagacagacag

SEQ ID NO: 6732184 - DNA, 13 bp, Homo sapiens
ccccgcagacctc

SEQ ID NO: 6732185 - DNA, 13 bp, Homo sapiens
ccccgcagcaccc

SEQ ID NO: 6732186 - DNA, 18 bp, Homo sapiens
ccccgcagcccgcctgcc

SEQ ID NO: 6732187 - DNA, 18 bp, Homo sapiens
ccccgcagccctctccac

SEQ ID NO: 6732188 - DNA, 19 bp, Homo sapiens
ccccgcagccctctccacc

SEQ ID NO: 6732189 - DNA, 13 bp, Homo sapiens
ccccgcagccctg

SEQ ID NO: 6732190 - DNA, 14 bp, Homo sapiens
ccccgcaggcctgc

SEQ ID NO: 6732191 - DNA, 21 bp, Homo sapiens
ccccgcaggcctgccttctca

SEQ ID NO: 6732192 - DNA, 12 bp, Homo sapiens
ccccgcagggtc

SEQ ID NO: 6732193 - DNA, 18 bp, Homo sapiens
ccccgcagtccccagccc

SEQ ID NO: 6732194 - DNA, 21 bp, Homo sapiens
ccccgcagtccccagcccttc

SEQ ID NO: 6732195 - DNA, 20 bp, Homo sapiens
ccccgcagtcgtcagcctcc

SEQ ID NO: 6732196 - DNA, 12 bp, Homo sapiens
ccccgccacagc

SEQ ID NO: 6732197 - DNA, 17 bp, Homo sapiens
ccccgccacctcagggc

SEQ ID NO: 6732198 - DNA, 21 bp, Homo sapiens
ccccgccacggccaccctcct

SEQ ID NO: 6732199 - DNA, 12 bp, Homo sapiens
ccccgccagcct

SEQ ID NO: 6732200 - DNA, 13 bp, Homo sapiens
ccccgccagggct

SEQ ID NO: 6732201 - DNA, 13 bp, Homo sapiens
ccccgccatcctt

SEQ ID NO: 6732202 - DNA, 21 bp, Homo sapiens
ccccgccatgcatgcagcgcc

SEQ ID NO: 6732203 - DNA, 15 bp, Homo sapiens
ccccgccatggtcac

SEQ ID NO: 6732204 - DNA, 14 bp, Homo sapiens
ccccgcccacaccc

SEQ ID NO: 6732205 - DNA, 17 bp, Homo sapiens
ccccgcccagctgcacc

SEQ ID NO: 6732206 - DNA, 23 bp, Homo sapiens
ccccgcccagctgcacctgccag

SEQ ID NO: 6732207 - DNA, 19 bp, Homo sapiens
ccccgcccaggctggccag

SEQ ID NO: 6732208 - DNA, 20 bp, Homo sapiens
ccccgccccacattccgaca

SEQ ID NO: 6732209 - DNA, 12 bp, Homo sapiens
ccccgccccagg

SEQ ID NO: 6732210 - DNA, 13 bp, Homo sapiens
ccccgccccaggc

SEQ ID NO: 6732211 - DNA, 14 bp, Homo sapiens
ccccgccccaggct

SEQ ID NO: 6732212 - DNA, 18 bp, Homo sapiens
ccccgccccaggcttccg

SEQ ID NO: 6732213 - DNA, 22 bp, Homo sapiens
ccccgccccaggcttccgcgcc

SEQ ID NO: 6732214 - DNA, 15 bp, Homo sapiens
ccccgccccatgggc

SEQ ID NO: 6732215 - DNA, 16 bp, Homo sapiens
ccccgcccccagtccc

SEQ ID NO: 6732216 - DNA, 19 bp, Homo sapiens
ccccgccccccagagccag

SEQ ID NO: 6732217 - DNA, 13 bp, Homo sapiens
ccccgccccctga

SEQ ID NO: 6732218 - DNA, 17 bp, Homo sapiens
ccccgccccctgccctc

SEQ ID NO: 6732219 - DNA, 16 bp, Homo sapiens
ccccgccccgccccac

SEQ ID NO: 6732220 - DNA, 17 bp, Homo sapiens
ccccgccccgctgctcc

SEQ ID NO: 6732221 - DNA, 12 bp, Homo sapiens
ccccgcccctgc

SEQ ID NO: 6732222 - DNA, 14 bp, Homo sapiens
ccccgccctctgcg

SEQ ID NO: 6732223 - DNA, 14 bp, Homo sapiens
ccccgccggaggaa

SEQ ID NO: 6732224 - DNA, 22 bp, Homo sapiens
ccccgccgtgtctgtggccctc

SEQ ID NO: 6732225 - DNA, 13 bp, Homo sapiens
ccccgcctccact

SEQ ID NO: 6732226 - DNA, 12 bp, Homo sapiens
ccccgcctcccc

SEQ ID NO: 6732227 - DNA, 12 bp, Homo sapiens
ccccgcctcctc

SEQ ID NO: 6732228 - DNA, 15 bp, Homo sapiens
ccccgcctcctccct

SEQ ID NO: 6732229 - DNA, 20 bp, Homo sapiens
ccccgcctcctccctgcctg

SEQ ID NO: 6732230 - DNA, 21 bp, Homo sapiens
ccccgcctcctccctgcctgg

SEQ ID NO: 6732231 - DNA, 13 bp, Homo sapiens
ccccgcctgagtc

SEQ ID NO: 6732232 - DNA, 16 bp, Homo sapiens
ccccgcctgagtcagt

SEQ ID NO: 6732233 - DNA, 13 bp, Homo sapiens
ccccgcctgccac

SEQ ID NO: 6732234 - DNA, 13 bp, Homo sapiens
ccccgcctggcca

SEQ ID NO: 6732235 - DNA, 17 bp, Homo sapiens
ccccgcctgtcctgcct

SEQ ID NO: 6732236 - DNA, 14 bp, Homo sapiens
ccccgcctgttccc

SEQ ID NO: 6732237 - DNA, 13 bp, Homo sapiens
ccccgccttccct

SEQ ID NO: 6732238 - DNA, 15 bp, Homo sapiens
ccccgccttcgtgtg

SEQ ID NO: 6732239 - DNA, 22 bp, Homo sapiens
ccccgcctttagttctccactg

SEQ ID NO: 6732240 - DNA, 16 bp, Homo sapiens
ccccgcgatgccctgg

SEQ ID NO: 6732241 - DNA, 13 bp, Homo sapiens
ccccgcgccccag

SEQ ID NO: 6732242 - DNA, 13 bp, Homo sapiens
ccccgcgccctcc

SEQ ID NO: 6732243 - DNA, 14 bp, Homo sapiens
ccccgcgcgcccac

SEQ ID NO: 6732244 - DNA, 22 bp, Homo sapiens
ccccgcgcgtgcccccagcgtg

SEQ ID NO: 6732245 - DNA, 13 bp, Homo sapiens
ccccgcggagccc

SEQ ID NO: 6732246 - DNA, 17 bp, Homo sapiens
ccccgcggagcccccgc

SEQ ID NO: 6732247 - DNA, 18 bp, Homo sapiens
ccccgcggagcccccgcc

SEQ ID NO: 6732248 - DNA, 23 bp, Homo sapiens
ccccgcggagcccccgcccctcc

SEQ ID NO: 6732249 - DNA, 15 bp, Homo sapiens
ccccgcgtcttcagc

SEQ ID NO: 6732250 - DNA, 21 bp, Homo sapiens
ccccgctagcggggccaggag

SEQ ID NO: 6732251 - DNA, 12 bp, Homo sapiens
ccccgctcacgc

SEQ ID NO: 6732252 - DNA, 19 bp, Homo sapiens
ccccgctcaggggcctgga

SEQ ID NO: 6732253 - DNA, 20 bp, Homo sapiens
ccccgctcaggggcctggag

SEQ ID NO: 6732254 - DNA, 15 bp, Homo sapiens
ccccgctccagatct

SEQ ID NO: 6732255 - DNA, 12 bp, Homo sapiens
ccccgctctccc

SEQ ID NO: 6732256 - DNA, 23 bp, Homo sapiens
ccccgctctgcatgcggcccagc

SEQ ID NO: 6732257 - DNA, 18 bp, Homo sapiens
ccccgctcttcccaagtc

SEQ ID NO: 6732258 - DNA, 20 bp, Homo sapiens
ccccgctgcctggcgggcag

SEQ ID NO: 6732259 - DNA, 13 bp, Homo sapiens
ccccgctggagga

SEQ ID NO: 6732260 - DNA, 22 bp, Homo sapiens
ccccgctggaggatgtgggcag

SEQ ID NO: 6732261 - DNA, 19 bp, Homo sapiens
ccccgctggctcctccagg

SEQ ID NO: 6732262 - DNA, 20 bp, Homo sapiens
ccccgctgtaagctcctttg

SEQ ID NO: 6732263 - DNA, 17 bp, Homo sapiens
ccccgcttccccacaga

SEQ ID NO: 6732264 - DNA, 18 bp, Homo sapiens
ccccgcttccccacagaa

SEQ ID NO: 6732265 - DNA, 19 bp, Homo sapiens
ccccgcttccccacagaac

SEQ ID NO: 6732266 - DNA, 17 bp, Homo sapiens
ccccggacaagcccagg

SEQ ID NO: 6732267 - DNA, 22 bp, Homo sapiens
ccccggaggcgcccacctgccc

SEQ ID NO: 6732268 - DNA, 21 bp, Homo sapiens
ccccggaggcgtggaggagag

SEQ ID NO: 6732269 - DNA, 22 bp, Homo sapiens
ccccggcaagccacaggaagga

SEQ ID NO: 6732270 - DNA, 22 bp, Homo sapiens
ccccggcacctcccttgggcac

SEQ ID NO: 6732271 - DNA, 13 bp, Homo sapiens
ccccggcagcagc

SEQ ID NO: 6732272 - DNA, 13 bp, Homo sapiens
ccccggcaggccc

SEQ ID NO: 6732273 - DNA, 13 bp, Homo sapiens
ccccggccaagga

SEQ ID NO: 6732274 - DNA, 12 bp, Homo sapiens
ccccggccacct

SEQ ID NO: 6732275 - DNA, 13 bp, Homo sapiens
ccccggccacctc

SEQ ID NO: 6732276 - DNA, 14 bp, Homo sapiens
ccccggccacctct

SEQ ID NO: 6732277 - DNA, 18 bp, Homo sapiens
ccccggccacctgcggtg

SEQ ID NO: 6732278 - DNA, 21 bp, Homo sapiens
ccccggccactccctgccaac

SEQ ID NO: 6732279 - DNA, 13 bp, Homo sapiens
ccccggcccagtg

SEQ ID NO: 6732280 - DNA, 14 bp, Homo sapiens
ccccggcccagtgc

SEQ ID NO: 6732281 - DNA, 16 bp, Homo sapiens
ccccggccccagccag

SEQ ID NO: 6732282 - DNA, 17 bp, Homo sapiens
ccccggccccagccaga

SEQ ID NO: 6732283 - DNA, 13 bp, Homo sapiens
ccccggccctacc

SEQ ID NO: 6732284 - DNA, 18 bp, Homo sapiens
ccccggccctaccagcgc

SEQ ID NO: 6732285 - DNA, 21 bp, Homo sapiens
ccccggccctgggctcggagg

SEQ ID NO: 6732286 - DNA, 12 bp, Homo sapiens
ccccggcctcag

SEQ ID NO: 6732287 - DNA, 17 bp, Homo sapiens
ccccggcctgatggcca

SEQ ID NO: 6732288 - DNA, 15 bp, Homo sapiens
ccccggcctggcccc

SEQ ID NO: 6732289 - DNA, 14 bp, Homo sapiens
ccccggctcccacc

SEQ ID NO: 6732290 - DNA, 22 bp, Homo sapiens
ccccggctcccaccggtgccaa

SEQ ID NO: 6732291 - DNA, 13 bp, Homo sapiens
ccccggctgggcc

SEQ ID NO: 6732292 - DNA, 17 bp, Homo sapiens
ccccggcttcctttccc

SEQ ID NO: 6732293 - DNA, 18 bp, Homo sapiens
ccccggctttcctccgga

SEQ ID NO: 6732294 - DNA, 16 bp, Homo sapiens
ccccgggaaaggccgg

SEQ ID NO: 6732295 - DNA, 16 bp, Homo sapiens
ccccgggatcctgccc

SEQ ID NO: 6732296 - DNA, 23 bp, Homo sapiens
ccccgggatcctgcccccaagtc

SEQ ID NO: 6732297 - DNA, 18 bp, Homo sapiens
ccccgggcagcagagaga

SEQ ID NO: 6732298 - DNA, 21 bp, Homo sapiens
ccccgggctctggccaccctg

SEQ ID NO: 6732299 - DNA, 20 bp, Homo sapiens
ccccgggctgacccagtgtg

SEQ ID NO: 6732300 - DNA, 15 bp, Homo sapiens
ccccgggctggagaa

SEQ ID NO: 6732301 - DNA, 21 bp, Homo sapiens
ccccgggctggagaaagagct

SEQ ID NO: 6732302 - DNA, 22 bp, Homo sapiens
ccccgggctggagaaagagctg

SEQ ID NO: 6732303 - DNA, 15 bp, Homo sapiens
ccccgggctggccct

SEQ ID NO: 6732304 - DNA, 16 bp, Homo sapiens
ccccgggctggccctg

SEQ ID NO: 6732305 - DNA, 23 bp, Homo sapiens
ccccgggctggccctgtgcagac

SEQ ID NO: 6732306 - DNA, 23 bp, Homo sapiens
ccccgggcttcccttctccccag

SEQ ID NO: 6732307 - DNA, 16 bp, Homo sapiens
ccccggggctggcaag

SEQ ID NO: 6732308 - DNA, 17 bp, Homo sapiens
ccccgggttcagcctgg

SEQ ID NO: 6732309 - DNA, 19 bp, Homo sapiens
ccccgggttcagcctggcc

SEQ ID NO: 6732310 - DNA, 16 bp, Homo sapiens
ccccggtcccccagag

SEQ ID NO: 6732311 - DNA, 17 bp, Homo sapiens
ccccggtcccccagagc

SEQ ID NO: 6732312 - DNA, 19 bp, Homo sapiens
ccccggtcccccagagcat

SEQ ID NO: 6732313 - DNA, 20 bp, Homo sapiens
ccccggtcccccagagcatc

SEQ ID NO: 6732314 - DNA, 24 bp, Homo sapiens
ccccggtcccttgagacctcagcc

SEQ ID NO: 6732315 - DNA, 16 bp, Homo sapiens
ccccggtcctggcccc

SEQ ID NO: 6732316 - DNA, 17 bp, Homo sapiens
ccccggtggctgggcag

SEQ ID NO: 6732317 - DNA, 22 bp, Homo sapiens
ccccggttgctggtcaggtccc

SEQ ID NO: 6732318 - DNA, 22 bp, Homo sapiens
ccccgtcagccacacctgtcag

SEQ ID NO: 6732319 - DNA, 13 bp, Homo sapiens
ccccgtcagggag

SEQ ID NO: 6732320 - DNA, 18 bp, Homo sapiens
ccccgtccatggtgctaa

SEQ ID NO: 6732321 - DNA, 21 bp, Homo sapiens
ccccgtcccagaggccgctgc

SEQ ID NO: 6732322 - DNA, 19 bp, Homo sapiens
ccccgtcccctgcagcctg

SEQ ID NO: 6732323 - DNA, 18 bp, Homo sapiens
ccccgtcccggccccgcg

SEQ ID NO: 6732324 - DNA, 15 bp, Homo sapiens
ccccgtcggactgcc

SEQ ID NO: 6732325 - DNA, 19 bp, Homo sapiens
ccccgtcggactgccccca

SEQ ID NO: 6732326 - DNA, 22 bp, Homo sapiens
ccccgtctctcttggacccacc

SEQ ID NO: 6732327 - DNA, 17 bp, Homo sapiens
ccccgtctctgccctgg

SEQ ID NO: 6732328 - DNA, 12 bp, Homo sapiens
ccccgtctgccc

SEQ ID NO: 6732329 - DNA, 14 bp, Homo sapiens
ccccgtctgcccac

SEQ ID NO: 6732330 - DNA, 15 bp, Homo sapiens
ccccgtctgcccacc

SEQ ID NO: 6732331 - DNA, 20 bp, Homo sapiens
ccccgtctggggttcagccc

SEQ ID NO: 6732332 - DNA, 16 bp, Homo sapiens
ccccgtcttctctcca

SEQ ID NO: 6732333 - DNA, 18 bp, Homo sapiens
ccccgtgacacatgctct

SEQ ID NO: 6732334 - DNA, 14 bp, Homo sapiens
ccccgtgctcctct

SEQ ID NO: 6732335 - DNA, 19 bp, Homo sapiens
ccccgtgctcctctgcccg

SEQ ID NO: 6732336 - DNA, 17 bp, Homo sapiens
ccccgtggatggtctcc

SEQ ID NO: 6732337 - DNA, 20 bp, Homo sapiens
ccccgtggccatccctgtga

SEQ ID NO: 6732338 - DNA, 17 bp, Homo sapiens
ccccgtggtctttgaat

SEQ ID NO: 6732339 - DNA, 21 bp, Homo sapiens
ccccgtggtgacatttcccaa

SEQ ID NO: 6732340 - DNA, 19 bp, Homo sapiens
ccccgtgtattcaggaccc

SEQ ID NO: 6732341 - DNA, 22 bp, Homo sapiens
ccccgtgtcctctccctgccaa

SEQ ID NO: 6732342 - DNA, 17 bp, Homo sapiens
ccccgtgtgccccaaga

SEQ ID NO: 6732343 - DNA, 17 bp, Homo sapiens
ccccgtgttcccctctt

SEQ ID NO: 6732344 - DNA, 15 bp, Homo sapiens
ccccgttagcttcct

SEQ ID NO: 6732345 - DNA, 21 bp, Homo sapiens
ccccgttcctgacatcacagc

SEQ ID NO: 6732346 - DNA, 14 bp, Homo sapiens
ccccgttgaagccg

SEQ ID NO: 6732347 - DNA, 18 bp, Homo sapiens
ccccgttgcttcccgctg

SEQ ID NO: 6732348 - DNA, 19 bp, Homo sapiens
ccccgttgcttcccgctgc

SEQ ID NO: 6732349 - DNA, 17 bp, Homo sapiens
ccccgttgttgtccctg

SEQ ID NO: 6732350 - DNA, 15 bp, Homo sapiens
ccccgtttcttgcaa

SEQ ID NO: 6732351 - DNA, 22 bp, Homo sapiens
cccctaaaccccaagcttccca

SEQ ID NO: 6732352 - DNA, 19 bp, Homo sapiens
cccctaaagagcatcctga

SEQ ID NO: 6732353 - DNA, 17 bp, Homo sapiens
cccctaaagatgggagg

SEQ ID NO: 6732354 - DNA, 18 bp, Homo sapiens
cccctaacccccagtcct

SEQ ID NO: 6732355 - DNA, 19 bp, Homo sapiens
cccctaacccccagtcctc

SEQ ID NO: 6732356 - DNA, 20 bp, Homo sapiens
cccctaaccctactttgctt

SEQ ID NO: 6732357 - DNA, 22 bp, Homo sapiens
cccctaaccctttgtgtgctct

SEQ ID NO: 6732358 - DNA, 23 bp, Homo sapiens
cccctaacctctaaccctcattg

SEQ ID NO: 6732359 - DNA, 15 bp, Homo sapiens
cccctaagactgcct

SEQ ID NO: 6732360 - DNA, 16 bp, Homo sapiens
cccctaagactgcctt

SEQ ID NO: 6732361 - DNA, 17 bp, Homo sapiens
cccctaagagagcacct

SEQ ID NO: 6732362 - DNA, 24 bp, Homo sapiens
cccctaagtgcaaacacagcatgg

SEQ ID NO: 6732363 - DNA, 23 bp, Homo sapiens
cccctaatgacatcaccacagtt

SEQ ID NO: 6732364 - DNA, 18 bp, Homo sapiens
cccctaatgcctgcggag

SEQ ID NO: 6732365 - DNA, 14 bp, Homo sapiens
cccctaatgtcagc

SEQ ID NO: 6732366 - DNA, 19 bp, Homo sapiens
cccctacacacacactccc

SEQ ID NO: 6732367 - DNA, 22 bp, Homo sapiens
cccctacacacacactccctgc

SEQ ID NO: 6732368 - DNA, 14 bp, Homo sapiens
cccctacagcctgc

SEQ ID NO: 6732369 - DNA, 18 bp, Homo sapiens
cccctacagcctgcacac

SEQ ID NO: 6732370 - DNA, 15 bp, Homo sapiens
cccctaccactgtct

SEQ ID NO: 6732371 - DNA, 13 bp, Homo sapiens
cccctaccagcca

SEQ ID NO: 6732372 - DNA, 22 bp, Homo sapiens
cccctaccccacaccaggccgt

SEQ ID NO: 6732373 - DNA, 15 bp, Homo sapiens
cccctacccctgccc

SEQ ID NO: 6732374 - DNA, 14 bp, Homo sapiens
cccctacccggctc

SEQ ID NO: 6732375 - DNA, 17 bp, Homo sapiens
cccctaccgcatggcag

SEQ ID NO: 6732376 - DNA, 18 bp, Homo sapiens
cccctaccgcatggcagc

SEQ ID NO: 6732377 - DNA, 19 bp, Homo sapiens
cccctaccgcatggcagct

SEQ ID NO: 6732378 - DNA, 18 bp, Homo sapiens
cccctacgcgccttgtct

SEQ ID NO: 6732379 - DNA, 14 bp, Homo sapiens
cccctactgctgtg

SEQ ID NO: 6732380 - DNA, 17 bp, Homo sapiens
cccctagaaacccaagc

SEQ ID NO: 6732381 - DNA, 21 bp, Homo sapiens
cccctagaaacccaagctcct

SEQ ID NO: 6732382 - DNA, 21 bp, Homo sapiens
cccctagacatggcctctgga

SEQ ID NO: 6732383 - DNA, 16 bp, Homo sapiens
cccctagagactcaga

SEQ ID NO: 6732384 - DNA, 20 bp, Homo sapiens
cccctagagccctctcctcc

SEQ ID NO: 6732385 - DNA, 12 bp, Homo sapiens
cccctagatcca

SEQ ID NO: 6732386 - DNA, 18 bp, Homo sapiens
cccctagccaccagtgtc

SEQ ID NO: 6732387 - DNA, 21 bp, Homo sapiens
cccctagccaccagtgtcctc

SEQ ID NO: 6732388 - DNA, 22 bp, Homo sapiens
cccctagccaccagtgtcctcc

SEQ ID NO: 6732389 - DNA, 14 bp, Homo sapiens
cccctagccatttt

SEQ ID NO: 6732390 - DNA, 13 bp, Homo sapiens
cccctagcccagg

SEQ ID NO: 6732391 - DNA, 14 bp, Homo sapiens
cccctagctcacca

SEQ ID NO: 6732392 - DNA, 15 bp, Homo sapiens
cccctagctcaccag

SEQ ID NO: 6732393 - DNA, 19 bp, Homo sapiens
cccctaggactcaggcctg

SEQ ID NO: 6732394 - DNA, 17 bp, Homo sapiens
cccctaggatgctgcag

SEQ ID NO: 6732395 - DNA, 18 bp, Homo sapiens
cccctaggatgctgcagc

SEQ ID NO: 6732396 - DNA, 20 bp, Homo sapiens
cccctaggatgctgcagcag

SEQ ID NO: 6732397 - DNA, 20 bp, Homo sapiens
cccctagggactgtcctagc

SEQ ID NO: 6732398 - DNA, 16 bp, Homo sapiens
cccctaggtgcccagg

SEQ ID NO: 6732399 - DNA, 19 bp, Homo sapiens
cccctagtatctggctggg

SEQ ID NO: 6732400 - DNA, 16 bp, Homo sapiens
cccctataccctaggt

SEQ ID NO: 6732401 - DNA, 18 bp, Homo sapiens
cccctatcagttgatttt

SEQ ID NO: 6732402 - DNA, 14 bp, Homo sapiens
cccctatccaccca

SEQ ID NO: 6732403 - DNA, 17 bp, Homo sapiens
cccctatccacccagcc

SEQ ID NO: 6732404 - DNA, 20 bp, Homo sapiens
cccctatccacccagcccat

SEQ ID NO: 6732405 - DNA, 14 bp, Homo sapiens
cccctatcctcccc

SEQ ID NO: 6732406 - DNA, 13 bp, Homo sapiens
cccctatcctgca

SEQ ID NO: 6732407 - DNA, 16 bp, Homo sapiens
cccctatcctgcaccc

SEQ ID NO: 6732408 - DNA, 21 bp, Homo sapiens
cccctatcctgcaccctctgc

SEQ ID NO: 6732409 - DNA, 12 bp, Homo sapiens
cccctatcctgt

SEQ ID NO: 6732410 - DNA, 15 bp, Homo sapiens
cccctatccttggca

SEQ ID NO: 6732411 - DNA, 18 bp, Homo sapiens
cccctatctcttcctgtc

SEQ ID NO: 6732412 - DNA, 19 bp, Homo sapiens
cccctatgccactaagcca

SEQ ID NO: 6732413 - DNA, 14 bp, Homo sapiens
cccctcaaaagcca

SEQ ID NO: 6732414 - DNA, 21 bp, Homo sapiens
cccctcaaagggagagaaaag

SEQ ID NO: 6732415 - DNA, 18 bp, Homo sapiens
cccctcaaatcgtccagc

SEQ ID NO: 6732416 - DNA, 15 bp, Homo sapiens
cccctcaacaccctg

SEQ ID NO: 6732417 - DNA, 23 bp, Homo sapiens
cccctcaagccccagcagccctc

SEQ ID NO: 6732418 - DNA, 18 bp, Homo sapiens
cccctcaagccccttctc

SEQ ID NO: 6732419 - DNA, 20 bp, Homo sapiens
cccctcaatccccaaaggtc

SEQ ID NO: 6732420 - DNA, 15 bp, Homo sapiens
cccctcacactgcaa

SEQ ID NO: 6732421 - DNA, 13 bp, Homo sapiens
cccctcacagact

SEQ ID NO: 6732422 - DNA, 14 bp, Homo sapiens
cccctcacagactc

SEQ ID NO: 6732423 - DNA, 15 bp, Homo sapiens
cccctcacagactct

SEQ ID NO: 6732424 - DNA, 19 bp, Homo sapiens
cccctcacagactcttcca

SEQ ID NO: 6732425 - DNA, 20 bp, Homo sapiens
cccctcacagcctctgaccc

SEQ ID NO: 6732426 - DNA, 16 bp, Homo sapiens
cccctcacatcctcct

SEQ ID NO: 6732427 - DNA, 18 bp, Homo sapiens
cccctcacatcctcctgc

SEQ ID NO: 6732428 - DNA, 18 bp, Homo sapiens
cccctcacatcctctcca

SEQ ID NO: 6732429 - DNA, 14 bp, Homo sapiens
cccctcaccacccc

SEQ ID NO: 6732430 - DNA, 18 bp, Homo sapiens
cccctcaccacccccact

SEQ ID NO: 6732431 - DNA, 16 bp, Homo sapiens
cccctcaccaggggca

SEQ ID NO: 6732432 - DNA, 17 bp, Homo sapiens
cccctcaccaggggcag

SEQ ID NO: 6732433 - DNA, 15 bp, Homo sapiens
cccctcaccatccag

SEQ ID NO: 6732434 - DNA, 15 bp, Homo sapiens
cccctcaccccagct

SEQ ID NO: 6732435 - DNA, 12 bp, Homo sapiens
cccctcaccccc

SEQ ID NO: 6732436 - DNA, 12 bp, Homo sapiens
cccctcaccctc

SEQ ID NO: 6732437 - DNA, 13 bp, Homo sapiens
cccctcacctcct

SEQ ID NO: 6732438 - DNA, 15 bp, Homo sapiens
cccctcacctgggca

SEQ ID NO: 6732439 - DNA, 12 bp, Homo sapiens
cccctcaccttg

SEQ ID NO: 6732440 - DNA, 13 bp, Homo sapiens
cccctcaccttgc

SEQ ID NO: 6732441 - DNA, 14 bp, Homo sapiens
cccctcaccttgca

SEQ ID NO: 6732442 - DNA, 15 bp, Homo sapiens
cccctcactccccag

SEQ ID NO: 6732443 - DNA, 18 bp, Homo sapiens
cccctcactccccaggga

SEQ ID NO: 6732444 - DNA, 21 bp, Homo sapiens
cccctcactccccagggagct

SEQ ID NO: 6732445 - DNA, 14 bp, Homo sapiens
cccctcactctggc

SEQ ID NO: 6732446 - DNA, 15 bp, Homo sapiens
cccctcactctgtca

SEQ ID NO: 6732447 - DNA, 21 bp, Homo sapiens
cccctcacttccagcttgcct

SEQ ID NO: 6732448 - DNA, 16 bp, Homo sapiens
cccctcagacagcccc

SEQ ID NO: 6732449 - DNA, 13 bp, Homo sapiens
cccctcagagccc

SEQ ID NO: 6732450 - DNA, 13 bp, Homo sapiens
cccctcagagctc

SEQ ID NO: 6732451 - DNA, 23 bp, Homo sapiens
cccctcagatgatctctccacgg

SEQ ID NO: 6732452 - DNA, 18 bp, Homo sapiens
cccctcagcaaggggctg

SEQ ID NO: 6732453 - DNA, 19 bp, Homo sapiens
cccctcagccaatgaatca

SEQ ID NO: 6732454 - DNA, 13 bp, Homo sapiens
cccctcagcccca

SEQ ID NO: 6732455 - DNA, 14 bp, Homo sapiens
cccctcagccccag

SEQ ID NO: 6732456 - DNA, 13 bp, Homo sapiens
cccctcagccctt

SEQ ID NO: 6732457 - DNA, 17 bp, Homo sapiens
cccctcagcccttgccc

SEQ ID NO: 6732458 - DNA, 15 bp, Homo sapiens
cccctcagcctgccc

SEQ ID NO: 6732459 - DNA, 21 bp, Homo sapiens
cccctcagcctgcccacctct

SEQ ID NO: 6732460 - DNA, 21 bp, Homo sapiens
cccctcagcgcccccagagcc

SEQ ID NO: 6732461 - DNA, 23 bp, Homo sapiens
cccctcagcgctccctgtcgcct

SEQ ID NO: 6732462 - DNA, 12 bp, Homo sapiens
cccctcagctcc

SEQ ID NO: 6732463 - DNA, 19 bp, Homo sapiens
cccctcagctctccctcac

SEQ ID NO: 6732464 - DNA, 17 bp, Homo sapiens
cccctcagctctgtcct

SEQ ID NO: 6732465 - DNA, 14 bp, Homo sapiens
cccctcaggaccct

SEQ ID NO: 6732466 - DNA, 22 bp, Homo sapiens
cccctcaggaccctcgctggcc

SEQ ID NO: 6732467 - DNA, 16 bp, Homo sapiens
cccctcaggggaagct

SEQ ID NO: 6732468 - DNA, 18 bp, Homo sapiens
cccctcaggggaagctgc

SEQ ID NO: 6732469 - DNA, 21 bp, Homo sapiens
cccctcaggggaagctgctag

SEQ ID NO: 6732470 - DNA, 21 bp, Homo sapiens
cccctcagggggccagctggg

SEQ ID NO: 6732471 - DNA, 17 bp, Homo sapiens
cccctcagggtccctgg

SEQ ID NO: 6732472 - DNA, 11 bp, Homo sapiens
cccctcagtgc

SEQ ID NO: 6732473 - DNA, 12 bp, Homo sapiens
cccctcagtgct

SEQ ID NO: 6732474 - DNA, 19 bp, Homo sapiens
cccctcagtgctcggcagt

SEQ ID NO: 6732475 - DNA, 16 bp, Homo sapiens
cccctcagttgtgcag

SEQ ID NO: 6732476 - DNA, 18 bp, Homo sapiens
cccctcatacctacaccc

SEQ ID NO: 6732477 - DNA, 20 bp, Homo sapiens
cccctcatagccctcaccct

SEQ ID NO: 6732478 - DNA, 14 bp, Homo sapiens
cccctcatctgcag

SEQ ID NO: 6732479 - DNA, 23 bp, Homo sapiens
cccctcatggagaaacatcctaa

SEQ ID NO: 6732480 - DNA, 21 bp, Homo sapiens
cccctccaaaatgtgcctatt

SEQ ID NO: 6732481 - DNA, 17 bp, Homo sapiens
cccctccaaacctccag

SEQ ID NO: 6732482 - DNA, 18 bp, Homo sapiens
cccctccaaacctccagc

SEQ ID NO: 6732483 - DNA, 14 bp, Homo sapiens
cccctccaacctgg

SEQ ID NO: 6732484 - DNA, 15 bp, Homo sapiens
cccctccaatcctgc

SEQ ID NO: 6732485 - DNA, 21 bp, Homo sapiens
cccctccaccccccactcagt

SEQ ID NO: 6732486 - DNA, 14 bp, Homo sapiens
cccctccaccgggc

SEQ ID NO: 6732487 - DNA, 13 bp, Homo sapiens
cccctccacctgc

SEQ ID NO: 6732488 - DNA, 23 bp, Homo sapiens
cccctccacggtccgcggcctgc

SEQ ID NO: 6732489 - DNA, 15 bp, Homo sapiens
cccctccactgctgg

SEQ ID NO: 6732490 - DNA, 11 bp, Homo sapiens
cccctccagac

SEQ ID NO: 6732491 - DNA, 20 bp, Homo sapiens
cccctccagacccctaccct

SEQ ID NO: 6732492 - DNA, 16 bp, Homo sapiens
cccctccagaccctgc

SEQ ID NO: 6732493 - DNA, 19 bp, Homo sapiens
cccctccagaccctgcctg

SEQ ID NO: 6732494 - DNA, 12 bp, Homo sapiens
cccctccagcac

SEQ ID NO: 6732495 - DNA, 15 bp, Homo sapiens
cccctccagcttgtg

SEQ ID NO: 6732496 - DNA, 22 bp, Homo sapiens
cccctccagcttgtggagcccc

SEQ ID NO: 6732497 - DNA, 11 bp, Homo sapiens
cccctccagga

SEQ ID NO: 6732498 - DNA, 13 bp, Homo sapiens
cccctccaggaag

SEQ ID NO: 6732499 - DNA, 14 bp, Homo sapiens
cccctccaggagag

SEQ ID NO: 6732500 - DNA, 13 bp, Homo sapiens
cccctccaggagg

SEQ ID NO: 6732501 - DNA, 22 bp, Homo sapiens
cccctccagtgcttggctgccc

SEQ ID NO: 6732502 - DNA, 15 bp, Homo sapiens
cccctccagtgttgc

SEQ ID NO: 6732503 - DNA, 16 bp, Homo sapiens
cccctccatgggcgtc

SEQ ID NO: 6732504 - DNA, 12 bp, Homo sapiens
cccctccatgtg

SEQ ID NO: 6732505 - DNA, 18 bp, Homo sapiens
cccctcccacgcctcacc

SEQ ID NO: 6732506 - DNA, 14 bp, Homo sapiens
cccctcccagacag

SEQ ID NO: 6732507 - DNA, 19 bp, Homo sapiens
cccctcccagacaggccct

SEQ ID NO: 6732508 - DNA, 22 bp, Homo sapiens
cccctcccagacaggccctccc

SEQ ID NO: 6732509 - DNA, 14 bp, Homo sapiens
cccctcccagccct

SEQ ID NO: 6732510 - DNA, 14 bp, Homo sapiens
cccctcccagccta

SEQ ID NO: 6732511 - DNA, 13 bp, Homo sapiens
cccctcccagctg

SEQ ID NO: 6732512 - DNA, 13 bp, Homo sapiens
cccctcccattag

SEQ ID NO: 6732513 - DNA, 18 bp, Homo sapiens
cccctccccaaaagaaac

SEQ ID NO: 6732514 - DNA, 13 bp, Homo sapiens
cccctccccaaag

SEQ ID NO: 6732515 - DNA, 12 bp, Homo sapiens
cccctccccaag

SEQ ID NO: 6732516 - DNA, 12 bp, Homo sapiens
cccctccccact

SEQ ID NO: 6732517 - DNA, 12 bp, Homo sapiens
cccctccccagc

SEQ ID NO: 6732518 - DNA, 14 bp, Homo sapiens
cccctccccagcca

SEQ ID NO: 6732519 - DNA, 15 bp, Homo sapiens
cccctccccagccag

SEQ ID NO: 6732520 - DNA, 14 bp, Homo sapiens
cccctccccagccc

SEQ ID NO: 6732521 - DNA, 16 bp, Homo sapiens
cccctccccagcccaa

SEQ ID NO: 6732522 - DNA, 15 bp, Homo sapiens
cccctccccagctcc

SEQ ID NO: 6732523 - DNA, 12 bp, Homo sapiens
cccctccccagt

SEQ ID NO: 6732524 - DNA, 18 bp, Homo sapiens
cccctccccatctgtgtt

SEQ ID NO: 6732525 - DNA, 12 bp, Homo sapiens
cccctccccatg

SEQ ID NO: 6732526 - DNA, 11 bp, Homo sapiens
cccctccccca

SEQ ID NO: 6732527 - DNA, 18 bp, Homo sapiens
cccctcccccaaccccca

SEQ ID NO: 6732528 - DNA, 21 bp, Homo sapiens
cccctcccccacgtctctctg

SEQ ID NO: 6732529 - DNA, 14 bp, Homo sapiens
cccctcccccactc

SEQ ID NO: 6732530 - DNA, 14 bp, Homo sapiens
cccctcccccagcc

SEQ ID NO: 6732531 - DNA, 15 bp, Homo sapiens
cccctcccccagctg

SEQ ID NO: 6732532 - DNA, 16 bp, Homo sapiens
cccctcccccagctgc

SEQ ID NO: 6732533 - DNA, 14 bp, Homo sapiens
cccctcccccgcag

SEQ ID NO: 6732534 - DNA, 15 bp, Homo sapiens
cccctccccctcctg

SEQ ID NO: 6732535 - DNA, 20 bp, Homo sapiens
cccctccccgccccctgaaa

SEQ ID NO: 6732536 - DNA, 16 bp, Homo sapiens
cccctccccgcctggc

SEQ ID NO: 6732537 - DNA, 17 bp, Homo sapiens
cccctccccgcctggcc

SEQ ID NO: 6732538 - DNA, 21 bp, Homo sapiens
cccctccccggccctaccagc

SEQ ID NO: 6732539 - DNA, 14 bp, Homo sapiens
cccctccccgtccc

SEQ ID NO: 6732540 - DNA, 19 bp, Homo sapiens
cccctcccctaatgcctgc

SEQ ID NO: 6732541 - DNA, 14 bp, Homo sapiens
cccctcccctcaga

SEQ ID NO: 6732542 - DNA, 16 bp, Homo sapiens
cccctcccctcagagc

SEQ ID NO: 6732543 - DNA, 13 bp, Homo sapiens
cccctcccctcca

SEQ ID NO: 6732544 - DNA, 14 bp, Homo sapiens
cccctcccctcctt

SEQ ID NO: 6732545 - DNA, 15 bp, Homo sapiens
cccctcccctccttt

SEQ ID NO: 6732546 - DNA, 15 bp, Homo sapiens
cccctcccctgggac

SEQ ID NO: 6732547 - DNA, 16 bp, Homo sapiens
cccctcccctggggac

SEQ ID NO: 6732548 - DNA, 19 bp, Homo sapiens
cccctcccctggggacgcc

SEQ ID NO: 6732549 - DNA, 20 bp, Homo sapiens
cccctcccgcttcctccggc

SEQ ID NO: 6732550 - DNA, 20 bp, Homo sapiens
cccctccctaccctcggaaa

SEQ ID NO: 6732551 - DNA, 17 bp, Homo sapiens
cccctccctcagggagc

SEQ ID NO: 6732552 - DNA, 19 bp, Homo sapiens
cccctccctcctctggccc

SEQ ID NO: 6732553 - DNA, 16 bp, Homo sapiens
cccctccctcgtgggc

SEQ ID NO: 6732554 - DNA, 14 bp, Homo sapiens
cccctccctctgtc

SEQ ID NO: 6732555 - DNA, 12 bp, Homo sapiens
cccctccctgcc

SEQ ID NO: 6732556 - DNA, 15 bp, Homo sapiens
cccctccctgcccaa

SEQ ID NO: 6732557 - DNA, 16 bp, Homo sapiens
cccctccctgcctgct

SEQ ID NO: 6732558 - DNA, 14 bp, Homo sapiens
cccctccctggatg

SEQ ID NO: 6732559 - DNA, 12 bp, Homo sapiens
cccctccctggc

SEQ ID NO: 6732560 - DNA, 15 bp, Homo sapiens
cccctccctggcctg

SEQ ID NO: 6732561 - DNA, 15 bp, Homo sapiens
cccctccctggctcc

SEQ ID NO: 6732562 - DNA, 12 bp, Homo sapiens
cccctcccttgc

SEQ ID NO: 6732563 - DNA, 20 bp, Homo sapiens
cccctccgatgctgaggcca

SEQ ID NO: 6732564 - DNA, 21 bp, Homo sapiens
cccctccgcagcagggaagct

SEQ ID NO: 6732565 - DNA, 17 bp, Homo sapiens
cccctccgccctgccac

SEQ ID NO: 6732566 - DNA, 18 bp, Homo sapiens
cccctccgccctgccact

SEQ ID NO: 6732567 - DNA, 13 bp, Homo sapiens
cccctccgcctcc

SEQ ID NO: 6732568 - DNA, 16 bp, Homo sapiens
cccctccgtccccagg

SEQ ID NO: 6732569 - DNA, 12 bp, Homo sapiens
cccctcctagac

SEQ ID NO: 6732570 - DNA, 13 bp, Homo sapiens
cccctcctcactg

SEQ ID NO: 6732571 - DNA, 12 bp, Homo sapiens
cccctcctccag

SEQ ID NO: 6732572 - DNA, 13 bp, Homo sapiens
cccctcctccagg

SEQ ID NO: 6732573 - DNA, 12 bp, Homo sapiens
cccctcctcccc

SEQ ID NO: 6732574 - DNA, 15 bp, Homo sapiens
cccctcctccccctt

SEQ ID NO: 6732575 - DNA, 15 bp, Homo sapiens
cccctcctccccgcg

SEQ ID NO: 6732576 - DNA, 12 bp, Homo sapiens
cccctcctccct

SEQ ID NO: 6732577 - DNA, 15 bp, Homo sapiens
cccctcctccctcag

SEQ ID NO: 6732578 - DNA, 16 bp, Homo sapiens
cccctcctccctcaga

SEQ ID NO: 6732579 - DNA, 18 bp, Homo sapiens
cccctcctccctcagacc

SEQ ID NO: 6732580 - DNA, 18 bp, Homo sapiens
cccctcctccctcaggcc

SEQ ID NO: 6732581 - DNA, 14 bp, Homo sapiens
cccctcctccctgc

SEQ ID NO: 6732582 - DNA, 21 bp, Homo sapiens
cccctcctcgggcgcctgcgc

SEQ ID NO: 6732583 - DNA, 22 bp, Homo sapiens
cccctcctcgggcgcctgcgct

SEQ ID NO: 6732584 - DNA, 22 bp, Homo sapiens
cccctcctctagctctggtggg

SEQ ID NO: 6732585 - DNA, 17 bp, Homo sapiens
cccctcctctagctgtg

SEQ ID NO: 6732586 - DNA, 23 bp, Homo sapiens
cccctcctctcctgcccagctct

SEQ ID NO: 6732587 - DNA, 15 bp, Homo sapiens
cccctcctctctgcc

SEQ ID NO: 6732588 - DNA, 11 bp, Homo sapiens
cccctcctctg

SEQ ID NO: 6732589 - DNA, 13 bp, Homo sapiens
cccctcctctgct

SEQ ID NO: 6732590 - DNA, 17 bp, Homo sapiens
cccctcctctgcttgcc

SEQ ID NO: 6732591 - DNA, 13 bp, Homo sapiens
cccctcctctgtg

SEQ ID NO: 6732592 - DNA, 15 bp, Homo sapiens
cccctcctcttccct

SEQ ID NO: 6732593 - DNA, 20 bp, Homo sapiens
cccctcctgaaccgcacagc

SEQ ID NO: 6732594 - DNA, 14 bp, Homo sapiens
cccctcctgctcct

SEQ ID NO: 6732595 - DNA, 15 bp, Homo sapiens
cccctcctgctcctc

SEQ ID NO: 6732596 - DNA, 19 bp, Homo sapiens
cccctcctgctcctccctg

SEQ ID NO: 6732597 - DNA, 15 bp, Homo sapiens
cccctcctgctgggc

SEQ ID NO: 6732598 - DNA, 13 bp, Homo sapiens
cccctcctggcaa

SEQ ID NO: 6732599 - DNA, 14 bp, Homo sapiens
cccctcctggctgt

SEQ ID NO: 6732600 - DNA, 11 bp, Homo sapiens
cccctcctggg

SEQ ID NO: 6732601 - DNA, 14 bp, Homo sapiens
cccctcctggggcc

SEQ ID NO: 6732602 - DNA, 13 bp, Homo sapiens
cccctccttcaga

SEQ ID NO: 6732603 - DNA, 14 bp, Homo sapiens
cccctccttccagc

SEQ ID NO: 6732604 - DNA, 16 bp, Homo sapiens
cccctccttcccagct

SEQ ID NO: 6732605 - DNA, 17 bp, Homo sapiens
cccctccttcccagctg

SEQ ID NO: 6732606 - DNA, 22 bp, Homo sapiens
cccctccttccccagacccaga

SEQ ID NO: 6732607 - DNA, 11 bp, Homo sapiens
cccctccttct

SEQ ID NO: 6732608 - DNA, 16 bp, Homo sapiens
cccctccttctcccct

SEQ ID NO: 6732609 - DNA, 22 bp, Homo sapiens
cccctccttctcccctccagac

SEQ ID NO: 6732610 - DNA, 13 bp, Homo sapiens
cccctccttgcaa

SEQ ID NO: 6732611 - DNA, 22 bp, Homo sapiens
cccctccttgcaaccaggcagc

SEQ ID NO: 6732612 - DNA, 20 bp, Homo sapiens
cccctccttgcctcctgtgt

SEQ ID NO: 6732613 - DNA, 13 bp, Homo sapiens
cccctccttgtct

SEQ ID NO: 6732614 - DNA, 19 bp, Homo sapiens
cccctccttttcccactgg

SEQ ID NO: 6732615 - DNA, 17 bp, Homo sapiens
cccctcgaccctgtgca

SEQ ID NO: 6732616 - DNA, 17 bp, Homo sapiens
cccctcgactcagcacc

SEQ ID NO: 6732617 - DNA, 18 bp, Homo sapiens
cccctcgactcagcacca

SEQ ID NO: 6732618 - DNA, 15 bp, Homo sapiens
cccctcgaggcctac

SEQ ID NO: 6732619 - DNA, 19 bp, Homo sapiens
cccctcgaggcctacagag

SEQ ID NO: 6732620 - DNA, 21 bp, Homo sapiens
cccctcgaggcctacagagga

SEQ ID NO: 6732621 - DNA, 20 bp, Homo sapiens
cccctcgcacacagggctca

SEQ ID NO: 6732622 - DNA, 13 bp, Homo sapiens
cccctcgccagct

SEQ ID NO: 6732623 - DNA, 20 bp, Homo sapiens
cccctcgccagcttctcctg

SEQ ID NO: 6732624 - DNA, 15 bp, Homo sapiens
cccctcgccagcttg

SEQ ID NO: 6732625 - DNA, 16 bp, Homo sapiens
cccctcgccagcttgg

SEQ ID NO: 6732626 - DNA, 16 bp, Homo sapiens
cccctcgccccagcct

SEQ ID NO: 6732627 - DNA, 18 bp, Homo sapiens
cccctcgctgctgctact

SEQ ID NO: 6732628 - DNA, 20 bp, Homo sapiens
cccctcggcattcacacaca

SEQ ID NO: 6732629 - DNA, 16 bp, Homo sapiens
cccctcggctctggag

SEQ ID NO: 6732630 - DNA, 18 bp, Homo sapiens
cccctcgggggcctgtgg

SEQ ID NO: 6732631 - DNA, 20 bp, Homo sapiens
cccctcggggtgtcagaaat

SEQ ID NO: 6732632 - DNA, 14 bp, Homo sapiens
cccctcgtgccagt

SEQ ID NO: 6732633 - DNA, 18 bp, Homo sapiens
cccctcgtgcgcatctca

SEQ ID NO: 6732634 - DNA, 23 bp, Homo sapiens
cccctcgtgtcagctcaggcagc

SEQ ID NO: 6732635 - DNA, 17 bp, Homo sapiens
cccctcgtgtgactctc

SEQ ID NO: 6732636 - DNA, 19 bp, Homo sapiens
cccctcgtgtgactctctt

SEQ ID NO: 6732637 - DNA, 16 bp, Homo sapiens
cccctctaactggaca

SEQ ID NO: 6732638 - DNA, 19 bp, Homo sapiens
cccctctaactggacagcc

SEQ ID NO: 6732639 - DNA, 23 bp, Homo sapiens
cccctctaactggacagcctctt

SEQ ID NO: 6732640 - DNA, 12 bp, Homo sapiens
cccctctcacca

SEQ ID NO: 6732641 - DNA, 20 bp, Homo sapiens
cccctctcacgccacccccg

SEQ ID NO: 6732642 - DNA, 12 bp, Homo sapiens
cccctctcagga

SEQ ID NO: 6732643 - DNA, 16 bp, Homo sapiens
cccctctcaggagcca

SEQ ID NO: 6732644 - DNA, 17 bp, Homo sapiens
cccctctcaggagccat

SEQ ID NO: 6732645 - DNA, 13 bp, Homo sapiens
cccctctcagtct

SEQ ID NO: 6732646 - DNA, 21 bp, Homo sapiens
cccctctcatcactgaaatcc

SEQ ID NO: 6732647 - DNA, 15 bp, Homo sapiens
cccctctccaggcct

SEQ ID NO: 6732648 - DNA, 19 bp, Homo sapiens
cccctctccaggcctgtca

SEQ ID NO: 6732649 - DNA, 17 bp, Homo sapiens
cccctctcccagttgtc

SEQ ID NO: 6732650 - DNA, 11 bp, Homo sapiens
cccctctcccc

SEQ ID NO: 6732651 - DNA, 13 bp, Homo sapiens
cccctctccctgg

SEQ ID NO: 6732652 - DNA, 14 bp, Homo sapiens
cccctctccctggg

SEQ ID NO: 6732653 - DNA, 15 bp, Homo sapiens
cccctctcccttggg

SEQ ID NO: 6732654 - DNA, 11 bp, Homo sapiens
cccctctcctc

SEQ ID NO: 6732655 - DNA, 14 bp, Homo sapiens
cccctctcctccca

SEQ ID NO: 6732656 - DNA, 15 bp, Homo sapiens
cccctctcctcccag

SEQ ID NO: 6732657 - DNA, 18 bp, Homo sapiens
cccctctcctcccagctg

SEQ ID NO: 6732658 - DNA, 18 bp, Homo sapiens
cccctctcctccccttcc

SEQ ID NO: 6732659 - DNA, 17 bp, Homo sapiens
cccctctcctggagggc

SEQ ID NO: 6732660 - DNA, 19 bp, Homo sapiens
cccctctccttcctgtgtg

SEQ ID NO: 6732661 - DNA, 13 bp, Homo sapiens
cccctctcgcccc

SEQ ID NO: 6732662 - DNA, 19 bp, Homo sapiens
cccctctctcacacatcac

SEQ ID NO: 6732663 - DNA, 12 bp, Homo sapiens
cccctctctcct

SEQ ID NO: 6732664 - DNA, 14 bp, Homo sapiens
cccctctctgcccc

SEQ ID NO: 6732665 - DNA, 15 bp, Homo sapiens
cccctctctgcccct

SEQ ID NO: 6732666 - DNA, 17 bp, Homo sapiens
cccctctctgcccctga

SEQ ID NO: 6732667 - DNA, 20 bp, Homo sapiens
cccctctcttaccccgtccc

SEQ ID NO: 6732668 - DNA, 21 bp, Homo sapiens
cccctctcttcgtcctgatcc

SEQ ID NO: 6732669 - DNA, 20 bp, Homo sapiens
cccctctgaaagttgtacat

SEQ ID NO: 6732670 - DNA, 15 bp, Homo sapiens
cccctctgacctgca

SEQ ID NO: 6732671 - DNA, 19 bp, Homo sapiens
cccctctgattgttcccga

SEQ ID NO: 6732672 - DNA, 18 bp, Homo sapiens
cccctctgcacccagaac

SEQ ID NO: 6732673 - DNA, 19 bp, Homo sapiens
cccctctgcacccagaaca

SEQ ID NO: 6732674 - DNA, 12 bp, Homo sapiens
cccctctgccca

SEQ ID NO: 6732675 - DNA, 13 bp, Homo sapiens
cccctctgcccag

SEQ ID NO: 6732676 - DNA, 15 bp, Homo sapiens
cccctctgccccacc

SEQ ID NO: 6732677 - DNA, 13 bp, Homo sapiens
cccctctgcccct

SEQ ID NO: 6732678 - DNA, 15 bp, Homo sapiens
cccctctgcccctgc

SEQ ID NO: 6732679 - DNA, 21 bp, Homo sapiens
cccctctgccggtcgggcagc

SEQ ID NO: 6732680 - DNA, 13 bp, Homo sapiens
cccctctgccttg

SEQ ID NO: 6732681 - DNA, 16 bp, Homo sapiens
cccctctgcgccccag

SEQ ID NO: 6732682 - DNA, 14 bp, Homo sapiens
cccctctgctgccg

SEQ ID NO: 6732683 - DNA, 12 bp, Homo sapiens
cccctctgctgg

SEQ ID NO: 6732684 - DNA, 14 bp, Homo sapiens
cccctctgcttctc

SEQ ID NO: 6732685 - DNA, 16 bp, Homo sapiens
cccctctggccaggat

SEQ ID NO: 6732686 - DNA, 18 bp, Homo sapiens
cccctctggctccagctg

SEQ ID NO: 6732687 - DNA, 19 bp, Homo sapiens
cccctctggtcgctcctgc

SEQ ID NO: 6732688 - DNA, 12 bp, Homo sapiens
cccctctggtgt

SEQ ID NO: 6732689 - DNA, 12 bp, Homo sapiens
cccctctgtcca

SEQ ID NO: 6732690 - DNA, 14 bp, Homo sapiens
cccctctgtccagg

SEQ ID NO: 6732691 - DNA, 16 bp, Homo sapiens
cccctctgtgtcctct

SEQ ID NO: 6732692 - DNA, 19 bp, Homo sapiens
cccctctgtgtcctctccc

SEQ ID NO: 6732693 - DNA, 19 bp, Homo sapiens
cccctcttattcctctagg

SEQ ID NO: 6732694 - DNA, 19 bp, Homo sapiens
cccctcttccagcttcttt

SEQ ID NO: 6732695 - DNA, 21 bp, Homo sapiens
cccctcttccctgtcttcccc

SEQ ID NO: 6732696 - DNA, 16 bp, Homo sapiens
cccctcttcctccctg

SEQ ID NO: 6732697 - DNA, 15 bp, Homo sapiens
cccctcttcctcttg

SEQ ID NO: 6732698 - DNA, 13 bp, Homo sapiens
cccctcttctgag

SEQ ID NO: 6732699 - DNA, 23 bp, Homo sapiens
cccctcttcttctgaagatcaga

SEQ ID NO: 6732700 - DNA, 19 bp, Homo sapiens
cccctcttcttctttcctt

SEQ ID NO: 6732701 - DNA, 12 bp, Homo sapiens
cccctcttgccc

SEQ ID NO: 6732702 - DNA, 13 bp, Homo sapiens
cccctcttgcccc

SEQ ID NO: 6732703 - DNA, 14 bp, Homo sapiens
cccctcttggagaa

SEQ ID NO: 6732704 - DNA, 12 bp, Homo sapiens
cccctctttctc

SEQ ID NO: 6732705 - DNA, 14 bp, Homo sapiens
cccctctttctctt

SEQ ID NO: 6732706 - DNA, 16 bp, Homo sapiens
cccctctttctctttc

SEQ ID NO: 6732707 - DNA, 21 bp, Homo sapiens
cccctctttgcacagcatgag

SEQ ID NO: 6732708 - DNA, 16 bp, Homo sapiens
cccctcttttggcctt

SEQ ID NO: 6732709 - DNA, 19 bp, Homo sapiens
cccctgaaacatgtgcccc

SEQ ID NO: 6732710 - DNA, 17 bp, Homo sapiens
cccctgaaacttatttt

SEQ ID NO: 6732711 - DNA, 16 bp, Homo sapiens
cccctgaaagcctcac

SEQ ID NO: 6732712 - DNA, 21 bp, Homo sapiens
cccctgaaagtgacagagacc

SEQ ID NO: 6732713 - DNA, 19 bp, Homo sapiens
cccctgaagtgaccccagc

SEQ ID NO: 6732714 - DNA, 24 bp, Homo sapiens
cccctgacagatctagttctcttc

SEQ ID NO: 6732715 - DNA, 16 bp, Homo sapiens
cccctgacagggccag

SEQ ID NO: 6732716 - DNA, 14 bp, Homo sapiens
cccctgacctcacc

SEQ ID NO: 6732717 - DNA, 17 bp, Homo sapiens
cccctgacctcaccttt

SEQ ID NO: 6732718 - DNA, 20 bp, Homo sapiens
cccctgacctgtgagcccag

SEQ ID NO: 6732719 - DNA, 18 bp, Homo sapiens
cccctgagaccaccccca

SEQ ID NO: 6732720 - DNA, 23 bp, Homo sapiens
cccctgagaccacccccaaacac

SEQ ID NO: 6732721 - DNA, 18 bp, Homo sapiens
cccctgagcaatgtctgt

SEQ ID NO: 6732722 - DNA, 21 bp, Homo sapiens
cccctgagcaatgtctgtgct

SEQ ID NO: 6732723 - DNA, 13 bp, Homo sapiens
cccctgagcccac

SEQ ID NO: 6732724 - DNA, 15 bp, Homo sapiens
cccctgagcccactg

SEQ ID NO: 6732725 - DNA, 19 bp, Homo sapiens
cccctgagcctgtgtcctg

SEQ ID NO: 6732726 - DNA, 22 bp, Homo sapiens
cccctgagcctgtgtcctgaag

SEQ ID NO: 6732727 - DNA, 21 bp, Homo sapiens
cccctgaggatcccctgtccc

SEQ ID NO: 6732728 - DNA, 17 bp, Homo sapiens
cccctgaggcagcccag

SEQ ID NO: 6732729 - DNA, 17 bp, Homo sapiens
cccctgaggtcatgcat

SEQ ID NO: 6732730 - DNA, 17 bp, Homo sapiens
cccctgagtccgcctgc

SEQ ID NO: 6732731 - DNA, 19 bp, Homo sapiens
cccctgagtccgcctgcgc

SEQ ID NO: 6732732 - DNA, 14 bp, Homo sapiens
cccctgatagaaga

SEQ ID NO: 6732733 - DNA, 18 bp, Homo sapiens
cccctgatcactcccagc

SEQ ID NO: 6732734 - DNA, 19 bp, Homo sapiens
cccctgatctctgacctct

SEQ ID NO: 6732735 - DNA, 19 bp, Homo sapiens
cccctgatgacgggatgct

SEQ ID NO: 6732736 - DNA, 15 bp, Homo sapiens
cccctgatgcagcct

SEQ ID NO: 6732737 - DNA, 13 bp, Homo sapiens
cccctgcaaagac

SEQ ID NO: 6732738 - DNA, 21 bp, Homo sapiens
cccctgcaacttccgctgagg

SEQ ID NO: 6732739 - DNA, 11 bp, Homo sapiens
cccctgcaatg

SEQ ID NO: 6732740 - DNA, 23 bp, Homo sapiens
cccctgcaatgcgtcttgtgaaa

SEQ ID NO: 6732741 - DNA, 19 bp, Homo sapiens
cccctgcacacacctgcac

SEQ ID NO: 6732742 - DNA, 20 bp, Homo sapiens
cccctgcacacacctgcaca

SEQ ID NO: 6732743 - DNA, 16 bp, Homo sapiens
cccctgcacagcaggc

SEQ ID NO: 6732744 - DNA, 23 bp, Homo sapiens
cccctgcacagcaggctgccagt

SEQ ID NO: 6732745 - DNA, 15 bp, Homo sapiens
cccctgcacccaccc

SEQ ID NO: 6732746 - DNA, 16 bp, Homo sapiens
cccctgcacccacccc

SEQ ID NO: 6732747 - DNA, 22 bp, Homo sapiens
cccctgcacccacccctgccca

SEQ ID NO: 6732748 - DNA, 19 bp, Homo sapiens
cccctgcacctgcttctca

SEQ ID NO: 6732749 - DNA, 13 bp, Homo sapiens
cccctgcactcca

SEQ ID NO: 6732750 - DNA, 19 bp, Homo sapiens
cccctgcagattctgagca

SEQ ID NO: 6732751 - DNA, 22 bp, Homo sapiens
cccctgcagattctgagcaaag

SEQ ID NO: 6732752 - DNA, 13 bp, Homo sapiens
cccctgcagcacg

SEQ ID NO: 6732753 - DNA, 22 bp, Homo sapiens
cccctgcagcccaggccagtca

SEQ ID NO: 6732754 - DNA, 21 bp, Homo sapiens
cccctgcagccgtgcaggact

SEQ ID NO: 6732755 - DNA, 22 bp, Homo sapiens
cccctgcagccgtgcaggactc

SEQ ID NO: 6732756 - DNA, 14 bp, Homo sapiens
cccctgcagcctgg

SEQ ID NO: 6732757 - DNA, 16 bp, Homo sapiens
cccctgcagcctgggt

SEQ ID NO: 6732758 - DNA, 13 bp, Homo sapiens
cccctgcagctgg

SEQ ID NO: 6732759 - DNA, 11 bp, Homo sapiens
cccctgcaggg

SEQ ID NO: 6732760 - DNA, 20 bp, Homo sapiens
cccctgcagttcccctggaa

SEQ ID NO: 6732761 - DNA, 24 bp, Homo sapiens
cccctgcatctatcgagtttgcaa

SEQ ID NO: 6732762 - DNA, 14 bp, Homo sapiens
cccctgcatgcctg

SEQ ID NO: 6732763 - DNA, 19 bp, Homo sapiens
cccctgcatgcctggcccc

SEQ ID NO: 6732764 - DNA, 22 bp, Homo sapiens
cccctgcatgcctggcccctcc

SEQ ID NO: 6732765 - DNA, 21 bp, Homo sapiens
cccctgcattggaactggagg

SEQ ID NO: 6732766 - DNA, 22 bp, Homo sapiens
cccctgcattggaactggaggc

SEQ ID NO: 6732767 - DNA, 14 bp, Homo sapiens
cccctgccaaggcc

SEQ ID NO: 6732768 - DNA, 12 bp, Homo sapiens
cccctgccacca

SEQ ID NO: 6732769 - DNA, 20 bp, Homo sapiens
cccctgccaccaggccacct

SEQ ID NO: 6732770 - DNA, 16 bp, Homo sapiens
cccctgccaccctggg

SEQ ID NO: 6732771 - DNA, 15 bp, Homo sapiens
cccctgccaccgact

SEQ ID NO: 6732772 - DNA, 21 bp, Homo sapiens
cccctgccagaggcctggtgc

SEQ ID NO: 6732773 - DNA, 23 bp, Homo sapiens
cccctgccagaggcctggtgccc

SEQ ID NO: 6732774 - DNA, 15 bp, Homo sapiens
cccctgccagtgcct

SEQ ID NO: 6732775 - DNA, 16 bp, Homo sapiens
cccctgccagtgcctt

SEQ ID NO: 6732776 - DNA, 17 bp, Homo sapiens
cccctgcccagcacctc

SEQ ID NO: 6732777 - DNA, 15 bp, Homo sapiens
cccctgcccagcctg

SEQ ID NO: 6732778 - DNA, 18 bp, Homo sapiens
cccctgcccagcctgctc

SEQ ID NO: 6732779 - DNA, 17 bp, Homo sapiens
cccctgccccagagaag

SEQ ID NO: 6732780 - DNA, 16 bp, Homo sapiens
cccctgcccccaggac

SEQ ID NO: 6732781 - DNA, 17 bp, Homo sapiens
cccctgcccccaggact

SEQ ID NO: 6732782 - DNA, 23 bp, Homo sapiens
cccctgcccccaggactgggcca

SEQ ID NO: 6732783 - DNA, 18 bp, Homo sapiens
cccctgccccctgcagga

SEQ ID NO: 6732784 - DNA, 17 bp, Homo sapiens
cccctgcccgagagctc

SEQ ID NO: 6732785 - DNA, 19 bp, Homo sapiens
cccctgcccggctgcggaa

SEQ ID NO: 6732786 - DNA, 17 bp, Homo sapiens
cccctgccctcggccat

SEQ ID NO: 6732787 - DNA, 17 bp, Homo sapiens
cccctgccctggtccag

SEQ ID NO: 6732788 - DNA, 15 bp, Homo sapiens
cccctgccctgtggg

SEQ ID NO: 6732789 - DNA, 12 bp, Homo sapiens
cccctgccgcct

SEQ ID NO: 6732790 - DNA, 18 bp, Homo sapiens
cccctgccgcctgtgccc

SEQ ID NO: 6732791 - DNA, 17 bp, Homo sapiens
cccctgccggccggggc

SEQ ID NO: 6732792 - DNA, 13 bp, Homo sapiens
cccctgccggcct

SEQ ID NO: 6732793 - DNA, 15 bp, Homo sapiens
cccctgccggccttg

SEQ ID NO: 6732794 - DNA, 16 bp, Homo sapiens
cccctgccggccttgg

SEQ ID NO: 6732795 - DNA, 23 bp, Homo sapiens
cccctgccggccttggccttggg

SEQ ID NO: 6732796 - DNA, 19 bp, Homo sapiens
cccctgccggtgcacaggc

SEQ ID NO: 6732797 - DNA, 22 bp, Homo sapiens
cccctgcctccaccctctgagc

SEQ ID NO: 6732798 - DNA, 17 bp, Homo sapiens
cccctgcctcccattct

SEQ ID NO: 6732799 - DNA, 12 bp, Homo sapiens
cccctgcctcct

SEQ ID NO: 6732800 - DNA, 13 bp, Homo sapiens
cccctgcctcctg

SEQ ID NO: 6732801 - DNA, 16 bp, Homo sapiens
cccctgcctcctgcca

SEQ ID NO: 6732802 - DNA, 18 bp, Homo sapiens
cccctgcctcctgccacc

SEQ ID NO: 6732803 - DNA, 20 bp, Homo sapiens
cccctgcctcctgcctcccg

SEQ ID NO: 6732804 - DNA, 22 bp, Homo sapiens
cccctgcctcgagggccgcctg

SEQ ID NO: 6732805 - DNA, 12 bp, Homo sapiens
cccctgcctgac

SEQ ID NO: 6732806 - DNA, 15 bp, Homo sapiens
cccctgcctgacagc

SEQ ID NO: 6732807 - DNA, 13 bp, Homo sapiens
cccctgcctgcca

SEQ ID NO: 6732808 - DNA, 19 bp, Homo sapiens
cccctgcctgccctgtcag

SEQ ID NO: 6732809 - DNA, 14 bp, Homo sapiens
cccctgcctgcctt

SEQ ID NO: 6732810 - DNA, 15 bp, Homo sapiens
cccctgcctgggttt

SEQ ID NO: 6732811 - DNA, 23 bp, Homo sapiens
cccctgcctggttctaggctgct

SEQ ID NO: 6732812 - DNA, 22 bp, Homo sapiens
cccctgcctgttggcaggccca

SEQ ID NO: 6732813 - DNA, 15 bp, Homo sapiens
cccctgcgcaggccc

SEQ ID NO: 6732814 - DNA, 17 bp, Homo sapiens
cccctgcgccctccctc

SEQ ID NO: 6732815 - DNA, 18 bp, Homo sapiens
cccctgcggagctgcatg

SEQ ID NO: 6732816 - DNA, 16 bp, Homo sapiens
cccctgcgtcgagctg

SEQ ID NO: 6732817 - DNA, 22 bp, Homo sapiens
cccctgctactccactgacctg

SEQ ID NO: 6732818 - DNA, 18 bp, Homo sapiens
cccctgctcactgggccc

SEQ ID NO: 6732819 - DNA, 14 bp, Homo sapiens
cccctgctcagcaa

SEQ ID NO: 6732820 - DNA, 20 bp, Homo sapiens
cccctgctccaccagcagca

SEQ ID NO: 6732821 - DNA, 12 bp, Homo sapiens
cccctgctccca

SEQ ID NO: 6732822 - DNA, 17 bp, Homo sapiens
cccctgctcccagcctg

SEQ ID NO: 6732823 - DNA, 18 bp, Homo sapiens
cccctgctcccagcctgc

SEQ ID NO: 6732824 - DNA, 20 bp, Homo sapiens
cccctgctctgtagccacct

SEQ ID NO: 6732825 - DNA, 13 bp, Homo sapiens
cccctgctgccca

SEQ ID NO: 6732826 - DNA, 16 bp, Homo sapiens
cccctgctgcccagtg

SEQ ID NO: 6732827 - DNA, 23 bp, Homo sapiens
cccctgctgccgccactggctgt

SEQ ID NO: 6732828 - DNA, 13 bp, Homo sapiens
cccctgctgcctc

SEQ ID NO: 6732829 - DNA, 14 bp, Homo sapiens
cccctgctgcctcc

SEQ ID NO: 6732830 - DNA, 23 bp, Homo sapiens
cccctgctgctcctcggccagag

SEQ ID NO: 6732831 - DNA, 21 bp, Homo sapiens
cccctgctgctgtcacctctc

SEQ ID NO: 6732832 - DNA, 22 bp, Homo sapiens
cccctgctggctcttctgccca

SEQ ID NO: 6732833 - DNA, 17 bp, Homo sapiens
cccctgctgggtgtggc

SEQ ID NO: 6732834 - DNA, 15 bp, Homo sapiens
cccctgctggttcag

SEQ ID NO: 6732835 - DNA, 21 bp, Homo sapiens
cccctgctgtctctctgggct

SEQ ID NO: 6732836 - DNA, 18 bp, Homo sapiens
cccctgctgtgctgctca

SEQ ID NO: 6732837 - DNA, 23 bp, Homo sapiens
cccctgcttcagatgtggagcca

SEQ ID NO: 6732838 - DNA, 15 bp, Homo sapiens
cccctgcttctccag

SEQ ID NO: 6732839 - DNA, 18 bp, Homo sapiens
cccctgcttctccagcct

SEQ ID NO: 6732840 - DNA, 14 bp, Homo sapiens
cccctgctttgccc

SEQ ID NO: 6732841 - DNA, 14 bp, Homo sapiens
cccctgctttgggc

SEQ ID NO: 6732842 - DNA, 12 bp, Homo sapiens
cccctggaacct

SEQ ID NO: 6732843 - DNA, 17 bp, Homo sapiens
cccctggaagagcccag

SEQ ID NO: 6732844 - DNA, 22 bp, Homo sapiens
cccctggaagagcccagtctgt

SEQ ID NO: 6732845 - DNA, 18 bp, Homo sapiens
cccctggaagcagtgccc

SEQ ID NO: 6732846 - DNA, 19 bp, Homo sapiens
cccctggaagcagtgccca

SEQ ID NO: 6732847 - DNA, 20 bp, Homo sapiens
cccctggaagcagtgcccag

SEQ ID NO: 6732848 - DNA, 16 bp, Homo sapiens
cccctggacatgcctg

SEQ ID NO: 6732849 - DNA, 18 bp, Homo sapiens
cccctggacatgcctgtc

SEQ ID NO: 6732850 - DNA, 20 bp, Homo sapiens
cccctggacatgcctgtcct

SEQ ID NO: 6732851 - DNA, 16 bp, Homo sapiens
cccctggaccacacct

SEQ ID NO: 6732852 - DNA, 14 bp, Homo sapiens
cccctggaccccag

SEQ ID NO: 6732853 - DNA, 19 bp, Homo sapiens
cccctggaccccagcctca

SEQ ID NO: 6732854 - DNA, 17 bp, Homo sapiens
cccctggacccctgggg

SEQ ID NO: 6732855 - DNA, 21 bp, Homo sapiens
cccctggagtgtgtcagagcc

SEQ ID NO: 6732856 - DNA, 14 bp, Homo sapiens
cccctggatgaagt

SEQ ID NO: 6732857 - DNA, 18 bp, Homo sapiens
cccctggatgcagcctca

SEQ ID NO: 6732858 - DNA, 22 bp, Homo sapiens
cccctggatgtcccctgtccca

SEQ ID NO: 6732859 - DNA, 21 bp, Homo sapiens
cccctggcacgtcctccaccg

SEQ ID NO: 6732860 - DNA, 14 bp, Homo sapiens
cccctggcactgca

SEQ ID NO: 6732861 - DNA, 16 bp, Homo sapiens
cccctggcactgcagg

SEQ ID NO: 6732862 - DNA, 16 bp, Homo sapiens
cccctggcactggcaa

SEQ ID NO: 6732863 - DNA, 22 bp, Homo sapiens
cccctggcagagatgcctccct

SEQ ID NO: 6732864 - DNA, 17 bp, Homo sapiens
cccctggcagctgcccc

SEQ ID NO: 6732865 - DNA, 18 bp, Homo sapiens
cccctggcagctgcccct

SEQ ID NO: 6732866 - DNA, 14 bp, Homo sapiens
cccctggcagtgct

SEQ ID NO: 6732867 - DNA, 14 bp, Homo sapiens
cccctggcatgttt

SEQ ID NO: 6732868 - DNA, 11 bp, Homo sapiens
cccctggccac

SEQ ID NO: 6732869 - DNA, 13 bp, Homo sapiens
cccctggccacag

SEQ ID NO: 6732870 - DNA, 18 bp, Homo sapiens
cccctggccagctctgag

SEQ ID NO: 6732871 - DNA, 19 bp, Homo sapiens
cccctggccccgcctgcct

SEQ ID NO: 6732872 - DNA, 19 bp, Homo sapiens
cccctggccctgcctcact

SEQ ID NO: 6732873 - DNA, 22 bp, Homo sapiens
cccctggccctgcctcactgtg

SEQ ID NO: 6732874 - DNA, 16 bp, Homo sapiens
cccctggccgcgctcc

SEQ ID NO: 6732875 - DNA, 12 bp, Homo sapiens
cccctggcctcc

SEQ ID NO: 6732876 - DNA, 19 bp, Homo sapiens
cccctggcctcccccactt

SEQ ID NO: 6732877 - DNA, 20 bp, Homo sapiens
cccctggctccaggccaggg

SEQ ID NO: 6732878 - DNA, 15 bp, Homo sapiens
cccctggctctgggc

SEQ ID NO: 6732879 - DNA, 21 bp, Homo sapiens
cccctggctgaacagtgctct

SEQ ID NO: 6732880 - DNA, 20 bp, Homo sapiens
cccctggctgactggccagt

SEQ ID NO: 6732881 - DNA, 22 bp, Homo sapiens
cccctggctgactggccagttg

SEQ ID NO: 6732882 - DNA, 15 bp, Homo sapiens
cccctggctggctcc

SEQ ID NO: 6732883 - DNA, 16 bp, Homo sapiens
cccctggctttgcctc

SEQ ID NO: 6732884 - DNA, 17 bp, Homo sapiens
cccctggctttgcctct

SEQ ID NO: 6732885 - DNA, 21 bp, Homo sapiens
cccctgggaactctcctggcc

SEQ ID NO: 6732886 - DNA, 21 bp, Homo sapiens
cccctgggatgctgacccagg

SEQ ID NO: 6732887 - DNA, 20 bp, Homo sapiens
cccctgggctaccatctgca

SEQ ID NO: 6732888 - DNA, 13 bp, Homo sapiens
cccctgggctctc

SEQ ID NO: 6732889 - DNA, 14 bp, Homo sapiens
cccctgggctctca

SEQ ID NO: 6732890 - DNA, 19 bp, Homo sapiens
cccctgggctctcacccag

SEQ ID NO: 6732891 - DNA, 21 bp, Homo sapiens
cccctgggctctgccccagct

SEQ ID NO: 6732892 - DNA, 23 bp, Homo sapiens
cccctgggctctgccccagctct

SEQ ID NO: 6732893 - DNA, 11 bp, Homo sapiens
cccctgggctg

SEQ ID NO: 6732894 - DNA, 21 bp, Homo sapiens
cccctgggctggggcctcaga

SEQ ID NO: 6732895 - DNA, 19 bp, Homo sapiens
cccctgggcttggcctgct

SEQ ID NO: 6732896 - DNA, 20 bp, Homo sapiens
cccctgggcttggcctgctg

SEQ ID NO: 6732897 - DNA, 22 bp, Homo sapiens
cccctgggcttggcctgctgtg

SEQ ID NO: 6732898 - DNA, 23 bp, Homo sapiens
cccctgggcttggcctgctgtga

SEQ ID NO: 6732899 - DNA, 17 bp, Homo sapiens
cccctggggacagagcc

SEQ ID NO: 6732900 - DNA, 15 bp, Homo sapiens
cccctggggacccac

SEQ ID NO: 6732901 - DNA, 23 bp, Homo sapiens
cccctggggagaacccttcctgc

SEQ ID NO: 6732902 - DNA, 18 bp, Homo sapiens
cccctggggatcacagcc

SEQ ID NO: 6732903 - DNA, 11 bp, Homo sapiens
cccctggggcc

SEQ ID NO: 6732904 - DNA, 23 bp, Homo sapiens
cccctggggcctagactctgtaa

SEQ ID NO: 6732905 - DNA, 20 bp, Homo sapiens
cccctggggctgagtctcca

SEQ ID NO: 6732906 - DNA, 20 bp, Homo sapiens
cccctgggggctagcagaag

SEQ ID NO: 6732907 - DNA, 19 bp, Homo sapiens
cccctgggggctctcatgt

SEQ ID NO: 6732908 - DNA, 15 bp, Homo sapiens
cccctggggggcaca

SEQ ID NO: 6732909 - DNA, 18 bp, Homo sapiens
cccctggggggcacagcc

SEQ ID NO: 6732910 - DNA, 19 bp, Homo sapiens
cccctggggtacttctgtg

SEQ ID NO: 6732911 - DNA, 12 bp, Homo sapiens
cccctggggtgg

SEQ ID NO: 6732912 - DNA, 16 bp, Homo sapiens
cccctggggtggccag

SEQ ID NO: 6732913 - DNA, 21 bp, Homo sapiens
cccctggggtgggatctgagc

SEQ ID NO: 6732914 - DNA, 18 bp, Homo sapiens
cccctgggtcctccaaag

SEQ ID NO: 6732915 - DNA, 15 bp, Homo sapiens
cccctgggtttcttt

SEQ ID NO: 6732916 - DNA, 23 bp, Homo sapiens
cccctggtactcccccagccctc

SEQ ID NO: 6732917 - DNA, 22 bp, Homo sapiens
cccctggtcaccgagactcagc

SEQ ID NO: 6732918 - DNA, 17 bp, Homo sapiens
cccctggtcccctcctt

SEQ ID NO: 6732919 - DNA, 18 bp, Homo sapiens
cccctggtccctctgcag

SEQ ID NO: 6732920 - DNA, 13 bp, Homo sapiens
cccctggtcctgc

SEQ ID NO: 6732921 - DNA, 15 bp, Homo sapiens
cccctggtctttgag

SEQ ID NO: 6732922 - DNA, 22 bp, Homo sapiens
cccctggtggaatgcgggggag

SEQ ID NO: 6732923 - DNA, 20 bp, Homo sapiens
cccctggtggacagtcctgg

SEQ ID NO: 6732924 - DNA, 11 bp, Homo sapiens
cccctggtggc

SEQ ID NO: 6732925 - DNA, 19 bp, Homo sapiens
cccctggtggctgcaggca

SEQ ID NO: 6732926 - DNA, 23 bp, Homo sapiens
cccctggtggttcactcttggag

SEQ ID NO: 6732927 - DNA, 20 bp, Homo sapiens
cccctggtgtccctgcctgg

SEQ ID NO: 6732928 - DNA, 21 bp, Homo sapiens
cccctggtgtccctgcctggc

SEQ ID NO: 6732929 - DNA, 15 bp, Homo sapiens
cccctggttctcatc

SEQ ID NO: 6732930 - DNA, 19 bp, Homo sapiens
cccctgtaaacacagtgct

SEQ ID NO: 6732931 - DNA, 19 bp, Homo sapiens
cccctgtaatcaggcaagg

SEQ ID NO: 6732932 - DNA, 11 bp, Homo sapiens
cccctgtacac

SEQ ID NO: 6732933 - DNA, 19 bp, Homo sapiens
cccctgtacccagccacct

SEQ ID NO: 6732934 - DNA, 17 bp, Homo sapiens
cccctgtacccagctcc

SEQ ID NO: 6732935 - DNA, 22 bp, Homo sapiens
cccctgtcccaccaactctgca

SEQ ID NO: 6732936 - DNA, 20 bp, Homo sapiens
cccctgtcccacccacacag

SEQ ID NO: 6732937 - DNA, 17 bp, Homo sapiens
cccctgtcccctggggc

SEQ ID NO: 6732938 - DNA, 12 bp, Homo sapiens
cccctgtcctga

SEQ ID NO: 6732939 - DNA, 14 bp, Homo sapiens
cccctgtcctgtga

SEQ ID NO: 6732940 - DNA, 20 bp, Homo sapiens
cccctgtcgcccacccagct

SEQ ID NO: 6732941 - DNA, 18 bp, Homo sapiens
cccctgtctagagaggga

SEQ ID NO: 6732942 - DNA, 22 bp, Homo sapiens
cccctgtctctaaggagcagcg

SEQ ID NO: 6732943 - DNA, 15 bp, Homo sapiens
cccctgtctggaaga

SEQ ID NO: 6732944 - DNA, 19 bp, Homo sapiens
cccctgtcttcacctgcca

SEQ ID NO: 6732945 - DNA, 20 bp, Homo sapiens
cccctgtcttctctcaaagg

SEQ ID NO: 6732946 - DNA, 11 bp, Homo sapiens
cccctgtgcag

SEQ ID NO: 6732947 - DNA, 20 bp, Homo sapiens
cccctgtgcagccgctgagc

SEQ ID NO: 6732948 - DNA, 17 bp, Homo sapiens
cccctgtgccagctcag

SEQ ID NO: 6732949 - DNA, 13 bp, Homo sapiens
cccctgtgcccac

SEQ ID NO: 6732950 - DNA, 17 bp, Homo sapiens
cccctgtgcccacccag

SEQ ID NO: 6732951 - DNA, 16 bp, Homo sapiens
cccctgtgcctctgtc

SEQ ID NO: 6732952 - DNA, 17 bp, Homo sapiens
cccctgtgcctgctggg

SEQ ID NO: 6732953 - DNA, 18 bp, Homo sapiens
cccctgtgcctgctgggc

SEQ ID NO: 6732954 - DNA, 19 bp, Homo sapiens
cccctgtgcctgctgggca

SEQ ID NO: 6732955 - DNA, 19 bp, Homo sapiens
cccctgtggatgctgctgc

SEQ ID NO: 6732956 - DNA, 16 bp, Homo sapiens
cccctgtggcagaccg

SEQ ID NO: 6732957 - DNA, 20 bp, Homo sapiens
cccctgtggccaactgcaaa

SEQ ID NO: 6732958 - DNA, 18 bp, Homo sapiens
cccctgtggggatctcag

SEQ ID NO: 6732959 - DNA, 21 bp, Homo sapiens
cccctgtggggatctcagggg

SEQ ID NO: 6732960 - DNA, 17 bp, Homo sapiens
cccctgtggtctgtgtg

SEQ ID NO: 6732961 - DNA, 22 bp, Homo sapiens
cccctgtgtgagttgagtctcc

SEQ ID NO: 6732962 - DNA, 16 bp, Homo sapiens
cccctgtgtggccctg

SEQ ID NO: 6732963 - DNA, 17 bp, Homo sapiens
cccctgtgtgggagggc

SEQ ID NO: 6732964 - DNA, 14 bp, Homo sapiens
cccctgttcatgcc

SEQ ID NO: 6732965 - DNA, 15 bp, Homo sapiens
cccctgttccctgtt

SEQ ID NO: 6732966 - DNA, 13 bp, Homo sapiens
cccctgttgaggt

SEQ ID NO: 6732967 - DNA, 23 bp, Homo sapiens
cccctgttgaggtgggtgggcct

SEQ ID NO: 6732968 - DNA, 19 bp, Homo sapiens
cccctgtttcaatcactgt

SEQ ID NO: 6732969 - DNA, 15 bp, Homo sapiens
cccctgtttgcatga

SEQ ID NO: 6732970 - DNA, 19 bp, Homo sapiens
cccctgttttctgctgttt

SEQ ID NO: 6732971 - DNA, 20 bp, Homo sapiens
ccccttaaacttccaaagct

SEQ ID NO: 6732972 - DNA, 22 bp, Homo sapiens
ccccttaagggttgaaggcagt

SEQ ID NO: 6732973 - DNA, 21 bp, Homo sapiens
ccccttaatcttgctttcttt

SEQ ID NO: 6732974 - DNA, 14 bp, Homo sapiens
ccccttaccactgc

SEQ ID NO: 6732975 - DNA, 15 bp, Homo sapiens
ccccttactgagcgc

SEQ ID NO: 6732976 - DNA, 17 bp, Homo sapiens
ccccttagacagaggcc

SEQ ID NO: 6732977 - DNA, 10 bp, Homo sapiens
ccccttagat

SEQ ID NO: 6732978 - DNA, 20 bp, Homo sapiens
ccccttagccagttgtatat

SEQ ID NO: 6732979 - DNA, 14 bp, Homo sapiens
ccccttatccagga

SEQ ID NO: 6732980 - DNA, 16 bp, Homo sapiens
ccccttatccaggact

SEQ ID NO: 6732981 - DNA, 17 bp, Homo sapiens
ccccttatcctccctgt

SEQ ID NO: 6732982 - DNA, 18 bp, Homo sapiens
ccccttatcctccctgta

SEQ ID NO: 6732983 - DNA, 20 bp, Homo sapiens
ccccttatcgtcccctgtga

SEQ ID NO: 6732984 - DNA, 18 bp, Homo sapiens
ccccttattgctgccaaa

SEQ ID NO: 6732985 - DNA, 19 bp, Homo sapiens
ccccttattgctgccaaaa

SEQ ID NO: 6732986 - DNA, 20 bp, Homo sapiens
ccccttcaacaaacagtgta

SEQ ID NO: 6732987 - DNA, 22 bp, Homo sapiens
ccccttcacttctgaccacact

SEQ ID NO: 6732988 - DNA, 13 bp, Homo sapiens
ccccttcagctcc

SEQ ID NO: 6732989 - DNA, 15 bp, Homo sapiens
ccccttcagctcctg

SEQ ID NO: 6732990 - DNA, 16 bp, Homo sapiens
ccccttcagctcctga

SEQ ID NO: 6732991 - DNA, 13 bp, Homo sapiens
ccccttcagtgcc

SEQ ID NO: 6732992 - DNA, 17 bp, Homo sapiens
ccccttcatccatcctg

SEQ ID NO: 6732993 - DNA, 20 bp, Homo sapiens
ccccttccatggactttgtt

SEQ ID NO: 6732994 - DNA, 23 bp, Homo sapiens
ccccttccatggtactgtagcag

SEQ ID NO: 6732995 - DNA, 13 bp, Homo sapiens
ccccttccatgtg

SEQ ID NO: 6732996 - DNA, 14 bp, Homo sapiens
ccccttccatgtgg

SEQ ID NO: 6732997 - DNA, 13 bp, Homo sapiens
ccccttcccagac

SEQ ID NO: 6732998 - DNA, 15 bp, Homo sapiens
ccccttcccagaccc

SEQ ID NO: 6732999 - DNA, 22 bp, Homo sapiens
ccccttcccagaccccgcagca

SEQ ID NO: 6733000 - DNA, 19 bp, Homo sapiens
ccccttccccactgcctgc

SEQ ID NO: 6733001 - DNA, 14 bp, Homo sapiens
ccccttccccagcc

SEQ ID NO: 6733002 - DNA, 16 bp, Homo sapiens
ccccttccccagccct

SEQ ID NO: 6733003 - DNA, 17 bp, Homo sapiens
ccccttccccagccctt

SEQ ID NO: 6733004 - DNA, 22 bp, Homo sapiens
ccccttccccgtcccctgcagc

SEQ ID NO: 6733005 - DNA, 15 bp, Homo sapiens
ccccttcccctgcgc

SEQ ID NO: 6733006 - DNA, 16 bp, Homo sapiens
ccccttcccctgctga

SEQ ID NO: 6733007 - DNA, 17 bp, Homo sapiens
ccccttcccgccttcag

SEQ ID NO: 6733008 - DNA, 18 bp, Homo sapiens
ccccttccctgcaaacat

SEQ ID NO: 6733009 - DNA, 15 bp, Homo sapiens
ccccttccctggcag

SEQ ID NO: 6733010 - DNA, 16 bp, Homo sapiens
ccccttccctgggagg

SEQ ID NO: 6733011 - DNA, 16 bp, Homo sapiens
ccccttccctggggag

SEQ ID NO: 6733012 - DNA, 13 bp, Homo sapiens
ccccttcccttgg

SEQ ID NO: 6733013 - DNA, 14 bp, Homo sapiens
ccccttccgccact

SEQ ID NO: 6733014 - DNA, 16 bp, Homo sapiens
ccccttccgccactgg

SEQ ID NO: 6733015 - DNA, 17 bp, Homo sapiens
ccccttccgccactggg

SEQ ID NO: 6733016 - DNA, 15 bp, Homo sapiens
ccccttcctagtgaa

SEQ ID NO: 6733017 - DNA, 10 bp, Homo sapiens
ccccttcctg

SEQ ID NO: 6733018 - DNA, 14 bp, Homo sapiens
ccccttcctgcacc

SEQ ID NO: 6733019 - DNA, 18 bp, Homo sapiens
ccccttcctggacacact

SEQ ID NO: 6733020 - DNA, 19 bp, Homo sapiens
ccccttcctggacacactc

SEQ ID NO: 6733021 - DNA, 20 bp, Homo sapiens
ccccttcctggacacactct

SEQ ID NO: 6733022 - DNA, 12 bp, Homo sapiens
ccccttcctggc

SEQ ID NO: 6733023 - DNA, 12 bp, Homo sapiens
ccccttcctgtc

SEQ ID NO: 6733024 - DNA, 14 bp, Homo sapiens
ccccttcctgtcct

SEQ ID NO: 6733025 - DNA, 15 bp, Homo sapiens
ccccttcctgtcctg

SEQ ID NO: 6733026 - DNA, 16 bp, Homo sapiens
ccccttcctgtcctgc

SEQ ID NO: 6733027 - DNA, 18 bp, Homo sapiens
ccccttcctgtcctgcct

SEQ ID NO: 6733028 - DNA, 21 bp, Homo sapiens
ccccttcctgtcctgcctcct

SEQ ID NO: 6733029 - DNA, 23 bp, Homo sapiens
ccccttcctgtcctgcctcctca

SEQ ID NO: 6733030 - DNA, 14 bp, Homo sapiens
ccccttcctgtctc

SEQ ID NO: 6733031 - DNA, 15 bp, Homo sapiens
ccccttcctgtctca

SEQ ID NO: 6733032 - DNA, 23 bp, Homo sapiens
ccccttcctgtctcactcttctg

SEQ ID NO: 6733033 - DNA, 12 bp, Homo sapiens
ccccttcctgtt

SEQ ID NO: 6733034 - DNA, 13 bp, Homo sapiens
ccccttcctttcc

SEQ ID NO: 6733035 - DNA, 21 bp, Homo sapiens
ccccttcctttcctctgcagc

SEQ ID NO: 6733036 - DNA, 22 bp, Homo sapiens
ccccttcctttggtgcctcact

SEQ ID NO: 6733037 - DNA, 13 bp, Homo sapiens
ccccttcctttta

SEQ ID NO: 6733038 - DNA, 19 bp, Homo sapiens
ccccttcgaggttgcccct

SEQ ID NO: 6733039 - DNA, 15 bp, Homo sapiens
ccccttcgctcctgt

SEQ ID NO: 6733040 - DNA, 17 bp, Homo sapiens
ccccttcgctcctgtgt

SEQ ID NO: 6733041 - DNA, 13 bp, Homo sapiens
ccccttcgggagc

SEQ ID NO: 6733042 - DNA, 19 bp, Homo sapiens
ccccttcgtgtgtccatgt

SEQ ID NO: 6733043 - DNA, 20 bp, Homo sapiens
ccccttctatgctgcttcca

SEQ ID NO: 6733044 - DNA, 14 bp, Homo sapiens
ccccttctccagca

SEQ ID NO: 6733045 - DNA, 14 bp, Homo sapiens
ccccttctctcctc

SEQ ID NO: 6733046 - DNA, 15 bp, Homo sapiens
ccccttctctcctcc

SEQ ID NO: 6733047 - DNA, 13 bp, Homo sapiens
ccccttctctctc

SEQ ID NO: 6733048 - DNA, 18 bp, Homo sapiens
ccccttctctgcccattc

SEQ ID NO: 6733049 - DNA, 17 bp, Homo sapiens
ccccttctctgcctcac

SEQ ID NO: 6733050 - DNA, 17 bp, Homo sapiens
ccccttctctgtagctg

SEQ ID NO: 6733051 - DNA, 21 bp, Homo sapiens
ccccttctgctcagctctggg

SEQ ID NO: 6733052 - DNA, 14 bp, Homo sapiens
ccccttctgggcat

SEQ ID NO: 6733053 - DNA, 22 bp, Homo sapiens
ccccttctgggcatctgttctg

SEQ ID NO: 6733054 - DNA, 19 bp, Homo sapiens
ccccttcttcctcccctca

SEQ ID NO: 6733055 - DNA, 12 bp, Homo sapiens
ccccttgaagca

SEQ ID NO: 6733056 - DNA, 14 bp, Homo sapiens
ccccttgaagcaat

SEQ ID NO: 6733057 - DNA, 16 bp, Homo sapiens
ccccttgaagcaataa

SEQ ID NO: 6733058 - DNA, 15 bp, Homo sapiens
ccccttgaccccaca

SEQ ID NO: 6733059 - DNA, 17 bp, Homo sapiens
ccccttgaccccacacg

SEQ ID NO: 6733060 - DNA, 22 bp, Homo sapiens
ccccttgaggtctcagcccctt

SEQ ID NO: 6733061 - DNA, 18 bp, Homo sapiens
ccccttgattcccaccgt

SEQ ID NO: 6733062 - DNA, 21 bp, Homo sapiens
ccccttgatttaaacacacag

SEQ ID NO: 6733063 - DNA, 20 bp, Homo sapiens
ccccttgccaccccaccctc

SEQ ID NO: 6733064 - DNA, 13 bp, Homo sapiens
ccccttgcccagg

SEQ ID NO: 6733065 - DNA, 14 bp, Homo sapiens
ccccttgcccaggc

SEQ ID NO: 6733066 - DNA, 19 bp, Homo sapiens
ccccttgcccaggcctccc

SEQ ID NO: 6733067 - DNA, 23 bp, Homo sapiens
ccccttgcccagggctcagcctg

SEQ ID NO: 6733068 - DNA, 19 bp, Homo sapiens
ccccttgcccgccagccag

SEQ ID NO: 6733069 - DNA, 13 bp, Homo sapiens
ccccttgccctcc

SEQ ID NO: 6733070 - DNA, 21 bp, Homo sapiens
ccccttgcccttgccctgacc

SEQ ID NO: 6733071 - DNA, 17 bp, Homo sapiens
ccccttgccttcccctg

SEQ ID NO: 6733072 - DNA, 19 bp, Homo sapiens
ccccttgccttcccctgtc

SEQ ID NO: 6733073 - DNA, 16 bp, Homo sapiens
ccccttgctcccttca

SEQ ID NO: 6733074 - DNA, 13 bp, Homo sapiens
ccccttgctctct

SEQ ID NO: 6733075 - DNA, 14 bp, Homo sapiens
ccccttgctgctgg

SEQ ID NO: 6733076 - DNA, 22 bp, Homo sapiens
ccccttggaaatgtctgctggt

SEQ ID NO: 6733077 - DNA, 17 bp, Homo sapiens
ccccttggacctccagg

SEQ ID NO: 6733078 - DNA, 13 bp, Homo sapiens
ccccttggagaga

SEQ ID NO: 6733079 - DNA, 22 bp, Homo sapiens
ccccttggaggagagagacccc

SEQ ID NO: 6733080 - DNA, 14 bp, Homo sapiens
ccccttggcactgt

SEQ ID NO: 6733081 - DNA, 17 bp, Homo sapiens
ccccttggcgggcagcc

SEQ ID NO: 6733082 - DNA, 22 bp, Homo sapiens
ccccttggcttttgcttggcag

SEQ ID NO: 6733083 - DNA, 19 bp, Homo sapiens
ccccttgggcccacacctc

SEQ ID NO: 6733084 - DNA, 16 bp, Homo sapiens
ccccttgggcctccca

SEQ ID NO: 6733085 - DNA, 15 bp, Homo sapiens
ccccttgggcggctg

SEQ ID NO: 6733086 - DNA, 12 bp, Homo sapiens
ccccttggtcct

SEQ ID NO: 6733087 - DNA, 21 bp, Homo sapiens
ccccttggtcctggcagggcg

SEQ ID NO: 6733088 - DNA, 24 bp, Homo sapiens
ccccttggttctgcactgttgcca

SEQ ID NO: 6733089 - DNA, 13 bp, Homo sapiens
ccccttgtccctg

SEQ ID NO: 6733090 - DNA, 17 bp, Homo sapiens
ccccttgtccctggggc

SEQ ID NO: 6733091 - DNA, 18 bp, Homo sapiens
ccccttgtccctggggca

SEQ ID NO: 6733092 - DNA, 22 bp, Homo sapiens
ccccttgtccctggggcactcc

SEQ ID NO: 6733093 - DNA, 16 bp, Homo sapiens
ccccttgtcctctccc

SEQ ID NO: 6733094 - DNA, 17 bp, Homo sapiens
ccccttgtcctgaagcc

SEQ ID NO: 6733095 - DNA, 18 bp, Homo sapiens
ccccttgtcctttccctt

SEQ ID NO: 6733096 - DNA, 21 bp, Homo sapiens
ccccttgtcgcgcgtctccca

SEQ ID NO: 6733097 - DNA, 13 bp, Homo sapiens
ccccttgtctccc

SEQ ID NO: 6733098 - DNA, 18 bp, Homo sapiens
ccccttgtcttcccccct

SEQ ID NO: 6733099 - DNA, 22 bp, Homo sapiens
ccccttgtgggcaaaggcaggg

SEQ ID NO: 6733100 - DNA, 17 bp, Homo sapiens
ccccttgttgcactgcc

SEQ ID NO: 6733101 - DNA, 20 bp, Homo sapiens
ccccttgtttgtcccttcta

SEQ ID NO: 6733102 - DNA, 18 bp, Homo sapiens
cccctttactcagcccag

SEQ ID NO: 6733103 - DNA, 21 bp, Homo sapiens
cccctttactcagcccagctg

SEQ ID NO: 6733104 - DNA, 22 bp, Homo sapiens
cccctttactcagcccagctgg

SEQ ID NO: 6733105 - DNA, 15 bp, Homo sapiens
cccctttcacaggca

SEQ ID NO: 6733106 - DNA, 16 bp, Homo sapiens
cccctttcacaggcag

SEQ ID NO: 6733107 - DNA, 19 bp, Homo sapiens
cccctttcacaggcagcca

SEQ ID NO: 6733108 - DNA, 14 bp, Homo sapiens
cccctttcccaccc

SEQ ID NO: 6733109 - DNA, 11 bp, Homo sapiens
cccctttcccc

SEQ ID NO: 6733110 - DNA, 16 bp, Homo sapiens
cccctttccccagcct

SEQ ID NO: 6733111 - DNA, 23 bp, Homo sapiens
cccctttccccagcctctcctcc

SEQ ID NO: 6733112 - DNA, 13 bp, Homo sapiens
cccctttccccca

SEQ ID NO: 6733113 - DNA, 14 bp, Homo sapiens
cccctttcccgggc

SEQ ID NO: 6733114 - DNA, 22 bp, Homo sapiens
cccctttcctaaagccatcatg

SEQ ID NO: 6733115 - DNA, 14 bp, Homo sapiens
cccctttctaagga

SEQ ID NO: 6733116 - DNA, 17 bp, Homo sapiens
cccctttctctgcctgg

SEQ ID NO: 6733117 - DNA, 15 bp, Homo sapiens
cccctttctcttgct

SEQ ID NO: 6733118 - DNA, 14 bp, Homo sapiens
cccctttcttcctc

SEQ ID NO: 6733119 - DNA, 15 bp, Homo sapiens
cccctttcttcctca

SEQ ID NO: 6733120 - DNA, 15 bp, Homo sapiens
cccctttgcctctgt

SEQ ID NO: 6733121 - DNA, 15 bp, Homo sapiens
cccctttggcacacc

SEQ ID NO: 6733122 - DNA, 16 bp, Homo sapiens
cccctttgggcccagg

SEQ ID NO: 6733123 - DNA, 18 bp, Homo sapiens
cccctttgggcccaggga

SEQ ID NO: 6733124 - DNA, 20 bp, Homo sapiens
cccctttgggccctgcatgt

SEQ ID NO: 6733125 - DNA, 18 bp, Homo sapiens
cccctttggtttgacaat

SEQ ID NO: 6733126 - DNA, 17 bp, Homo sapiens
cccctttggtttggcct

SEQ ID NO: 6733127 - DNA, 18 bp, Homo sapiens
cccctttggtttggcctc

SEQ ID NO: 6733128 - DNA, 19 bp, Homo sapiens
cccctttggtttggcctcc

SEQ ID NO: 6733129 - DNA, 13 bp, Homo sapiens
cccctttgtcctg

SEQ ID NO: 6733130 - DNA, 18 bp, Homo sapiens
ccccttttacttttttat

SEQ ID NO: 6733131 - DNA, 22 bp, Homo sapiens
ccccttttcagctgagccctgg

SEQ ID NO: 6733132 - DNA, 16 bp, Homo sapiens
ccccttttcagcttct

SEQ ID NO: 6733133 - DNA, 23 bp, Homo sapiens
ccccttttccagttgctgtggac

SEQ ID NO: 6733134 - DNA, 21 bp, Homo sapiens
ccccttttctctgctcttgtt

SEQ ID NO: 6733135 - DNA, 16 bp, Homo sapiens
ccccttttctgcattt

SEQ ID NO: 6733136 - DNA, 15 bp, Homo sapiens
ccccttttcttttct

SEQ ID NO: 6733137 - DNA, 20 bp, Homo sapiens
ccccttttcttttctaccct

SEQ ID NO: 6733138 - DNA, 20 bp, Homo sapiens
ccccttttgcctggctgtgg

SEQ ID NO: 6733139 - DNA, 23 bp, Homo sapiens
ccccttttgtgggtttctctgtg

SEQ ID NO: 6733140 - DNA, 22 bp, Homo sapiens
cccctttttctttcccttcttt

SEQ ID NO: 6733141 - DNA, 18 bp, Homo sapiens
cccctttttttccttttt

SEQ ID NO: 6733142 - DNA, 24 bp, Homo sapiens
cccgaaagaggcacccttccatct

SEQ ID NO: 6733143 - DNA, 15 bp, Homo sapiens
cccgaaagcatcact

SEQ ID NO: 6733144 - DNA, 16 bp, Homo sapiens
cccgaaagctgagacc

SEQ ID NO: 6733145 - DNA, 16 bp, Homo sapiens
cccgaaagggacacaa

SEQ ID NO: 6733146 - DNA, 17 bp, Homo sapiens
cccgaaaggtcacctca

SEQ ID NO: 6733147 - DNA, 19 bp, Homo sapiens
cccgaaaggtcacctcact

SEQ ID NO: 6733148 - DNA, 14 bp, Homo sapiens
cccgaacagggact

SEQ ID NO: 6733149 - DNA, 17 bp, Homo sapiens
cccgaagccatcacttc

SEQ ID NO: 6733150 - DNA, 18 bp, Homo sapiens
cccgaagccatcacttct

SEQ ID NO: 6733151 - DNA, 17 bp, Homo sapiens
cccgaagcccaggctga

SEQ ID NO: 6733152 - DNA, 13 bp, Homo sapiens
cccgaagcccagt

SEQ ID NO: 6733153 - DNA, 18 bp, Homo sapiens
cccgaagggagcatctgt

SEQ ID NO: 6733154 - DNA, 16 bp, Homo sapiens
cccgaagtcctgtcac

SEQ ID NO: 6733155 - DNA, 22 bp, Homo sapiens
cccgaagtcctgtcactgagca

SEQ ID NO: 6733156 - DNA, 23 bp, Homo sapiens
cccgaatacaaacacctggactt

SEQ ID NO: 6733157 - DNA, 16 bp, Homo sapiens
cccgaatagctgggac

SEQ ID NO: 6733158 - DNA, 17 bp, Homo sapiens
cccgaatagctgggact

SEQ ID NO: 6733159 - DNA, 18 bp, Homo sapiens
cccgaatagctgggacta

SEQ ID NO: 6733160 - DNA, 20 bp, Homo sapiens
cccgacacacggggctcggg

SEQ ID NO: 6733161 - DNA, 15 bp, Homo sapiens
cccgacactgctgca

SEQ ID NO: 6733162 - DNA, 18 bp, Homo sapiens
cccgacactgctgcacca

SEQ ID NO: 6733163 - DNA, 23 bp, Homo sapiens
cccgacactgctgcaccagagtg

SEQ ID NO: 6733164 - DNA, 14 bp, Homo sapiens
cccgacagcccagc

SEQ ID NO: 6733165 - DNA, 16 bp, Homo sapiens
cccgacagcccagcct

SEQ ID NO: 6733166 - DNA, 13 bp, Homo sapiens
cccgacagcccat

SEQ ID NO: 6733167 - DNA, 14 bp, Homo sapiens
cccgacagcctggc

SEQ ID NO: 6733168 - DNA, 18 bp, Homo sapiens
cccgacagcctggcacag

SEQ ID NO: 6733169 - DNA, 23 bp, Homo sapiens
cccgacagtgccatccccacctt

SEQ ID NO: 6733170 - DNA, 14 bp, Homo sapiens
cccgacagtggctc

SEQ ID NO: 6733171 - DNA, 17 bp, Homo sapiens
cccgacagtggctctcc

SEQ ID NO: 6733172 - DNA, 17 bp, Homo sapiens
cccgaccaatccccagc

SEQ ID NO: 6733173 - DNA, 20 bp, Homo sapiens
cccgaccaatccccagccta

SEQ ID NO: 6733174 - DNA, 23 bp, Homo sapiens
cccgaccagatccttttccatcc

SEQ ID NO: 6733175 - DNA, 15 bp, Homo sapiens
cccgacccagccagc

SEQ ID NO: 6733176 - DNA, 17 bp, Homo sapiens
cccgacccagccagctg

SEQ ID NO: 6733177 - DNA, 14 bp, Homo sapiens
cccgacccagctct

SEQ ID NO: 6733178 - DNA, 16 bp, Homo sapiens
cccgacccccctaccc

SEQ ID NO: 6733179 - DNA, 18 bp, Homo sapiens
cccgaccctgccctgggc

SEQ ID NO: 6733180 - DNA, 22 bp, Homo sapiens
cccgaccgtatacttaaaatga

SEQ ID NO: 6733181 - DNA, 23 bp, Homo sapiens
cccgacctggctgcccctcacct

SEQ ID NO: 6733182 - DNA, 18 bp, Homo sapiens
cccgacggcctccaggag

SEQ ID NO: 6733183 - DNA, 15 bp, Homo sapiens
cccgactagcaggca

SEQ ID NO: 6733184 - DNA, 19 bp, Homo sapiens
cccgactatccctgcacat

SEQ ID NO: 6733185 - DNA, 17 bp, Homo sapiens
cccgactccagccagcg

SEQ ID NO: 6733186 - DNA, 12 bp, Homo sapiens
cccgactcctca

SEQ ID NO: 6733187 - DNA, 16 bp, Homo sapiens
cccgactgcctgtctc

SEQ ID NO: 6733188 - DNA, 20 bp, Homo sapiens
cccgagaaaacaaacccagg

SEQ ID NO: 6733189 - DNA, 21 bp, Homo sapiens
cccgagaacatggcctaaggg

SEQ ID NO: 6733190 - DNA, 17 bp, Homo sapiens
cccgagacgtgtaatga

SEQ ID NO: 6733191 - DNA, 16 bp, Homo sapiens
cccgagagagacccca

SEQ ID NO: 6733192 - DNA, 13 bp, Homo sapiens
cccgagagctctt

SEQ ID NO: 6733193 - DNA, 23 bp, Homo sapiens
cccgagagctcttagtttttaaa

SEQ ID NO: 6733194 - DNA, 22 bp, Homo sapiens
cccgagatgtgacccaccagtg

SEQ ID NO: 6733195 - DNA, 18 bp, Homo sapiens
cccgagcaatggcgcctg

SEQ ID NO: 6733196 - DNA, 23 bp, Homo sapiens
cccgagcaatggcgcctgctccc

SEQ ID NO: 6733197 - DNA, 12 bp, Homo sapiens
cccgagcacata

SEQ ID NO: 6733198 - DNA, 13 bp, Homo sapiens
cccgagcagctga

SEQ ID NO: 6733199 - DNA, 19 bp, Homo sapiens
cccgagcagctgagcaggg

SEQ ID NO: 6733200 - DNA, 21 bp, Homo sapiens
cccgagcagctgagcagggcc

SEQ ID NO: 6733201 - DNA, 20 bp, Homo sapiens
cccgagccctgactcctgga

SEQ ID NO: 6733202 - DNA, 15 bp, Homo sapiens
cccgagcctggctcc

SEQ ID NO: 6733203 - DNA, 13 bp, Homo sapiens
cccgagctcttgg

SEQ ID NO: 6733204 - DNA, 20 bp, Homo sapiens
cccgagctcttggcctttgc

SEQ ID NO: 6733205 - DNA, 11 bp, Homo sapiens
cccgagctggg

SEQ ID NO: 6733206 - DNA, 22 bp, Homo sapiens
cccgagctgggggccatgagct

SEQ ID NO: 6733207 - DNA, 12 bp, Homo sapiens
cccgagctggtg

SEQ ID NO: 6733208 - DNA, 14 bp, Homo sapiens
cccgagctggtgca

SEQ ID NO: 6733209 - DNA, 22 bp, Homo sapiens
cccgagctggtgcattacagag

SEQ ID NO: 6733210 - DNA, 14 bp, Homo sapiens
cccgagctgtcccc

SEQ ID NO: 6733211 - DNA, 14 bp, Homo sapiens
cccgagctgtttat

SEQ ID NO: 6733212 - DNA, 13 bp, Homo sapiens
cccgagcttgcct

SEQ ID NO: 6733213 - DNA, 14 bp, Homo sapiens
cccgagcttgcctc

SEQ ID NO: 6733214 - DNA, 20 bp, Homo sapiens
cccgaggaactcgcctcagc

SEQ ID NO: 6733215 - DNA, 21 bp, Homo sapiens
cccgaggaagatgctcatctg

SEQ ID NO: 6733216 - DNA, 15 bp, Homo sapiens
cccgaggacccagac

SEQ ID NO: 6733217 - DNA, 17 bp, Homo sapiens
cccgaggacccagaccc

SEQ ID NO: 6733218 - DNA, 22 bp, Homo sapiens
cccgaggacgctccctgctcca

SEQ ID NO: 6733219 - DNA, 15 bp, Homo sapiens
cccgaggatttctgg

SEQ ID NO: 6733220 - DNA, 22 bp, Homo sapiens
cccgaggcagacgtctgtcagg

SEQ ID NO: 6733221 - DNA, 12 bp, Homo sapiens
cccgaggcagca

SEQ ID NO: 6733222 - DNA, 13 bp, Homo sapiens
cccgaggccaggg

SEQ ID NO: 6733223 - DNA, 13 bp, Homo sapiens
cccgaggcccaga

SEQ ID NO: 6733224 - DNA, 17 bp, Homo sapiens
cccgaggcccccctctg

SEQ ID NO: 6733225 - DNA, 21 bp, Homo sapiens
cccgaggcccccctctgcctt

SEQ ID NO: 6733226 - DNA, 14 bp, Homo sapiens
cccgaggccctgca

SEQ ID NO: 6733227 - DNA, 15 bp, Homo sapiens
cccgaggccttctct

SEQ ID NO: 6733228 - DNA, 20 bp, Homo sapiens
cccgaggctgccccaggccg

SEQ ID NO: 6733229 - DNA, 14 bp, Homo sapiens
cccgagggagctgc

SEQ ID NO: 6733230 - DNA, 22 bp, Homo sapiens
cccgagggatggtgcccctagg

SEQ ID NO: 6733231 - DNA, 17 bp, Homo sapiens
cccgagggcagccccct

SEQ ID NO: 6733232 - DNA, 19 bp, Homo sapiens
cccgagggcagccccctcc

SEQ ID NO: 6733233 - DNA, 17 bp, Homo sapiens
cccgagggcgcctgggt

SEQ ID NO: 6733234 - DNA, 18 bp, Homo sapiens
cccgagggctcagaagag

SEQ ID NO: 6733235 - DNA, 12 bp, Homo sapiens
cccgagggctga

SEQ ID NO: 6733236 - DNA, 15 bp, Homo sapiens
cccgagggctgagga

SEQ ID NO: 6733237 - DNA, 18 bp, Homo sapiens
cccgagggctgaggagca

SEQ ID NO: 6733238 - DNA, 20 bp, Homo sapiens
cccgagggctgaggagcagc

SEQ ID NO: 6733239 - DNA, 15 bp, Homo sapiens
cccgaggggagggca

SEQ ID NO: 6733240 - DNA, 17 bp, Homo sapiens
cccgagggttgattaag

SEQ ID NO: 6733241 - DNA, 19 bp, Homo sapiens
cccgagggttgattaaggc

SEQ ID NO: 6733242 - DNA, 16 bp, Homo sapiens
cccgagtagctgggac

SEQ ID NO: 6733243 - DNA, 17 bp, Homo sapiens
cccgagtagctgggact

SEQ ID NO: 6733244 - DNA, 16 bp, Homo sapiens
cccgagtagctgggat

SEQ ID NO: 6733245 - DNA, 20 bp, Homo sapiens
cccgagtagctgggattaca

SEQ ID NO: 6733246 - DNA, 23 bp, Homo sapiens
cccgagtagttgggattacaggt

SEQ ID NO: 6733247 - DNA, 19 bp, Homo sapiens
cccgagtcctcaggtacag

SEQ ID NO: 6733248 - DNA, 21 bp, Homo sapiens
cccgagtggtctcctctcagc

SEQ ID NO: 6733249 - DNA, 16 bp, Homo sapiens
cccgagtttccccaga

SEQ ID NO: 6733250 - DNA, 19 bp, Homo sapiens
cccgagtttggtccctggg

SEQ ID NO: 6733251 - DNA, 21 bp, Homo sapiens
cccgatccagattcccaggcc

SEQ ID NO: 6733252 - DNA, 23 bp, Homo sapiens
cccgatccagattcccaggccag

SEQ ID NO: 6733253 - DNA, 20 bp, Homo sapiens
cccgatccccgacagtggct

SEQ ID NO: 6733254 - DNA, 15 bp, Homo sapiens
cccgatcgccagcaa

SEQ ID NO: 6733255 - DNA, 16 bp, Homo sapiens
cccgatgctgctttcc

SEQ ID NO: 6733256 - DNA, 22 bp, Homo sapiens
cccgatgctgctttcccctgtg

SEQ ID NO: 6733257 - DNA, 19 bp, Homo sapiens
cccgatggactcctgacca

SEQ ID NO: 6733258 - DNA, 22 bp, Homo sapiens
cccgatggaggactccaggcag

SEQ ID NO: 6733259 - DNA, 13 bp, Homo sapiens
cccgatggtctct

SEQ ID NO: 6733260 - DNA, 19 bp, Homo sapiens
cccgatgtcccctgcgggc

SEQ ID NO: 6733261 - DNA, 20 bp, Homo sapiens
cccgatgtcgacatgttttt

SEQ ID NO: 6733262 - DNA, 17 bp, Homo sapiens
cccgatgtgagccgcct

SEQ ID NO: 6733263 - DNA, 18 bp, Homo sapiens
cccgattcagagacttag

SEQ ID NO: 6733264 - DNA, 14 bp, Homo sapiens
cccgattgtaactc

SEQ ID NO: 6733265 - DNA, 16 bp, Homo sapiens
cccgcaactctccagc

SEQ ID NO: 6733266 - DNA, 18 bp, Homo sapiens
cccgcaagagggacagag

SEQ ID NO: 6733267 - DNA, 21 bp, Homo sapiens
cccgcaagagggacagagccc

SEQ ID NO: 6733268 - DNA, 22 bp, Homo sapiens
cccgcaagagggacagagcccg

SEQ ID NO: 6733269 - DNA, 15 bp, Homo sapiens
cccgcaaggcctctc

SEQ ID NO: 6733270 - DNA, 19 bp, Homo sapiens
cccgcacaaagcggctcta

SEQ ID NO: 6733271 - DNA, 22 bp, Homo sapiens
cccgcacaccctcactctgcca

SEQ ID NO: 6733272 - DNA, 12 bp, Homo sapiens
cccgcacacctg

SEQ ID NO: 6733273 - DNA, 16 bp, Homo sapiens
cccgcacagcagcctg

SEQ ID NO: 6733274 - DNA, 16 bp, Homo sapiens
cccgcacagccacccg

SEQ ID NO: 6733275 - DNA, 16 bp, Homo sapiens
cccgcacccccaccct

SEQ ID NO: 6733276 - DNA, 12 bp, Homo sapiens
cccgcacccccg

SEQ ID NO: 6733277 - DNA, 12 bp, Homo sapiens
cccgcacccctc

SEQ ID NO: 6733278 - DNA, 15 bp, Homo sapiens
cccgcacctgtacag

SEQ ID NO: 6733279 - DNA, 14 bp, Homo sapiens
cccgcacctgtctg

SEQ ID NO: 6733280 - DNA, 19 bp, Homo sapiens
cccgcacgactgcgggagc

SEQ ID NO: 6733281 - DNA, 22 bp, Homo sapiens
cccgcacgactgcgggagccag

SEQ ID NO: 6733282 - DNA, 17 bp, Homo sapiens
cccgcacgcaagcctca

SEQ ID NO: 6733283 - DNA, 19 bp, Homo sapiens
cccgcacgcaagcctcagc

SEQ ID NO: 6733284 - DNA, 20 bp, Homo sapiens
cccgcacgcaagcctcagcc

SEQ ID NO: 6733285 - DNA, 22 bp, Homo sapiens
cccgcactcaggagcacagcca

SEQ ID NO: 6733286 - DNA, 12 bp, Homo sapiens
cccgcactctgc

SEQ ID NO: 6733287 - DNA, 16 bp, Homo sapiens
cccgcagacaccttgg

SEQ ID NO: 6733288 - DNA, 12 bp, Homo sapiens
cccgcagacctc

SEQ ID NO: 6733289 - DNA, 18 bp, Homo sapiens
cccgcagacctccccagc

SEQ ID NO: 6733290 - DNA, 14 bp, Homo sapiens
cccgcagacctctg

SEQ ID NO: 6733291 - DNA, 12 bp, Homo sapiens
cccgcagaggca

SEQ ID NO: 6733292 - DNA, 20 bp, Homo sapiens
cccgcagaggtggggtgctg

SEQ ID NO: 6733293 - DNA, 17 bp, Homo sapiens
cccgcagcaccagcctg

SEQ ID NO: 6733294 - DNA, 19 bp, Homo sapiens
cccgcagcacgcctctccc

SEQ ID NO: 6733295 - DNA, 23 bp, Homo sapiens
cccgcagcacgcctctccccacc

SEQ ID NO: 6733296 - DNA, 17 bp, Homo sapiens
cccgcagcccgcctgcc

SEQ ID NO: 6733297 - DNA, 21 bp, Homo sapiens
cccgcagcccgcctgccgtgc

SEQ ID NO: 6733298 - DNA, 22 bp, Homo sapiens
cccgcagcccgtgaagcagtgc

SEQ ID NO: 6733299 - DNA, 22 bp, Homo sapiens
cccgcagccctctccacccaga

SEQ ID NO: 6733300 - DNA, 12 bp, Homo sapiens
cccgcagcctcg

SEQ ID NO: 6733301 - DNA, 19 bp, Homo sapiens
cccgcagcctggcatctgt

SEQ ID NO: 6733302 - DNA, 21 bp, Homo sapiens
cccgcaggaactgggctgggc

SEQ ID NO: 6733303 - DNA, 22 bp, Homo sapiens
cccgcaggaactgggctgggcc

SEQ ID NO: 6733304 - DNA, 16 bp, Homo sapiens
cccgcaggatccctcc

SEQ ID NO: 6733305 - DNA, 21 bp, Homo sapiens
cccgcaggatccctcctgagc

SEQ ID NO: 6733306 - DNA, 22 bp, Homo sapiens
cccgcaggatccctcctgagct

SEQ ID NO: 6733307 - DNA, 23 bp, Homo sapiens
cccgcaggatccctcctgagctc

SEQ ID NO: 6733308 - DNA, 19 bp, Homo sapiens
cccgcaggcctgccttctc

SEQ ID NO: 6733309 - DNA, 16 bp, Homo sapiens
cccgcagggccatgca

SEQ ID NO: 6733310 - DNA, 18 bp, Homo sapiens
cccgcagtccccagccct

SEQ ID NO: 6733311 - DNA, 18 bp, Homo sapiens
cccgcagtcgtcagcctc

SEQ ID NO: 6733312 - DNA, 20 bp, Homo sapiens
cccgcagtcgtcagcctccc

SEQ ID NO: 6733313 - DNA, 18 bp, Homo sapiens
cccgcagtgctgggacca

SEQ ID NO: 6733314 - DNA, 21 bp, Homo sapiens
cccgcagtgctgggaccagag

SEQ ID NO: 6733315 - DNA, 22 bp, Homo sapiens
cccgcagtgctgggaccagagc

SEQ ID NO: 6733316 - DNA, 23 bp, Homo sapiens
cccgcagtgggagcaaactgcat

SEQ ID NO: 6733317 - DNA, 22 bp, Homo sapiens
cccgcagtgtgcactaaggggc

SEQ ID NO: 6733318 - DNA, 14 bp, Homo sapiens
cccgcatcccctgc

SEQ ID NO: 6733319 - DNA, 22 bp, Homo sapiens
cccgcatgcagcagcttgctgc

SEQ ID NO: 6733320 - DNA, 18 bp, Homo sapiens
cccgcatgctgcctgcct

SEQ ID NO: 6733321 - DNA, 19 bp, Homo sapiens
cccgcatgctgcctgcctc

SEQ ID NO: 6733322 - DNA, 23 bp, Homo sapiens
cccgcatgtacaaaaacacaaat

SEQ ID NO: 6733323 - DNA, 13 bp, Homo sapiens
cccgcatgtgtgc

SEQ ID NO: 6733324 - DNA, 17 bp, Homo sapiens
cccgcatgtgtgcctgg

SEQ ID NO: 6733325 - DNA, 14 bp, Homo sapiens
cccgcattggtggc

SEQ ID NO: 6733326 - DNA, 15 bp, Homo sapiens
cccgcatttctcatg

SEQ ID NO: 6733327 - DNA, 13 bp, Homo sapiens
cccgccaccctgt

SEQ ID NO: 6733328 - DNA, 20 bp, Homo sapiens
cccgccacctgtgtgttctt

SEQ ID NO: 6733329 - DNA, 13 bp, Homo sapiens
cccgccagcctac

SEQ ID NO: 6733330 - DNA, 16 bp, Homo sapiens
cccgccagcctcagtg

SEQ ID NO: 6733331 - DNA, 12 bp, Homo sapiens
cccgccagggct

SEQ ID NO: 6733332 - DNA, 13 bp, Homo sapiens
cccgccagggctg

SEQ ID NO: 6733333 - DNA, 19 bp, Homo sapiens
cccgccatggtcaccctca

SEQ ID NO: 6733334 - DNA, 21 bp, Homo sapiens
cccgccatggtcaccctcagg

SEQ ID NO: 6733335 - DNA, 14 bp, Homo sapiens
cccgccattggcct

SEQ ID NO: 6733336 - DNA, 15 bp, Homo sapiens
cccgccattggcctt

SEQ ID NO: 6733337 - DNA, 16 bp, Homo sapiens
cccgccattggcctta

SEQ ID NO: 6733338 - DNA, 16 bp, Homo sapiens
cccgcccacccacgca

SEQ ID NO: 6733339 - DNA, 16 bp, Homo sapiens
cccgcccaccccgctg

SEQ ID NO: 6733340 - DNA, 14 bp, Homo sapiens
cccgcccacctggg

SEQ ID NO: 6733341 - DNA, 12 bp, Homo sapiens
cccgcccactgt

SEQ ID NO: 6733342 - DNA, 19 bp, Homo sapiens
cccgcccagaggagcccag

SEQ ID NO: 6733343 - DNA, 21 bp, Homo sapiens
cccgcccagaggagcccagcg

SEQ ID NO: 6733344 - DNA, 14 bp, Homo sapiens
cccgcccagcctca

SEQ ID NO: 6733345 - DNA, 17 bp, Homo sapiens
cccgcccaggctggcca

SEQ ID NO: 6733346 - DNA, 20 bp, Homo sapiens
cccgcccaggcttagtcact

SEQ ID NO: 6733347 - DNA, 12 bp, Homo sapiens
cccgccccagag

SEQ ID NO: 6733348 - DNA, 16 bp, Homo sapiens
cccgccccagagactg

SEQ ID NO: 6733349 - DNA, 15 bp, Homo sapiens
cccgccccagccctc

SEQ ID NO: 6733350 - DNA, 18 bp, Homo sapiens
cccgccccagccctcagt

SEQ ID NO: 6733351 - DNA, 13 bp, Homo sapiens
cccgccccagggt

SEQ ID NO: 6733352 - DNA, 16 bp, Homo sapiens
cccgccccagggtctg

SEQ ID NO: 6733353 - DNA, 18 bp, Homo sapiens
cccgccccatcctcctgc

SEQ ID NO: 6733354 - DNA, 12 bp, Homo sapiens
cccgcccccacc

SEQ ID NO: 6733355 - DNA, 14 bp, Homo sapiens
cccgccccccacac

SEQ ID NO: 6733356 - DNA, 23 bp, Homo sapiens
cccgccccccacacttccctggc

SEQ ID NO: 6733357 - DNA, 14 bp, Homo sapiens
cccgccccccagag

SEQ ID NO: 6733358 - DNA, 15 bp, Homo sapiens
cccgccccccagagc

SEQ ID NO: 6733359 - DNA, 17 bp, Homo sapiens
cccgccccccagagcca

SEQ ID NO: 6733360 - DNA, 23 bp, Homo sapiens
cccgccccccagagccagggctg

SEQ ID NO: 6733361 - DNA, 18 bp, Homo sapiens
cccgcccccgccccgctg

SEQ ID NO: 6733362 - DNA, 15 bp, Homo sapiens
cccgcccccgccctc

SEQ ID NO: 6733363 - DNA, 14 bp, Homo sapiens
cccgccccgctgct

SEQ ID NO: 6733364 - DNA, 17 bp, Homo sapiens
cccgccccgggctggcc

SEQ ID NO: 6733365 - DNA, 20 bp, Homo sapiens
cccgccccgggctggccctg

SEQ ID NO: 6733366 - DNA, 21 bp, Homo sapiens
cccgccccgggctggccctgt

SEQ ID NO: 6733367 - DNA, 15 bp, Homo sapiens
cccgcccctcccacg

SEQ ID NO: 6733368 - DNA, 16 bp, Homo sapiens
cccgcccctcgctgct

SEQ ID NO: 6733369 - DNA, 14 bp, Homo sapiens
cccgcccctgcagc

SEQ ID NO: 6733370 - DNA, 13 bp, Homo sapiens
cccgcccctgcat

SEQ ID NO: 6733371 - DNA, 14 bp, Homo sapiens
cccgcccctgcatg

SEQ ID NO: 6733372 - DNA, 22 bp, Homo sapiens
cccgcccctgcatgcctggccc

SEQ ID NO: 6733373 - DNA, 14 bp, Homo sapiens
cccgcccctgggga

SEQ ID NO: 6733374 - DNA, 14 bp, Homo sapiens
cccgcccctgtggc

SEQ ID NO: 6733375 - DNA, 20 bp, Homo sapiens
cccgccccttccccgaggga

SEQ ID NO: 6733376 - DNA, 18 bp, Homo sapiens
cccgcccgtctctgctct

SEQ ID NO: 6733377 - DNA, 18 bp, Homo sapiens
cccgccctcacctgcaga

SEQ ID NO: 6733378 - DNA, 14 bp, Homo sapiens
cccgccctcctctg

SEQ ID NO: 6733379 - DNA, 21 bp, Homo sapiens
cccgccctcctctgccccctc

SEQ ID NO: 6733380 - DNA, 14 bp, Homo sapiens
cccgccctctctca

SEQ ID NO: 6733381 - DNA, 15 bp, Homo sapiens
cccgccctcttcctg

SEQ ID NO: 6733382 - DNA, 14 bp, Homo sapiens
cccgccctgcccct

SEQ ID NO: 6733383 - DNA, 21 bp, Homo sapiens
cccgcccttccatgtgccttt

SEQ ID NO: 6733384 - DNA, 17 bp, Homo sapiens
cccgcccttcttttgac

SEQ ID NO: 6733385 - DNA, 17 bp, Homo sapiens
cccgccgcccagcccac

SEQ ID NO: 6733386 - DNA, 20 bp, Homo sapiens
cccgccgcccctccacccat

SEQ ID NO: 6733387 - DNA, 12 bp, Homo sapiens
cccgccgcccgc

SEQ ID NO: 6733388 - DNA, 17 bp, Homo sapiens
cccgccgccctggacag

SEQ ID NO: 6733389 - DNA, 19 bp, Homo sapiens
cccgccgcttttctcctct

SEQ ID NO: 6733390 - DNA, 15 bp, Homo sapiens
cccgccggaggaagg

SEQ ID NO: 6733391 - DNA, 16 bp, Homo sapiens
cccgccggaggccagc

SEQ ID NO: 6733392 - DNA, 19 bp, Homo sapiens
cccgccggaggccagctat

SEQ ID NO: 6733393 - DNA, 21 bp, Homo sapiens
cccgccggccgcgcaccgcca

SEQ ID NO: 6733394 - DNA, 23 bp, Homo sapiens
cccgccggccgcgcaccgccatg

SEQ ID NO: 6733395 - DNA, 21 bp, Homo sapiens
cccgccgtctgcaggggcctg

SEQ ID NO: 6733396 - DNA, 22 bp, Homo sapiens
cccgccgtgtctgtggccctct

SEQ ID NO: 6733397 - DNA, 13 bp, Homo sapiens
cccgcctcagcct

SEQ ID NO: 6733398 - DNA, 18 bp, Homo sapiens
cccgcctcagcctctcaa

SEQ ID NO: 6733399 - DNA, 17 bp, Homo sapiens
cccgcctcagggccagg

SEQ ID NO: 6733400 - DNA, 14 bp, Homo sapiens
cccgcctccaaccc

SEQ ID NO: 6733401 - DNA, 19 bp, Homo sapiens
cccgcctccaacccctcgc

SEQ ID NO: 6733402 - DNA, 12 bp, Homo sapiens
cccgcctccact

SEQ ID NO: 6733403 - DNA, 19 bp, Homo sapiens
cccgcctccactctagttc

SEQ ID NO: 6733404 - DNA, 23 bp, Homo sapiens
cccgcctccccatacttcctggg

SEQ ID NO: 6733405 - DNA, 18 bp, Homo sapiens
cccgcctccctcccctgc

SEQ ID NO: 6733406 - DNA, 20 bp, Homo sapiens
cccgcctcctccctgcctgg

SEQ ID NO: 6733407 - DNA, 12 bp, Homo sapiens
cccgcctctccc

SEQ ID NO: 6733408 - DNA, 12 bp, Homo sapiens
cccgcctgagtc

SEQ ID NO: 6733409 - DNA, 20 bp, Homo sapiens
cccgcctgcagtcttctggg

SEQ ID NO: 6733410 - DNA, 11 bp, Homo sapiens
cccgcctgcca

SEQ ID NO: 6733411 - DNA, 12 bp, Homo sapiens
cccgcctgccac

SEQ ID NO: 6733412 - DNA, 14 bp, Homo sapiens
cccgcctgccaccg

SEQ ID NO: 6733413 - DNA, 13 bp, Homo sapiens
cccgcctgcccac

SEQ ID NO: 6733414 - DNA, 17 bp, Homo sapiens
cccgcctgcccacctgc

SEQ ID NO: 6733415 - DNA, 18 bp, Homo sapiens
cccgcctgcccacctgcc

SEQ ID NO: 6733416 - DNA, 12 bp, Homo sapiens
cccgcctgccct

SEQ ID NO: 6733417 - DNA, 11 bp, Homo sapiens
cccgcctgcct

SEQ ID NO: 6733418 - DNA, 16 bp, Homo sapiens
cccgcctgcctcctgg

SEQ ID NO: 6733419 - DNA, 16 bp, Homo sapiens
cccgcctgcctgccac

SEQ ID NO: 6733420 - DNA, 15 bp, Homo sapiens
cccgcctgcgccccc

SEQ ID NO: 6733421 - DNA, 12 bp, Homo sapiens
cccgcctggcca

SEQ ID NO: 6733422 - DNA, 17 bp, Homo sapiens
cccgcctggccaggagc

SEQ ID NO: 6733423 - DNA, 13 bp, Homo sapiens
cccgcctgggcac

SEQ ID NO: 6733424 - DNA, 14 bp, Homo sapiens
cccgcctgtcacaa

SEQ ID NO: 6733425 - DNA, 13 bp, Homo sapiens
cccgcctgtcctg

SEQ ID NO: 6733426 - DNA, 22 bp, Homo sapiens
cccgccttcaggttcctcctag

SEQ ID NO: 6733427 - DNA, 24 bp, Homo sapiens
cccgccttcaggttcctcctaggc

SEQ ID NO: 6733428 - DNA, 20 bp, Homo sapiens
cccgccttccaaaacctgct

SEQ ID NO: 6733429 - DNA, 16 bp, Homo sapiens
cccgccttcctcctcc

SEQ ID NO: 6733430 - DNA, 18 bp, Homo sapiens
cccgccttcgtgtgctgc

SEQ ID NO: 6733431 - DNA, 22 bp, Homo sapiens
cccgccttcgtgtgctgctgct

SEQ ID NO: 6733432 - DNA, 15 bp, Homo sapiens
cccgccttctccagg

SEQ ID NO: 6733433 - DNA, 13 bp, Homo sapiens
cccgccttggcct

SEQ ID NO: 6733434 - DNA, 17 bp, Homo sapiens
cccgcgaccacccctgt

SEQ ID NO: 6733435 - DNA, 18 bp, Homo sapiens
cccgcgaccacccctgtg

SEQ ID NO: 6733436 - DNA, 16 bp, Homo sapiens
cccgcgcagctgccta

SEQ ID NO: 6733437 - DNA, 17 bp, Homo sapiens
cccgcgccacaggaccc

SEQ ID NO: 6733438 - DNA, 16 bp, Homo sapiens
cccgcgcgtgccccca

SEQ ID NO: 6733439 - DNA, 14 bp, Homo sapiens
cccgcgctcaggag

SEQ ID NO: 6733440 - DNA, 19 bp, Homo sapiens
cccgcgctcgcccagcagg

SEQ ID NO: 6733441 - DNA, 14 bp, Homo sapiens
cccgcggagccccc

SEQ ID NO: 6733442 - DNA, 19 bp, Homo sapiens
cccgcggatcaaccaggca

SEQ ID NO: 6733443 - DNA, 20 bp, Homo sapiens
cccgcggatcaaccaggcag

SEQ ID NO: 6733444 - DNA, 20 bp, Homo sapiens
cccgcggcgcgaccctcccc

SEQ ID NO: 6733445 - DNA, 15 bp, Homo sapiens
cccgcgggtagatgc

SEQ ID NO: 6733446 - DNA, 16 bp, Homo sapiens
cccgcgggttctagac

SEQ ID NO: 6733447 - DNA, 15 bp, Homo sapiens
cccgcggtgctctgg

SEQ ID NO: 6733448 - DNA, 20 bp, Homo sapiens
cccgcggtgctctggcggct

SEQ ID NO: 6733449 - DNA, 22 bp, Homo sapiens
cccgcggtgctgactgaggcct

SEQ ID NO: 6733450 - DNA, 15 bp, Homo sapiens
cccgcgtccaacccc

SEQ ID NO: 6733451 - DNA, 18 bp, Homo sapiens
cccgcgtccaaccccggg

SEQ ID NO: 6733452 - DNA, 15 bp, Homo sapiens
cccgctaaggaagat

SEQ ID NO: 6733453 - DNA, 23 bp, Homo sapiens
cccgctcaacctctcagatccct

SEQ ID NO: 6733454 - DNA, 21 bp, Homo sapiens
cccgctcacaacttgggttct

SEQ ID NO: 6733455 - DNA, 19 bp, Homo sapiens
cccgctcagccctccctgc

SEQ ID NO: 6733456 - DNA, 23 bp, Homo sapiens
cccgctcagccctccctgcccct

SEQ ID NO: 6733457 - DNA, 12 bp, Homo sapiens
cccgctcaggcc

SEQ ID NO: 6733458 - DNA, 14 bp, Homo sapiens
cccgctcaggggcc

SEQ ID NO: 6733459 - DNA, 20 bp, Homo sapiens
cccgctcatgggcccctctg

SEQ ID NO: 6733460 - DNA, 12 bp, Homo sapiens
cccgctcccaca

SEQ ID NO: 6733461 - DNA, 13 bp, Homo sapiens
cccgctcccacag

SEQ ID NO: 6733462 - DNA, 14 bp, Homo sapiens
cccgctcccaggtt

SEQ ID NO: 6733463 - DNA, 14 bp, Homo sapiens
cccgctcccagtgt

SEQ ID NO: 6733464 - DNA, 18 bp, Homo sapiens
cccgctccccacctaccc

SEQ ID NO: 6733465 - DNA, 20 bp, Homo sapiens
cccgctcccccaaaaatttg

SEQ ID NO: 6733466 - DNA, 19 bp, Homo sapiens
cccgctccgtctctgtcct

SEQ ID NO: 6733467 - DNA, 16 bp, Homo sapiens
cccgctcctgctgaaa

SEQ ID NO: 6733468 - DNA, 22 bp, Homo sapiens
cccgctcggacttactgcctga

SEQ ID NO: 6733469 - DNA, 21 bp, Homo sapiens
cccgctctacatcttctgcct

SEQ ID NO: 6733470 - DNA, 14 bp, Homo sapiens
cccgctctccctgt

SEQ ID NO: 6733471 - DNA, 15 bp, Homo sapiens
cccgctctccctgtc

SEQ ID NO: 6733472 - DNA, 18 bp, Homo sapiens
cccgctctccctgtcacg

SEQ ID NO: 6733473 - DNA, 12 bp, Homo sapiens
cccgctctggac

SEQ ID NO: 6733474 - DNA, 15 bp, Homo sapiens
cccgctcttttccta

SEQ ID NO: 6733475 - DNA, 17 bp, Homo sapiens
cccgctgacgcttccct

SEQ ID NO: 6733476 - DNA, 18 bp, Homo sapiens
cccgctgagctgagtggc

SEQ ID NO: 6733477 - DNA, 23 bp, Homo sapiens
cccgctgatggagccccaccttg

SEQ ID NO: 6733478 - DNA, 12 bp, Homo sapiens
cccgctgcacac

SEQ ID NO: 6733479 - DNA, 19 bp, Homo sapiens
cccgctgcacacagacggc

SEQ ID NO: 6733480 - DNA, 13 bp, Homo sapiens
cccgctgcccagc

SEQ ID NO: 6733481 - DNA, 14 bp, Homo sapiens
cccgctgcccagcc

SEQ ID NO: 6733482 - DNA, 22 bp, Homo sapiens
cccgctgcccaggggagccctc

SEQ ID NO: 6733483 - DNA, 12 bp, Homo sapiens
cccgctgcctct

SEQ ID NO: 6733484 - DNA, 20 bp, Homo sapiens
cccgctgcctggcgggcagc

SEQ ID NO: 6733485 - DNA, 12 bp, Homo sapiens
cccgctgctccc

SEQ ID NO: 6733486 - DNA, 12 bp, Homo sapiens
cccgctgctgct

SEQ ID NO: 6733487 - DNA, 11 bp, Homo sapiens
cccgctgctgt

SEQ ID NO: 6733488 - DNA, 16 bp, Homo sapiens
cccgctgctgtgcaac

SEQ ID NO: 6733489 - DNA, 19 bp, Homo sapiens
cccgctgctgtgctctggg

SEQ ID NO: 6733490 - DNA, 21 bp, Homo sapiens
cccgctgctgtgctctgggga

SEQ ID NO: 6733491 - DNA, 18 bp, Homo sapiens
cccgctggagcccacagc

SEQ ID NO: 6733492 - DNA, 22 bp, Homo sapiens
cccgctggagcccacagcgagc

SEQ ID NO: 6733493 - DNA, 21 bp, Homo sapiens
cccgctggaggatgtgggcag

SEQ ID NO: 6733494 - DNA, 23 bp, Homo sapiens
cccgctggaggatgtgggcagct

SEQ ID NO: 6733495 - DNA, 12 bp, Homo sapiens
cccgctggctca

SEQ ID NO: 6733496 - DNA, 16 bp, Homo sapiens
cccgctggctcctcca

SEQ ID NO: 6733497 - DNA, 23 bp, Homo sapiens
cccgctggggaccggttcccaca

SEQ ID NO: 6733498 - DNA, 16 bp, Homo sapiens
cccgctgtcccagggg

SEQ ID NO: 6733499 - DNA, 14 bp, Homo sapiens
cccgctgtggccgg

SEQ ID NO: 6733500 - DNA, 23 bp, Homo sapiens
cccgctgtggccggtgccagctg

SEQ ID NO: 6733501 - DNA, 18 bp, Homo sapiens
cccgctgtgtcctccctc

SEQ ID NO: 6733502 - DNA, 19 bp, Homo sapiens
cccgctgtgtcctccctcc

SEQ ID NO: 6733503 - DNA, 17 bp, Homo sapiens
cccgcttagcctgcctc

SEQ ID NO: 6733504 - DNA, 16 bp, Homo sapiens
cccgcttagcgctctg

SEQ ID NO: 6733505 - DNA, 21 bp, Homo sapiens
cccgcttagcgctctggacag

SEQ ID NO: 6733506 - DNA, 15 bp, Homo sapiens
cccgcttagttcttg

SEQ ID NO: 6733507 - DNA, 19 bp, Homo sapiens
cccgcttagttcttgaatt

SEQ ID NO: 6733508 - DNA, 21 bp, Homo sapiens
cccgcttagttcttgaattgt

SEQ ID NO: 6733509 - DNA, 14 bp, Homo sapiens
cccgcttccctcct

SEQ ID NO: 6733510 - DNA, 19 bp, Homo sapiens
cccgcttgcctcggctcct

SEQ ID NO: 6733511 - DNA, 22 bp, Homo sapiens
cccgcttgcctcggctcctgct

SEQ ID NO: 6733512 - DNA, 15 bp, Homo sapiens
cccgctttgcctgct

SEQ ID NO: 6733513 - DNA, 16 bp, Homo sapiens
cccgctttgcctgctt

SEQ ID NO: 6733514 - DNA, 18 bp, Homo sapiens
cccggaagaaccagaagt

SEQ ID NO: 6733515 - DNA, 19 bp, Homo sapiens
cccggaattccgtcaccac

SEQ ID NO: 6733516 - DNA, 13 bp, Homo sapiens
cccggacctacct

SEQ ID NO: 6733517 - DNA, 22 bp, Homo sapiens
cccggacgggggagctttccca

SEQ ID NO: 6733518 - DNA, 18 bp, Homo sapiens
cccggactcaccaacttg

SEQ ID NO: 6733519 - DNA, 23 bp, Homo sapiens
cccggagaagtgtgccttctctc

SEQ ID NO: 6733520 - DNA, 13 bp, Homo sapiens
cccggagcacagc

SEQ ID NO: 6733521 - DNA, 14 bp, Homo sapiens
cccggagcacagcc

SEQ ID NO: 6733522 - DNA, 15 bp, Homo sapiens
cccggagcacagccc

SEQ ID NO: 6733523 - DNA, 20 bp, Homo sapiens
cccggagcacagccctggga

SEQ ID NO: 6733524 - DNA, 20 bp, Homo sapiens
cccggagcagcagcttctcc

SEQ ID NO: 6733525 - DNA, 21 bp, Homo sapiens
cccggagcagcagcttctcca

SEQ ID NO: 6733526 - DNA, 23 bp, Homo sapiens
cccggagccggcactgcatgttc

SEQ ID NO: 6733527 - DNA, 16 bp, Homo sapiens
cccggagcctgtgcag

SEQ ID NO: 6733528 - DNA, 16 bp, Homo sapiens
cccggagcgcacctgc

SEQ ID NO: 6733529 - DNA, 14 bp, Homo sapiens
cccggagctcaagg

SEQ ID NO: 6733530 - DNA, 17 bp, Homo sapiens
cccggagctcaggccct

SEQ ID NO: 6733531 - DNA, 12 bp, Homo sapiens
cccggagctggg

SEQ ID NO: 6733532 - DNA, 20 bp, Homo sapiens
cccggagctgggaaggtccc

SEQ ID NO: 6733533 - DNA, 17 bp, Homo sapiens
cccggaggagctgggcc

SEQ ID NO: 6733534 - DNA, 19 bp, Homo sapiens
cccggaggcgcccacctgc

SEQ ID NO: 6733535 - DNA, 19 bp, Homo sapiens
cccggaggcgtggaggaga

SEQ ID NO: 6733536 - DNA, 21 bp, Homo sapiens
cccggagggaaactgtgaatg

SEQ ID NO: 6733537 - DNA, 15 bp, Homo sapiens
cccggaggtgtcacc

SEQ ID NO: 6733538 - DNA, 20 bp, Homo sapiens
cccggatcagagcaggacct

SEQ ID NO: 6733539 - DNA, 21 bp, Homo sapiens
cccggatcagagcaggacctc

SEQ ID NO: 6733540 - DNA, 22 bp, Homo sapiens
cccggatcagagcaggacctcc

SEQ ID NO: 6733541 - DNA, 15 bp, Homo sapiens
cccggatctccaggc

SEQ ID NO: 6733542 - DNA, 23 bp, Homo sapiens
cccggatgcagaggcctgcaggg

SEQ ID NO: 6733543 - DNA, 20 bp, Homo sapiens
cccggatgcccacccctgct

SEQ ID NO: 6733544 - DNA, 16 bp, Homo sapiens
cccggattctgggagg

SEQ ID NO: 6733545 - DNA, 19 bp, Homo sapiens
cccggattggccctgcccc

SEQ ID NO: 6733546 - DNA, 20 bp, Homo sapiens
cccggattggccctgcccct

SEQ ID NO: 6733547 - DNA, 23 bp, Homo sapiens
cccggcaagcgcttctgctgaaa

SEQ ID NO: 6733548 - DNA, 18 bp, Homo sapiens
cccggcaaggggcgcgcg

SEQ ID NO: 6733549 - DNA, 22 bp, Homo sapiens
cccggcacagagtcgatgctca

SEQ ID NO: 6733550 - DNA, 15 bp, Homo sapiens
cccggcaccccctgc

SEQ ID NO: 6733551 - DNA, 16 bp, Homo sapiens
cccggcaccctctggc

SEQ ID NO: 6733552 - DNA, 13 bp, Homo sapiens
cccggcagacgcc

SEQ ID NO: 6733553 - DNA, 15 bp, Homo sapiens
cccggcagcccccca

SEQ ID NO: 6733554 - DNA, 13 bp, Homo sapiens
cccggcagcccct

SEQ ID NO: 6733555 - DNA, 19 bp, Homo sapiens
cccggcagcgaggctgggc

SEQ ID NO: 6733556 - DNA, 12 bp, Homo sapiens
cccggcaggccc

SEQ ID NO: 6733557 - DNA, 18 bp, Homo sapiens
cccggcaggcctgagaat

SEQ ID NO: 6733558 - DNA, 12 bp, Homo sapiens
cccggcagggcg

SEQ ID NO: 6733559 - DNA, 16 bp, Homo sapiens
cccggcagtgcacgcg

SEQ ID NO: 6733560 - DNA, 13 bp, Homo sapiens
cccggcatcctga

SEQ ID NO: 6733561 - DNA, 17 bp, Homo sapiens
cccggccacacccagcg

SEQ ID NO: 6733562 - DNA, 17 bp, Homo sapiens
cccggccacagctgctg

SEQ ID NO: 6733563 - DNA, 19 bp, Homo sapiens
cccggccacagctgctgga

SEQ ID NO: 6733564 - DNA, 12 bp, Homo sapiens
cccggccacctc

SEQ ID NO: 6733565 - DNA, 15 bp, Homo sapiens
cccggccacctctgc

SEQ ID NO: 6733566 - DNA, 14 bp, Homo sapiens
cccggccacctgcg

SEQ ID NO: 6733567 - DNA, 17 bp, Homo sapiens
cccggccacctgcggtg

SEQ ID NO: 6733568 - DNA, 16 bp, Homo sapiens
cccggccagcgggcac

SEQ ID NO: 6733569 - DNA, 17 bp, Homo sapiens
cccggccagcgggcaca

SEQ ID NO: 6733570 - DNA, 23 bp, Homo sapiens
cccggccagcgggcacagggcac

SEQ ID NO: 6733571 - DNA, 24 bp, Homo sapiens
cccggccagcgggcacagggcacc

SEQ ID NO: 6733572 - DNA, 11 bp, Homo sapiens
cccggccagct

SEQ ID NO: 6733573 - DNA, 16 bp, Homo sapiens
cccggccagctctgga

SEQ ID NO: 6733574 - DNA, 14 bp, Homo sapiens
cccggccagggcct

SEQ ID NO: 6733575 - DNA, 21 bp, Homo sapiens
cccggcccaacccagcccagc

SEQ ID NO: 6733576 - DNA, 15 bp, Homo sapiens
cccggcccacgcaga

SEQ ID NO: 6733577 - DNA, 22 bp, Homo sapiens
cccggcccagagaccccttcct

SEQ ID NO: 6733578 - DNA, 20 bp, Homo sapiens
cccggccccaccccctgggc

SEQ ID NO: 6733579 - DNA, 13 bp, Homo sapiens
cccggccccagcc

SEQ ID NO: 6733580 - DNA, 19 bp, Homo sapiens
cccggcccccgccctctgc

SEQ ID NO: 6733581 - DNA, 15 bp, Homo sapiens
cccggcccctaccag

SEQ ID NO: 6733582 - DNA, 20 bp, Homo sapiens
cccggcccctcaccctctgt

SEQ ID NO: 6733583 - DNA, 15 bp, Homo sapiens
cccggcccctcctga

SEQ ID NO: 6733584 - DNA, 15 bp, Homo sapiens
cccggcccctgctgg

SEQ ID NO: 6733585 - DNA, 16 bp, Homo sapiens
cccggcccctgctggt

SEQ ID NO: 6733586 - DNA, 18 bp, Homo sapiens
cccggcccggctgagccc

SEQ ID NO: 6733587 - DNA, 21 bp, Homo sapiens
cccggccctcccccagctcct

SEQ ID NO: 6733588 - DNA, 16 bp, Homo sapiens
cccggccctgcctgct

SEQ ID NO: 6733589 - DNA, 21 bp, Homo sapiens
cccggccgccccgccccagag

SEQ ID NO: 6733590 - DNA, 17 bp, Homo sapiens
cccggccgcgccgccgc

SEQ ID NO: 6733591 - DNA, 16 bp, Homo sapiens
cccggccggcctggca

SEQ ID NO: 6733592 - DNA, 18 bp, Homo sapiens
cccggcctcagcacccct

SEQ ID NO: 6733593 - DNA, 16 bp, Homo sapiens
cccggcctcagggcgc

SEQ ID NO: 6733594 - DNA, 19 bp, Homo sapiens
cccggcctccactccccca

SEQ ID NO: 6733595 - DNA, 14 bp, Homo sapiens
cccggcctccaggc

SEQ ID NO: 6733596 - DNA, 16 bp, Homo sapiens
cccggcctccaggctg

SEQ ID NO: 6733597 - DNA, 21 bp, Homo sapiens
cccggcctccaggctggggcc

SEQ ID NO: 6733598 - DNA, 15 bp, Homo sapiens
cccggcctccctccc

SEQ ID NO: 6733599 - DNA, 17 bp, Homo sapiens
cccggcctcctagcctc

SEQ ID NO: 6733600 - DNA, 14 bp, Homo sapiens
cccggcctctctgc

SEQ ID NO: 6733601 - DNA, 15 bp, Homo sapiens
cccggcctcttccac

SEQ ID NO: 6733602 - DNA, 17 bp, Homo sapiens
cccggcctcttccaccc

SEQ ID NO: 6733603 - DNA, 22 bp, Homo sapiens
cccggcgaggccggagagctgg

SEQ ID NO: 6733604 - DNA, 14 bp, Homo sapiens
cccggcgccctctg

SEQ ID NO: 6733605 - DNA, 15 bp, Homo sapiens
cccggcgccctctgt

SEQ ID NO: 6733606 - DNA, 18 bp, Homo sapiens
cccggcgccctctgtcct

SEQ ID NO: 6733607 - DNA, 14 bp, Homo sapiens
cccggcgccgggca

SEQ ID NO: 6733608 - DNA, 16 bp, Homo sapiens
cccggcgccgggcacc

SEQ ID NO: 6733609 - DNA, 20 bp, Homo sapiens
cccggcgcctgccctgccca

SEQ ID NO: 6733610 - DNA, 16 bp, Homo sapiens
cccggcgcctggcctc

SEQ ID NO: 6733611 - DNA, 21 bp, Homo sapiens
cccggcgcctggcctccaggc

SEQ ID NO: 6733612 - DNA, 19 bp, Homo sapiens
cccggcggcggccagggac

SEQ ID NO: 6733613 - DNA, 19 bp, Homo sapiens
cccggcggggtgcctgctg

SEQ ID NO: 6733614 - DNA, 19 bp, Homo sapiens
cccggcgtttacctcgtgg

SEQ ID NO: 6733615 - DNA, 20 bp, Homo sapiens
cccggctaatttttgtattt

SEQ ID NO: 6733616 - DNA, 11 bp, Homo sapiens
cccggctccag

SEQ ID NO: 6733617 - DNA, 15 bp, Homo sapiens
cccggctccagagca

SEQ ID NO: 6733618 - DNA, 12 bp, Homo sapiens
cccggctccagg

SEQ ID NO: 6733619 - DNA, 15 bp, Homo sapiens
cccggctccaggctc

SEQ ID NO: 6733620 - DNA, 17 bp, Homo sapiens
cccggctccccctgcca

SEQ ID NO: 6733621 - DNA, 16 bp, Homo sapiens
cccggctccccctgct

SEQ ID NO: 6733622 - DNA, 13 bp, Homo sapiens
cccggctcctggt

SEQ ID NO: 6733623 - DNA, 18 bp, Homo sapiens
cccggctcctggtcacct

SEQ ID NO: 6733624 - DNA, 22 bp, Homo sapiens
cccggctgacacctcccttcgt

SEQ ID NO: 6733625 - DNA, 12 bp, Homo sapiens
cccggctgaccc

SEQ ID NO: 6733626 - DNA, 12 bp, Homo sapiens
cccggctgactc

SEQ ID NO: 6733627 - DNA, 17 bp, Homo sapiens
cccggctgagcccccca

SEQ ID NO: 6733628 - DNA, 20 bp, Homo sapiens
cccggctgagccctgcccca

SEQ ID NO: 6733629 - DNA, 13 bp, Homo sapiens
cccggctgccctt

SEQ ID NO: 6733630 - DNA, 13 bp, Homo sapiens
cccggctgcctgc

SEQ ID NO: 6733631 - DNA, 12 bp, Homo sapiens
cccggctgcgga

SEQ ID NO: 6733632 - DNA, 14 bp, Homo sapiens
cccggctgctgctt

SEQ ID NO: 6733633 - DNA, 13 bp, Homo sapiens
cccggctggactt

SEQ ID NO: 6733634 - DNA, 12 bp, Homo sapiens
cccggctgggcc

SEQ ID NO: 6733635 - DNA, 13 bp, Homo sapiens
cccggctgggccc

SEQ ID NO: 6733636 - DNA, 23 bp, Homo sapiens
cccggcttgcctgtaatcccagc

SEQ ID NO: 6733637 - DNA, 20 bp, Homo sapiens
cccgggaacctccccagcct

SEQ ID NO: 6733638 - DNA, 16 bp, Homo sapiens
cccgggaactcctgcc

SEQ ID NO: 6733639 - DNA, 12 bp, Homo sapiens
cccgggaagcaa

SEQ ID NO: 6733640 - DNA, 23 bp, Homo sapiens
cccgggaagcatcctccccacca

SEQ ID NO: 6733641 - DNA, 16 bp, Homo sapiens
cccgggaaggaaggct

SEQ ID NO: 6733642 - DNA, 18 bp, Homo sapiens
cccgggaagggggctggg

SEQ ID NO: 6733643 - DNA, 22 bp, Homo sapiens
cccgggaagggggctgggacat

SEQ ID NO: 6733644 - DNA, 20 bp, Homo sapiens
cccgggacccacggagccct

SEQ ID NO: 6733645 - DNA, 19 bp, Homo sapiens
cccgggagcctaggaccac

SEQ ID NO: 6733646 - DNA, 14 bp, Homo sapiens
cccgggagcggagg

SEQ ID NO: 6733647 - DNA, 14 bp, Homo sapiens
cccgggagctcagg

SEQ ID NO: 6733648 - DNA, 12 bp, Homo sapiens
cccgggagctgg

SEQ ID NO: 6733649 - DNA, 13 bp, Homo sapiens
cccgggagctggg

SEQ ID NO: 6733650 - DNA, 16 bp, Homo sapiens
cccgggagctgggccc

SEQ ID NO: 6733651 - DNA, 23 bp, Homo sapiens
cccgggaggaggatccgggcttt

SEQ ID NO: 6733652 - DNA, 13 bp, Homo sapiens
cccgggaggcaga

SEQ ID NO: 6733653 - DNA, 15 bp, Homo sapiens
cccgggagggcggca

SEQ ID NO: 6733654 - DNA, 22 bp, Homo sapiens
cccgggaggggcccgcttgcct

SEQ ID NO: 6733655 - DNA, 23 bp, Homo sapiens
cccgggaggggcccgcttgcctc

SEQ ID NO: 6733656 - DNA, 18 bp, Homo sapiens
cccgggatattatagaaa

SEQ ID NO: 6733657 - DNA, 17 bp, Homo sapiens
cccgggatcctgccccc

SEQ ID NO: 6733658 - DNA, 15 bp, Homo sapiens
cccgggatgggtgga

SEQ ID NO: 6733659 - DNA, 16 bp, Homo sapiens
cccgggcaaagggtct

SEQ ID NO: 6733660 - DNA, 19 bp, Homo sapiens
cccgggcactgtcatgccc

SEQ ID NO: 6733661 - DNA, 20 bp, Homo sapiens
cccgggcactgtcatgccca

SEQ ID NO: 6733662 - DNA, 15 bp, Homo sapiens
cccgggcagcagaga

SEQ ID NO: 6733663 - DNA, 14 bp, Homo sapiens
cccgggcaggccag

SEQ ID NO: 6733664 - DNA, 13 bp, Homo sapiens
cccgggcagggct

SEQ ID NO: 6733665 - DNA, 22 bp, Homo sapiens
cccgggcagggctcccacagag

SEQ ID NO: 6733666 - DNA, 17 bp, Homo sapiens
cccgggccacgccccag

SEQ ID NO: 6733667 - DNA, 18 bp, Homo sapiens
cccgggccacgccccagc

SEQ ID NO: 6733668 - DNA, 13 bp, Homo sapiens
cccgggcccagag

SEQ ID NO: 6733669 - DNA, 18 bp, Homo sapiens
cccgggcccccgccccgc

SEQ ID NO: 6733670 - DNA, 23 bp, Homo sapiens
cccgggcccccgccccgcccccg

SEQ ID NO: 6733671 - DNA, 22 bp, Homo sapiens
cccgggcccgttgaggatgagg

SEQ ID NO: 6733672 - DNA, 12 bp, Homo sapiens
cccgggccctca

SEQ ID NO: 6733673 - DNA, 20 bp, Homo sapiens
cccgggccctcctgggcacc

SEQ ID NO: 6733674 - DNA, 21 bp, Homo sapiens
cccgggccctcctgggcaccc

SEQ ID NO: 6733675 - DNA, 18 bp, Homo sapiens
cccgggccctgggcccgg

SEQ ID NO: 6733676 - DNA, 21 bp, Homo sapiens
cccgggccgaccctgcggcct

SEQ ID NO: 6733677 - DNA, 15 bp, Homo sapiens
cccgggcctgcacag

SEQ ID NO: 6733678 - DNA, 22 bp, Homo sapiens
cccgggcctgcctctgactcac

SEQ ID NO: 6733679 - DNA, 19 bp, Homo sapiens
cccgggcgcggccagcccc

SEQ ID NO: 6733680 - DNA, 21 bp, Homo sapiens
cccgggcgcggccagccccgg

SEQ ID NO: 6733681 - DNA, 21 bp, Homo sapiens
cccgggctcagggaccacagc

SEQ ID NO: 6733682 - DNA, 16 bp, Homo sapiens
cccgggctctctgctg

SEQ ID NO: 6733683 - DNA, 12 bp, Homo sapiens
cccgggctctgc

SEQ ID NO: 6733684 - DNA, 15 bp, Homo sapiens
cccgggctctgcctc

SEQ ID NO: 6733685 - DNA, 13 bp, Homo sapiens
cccgggctgcctg

SEQ ID NO: 6733686 - DNA, 15 bp, Homo sapiens
cccgggctgcctggg

SEQ ID NO: 6733687 - DNA, 16 bp, Homo sapiens
cccgggctgcctgggc

SEQ ID NO: 6733688 - DNA, 12 bp, Homo sapiens
cccgggctggcc

SEQ ID NO: 6733689 - DNA, 12 bp, Homo sapiens
cccgggcttccc

SEQ ID NO: 6733690 - DNA, 17 bp, Homo sapiens
cccgggcttcccttctc

SEQ ID NO: 6733691 - DNA, 22 bp, Homo sapiens
cccggggaaaggcaaggtccgg

SEQ ID NO: 6733692 - DNA, 21 bp, Homo sapiens
cccggggaccctgtgacatgg

SEQ ID NO: 6733693 - DNA, 14 bp, Homo sapiens
cccggggactcaag

SEQ ID NO: 6733694 - DNA, 21 bp, Homo sapiens
cccggggagctgcagagcagc

SEQ ID NO: 6733695 - DNA, 11 bp, Homo sapiens
cccggggagga

SEQ ID NO: 6733696 - DNA, 17 bp, Homo sapiens
cccggggaggggccaga

SEQ ID NO: 6733697 - DNA, 18 bp, Homo sapiens
cccggggatcccccgccc

SEQ ID NO: 6733698 - DNA, 17 bp, Homo sapiens
cccggggcaaggtctcc

SEQ ID NO: 6733699 - DNA, 19 bp, Homo sapiens
cccggggcagagctcagag

SEQ ID NO: 6733700 - DNA, 20 bp, Homo sapiens
cccggggcagcagcagccct

SEQ ID NO: 6733701 - DNA, 13 bp, Homo sapiens
cccggggcagctg

SEQ ID NO: 6733702 - DNA, 20 bp, Homo sapiens
cccggggcagctgccagaga

SEQ ID NO: 6733703 - DNA, 16 bp, Homo sapiens
cccggggcagctggca

SEQ ID NO: 6733704 - DNA, 16 bp, Homo sapiens
cccggggccagagaca

SEQ ID NO: 6733705 - DNA, 16 bp, Homo sapiens
cccggggccagcactt

SEQ ID NO: 6733706 - DNA, 13 bp, Homo sapiens
cccggggcccagg

SEQ ID NO: 6733707 - DNA, 16 bp, Homo sapiens
cccggggcccaggact

SEQ ID NO: 6733708 - DNA, 14 bp, Homo sapiens
cccggggcccaggg

SEQ ID NO: 6733709 - DNA, 15 bp, Homo sapiens
cccggggcccagggc

SEQ ID NO: 6733710 - DNA, 16 bp, Homo sapiens
cccggggcccttcctc

SEQ ID NO: 6733711 - DNA, 14 bp, Homo sapiens
cccggggccttcct

SEQ ID NO: 6733712 - DNA, 23 bp, Homo sapiens
cccgggggcagacacctgtgcac

SEQ ID NO: 6733713 - DNA, 18 bp, Homo sapiens
cccgggggcagggtgggg

SEQ ID NO: 6733714 - DNA, 17 bp, Homo sapiens
cccgggggtccccggac

SEQ ID NO: 6733715 - DNA, 23 bp, Homo sapiens
cccggggtccccgccctctctca

SEQ ID NO: 6733716 - DNA, 17 bp, Homo sapiens
cccggggtcctgtggca

SEQ ID NO: 6733717 - DNA, 23 bp, Homo sapiens
cccggggtgagggggggctccct

SEQ ID NO: 6733718 - DNA, 14 bp, Homo sapiens
cccgggtccccagc

SEQ ID NO: 6733719 - DNA, 16 bp, Homo sapiens
cccgggtccccagctc

SEQ ID NO: 6733720 - DNA, 21 bp, Homo sapiens
cccgggtccccagctccccag

SEQ ID NO: 6733721 - DNA, 15 bp, Homo sapiens
cccgggtctcaggcc

SEQ ID NO: 6733722 - DNA, 16 bp, Homo sapiens
cccgggtctctcactg

SEQ ID NO: 6733723 - DNA, 21 bp, Homo sapiens
cccgggtctctcactgttgca

SEQ ID NO: 6733724 - DNA, 19 bp, Homo sapiens
cccgggtgcctcagagcag

SEQ ID NO: 6733725 - DNA, 18 bp, Homo sapiens
cccgggtgtgcctgccct

SEQ ID NO: 6733726 - DNA, 16 bp, Homo sapiens
cccgggttagcctggt

SEQ ID NO: 6733727 - DNA, 20 bp, Homo sapiens
cccgggttcagcctggcctg

SEQ ID NO: 6733728 - DNA, 20 bp, Homo sapiens
cccgggtttggcgggccaag

SEQ ID NO: 6733729 - DNA, 14 bp, Homo sapiens
cccggtaccttcca

SEQ ID NO: 6733730 - DNA, 16 bp, Homo sapiens
cccggtcccaggccgc

SEQ ID NO: 6733731 - DNA, 16 bp, Homo sapiens
cccggtgcagggcctg

SEQ ID NO: 6733732 - DNA, 19 bp, Homo sapiens
cccggtgcagggcctggca

SEQ ID NO: 6733733 - DNA, 14 bp, Homo sapiens
cccggtgcatctgg

SEQ ID NO: 6733734 - DNA, 18 bp, Homo sapiens
cccggtgcccaagaatag

SEQ ID NO: 6733735 - DNA, 13 bp, Homo sapiens
cccggtggcggca

SEQ ID NO: 6733736 - DNA, 23 bp, Homo sapiens
cccggtgtatcctggccctgggg

SEQ ID NO: 6733737 - DNA, 18 bp, Homo sapiens
cccggtgtgaggaggggc

SEQ ID NO: 6733738 - DNA, 18 bp, Homo sapiens
cccggttcagacccctgc

SEQ ID NO: 6733739 - DNA, 15 bp, Homo sapiens
cccggttgcagtcac

SEQ ID NO: 6733740 - DNA, 16 bp, Homo sapiens
cccggttgctggtcag

SEQ ID NO: 6733741 - DNA, 14 bp, Homo sapiens
cccgtaagaccacc

SEQ ID NO: 6733742 - DNA, 24 bp, Homo sapiens
cccgtaagaccaccttcccttcct

SEQ ID NO: 6733743 - DNA, 20 bp, Homo sapiens
cccgtaaggctgtacatagt

SEQ ID NO: 6733744 - DNA, 21 bp, Homo sapiens
cccgtacctcttcccatgact

SEQ ID NO: 6733745 - DNA, 14 bp, Homo sapiens
cccgtagagaatgt

SEQ ID NO: 6733746 - DNA, 14 bp, Homo sapiens
cccgtagctgccag

SEQ ID NO: 6733747 - DNA, 16 bp, Homo sapiens
cccgtaggcagcctct

SEQ ID NO: 6733748 - DNA, 15 bp, Homo sapiens
cccgtcacagcctca

SEQ ID NO: 6733749 - DNA, 18 bp, Homo sapiens
cccgtcaccatctcaggc

SEQ ID NO: 6733750 - DNA, 15 bp, Homo sapiens
cccgtcagctgcttc

SEQ ID NO: 6733751 - DNA, 16 bp, Homo sapiens
cccgtcaggccacagc

SEQ ID NO: 6733752 - DNA, 12 bp, Homo sapiens
cccgtcagggag

SEQ ID NO: 6733753 - DNA, 17 bp, Homo sapiens
cccgtcagggcccaagt

SEQ ID NO: 6733754 - DNA, 14 bp, Homo sapiens
cccgtccattcttc

SEQ ID NO: 6733755 - DNA, 17 bp, Homo sapiens
cccgtccattcttcagt

SEQ ID NO: 6733756 - DNA, 14 bp, Homo sapiens
cccgtcccacctcg

SEQ ID NO: 6733757 - DNA, 15 bp, Homo sapiens
cccgtcccagaggcc

SEQ ID NO: 6733758 - DNA, 14 bp, Homo sapiens
cccgtccccacacg

SEQ ID NO: 6733759 - DNA, 14 bp, Homo sapiens
cccgtcccctgcag

SEQ ID NO: 6733760 - DNA, 20 bp, Homo sapiens
cccgtcccctgcagcctggg

SEQ ID NO: 6733761 - DNA, 19 bp, Homo sapiens
cccgtccctgtcccccagc

SEQ ID NO: 6733762 - DNA, 21 bp, Homo sapiens
cccgtccctgtcccccagcat

SEQ ID NO: 6733763 - DNA, 16 bp, Homo sapiens
cccgtccctttccctg

SEQ ID NO: 6733764 - DNA, 17 bp, Homo sapiens
cccgtccgtccgcccgc

SEQ ID NO: 6733765 - DNA, 13 bp, Homo sapiens
cccgtcctccctc

SEQ ID NO: 6733766 - DNA, 18 bp, Homo sapiens
cccgtcctccctcagcct

SEQ ID NO: 6733767 - DNA, 13 bp, Homo sapiens
cccgtcctgcctg

SEQ ID NO: 6733768 - DNA, 15 bp, Homo sapiens
cccgtcctgcctgtg

SEQ ID NO: 6733769 - DNA, 19 bp, Homo sapiens
cccgtcggactgcccccag

SEQ ID NO: 6733770 - DNA, 22 bp, Homo sapiens
cccgtcggactgcccccagaaa

SEQ ID NO: 6733771 - DNA, 23 bp, Homo sapiens
cccgtcggactgcccccagaaag

SEQ ID NO: 6733772 - DNA, 16 bp, Homo sapiens
cccgtcggagctgcct

SEQ ID NO: 6733773 - DNA, 19 bp, Homo sapiens
cccgtcggagctgcctgca

SEQ ID NO: 6733774 - DNA, 21 bp, Homo sapiens
cccgtcggagctgcctgcagc

SEQ ID NO: 6733775 - DNA, 13 bp, Homo sapiens
cccgtctcagtgt

SEQ ID NO: 6733776 - DNA, 16 bp, Homo sapiens
cccgtctccagctgct

SEQ ID NO: 6733777 - DNA, 23 bp, Homo sapiens
cccgtctctgccctgggctcctc

SEQ ID NO: 6733778 - DNA, 12 bp, Homo sapiens
cccgtctgaccc

SEQ ID NO: 6733779 - DNA, 20 bp, Homo sapiens
cccgtctgattgttcctccc

SEQ ID NO: 6733780 - DNA, 21 bp, Homo sapiens
cccgtctgattgttcctcccc

SEQ ID NO: 6733781 - DNA, 13 bp, Homo sapiens
cccgtctgcccac

SEQ ID NO: 6733782 - DNA, 13 bp, Homo sapiens
cccgtctgcccct

SEQ ID NO: 6733783 - DNA, 14 bp, Homo sapiens
cccgtctgcccctt

SEQ ID NO: 6733784 - DNA, 22 bp, Homo sapiens
cccgtctgggaatcctggacag

SEQ ID NO: 6733785 - DNA, 21 bp, Homo sapiens
cccgtctggggttcagcccct

SEQ ID NO: 6733786 - DNA, 17 bp, Homo sapiens
cccgtctgtccatctgc

SEQ ID NO: 6733787 - DNA, 13 bp, Homo sapiens
cccgtcttcagcc

SEQ ID NO: 6733788 - DNA, 15 bp, Homo sapiens
cccgtcttcctcctc

SEQ ID NO: 6733789 - DNA, 22 bp, Homo sapiens
cccgtgaactcaccgctcaccc

SEQ ID NO: 6733790 - DNA, 19 bp, Homo sapiens
cccgtgaagcagtgcctcg

SEQ ID NO: 6733791 - DNA, 16 bp, Homo sapiens
cccgtgacacatgctc

SEQ ID NO: 6733792 - DNA, 18 bp, Homo sapiens
cccgtgcaaaacatgcta

SEQ ID NO: 6733793 - DNA, 13 bp, Homo sapiens
cccgtgcagactg

SEQ ID NO: 6733794 - DNA, 11 bp, Homo sapiens
cccgtgcagta

SEQ ID NO: 6733795 - DNA, 20 bp, Homo sapiens
cccgtgcatcccccctgctc

SEQ ID NO: 6733796 - DNA, 16 bp, Homo sapiens
cccgtgcccctgggat

SEQ ID NO: 6733797 - DNA, 12 bp, Homo sapiens
cccgtgcccctt

SEQ ID NO: 6733798 - DNA, 16 bp, Homo sapiens
cccgtgcgcagccgcg

SEQ ID NO: 6733799 - DNA, 15 bp, Homo sapiens
cccgtggacacccca

SEQ ID NO: 6733800 - DNA, 17 bp, Homo sapiens
cccgtggacaccccaga

SEQ ID NO: 6733801 - DNA, 13 bp, Homo sapiens
cccgtggaggctg

SEQ ID NO: 6733802 - DNA, 17 bp, Homo sapiens
cccgtggaggctgctcg

SEQ ID NO: 6733803 - DNA, 14 bp, Homo sapiens
cccgtggatggtct

SEQ ID NO: 6733804 - DNA, 15 bp, Homo sapiens
cccgtggccccagcc

SEQ ID NO: 6733805 - DNA, 21 bp, Homo sapiens
cccgtggccccagcctggccc

SEQ ID NO: 6733806 - DNA, 23 bp, Homo sapiens
cccgtggccccagcctggcccag

SEQ ID NO: 6733807 - DNA, 17 bp, Homo sapiens
cccgtggcctggcatct

SEQ ID NO: 6733808 - DNA, 15 bp, Homo sapiens
cccgtggctctggga

SEQ ID NO: 6733809 - DNA, 20 bp, Homo sapiens
cccgtggcttggcatctgtg

SEQ ID NO: 6733810 - DNA, 21 bp, Homo sapiens
cccgtggcttggcatctgtgt

SEQ ID NO: 6733811 - DNA, 22 bp, Homo sapiens
cccgtggcttggcatctgtgtg

SEQ ID NO: 6733812 - DNA, 15 bp, Homo sapiens
cccgtggctttgtgc

SEQ ID NO: 6733813 - DNA, 23 bp, Homo sapiens
cccgtggggccccggctcccacc

SEQ ID NO: 6733814 - DNA, 14 bp, Homo sapiens
cccgtggggccggg

SEQ ID NO: 6733815 - DNA, 15 bp, Homo sapiens
cccgtggggctcccg

SEQ ID NO: 6733816 - DNA, 16 bp, Homo sapiens
cccgtggggctcccgg

SEQ ID NO: 6733817 - DNA, 20 bp, Homo sapiens
cccgtgggtgggcctggccc

SEQ ID NO: 6733818 - DNA, 22 bp, Homo sapiens
cccgtgggtgggcctggccctg

SEQ ID NO: 6733819 - DNA, 12 bp, Homo sapiens
cccgtggtcttt

SEQ ID NO: 6733820 - DNA, 16 bp, Homo sapiens
cccgtgtaaaaagcct

SEQ ID NO: 6733821 - DNA, 18 bp, Homo sapiens
cccgtgtaaatatgtaca

SEQ ID NO: 6733822 - DNA, 18 bp, Homo sapiens
cccgtgtccccccaggtg

SEQ ID NO: 6733823 - DNA, 15 bp, Homo sapiens
cccgtgtcctgcctg

SEQ ID NO: 6733824 - DNA, 15 bp, Homo sapiens
cccgtgtgaatgtag

SEQ ID NO: 6733825 - DNA, 22 bp, Homo sapiens
cccgtgtgaatgtagcttccac

SEQ ID NO: 6733826 - DNA, 21 bp, Homo sapiens
cccgtgtgcacaccaccctcc

SEQ ID NO: 6733827 - DNA, 17 bp, Homo sapiens
cccgtgtgccccaagag

SEQ ID NO: 6733828 - DNA, 18 bp, Homo sapiens
cccgtgtgccccaagagg

SEQ ID NO: 6733829 - DNA, 17 bp, Homo sapiens
cccgtgtggccccttca

SEQ ID NO: 6733830 - DNA, 22 bp, Homo sapiens
cccgtgtggccccttcacttct

SEQ ID NO: 6733831 - DNA, 16 bp, Homo sapiens
cccgtgtggcttacaa

SEQ ID NO: 6733832 - DNA, 18 bp, Homo sapiens
cccgtgtgtatttctaag

SEQ ID NO: 6733833 - DNA, 17 bp, Homo sapiens
cccgtgtgtggttggaa

SEQ ID NO: 6733834 - DNA, 12 bp, Homo sapiens
cccgtgtgtgtg

SEQ ID NO: 6733835 - DNA, 15 bp, Homo sapiens
cccgtgtgtgtggcc

SEQ ID NO: 6733836 - DNA, 13 bp, Homo sapiens
cccgtgtgtgtgt

SEQ ID NO: 6733837 - DNA, 17 bp, Homo sapiens
cccgtgttcacacacac

SEQ ID NO: 6733838 - DNA, 21 bp, Homo sapiens
cccgttaaataattccctatg

SEQ ID NO: 6733839 - DNA, 22 bp, Homo sapiens
cccgttaatttaaagctgtttc

SEQ ID NO: 6733840 - DNA, 14 bp, Homo sapiens
cccgttcaccttct

SEQ ID NO: 6733841 - DNA, 14 bp, Homo sapiens
cccgttcccagcgc

SEQ ID NO: 6733842 - DNA, 22 bp, Homo sapiens
cccgttccgtgggatgccataa

SEQ ID NO: 6733843 - DNA, 15 bp, Homo sapiens
cccgttgccccactc

SEQ ID NO: 6733844 - DNA, 19 bp, Homo sapiens
cccgttgcggggtggagtg

SEQ ID NO: 6733845 - DNA, 18 bp, Homo sapiens
cccgttgttgtccctgca

SEQ ID NO: 6733846 - DNA, 14 bp, Homo sapiens
cccgtttcagaagg

SEQ ID NO: 6733847 - DNA, 22 bp, Homo sapiens
cccgtttcagtggaccctgtgg

SEQ ID NO: 6733848 - DNA, 12 bp, Homo sapiens
cccgtttctcca

SEQ ID NO: 6733849 - DNA, 21 bp, Homo sapiens
cccgtttgtcaaagaggatgg

SEQ ID NO: 6733850 - DNA, 22 bp, Homo sapiens
cccgttttaccaataaactgag

SEQ ID NO: 6733851 - DNA, 19 bp, Homo sapiens
cccgttttatgatttactc

SEQ ID NO: 6733852 - DNA, 19 bp, Homo sapiens
ccctaaaaacaaaacaaac

SEQ ID NO: 6733853 - DNA, 13 bp, Homo sapiens
ccctaaaataaaa

SEQ ID NO: 6733854 - DNA, 22 bp, Homo sapiens
ccctaaaccccaagcttcccaa

SEQ ID NO: 6733855 - DNA, 18 bp, Homo sapiens
ccctaaacccctgtccca

SEQ ID NO: 6733856 - DNA, 12 bp, Homo sapiens
ccctaaactgta

SEQ ID NO: 6733857 - DNA, 17 bp, Homo sapiens
ccctaaactttggcctt

SEQ ID NO: 6733858 - DNA, 17 bp, Homo sapiens
ccctaaagatgggagga

SEQ ID NO: 6733859 - DNA, 21 bp, Homo sapiens
ccctaaagcagtaaaataaaa

SEQ ID NO: 6733860 - DNA, 14 bp, Homo sapiens
ccctaaagccaggc

SEQ ID NO: 6733861 - DNA, 19 bp, Homo sapiens
ccctaaagccaggctcagg

SEQ ID NO: 6733862 - DNA, 19 bp, Homo sapiens
ccctaaataataaaaataa

SEQ ID NO: 6733863 - DNA, 15 bp, Homo sapiens
ccctaaccaaatgct

SEQ ID NO: 6733864 - DNA, 15 bp, Homo sapiens
ccctaaccaagttcc

SEQ ID NO: 6733865 - DNA, 19 bp, Homo sapiens
ccctaactctgcccaccct

SEQ ID NO: 6733866 - DNA, 16 bp, Homo sapiens
ccctaactcttgctca

SEQ ID NO: 6733867 - DNA, 21 bp, Homo sapiens
ccctaactcttgctcactccc

SEQ ID NO: 6733868 - DNA, 14 bp, Homo sapiens
ccctaactgcagac

SEQ ID NO: 6733869 - DNA, 17 bp, Homo sapiens
ccctaagaatgctttgc

SEQ ID NO: 6733870 - DNA, 18 bp, Homo sapiens
ccctaagactgccttcag

SEQ ID NO: 6733871 - DNA, 12 bp, Homo sapiens
ccctaagagact

SEQ ID NO: 6733872 - DNA, 21 bp, Homo sapiens
ccctaagcagaaagtgccttt

SEQ ID NO: 6733873 - DNA, 23 bp, Homo sapiens
ccctaagcatggtcccttgtcac

SEQ ID NO: 6733874 - DNA, 17 bp, Homo sapiens
ccctaagccaagggcct

SEQ ID NO: 6733875 - DNA, 13 bp, Homo sapiens
ccctaagccactc

SEQ ID NO: 6733876 - DNA, 14 bp, Homo sapiens
ccctaagccagcct

SEQ ID NO: 6733877 - DNA, 16 bp, Homo sapiens
ccctaagcccccaggg

SEQ ID NO: 6733878 - DNA, 18 bp, Homo sapiens
ccctaagcccccagggcc

SEQ ID NO: 6733879 - DNA, 21 bp, Homo sapiens
ccctaaggtcattaccacagg

SEQ ID NO: 6733880 - DNA, 13 bp, Homo sapiens
ccctaaggtccta

SEQ ID NO: 6733881 - DNA, 22 bp, Homo sapiens
ccctaagtaagtttcttcctgc

SEQ ID NO: 6733882 - DNA, 23 bp, Homo sapiens
ccctaagtggattggctttgtgc

SEQ ID NO: 6733883 - DNA, 20 bp, Homo sapiens
ccctaagtggctgccttctt

SEQ ID NO: 6733884 - DNA, 14 bp, Homo sapiens
ccctaataagaccc

SEQ ID NO: 6733885 - DNA, 14 bp, Homo sapiens
ccctaatcctccaa

SEQ ID NO: 6733886 - DNA, 22 bp, Homo sapiens
ccctaatctatggtcgggagac

SEQ ID NO: 6733887 - DNA, 23 bp, Homo sapiens
ccctaatctttcacttgaaagat

SEQ ID NO: 6733888 - DNA, 20 bp, Homo sapiens
ccctaatgagggtgtgagaa

SEQ ID NO: 6733889 - DNA, 12 bp, Homo sapiens
ccctaatgcctg

SEQ ID NO: 6733890 - DNA, 19 bp, Homo sapiens
ccctaatgttttgcttaaa

SEQ ID NO: 6733891 - DNA, 16 bp, Homo sapiens
ccctaattcagccatg

SEQ ID NO: 6733892 - DNA, 19 bp, Homo sapiens
ccctaatttatcttcatgt

SEQ ID NO: 6733893 - DNA, 12 bp, Homo sapiens
ccctacaaacct

SEQ ID NO: 6733894 - DNA, 18 bp, Homo sapiens
ccctacaaacctgtattt

SEQ ID NO: 6733895 - DNA, 22 bp, Homo sapiens
ccctacacaaggacagaaccct

SEQ ID NO: 6733896 - DNA, 15 bp, Homo sapiens
ccctacacacacact

SEQ ID NO: 6733897 - DNA, 17 bp, Homo sapiens
ccctacacacacactcc

SEQ ID NO: 6733898 - DNA, 18 bp, Homo sapiens
ccctacacacagaccgcg

SEQ ID NO: 6733899 - DNA, 15 bp, Homo sapiens
ccctacacctctggg

SEQ ID NO: 6733900 - DNA, 20 bp, Homo sapiens
ccctacagacagcttacagg

SEQ ID NO: 6733901 - DNA, 16 bp, Homo sapiens
ccctacagcagatcca

SEQ ID NO: 6733902 - DNA, 17 bp, Homo sapiens
ccctacagcagatccac

SEQ ID NO: 6733903 - DNA, 15 bp, Homo sapiens
ccctacagcctgcac

SEQ ID NO: 6733904 - DNA, 17 bp, Homo sapiens
ccctacagcctgcacac

SEQ ID NO: 6733905 - DNA, 19 bp, Homo sapiens
ccctacagcctgcacacac

SEQ ID NO: 6733906 - DNA, 20 bp, Homo sapiens
ccctacagcctgcacacacc

SEQ ID NO: 6733907 - DNA, 13 bp, Homo sapiens
ccctacagtatat

SEQ ID NO: 6733908 - DNA, 19 bp, Homo sapiens
ccctacagtatataagctt

SEQ ID NO: 6733909 - DNA, 20 bp, Homo sapiens
ccctacagttgaaaaacagc

SEQ ID NO: 6733910 - DNA, 19 bp, Homo sapiens
ccctacatcttcagctccc

SEQ ID NO: 6733911 - DNA, 21 bp, Homo sapiens
ccctacatcttcagctcccat

SEQ ID NO: 6733912 - DNA, 23 bp, Homo sapiens
ccctacatcttcagctcccatag

SEQ ID NO: 6733913 - DNA, 24 bp, Homo sapiens
ccctacatcttcagctcccatagc

SEQ ID NO: 6733914 - DNA, 14 bp, Homo sapiens
ccctacatgtattg

SEQ ID NO: 6733915 - DNA, 18 bp, Homo sapiens
ccctaccactgagccctt

SEQ ID NO: 6733916 - DNA, 20 bp, Homo sapiens
ccctaccactgtcttcttca

SEQ ID NO: 6733917 - DNA, 20 bp, Homo sapiens
ccctaccagcgcccgctggg

SEQ ID NO: 6733918 - DNA, 21 bp, Homo sapiens
ccctaccagcgcccgctgggc

SEQ ID NO: 6733919 - DNA, 13 bp, Homo sapiens
ccctaccagctcc

SEQ ID NO: 6733920 - DNA, 14 bp, Homo sapiens
ccctaccagctcct

SEQ ID NO: 6733921 - DNA, 20 bp, Homo sapiens
ccctaccagctcctccagcc

SEQ ID NO: 6733922 - DNA, 15 bp, Homo sapiens
ccctacccaaccctg

SEQ ID NO: 6733923 - DNA, 20 bp, Homo sapiens
ccctacccaatgtctcccac

SEQ ID NO: 6733924 - DNA, 16 bp, Homo sapiens
ccctacccactctttg

SEQ ID NO: 6733925 - DNA, 14 bp, Homo sapiens
ccctacccagtccc

SEQ ID NO: 6733926 - DNA, 21 bp, Homo sapiens
ccctaccccacaccaggccgt

SEQ ID NO: 6733927 - DNA, 18 bp, Homo sapiens
ccctaccccctcatcccc

SEQ ID NO: 6733928 - DNA, 16 bp, Homo sapiens
ccctacccctggctgt

SEQ ID NO: 6733929 - DNA, 22 bp, Homo sapiens
ccctacccggctcgttccccca

SEQ ID NO: 6733930 - DNA, 12 bp, Homo sapiens
ccctaccctcct

SEQ ID NO: 6733931 - DNA, 15 bp, Homo sapiens
ccctaccctcctgct

SEQ ID NO: 6733932 - DNA, 16 bp, Homo sapiens
ccctaccctcctgctg

SEQ ID NO: 6733933 - DNA, 13 bp, Homo sapiens
ccctaccctctag

SEQ ID NO: 6733934 - DNA, 17 bp, Homo sapiens
ccctaccctcttctcag

SEQ ID NO: 6733935 - DNA, 18 bp, Homo sapiens
ccctaccgagtctcttct

SEQ ID NO: 6733936 - DNA, 22 bp, Homo sapiens
ccctaccgcatggcagctgggc

SEQ ID NO: 6733937 - DNA, 23 bp, Homo sapiens
ccctaccgcatggcagctgggcc

SEQ ID NO: 6733938 - DNA, 18 bp, Homo sapiens
ccctacctcaacctgtaa

SEQ ID NO: 6733939 - DNA, 19 bp, Homo sapiens
ccctacctcaacctgtaaa

SEQ ID NO: 6733940 - DNA, 20 bp, Homo sapiens
ccctacctcaacctgtaaat

SEQ ID NO: 6733941 - DNA, 13 bp, Homo sapiens
ccctacctcaggc

SEQ ID NO: 6733942 - DNA, 16 bp, Homo sapiens
ccctacctcaggcagg

SEQ ID NO: 6733943 - DNA, 18 bp, Homo sapiens
ccctacctccctcctcag

SEQ ID NO: 6733944 - DNA, 20 bp, Homo sapiens
ccctacctccctcctcaggg

SEQ ID NO: 6733945 - DNA, 22 bp, Homo sapiens
ccctacctccctcctcaggggc

SEQ ID NO: 6733946 - DNA, 16 bp, Homo sapiens
ccctacctgccccact

SEQ ID NO: 6733947 - DNA, 19 bp, Homo sapiens
ccctacctgttcagtgtcc

SEQ ID NO: 6733948 - DNA, 13 bp, Homo sapiens
ccctaccttgcct

SEQ ID NO: 6733949 - DNA, 14 bp, Homo sapiens
ccctaccttgcctc

SEQ ID NO: 6733950 - DNA, 13 bp, Homo sapiens
ccctacggaccag

SEQ ID NO: 6733951 - DNA, 18 bp, Homo sapiens
ccctactacactttgcta

SEQ ID NO: 6733952 - DNA, 19 bp, Homo sapiens
ccctactagagacctctca

SEQ ID NO: 6733953 - DNA, 23 bp, Homo sapiens
ccctactattcagtggcgagaaa

SEQ ID NO: 6733954 - DNA, 14 bp, Homo sapiens
ccctactccactgc

SEQ ID NO: 6733955 - DNA, 18 bp, Homo sapiens
ccctactccactgccctg

SEQ ID NO: 6733956 - DNA, 16 bp, Homo sapiens
ccctactcccctgggc

SEQ ID NO: 6733957 - DNA, 15 bp, Homo sapiens
ccctactccctgcag

SEQ ID NO: 6733958 - DNA, 21 bp, Homo sapiens
ccctactccctgcagatgcca

SEQ ID NO: 6733959 - DNA, 18 bp, Homo sapiens
ccctactcggatggggca

SEQ ID NO: 6733960 - DNA, 20 bp, Homo sapiens
ccctactgaaccctgcctct

SEQ ID NO: 6733961 - DNA, 12 bp, Homo sapiens
ccctactggctg

SEQ ID NO: 6733962 - DNA, 13 bp, Homo sapiens
ccctactggctgt

SEQ ID NO: 6733963 - DNA, 14 bp, Homo sapiens
ccctactggctgta

SEQ ID NO: 6733964 - DNA, 11 bp, Homo sapiens
ccctactgtgg

SEQ ID NO: 6733965 - DNA, 13 bp, Homo sapiens
ccctactgtgggg

SEQ ID NO: 6733966 - DNA, 16 bp, Homo sapiens
ccctacttccaggatg

SEQ ID NO: 6733967 - DNA, 14 bp, Homo sapiens
ccctacttgagata

SEQ ID NO: 6733968 - DNA, 13 bp, Homo sapiens
ccctacttgataa

SEQ ID NO: 6733969 - DNA, 13 bp, Homo sapiens
ccctacttgcagc

SEQ ID NO: 6733970 - DNA, 18 bp, Homo sapiens
ccctagaaacccaagctc

SEQ ID NO: 6733971 - DNA, 15 bp, Homo sapiens
ccctagaaaggagag

SEQ ID NO: 6733972 - DNA, 22 bp, Homo sapiens
ccctagaagaaaacccgaggga

SEQ ID NO: 6733973 - DNA, 20 bp, Homo sapiens
ccctagaagatcacagcagg

SEQ ID NO: 6733974 - DNA, 21 bp, Homo sapiens
ccctagaagatcacagcaggg

SEQ ID NO: 6733975 - DNA, 22 bp, Homo sapiens
ccctagacatggcctctggaaa

SEQ ID NO: 6733976 - DNA, 16 bp, Homo sapiens
ccctagacctccccct

SEQ ID NO: 6733977 - DNA, 18 bp, Homo sapiens
ccctagacctccccctca

SEQ ID NO: 6733978 - DNA, 13 bp, Homo sapiens
ccctagactgcat

SEQ ID NO: 6733979 - DNA, 22 bp, Homo sapiens
ccctagactttaggctttcagc

SEQ ID NO: 6733980 - DNA, 16 bp, Homo sapiens
ccctagagacagtgat

SEQ ID NO: 6733981 - DNA, 16 bp, Homo sapiens
ccctagagagaataaa

SEQ ID NO: 6733982 - DNA, 21 bp, Homo sapiens
ccctagagccctctcctccct

SEQ ID NO: 6733983 - DNA, 15 bp, Homo sapiens
ccctagagcctgcct

SEQ ID NO: 6733984 - DNA, 20 bp, Homo sapiens
ccctagagcctgcctggagc

SEQ ID NO: 6733985 - DNA, 21 bp, Homo sapiens
ccctagagcctgcctggagcg

SEQ ID NO: 6733986 - DNA, 19 bp, Homo sapiens
ccctagaggacactaggag

SEQ ID NO: 6733987 - DNA, 21 bp, Homo sapiens
ccctagaggacactaggagac

SEQ ID NO: 6733988 - DNA, 13 bp, Homo sapiens
ccctagatagttt

SEQ ID NO: 6733989 - DNA, 13 bp, Homo sapiens
ccctagatccaga

SEQ ID NO: 6733990 - DNA, 16 bp, Homo sapiens
ccctagatccagaaat

SEQ ID NO: 6733991 - DNA, 23 bp, Homo sapiens
ccctagatccaggcttctcccgg

SEQ ID NO: 6733992 - DNA, 19 bp, Homo sapiens
ccctagatggttccctttg

SEQ ID NO: 6733993 - DNA, 21 bp, Homo sapiens
ccctagcaaaatgctaggcct

SEQ ID NO: 6733994 - DNA, 21 bp, Homo sapiens
ccctagcacaaatttgctttg

SEQ ID NO: 6733995 - DNA, 23 bp, Homo sapiens
ccctagcagcccaccctgctgct

SEQ ID NO: 6733996 - DNA, 21 bp, Homo sapiens
ccctagcaggaacttctagct

SEQ ID NO: 6733997 - DNA, 13 bp, Homo sapiens
ccctagcagtgaa

SEQ ID NO: 6733998 - DNA, 19 bp, Homo sapiens
ccctagccagagaatagat

SEQ ID NO: 6733999 - DNA, 13 bp, Homo sapiens
ccctagccattcc

SEQ ID NO: 6734000 - DNA, 15 bp, Homo sapiens
ccctagccattcctg

SEQ ID NO: 6734001 - DNA, 15 bp, Homo sapiens
ccctagcccagactc

SEQ ID NO: 6734002 - DNA, 17 bp, Homo sapiens
ccctagcccagactctg

SEQ ID NO: 6734003 - DNA, 19 bp, Homo sapiens
ccctagcccagactctgag

SEQ ID NO: 6734004 - DNA, 16 bp, Homo sapiens
ccctagccctggttag

SEQ ID NO: 6734005 - DNA, 13 bp, Homo sapiens
ccctagcccttcc

SEQ ID NO: 6734006 - DNA, 23 bp, Homo sapiens
ccctagccggttcctgtccctgc

SEQ ID NO: 6734007 - DNA, 11 bp, Homo sapiens
ccctagccttg

SEQ ID NO: 6734008 - DNA, 15 bp, Homo sapiens
ccctagctaataaac

SEQ ID NO: 6734009 - DNA, 21 bp, Homo sapiens
ccctagctataccagcagaaa

SEQ ID NO: 6734010 - DNA, 18 bp, Homo sapiens
ccctagctcaccaggcct

SEQ ID NO: 6734011 - DNA, 19 bp, Homo sapiens
ccctagctcttccccatct

SEQ ID NO: 6734012 - DNA, 14 bp, Homo sapiens
ccctagctgtccca

SEQ ID NO: 6734013 - DNA, 22 bp, Homo sapiens
ccctagcttagagcctccctca

SEQ ID NO: 6734014 - DNA, 19 bp, Homo sapiens
ccctaggagggaaggagct

SEQ ID NO: 6734015 - DNA, 20 bp, Homo sapiens
ccctaggagtatatttccgc

SEQ ID NO: 6734016 - DNA, 21 bp, Homo sapiens
ccctaggagtatatttccgca

SEQ ID NO: 6734017 - DNA, 21 bp, Homo sapiens
ccctaggatgctgcagcagag

SEQ ID NO: 6734018 - DNA, 17 bp, Homo sapiens
ccctaggattccccctg

SEQ ID NO: 6734019 - DNA, 22 bp, Homo sapiens
ccctaggattccccctgccctg

SEQ ID NO: 6734020 - DNA, 19 bp, Homo sapiens
ccctaggcatactctccag

SEQ ID NO: 6734021 - DNA, 21 bp, Homo sapiens
ccctaggctgagctggcattg

SEQ ID NO: 6734022 - DNA, 23 bp, Homo sapiens
ccctagggaaaacacggccctcc

SEQ ID NO: 6734023 - DNA, 13 bp, Homo sapiens
ccctagggctctc

SEQ ID NO: 6734024 - DNA, 13 bp, Homo sapiens
ccctagggctggg

SEQ ID NO: 6734025 - DNA, 15 bp, Homo sapiens
ccctagggctgggtg

SEQ ID NO: 6734026 - DNA, 14 bp, Homo sapiens
ccctaggggacact

SEQ ID NO: 6734027 - DNA, 20 bp, Homo sapiens
ccctaggtctccacccctca

SEQ ID NO: 6734028 - DNA, 15 bp, Homo sapiens
ccctaggtgttttgt

SEQ ID NO: 6734029 - DNA, 22 bp, Homo sapiens
ccctaggtgttttgttcaccat

SEQ ID NO: 6734030 - DNA, 17 bp, Homo sapiens
ccctaggttcccggtcc

SEQ ID NO: 6734031 - DNA, 19 bp, Homo sapiens
ccctaggttccctgttctt

SEQ ID NO: 6734032 - DNA, 23 bp, Homo sapiens
ccctaggttccctgttcttcctc

SEQ ID NO: 6734033 - DNA, 17 bp, Homo sapiens
ccctagtatctggctgg

SEQ ID NO: 6734034 - DNA, 19 bp, Homo sapiens
ccctagtgacccggaggcc

SEQ ID NO: 6734035 - DNA, 17 bp, Homo sapiens
ccctagtgggagcccag

SEQ ID NO: 6734036 - DNA, 19 bp, Homo sapiens
ccctagttagcatccaggc

SEQ ID NO: 6734037 - DNA, 21 bp, Homo sapiens
ccctagttccctctgctcagc

SEQ ID NO: 6734038 - DNA, 13 bp, Homo sapiens
ccctagttctttg

SEQ ID NO: 6734039 - DNA, 15 bp, Homo sapiens
ccctataataaaggc

SEQ ID NO: 6734040 - DNA, 18 bp, Homo sapiens
ccctataatgctggagcg

SEQ ID NO: 6734041 - DNA, 16 bp, Homo sapiens
ccctatacactagaca

SEQ ID NO: 6734042 - DNA, 22 bp, Homo sapiens
ccctatacctgagcctcaacct

SEQ ID NO: 6734043 - DNA, 19 bp, Homo sapiens
ccctatactgtagtattct

SEQ ID NO: 6734044 - DNA, 18 bp, Homo sapiens
ccctataggaacagccca

SEQ ID NO: 6734045 - DNA, 22 bp, Homo sapiens
ccctatatcagggcctgagtga

SEQ ID NO: 6734046 - DNA, 19 bp, Homo sapiens
ccctatatctataaacact

SEQ ID NO: 6734047 - DNA, 11 bp, Homo sapiens
ccctatcaaaa

SEQ ID NO: 6734048 - DNA, 21 bp, Homo sapiens
ccctatcaaaacatatcaatt

SEQ ID NO: 6734049 - DNA, 14 bp, Homo sapiens
ccctatcctcccct

SEQ ID NO: 6734050 - DNA, 14 bp, Homo sapiens
ccctatcctgcacc

SEQ ID NO: 6734051 - DNA, 17 bp, Homo sapiens
ccctatcctgcaccctc

SEQ ID NO: 6734052 - DNA, 20 bp, Homo sapiens
ccctatcctgcaccctctgc

SEQ ID NO: 6734053 - DNA, 14 bp, Homo sapiens
ccctatccttggca

SEQ ID NO: 6734054 - DNA, 16 bp, Homo sapiens
ccctatccttggcacc

SEQ ID NO: 6734055 - DNA, 19 bp, Homo sapiens
ccctatccttggcaccaaa

SEQ ID NO: 6734056 - DNA, 23 bp, Homo sapiens
ccctatctaaccctcccatggca

SEQ ID NO: 6734057 - DNA, 18 bp, Homo sapiens
ccctatctatgtcctgga

SEQ ID NO: 6734058 - DNA, 17 bp, Homo sapiens
ccctatctcctgacaga

SEQ ID NO: 6734059 - DNA, 20 bp, Homo sapiens
ccctatctcctgacagaagg

SEQ ID NO: 6734060 - DNA, 22 bp, Homo sapiens
ccctatctccttcccaccccta

SEQ ID NO: 6734061 - DNA, 19 bp, Homo sapiens
ccctatcttgtcctggaat

SEQ ID NO: 6734062 - DNA, 14 bp, Homo sapiens
ccctatcttgtgaa

SEQ ID NO: 6734063 - DNA, 19 bp, Homo sapiens
ccctatctttgccaccctc

SEQ ID NO: 6734064 - DNA, 20 bp, Homo sapiens
ccctatgaaagattccacag

SEQ ID NO: 6734065 - DNA, 13 bp, Homo sapiens
ccctatgctgtgc

SEQ ID NO: 6734066 - DNA, 18 bp, Homo sapiens
ccctatggagaggcttcc

SEQ ID NO: 6734067 - DNA, 21 bp, Homo sapiens
ccctatgggcctgccgggctg

SEQ ID NO: 6734068 - DNA, 15 bp, Homo sapiens
ccctatgtcccagcc

SEQ ID NO: 6734069 - DNA, 24 bp, Homo sapiens
ccctatgtcccagcccctggtact

SEQ ID NO: 6734070 - DNA, 15 bp, Homo sapiens
ccctattccctaact

SEQ ID NO: 6734071 - DNA, 21 bp, Homo sapiens
ccctattctatccatctcctg

SEQ ID NO: 6734072 - DNA, 13 bp, Homo sapiens
ccctattgctgct

SEQ ID NO: 6734073 - DNA, 21 bp, Homo sapiens
ccctattggcttactgaaaga

SEQ ID NO: 6734074 - DNA, 17 bp, Homo sapiens
ccctattggtaaagaat

SEQ ID NO: 6734075 - DNA, 15 bp, Homo sapiens
ccctatttaaatgaa

SEQ ID NO: 6734076 - DNA, 17 bp, Homo sapiens
ccctatttattgacttt

SEQ ID NO: 6734077 - DNA, 11 bp, Homo sapiens
ccctatttcta

SEQ ID NO: 6734078 - DNA, 17 bp, Homo sapiens
ccctcaaaaaaagcctt

SEQ ID NO: 6734079 - DNA, 24 bp, Homo sapiens
ccctcaaacctcctcttctgacgt

SEQ ID NO: 6734080 - DNA, 16 bp, Homo sapiens
ccctcaaagaggcctt

SEQ ID NO: 6734081 - DNA, 18 bp, Homo sapiens
ccctcaaatgacccaaag

SEQ ID NO: 6734082 - DNA, 15 bp, Homo sapiens
ccctcaaatgtcaga

SEQ ID NO: 6734083 - DNA, 17 bp, Homo sapiens
ccctcaacaagggagag

SEQ ID NO: 6734084 - DNA, 15 bp, Homo sapiens
ccctcaacaccctgc

SEQ ID NO: 6734085 - DNA, 16 bp, Homo sapiens
ccctcaacaccctgct

SEQ ID NO: 6734086 - DNA, 18 bp, Homo sapiens
ccctcaacaccctgcttc

SEQ ID NO: 6734087 - DNA, 21 bp, Homo sapiens
ccctcaacaccctgcttctcc

SEQ ID NO: 6734088 - DNA, 16 bp, Homo sapiens
ccctcaacacctctgc

SEQ ID NO: 6734089 - DNA, 19 bp, Homo sapiens
ccctcaacaggcccaggga

SEQ ID NO: 6734090 - DNA, 16 bp, Homo sapiens
ccctcaacctcttctg

SEQ ID NO: 6734091 - DNA, 20 bp, Homo sapiens
ccctcaactctcctccagag

SEQ ID NO: 6734092 - DNA, 15 bp, Homo sapiens
ccctcaagaacatga

SEQ ID NO: 6734093 - DNA, 16 bp, Homo sapiens
ccctcaagaacatgat

SEQ ID NO: 6734094 - DNA, 21 bp, Homo sapiens
ccctcaagaacatgatgggcc

SEQ ID NO: 6734095 - DNA, 20 bp, Homo sapiens
ccctcaagagcaaagtagat

SEQ ID NO: 6734096 - DNA, 21 bp, Homo sapiens
ccctcaagccaggagaccctg

SEQ ID NO: 6734097 - DNA, 22 bp, Homo sapiens
ccctcaagccaggagaccctgt

SEQ ID NO: 6734098 - DNA, 17 bp, Homo sapiens
ccctcaagccccagcag

SEQ ID NO: 6734099 - DNA, 23 bp, Homo sapiens
ccctcaagccccagcagccctca

SEQ ID NO: 6734100 - DNA, 16 bp, Homo sapiens
ccctcaagctttcctg

SEQ ID NO: 6734101 - DNA, 18 bp, Homo sapiens
ccctcaaggcctcccaca

SEQ ID NO: 6734102 - DNA, 20 bp, Homo sapiens
ccctcaaggcctcccacagt

SEQ ID NO: 6734103 - DNA, 17 bp, Homo sapiens
ccctcaaggggcaggga

SEQ ID NO: 6734104 - DNA, 23 bp, Homo sapiens
ccctcaagtctttctctttccct

SEQ ID NO: 6734105 - DNA, 22 bp, Homo sapiens
ccctcaatccccaagctggcag

SEQ ID NO: 6734106 - DNA, 19 bp, Homo sapiens
ccctcaattccccctggcc

SEQ ID NO: 6734107 - DNA, 22 bp, Homo sapiens
ccctcacaacagtcacctcaca

SEQ ID NO: 6734108 - DNA, 18 bp, Homo sapiens
ccctcacaagcgctccca

SEQ ID NO: 6734109 - DNA, 21 bp, Homo sapiens
ccctcacaagtaacagttgaa

SEQ ID NO: 6734110 - DNA, 17 bp, Homo sapiens
ccctcacacacacagct

SEQ ID NO: 6734111 - DNA, 18 bp, Homo sapiens
ccctcacacacacccccc

SEQ ID NO: 6734112 - DNA, 20 bp, Homo sapiens
ccctcacacacaccccccca

SEQ ID NO: 6734113 - DNA, 15 bp, Homo sapiens
ccctcacacaccctg

SEQ ID NO: 6734114 - DNA, 16 bp, Homo sapiens
ccctcacactgcaagg

SEQ ID NO: 6734115 - DNA, 23 bp, Homo sapiens
ccctcacagactcttccaccaga

SEQ ID NO: 6734116 - DNA, 14 bp, Homo sapiens
ccctcacagcctct

SEQ ID NO: 6734117 - DNA, 16 bp, Homo sapiens
ccctcacatcctctcc

SEQ ID NO: 6734118 - DNA, 13 bp, Homo sapiens
ccctcaccaccac

SEQ ID NO: 6734119 - DNA, 17 bp, Homo sapiens
ccctcaccacctgcccg

SEQ ID NO: 6734120 - DNA, 14 bp, Homo sapiens
ccctcaccaggggc

SEQ ID NO: 6734121 - DNA, 9 bp, Homo sapiens
ccctcaccc

SEQ ID NO: 6734122 - DNA, 13 bp, Homo sapiens
ccctcacccactc

SEQ ID NO: 6734123 - DNA, 13 bp, Homo sapiens
ccctcaccccaag

SEQ ID NO: 6734124 - DNA, 14 bp, Homo sapiens
ccctcaccccaagg

SEQ ID NO: 6734125 - DNA, 16 bp, Homo sapiens
ccctcaccccacaatt

SEQ ID NO: 6734126 - DNA, 17 bp, Homo sapiens
ccctcaccccagctccg

SEQ ID NO: 6734127 - DNA, 14 bp, Homo sapiens
ccctcacccccacc

SEQ ID NO: 6734128 - DNA, 15 bp, Homo sapiens
ccctcacccccacct

SEQ ID NO: 6734129 - DNA, 18 bp, Homo sapiens
ccctcacccccaggtgtt

SEQ ID NO: 6734130 - DNA, 18 bp, Homo sapiens
ccctcaccccctcccacc

SEQ ID NO: 6734131 - DNA, 19 bp, Homo sapiens
ccctcaccccctcctggca

SEQ ID NO: 6734132 - DNA, 13 bp, Homo sapiens
ccctcacccctgc

SEQ ID NO: 6734133 - DNA, 18 bp, Homo sapiens
ccctcacccgctgcccag

SEQ ID NO: 6734134 - DNA, 10 bp, Homo sapiens
ccctcacctc

SEQ ID NO: 6734135 - DNA, 14 bp, Homo sapiens
ccctcacctccctt

SEQ ID NO: 6734136 - DNA, 14 bp, Homo sapiens
ccctcacctcctct

SEQ ID NO: 6734137 - DNA, 12 bp, Homo sapiens
ccctcacctctc

SEQ ID NO: 6734138 - DNA, 14 bp, Homo sapiens
ccctcacctctcca

SEQ ID NO: 6734139 - DNA, 15 bp, Homo sapiens
ccctcacctctgagg

SEQ ID NO: 6734140 - DNA, 19 bp, Homo sapiens
ccctcacctctgaggacag

SEQ ID NO: 6734141 - DNA, 15 bp, Homo sapiens
ccctcacctgcagag

SEQ ID NO: 6734142 - DNA, 14 bp, Homo sapiens
ccctcacctgggca

SEQ ID NO: 6734143 - DNA, 23 bp, Homo sapiens
ccctcacctgggcacctggggag

SEQ ID NO: 6734144 - DNA, 14 bp, Homo sapiens
ccctcacctgggcc

SEQ ID NO: 6734145 - DNA, 19 bp, Homo sapiens
ccctcacctgggcctttcc

SEQ ID NO: 6734146 - DNA, 19 bp, Homo sapiens
ccctcacctggtacctgga

SEQ ID NO: 6734147 - DNA, 18 bp, Homo sapiens
ccctcaccttgcaacaca

SEQ ID NO: 6734148 - DNA, 21 bp, Homo sapiens
ccctcaccttgcaacacacag

SEQ ID NO: 6734149 - DNA, 13 bp, Homo sapiens
ccctcaccttggg

SEQ ID NO: 6734150 - DNA, 19 bp, Homo sapiens
ccctcaccttgggctgggg

SEQ ID NO: 6734151 - DNA, 17 bp, Homo sapiens
ccctcacgtttcttccc

SEQ ID NO: 6734152 - DNA, 18 bp, Homo sapiens
ccctcacgtttcttcccc

SEQ ID NO: 6734153 - DNA, 13 bp, Homo sapiens
ccctcactccact

SEQ ID NO: 6734154 - DNA, 16 bp, Homo sapiens
ccctcactccactccc

SEQ ID NO: 6734155 - DNA, 17 bp, Homo sapiens
ccctcactcgtctcccc

SEQ ID NO: 6734156 - DNA, 15 bp, Homo sapiens
ccctcactctcagga

SEQ ID NO: 6734157 - DNA, 15 bp, Homo sapiens
ccctcactctctaca

SEQ ID NO: 6734158 - DNA, 15 bp, Homo sapiens
ccctcactctgccag

SEQ ID NO: 6734159 - DNA, 21 bp, Homo sapiens
ccctcactctgccagggcagt

SEQ ID NO: 6734160 - DNA, 23 bp, Homo sapiens
ccctcactctgtcagccagccgc

SEQ ID NO: 6734161 - DNA, 16 bp, Homo sapiens
ccctcactcttcctca

SEQ ID NO: 6734162 - DNA, 14 bp, Homo sapiens
ccctcactggatga

SEQ ID NO: 6734163 - DNA, 12 bp, Homo sapiens
ccctcactggct

SEQ ID NO: 6734164 - DNA, 13 bp, Homo sapiens
ccctcactggctg

SEQ ID NO: 6734165 - DNA, 14 bp, Homo sapiens
ccctcactggctgg

SEQ ID NO: 6734166 - DNA, 20 bp, Homo sapiens
ccctcactgtcagtcccact

SEQ ID NO: 6734167 - DNA, 22 bp, Homo sapiens
ccctcagaacccttggcttgcc

SEQ ID NO: 6734168 - DNA, 22 bp, Homo sapiens
ccctcagaagaaaacttttgtt

SEQ ID NO: 6734169 - DNA, 21 bp, Homo sapiens
ccctcagaaggtctgttttga

SEQ ID NO: 6734170 - DNA, 17 bp, Homo sapiens
ccctcagacagccccct

SEQ ID NO: 6734171 - DNA, 18 bp, Homo sapiens
ccctcagacatttatata

SEQ ID NO: 6734172 - DNA, 15 bp, Homo sapiens
ccctcagacccagga

SEQ ID NO: 6734173 - DNA, 12 bp, Homo sapiens
ccctcagactca

SEQ ID NO: 6734174 - DNA, 18 bp, Homo sapiens
ccctcagactcagaggtc

SEQ ID NO: 6734175 - DNA, 23 bp, Homo sapiens
ccctcagactcagaggtccaggc

SEQ ID NO: 6734176 - DNA, 17 bp, Homo sapiens
ccctcagactgtcaggc

SEQ ID NO: 6734177 - DNA, 14 bp, Homo sapiens
ccctcagagcccat

SEQ ID NO: 6734178 - DNA, 14 bp, Homo sapiens
ccctcagagccctg

SEQ ID NO: 6734179 - DNA, 12 bp, Homo sapiens
ccctcagagctc

SEQ ID NO: 6734180 - DNA, 18 bp, Homo sapiens
ccctcagatgatctctcc

SEQ ID NO: 6734181 - DNA, 22 bp, Homo sapiens
ccctcagatgcgttcgcctctg

SEQ ID NO: 6734182 - DNA, 13 bp, Homo sapiens
ccctcagatggca

SEQ ID NO: 6734183 - DNA, 17 bp, Homo sapiens
ccctcagattttatatt

SEQ ID NO: 6734184 - DNA, 17 bp, Homo sapiens
ccctcagcaaggggctg

SEQ ID NO: 6734185 - DNA, 14 bp, Homo sapiens
ccctcagcagctct

SEQ ID NO: 6734186 - DNA, 15 bp, Homo sapiens
ccctcagccaccctt

SEQ ID NO: 6734187 - DNA, 15 bp, Homo sapiens
ccctcagccacgcct

SEQ ID NO: 6734188 - DNA, 16 bp, Homo sapiens
ccctcagccacgcctc

SEQ ID NO: 6734189 - DNA, 15 bp, Homo sapiens
ccctcagccccagga

SEQ ID NO: 6734190 - DNA, 17 bp, Homo sapiens
ccctcagccctcattaa

SEQ ID NO: 6734191 - DNA, 14 bp, Homo sapiens
ccctcagccctggc

SEQ ID NO: 6734192 - DNA, 15 bp, Homo sapiens
ccctcagccctggcc

SEQ ID NO: 6734193 - DNA, 19 bp, Homo sapiens
ccctcagccctggcctttt

SEQ ID NO: 6734194 - DNA, 21 bp, Homo sapiens
ccctcagccctggcctttttc

SEQ ID NO: 6734195 - DNA, 13 bp, Homo sapiens
ccctcagcctcag

SEQ ID NO: 6734196 - DNA, 14 bp, Homo sapiens
ccctcagcctcaga

SEQ ID NO: 6734197 - DNA, 16 bp, Homo sapiens
ccctcagcctcagagg

SEQ ID NO: 6734198 - DNA, 17 bp, Homo sapiens
ccctcagcctcagagga

SEQ ID NO: 6734199 - DNA, 20 bp, Homo sapiens
ccctcagcctcagaggagct

SEQ ID NO: 6734200 - DNA, 12 bp, Homo sapiens
ccctcagcctcc

SEQ ID NO: 6734201 - DNA, 12 bp, Homo sapiens
ccctcagcctct

SEQ ID NO: 6734202 - DNA, 23 bp, Homo sapiens
ccctcagcctctcccctgcctgc

SEQ ID NO: 6734203 - DNA, 14 bp, Homo sapiens
ccctcagcctctgc

SEQ ID NO: 6734204 - DNA, 17 bp, Homo sapiens
ccctcagcctctgccac

SEQ ID NO: 6734205 - DNA, 15 bp, Homo sapiens
ccctcagcctcttct

SEQ ID NO: 6734206 - DNA, 13 bp, Homo sapiens
ccctcagcctgcc

SEQ ID NO: 6734207 - DNA, 14 bp, Homo sapiens
ccctcagcctgccc

SEQ ID NO: 6734208 - DNA, 20 bp, Homo sapiens
ccctcagcctgcccacctct

SEQ ID NO: 6734209 - DNA, 21 bp, Homo sapiens
ccctcagcctgcccacctctc

SEQ ID NO: 6734210 - DNA, 14 bp, Homo sapiens
ccctcagcctgcct

SEQ ID NO: 6734211 - DNA, 20 bp, Homo sapiens
ccctcagcctgcctgaagag

SEQ ID NO: 6734212 - DNA, 20 bp, Homo sapiens
ccctcagcctgtaccggttt

SEQ ID NO: 6734213 - DNA, 19 bp, Homo sapiens
ccctcagcgcaggctgcag

SEQ ID NO: 6734214 - DNA, 18 bp, Homo sapiens
ccctcagcgcccccagag

SEQ ID NO: 6734215 - DNA, 21 bp, Homo sapiens
ccctcagcgggggccttgaag

SEQ ID NO: 6734216 - DNA, 15 bp, Homo sapiens
ccctcagctctccct

SEQ ID NO: 6734217 - DNA, 16 bp, Homo sapiens
ccctcagctctctggg

SEQ ID NO: 6734218 - DNA, 13 bp, Homo sapiens
ccctcagctctgt

SEQ ID NO: 6734219 - DNA, 15 bp, Homo sapiens
ccctcagctggtcct

SEQ ID NO: 6734220 - DNA, 21 bp, Homo sapiens
ccctcagctggtcctgaccag

SEQ ID NO: 6734221 - DNA, 15 bp, Homo sapiens
ccctcagctgtcacc

SEQ ID NO: 6734222 - DNA, 21 bp, Homo sapiens
ccctcagctgtcacctgctca

SEQ ID NO: 6734223 - DNA, 22 bp, Homo sapiens
ccctcagctgtcacctgctcac

SEQ ID NO: 6734224 - DNA, 15 bp, Homo sapiens
ccctcaggaattcag

SEQ ID NO: 6734225 - DNA, 15 bp, Homo sapiens
ccctcaggaccctcg

SEQ ID NO: 6734226 - DNA, 17 bp, Homo sapiens
ccctcaggactgcaaca

SEQ ID NO: 6734227 - DNA, 14 bp, Homo sapiens
ccctcaggcacacc

SEQ ID NO: 6734228 - DNA, 16 bp, Homo sapiens
ccctcaggcacacctt

SEQ ID NO: 6734229 - DNA, 18 bp, Homo sapiens
ccctcaggcataggcctg

SEQ ID NO: 6734230 - DNA, 21 bp, Homo sapiens
ccctcaggcataggcctgggt

SEQ ID NO: 6734231 - DNA, 22 bp, Homo sapiens
ccctcaggcataggcctgggtg

SEQ ID NO: 6734232 - DNA, 23 bp, Homo sapiens
ccctcaggcataggcctgggtgc

SEQ ID NO: 6734233 - DNA, 11 bp, Homo sapiens
ccctcaggcca

SEQ ID NO: 6734234 - DNA, 12 bp, Homo sapiens
ccctcaggccag

SEQ ID NO: 6734235 - DNA, 17 bp, Homo sapiens
ccctcaggccattcccc

SEQ ID NO: 6734236 - DNA, 18 bp, Homo sapiens
ccctcaggctctgtggag

SEQ ID NO: 6734237 - DNA, 17 bp, Homo sapiens
ccctcagggactgcacc

SEQ ID NO: 6734238 - DNA, 19 bp, Homo sapiens
ccctcagggactgcaccct

SEQ ID NO: 6734239 - DNA, 17 bp, Homo sapiens
ccctcagggagcctccc

SEQ ID NO: 6734240 - DNA, 20 bp, Homo sapiens
ccctcagggagcctccccat

SEQ ID NO: 6734241 - DNA, 21 bp, Homo sapiens
ccctcagggcaaagccaggtc

SEQ ID NO: 6734242 - DNA, 13 bp, Homo sapiens
ccctcaggggcct

SEQ ID NO: 6734243 - DNA, 15 bp, Homo sapiens
ccctcaggggcctct

SEQ ID NO: 6734244 - DNA, 15 bp, Homo sapiens
ccctcagggggccag

SEQ ID NO: 6734245 - DNA, 21 bp, Homo sapiens
ccctcagggggccagctgggg

SEQ ID NO: 6734246 - DNA, 22 bp, Homo sapiens
ccctcagggggccagctgggga

SEQ ID NO: 6734247 - DNA, 14 bp, Homo sapiens
ccctcaggtgcctc

SEQ ID NO: 6734248 - DNA, 16 bp, Homo sapiens
ccctcaggttcctttt

SEQ ID NO: 6734249 - DNA, 19 bp, Homo sapiens
ccctcagtagtccctgcac

SEQ ID NO: 6734250 - DNA, 19 bp, Homo sapiens
ccctcagtcacccccactt

SEQ ID NO: 6734251 - DNA, 19 bp, Homo sapiens
ccctcagtcttcctgccgg

SEQ ID NO: 6734252 - DNA, 19 bp, Homo sapiens
ccctcagtttccctatctc

SEQ ID NO: 6734253 - DNA, 13 bp, Homo sapiens
ccctcatccacta

SEQ ID NO: 6734254 - DNA, 19 bp, Homo sapiens
ccctcatccccacagtctt

SEQ ID NO: 6734255 - DNA, 17 bp, Homo sapiens
ccctcatcccgagcacc

SEQ ID NO: 6734256 - DNA, 20 bp, Homo sapiens
ccctcatcctcatacccacc

SEQ ID NO: 6734257 - DNA, 14 bp, Homo sapiens
ccctcatctccagc

SEQ ID NO: 6734258 - DNA, 21 bp, Homo sapiens
ccctcatcttgaagggcccag

SEQ ID NO: 6734259 - DNA, 14 bp, Homo sapiens
ccctcatctttctt

SEQ ID NO: 6734260 - DNA, 17 bp, Homo sapiens
ccctcatgctgccaata

SEQ ID NO: 6734261 - DNA, 18 bp, Homo sapiens
ccctcatggagaaacatc

SEQ ID NO: 6734262 - DNA, 20 bp, Homo sapiens
ccctcatggcccccaggggc

SEQ ID NO: 6734263 - DNA, 21 bp, Homo sapiens
ccctcatggcccctctgacct

SEQ ID NO: 6734264 - DNA, 20 bp, Homo sapiens
ccctcattaaactaattaaa

SEQ ID NO: 6734265 - DNA, 18 bp, Homo sapiens
ccctcattcagagactgc

SEQ ID NO: 6734266 - DNA, 17 bp, Homo sapiens
ccctcattcaggaaaac

SEQ ID NO: 6734267 - DNA, 22 bp, Homo sapiens
ccctcattccaccttcccatgc

SEQ ID NO: 6734268 - DNA, 15 bp, Homo sapiens
ccctcattcccctcg

SEQ ID NO: 6734269 - DNA, 16 bp, Homo sapiens
ccctcattctgcatta

SEQ ID NO: 6734270 - DNA, 18 bp, Homo sapiens
ccctcattgctgtcttgc

SEQ ID NO: 6734271 - DNA, 17 bp, Homo sapiens
ccctcatttctgccagc

SEQ ID NO: 6734272 - DNA, 18 bp, Homo sapiens
ccctccaaacactgggct

SEQ ID NO: 6734273 - DNA, 18 bp, Homo sapiens
ccctccaaacctccagcc

SEQ ID NO: 6734274 - DNA, 19 bp, Homo sapiens
ccctccaaacctccagcct

SEQ ID NO: 6734275 - DNA, 23 bp, Homo sapiens
ccctccaaacctccagcctccct

SEQ ID NO: 6734276 - DNA, 11 bp, Homo sapiens
ccctccaaaga

SEQ ID NO: 6734277 - DNA, 20 bp, Homo sapiens
ccctccaaatggagaagctg

SEQ ID NO: 6734278 - DNA, 23 bp, Homo sapiens
ccctccaaatgtcctttctcaga

SEQ ID NO: 6734279 - DNA, 17 bp, Homo sapiens
ccctccaagcctggcac

SEQ ID NO: 6734280 - DNA, 10 bp, Homo sapiens
ccctccaagg

SEQ ID NO: 6734281 - DNA, 18 bp, Homo sapiens
ccctccacaaagagacca

SEQ ID NO: 6734282 - DNA, 15 bp, Homo sapiens
ccctccacacacttc

SEQ ID NO: 6734283 - DNA, 12 bp, Homo sapiens
ccctccacacca

SEQ ID NO: 6734284 - DNA, 17 bp, Homo sapiens
ccctccacacctccacc

SEQ ID NO: 6734285 - DNA, 15 bp, Homo sapiens
ccctccacacctgcg

SEQ ID NO: 6734286 - DNA, 15 bp, Homo sapiens
ccctccacagctgca

SEQ ID NO: 6734287 - DNA, 16 bp, Homo sapiens
ccctccacaggagccg

SEQ ID NO: 6734288 - DNA, 11 bp, Homo sapiens
ccctccaccag

SEQ ID NO: 6734289 - DNA, 17 bp, Homo sapiens
ccctccaccagcctgct

SEQ ID NO: 6734290 - DNA, 21 bp, Homo sapiens
ccctccacccatccagtggac

SEQ ID NO: 6734291 - DNA, 16 bp, Homo sapiens
ccctccaccccacaga

SEQ ID NO: 6734292 - DNA, 16 bp, Homo sapiens
ccctccaccctgtccc

SEQ ID NO: 6734293 - DNA, 17 bp, Homo sapiens
ccctccaccgagccacg

SEQ ID NO: 6734294 - DNA, 18 bp, Homo sapiens
ccctccaccgcagaagga

SEQ ID NO: 6734295 - DNA, 21 bp, Homo sapiens
ccctccaccgcagaaggaagg

SEQ ID NO: 6734296 - DNA, 14 bp, Homo sapiens
ccctccacctccct

SEQ ID NO: 6734297 - DNA, 15 bp, Homo sapiens
ccctccacctccctg

SEQ ID NO: 6734298 - DNA, 19 bp, Homo sapiens
ccctccacctcctctcttg

SEQ ID NO: 6734299 - DNA, 13 bp, Homo sapiens
ccctccacctgct

SEQ ID NO: 6734300 - DNA, 16 bp, Homo sapiens
ccctccacgcaaggct

SEQ ID NO: 6734301 - DNA, 17 bp, Homo sapiens
ccctccacgcctcctgg

SEQ ID NO: 6734302 - DNA, 15 bp, Homo sapiens
ccctccacggtccgc

SEQ ID NO: 6734303 - DNA, 23 bp, Homo sapiens
ccctccacggtccgcggcctgca

SEQ ID NO: 6734304 - DNA, 16 bp, Homo sapiens
ccctccacgtgtccgt

SEQ ID NO: 6734305 - DNA, 12 bp, Homo sapiens
ccctccactcct

SEQ ID NO: 6734306 - DNA, 14 bp, Homo sapiens
ccctccactctgag

SEQ ID NO: 6734307 - DNA, 12 bp, Homo sapiens
ccctccactgtc

SEQ ID NO: 6734308 - DNA, 19 bp, Homo sapiens
ccctccagaacacggctca

SEQ ID NO: 6734309 - DNA, 11 bp, Homo sapiens
ccctccagacc

SEQ ID NO: 6734310 - DNA, 19 bp, Homo sapiens
ccctccagaccctgcctga

SEQ ID NO: 6734311 - DNA, 23 bp, Homo sapiens
ccctccagagaaagcacaattta

SEQ ID NO: 6734312 - DNA, 19 bp, Homo sapiens
ccctccagagacaggaaag

SEQ ID NO: 6734313 - DNA, 21 bp, Homo sapiens
ccctccagagactcgagtccc

SEQ ID NO: 6734314 - DNA, 12 bp, Homo sapiens
ccctccagagca

SEQ ID NO: 6734315 - DNA, 13 bp, Homo sapiens
ccctccagagccc

SEQ ID NO: 6734316 - DNA, 18 bp, Homo sapiens
ccctccagagccccacag

SEQ ID NO: 6734317 - DNA, 14 bp, Homo sapiens
ccctccagcacaga

SEQ ID NO: 6734318 - DNA, 14 bp, Homo sapiens
ccctccagcaccac

SEQ ID NO: 6734319 - DNA, 14 bp, Homo sapiens
ccctccagctcatg

SEQ ID NO: 6734320 - DNA, 20 bp, Homo sapiens
ccctccagctcatgacactg

SEQ ID NO: 6734321 - DNA, 11 bp, Homo sapiens
ccctccaggaa

SEQ ID NO: 6734322 - DNA, 19 bp, Homo sapiens
ccctccaggagagagccag

SEQ ID NO: 6734323 - DNA, 12 bp, Homo sapiens
ccctccaggagg

SEQ ID NO: 6734324 - DNA, 21 bp, Homo sapiens
ccctccaggagggaccaccct

SEQ ID NO: 6734325 - DNA, 12 bp, Homo sapiens
ccctccaggagt

SEQ ID NO: 6734326 - DNA, 14 bp, Homo sapiens
ccctccaggcatgc

SEQ ID NO: 6734327 - DNA, 15 bp, Homo sapiens
ccctccaggcatgct

SEQ ID NO: 6734328 - DNA, 19 bp, Homo sapiens
ccctccaggcatgctggcc

SEQ ID NO: 6734329 - DNA, 22 bp, Homo sapiens
ccctccaggcatgctggcctcc

SEQ ID NO: 6734330 - DNA, 13 bp, Homo sapiens
ccctccaggcctg

SEQ ID NO: 6734331 - DNA, 18 bp, Homo sapiens
ccctccaggcctgcaggg

SEQ ID NO: 6734332 - DNA, 13 bp, Homo sapiens
ccctccagggcca

SEQ ID NO: 6734333 - DNA, 14 bp, Homo sapiens
ccctccagggccag

SEQ ID NO: 6734334 - DNA, 12 bp, Homo sapiens
ccctccaggtgt

SEQ ID NO: 6734335 - DNA, 16 bp, Homo sapiens
ccctccagtgggctga

SEQ ID NO: 6734336 - DNA, 15 bp, Homo sapiens
ccctccatccccatc

SEQ ID NO: 6734337 - DNA, 15 bp, Homo sapiens
ccctccatcccgaca

SEQ ID NO: 6734338 - DNA, 13 bp, Homo sapiens
ccctccatccctg

SEQ ID NO: 6734339 - DNA, 22 bp, Homo sapiens
ccctccatctgtacttggtcca

SEQ ID NO: 6734340 - DNA, 12 bp, Homo sapiens
ccctccatggca

SEQ ID NO: 6734341 - DNA, 21 bp, Homo sapiens
ccctccatggcaggaaggcgg

SEQ ID NO: 6734342 - DNA, 23 bp, Homo sapiens
ccctccatggtcctgtctgtcct

SEQ ID NO: 6734343 - DNA, 16 bp, Homo sapiens
ccctccatgtgagaat

SEQ ID NO: 6734344 - DNA, 17 bp, Homo sapiens
ccctccatgtgggctag

SEQ ID NO: 6734345 - DNA, 16 bp, Homo sapiens
ccctccattcccaccc

SEQ ID NO: 6734346 - DNA, 17 bp, Homo sapiens
ccctccattctgcactc

SEQ ID NO: 6734347 - DNA, 11 bp, Homo sapiens
ccctcccaaca

SEQ ID NO: 6734348 - DNA, 14 bp, Homo sapiens
ccctcccaacctca

SEQ ID NO: 6734349 - DNA, 16 bp, Homo sapiens
ccctcccaacctcaat

SEQ ID NO: 6734350 - DNA, 15 bp, Homo sapiens
ccctcccaagctggc

SEQ ID NO: 6734351 - DNA, 18 bp, Homo sapiens
ccctcccaagtagctggg

SEQ ID NO: 6734352 - DNA, 21 bp, Homo sapiens
ccctcccaatcctctctcccc

SEQ ID NO: 6734353 - DNA, 14 bp, Homo sapiens
ccctcccacagcgc

SEQ ID NO: 6734354 - DNA, 14 bp, Homo sapiens
ccctcccaccacag

SEQ ID NO: 6734355 - DNA, 17 bp, Homo sapiens
ccctcccaccacagcag

SEQ ID NO: 6734356 - DNA, 16 bp, Homo sapiens
ccctcccaccatgcgc

SEQ ID NO: 6734357 - DNA, 14 bp, Homo sapiens
ccctcccacctctg

SEQ ID NO: 6734358 - DNA, 13 bp, Homo sapiens
ccctcccacgcct

SEQ ID NO: 6734359 - DNA, 13 bp, Homo sapiens
ccctcccactccc

SEQ ID NO: 6734360 - DNA, 14 bp, Homo sapiens
ccctcccactccca

SEQ ID NO: 6734361 - DNA, 14 bp, Homo sapiens
ccctcccactccct

SEQ ID NO: 6734362 - DNA, 19 bp, Homo sapiens
ccctcccactcttgaagag

SEQ ID NO: 6734363 - DNA, 15 bp, Homo sapiens
ccctcccactttgct

SEQ ID NO: 6734364 - DNA, 9 bp, Homo sapiens
ccctcccag

SEQ ID NO: 6734365 - DNA, 10 bp, Homo sapiens
ccctcccaga

SEQ ID NO: 6734366 - DNA, 13 bp, Homo sapiens
ccctcccagacag

SEQ ID NO: 6734367 - DNA, 19 bp, Homo sapiens
ccctcccagacaggccctc

SEQ ID NO: 6734368 - DNA, 21 bp, Homo sapiens
ccctcccagacaggccctccc

SEQ ID NO: 6734369 - DNA, 18 bp, Homo sapiens
ccctcccagacccccttg

SEQ ID NO: 6734370 - DNA, 13 bp, Homo sapiens
ccctcccagaggc

SEQ ID NO: 6734371 - DNA, 12 bp, Homo sapiens
ccctcccagatc

SEQ ID NO: 6734372 - DNA, 14 bp, Homo sapiens
ccctcccagcagtg

SEQ ID NO: 6734373 - DNA, 14 bp, Homo sapiens
ccctcccagcccat

SEQ ID NO: 6734374 - DNA, 13 bp, Homo sapiens
ccctcccagccct

SEQ ID NO: 6734375 - DNA, 13 bp, Homo sapiens
ccctcccagccta

SEQ ID NO: 6734376 - DNA, 13 bp, Homo sapiens
ccctcccagctct

SEQ ID NO: 6734377 - DNA, 12 bp, Homo sapiens
ccctcccagctg

SEQ ID NO: 6734378 - DNA, 13 bp, Homo sapiens
ccctcccagctga

SEQ ID NO: 6734379 - DNA, 22 bp, Homo sapiens
ccctcccaggaccctccactca

SEQ ID NO: 6734380 - DNA, 14 bp, Homo sapiens
ccctcccaggactc

SEQ ID NO: 6734381 - DNA, 20 bp, Homo sapiens
ccctcccaggactctgaccc

SEQ ID NO: 6734382 - DNA, 11 bp, Homo sapiens
ccctcccaggc

SEQ ID NO: 6734383 - DNA, 14 bp, Homo sapiens
ccctcccagggagc

SEQ ID NO: 6734384 - DNA, 23 bp, Homo sapiens
ccctcccaggggagccagctgct

SEQ ID NO: 6734385 - DNA, 14 bp, Homo sapiens
ccctcccagtcctc

SEQ ID NO: 6734386 - DNA, 22 bp, Homo sapiens
ccctcccagtctcatctcctga

SEQ ID NO: 6734387 - DNA, 13 bp, Homo sapiens
ccctcccatctgg

SEQ ID NO: 6734388 - DNA, 17 bp, Homo sapiens
ccctcccatctgggagt

SEQ ID NO: 6734389 - DNA, 15 bp, Homo sapiens
ccctcccatggccca

SEQ ID NO: 6734390 - DNA, 17 bp, Homo sapiens
ccctcccatggcccagc

SEQ ID NO: 6734391 - DNA, 21 bp, Homo sapiens
ccctcccatttgcagaccagg

SEQ ID NO: 6734392 - DNA, 21 bp, Homo sapiens
ccctccccaaacccatcagac

SEQ ID NO: 6734393 - DNA, 20 bp, Homo sapiens
ccctccccaaagccactgga

SEQ ID NO: 6734394 - DNA, 22 bp, Homo sapiens
ccctccccaaagccactggaag

SEQ ID NO: 6734395 - DNA, 20 bp, Homo sapiens
ccctccccaaggatgaccac

SEQ ID NO: 6734396 - DNA, 22 bp, Homo sapiens
ccctccccaaggatgaccacac

SEQ ID NO: 6734397 - DNA, 17 bp, Homo sapiens
ccctccccacagtcctc

SEQ ID NO: 6734398 - DNA, 19 bp, Homo sapiens
ccctccccacccaccaccg

SEQ ID NO: 6734399 - DNA, 14 bp, Homo sapiens
ccctccccacccct

SEQ ID NO: 6734400 - DNA, 16 bp, Homo sapiens
ccctccccacctgctc

SEQ ID NO: 6734401 - DNA, 11 bp, Homo sapiens
ccctccccaga

SEQ ID NO: 6734402 - DNA, 15 bp, Homo sapiens
ccctccccagagcac

SEQ ID NO: 6734403 - DNA, 22 bp, Homo sapiens
ccctccccagatctgtcctggg

SEQ ID NO: 6734404 - DNA, 12 bp, Homo sapiens
ccctccccagcc

SEQ ID NO: 6734405 - DNA, 14 bp, Homo sapiens
ccctccccagccag

SEQ ID NO: 6734406 - DNA, 16 bp, Homo sapiens
ccctccccagccagcc

SEQ ID NO: 6734407 - DNA, 17 bp, Homo sapiens
ccctccccagccagccc

SEQ ID NO: 6734408 - DNA, 13 bp, Homo sapiens
ccctccccagctc

SEQ ID NO: 6734409 - DNA, 13 bp, Homo sapiens
ccctccccaggaa

SEQ ID NO: 6734410 - DNA, 15 bp, Homo sapiens
ccctccccaggctgg

SEQ ID NO: 6734411 - DNA, 12 bp, Homo sapiens
ccctccccaggg

SEQ ID NO: 6734412 - DNA, 14 bp, Homo sapiens
ccctccccagggga

SEQ ID NO: 6734413 - DNA, 16 bp, Homo sapiens
ccctccccatctgtgt

SEQ ID NO: 6734414 - DNA, 16 bp, Homo sapiens
ccctccccattcacag

SEQ ID NO: 6734415 - DNA, 18 bp, Homo sapiens
ccctccccattcacagag

SEQ ID NO: 6734416 - DNA, 18 bp, Homo sapiens
ccctccccattcagacac

SEQ ID NO: 6734417 - DNA, 14 bp, Homo sapiens
ccctcccccagagc

SEQ ID NO: 6734418 - DNA, 17 bp, Homo sapiens
ccctcccccagagcccc

SEQ ID NO: 6734419 - DNA, 15 bp, Homo sapiens
ccctcccccagccac

SEQ ID NO: 6734420 - DNA, 17 bp, Homo sapiens
ccctcccccagctcctt

SEQ ID NO: 6734421 - DNA, 13 bp, Homo sapiens
ccctccccccaga

SEQ ID NO: 6734422 - DNA, 15 bp, Homo sapiens
ccctccccccagact

SEQ ID NO: 6734423 - DNA, 17 bp, Homo sapiens
ccctccccccagctccc

SEQ ID NO: 6734424 - DNA, 15 bp, Homo sapiens
ccctcccccccatgc

SEQ ID NO: 6734425 - DNA, 15 bp, Homo sapiens
ccctcccccctgtaa

SEQ ID NO: 6734426 - DNA, 17 bp, Homo sapiens
ccctcccccgcagacag

SEQ ID NO: 6734427 - DNA, 21 bp, Homo sapiens
ccctcccccgccactcctgaa

SEQ ID NO: 6734428 - DNA, 20 bp, Homo sapiens
ccctcccccggggtctccac

SEQ ID NO: 6734429 - DNA, 12 bp, Homo sapiens
ccctccccctac

SEQ ID NO: 6734430 - DNA, 15 bp, Homo sapiens
ccctccccctagtcc

SEQ ID NO: 6734431 - DNA, 16 bp, Homo sapiens
ccctccccctcaacct

SEQ ID NO: 6734432 - DNA, 13 bp, Homo sapiens
ccctccccctcct

SEQ ID NO: 6734433 - DNA, 14 bp, Homo sapiens
ccctccccctgcca

SEQ ID NO: 6734434 - DNA, 15 bp, Homo sapiens
ccctccccctgccag

SEQ ID NO: 6734435 - DNA, 17 bp, Homo sapiens
ccctcccccttctccca

SEQ ID NO: 6734436 - DNA, 15 bp, Homo sapiens
ccctcccccttgtcc

SEQ ID NO: 6734437 - DNA, 18 bp, Homo sapiens
ccctccccgccccctgaa

SEQ ID NO: 6734438 - DNA, 21 bp, Homo sapiens
ccctccccgcctggccagggc

SEQ ID NO: 6734439 - DNA, 15 bp, Homo sapiens
ccctccccgctgccc

SEQ ID NO: 6734440 - DNA, 13 bp, Homo sapiens
ccctccccggcat

SEQ ID NO: 6734441 - DNA, 18 bp, Homo sapiens
ccctccccggccacatgc

SEQ ID NO: 6734442 - DNA, 13 bp, Homo sapiens
ccctccccggcgg

SEQ ID NO: 6734443 - DNA, 13 bp, Homo sapiens
ccctccccgggca

SEQ ID NO: 6734444 - DNA, 15 bp, Homo sapiens
ccctccccgggcagc

SEQ ID NO: 6734445 - DNA, 19 bp, Homo sapiens
ccctccccgggcagcagag

SEQ ID NO: 6734446 - DNA, 17 bp, Homo sapiens
ccctcccctcagcctgc

SEQ ID NO: 6734447 - DNA, 18 bp, Homo sapiens
ccctcccctcagcctgcc

SEQ ID NO: 6734448 - DNA, 23 bp, Homo sapiens
ccctcccctcagcctgcccacct

SEQ ID NO: 6734449 - DNA, 19 bp, Homo sapiens
ccctcccctcagcgcaggc

SEQ ID NO: 6734450 - DNA, 14 bp, Homo sapiens
ccctcccctccccc

SEQ ID NO: 6734451 - DNA, 15 bp, Homo sapiens
ccctcccctccttgt

SEQ ID NO: 6734452 - DNA, 17 bp, Homo sapiens
ccctcccctccttgtct

SEQ ID NO: 6734453 - DNA, 15 bp, Homo sapiens
ccctcccctctcttg

SEQ ID NO: 6734454 - DNA, 16 bp, Homo sapiens
ccctcccctctcttgc

SEQ ID NO: 6734455 - DNA, 24 bp, Homo sapiens
ccctcccctctcttgcacccgcct

SEQ ID NO: 6734456 - DNA, 13 bp, Homo sapiens
ccctcccctgccc

SEQ ID NO: 6734457 - DNA, 15 bp, Homo sapiens
ccctcccctgcctcc

SEQ ID NO: 6734458 - DNA, 14 bp, Homo sapiens
ccctcccctgctcc

SEQ ID NO: 6734459 - DNA, 20 bp, Homo sapiens
ccctcccctgctcccaggtt

SEQ ID NO: 6734460 - DNA, 16 bp, Homo sapiens
ccctcccctgctgcag

SEQ ID NO: 6734461 - DNA, 13 bp, Homo sapiens
ccctcccgcacct

SEQ ID NO: 6734462 - DNA, 19 bp, Homo sapiens
ccctcccgcaccttcctcc

SEQ ID NO: 6734463 - DNA, 21 bp, Homo sapiens
ccctcccgcaccttcctcctc

SEQ ID NO: 6734464 - DNA, 14 bp, Homo sapiens
ccctcccgcttcct

SEQ ID NO: 6734465 - DNA, 20 bp, Homo sapiens
ccctcccgcttcctccggct

SEQ ID NO: 6734466 - DNA, 14 bp, Homo sapiens
ccctcccggctgcc

SEQ ID NO: 6734467 - DNA, 14 bp, Homo sapiens
ccctccctacctca

SEQ ID NO: 6734468 - DNA, 13 bp, Homo sapiens
ccctccctacctg

SEQ ID NO: 6734469 - DNA, 15 bp, Homo sapiens
ccctccctagatcca

SEQ ID NO: 6734470 - DNA, 19 bp, Homo sapiens
ccctccctagatccaggct

SEQ ID NO: 6734471 - DNA, 14 bp, Homo sapiens
ccctccctagccct

SEQ ID NO: 6734472 - DNA, 13 bp, Homo sapiens
ccctccctagctc

SEQ ID NO: 6734473 - DNA, 16 bp, Homo sapiens
ccctccctcagcccct

SEQ ID NO: 6734474 - DNA, 23 bp, Homo sapiens
ccctccctcagccgtcagccatc

SEQ ID NO: 6734475 - DNA, 14 bp, Homo sapiens
ccctccctcccaga

SEQ ID NO: 6734476 - DNA, 15 bp, Homo sapiens
ccctccctccctctt

SEQ ID NO: 6734477 - DNA, 17 bp, Homo sapiens
ccctccctccctctttc

SEQ ID NO: 6734478 - DNA, 16 bp, Homo sapiens
ccctccctcctggctc

SEQ ID NO: 6734479 - DNA, 14 bp, Homo sapiens
ccctccctcgtggg

SEQ ID NO: 6734480 - DNA, 20 bp, Homo sapiens
ccctccctctactcttcctg

SEQ ID NO: 6734481 - DNA, 23 bp, Homo sapiens
ccctccctctactgggagcctac

SEQ ID NO: 6734482 - DNA, 13 bp, Homo sapiens
ccctccctctctg

SEQ ID NO: 6734483 - DNA, 14 bp, Homo sapiens
ccctccctctctgc

SEQ ID NO: 6734484 - DNA, 13 bp, Homo sapiens
ccctccctctgcc

SEQ ID NO: 6734485 - DNA, 14 bp, Homo sapiens
ccctccctcttccc

SEQ ID NO: 6734486 - DNA, 13 bp, Homo sapiens
ccctccctctttc

SEQ ID NO: 6734487 - DNA, 17 bp, Homo sapiens
ccctccctgcagggtag

SEQ ID NO: 6734488 - DNA, 18 bp, Homo sapiens
ccctccctgcccaaactc

SEQ ID NO: 6734489 - DNA, 23 bp, Homo sapiens
ccctccctgcccaaactcccctt

SEQ ID NO: 6734490 - DNA, 13 bp, Homo sapiens
ccctccctgcctc

SEQ ID NO: 6734491 - DNA, 16 bp, Homo sapiens
ccctccctgcctgctc

SEQ ID NO: 6734492 - DNA, 14 bp, Homo sapiens
ccctccctgcgctt

SEQ ID NO: 6734493 - DNA, 15 bp, Homo sapiens
ccctccctgctagca

SEQ ID NO: 6734494 - DNA, 14 bp, Homo sapiens
ccctccctgcttca

SEQ ID NO: 6734495 - DNA, 23 bp, Homo sapiens
ccctccctgcttgcacacttccc

SEQ ID NO: 6734496 - DNA, 15 bp, Homo sapiens
ccctccctggcctca

SEQ ID NO: 6734497 - DNA, 19 bp, Homo sapiens
ccctccctggctgtgagca

SEQ ID NO: 6734498 - DNA, 16 bp, Homo sapiens
ccctccctgggttcag

SEQ ID NO: 6734499 - DNA, 18 bp, Homo sapiens
ccctccctgtaatgcact

SEQ ID NO: 6734500 - DNA, 22 bp, Homo sapiens
ccctccctgtaatgcactcctg

SEQ ID NO: 6734501 - DNA, 13 bp, Homo sapiens
ccctccctgtcct

SEQ ID NO: 6734502 - DNA, 23 bp, Homo sapiens
ccctccctgtctgtctgtctctc

SEQ ID NO: 6734503 - DNA, 20 bp, Homo sapiens
ccctccctgttccccagaga

SEQ ID NO: 6734504 - DNA, 14 bp, Homo sapiens
ccctcccttcaacc

SEQ ID NO: 6734505 - DNA, 14 bp, Homo sapiens
ccctcccttcacag

SEQ ID NO: 6734506 - DNA, 14 bp, Homo sapiens
ccctcccttccttg

SEQ ID NO: 6734507 - DNA, 23 bp, Homo sapiens
ccctcccttgctgaacacacaca

SEQ ID NO: 6734508 - DNA, 19 bp, Homo sapiens
ccctcccttggaaacctgc

SEQ ID NO: 6734509 - DNA, 23 bp, Homo sapiens
ccctcccttggaaacctgccctg

SEQ ID NO: 6734510 - DNA, 18 bp, Homo sapiens
ccctccgaacgctgctcc

SEQ ID NO: 6734511 - DNA, 16 bp, Homo sapiens
ccctccgactccagat

SEQ ID NO: 6734512 - DNA, 16 bp, Homo sapiens
ccctccgatgctgagg

SEQ ID NO: 6734513 - DNA, 16 bp, Homo sapiens
ccctccgccagccctg

SEQ ID NO: 6734514 - DNA, 18 bp, Homo sapiens
ccctccgccagccctgtt

SEQ ID NO: 6734515 - DNA, 16 bp, Homo sapiens
ccctccgccaggcgag

SEQ ID NO: 6734516 - DNA, 18 bp, Homo sapiens
ccctccgccaggcgagat

SEQ ID NO: 6734517 - DNA, 13 bp, Homo sapiens
ccctccgccctgc

SEQ ID NO: 6734518 - DNA, 16 bp, Homo sapiens
ccctccgcctccagga

SEQ ID NO: 6734519 - DNA, 13 bp, Homo sapiens
ccctccgccttca

SEQ ID NO: 6734520 - DNA, 21 bp, Homo sapiens
ccctccgccttcactccggtg

SEQ ID NO: 6734521 - DNA, 13 bp, Homo sapiens
ccctccgccttct

SEQ ID NO: 6734522 - DNA, 19 bp, Homo sapiens
ccctccgcggcgggccctg

SEQ ID NO: 6734523 - DNA, 21 bp, Homo sapiens
ccctccgcggcgggccctgcc

SEQ ID NO: 6734524 - DNA, 19 bp, Homo sapiens
ccctccggactggtgccct

SEQ ID NO: 6734525 - DNA, 16 bp, Homo sapiens
ccctccggaggagcag

SEQ ID NO: 6734526 - DNA, 15 bp, Homo sapiens
ccctccggccccgtc

SEQ ID NO: 6734527 - DNA, 21 bp, Homo sapiens
ccctccgggcagagaccaccg

SEQ ID NO: 6734528 - DNA, 19 bp, Homo sapiens
ccctccgtccccagggtgc

SEQ ID NO: 6734529 - DNA, 15 bp, Homo sapiens
ccctccgtcgggccc

SEQ ID NO: 6734530 - DNA, 20 bp, Homo sapiens
ccctccgtcgggcccctgcc

SEQ ID NO: 6734531 - DNA, 22 bp, Homo sapiens
ccctccgtcgggcccctgcctg

SEQ ID NO: 6734532 - DNA, 17 bp, Homo sapiens
ccctccgtgatccatcc

SEQ ID NO: 6734533 - DNA, 15 bp, Homo sapiens
ccctcctagacccag

SEQ ID NO: 6734534 - DNA, 22 bp, Homo sapiens
ccctcctagacccaggtggagg

SEQ ID NO: 6734535 - DNA, 12 bp, Homo sapiens
ccctcctagcac

SEQ ID NO: 6734536 - DNA, 23 bp, Homo sapiens
ccctcctagcctgctctgccact

SEQ ID NO: 6734537 - DNA, 19 bp, Homo sapiens
ccctcctagctctcccagt

SEQ ID NO: 6734538 - DNA, 18 bp, Homo sapiens
ccctcctagggggtgtca

SEQ ID NO: 6734539 - DNA, 13 bp, Homo sapiens
ccctcctcacact

SEQ ID NO: 6734540 - DNA, 14 bp, Homo sapiens
ccctcctcacactc

SEQ ID NO: 6734541 - DNA, 21 bp, Homo sapiens
ccctcctcacagttgccatgt

SEQ ID NO: 6734542 - DNA, 13 bp, Homo sapiens
ccctcctcacccc

SEQ ID NO: 6734543 - DNA, 12 bp, Homo sapiens
ccctcctcacct

SEQ ID NO: 6734544 - DNA, 13 bp, Homo sapiens
ccctcctcacctc

SEQ ID NO: 6734545 - DNA, 17 bp, Homo sapiens
ccctcctcacctctgga

SEQ ID NO: 6734546 - DNA, 18 bp, Homo sapiens
ccctcctcacctctggac

SEQ ID NO: 6734547 - DNA, 16 bp, Homo sapiens
ccctcctcactggcca

SEQ ID NO: 6734548 - DNA, 21 bp, Homo sapiens
ccctcctcactggccatccct

SEQ ID NO: 6734549 - DNA, 15 bp, Homo sapiens
ccctcctcagccagc

SEQ ID NO: 6734550 - DNA, 12 bp, Homo sapiens
ccctcctccact

SEQ ID NO: 6734551 - DNA, 14 bp, Homo sapiens
ccctcctccactct

SEQ ID NO: 6734552 - DNA, 15 bp, Homo sapiens
ccctcctccacttgg

SEQ ID NO: 6734553 - DNA, 23 bp, Homo sapiens
ccctcctccaggcctgcctccca

SEQ ID NO: 6734554 - DNA, 13 bp, Homo sapiens
ccctcctccaggt

SEQ ID NO: 6734555 - DNA, 23 bp, Homo sapiens
ccctcctccatgctgtccctgtg

SEQ ID NO: 6734556 - DNA, 20 bp, Homo sapiens
ccctcctcccagggcctcct

SEQ ID NO: 6734557 - DNA, 13 bp, Homo sapiens
ccctcctcccatc

SEQ ID NO: 6734558 - DNA, 19 bp, Homo sapiens
ccctcctcccatgtcactg

SEQ ID NO: 6734559 - DNA, 20 bp, Homo sapiens
ccctcctcccatgtcactgc

SEQ ID NO: 6734560 - DNA, 16 bp, Homo sapiens
ccctcctccccagagc

SEQ ID NO: 6734561 - DNA, 18 bp, Homo sapiens
ccctcctccccagagctg

SEQ ID NO: 6734562 - DNA, 16 bp, Homo sapiens
ccctcctcccccacgc

SEQ ID NO: 6734563 - DNA, 22 bp, Homo sapiens
ccctcctcccccggctgggcct

SEQ ID NO: 6734564 - DNA, 18 bp, Homo sapiens
ccctcctccccctttggg

SEQ ID NO: 6734565 - DNA, 19 bp, Homo sapiens
ccctcctccccctttgggg

SEQ ID NO: 6734566 - DNA, 14 bp, Homo sapiens
ccctcctccctcaa

SEQ ID NO: 6734567 - DNA, 17 bp, Homo sapiens
ccctcctccctcagacc

SEQ ID NO: 6734568 - DNA, 17 bp, Homo sapiens
ccctcctccctcagact

SEQ ID NO: 6734569 - DNA, 16 bp, Homo sapiens
ccctcctccctcaggc

SEQ ID NO: 6734570 - DNA, 15 bp, Homo sapiens
ccctcctcctccttt

SEQ ID NO: 6734571 - DNA, 11 bp, Homo sapiens
ccctcctcctg

SEQ ID NO: 6734572 - DNA, 16 bp, Homo sapiens
ccctcctcctggactc

SEQ ID NO: 6734573 - DNA, 18 bp, Homo sapiens
ccctcctcctggactcct

SEQ ID NO: 6734574 - DNA, 17 bp, Homo sapiens
ccctcctccttgctgat

SEQ ID NO: 6734575 - DNA, 20 bp, Homo sapiens
ccctcctccttgctgatttg

SEQ ID NO: 6734576 - DNA, 17 bp, Homo sapiens
ccctcctcgctgtgcca

SEQ ID NO: 6734577 - DNA, 18 bp, Homo sapiens
ccctcctcgggccgaggc

SEQ ID NO: 6734578 - DNA, 15 bp, Homo sapiens
ccctcctctagccat

SEQ ID NO: 6734579 - DNA, 16 bp, Homo sapiens
ccctcctctagccatc

SEQ ID NO: 6734580 - DNA, 20 bp, Homo sapiens
ccctcctctagccatccctt

SEQ ID NO: 6734581 - DNA, 16 bp, Homo sapiens
ccctcctctagctctg

SEQ ID NO: 6734582 - DNA, 18 bp, Homo sapiens
ccctcctctagctgtggg

SEQ ID NO: 6734583 - DNA, 17 bp, Homo sapiens
ccctcctctccaccatc

SEQ ID NO: 6734584 - DNA, 15 bp, Homo sapiens
ccctcctctcccatc

SEQ ID NO: 6734585 - DNA, 17 bp, Homo sapiens
ccctcctctccctgtta

SEQ ID NO: 6734586 - DNA, 13 bp, Homo sapiens
ccctcctctgaaa

SEQ ID NO: 6734587 - DNA, 21 bp, Homo sapiens
ccctcctctgaaacagctgcc

SEQ ID NO: 6734588 - DNA, 15 bp, Homo sapiens
ccctcctctgagcag

SEQ ID NO: 6734589 - DNA, 20 bp, Homo sapiens
ccctcctctgagcagcctct

SEQ ID NO: 6734590 - DNA, 18 bp, Homo sapiens
ccctcctctgccccctcc

SEQ ID NO: 6734591 - DNA, 13 bp, Homo sapiens
ccctcctctgctg

SEQ ID NO: 6734592 - DNA, 17 bp, Homo sapiens
ccctcctctgctgggaa

SEQ ID NO: 6734593 - DNA, 22 bp, Homo sapiens
ccctcctctgcttgccatccct

SEQ ID NO: 6734594 - DNA, 14 bp, Homo sapiens
ccctcctctggccc

SEQ ID NO: 6734595 - DNA, 15 bp, Homo sapiens
ccctcctctggccca

SEQ ID NO: 6734596 - DNA, 19 bp, Homo sapiens
ccctcctctggcccagcct

SEQ ID NO: 6734597 - DNA, 12 bp, Homo sapiens
ccctcctctgtg

SEQ ID NO: 6734598 - DNA, 18 bp, Homo sapiens
ccctcctctgtgctccct

SEQ ID NO: 6734599 - DNA, 22 bp, Homo sapiens
ccctcctcttcccttagcctct

SEQ ID NO: 6734600 - DNA, 20 bp, Homo sapiens
ccctcctcttccgagctgct

SEQ ID NO: 6734601 - DNA, 14 bp, Homo sapiens
ccctcctcttggaa

SEQ ID NO: 6734602 - DNA, 18 bp, Homo sapiens
ccctcctgaaacttacac

SEQ ID NO: 6734603 - DNA, 16 bp, Homo sapiens
ccctcctgacaaatat

SEQ ID NO: 6734604 - DNA, 19 bp, Homo sapiens
ccctcctgactcatccgcc

SEQ ID NO: 6734605 - DNA, 12 bp, Homo sapiens
ccctcctgagct

SEQ ID NO: 6734606 - DNA, 13 bp, Homo sapiens
ccctcctgagctc

SEQ ID NO: 6734607 - DNA, 16 bp, Homo sapiens
ccctcctgagctcggg

SEQ ID NO: 6734608 - DNA, 22 bp, Homo sapiens
ccctcctgagggaggacctggg

SEQ ID NO: 6734609 - DNA, 13 bp, Homo sapiens
ccctcctgagggc

SEQ ID NO: 6734610 - DNA, 19 bp, Homo sapiens
ccctcctgagtgccccact

SEQ ID NO: 6734611 - DNA, 21 bp, Homo sapiens
ccctcctgagtgccccacttc

SEQ ID NO: 6734612 - DNA, 20 bp, Homo sapiens
ccctcctgcacacagggcag

SEQ ID NO: 6734613 - DNA, 13 bp, Homo sapiens
ccctcctgcccac

SEQ ID NO: 6734614 - DNA, 21 bp, Homo sapiens
ccctcctgcccaggactgcat

SEQ ID NO: 6734615 - DNA, 20 bp, Homo sapiens
ccctcctgccccacactccc

SEQ ID NO: 6734616 - DNA, 17 bp, Homo sapiens
ccctcctgctcctccct

SEQ ID NO: 6734617 - DNA, 18 bp, Homo sapiens
ccctcctgctgagctgcc

SEQ ID NO: 6734618 - DNA, 23 bp, Homo sapiens
ccctcctgctggctgaggcttgg

SEQ ID NO: 6734619 - DNA, 13 bp, Homo sapiens
ccctcctgctttg

SEQ ID NO: 6734620 - DNA, 16 bp, Homo sapiens
ccctcctggagcagaa

SEQ ID NO: 6734621 - DNA, 17 bp, Homo sapiens
ccctcctggagcatccc

SEQ ID NO: 6734622 - DNA, 21 bp, Homo sapiens
ccctcctggagctctgtgggt

SEQ ID NO: 6734623 - DNA, 11 bp, Homo sapiens
ccctcctggca

SEQ ID NO: 6734624 - DNA, 13 bp, Homo sapiens
ccctcctggcaat

SEQ ID NO: 6734625 - DNA, 20 bp, Homo sapiens
ccctcctggcaatcaataca

SEQ ID NO: 6734626 - DNA, 14 bp, Homo sapiens
ccctcctggcacaa

SEQ ID NO: 6734627 - DNA, 13 bp, Homo sapiens
ccctcctggccag

SEQ ID NO: 6734628 - DNA, 19 bp, Homo sapiens
ccctcctggcctcagactg

SEQ ID NO: 6734629 - DNA, 15 bp, Homo sapiens
ccctcctggccttcc

SEQ ID NO: 6734630 - DNA, 17 bp, Homo sapiens
ccctcctggccttcctc

SEQ ID NO: 6734631 - DNA, 14 bp, Homo sapiens
ccctcctggctcac

SEQ ID NO: 6734632 - DNA, 15 bp, Homo sapiens
ccctcctggctcaca

SEQ ID NO: 6734633 - DNA, 19 bp, Homo sapiens
ccctcctggctcacagcca

SEQ ID NO: 6734634 - DNA, 22 bp, Homo sapiens
ccctcctggctcacagccacca

SEQ ID NO: 6734635 - DNA, 16 bp, Homo sapiens
ccctcctggctgtgac

SEQ ID NO: 6734636 - DNA, 13 bp, Homo sapiens
ccctcctgggccc

SEQ ID NO: 6734637 - DNA, 20 bp, Homo sapiens
ccctcctgggcccaggcagc

SEQ ID NO: 6734638 - DNA, 17 bp, Homo sapiens
ccctcctggggccaggc

SEQ ID NO: 6734639 - DNA, 19 bp, Homo sapiens
ccctcctggggccaggccg

SEQ ID NO: 6734640 - DNA, 11 bp, Homo sapiens
ccctcctggta

SEQ ID NO: 6734641 - DNA, 15 bp, Homo sapiens
ccctcctggtcctgg

SEQ ID NO: 6734642 - DNA, 18 bp, Homo sapiens
ccctcctggtcctggaca

SEQ ID NO: 6734643 - DNA, 19 bp, Homo sapiens
ccctcctggtcctggacac

SEQ ID NO: 6734644 - DNA, 21 bp, Homo sapiens
ccctcctggtcctggacacct

SEQ ID NO: 6734645 - DNA, 17 bp, Homo sapiens
ccctcctggtgaagtgt

SEQ ID NO: 6734646 - DNA, 19 bp, Homo sapiens
ccctcctggtgtcacccca

SEQ ID NO: 6734647 - DNA, 13 bp, Homo sapiens
ccctcctgtaaat

SEQ ID NO: 6734648 - DNA, 14 bp, Homo sapiens
ccctcctgtcttcc

SEQ ID NO: 6734649 - DNA, 16 bp, Homo sapiens
ccctcctgtcttccca

SEQ ID NO: 6734650 - DNA, 22 bp, Homo sapiens
ccctcctgtgccccagctgcca

SEQ ID NO: 6734651 - DNA, 19 bp, Homo sapiens
ccctcctgtgctcagccct

SEQ ID NO: 6734652 - DNA, 19 bp, Homo sapiens
ccctcctgttgccacactt

SEQ ID NO: 6734653 - DNA, 20 bp, Homo sapiens
ccctcctgttgggagagggc

SEQ ID NO: 6734654 - DNA, 13 bp, Homo sapiens
ccctcctgttgtg

SEQ ID NO: 6734655 - DNA, 11 bp, Homo sapiens
ccctccttccc

SEQ ID NO: 6734656 - DNA, 16 bp, Homo sapiens
ccctccttcccaatct

SEQ ID NO: 6734657 - DNA, 20 bp, Homo sapiens
ccctccttcccaatcttctt

SEQ ID NO: 6734658 - DNA, 12 bp, Homo sapiens
ccctccttcccc

SEQ ID NO: 6734659 - DNA, 14 bp, Homo sapiens
ccctccttccccac

SEQ ID NO: 6734660 - DNA, 17 bp, Homo sapiens
ccctccttccccagacc

SEQ ID NO: 6734661 - DNA, 18 bp, Homo sapiens
ccctccttccctcacccc

SEQ ID NO: 6734662 - DNA, 15 bp, Homo sapiens
ccctccttccctggt

SEQ ID NO: 6734663 - DNA, 18 bp, Homo sapiens
ccctccttccctggtcca

SEQ ID NO: 6734664 - DNA, 17 bp, Homo sapiens
ccctccttcccttctct

SEQ ID NO: 6734665 - DNA, 11 bp, Homo sapiens
ccctccttcct

SEQ ID NO: 6734666 - DNA, 16 bp, Homo sapiens
ccctccttctcccctc

SEQ ID NO: 6734667 - DNA, 19 bp, Homo sapiens
ccctccttctcccctccag

SEQ ID NO: 6734668 - DNA, 21 bp, Homo sapiens
ccctccttctcccctccagac

SEQ ID NO: 6734669 - DNA, 22 bp, Homo sapiens
ccctccttctcccctccagacc

SEQ ID NO: 6734670 - DNA, 23 bp, Homo sapiens
ccctccttctcccctccagaccc

SEQ ID NO: 6734671 - DNA, 14 bp, Homo sapiens
ccctccttctcctt

SEQ ID NO: 6734672 - DNA, 15 bp, Homo sapiens
ccctccttctgctgt

SEQ ID NO: 6734673 - DNA, 18 bp, Homo sapiens
ccctccttcttgccctga

SEQ ID NO: 6734674 - DNA, 21 bp, Homo sapiens
ccctccttcttgccctgagct

SEQ ID NO: 6734675 - DNA, 22 bp, Homo sapiens
ccctccttcttgccctgagctt

SEQ ID NO: 6734676 - DNA, 18 bp, Homo sapiens
ccctccttgagcaccagc

SEQ ID NO: 6734677 - DNA, 16 bp, Homo sapiens
ccctccttgcaaccag

SEQ ID NO: 6734678 - DNA, 18 bp, Homo sapiens
ccctccttgcaaccaggc

SEQ ID NO: 6734679 - DNA, 22 bp, Homo sapiens
ccctccttgcaaccaggcagct

SEQ ID NO: 6734680 - DNA, 13 bp, Homo sapiens
ccctccttgccac

SEQ ID NO: 6734681 - DNA, 18 bp, Homo sapiens
ccctccttgccacccccc

SEQ ID NO: 6734682 - DNA, 20 bp, Homo sapiens
ccctccttgccgctgggaga

SEQ ID NO: 6734683 - DNA, 16 bp, Homo sapiens
ccctcctttaccccac

SEQ ID NO: 6734684 - DNA, 17 bp, Homo sapiens
ccctcctttaccgagga

SEQ ID NO: 6734685 - DNA, 13 bp, Homo sapiens
ccctcctttccca

SEQ ID NO: 6734686 - DNA, 13 bp, Homo sapiens
ccctcctttccct

SEQ ID NO: 6734687 - DNA, 18 bp, Homo sapiens
ccctcctttcccttattg

SEQ ID NO: 6734688 - DNA, 19 bp, Homo sapiens
ccctccttttcccactggt

SEQ ID NO: 6734689 - DNA, 21 bp, Homo sapiens
ccctccttttggcctggggga

SEQ ID NO: 6734690 - DNA, 22 bp, Homo sapiens
ccctccttttggcctgggggag

SEQ ID NO: 6734691 - DNA, 15 bp, Homo sapiens
ccctcctttttatgt

SEQ ID NO: 6734692 - DNA, 17 bp, Homo sapiens
ccctcgaaccaaggcag

SEQ ID NO: 6734693 - DNA, 19 bp, Homo sapiens
ccctcgaagcgcgccactc

SEQ ID NO: 6734694 - DNA, 18 bp, Homo sapiens
ccctcgacagcgcccctg

SEQ ID NO: 6734695 - DNA, 21 bp, Homo sapiens
ccctcgacagcgcccctgctg

SEQ ID NO: 6734696 - DNA, 22 bp, Homo sapiens
ccctcgacagcgcccctgctgt

SEQ ID NO: 6734697 - DNA, 15 bp, Homo sapiens
ccctcgaccctgtgc

SEQ ID NO: 6734698 - DNA, 22 bp, Homo sapiens
ccctcgacttgaccctttcctc

SEQ ID NO: 6734699 - DNA, 19 bp, Homo sapiens
ccctcgagctctgtagcct

SEQ ID NO: 6734700 - DNA, 23 bp, Homo sapiens
ccctcgagctctgtagcctggtc

SEQ ID NO: 6734701 - DNA, 15 bp, Homo sapiens
ccctcgaggcctaca

SEQ ID NO: 6734702 - DNA, 22 bp, Homo sapiens
ccctcgaggcggatctttggac

SEQ ID NO: 6734703 - DNA, 21 bp, Homo sapiens
ccctcgatcatatttcccctt

SEQ ID NO: 6734704 - DNA, 15 bp, Homo sapiens
ccctcgcaaccctgc

SEQ ID NO: 6734705 - DNA, 16 bp, Homo sapiens
ccctcgcaaccctgcc

SEQ ID NO: 6734706 - DNA, 22 bp, Homo sapiens
ccctcgcagacctaagccctgc

SEQ ID NO: 6734707 - DNA, 13 bp, Homo sapiens
ccctcgccagctt

SEQ ID NO: 6734708 - DNA, 15 bp, Homo sapiens
ccctcgccagcttct

SEQ ID NO: 6734709 - DNA, 14 bp, Homo sapiens
ccctcgccagcttg

SEQ ID NO: 6734710 - DNA, 16 bp, Homo sapiens
ccctcgccagcttggc

SEQ ID NO: 6734711 - DNA, 12 bp, Homo sapiens
ccctcgcccagt

SEQ ID NO: 6734712 - DNA, 13 bp, Homo sapiens
ccctcgcccagtc

SEQ ID NO: 6734713 - DNA, 18 bp, Homo sapiens
ccctcgcccagtcccagc

SEQ ID NO: 6734714 - DNA, 13 bp, Homo sapiens
ccctcgcccccgc

SEQ ID NO: 6734715 - DNA, 17 bp, Homo sapiens
ccctcgcccgcccacac

SEQ ID NO: 6734716 - DNA, 12 bp, Homo sapiens
ccctcgccctgt

SEQ ID NO: 6734717 - DNA, 16 bp, Homo sapiens
ccctcgccctgtccct

SEQ ID NO: 6734718 - DNA, 13 bp, Homo sapiens
ccctcgcctcctc

SEQ ID NO: 6734719 - DNA, 12 bp, Homo sapiens
ccctcgcctgtg

SEQ ID NO: 6734720 - DNA, 16 bp, Homo sapiens
ccctcgcgcccctgtc

SEQ ID NO: 6734721 - DNA, 13 bp, Homo sapiens
ccctcgctccggg

SEQ ID NO: 6734722 - DNA, 14 bp, Homo sapiens
ccctcgctgccagc

SEQ ID NO: 6734723 - DNA, 13 bp, Homo sapiens
ccctcgctgctgc

SEQ ID NO: 6734724 - DNA, 14 bp, Homo sapiens
ccctcgctgctgct

SEQ ID NO: 6734725 - DNA, 15 bp, Homo sapiens
ccctcgctgcttctg

SEQ ID NO: 6734726 - DNA, 15 bp, Homo sapiens
ccctcgctgtcctgc

SEQ ID NO: 6734727 - DNA, 23 bp, Homo sapiens
ccctcgcttcataggcagagccc

SEQ ID NO: 6734728 - DNA, 23 bp, Homo sapiens
ccctcgcttggacggctgggcac

SEQ ID NO: 6734729 - DNA, 14 bp, Homo sapiens
ccctcggacccacc

SEQ ID NO: 6734730 - DNA, 13 bp, Homo sapiens
ccctcggagcctg

SEQ ID NO: 6734731 - DNA, 17 bp, Homo sapiens
ccctcggagctggctgt

SEQ ID NO: 6734732 - DNA, 20 bp, Homo sapiens
ccctcggaggtccagctggg

SEQ ID NO: 6734733 - DNA, 14 bp, Homo sapiens
ccctcggcccctca

SEQ ID NO: 6734734 - DNA, 14 bp, Homo sapiens
ccctcggcctccag

SEQ ID NO: 6734735 - DNA, 13 bp, Homo sapiens
ccctcggctaccc

SEQ ID NO: 6734736 - DNA, 17 bp, Homo sapiens
ccctcgggaagcagcca

SEQ ID NO: 6734737 - DNA, 18 bp, Homo sapiens
ccctcgggaagcagccag

SEQ ID NO: 6734738 - DNA, 18 bp, Homo sapiens
ccctcgggaccccactcg

SEQ ID NO: 6734739 - DNA, 14 bp, Homo sapiens
ccctcgggcccacc

SEQ ID NO: 6734740 - DNA, 19 bp, Homo sapiens
ccctcgggccccatcctca

SEQ ID NO: 6734741 - DNA, 13 bp, Homo sapiens
ccctcgggccctc

SEQ ID NO: 6734742 - DNA, 18 bp, Homo sapiens
ccctcggggatgtgtcct

SEQ ID NO: 6734743 - DNA, 17 bp, Homo sapiens
ccctcggggcaggaagt

SEQ ID NO: 6734744 - DNA, 21 bp, Homo sapiens
ccctcggggcaggaagtccct

SEQ ID NO: 6734745 - DNA, 16 bp, Homo sapiens
ccctcgggggcctgtg

SEQ ID NO: 6734746 - DNA, 14 bp, Homo sapiens
ccctcgggggctct

SEQ ID NO: 6734747 - DNA, 15 bp, Homo sapiens
ccctcgggggctctt

SEQ ID NO: 6734748 - DNA, 19 bp, Homo sapiens
ccctcgggggctcttcccc

SEQ ID NO: 6734749 - DNA, 22 bp, Homo sapiens
ccctcggggggtcacaggccca

SEQ ID NO: 6734750 - DNA, 20 bp, Homo sapiens
ccctcgggtctccccacctg

SEQ ID NO: 6734751 - DNA, 18 bp, Homo sapiens
ccctcgggtctcctcact

SEQ ID NO: 6734752 - DNA, 19 bp, Homo sapiens
ccctcgggtctcctcactc

SEQ ID NO: 6734753 - DNA, 12 bp, Homo sapiens
ccctcgggtggg

SEQ ID NO: 6734754 - DNA, 20 bp, Homo sapiens
ccctcggtcacctgtgctac

SEQ ID NO: 6734755 - DNA, 21 bp, Homo sapiens
ccctcggtcagcaccgtggtg

SEQ ID NO: 6734756 - DNA, 21 bp, Homo sapiens
ccctcggtggctgcacagaag

SEQ ID NO: 6734757 - DNA, 16 bp, Homo sapiens
ccctcggtgggagcca

SEQ ID NO: 6734758 - DNA, 19 bp, Homo sapiens
ccctcgtccacaggggcag

SEQ ID NO: 6734759 - DNA, 23 bp, Homo sapiens
ccctcgtccacaggggcaggcct

SEQ ID NO: 6734760 - DNA, 19 bp, Homo sapiens
ccctcgtccaccccccaca

SEQ ID NO: 6734761 - DNA, 14 bp, Homo sapiens
ccctcgtcctgtcc

SEQ ID NO: 6734762 - DNA, 16 bp, Homo sapiens
ccctcgtcctgtccca

SEQ ID NO: 6734763 - DNA, 13 bp, Homo sapiens
ccctcgtggccag

SEQ ID NO: 6734764 - DNA, 21 bp, Homo sapiens
ccctcgtgggcttgtgctcgg

SEQ ID NO: 6734765 - DNA, 18 bp, Homo sapiens
ccctcgtggtccccaaca

SEQ ID NO: 6734766 - DNA, 23 bp, Homo sapiens
ccctcgtggtccccaacagcgac

SEQ ID NO: 6734767 - DNA, 17 bp, Homo sapiens
ccctcgtgtcagctcag

SEQ ID NO: 6734768 - DNA, 16 bp, Homo sapiens
ccctctaaagcaataa

SEQ ID NO: 6734769 - DNA, 19 bp, Homo sapiens
ccctctaacctcgccctct

SEQ ID NO: 6734770 - DNA, 19 bp, Homo sapiens
ccctctaatgctcacgctc

SEQ ID NO: 6734771 - DNA, 15 bp, Homo sapiens
ccctctacagagctt

SEQ ID NO: 6734772 - DNA, 18 bp, Homo sapiens
ccctctacagagcttccc

SEQ ID NO: 6734773 - DNA, 21 bp, Homo sapiens
ccctctacagagcttccctga

SEQ ID NO: 6734774 - DNA, 14 bp, Homo sapiens
ccctctactcttcc

SEQ ID NO: 6734775 - DNA, 17 bp, Homo sapiens
ccctctactcttcctgt

SEQ ID NO: 6734776 - DNA, 17 bp, Homo sapiens
ccctctactgggagcct

SEQ ID NO: 6734777 - DNA, 20 bp, Homo sapiens
ccctctactgggagcctacc

SEQ ID NO: 6734778 - DNA, 22 bp, Homo sapiens
ccctctagaggctgcctgggcc

SEQ ID NO: 6734779 - DNA, 14 bp, Homo sapiens
ccctctagggcagg

SEQ ID NO: 6734780 - DNA, 17 bp, Homo sapiens
ccctctagtgccttctt

SEQ ID NO: 6734781 - DNA, 17 bp, Homo sapiens
ccctctatgctggcttt

SEQ ID NO: 6734782 - DNA, 13 bp, Homo sapiens
ccctctatttatt

SEQ ID NO: 6734783 - DNA, 15 bp, Homo sapiens
ccctctcaaccttgt

SEQ ID NO: 6734784 - DNA, 13 bp, Homo sapiens
ccctctcaccaaa

SEQ ID NO: 6734785 - DNA, 16 bp, Homo sapiens
ccctctcacccgggac

SEQ ID NO: 6734786 - DNA, 15 bp, Homo sapiens
ccctctcacgccacc

SEQ ID NO: 6734787 - DNA, 22 bp, Homo sapiens
ccctctcactccagccaaagaa

SEQ ID NO: 6734788 - DNA, 17 bp, Homo sapiens
ccctctcagaggcctgc

SEQ ID NO: 6734789 - DNA, 23 bp, Homo sapiens
ccctctcagatcaccccagcctc

SEQ ID NO: 6734790 - DNA, 14 bp, Homo sapiens
ccctctcagccctc

SEQ ID NO: 6734791 - DNA, 18 bp, Homo sapiens
ccctctcagccctcacac

SEQ ID NO: 6734792 - DNA, 17 bp, Homo sapiens
ccctctcagtgccttct

SEQ ID NO: 6734793 - DNA, 18 bp, Homo sapiens
ccctctcatccaggtcct

SEQ ID NO: 6734794 - DNA, 15 bp, Homo sapiens
ccctctcatccccct

SEQ ID NO: 6734795 - DNA, 20 bp, Homo sapiens
ccctctcatccccctgtgga

SEQ ID NO: 6734796 - DNA, 15 bp, Homo sapiens
ccctctcatctcagg

SEQ ID NO: 6734797 - DNA, 20 bp, Homo sapiens
ccctctccaagcgcctggct

SEQ ID NO: 6734798 - DNA, 12 bp, Homo sapiens
ccctctccacac

SEQ ID NO: 6734799 - DNA, 13 bp, Homo sapiens
ccctctccacacc

SEQ ID NO: 6734800 - DNA, 14 bp, Homo sapiens
ccctctccaggcct

SEQ ID NO: 6734801 - DNA, 16 bp, Homo sapiens
ccctctccaggcctgt

SEQ ID NO: 6734802 - DNA, 18 bp, Homo sapiens
ccctctccataaccccac

SEQ ID NO: 6734803 - DNA, 20 bp, Homo sapiens
ccctctcccaaaaaactact

SEQ ID NO: 6734804 - DNA, 11 bp, Homo sapiens
ccctctcccac

SEQ ID NO: 6734805 - DNA, 17 bp, Homo sapiens
ccctctcccacccaagg

SEQ ID NO: 6734806 - DNA, 13 bp, Homo sapiens
ccctctcccaggc

SEQ ID NO: 6734807 - DNA, 20 bp, Homo sapiens
ccctctcccaggccccatga

SEQ ID NO: 6734808 - DNA, 15 bp, Homo sapiens
ccctctcccagggat

SEQ ID NO: 6734809 - DNA, 21 bp, Homo sapiens
ccctctcccagggatgctctt

SEQ ID NO: 6734810 - DNA, 14 bp, Homo sapiens
ccctctcccagtcc

SEQ ID NO: 6734811 - DNA, 18 bp, Homo sapiens
ccctctccccacccctac

SEQ ID NO: 6734812 - DNA, 13 bp, Homo sapiens
ccctctccccgga

SEQ ID NO: 6734813 - DNA, 23 bp, Homo sapiens
ccctctccccggacaagcccagg

SEQ ID NO: 6734814 - DNA, 18 bp, Homo sapiens
ccctctcccctgccccct

SEQ ID NO: 6734815 - DNA, 14 bp, Homo sapiens
ccctctccctcagt

SEQ ID NO: 6734816 - DNA, 17 bp, Homo sapiens
ccctctccctctaggct

SEQ ID NO: 6734817 - DNA, 22 bp, Homo sapiens
ccctctccctgtgttctgggct

SEQ ID NO: 6734818 - DNA, 19 bp, Homo sapiens
ccctctccgcacacctctg

SEQ ID NO: 6734819 - DNA, 23 bp, Homo sapiens
ccctctccgcgggagaccccttg

SEQ ID NO: 6734820 - DNA, 12 bp, Homo sapiens
ccctctcctccc

SEQ ID NO: 6734821 - DNA, 15 bp, Homo sapiens
ccctctcctcccagc

SEQ ID NO: 6734822 - DNA, 18 bp, Homo sapiens
ccctctcctcccagctgc

SEQ ID NO: 6734823 - DNA, 20 bp, Homo sapiens
ccctctcctcccagctgctt

SEQ ID NO: 6734824 - DNA, 20 bp, Homo sapiens
ccctctcctcccccaccttc

SEQ ID NO: 6734825 - DNA, 15 bp, Homo sapiens
ccctctcctccccct

SEQ ID NO: 6734826 - DNA, 12 bp, Homo sapiens
ccctctcctccg

SEQ ID NO: 6734827 - DNA, 19 bp, Homo sapiens
ccctctcctctcccccagg

SEQ ID NO: 6734828 - DNA, 12 bp, Homo sapiens
ccctctcctctg

SEQ ID NO: 6734829 - DNA, 18 bp, Homo sapiens
ccctctcctctgccctct

SEQ ID NO: 6734830 - DNA, 15 bp, Homo sapiens
ccctctcctgcccag

SEQ ID NO: 6734831 - DNA, 17 bp, Homo sapiens
ccctctcctgcctactc

SEQ ID NO: 6734832 - DNA, 14 bp, Homo sapiens
ccctctcctggagg

SEQ ID NO: 6734833 - DNA, 20 bp, Homo sapiens
ccctctcctgggcagctgcc

SEQ ID NO: 6734834 - DNA, 18 bp, Homo sapiens
ccctctcctgtctgccct

SEQ ID NO: 6734835 - DNA, 14 bp, Homo sapiens
ccctctccttcctg

SEQ ID NO: 6734836 - DNA, 17 bp, Homo sapiens
ccctctcctttcactcc

SEQ ID NO: 6734837 - DNA, 15 bp, Homo sapiens
ccctctcgccccatc

SEQ ID NO: 6734838 - DNA, 21 bp, Homo sapiens
ccctctcgccccatccctgct

SEQ ID NO: 6734839 - DNA, 17 bp, Homo sapiens
ccctctcgcctcattac

SEQ ID NO: 6734840 - DNA, 13 bp, Homo sapiens
ccctctctaggga

SEQ ID NO: 6734841 - DNA, 14 bp, Homo sapiens
ccctctctagggac

SEQ ID NO: 6734842 - DNA, 15 bp, Homo sapiens
ccctctctagggacc

SEQ ID NO: 6734843 - DNA, 17 bp, Homo sapiens
ccctctctagggacccc

SEQ ID NO: 6734844 - DNA, 19 bp, Homo sapiens
ccctctctagggacccctc

SEQ ID NO: 6734845 - DNA, 10 bp, Homo sapiens
ccctctctca

SEQ ID NO: 6734846 - DNA, 13 bp, Homo sapiens
ccctctctcacca

SEQ ID NO: 6734847 - DNA, 18 bp, Homo sapiens
ccctctctcaccagcctt

SEQ ID NO: 6734848 - DNA, 20 bp, Homo sapiens
ccctctctcagcacagcctg

SEQ ID NO: 6734849 - DNA, 14 bp, Homo sapiens
ccctctctccctgc

SEQ ID NO: 6734850 - DNA, 15 bp, Homo sapiens
ccctctctcctggac

SEQ ID NO: 6734851 - DNA, 10 bp, Homo sapiens
ccctctctct

SEQ ID NO: 6734852 - DNA, 13 bp, Homo sapiens
ccctctctctcac

SEQ ID NO: 6734853 - DNA, 17 bp, Homo sapiens
ccctctctctcactccc

SEQ ID NO: 6734854 - DNA, 21 bp, Homo sapiens
ccctctctctctctctcctct

SEQ ID NO: 6734855 - DNA, 14 bp, Homo sapiens
ccctctctctgggc

SEQ ID NO: 6734856 - DNA, 17 bp, Homo sapiens
ccctctctcttctgctc

SEQ ID NO: 6734857 - DNA, 23 bp, Homo sapiens
ccctctctcttctgctccaccct

SEQ ID NO: 6734858 - DNA, 18 bp, Homo sapiens
ccctctctgaaggaggcc

SEQ ID NO: 6734859 - DNA, 10 bp, Homo sapiens
ccctctctgc

SEQ ID NO: 6734860 - DNA, 14 bp, Homo sapiens
ccctctctgcaccg

SEQ ID NO: 6734861 - DNA, 20 bp, Homo sapiens
ccctctctgcccctgatcac

SEQ ID NO: 6734862 - DNA, 16 bp, Homo sapiens
ccctctctgctccaga

SEQ ID NO: 6734863 - DNA, 14 bp, Homo sapiens
ccctctctgctctg

SEQ ID NO: 6734864 - DNA, 15 bp, Homo sapiens
ccctctctgctctgc

SEQ ID NO: 6734865 - DNA, 19 bp, Homo sapiens
ccctctctggacctcagtt

SEQ ID NO: 6734866 - DNA, 22 bp, Homo sapiens
ccctctctgtttaccctccctg

SEQ ID NO: 6734867 - DNA, 20 bp, Homo sapiens
ccctctcttaatgccacggc

SEQ ID NO: 6734868 - DNA, 22 bp, Homo sapiens
ccctctcttaatgccacggcag

SEQ ID NO: 6734869 - DNA, 17 bp, Homo sapiens
ccctctcttaccccgtc

SEQ ID NO: 6734870 - DNA, 15 bp, Homo sapiens
ccctctcttccctat

SEQ ID NO: 6734871 - DNA, 21 bp, Homo sapiens
ccctctcttccgggagctggt

SEQ ID NO: 6734872 - DNA, 12 bp, Homo sapiens
ccctctcttgcc

SEQ ID NO: 6734873 - DNA, 14 bp, Homo sapiens
ccctctctttctaa

SEQ ID NO: 6734874 - DNA, 21 bp, Homo sapiens
ccctctgaagagaccttggct

SEQ ID NO: 6734875 - DNA, 22 bp, Homo sapiens
ccctctgaagagaccttggctg

SEQ ID NO: 6734876 - DNA, 19 bp, Homo sapiens
ccctctgaatggtccaggg

SEQ ID NO: 6734877 - DNA, 19 bp, Homo sapiens
ccctctgacctgcactggg

SEQ ID NO: 6734878 - DNA, 20 bp, Homo sapiens
ccctctgagcaactgtgcag

SEQ ID NO: 6734879 - DNA, 19 bp, Homo sapiens
ccctctgaggctcagccct

SEQ ID NO: 6734880 - DNA, 20 bp, Homo sapiens
ccctctgattggttttgggg

SEQ ID NO: 6734881 - DNA, 17 bp, Homo sapiens
ccctctgcaacccccca

SEQ ID NO: 6734882 - DNA, 16 bp, Homo sapiens
ccctctgcacccagaa

SEQ ID NO: 6734883 - DNA, 12 bp, Homo sapiens
ccctctgcagaa

SEQ ID NO: 6734884 - DNA, 19 bp, Homo sapiens
ccctctgcagaacagtgaa

SEQ ID NO: 6734885 - DNA, 21 bp, Homo sapiens
ccctctgcagggcagcctgtg

SEQ ID NO: 6734886 - DNA, 14 bp, Homo sapiens
ccctctgccaccag

SEQ ID NO: 6734887 - DNA, 12 bp, Homo sapiens
ccctctgccact

SEQ ID NO: 6734888 - DNA, 18 bp, Homo sapiens
ccctctgcccagcttggg

SEQ ID NO: 6734889 - DNA, 22 bp, Homo sapiens
ccctctgccccaagcagccagc

SEQ ID NO: 6734890 - DNA, 15 bp, Homo sapiens
ccctctgcccctgca

SEQ ID NO: 6734891 - DNA, 16 bp, Homo sapiens
ccctctgcccctgcag

SEQ ID NO: 6734892 - DNA, 17 bp, Homo sapiens
ccctctgcccctgcagc

SEQ ID NO: 6734893 - DNA, 18 bp, Homo sapiens
ccctctgccgaccgcctg

SEQ ID NO: 6734894 - DNA, 21 bp, Homo sapiens
ccctctgccgaccgcctgctt

SEQ ID NO: 6734895 - DNA, 10 bp, Homo sapiens
ccctctgcct

SEQ ID NO: 6734896 - DNA, 14 bp, Homo sapiens
ccctctgcctcctc

SEQ ID NO: 6734897 - DNA, 11 bp, Homo sapiens
ccctctgcctg

SEQ ID NO: 6734898 - DNA, 15 bp, Homo sapiens
ccctctgcctgcact

SEQ ID NO: 6734899 - DNA, 17 bp, Homo sapiens
ccctctgcctgcactcc

SEQ ID NO: 6734900 - DNA, 23 bp, Homo sapiens
ccctctgcctgcactccctggcc

SEQ ID NO: 6734901 - DNA, 13 bp, Homo sapiens
ccctctgcctggg

SEQ ID NO: 6734902 - DNA, 14 bp, Homo sapiens
ccctctgcctggga

SEQ ID NO: 6734903 - DNA, 15 bp, Homo sapiens
ccctctgcctgggat

SEQ ID NO: 6734904 - DNA, 13 bp, Homo sapiens
ccctctgcctgtc

SEQ ID NO: 6734905 - DNA, 15 bp, Homo sapiens
ccctctgcctgtccc

SEQ ID NO: 6734906 - DNA, 13 bp, Homo sapiens
ccctctgccttca

SEQ ID NO: 6734907 - DNA, 20 bp, Homo sapiens
ccctctgccttcaggcttct

SEQ ID NO: 6734908 - DNA, 12 bp, Homo sapiens
ccctctgcggct

SEQ ID NO: 6734909 - DNA, 19 bp, Homo sapiens
ccctctgcgtcccccagcc

SEQ ID NO: 6734910 - DNA, 15 bp, Homo sapiens
ccctctgctcagcca

SEQ ID NO: 6734911 - DNA, 15 bp, Homo sapiens
ccctctgctccacag

SEQ ID NO: 6734912 - DNA, 20 bp, Homo sapiens
ccctctgctccccagtgcta

SEQ ID NO: 6734913 - DNA, 15 bp, Homo sapiens
ccctctgctctcata

SEQ ID NO: 6734914 - DNA, 17 bp, Homo sapiens
ccctctgctctgcctgg

SEQ ID NO: 6734915 - DNA, 18 bp, Homo sapiens
ccctctgctctgcctgga

SEQ ID NO: 6734916 - DNA, 15 bp, Homo sapiens
ccctctgctgaagac

SEQ ID NO: 6734917 - DNA, 20 bp, Homo sapiens
ccctctgctgcaacaagctc

SEQ ID NO: 6734918 - DNA, 12 bp, Homo sapiens
ccctctgctgct

SEQ ID NO: 6734919 - DNA, 18 bp, Homo sapiens
ccctctgctgctgcccgg

SEQ ID NO: 6734920 - DNA, 23 bp, Homo sapiens
ccctctgctgctgcccggggtgg

SEQ ID NO: 6734921 - DNA, 14 bp, Homo sapiens
ccctctgctgctgt

SEQ ID NO: 6734922 - DNA, 15 bp, Homo sapiens
ccctctgctgctgtc

SEQ ID NO: 6734923 - DNA, 14 bp, Homo sapiens
ccctctgctgcttt

SEQ ID NO: 6734924 - DNA, 14 bp, Homo sapiens
ccctctgctggccg

SEQ ID NO: 6734925 - DNA, 23 bp, Homo sapiens
ccctctgctggccgggcacagct

SEQ ID NO: 6734926 - DNA, 12 bp, Homo sapiens
ccctctggaagt

SEQ ID NO: 6734927 - DNA, 15 bp, Homo sapiens
ccctctggacagctt

SEQ ID NO: 6734928 - DNA, 13 bp, Homo sapiens
ccctctggatcaa

SEQ ID NO: 6734929 - DNA, 23 bp, Homo sapiens
ccctctggatcctgctgtggcct

SEQ ID NO: 6734930 - DNA, 15 bp, Homo sapiens
ccctctggattctct

SEQ ID NO: 6734931 - DNA, 12 bp, Homo sapiens
ccctctggccag

SEQ ID NO: 6734932 - DNA, 22 bp, Homo sapiens
ccctctggccaggatggagggg

SEQ ID NO: 6734933 - DNA, 17 bp, Homo sapiens
ccctctggctccagctg

SEQ ID NO: 6734934 - DNA, 13 bp, Homo sapiens
ccctctggcttcc

SEQ ID NO: 6734935 - DNA, 15 bp, Homo sapiens
ccctctggcttccca

SEQ ID NO: 6734936 - DNA, 21 bp, Homo sapiens
ccctctgggcacgcctgctgg

SEQ ID NO: 6734937 - DNA, 15 bp, Homo sapiens
ccctctgggcagctg

SEQ ID NO: 6734938 - DNA, 19 bp, Homo sapiens
ccctctgggcagctgtcat

SEQ ID NO: 6734939 - DNA, 12 bp, Homo sapiens
ccctctgggctc

SEQ ID NO: 6734940 - DNA, 17 bp, Homo sapiens
ccctctgggctctgagt

SEQ ID NO: 6734941 - DNA, 15 bp, Homo sapiens
ccctctggggctcag

SEQ ID NO: 6734942 - DNA, 19 bp, Homo sapiens
ccctctggggctcagccct

SEQ ID NO: 6734943 - DNA, 21 bp, Homo sapiens
ccctctgggggctctggccaa

SEQ ID NO: 6734944 - DNA, 20 bp, Homo sapiens
ccctctgggggtcctctctg

SEQ ID NO: 6734945 - DNA, 15 bp, Homo sapiens
ccctctggtcccaca

SEQ ID NO: 6734946 - DNA, 17 bp, Homo sapiens
ccctctggtccttctga

SEQ ID NO: 6734947 - DNA, 22 bp, Homo sapiens
ccctctggtcgctcctgcccac

SEQ ID NO: 6734948 - DNA, 21 bp, Homo sapiens
ccctctgtagctccctcctcc

SEQ ID NO: 6734949 - DNA, 21 bp, Homo sapiens
ccctctgtcatcactccctgg

SEQ ID NO: 6734950 - DNA, 13 bp, Homo sapiens
ccctctgtccacc

SEQ ID NO: 6734951 - DNA, 24 bp, Homo sapiens
ccctctgtccaggcactgagatac

SEQ ID NO: 6734952 - DNA, 16 bp, Homo sapiens
ccctctgtcccacccc

SEQ ID NO: 6734953 - DNA, 15 bp, Homo sapiens
ccctctgtccccagg

SEQ ID NO: 6734954 - DNA, 15 bp, Homo sapiens
ccctctgtcctgact

SEQ ID NO: 6734955 - DNA, 22 bp, Homo sapiens
ccctctgtctaggactgcagtg

SEQ ID NO: 6734956 - DNA, 21 bp, Homo sapiens
ccctctgtcttttctcctccg

SEQ ID NO: 6734957 - DNA, 13 bp, Homo sapiens
ccctctgtgccta

SEQ ID NO: 6734958 - DNA, 15 bp, Homo sapiens
ccctctgtgcctaat

SEQ ID NO: 6734959 - DNA, 17 bp, Homo sapiens
ccctctgtgcctaataa

SEQ ID NO: 6734960 - DNA, 19 bp, Homo sapiens
ccctctgtggccaggagcc

SEQ ID NO: 6734961 - DNA, 21 bp, Homo sapiens
ccctctgtggccaggagccct

SEQ ID NO: 6734962 - DNA, 21 bp, Homo sapiens
ccctctgttaggtccattttc

SEQ ID NO: 6734963 - DNA, 17 bp, Homo sapiens
ccctctgttcagtaaca

SEQ ID NO: 6734964 - DNA, 20 bp, Homo sapiens
ccctctgtttctctttcctt

SEQ ID NO: 6734965 - DNA, 16 bp, Homo sapiens
ccctcttaagatctga

SEQ ID NO: 6734966 - DNA, 19 bp, Homo sapiens
ccctcttattgttcctctt

SEQ ID NO: 6734967 - DNA, 21 bp, Homo sapiens
ccctcttccaaaggcagcgtg

SEQ ID NO: 6734968 - DNA, 22 bp, Homo sapiens
ccctcttccaaaggcagcgtgc

SEQ ID NO: 6734969 - DNA, 11 bp, Homo sapiens
ccctcttccat

SEQ ID NO: 6734970 - DNA, 18 bp, Homo sapiens
ccctcttccctctccctc

SEQ ID NO: 6734971 - DNA, 23 bp, Homo sapiens
ccctcttccctgtcttccccacc

SEQ ID NO: 6734972 - DNA, 13 bp, Homo sapiens
ccctcttcccttc

SEQ ID NO: 6734973 - DNA, 20 bp, Homo sapiens
ccctcttcccttctgagtct

SEQ ID NO: 6734974 - DNA, 14 bp, Homo sapiens
ccctcttcctactg

SEQ ID NO: 6734975 - DNA, 19 bp, Homo sapiens
ccctcttcctactggtctc

SEQ ID NO: 6734976 - DNA, 22 bp, Homo sapiens
ccctcttcctactggtctctct

SEQ ID NO: 6734977 - DNA, 12 bp, Homo sapiens
ccctcttcctcc

SEQ ID NO: 6734978 - DNA, 16 bp, Homo sapiens
ccctcttcctccctgg

SEQ ID NO: 6734979 - DNA, 15 bp, Homo sapiens
ccctcttcctgtgat

SEQ ID NO: 6734980 - DNA, 17 bp, Homo sapiens
ccctcttccttccccca

SEQ ID NO: 6734981 - DNA, 17 bp, Homo sapiens
ccctcttctcagctcca

SEQ ID NO: 6734982 - DNA, 18 bp, Homo sapiens
ccctcttctcagctccac

SEQ ID NO: 6734983 - DNA, 13 bp, Homo sapiens
ccctcttctctcc

SEQ ID NO: 6734984 - DNA, 15 bp, Homo sapiens
ccctcttctctcctc

SEQ ID NO: 6734985 - DNA, 13 bp, Homo sapiens
ccctcttctctgg

SEQ ID NO: 6734986 - DNA, 14 bp, Homo sapiens
ccctcttctgagca

SEQ ID NO: 6734987 - DNA, 15 bp, Homo sapiens
ccctcttctgagcac

SEQ ID NO: 6734988 - DNA, 18 bp, Homo sapiens
ccctcttctggtttccct

SEQ ID NO: 6734989 - DNA, 20 bp, Homo sapiens
ccctcttctttcagacttgc

SEQ ID NO: 6734990 - DNA, 13 bp, Homo sapiens
ccctcttgccagc

SEQ ID NO: 6734991 - DNA, 18 bp, Homo sapiens
ccctcttgccagcctcct

SEQ ID NO: 6734992 - DNA, 21 bp, Homo sapiens
ccctcttgccatcctgatgga

SEQ ID NO: 6734993 - DNA, 12 bp, Homo sapiens
ccctcttgcccc

SEQ ID NO: 6734994 - DNA, 19 bp, Homo sapiens
ccctcttgccccaaccccc

SEQ ID NO: 6734995 - DNA, 22 bp, Homo sapiens
ccctcttgccccaacccccagc

SEQ ID NO: 6734996 - DNA, 15 bp, Homo sapiens
ccctcttgcgggcct

SEQ ID NO: 6734997 - DNA, 18 bp, Homo sapiens
ccctcttggattaaggaa

SEQ ID NO: 6734998 - DNA, 21 bp, Homo sapiens
ccctcttgtaagtcatctact

SEQ ID NO: 6734999 - DNA, 15 bp, Homo sapiens
ccctcttgtcagtgt

SEQ ID NO: 6735000 - DNA, 21 bp, Homo sapiens
ccctcttgtcagtgtagacac

SEQ ID NO: 6735001 - DNA, 20 bp, Homo sapiens
ccctcttgtccctttcccta

SEQ ID NO: 6735002 - DNA, 22 bp, Homo sapiens
ccctcttgttttgtttgtctct

SEQ ID NO: 6735003 - DNA, 17 bp, Homo sapiens
ccctctttccctccctt

SEQ ID NO: 6735004 - DNA, 12 bp, Homo sapiens
ccctctttctac

SEQ ID NO: 6735005 - DNA, 18 bp, Homo sapiens
ccctctttctagcctggg

SEQ ID NO: 6735006 - DNA, 14 bp, Homo sapiens
ccctctttctctct

SEQ ID NO: 6735007 - DNA, 16 bp, Homo sapiens
ccctctttctctctgt

SEQ ID NO: 6735008 - DNA, 14 bp, Homo sapiens
ccctctttctcttt

SEQ ID NO: 6735009 - DNA, 23 bp, Homo sapiens
ccctctttcttgtttgtcagcat

SEQ ID NO: 6735010 - DNA, 17 bp, Homo sapiens
ccctctttgaatctctg

SEQ ID NO: 6735011 - DNA, 20 bp, Homo sapiens
ccctctttgcacagcatgag

SEQ ID NO: 6735012 - DNA, 21 bp, Homo sapiens
ccctctttgcctgtgtgagca

SEQ ID NO: 6735013 - DNA, 16 bp, Homo sapiens
ccctctttgctgaaga

SEQ ID NO: 6735014 - DNA, 19 bp, Homo sapiens
ccctctttggctcccctgt

SEQ ID NO: 6735015 - DNA, 21 bp, Homo sapiens
ccctcttttgttaaataatat

SEQ ID NO: 6735016 - DNA, 16 bp, Homo sapiens
ccctgaaaacccagag

SEQ ID NO: 6735017 - DNA, 19 bp, Homo sapiens
ccctgaaaacgaaggggcc

SEQ ID NO: 6735018 - DNA, 22 bp, Homo sapiens
ccctgaaaatgtttttctgcca

SEQ ID NO: 6735019 - DNA, 19 bp, Homo sapiens
ccctgaaacacgaaacttg

SEQ ID NO: 6735020 - DNA, 21 bp, Homo sapiens
ccctgaaacacgaaacttgtt

SEQ ID NO: 6735021 - DNA, 19 bp, Homo sapiens
ccctgaaacatgtgcccct

SEQ ID NO: 6735022 - DNA, 22 bp, Homo sapiens
ccctgaaacatgtgcccctgcc

SEQ ID NO: 6735023 - DNA, 23 bp, Homo sapiens
ccctgaaacattgcatgtattta

SEQ ID NO: 6735024 - DNA, 15 bp, Homo sapiens
ccctgaaacgagaag

SEQ ID NO: 6735025 - DNA, 21 bp, Homo sapiens
ccctgaaacgagaagtgccct

SEQ ID NO: 6735026 - DNA, 23 bp, Homo sapiens
ccctgaaacgagaagtgccctta

SEQ ID NO: 6735027 - DNA, 16 bp, Homo sapiens
ccctgaaactactgta

SEQ ID NO: 6735028 - DNA, 19 bp, Homo sapiens
ccctgaaactactgtatct

SEQ ID NO: 6735029 - DNA, 21 bp, Homo sapiens
ccctgaaactgagtctgtgga

SEQ ID NO: 6735030 - DNA, 14 bp, Homo sapiens
ccctgaaacttatt

SEQ ID NO: 6735031 - DNA, 23 bp, Homo sapiens
ccctgaaacttatttttttctga

SEQ ID NO: 6735032 - DNA, 16 bp, Homo sapiens
ccctgaaagccctgag

SEQ ID NO: 6735033 - DNA, 20 bp, Homo sapiens
ccctgaaagtgacagagacc

SEQ ID NO: 6735034 - DNA, 15 bp, Homo sapiens
ccctgaaatggcctg

SEQ ID NO: 6735035 - DNA, 20 bp, Homo sapiens
ccctgaaatggcctgtccct

SEQ ID NO: 6735036 - DNA, 14 bp, Homo sapiens
ccctgaacaagaat

SEQ ID NO: 6735037 - DNA, 14 bp, Homo sapiens
ccctgaacatctgt

SEQ ID NO: 6735038 - DNA, 23 bp, Homo sapiens
ccctgaacatttagtaccctgca

SEQ ID NO: 6735039 - DNA, 13 bp, Homo sapiens
ccctgaaccacga

SEQ ID NO: 6735040 - DNA, 14 bp, Homo sapiens
ccctgaaccacgag

SEQ ID NO: 6735041 - DNA, 16 bp, Homo sapiens
ccctgaacccacacct

SEQ ID NO: 6735042 - DNA, 19 bp, Homo sapiens
ccctgaacccacacctggg

SEQ ID NO: 6735043 - DNA, 19 bp, Homo sapiens
ccctgaacccctcttggat

SEQ ID NO: 6735044 - DNA, 15 bp, Homo sapiens
ccctgaacccctggc

SEQ ID NO: 6735045 - DNA, 17 bp, Homo sapiens
ccctgaacccctggcca

SEQ ID NO: 6735046 - DNA, 21 bp, Homo sapiens
ccctgaacctcagtttcctca

SEQ ID NO: 6735047 - DNA, 14 bp, Homo sapiens
ccctgaaccttcct

SEQ ID NO: 6735048 - DNA, 23 bp, Homo sapiens
ccctgaaccttcctgtctcccag

SEQ ID NO: 6735049 - DNA, 19 bp, Homo sapiens
ccctgaacgccctggtaag

SEQ ID NO: 6735050 - DNA, 19 bp, Homo sapiens
ccctgaacgttttcttctt

SEQ ID NO: 6735051 - DNA, 20 bp, Homo sapiens
ccctgaacgttttcttcttt

SEQ ID NO: 6735052 - DNA, 22 bp, Homo sapiens
ccctgaagacgagcatccccct

SEQ ID NO: 6735053 - DNA, 17 bp, Homo sapiens
ccctgaagatttcagag

SEQ ID NO: 6735054 - DNA, 12 bp, Homo sapiens
ccctgaagcctc

SEQ ID NO: 6735055 - DNA, 14 bp, Homo sapiens
ccctgaagcctccg

SEQ ID NO: 6735056 - DNA, 17 bp, Homo sapiens
ccctgaagcctccgtgg

SEQ ID NO: 6735057 - DNA, 19 bp, Homo sapiens
ccctgaagcctccgtggaa

SEQ ID NO: 6735058 - DNA, 17 bp, Homo sapiens
ccctgaagctgtgcgga

SEQ ID NO: 6735059 - DNA, 19 bp, Homo sapiens
ccctgaaggccccgcccag

SEQ ID NO: 6735060 - DNA, 20 bp, Homo sapiens
ccctgaaggccccgcccagg

SEQ ID NO: 6735061 - DNA, 22 bp, Homo sapiens
ccctgaaggccccgcccaggct

SEQ ID NO: 6735062 - DNA, 17 bp, Homo sapiens
ccctgaaggttcctgag

SEQ ID NO: 6735063 - DNA, 19 bp, Homo sapiens
ccctgaaggttcctgagga

SEQ ID NO: 6735064 - DNA, 17 bp, Homo sapiens
ccctgaagtgaccccag

SEQ ID NO: 6735065 - DNA, 20 bp, Homo sapiens
ccctgaagtgaccccagctc

SEQ ID NO: 6735066 - DNA, 20 bp, Homo sapiens
ccctgaagtgagcacagcct

SEQ ID NO: 6735067 - DNA, 17 bp, Homo sapiens
ccctgaatcagaggcag

SEQ ID NO: 6735068 - DNA, 16 bp, Homo sapiens
ccctgaatcctcagag

SEQ ID NO: 6735069 - DNA, 20 bp, Homo sapiens
ccctgaatctgaccacagac

SEQ ID NO: 6735070 - DNA, 20 bp, Homo sapiens
ccctgaatggttccatgcct

SEQ ID NO: 6735071 - DNA, 21 bp, Homo sapiens
ccctgacaacaactatcacca

SEQ ID NO: 6735072 - DNA, 14 bp, Homo sapiens
ccctgacaacactc

SEQ ID NO: 6735073 - DNA, 20 bp, Homo sapiens
ccctgacactgcggggcttg

SEQ ID NO: 6735074 - DNA, 20 bp, Homo sapiens
ccctgacagtccctcctctc

SEQ ID NO: 6735075 - DNA, 14 bp, Homo sapiens
ccctgaccaccctg

SEQ ID NO: 6735076 - DNA, 20 bp, Homo sapiens
ccctgaccaccctgcctgtg

SEQ ID NO: 6735077 - DNA, 16 bp, Homo sapiens
ccctgaccactcagag

SEQ ID NO: 6735078 - DNA, 19 bp, Homo sapiens
ccctgaccactcagagaca

SEQ ID NO: 6735079 - DNA, 23 bp, Homo sapiens
ccctgaccactcagagacatgca

SEQ ID NO: 6735080 - DNA, 16 bp, Homo sapiens
ccctgaccagctcccc

SEQ ID NO: 6735081 - DNA, 14 bp, Homo sapiens
ccctgacccaggga

SEQ ID NO: 6735082 - DNA, 15 bp, Homo sapiens
ccctgacccccatcg

SEQ ID NO: 6735083 - DNA, 14 bp, Homo sapiens
ccctgacccccttc

SEQ ID NO: 6735084 - DNA, 16 bp, Homo sapiens
ccctgacccctgcacc

SEQ ID NO: 6735085 - DNA, 13 bp, Homo sapiens
ccctgaccctgct

SEQ ID NO: 6735086 - DNA, 14 bp, Homo sapiens
ccctgaccctgctc

SEQ ID NO: 6735087 - DNA, 16 bp, Homo sapiens
ccctgaccctgtatat

SEQ ID NO: 6735088 - DNA, 17 bp, Homo sapiens
ccctgacctaccccagc

SEQ ID NO: 6735089 - DNA, 18 bp, Homo sapiens
ccctgacctaccccagcc

SEQ ID NO: 6735090 - DNA, 19 bp, Homo sapiens
ccctgacctaccccagcca

SEQ ID NO: 6735091 - DNA, 15 bp, Homo sapiens
ccctgacctcactgt

SEQ ID NO: 6735092 - DNA, 15 bp, Homo sapiens
ccctgacctcccagc

SEQ ID NO: 6735093 - DNA, 19 bp, Homo sapiens
ccctgacctcccagcccta

SEQ ID NO: 6735094 - DNA, 16 bp, Homo sapiens
ccctgacctggccccc

SEQ ID NO: 6735095 - DNA, 18 bp, Homo sapiens
ccctgaccttagcgttct

SEQ ID NO: 6735096 - DNA, 21 bp, Homo sapiens
ccctgaccttagcgttctgga

SEQ ID NO: 6735097 - DNA, 22 bp, Homo sapiens
ccctgaccttagcgttctggac

SEQ ID NO: 6735098 - DNA, 13 bp, Homo sapiens
ccctgaccttctc

SEQ ID NO: 6735099 - DNA, 19 bp, Homo sapiens
ccctgaccttctccaggga

SEQ ID NO: 6735100 - DNA, 15 bp, Homo sapiens
ccctgaccttggctg

SEQ ID NO: 6735101 - DNA, 15 bp, Homo sapiens
ccctgacggctgcca

SEQ ID NO: 6735102 - DNA, 23 bp, Homo sapiens
ccctgacgtctgccaccagcgcc

SEQ ID NO: 6735103 - DNA, 22 bp, Homo sapiens
ccctgacgttaggaccaggaga

SEQ ID NO: 6735104 - DNA, 22 bp, Homo sapiens
ccctgactaaactaccacctca

SEQ ID NO: 6735105 - DNA, 23 bp, Homo sapiens
ccctgactaaactaccacctcag

SEQ ID NO: 6735106 - DNA, 15 bp, Homo sapiens
ccctgactcattctg

SEQ ID NO: 6735107 - DNA, 17 bp, Homo sapiens
ccctgactcctctggct

SEQ ID NO: 6735108 - DNA, 18 bp, Homo sapiens
ccctgactcctctggctt

SEQ ID NO: 6735109 - DNA, 17 bp, Homo sapiens
ccctgactcctggactc

SEQ ID NO: 6735110 - DNA, 13 bp, Homo sapiens
ccctgactctctg

SEQ ID NO: 6735111 - DNA, 9 bp, Homo sapiens
ccctgactg

SEQ ID NO: 6735112 - DNA, 14 bp, Homo sapiens
ccctgactggcctg

SEQ ID NO: 6735113 - DNA, 13 bp, Homo sapiens
ccctgactgggag

SEQ ID NO: 6735114 - DNA, 20 bp, Homo sapiens
ccctgactgggggcagacat

SEQ ID NO: 6735115 - DNA, 14 bp, Homo sapiens
ccctgactggtgct

SEQ ID NO: 6735116 - DNA, 18 bp, Homo sapiens
ccctgactgtcagggagg

SEQ ID NO: 6735117 - DNA, 21 bp, Homo sapiens
ccctgactgtgttgtcccagg

SEQ ID NO: 6735118 - DNA, 13 bp, Homo sapiens
ccctgacttccca

SEQ ID NO: 6735119 - DNA, 13 bp, Homo sapiens
ccctgacttctgg

SEQ ID NO: 6735120 - DNA, 16 bp, Homo sapiens
ccctgacttctggaga

SEQ ID NO: 6735121 - DNA, 14 bp, Homo sapiens
ccctgacttttctg

SEQ ID NO: 6735122 - DNA, 16 bp, Homo sapiens
ccctgagaagctgctc

SEQ ID NO: 6735123 - DNA, 13 bp, Homo sapiens
ccctgagactcca

SEQ ID NO: 6735124 - DNA, 15 bp, Homo sapiens
ccctgagactccaga

SEQ ID NO: 6735125 - DNA, 22 bp, Homo sapiens
ccctgagagagaatagagctgc

SEQ ID NO: 6735126 - DNA, 15 bp, Homo sapiens
ccctgagagcatgtg

SEQ ID NO: 6735127 - DNA, 21 bp, Homo sapiens
ccctgagagcatgtgggggaa

SEQ ID NO: 6735128 - DNA, 13 bp, Homo sapiens
ccctgagaggttt

SEQ ID NO: 6735129 - DNA, 17 bp, Homo sapiens
ccctgagagtctggtct

SEQ ID NO: 6735130 - DNA, 20 bp, Homo sapiens
ccctgagagtggtgccctgg

SEQ ID NO: 6735131 - DNA, 17 bp, Homo sapiens
ccctgagagtttcctca

SEQ ID NO: 6735132 - DNA, 14 bp, Homo sapiens
ccctgagatcccct

SEQ ID NO: 6735133 - DNA, 22 bp, Homo sapiens
ccctgagatttaacccctccac

SEQ ID NO: 6735134 - DNA, 18 bp, Homo sapiens
ccctgagcaatgtctgtg

SEQ ID NO: 6735135 - DNA, 16 bp, Homo sapiens
ccctgagcactcctgg

SEQ ID NO: 6735136 - DNA, 18 bp, Homo sapiens
ccctgagcactcctggtg

SEQ ID NO: 6735137 - DNA, 19 bp, Homo sapiens
ccctgagcactcctggtgc

SEQ ID NO: 6735138 - DNA, 16 bp, Homo sapiens
ccctgagcaggaaagt

SEQ ID NO: 6735139 - DNA, 16 bp, Homo sapiens
ccctgagcatcctggt

SEQ ID NO: 6735140 - DNA, 16 bp, Homo sapiens
ccctgagccagcaggg

SEQ ID NO: 6735141 - DNA, 13 bp, Homo sapiens
ccctgagcccact

SEQ ID NO: 6735142 - DNA, 17 bp, Homo sapiens
ccctgagcccactgtgc

SEQ ID NO: 6735143 - DNA, 23 bp, Homo sapiens
ccctgagcccagaaaaaaggact

SEQ ID NO: 6735144 - DNA, 18 bp, Homo sapiens
ccctgagccccagggtgc

SEQ ID NO: 6735145 - DNA, 14 bp, Homo sapiens
ccctgagccctcca

SEQ ID NO: 6735146 - DNA, 15 bp, Homo sapiens
ccctgagcctgacct

SEQ ID NO: 6735147 - DNA, 12 bp, Homo sapiens
ccctgagcctgc

SEQ ID NO: 6735148 - DNA, 19 bp, Homo sapiens
ccctgagcctgcattctgc

SEQ ID NO: 6735149 - DNA, 21 bp, Homo sapiens
ccctgagcctgccccagctgg

SEQ ID NO: 6735150 - DNA, 12 bp, Homo sapiens
ccctgagcctgt

SEQ ID NO: 6735151 - DNA, 13 bp, Homo sapiens
ccctgagcctgtg

SEQ ID NO: 6735152 - DNA, 15 bp, Homo sapiens
ccctgagcctgtgtc

SEQ ID NO: 6735153 - DNA, 12 bp, Homo sapiens
ccctgagcgcct

SEQ ID NO: 6735154 - DNA, 22 bp, Homo sapiens
ccctgagcgcctggatttctgg

SEQ ID NO: 6735155 - DNA, 16 bp, Homo sapiens
ccctgagctcaggctg

SEQ ID NO: 6735156 - DNA, 14 bp, Homo sapiens
ccctgagctgaggc

SEQ ID NO: 6735157 - DNA, 21 bp, Homo sapiens
ccctgagctgaggcagcagtg

SEQ ID NO: 6735158 - DNA, 19 bp, Homo sapiens
ccctgagctggcctcacct

SEQ ID NO: 6735159 - DNA, 20 bp, Homo sapiens
ccctgagctggcctcacctg

SEQ ID NO: 6735160 - DNA, 22 bp, Homo sapiens
ccctgagctttccggggaggag

SEQ ID NO: 6735161 - DNA, 22 bp, Homo sapiens
ccctgaggaaggaggggaagct

SEQ ID NO: 6735162 - DNA, 15 bp, Homo sapiens
ccctgaggaataaag

SEQ ID NO: 6735163 - DNA, 17 bp, Homo sapiens
ccctgaggaataaagct

SEQ ID NO: 6735164 - DNA, 18 bp, Homo sapiens
ccctgaggaataaagctt

SEQ ID NO: 6735165 - DNA, 14 bp, Homo sapiens
ccctgaggactgga

SEQ ID NO: 6735166 - DNA, 14 bp, Homo sapiens
ccctgaggagccag

SEQ ID NO: 6735167 - DNA, 14 bp, Homo sapiens
ccctgaggaggccg

SEQ ID NO: 6735168 - DNA, 18 bp, Homo sapiens
ccctgaggagggccctga

SEQ ID NO: 6735169 - DNA, 14 bp, Homo sapiens
ccctgaggagtctg

SEQ ID NO: 6735170 - DNA, 19 bp, Homo sapiens
ccctgaggagtctgaggtc

SEQ ID NO: 6735171 - DNA, 19 bp, Homo sapiens
ccctgaggatcccctgtcc

SEQ ID NO: 6735172 - DNA, 21 bp, Homo sapiens
ccctgaggatgggtcagagct

SEQ ID NO: 6735173 - DNA, 22 bp, Homo sapiens
ccctgaggatgggtcagagcta

SEQ ID NO: 6735174 - DNA, 17 bp, Homo sapiens
ccctgaggcagcccagc

SEQ ID NO: 6735175 - DNA, 18 bp, Homo sapiens
ccctgaggcaggtcccca

SEQ ID NO: 6735176 - DNA, 12 bp, Homo sapiens
ccctgaggccca

SEQ ID NO: 6735177 - DNA, 18 bp, Homo sapiens
ccctgaggcccagagggc

SEQ ID NO: 6735178 - DNA, 18 bp, Homo sapiens
ccctgaggccctgggctg

SEQ ID NO: 6735179 - DNA, 12 bp, Homo sapiens
ccctgaggccta

SEQ ID NO: 6735180 - DNA, 15 bp, Homo sapiens
ccctgaggcctgagg

SEQ ID NO: 6735181 - DNA, 17 bp, Homo sapiens
ccctgaggcggaggctg

SEQ ID NO: 6735182 - DNA, 23 bp, Homo sapiens
ccctgaggcggaggctgtgctcc

SEQ ID NO: 6735183 - DNA, 18 bp, Homo sapiens
ccctgaggctcagggaaa

SEQ ID NO: 6735184 - DNA, 16 bp, Homo sapiens
ccctgaggctggactc

SEQ ID NO: 6735185 - DNA, 15 bp, Homo sapiens
ccctgaggctgtgag

SEQ ID NO: 6735186 - DNA, 22 bp, Homo sapiens
ccctgagggacgagcagagcgc

SEQ ID NO: 6735187 - DNA, 23 bp, Homo sapiens
ccctgagggcccttcccaacctc

SEQ ID NO: 6735188 - DNA, 21 bp, Homo sapiens
ccctgagggctcctccatggt

SEQ ID NO: 6735189 - DNA, 19 bp, Homo sapiens
ccctgaggggcctgccact

SEQ ID NO: 6735190 - DNA, 15 bp, Homo sapiens
ccctgaggggctggg

SEQ ID NO: 6735191 - DNA, 23 bp, Homo sapiens
ccctgaggggctggggagggggt

SEQ ID NO: 6735192 - DNA, 19 bp, Homo sapiens
ccctgagggtttccacctt

SEQ ID NO: 6735193 - DNA, 13 bp, Homo sapiens
ccctgaggtacct

SEQ ID NO: 6735194 - DNA, 23 bp, Homo sapiens
ccctgaggtcacctggaatcaga

SEQ ID NO: 6735195 - DNA, 16 bp, Homo sapiens
ccctgaggtcactgct

SEQ ID NO: 6735196 - DNA, 15 bp, Homo sapiens
ccctgaggtcatgca

SEQ ID NO: 6735197 - DNA, 18 bp, Homo sapiens
ccctgaggtgaaagggag

SEQ ID NO: 6735198 - DNA, 22 bp, Homo sapiens
ccctgaggtgtgggggctgcag

SEQ ID NO: 6735199 - DNA, 22 bp, Homo sapiens
ccctgagtaatcgcttaaagat

SEQ ID NO: 6735200 - DNA, 16 bp, Homo sapiens
ccctgagtcaccagga

SEQ ID NO: 6735201 - DNA, 17 bp, Homo sapiens
ccctgagtcaccaggaa

SEQ ID NO: 6735202 - DNA, 15 bp, Homo sapiens
ccctgagtccgcctg

SEQ ID NO: 6735203 - DNA, 13 bp, Homo sapiens
ccctgagtctgga

SEQ ID NO: 6735204 - DNA, 16 bp, Homo sapiens
ccctgagtctggacct

SEQ ID NO: 6735205 - DNA, 21 bp, Homo sapiens
ccctgagtctggacctccatc

SEQ ID NO: 6735206 - DNA, 16 bp, Homo sapiens
ccctgagtctgggcag

SEQ ID NO: 6735207 - DNA, 13 bp, Homo sapiens
ccctgagtgaaca

SEQ ID NO: 6735208 - DNA, 22 bp, Homo sapiens
ccctgagtggatctccaaggac

SEQ ID NO: 6735209 - DNA, 18 bp, Homo sapiens
ccctgagtgggctgggcc

SEQ ID NO: 6735210 - DNA, 17 bp, Homo sapiens
ccctgagttcccaaagg

SEQ ID NO: 6735211 - DNA, 22 bp, Homo sapiens
ccctgagttcccaaagggaggg

SEQ ID NO: 6735212 - DNA, 23 bp, Homo sapiens
ccctgagttgcaccattctttct

SEQ ID NO: 6735213 - DNA, 20 bp, Homo sapiens
ccctgagttggcatcacctg

SEQ ID NO: 6735214 - DNA, 16 bp, Homo sapiens
ccctgagttgggcagc

SEQ ID NO: 6735215 - DNA, 17 bp, Homo sapiens
ccctgatagaagattgt

SEQ ID NO: 6735216 - DNA, 14 bp, Homo sapiens
ccctgatcactccc

SEQ ID NO: 6735217 - DNA, 18 bp, Homo sapiens
ccctgatcccaccccctc

SEQ ID NO: 6735218 - DNA, 17 bp, Homo sapiens
ccctgatcccagagagc

SEQ ID NO: 6735219 - DNA, 20 bp, Homo sapiens
ccctgatcccagagagcccg

SEQ ID NO: 6735220 - DNA, 18 bp, Homo sapiens
ccctgatcccattttcct

SEQ ID NO: 6735221 - DNA, 15 bp, Homo sapiens
ccctgatcccttcca

SEQ ID NO: 6735222 - DNA, 15 bp, Homo sapiens
ccctgatgcagcctg

SEQ ID NO: 6735223 - DNA, 13 bp, Homo sapiens
ccctgatgccttt

SEQ ID NO: 6735224 - DNA, 14 bp, Homo sapiens
ccctgatgcttaat

SEQ ID NO: 6735225 - DNA, 13 bp, Homo sapiens
ccctgatggcctt

SEQ ID NO: 6735226 - DNA, 18 bp, Homo sapiens
ccctgatggcctttggac

SEQ ID NO: 6735227 - DNA, 19 bp, Homo sapiens
ccctgatgtgacattccat

SEQ ID NO: 6735228 - DNA, 15 bp, Homo sapiens
ccctgattatttatc

SEQ ID NO: 6735229 - DNA, 18 bp, Homo sapiens
ccctgattcatactcctt

SEQ ID NO: 6735230 - DNA, 18 bp, Homo sapiens
ccctgattgacctgctcc

SEQ ID NO: 6735231 - DNA, 21 bp, Homo sapiens
ccctgattgacctgctccgct

SEQ ID NO: 6735232 - DNA, 19 bp, Homo sapiens
ccctgattgtgccagtgca

SEQ ID NO: 6735233 - DNA, 16 bp, Homo sapiens
ccctgatttattctgg

SEQ ID NO: 6735234 - DNA, 14 bp, Homo sapiens
ccctgcaaaaagaa

SEQ ID NO: 6735235 - DNA, 18 bp, Homo sapiens
ccctgcaaaaggactctc

SEQ ID NO: 6735236 - DNA, 19 bp, Homo sapiens
ccctgcaaaatgagaccct

SEQ ID NO: 6735237 - DNA, 23 bp, Homo sapiens
ccctgcaaaatttgatgccagga

SEQ ID NO: 6735238 - DNA, 20 bp, Homo sapiens
ccctgcaaagcccagcttga

SEQ ID NO: 6735239 - DNA, 16 bp, Homo sapiens
ccctgcaacctgattg

SEQ ID NO: 6735240 - DNA, 16 bp, Homo sapiens
ccctgcaactcagccc

SEQ ID NO: 6735241 - DNA, 18 bp, Homo sapiens
ccctgcaagaccacggag

SEQ ID NO: 6735242 - DNA, 15 bp, Homo sapiens
ccctgcaaggcccac

SEQ ID NO: 6735243 - DNA, 21 bp, Homo sapiens
ccctgcaaggcccacaggagg

SEQ ID NO: 6735244 - DNA, 14 bp, Homo sapiens
ccctgcaagtggac

SEQ ID NO: 6735245 - DNA, 15 bp, Homo sapiens
ccctgcaataaaatg

SEQ ID NO: 6735246 - DNA, 21 bp, Homo sapiens
ccctgcaatcactttttggaa

SEQ ID NO: 6735247 - DNA, 20 bp, Homo sapiens
ccctgcaatgcgtcttgtga

SEQ ID NO: 6735248 - DNA, 23 bp, Homo sapiens
ccctgcaatgtatcccttctcac

SEQ ID NO: 6735249 - DNA, 17 bp, Homo sapiens
ccctgcacacacctgca

SEQ ID NO: 6735250 - DNA, 16 bp, Homo sapiens
ccctgcacaccagaga

SEQ ID NO: 6735251 - DNA, 19 bp, Homo sapiens
ccctgcacacggcacagag

SEQ ID NO: 6735252 - DNA, 22 bp, Homo sapiens
ccctgcacaggcacacagggcc

SEQ ID NO: 6735253 - DNA, 13 bp, Homo sapiens
ccctgcacagttg

SEQ ID NO: 6735254 - DNA, 13 bp, Homo sapiens
ccctgcacccacc

SEQ ID NO: 6735255 - DNA, 17 bp, Homo sapiens
ccctgcacccacccctg

SEQ ID NO: 6735256 - DNA, 14 bp, Homo sapiens
ccctgcaccctcct

SEQ ID NO: 6735257 - DNA, 12 bp, Homo sapiens
ccctgcaccctg

SEQ ID NO: 6735258 - DNA, 16 bp, Homo sapiens
ccctgcaccctggaaa

SEQ ID NO: 6735259 - DNA, 17 bp, Homo sapiens
ccctgcacctcattcca

SEQ ID NO: 6735260 - DNA, 18 bp, Homo sapiens
ccctgcacctcattccaa

SEQ ID NO: 6735261 - DNA, 16 bp, Homo sapiens
ccctgcacctgcttct

SEQ ID NO: 6735262 - DNA, 14 bp, Homo sapiens
ccctgcacgtcatg

SEQ ID NO: 6735263 - DNA, 22 bp, Homo sapiens
ccctgcactaaagccagcctga

SEQ ID NO: 6735264 - DNA, 22 bp, Homo sapiens
ccctgcactcccgaccttagct

SEQ ID NO: 6735265 - DNA, 13 bp, Homo sapiens
ccctgcactggag

SEQ ID NO: 6735266 - DNA, 22 bp, Homo sapiens
ccctgcactggagtccagtctc

SEQ ID NO: 6735267 - DNA, 13 bp, Homo sapiens
ccctgcactgtcc

SEQ ID NO: 6735268 - DNA, 21 bp, Homo sapiens
ccctgcactgtcctgctccac

SEQ ID NO: 6735269 - DNA, 22 bp, Homo sapiens
ccctgcactgtcctgctccaca

SEQ ID NO: 6735270 - DNA, 14 bp, Homo sapiens
ccctgcactgtgcc

SEQ ID NO: 6735271 - DNA, 19 bp, Homo sapiens
ccctgcacttgcagactct

SEQ ID NO: 6735272 - DNA, 22 bp, Homo sapiens
ccctgcacttgcagactctaca

SEQ ID NO: 6735273 - DNA, 22 bp, Homo sapiens
ccctgcactttcctccacctcc

SEQ ID NO: 6735274 - DNA, 14 bp, Homo sapiens
ccctgcagaaccca

SEQ ID NO: 6735275 - DNA, 23 bp, Homo sapiens
ccctgcagaaccggagagccagc

SEQ ID NO: 6735276 - DNA, 20 bp, Homo sapiens
ccctgcagaagccagaaggt

SEQ ID NO: 6735277 - DNA, 14 bp, Homo sapiens
ccctgcagaccctg

SEQ ID NO: 6735278 - DNA, 15 bp, Homo sapiens
ccctgcagaccctgc

SEQ ID NO: 6735279 - DNA, 17 bp, Homo sapiens
ccctgcagaccctgccc

SEQ ID NO: 6735280 - DNA, 12 bp, Homo sapiens
ccctgcagacct

SEQ ID NO: 6735281 - DNA, 13 bp, Homo sapiens
ccctgcagacctc

SEQ ID NO: 6735282 - DNA, 18 bp, Homo sapiens
ccctgcagacctcaagcc

SEQ ID NO: 6735283 - DNA, 22 bp, Homo sapiens
ccctgcagacgtctggccctgg

SEQ ID NO: 6735284 - DNA, 23 bp, Homo sapiens
ccctgcagactccaatggggcca

SEQ ID NO: 6735285 - DNA, 12 bp, Homo sapiens
ccctgcagagca

SEQ ID NO: 6735286 - DNA, 14 bp, Homo sapiens
ccctgcagagcaat

SEQ ID NO: 6735287 - DNA, 17 bp, Homo sapiens
ccctgcagagcaataac

SEQ ID NO: 6735288 - DNA, 19 bp, Homo sapiens
ccctgcagagcaataacac

SEQ ID NO: 6735289 - DNA, 20 bp, Homo sapiens
ccctgcagagcaataacact

SEQ ID NO: 6735290 - DNA, 17 bp, Homo sapiens
ccctgcagagcacacag

SEQ ID NO: 6735291 - DNA, 14 bp, Homo sapiens
ccctgcagcacgga

SEQ ID NO: 6735292 - DNA, 19 bp, Homo sapiens
ccctgcagcacggacaata

SEQ ID NO: 6735293 - DNA, 19 bp, Homo sapiens
ccctgcagccaaacagagc

SEQ ID NO: 6735294 - DNA, 15 bp, Homo sapiens
ccctgcagccatccc

SEQ ID NO: 6735295 - DNA, 14 bp, Homo sapiens
ccctgcagcccaaa

SEQ ID NO: 6735296 - DNA, 15 bp, Homo sapiens
ccctgcagcccaggc

SEQ ID NO: 6735297 - DNA, 16 bp, Homo sapiens
ccctgcagcccaggcc

SEQ ID NO: 6735298 - DNA, 14 bp, Homo sapiens
ccctgcagccctgg

SEQ ID NO: 6735299 - DNA, 15 bp, Homo sapiens
ccctgcagccctggc

SEQ ID NO: 6735300 - DNA, 13 bp, Homo sapiens
ccctgcagcctgg

SEQ ID NO: 6735301 - DNA, 14 bp, Homo sapiens
ccctgcagcctggg

SEQ ID NO: 6735302 - DNA, 17 bp, Homo sapiens
ccctgcagcctgggtct

SEQ ID NO: 6735303 - DNA, 13 bp, Homo sapiens
ccctgcagctgac

SEQ ID NO: 6735304 - DNA, 14 bp, Homo sapiens
ccctgcagctggaa

SEQ ID NO: 6735305 - DNA, 21 bp, Homo sapiens
ccctgcagcttggagaactcc

SEQ ID NO: 6735306 - DNA, 20 bp, Homo sapiens
ccctgcagcttgtagccagc

SEQ ID NO: 6735307 - DNA, 19 bp, Homo sapiens
ccctgcaggaaggagctgc

SEQ ID NO: 6735308 - DNA, 18 bp, Homo sapiens
ccctgcaggacttgccac

SEQ ID NO: 6735309 - DNA, 16 bp, Homo sapiens
ccctgcaggcacagag

SEQ ID NO: 6735310 - DNA, 17 bp, Homo sapiens
ccctgcaggcacagagg

SEQ ID NO: 6735311 - DNA, 20 bp, Homo sapiens
ccctgcaggcacagaggagg

SEQ ID NO: 6735312 - DNA, 16 bp, Homo sapiens
ccctgcaggccaggcc

SEQ ID NO: 6735313 - DNA, 13 bp, Homo sapiens
ccctgcaggcggt

SEQ ID NO: 6735314 - DNA, 22 bp, Homo sapiens
ccctgcagggccatctgactgc

SEQ ID NO: 6735315 - DNA, 20 bp, Homo sapiens
ccctgcagggccgggcaggg

SEQ ID NO: 6735316 - DNA, 17 bp, Homo sapiens
ccctgcagttcccctgg

SEQ ID NO: 6735317 - DNA, 20 bp, Homo sapiens
ccctgcagttggcagaaagg

SEQ ID NO: 6735318 - DNA, 16 bp, Homo sapiens
ccctgcatatgcttct

SEQ ID NO: 6735319 - DNA, 13 bp, Homo sapiens
ccctgcatcccct

SEQ ID NO: 6735320 - DNA, 13 bp, Homo sapiens
ccctgcatccctt

SEQ ID NO: 6735321 - DNA, 17 bp, Homo sapiens
ccctgcatcccttggcc

SEQ ID NO: 6735322 - DNA, 22 bp, Homo sapiens
ccctgcatcccttggcccctct

SEQ ID NO: 6735323 - DNA, 12 bp, Homo sapiens
ccctgcatcctg

SEQ ID NO: 6735324 - DNA, 15 bp, Homo sapiens
ccctgcatcctgagg

SEQ ID NO: 6735325 - DNA, 21 bp, Homo sapiens
ccctgcatcctgaggccagtg

SEQ ID NO: 6735326 - DNA, 18 bp, Homo sapiens
ccctgcatctgaccagca

SEQ ID NO: 6735327 - DNA, 20 bp, Homo sapiens
ccctgcatctgtctgctctg

SEQ ID NO: 6735328 - DNA, 14 bp, Homo sapiens
ccctgcatgctgcc

SEQ ID NO: 6735329 - DNA, 22 bp, Homo sapiens
ccctgcattcttccgcaccctc

SEQ ID NO: 6735330 - DNA, 21 bp, Homo sapiens
ccctgcattctttctgtattg

SEQ ID NO: 6735331 - DNA, 15 bp, Homo sapiens
ccctgcattggcctg

SEQ ID NO: 6735332 - DNA, 17 bp, Homo sapiens
ccctgcattggcctggc

SEQ ID NO: 6735333 - DNA, 18 bp, Homo sapiens
ccctgcattggcctggcc

SEQ ID NO: 6735334 - DNA, 17 bp, Homo sapiens
ccctgccaactttccag

SEQ ID NO: 6735335 - DNA, 18 bp, Homo sapiens
ccctgccaagactcctca

SEQ ID NO: 6735336 - DNA, 18 bp, Homo sapiens
ccctgccaaggccggaga

SEQ ID NO: 6735337 - DNA, 18 bp, Homo sapiens
ccctgccaatgctccagc

SEQ ID NO: 6735338 - DNA, 13 bp, Homo sapiens
ccctgccacacta

SEQ ID NO: 6735339 - DNA, 18 bp, Homo sapiens
ccctgccacagccagagg

SEQ ID NO: 6735340 - DNA, 13 bp, Homo sapiens
ccctgccaccctc

SEQ ID NO: 6735341 - DNA, 17 bp, Homo sapiens
ccctgccaccctctgct

SEQ ID NO: 6735342 - DNA, 19 bp, Homo sapiens
ccctgccaccctctgctgc

SEQ ID NO: 6735343 - DNA, 20 bp, Homo sapiens
ccctgccaccctctgctgca

SEQ ID NO: 6735344 - DNA, 14 bp, Homo sapiens
ccctgccaccctgg

SEQ ID NO: 6735345 - DNA, 16 bp, Homo sapiens
ccctgccaccgtcaca

SEQ ID NO: 6735346 - DNA, 14 bp, Homo sapiens
ccctgccacctcct

SEQ ID NO: 6735347 - DNA, 16 bp, Homo sapiens
ccctgccacctgtctg

SEQ ID NO: 6735348 - DNA, 21 bp, Homo sapiens
ccctgccacgtcccgctgcct

SEQ ID NO: 6735349 - DNA, 21 bp, Homo sapiens
ccctgccactcacccttcctg

SEQ ID NO: 6735350 - DNA, 19 bp, Homo sapiens
ccctgccactcactaggcc

SEQ ID NO: 6735351 - DNA, 15 bp, Homo sapiens
ccctgccactcctca

SEQ ID NO: 6735352 - DNA, 13 bp, Homo sapiens
ccctgccactggg

SEQ ID NO: 6735353 - DNA, 16 bp, Homo sapiens
ccctgccactgggctc

SEQ ID NO: 6735354 - DNA, 18 bp, Homo sapiens
ccctgccactgggctctg

SEQ ID NO: 6735355 - DNA, 20 bp, Homo sapiens
ccctgccactgggctctgga

SEQ ID NO: 6735356 - DNA, 13 bp, Homo sapiens
ccctgccagaccc

SEQ ID NO: 6735357 - DNA, 11 bp, Homo sapiens
ccctgccagca

SEQ ID NO: 6735358 - DNA, 14 bp, Homo sapiens
ccctgccagcaccc

SEQ ID NO: 6735359 - DNA, 23 bp, Homo sapiens
ccctgccagccgaccctcctggc

SEQ ID NO: 6735360 - DNA, 12 bp, Homo sapiens
ccctgccagctc

SEQ ID NO: 6735361 - DNA, 22 bp, Homo sapiens
ccctgccagctgcagcctggtt

SEQ ID NO: 6735362 - DNA, 14 bp, Homo sapiens
ccctgccaggaggc

SEQ ID NO: 6735363 - DNA, 23 bp, Homo sapiens
ccctgccaggcacaggcagggca

SEQ ID NO: 6735364 - DNA, 12 bp, Homo sapiens
ccctgccagggc

SEQ ID NO: 6735365 - DNA, 13 bp, Homo sapiens
ccctgccagggct

SEQ ID NO: 6735366 - DNA, 23 bp, Homo sapiens
ccctgccagggctcgggcgctgt

SEQ ID NO: 6735367 - DNA, 14 bp, Homo sapiens
ccctgccagtgaag

SEQ ID NO: 6735368 - DNA, 19 bp, Homo sapiens
ccctgccatccccctctca

SEQ ID NO: 6735369 - DNA, 16 bp, Homo sapiens
ccctgccatcttccca

SEQ ID NO: 6735370 - DNA, 19 bp, Homo sapiens
ccctgccatcttcccagca

SEQ ID NO: 6735371 - DNA, 19 bp, Homo sapiens
ccctgccatggaggcgcct

SEQ ID NO: 6735372 - DNA, 17 bp, Homo sapiens
ccctgccattggcctct

SEQ ID NO: 6735373 - DNA, 20 bp, Homo sapiens
ccctgcccaaacccttaact

SEQ ID NO: 6735374 - DNA, 22 bp, Homo sapiens
ccctgcccaaacccttaactga

SEQ ID NO: 6735375 - DNA, 16 bp, Homo sapiens
ccctgcccaagtgacc

SEQ ID NO: 6735376 - DNA, 19 bp, Homo sapiens
ccctgcccaatcctccctg

SEQ ID NO: 6735377 - DNA, 12 bp, Homo sapiens
ccctgcccaccc

SEQ ID NO: 6735378 - DNA, 14 bp, Homo sapiens
ccctgcccacccca

SEQ ID NO: 6735379 - DNA, 14 bp, Homo sapiens
ccctgcccaccccc

SEQ ID NO: 6735380 - DNA, 15 bp, Homo sapiens
ccctgcccacccccg

SEQ ID NO: 6735381 - DNA, 14 bp, Homo sapiens
ccctgcccacctgg

SEQ ID NO: 6735382 - DNA, 17 bp, Homo sapiens
ccctgcccactcccatc

SEQ ID NO: 6735383 - DNA, 17 bp, Homo sapiens
ccctgcccagagctgag

SEQ ID NO: 6735384 - DNA, 15 bp, Homo sapiens
ccctgcccagagtat

SEQ ID NO: 6735385 - DNA, 24 bp, Homo sapiens
ccctgcccagagtatgggcactca

SEQ ID NO: 6735386 - DNA, 14 bp, Homo sapiens
ccctgcccagcacc

SEQ ID NO: 6735387 - DNA, 15 bp, Homo sapiens
ccctgcccagcacct

SEQ ID NO: 6735388 - DNA, 15 bp, Homo sapiens
ccctgcccagccagc

SEQ ID NO: 6735389 - DNA, 15 bp, Homo sapiens
ccctgcccagcccat

SEQ ID NO: 6735390 - DNA, 13 bp, Homo sapiens
ccctgcccagcct

SEQ ID NO: 6735391 - DNA, 14 bp, Homo sapiens
ccctgcccagcctg

SEQ ID NO: 6735392 - DNA, 16 bp, Homo sapiens
ccctgcccagcctgtg

SEQ ID NO: 6735393 - DNA, 12 bp, Homo sapiens
ccctgcccaggc

SEQ ID NO: 6735394 - DNA, 22 bp, Homo sapiens
ccctgcccaggcagtctttgct

SEQ ID NO: 6735395 - DNA, 22 bp, Homo sapiens
ccctgcccaggtatcctggggg

SEQ ID NO: 6735396 - DNA, 20 bp, Homo sapiens
ccctgcccatccgtctgtct

SEQ ID NO: 6735397 - DNA, 18 bp, Homo sapiens
ccctgccccaacccccac

SEQ ID NO: 6735398 - DNA, 13 bp, Homo sapiens
ccctgccccagag

SEQ ID NO: 6735399 - DNA, 14 bp, Homo sapiens
ccctgccccagaga

SEQ ID NO: 6735400 - DNA, 21 bp, Homo sapiens
ccctgccccagagaagcctca

SEQ ID NO: 6735401 - DNA, 13 bp, Homo sapiens
ccctgccccagcc

SEQ ID NO: 6735402 - DNA, 19 bp, Homo sapiens
ccctgccccagcccaagtc

SEQ ID NO: 6735403 - DNA, 17 bp, Homo sapiens
ccctgccccagccccta

SEQ ID NO: 6735404 - DNA, 14 bp, Homo sapiens
ccctgccccaggcc

SEQ ID NO: 6735405 - DNA, 16 bp, Homo sapiens
ccctgccccaggcctg

SEQ ID NO: 6735406 - DNA, 18 bp, Homo sapiens
ccctgccccaggcctgga

SEQ ID NO: 6735407 - DNA, 19 bp, Homo sapiens
ccctgccccaggcctggac

SEQ ID NO: 6735408 - DNA, 19 bp, Homo sapiens
ccctgccccatcctgggcc

SEQ ID NO: 6735409 - DNA, 20 bp, Homo sapiens
ccctgccccatcctgggcct

SEQ ID NO: 6735410 - DNA, 14 bp, Homo sapiens
ccctgcccccaaag

SEQ ID NO: 6735411 - DNA, 20 bp, Homo sapiens
ccctgcccccaaataagaag

SEQ ID NO: 6735412 - DNA, 22 bp, Homo sapiens
ccctgcccccaatttcccagac

SEQ ID NO: 6735413 - DNA, 18 bp, Homo sapiens
ccctgcccccacttcctg

SEQ ID NO: 6735414 - DNA, 20 bp, Homo sapiens
ccctgcccccacttcctgtt

SEQ ID NO: 6735415 - DNA, 13 bp, Homo sapiens
ccctgcccccagg

SEQ ID NO: 6735416 - DNA, 15 bp, Homo sapiens
ccctgcccccaggtg

SEQ ID NO: 6735417 - DNA, 19 bp, Homo sapiens
ccctgcccccatctcccca

SEQ ID NO: 6735418 - DNA, 21 bp, Homo sapiens
ccctgccccccagcctctggc

SEQ ID NO: 6735419 - DNA, 14 bp, Homo sapiens
ccctgccccctgca

SEQ ID NO: 6735420 - DNA, 15 bp, Homo sapiens
ccctgccccctgcag

SEQ ID NO: 6735421 - DNA, 17 bp, Homo sapiens
ccctgccccctgcagga

SEQ ID NO: 6735422 - DNA, 16 bp, Homo sapiens
ccctgccccctgccag

SEQ ID NO: 6735423 - DNA, 16 bp, Homo sapiens
ccctgccccctggctg

SEQ ID NO: 6735424 - DNA, 16 bp, Homo sapiens
ccctgccccgcccccc

SEQ ID NO: 6735425 - DNA, 17 bp, Homo sapiens
ccctgccccgcccccca

SEQ ID NO: 6735426 - DNA, 18 bp, Homo sapiens
ccctgccccggaggaagc

SEQ ID NO: 6735427 - DNA, 15 bp, Homo sapiens
ccctgccccgtcacc

SEQ ID NO: 6735428 - DNA, 23 bp, Homo sapiens
ccctgcccctaggatgctgcagc

SEQ ID NO: 6735429 - DNA, 16 bp, Homo sapiens
ccctgcccctcatgcc

SEQ ID NO: 6735430 - DNA, 12 bp, Homo sapiens
ccctgcccctcc

SEQ ID NO: 6735431 - DNA, 21 bp, Homo sapiens
ccctgcccctccccctaccgc

SEQ ID NO: 6735432 - DNA, 17 bp, Homo sapiens
ccctgcccctcccttca

SEQ ID NO: 6735433 - DNA, 14 bp, Homo sapiens
ccctgcccctcctg

SEQ ID NO: 6735434 - DNA, 16 bp, Homo sapiens
ccctgcccctcctgta

SEQ ID NO: 6735435 - DNA, 15 bp, Homo sapiens
ccctgcccctcttcc

SEQ ID NO: 6735436 - DNA, 18 bp, Homo sapiens
ccctgcccctgccccgtc

SEQ ID NO: 6735437 - DNA, 17 bp, Homo sapiens
ccctgcccctgcccgag

SEQ ID NO: 6735438 - DNA, 18 bp, Homo sapiens
ccctgcccctgcccgaga

SEQ ID NO: 6735439 - DNA, 12 bp, Homo sapiens
ccctgcccctgt

SEQ ID NO: 6735440 - DNA, 23 bp, Homo sapiens
ccctgcccctgtgcctctgtcct

SEQ ID NO: 6735441 - DNA, 18 bp, Homo sapiens
ccctgccccttctacact

SEQ ID NO: 6735442 - DNA, 17 bp, Homo sapiens
ccctgcccgctcccaac

SEQ ID NO: 6735443 - DNA, 15 bp, Homo sapiens
ccctgcccggggagc

SEQ ID NO: 6735444 - DNA, 19 bp, Homo sapiens
ccctgcccggggagctgca

SEQ ID NO: 6735445 - DNA, 20 bp, Homo sapiens
ccctgcccggggagctgcag

SEQ ID NO: 6735446 - DNA, 23 bp, Homo sapiens
ccctgcccggggagctgcagagc

SEQ ID NO: 6735447 - DNA, 17 bp, Homo sapiens
ccctgcccgtgtacata

SEQ ID NO: 6735448 - DNA, 16 bp, Homo sapiens
ccctgccctcacctcc

SEQ ID NO: 6735449 - DNA, 11 bp, Homo sapiens
ccctgccctcg

SEQ ID NO: 6735450 - DNA, 15 bp, Homo sapiens
ccctgccctcggcca

SEQ ID NO: 6735451 - DNA, 15 bp, Homo sapiens
ccctgccctcgggtc

SEQ ID NO: 6735452 - DNA, 13 bp, Homo sapiens
ccctgccctcgtg

SEQ ID NO: 6735453 - DNA, 14 bp, Homo sapiens
ccctgccctcgtgg

SEQ ID NO: 6735454 - DNA, 12 bp, Homo sapiens
ccctgccctgag

SEQ ID NO: 6735455 - DNA, 17 bp, Homo sapiens
ccctgccctgaggaagg

SEQ ID NO: 6735456 - DNA, 15 bp, Homo sapiens
ccctgccctgaggag

SEQ ID NO: 6735457 - DNA, 12 bp, Homo sapiens
ccctgccctgct

SEQ ID NO: 6735458 - DNA, 17 bp, Homo sapiens
ccctgccctgctgagca

SEQ ID NO: 6735459 - DNA, 11 bp, Homo sapiens
ccctgccctgg

SEQ ID NO: 6735460 - DNA, 16 bp, Homo sapiens
ccctgccctggccact

SEQ ID NO: 6735461 - DNA, 17 bp, Homo sapiens
ccctgccctggccactg

SEQ ID NO: 6735462 - DNA, 19 bp, Homo sapiens
ccctgccctggccactggc

SEQ ID NO: 6735463 - DNA, 21 bp, Homo sapiens
ccctgccctggccactggccc

SEQ ID NO: 6735464 - DNA, 18 bp, Homo sapiens
ccctgccctggcctacca

SEQ ID NO: 6735465 - DNA, 20 bp, Homo sapiens
ccctgccctggcctaccaca

SEQ ID NO: 6735466 - DNA, 13 bp, Homo sapiens
ccctgccctggga

SEQ ID NO: 6735467 - DNA, 22 bp, Homo sapiens
ccctgccctgggcgagcccctc

SEQ ID NO: 6735468 - DNA, 14 bp, Homo sapiens
ccctgccctggtcc

SEQ ID NO: 6735469 - DNA, 15 bp, Homo sapiens
ccctgccctggtcca

SEQ ID NO: 6735470 - DNA, 18 bp, Homo sapiens
ccctgccctggtccaggg

SEQ ID NO: 6735471 - DNA, 15 bp, Homo sapiens
ccctgccctgtcctc

SEQ ID NO: 6735472 - DNA, 12 bp, Homo sapiens
ccctgccctgtg

SEQ ID NO: 6735473 - DNA, 13 bp, Homo sapiens
ccctgccctgtgc

SEQ ID NO: 6735474 - DNA, 13 bp, Homo sapiens
ccctgccctgtgg

SEQ ID NO: 6735475 - DNA, 14 bp, Homo sapiens
ccctgccctgtggg

SEQ ID NO: 6735476 - DNA, 15 bp, Homo sapiens
ccctgccctgtgggc

SEQ ID NO: 6735477 - DNA, 20 bp, Homo sapiens
ccctgccctgtgggccccca

SEQ ID NO: 6735478 - DNA, 18 bp, Homo sapiens
ccctgcccttccctggtg

SEQ ID NO: 6735479 - DNA, 15 bp, Homo sapiens
ccctgcccttcctca

SEQ ID NO: 6735480 - DNA, 22 bp, Homo sapiens
ccctgcccttggcaccaccagg

SEQ ID NO: 6735481 - DNA, 22 bp, Homo sapiens
ccctgccgaacacacatcccag

SEQ ID NO: 6735482 - DNA, 22 bp, Homo sapiens
ccctgccggaatgaactgtccg

SEQ ID NO: 6735483 - DNA, 13 bp, Homo sapiens
ccctgccggccgg

SEQ ID NO: 6735484 - DNA, 14 bp, Homo sapiens
ccctgccggccttg

SEQ ID NO: 6735485 - DNA, 16 bp, Homo sapiens
ccctgcctatcctctg

SEQ ID NO: 6735486 - DNA, 10 bp, Homo sapiens
ccctgcctca

SEQ ID NO: 6735487 - DNA, 18 bp, Homo sapiens
ccctgcctcacatctccc

SEQ ID NO: 6735488 - DNA, 16 bp, Homo sapiens
ccctgcctcagccagg

SEQ ID NO: 6735489 - DNA, 17 bp, Homo sapiens
ccctgcctcagccaggc

SEQ ID NO: 6735490 - DNA, 24 bp, Homo sapiens
ccctgcctcaggccaagggaccag

SEQ ID NO: 6735491 - DNA, 13 bp, Homo sapiens
ccctgcctccacc

SEQ ID NO: 6735492 - DNA, 14 bp, Homo sapiens
ccctgcctccaccc

SEQ ID NO: 6735493 - DNA, 19 bp, Homo sapiens
ccctgcctccaccctctga

SEQ ID NO: 6735494 - DNA, 20 bp, Homo sapiens
ccctgcctccaccctctgag

SEQ ID NO: 6735495 - DNA, 18 bp, Homo sapiens
ccctgcctccatcctagt

SEQ ID NO: 6735496 - DNA, 21 bp, Homo sapiens
ccctgcctccgaggcctacct

SEQ ID NO: 6735497 - DNA, 12 bp, Homo sapiens
ccctgcctcctg

SEQ ID NO: 6735498 - DNA, 16 bp, Homo sapiens
ccctgcctcctgccac

SEQ ID NO: 6735499 - DNA, 16 bp, Homo sapiens
ccctgcctcctgcctc

SEQ ID NO: 6735500 - DNA, 15 bp, Homo sapiens
ccctgcctcctggga

SEQ ID NO: 6735501 - DNA, 16 bp, Homo sapiens
ccctgcctcgagggcc

SEQ ID NO: 6735502 - DNA, 19 bp, Homo sapiens
ccctgcctctacccaacca

SEQ ID NO: 6735503 - DNA, 21 bp, Homo sapiens
ccctgcctctatccctggcca

SEQ ID NO: 6735504 - DNA, 15 bp, Homo sapiens
ccctgcctctcagag

SEQ ID NO: 6735505 - DNA, 22 bp, Homo sapiens
ccctgcctctcatcaactgaat

SEQ ID NO: 6735506 - DNA, 20 bp, Homo sapiens
ccctgcctctcccaggcagg

SEQ ID NO: 6735507 - DNA, 16 bp, Homo sapiens
ccctgcctctccgccc

SEQ ID NO: 6735508 - DNA, 22 bp, Homo sapiens
ccctgcctctctgcaggtccct

SEQ ID NO: 6735509 - DNA, 13 bp, Homo sapiens
ccctgcctctgtg

SEQ ID NO: 6735510 - DNA, 13 bp, Homo sapiens
ccctgcctctgtt

SEQ ID NO: 6735511 - DNA, 16 bp, Homo sapiens
ccctgcctgaaacctg

SEQ ID NO: 6735512 - DNA, 23 bp, Homo sapiens
ccctgcctgagaagccccgacac

SEQ ID NO: 6735513 - DNA, 13 bp, Homo sapiens
ccctgcctgagac

SEQ ID NO: 6735514 - DNA, 18 bp, Homo sapiens
ccctgcctgaggaggagg

SEQ ID NO: 6735515 - DNA, 20 bp, Homo sapiens
ccctgcctgagggcccctct

SEQ ID NO: 6735516 - DNA, 14 bp, Homo sapiens
ccctgcctgcagcc

SEQ ID NO: 6735517 - DNA, 19 bp, Homo sapiens
ccctgcctgcagccagggc

SEQ ID NO: 6735518 - DNA, 20 bp, Homo sapiens
ccctgcctgcagccagggct

SEQ ID NO: 6735519 - DNA, 11 bp, Homo sapiens
ccctgcctgcc

SEQ ID NO: 6735520 - DNA, 14 bp, Homo sapiens
ccctgcctgccatg

SEQ ID NO: 6735521 - DNA, 20 bp, Homo sapiens
ccctgcctgccatgtacctc

SEQ ID NO: 6735522 - DNA, 13 bp, Homo sapiens
ccctgcctgccct

SEQ ID NO: 6735523 - DNA, 23 bp, Homo sapiens
ccctgcctgccctgtcaggaggc

SEQ ID NO: 6735524 - DNA, 19 bp, Homo sapiens
ccctgcctgccgctgcacc

SEQ ID NO: 6735525 - DNA, 20 bp, Homo sapiens
ccctgcctgccgctgcacct

SEQ ID NO: 6735526 - DNA, 18 bp, Homo sapiens
ccctgcctgcctcttggc

SEQ ID NO: 6735527 - DNA, 15 bp, Homo sapiens
ccctgcctgccttct

SEQ ID NO: 6735528 - DNA, 11 bp, Homo sapiens
ccctgcctgct

SEQ ID NO: 6735529 - DNA, 10 bp, Homo sapiens
ccctgcctgg

SEQ ID NO: 6735530 - DNA, 15 bp, Homo sapiens
ccctgcctggaggac

SEQ ID NO: 6735531 - DNA, 19 bp, Homo sapiens
ccctgcctggatttcttcc

SEQ ID NO: 6735532 - DNA, 11 bp, Homo sapiens
ccctgcctggg

SEQ ID NO: 6735533 - DNA, 14 bp, Homo sapiens
ccctgcctgggcct

SEQ ID NO: 6735534 - DNA, 17 bp, Homo sapiens
ccctgcctgggccttgg

SEQ ID NO: 6735535 - DNA, 17 bp, Homo sapiens
ccctgcctggtatgagt

SEQ ID NO: 6735536 - DNA, 13 bp, Homo sapiens
ccctgcctggtca

SEQ ID NO: 6735537 - DNA, 19 bp, Homo sapiens
ccctgcctggttctaggct

SEQ ID NO: 6735538 - DNA, 20 bp, Homo sapiens
ccctgcctgtcacctgggag

SEQ ID NO: 6735539 - DNA, 23 bp, Homo sapiens
ccctgcctgtggaggtgacctgt

SEQ ID NO: 6735540 - DNA, 19 bp, Homo sapiens
ccctgccttaacctgggac

SEQ ID NO: 6735541 - DNA, 11 bp, Homo sapiens
ccctgccttcc

SEQ ID NO: 6735542 - DNA, 11 bp, Homo sapiens
ccctgccttgc

SEQ ID NO: 6735543 - DNA, 21 bp, Homo sapiens
ccctgccttgccgctcccctt

SEQ ID NO: 6735544 - DNA, 22 bp, Homo sapiens
ccctgccttgctgacaataaag

SEQ ID NO: 6735545 - DNA, 22 bp, Homo sapiens
ccctgccttgggccttgctgct

SEQ ID NO: 6735546 - DNA, 23 bp, Homo sapiens
ccctgccttgggccttgctgctg

SEQ ID NO: 6735547 - DNA, 23 bp, Homo sapiens
ccctgcctttgaaattcccccac

SEQ ID NO: 6735548 - DNA, 18 bp, Homo sapiens
ccctgcctttgggagcag

SEQ ID NO: 6735549 - DNA, 17 bp, Homo sapiens
ccctgcgaaggggccct

SEQ ID NO: 6735550 - DNA, 21 bp, Homo sapiens
ccctgcgaagtggctctcagg

SEQ ID NO: 6735551 - DNA, 14 bp, Homo sapiens
ccctgcgccccgca

SEQ ID NO: 6735552 - DNA, 15 bp, Homo sapiens
ccctgcgccccgcac

SEQ ID NO: 6735553 - DNA, 13 bp, Homo sapiens
ccctgcgcctcca

SEQ ID NO: 6735554 - DNA, 15 bp, Homo sapiens
ccctgcgcctccaga

SEQ ID NO: 6735555 - DNA, 16 bp, Homo sapiens
ccctgcgcctccagag

SEQ ID NO: 6735556 - DNA, 18 bp, Homo sapiens
ccctgcgcctttcctttt

SEQ ID NO: 6735557 - DNA, 13 bp, Homo sapiens
ccctgcgcgcagc

SEQ ID NO: 6735558 - DNA, 22 bp, Homo sapiens
ccctgcggaagccacagggtga

SEQ ID NO: 6735559 - DNA, 13 bp, Homo sapiens
ccctgcggagacc

SEQ ID NO: 6735560 - DNA, 23 bp, Homo sapiens
ccctgcggccgtcaccccgccag

SEQ ID NO: 6735561 - DNA, 13 bp, Homo sapiens
ccctgcggcctcc

SEQ ID NO: 6735562 - DNA, 14 bp, Homo sapiens
ccctgcggcctcca

SEQ ID NO: 6735563 - DNA, 13 bp, Homo sapiens
ccctgcggctctg

SEQ ID NO: 6735564 - DNA, 16 bp, Homo sapiens
ccctgcggctctggaa

SEQ ID NO: 6735565 - DNA, 17 bp, Homo sapiens
ccctgcggctctggaaa

SEQ ID NO: 6735566 - DNA, 18 bp, Homo sapiens
ccctgcgggcgcgggcag

SEQ ID NO: 6735567 - DNA, 17 bp, Homo sapiens
ccctgcggtagatggga

SEQ ID NO: 6735568 - DNA, 23 bp, Homo sapiens
ccctgcggtcaggctgggcagcc

SEQ ID NO: 6735569 - DNA, 18 bp, Homo sapiens
ccctgcgtaaccctcgcc

SEQ ID NO: 6735570 - DNA, 21 bp, Homo sapiens
ccctgcgtaaccctcgccctg

SEQ ID NO: 6735571 - DNA, 22 bp, Homo sapiens
ccctgcgtaaccctcgccctgt

SEQ ID NO: 6735572 - DNA, 23 bp, Homo sapiens
ccctgcgtaaccctcgccctgtc

SEQ ID NO: 6735573 - DNA, 24 bp, Homo sapiens
ccctgcgtaaccctcgccctgtcc

SEQ ID NO: 6735574 - DNA, 22 bp, Homo sapiens
ccctgcgtcctgacgccctgcg

SEQ ID NO: 6735575 - DNA, 18 bp, Homo sapiens
ccctgcgtcgagctggga

SEQ ID NO: 6735576 - DNA, 21 bp, Homo sapiens
ccctgcgtcgagctgggaagg

SEQ ID NO: 6735577 - DNA, 16 bp, Homo sapiens
ccctgcgtctcctgcc

SEQ ID NO: 6735578 - DNA, 15 bp, Homo sapiens
ccctgcgtggcctga

SEQ ID NO: 6735579 - DNA, 22 bp, Homo sapiens
ccctgcgttggagccactcctg

SEQ ID NO: 6735580 - DNA, 20 bp, Homo sapiens
ccctgctaagtgttgacttt

SEQ ID NO: 6735581 - DNA, 21 bp, Homo sapiens
ccctgctaccaaggcccagct

SEQ ID NO: 6735582 - DNA, 16 bp, Homo sapiens
ccctgctacctgttct

SEQ ID NO: 6735583 - DNA, 18 bp, Homo sapiens
ccctgctactccactgac

SEQ ID NO: 6735584 - DNA, 21 bp, Homo sapiens
ccctgctagacgcaccgcctg

SEQ ID NO: 6735585 - DNA, 17 bp, Homo sapiens
ccctgctagcacagagg

SEQ ID NO: 6735586 - DNA, 21 bp, Homo sapiens
ccctgctagcacagaggcctg

SEQ ID NO: 6735587 - DNA, 21 bp, Homo sapiens
ccctgctatttcaggccctca

SEQ ID NO: 6735588 - DNA, 13 bp, Homo sapiens
ccctgctcactgc

SEQ ID NO: 6735589 - DNA, 15 bp, Homo sapiens
ccctgctcagcccat

SEQ ID NO: 6735590 - DNA, 17 bp, Homo sapiens
ccctgctcagctggccg

SEQ ID NO: 6735591 - DNA, 9 bp, Homo sapiens
ccctgctcc

SEQ ID NO: 6735592 - DNA, 16 bp, Homo sapiens
ccctgctccaccagca

SEQ ID NO: 6735593 - DNA, 20 bp, Homo sapiens
ccctgctccaccagcagcat

SEQ ID NO: 6735594 - DNA, 10 bp, Homo sapiens
ccctgctccc

SEQ ID NO: 6735595 - DNA, 15 bp, Homo sapiens
ccctgctcccagcct

SEQ ID NO: 6735596 - DNA, 17 bp, Homo sapiens
ccctgctcccagcctgc

SEQ ID NO: 6735597 - DNA, 14 bp, Homo sapiens
ccctgctcccaggg

SEQ ID NO: 6735598 - DNA, 16 bp, Homo sapiens
ccctgctcccagggac

SEQ ID NO: 6735599 - DNA, 14 bp, Homo sapiens
ccctgctcccattc

SEQ ID NO: 6735600 - DNA, 21 bp, Homo sapiens
ccctgctcccattcctccctc

SEQ ID NO: 6735601 - DNA, 16 bp, Homo sapiens
ccctgctcccctttgg

SEQ ID NO: 6735602 - DNA, 11 bp, Homo sapiens
ccctgctccct

SEQ ID NO: 6735603 - DNA, 17 bp, Homo sapiens
ccctgctccctcccatc

SEQ ID NO: 6735604 - DNA, 19 bp, Homo sapiens
ccctgctccctccctccac

SEQ ID NO: 6735605 - DNA, 19 bp, Homo sapiens
ccctgctccctctccccct

SEQ ID NO: 6735606 - DNA, 15 bp, Homo sapiens
ccctgctccctgcct

SEQ ID NO: 6735607 - DNA, 12 bp, Homo sapiens
ccctgctcctca

SEQ ID NO: 6735608 - DNA, 13 bp, Homo sapiens
ccctgctcctcat

SEQ ID NO: 6735609 - DNA, 16 bp, Homo sapiens
ccctgctcctcatggg

SEQ ID NO: 6735610 - DNA, 12 bp, Homo sapiens
ccctgctcctcc

SEQ ID NO: 6735611 - DNA, 13 bp, Homo sapiens
ccctgctcctccc

SEQ ID NO: 6735612 - DNA, 12 bp, Homo sapiens
ccctgctcctgc

SEQ ID NO: 6735613 - DNA, 17 bp, Homo sapiens
ccctgctcggccggtgt

SEQ ID NO: 6735614 - DNA, 23 bp, Homo sapiens
ccctgctctacccatgagcctgc

SEQ ID NO: 6735615 - DNA, 14 bp, Homo sapiens
ccctgctctctgag

SEQ ID NO: 6735616 - DNA, 15 bp, Homo sapiens
ccctgctctgcccag

SEQ ID NO: 6735617 - DNA, 21 bp, Homo sapiens
ccctgctctgcccaggcaagg

SEQ ID NO: 6735618 - DNA, 15 bp, Homo sapiens
ccctgctctggtccc

SEQ ID NO: 6735619 - DNA, 15 bp, Homo sapiens
ccctgctctgtagcc

SEQ ID NO: 6735620 - DNA, 21 bp, Homo sapiens
ccctgctcttctctccccagc

SEQ ID NO: 6735621 - DNA, 23 bp, Homo sapiens
ccctgctcttctctccccagccc

SEQ ID NO: 6735622 - DNA, 17 bp, Homo sapiens
ccctgctctttctctga

SEQ ID NO: 6735623 - DNA, 17 bp, Homo sapiens
ccctgctgaatgcctcg

SEQ ID NO: 6735624 - DNA, 14 bp, Homo sapiens
ccctgctgaccttg

SEQ ID NO: 6735625 - DNA, 14 bp, Homo sapiens
ccctgctgagcaca

SEQ ID NO: 6735626 - DNA, 18 bp, Homo sapiens
ccctgctgagtcatctgt

SEQ ID NO: 6735627 - DNA, 23 bp, Homo sapiens
ccctgctgagtcccaggctgagc

SEQ ID NO: 6735628 - DNA, 10 bp, Homo sapiens
ccctgctgca

SEQ ID NO: 6735629 - DNA, 16 bp, Homo sapiens
ccctgctgcaggggct

SEQ ID NO: 6735630 - DNA, 21 bp, Homo sapiens
ccctgctgcaggggctctgga

SEQ ID NO: 6735631 - DNA, 13 bp, Homo sapiens
ccctgctgccaca

SEQ ID NO: 6735632 - DNA, 14 bp, Homo sapiens
ccctgctgccacag

SEQ ID NO: 6735633 - DNA, 14 bp, Homo sapiens
ccctgctgccaggc

SEQ ID NO: 6735634 - DNA, 23 bp, Homo sapiens
ccctgctgccaggctcccactgc

SEQ ID NO: 6735635 - DNA, 12 bp, Homo sapiens
ccctgctgccca

SEQ ID NO: 6735636 - DNA, 21 bp, Homo sapiens
ccctgctgcccaatctccatc

SEQ ID NO: 6735637 - DNA, 13 bp, Homo sapiens
ccctgctgcccag

SEQ ID NO: 6735638 - DNA, 12 bp, Homo sapiens
ccctgctgcccc

SEQ ID NO: 6735639 - DNA, 15 bp, Homo sapiens
ccctgctgcccctcc

SEQ ID NO: 6735640 - DNA, 18 bp, Homo sapiens
ccctgctgcccctccctg

SEQ ID NO: 6735641 - DNA, 19 bp, Homo sapiens
ccctgctgcccctccctgc

SEQ ID NO: 6735642 - DNA, 23 bp, Homo sapiens
ccctgctgccgcctcccagcctg

SEQ ID NO: 6735643 - DNA, 12 bp, Homo sapiens
ccctgctgcctc

SEQ ID NO: 6735644 - DNA, 16 bp, Homo sapiens
ccctgctgcctcccca

SEQ ID NO: 6735645 - DNA, 13 bp, Homo sapiens
ccctgctgccttc

SEQ ID NO: 6735646 - DNA, 15 bp, Homo sapiens
ccctgctgcgctgct

SEQ ID NO: 6735647 - DNA, 16 bp, Homo sapiens
ccctgctgcgctgctt

SEQ ID NO: 6735648 - DNA, 14 bp, Homo sapiens
ccctgctgctccta

SEQ ID NO: 6735649 - DNA, 20 bp, Homo sapiens
ccctgctgctgccagggctt

SEQ ID NO: 6735650 - DNA, 16 bp, Homo sapiens
ccctgctgctgcctgc

SEQ ID NO: 6735651 - DNA, 16 bp, Homo sapiens
ccctgctgctggtgca

SEQ ID NO: 6735652 - DNA, 19 bp, Homo sapiens
ccctgctgctgtcacctct

SEQ ID NO: 6735653 - DNA, 12 bp, Homo sapiens
ccctgctggacc

SEQ ID NO: 6735654 - DNA, 16 bp, Homo sapiens
ccctgctggccggaca

SEQ ID NO: 6735655 - DNA, 13 bp, Homo sapiens
ccctgctggggaa

SEQ ID NO: 6735656 - DNA, 19 bp, Homo sapiens
ccctgctggggaagaacag

SEQ ID NO: 6735657 - DNA, 22 bp, Homo sapiens
ccctgctggggaagaacagccc

SEQ ID NO: 6735658 - DNA, 19 bp, Homo sapiens
ccctgctggggtctcaggt

SEQ ID NO: 6735659 - DNA, 23 bp, Homo sapiens
ccctgctgggtgggaatgcgctc

SEQ ID NO: 6735660 - DNA, 20 bp, Homo sapiens
ccctgctggttcagggttgg

SEQ ID NO: 6735661 - DNA, 19 bp, Homo sapiens
ccctgctgtatcttccaga

SEQ ID NO: 6735662 - DNA, 10 bp, Homo sapiens
ccctgctgtc

SEQ ID NO: 6735663 - DNA, 13 bp, Homo sapiens
ccctgctgtcccc

SEQ ID NO: 6735664 - DNA, 18 bp, Homo sapiens
ccctgctgtcccctcttg

SEQ ID NO: 6735665 - DNA, 19 bp, Homo sapiens
ccctgctgtcccctcttgc

SEQ ID NO: 6735666 - DNA, 23 bp, Homo sapiens
ccctgctgtcccctcttgcccca

SEQ ID NO: 6735667 - DNA, 13 bp, Homo sapiens
ccctgctgtctct

SEQ ID NO: 6735668 - DNA, 15 bp, Homo sapiens
ccctgctgtctctct

SEQ ID NO: 6735669 - DNA, 19 bp, Homo sapiens
ccctgctgtctctctgggc

SEQ ID NO: 6735670 - DNA, 23 bp, Homo sapiens
ccctgctgtcttccccaccgcag

SEQ ID NO: 6735671 - DNA, 16 bp, Homo sapiens
ccctgctgtgctgctc

SEQ ID NO: 6735672 - DNA, 13 bp, Homo sapiens
ccctgctgtggga

SEQ ID NO: 6735673 - DNA, 14 bp, Homo sapiens
ccctgctgtgggag

SEQ ID NO: 6735674 - DNA, 13 bp, Homo sapiens
ccctgctgtttat

SEQ ID NO: 6735675 - DNA, 21 bp, Homo sapiens
ccctgcttagaacccttctgc

SEQ ID NO: 6735676 - DNA, 18 bp, Homo sapiens
ccctgcttaggatggggg

SEQ ID NO: 6735677 - DNA, 23 bp, Homo sapiens
ccctgcttagtgtcccttacctg

SEQ ID NO: 6735678 - DNA, 14 bp, Homo sapiens
ccctgcttccacct

SEQ ID NO: 6735679 - DNA, 17 bp, Homo sapiens
ccctgcttccacctcac

SEQ ID NO: 6735680 - DNA, 18 bp, Homo sapiens
ccctgcttccacctcacc

SEQ ID NO: 6735681 - DNA, 14 bp, Homo sapiens
ccctgcttccagga

SEQ ID NO: 6735682 - DNA, 15 bp, Homo sapiens
ccctgcttccaggaa

SEQ ID NO: 6735683 - DNA, 16 bp, Homo sapiens
ccctgcttccaggaaa

SEQ ID NO: 6735684 - DNA, 22 bp, Homo sapiens
ccctgcttcccaaactcccagg

SEQ ID NO: 6735685 - DNA, 12 bp, Homo sapiens
ccctgcttctcc

SEQ ID NO: 6735686 - DNA, 17 bp, Homo sapiens
ccctgcttctccagcct

SEQ ID NO: 6735687 - DNA, 13 bp, Homo sapiens
ccctgcttctccc

SEQ ID NO: 6735688 - DNA, 23 bp, Homo sapiens
ccctgcttctcccgccattggcc

SEQ ID NO: 6735689 - DNA, 21 bp, Homo sapiens
ccctgcttctcccggggacgc

SEQ ID NO: 6735690 - DNA, 20 bp, Homo sapiens
ccctgcttctgctgccctga

SEQ ID NO: 6735691 - DNA, 13 bp, Homo sapiens
ccctgcttctggc

SEQ ID NO: 6735692 - DNA, 19 bp, Homo sapiens
ccctgcttgcacacttccc

SEQ ID NO: 6735693 - DNA, 20 bp, Homo sapiens
ccctgcttgcaggaggccaa

SEQ ID NO: 6735694 - DNA, 21 bp, Homo sapiens
ccctgcttgcccgctcccaca

SEQ ID NO: 6735695 - DNA, 18 bp, Homo sapiens
ccctgcttggcccagggg

SEQ ID NO: 6735696 - DNA, 13 bp, Homo sapiens
ccctgcttgggac

SEQ ID NO: 6735697 - DNA, 13 bp, Homo sapiens
ccctgcttggtca

SEQ ID NO: 6735698 - DNA, 17 bp, Homo sapiens
ccctgctttcagatact

SEQ ID NO: 6735699 - DNA, 12 bp, Homo sapiens
ccctgctttctg

SEQ ID NO: 6735700 - DNA, 14 bp, Homo sapiens
ccctgctttgcaaa

SEQ ID NO: 6735701 - DNA, 16 bp, Homo sapiens
ccctgctttgccccac

SEQ ID NO: 6735702 - DNA, 17 bp, Homo sapiens
ccctgctttgccccact

SEQ ID NO: 6735703 - DNA, 19 bp, Homo sapiens
ccctgctttgccccactgg

SEQ ID NO: 6735704 - DNA, 22 bp, Homo sapiens
ccctgctttgccccactgggag

SEQ ID NO: 6735705 - DNA, 23 bp, Homo sapiens
ccctgctttgccccactgggaga

SEQ ID NO: 6735706 - DNA, 18 bp, Homo sapiens
ccctgctttggctgaggg

SEQ ID NO: 6735707 - DNA, 19 bp, Homo sapiens
ccctgctttggctgagggg

SEQ ID NO: 6735708 - DNA, 22 bp, Homo sapiens
ccctgctttggctgaggggctt

SEQ ID NO: 6735709 - DNA, 17 bp, Homo sapiens
ccctgctttgggctgcc

SEQ ID NO: 6735710 - DNA, 17 bp, Homo sapiens
ccctgctttgggcttgg

SEQ ID NO: 6735711 - DNA, 22 bp, Homo sapiens
ccctgctttgggcttgggccta

SEQ ID NO: 6735712 - DNA, 24 bp, Homo sapiens
ccctgcttttctcccagaaggctg

SEQ ID NO: 6735713 - DNA, 18 bp, Homo sapiens
ccctgctttttttcttaa

SEQ ID NO: 6735714 - DNA, 21 bp, Homo sapiens
ccctggaaaacagacgggtct

SEQ ID NO: 6735715 - DNA, 22 bp, Homo sapiens
ccctggaaacccacctctctgg

SEQ ID NO: 6735716 - DNA, 19 bp, Homo sapiens
ccctggaaaggggagttga

SEQ ID NO: 6735717 - DNA, 21 bp, Homo sapiens
ccctggaaagggggtgacctc

SEQ ID NO: 6735718 - DNA, 23 bp, Homo sapiens
ccctggaactctatctgggcctg

SEQ ID NO: 6735719 - DNA, 18 bp, Homo sapiens
ccctggaagagcccagtc

SEQ ID NO: 6735720 - DNA, 17 bp, Homo sapiens
ccctggaagcagtgccc

SEQ ID NO: 6735721 - DNA, 21 bp, Homo sapiens
ccctggaagcagtgcccaggt

SEQ ID NO: 6735722 - DNA, 18 bp, Homo sapiens
ccctggaagttgtccttt

SEQ ID NO: 6735723 - DNA, 19 bp, Homo sapiens
ccctggaattcagcaccct

SEQ ID NO: 6735724 - DNA, 11 bp, Homo sapiens
ccctggacaca

SEQ ID NO: 6735725 - DNA, 16 bp, Homo sapiens
ccctggacacagccca

SEQ ID NO: 6735726 - DNA, 18 bp, Homo sapiens
ccctggacacagcccacc

SEQ ID NO: 6735727 - DNA, 23 bp, Homo sapiens
ccctggacacagcccaccctctg

SEQ ID NO: 6735728 - DNA, 14 bp, Homo sapiens
ccctggacacagct

SEQ ID NO: 6735729 - DNA, 18 bp, Homo sapiens
ccctggacacccctgctc

SEQ ID NO: 6735730 - DNA, 20 bp, Homo sapiens
ccctggacagaggcggggct

SEQ ID NO: 6735731 - DNA, 21 bp, Homo sapiens
ccctggacagatggcccaagg

SEQ ID NO: 6735732 - DNA, 17 bp, Homo sapiens
ccctggacatgcctgtc

SEQ ID NO: 6735733 - DNA, 21 bp, Homo sapiens
ccctggacatgcctgtcctga

SEQ ID NO: 6735734 - DNA, 18 bp, Homo sapiens
ccctggaccacacctccg

SEQ ID NO: 6735735 - DNA, 19 bp, Homo sapiens
ccctggaccaccagcccca

SEQ ID NO: 6735736 - DNA, 20 bp, Homo sapiens
ccctggaccaccagccccag

SEQ ID NO: 6735737 - DNA, 18 bp, Homo sapiens
ccctggacccagccagaa

SEQ ID NO: 6735738 - DNA, 15 bp, Homo sapiens
ccctggaccccagcc

SEQ ID NO: 6735739 - DNA, 19 bp, Homo sapiens
ccctggaccccagcctcaa

SEQ ID NO: 6735740 - DNA, 20 bp, Homo sapiens
ccctggaccgagtggaccac

SEQ ID NO: 6735741 - DNA, 13 bp, Homo sapiens
ccctggacctggg

SEQ ID NO: 6735742 - DNA, 20 bp, Homo sapiens
ccctggacgcatgcagggcc

SEQ ID NO: 6735743 - DNA, 23 bp, Homo sapiens
ccctggactggtggcccctgcct

SEQ ID NO: 6735744 - DNA, 15 bp, Homo sapiens
ccctggactgtttca

SEQ ID NO: 6735745 - DNA, 22 bp, Homo sapiens
ccctggagaaaaaaattgctct

SEQ ID NO: 6735746 - DNA, 20 bp, Homo sapiens
ccctggagagtgcacatgcc

SEQ ID NO: 6735747 - DNA, 13 bp, Homo sapiens
ccctggagagttc

SEQ ID NO: 6735748 - DNA, 22 bp, Homo sapiens
ccctggagagttcaatggctgc

SEQ ID NO: 6735749 - DNA, 23 bp, Homo sapiens
ccctggagagttcaatggctgct

SEQ ID NO: 6735750 - DNA, 16 bp, Homo sapiens
ccctggagccaactgc

SEQ ID NO: 6735751 - DNA, 19 bp, Homo sapiens
ccctggagccaactgctgc

SEQ ID NO: 6735752 - DNA, 21 bp, Homo sapiens
ccctggagccaactgctgctt

SEQ ID NO: 6735753 - DNA, 13 bp, Homo sapiens
ccctggagccaga

SEQ ID NO: 6735754 - DNA, 21 bp, Homo sapiens
ccctggagccagactctggtc

SEQ ID NO: 6735755 - DNA, 21 bp, Homo sapiens
ccctggagccagcagggctgt

SEQ ID NO: 6735756 - DNA, 14 bp, Homo sapiens
ccctggagccaggg

SEQ ID NO: 6735757 - DNA, 16 bp, Homo sapiens
ccctggagccagggca

SEQ ID NO: 6735758 - DNA, 21 bp, Homo sapiens
ccctggagccagggcagagga

SEQ ID NO: 6735759 - DNA, 22 bp, Homo sapiens
ccctggagccagggcagaggaa

SEQ ID NO: 6735760 - DNA, 14 bp, Homo sapiens
ccctggagcccggc

SEQ ID NO: 6735761 - DNA, 14 bp, Homo sapiens
ccctggagccctgt

SEQ ID NO: 6735762 - DNA, 13 bp, Homo sapiens
ccctggagcctca

SEQ ID NO: 6735763 - DNA, 16 bp, Homo sapiens
ccctggagcctcagca

SEQ ID NO: 6735764 - DNA, 18 bp, Homo sapiens
ccctggagcctcagcagc

SEQ ID NO: 6735765 - DNA, 18 bp, Homo sapiens
ccctggagcctccactgc

SEQ ID NO: 6735766 - DNA, 21 bp, Homo sapiens
ccctggagcggctctcctgag

SEQ ID NO: 6735767 - DNA, 14 bp, Homo sapiens
ccctggagctcaag

SEQ ID NO: 6735768 - DNA, 16 bp, Homo sapiens
ccctggagctcctgct

SEQ ID NO: 6735769 - DNA, 12 bp, Homo sapiens
ccctggagctgt

SEQ ID NO: 6735770 - DNA, 14 bp, Homo sapiens
ccctggagctgtcc

SEQ ID NO: 6735771 - DNA, 18 bp, Homo sapiens
ccctggagctgtccttca

SEQ ID NO: 6735772 - DNA, 19 bp, Homo sapiens
ccctggagctgtccttcat

SEQ ID NO: 6735773 - DNA, 20 bp, Homo sapiens
ccctggagctgtccttcatt

SEQ ID NO: 6735774 - DNA, 23 bp, Homo sapiens
ccctggaggacagagggagacag

SEQ ID NO: 6735775 - DNA, 16 bp, Homo sapiens
ccctggaggcacgcac

SEQ ID NO: 6735776 - DNA, 21 bp, Homo sapiens
ccctggaggcacgcaccactg

SEQ ID NO: 6735777 - DNA, 18 bp, Homo sapiens
ccctggaggccgctgctg

SEQ ID NO: 6735778 - DNA, 12 bp, Homo sapiens
ccctggaggcgg

SEQ ID NO: 6735779 - DNA, 13 bp, Homo sapiens
ccctggaggctct

SEQ ID NO: 6735780 - DNA, 15 bp, Homo sapiens
ccctggaggctgcct

SEQ ID NO: 6735781 - DNA, 19 bp, Homo sapiens
ccctggaggctgcctccca

SEQ ID NO: 6735782 - DNA, 14 bp, Homo sapiens
ccctggaggctgga

SEQ ID NO: 6735783 - DNA, 16 bp, Homo sapiens
ccctggaggctggatg

SEQ ID NO: 6735784 - DNA, 10 bp, Homo sapiens
ccctggaggg

SEQ ID NO: 6735785 - DNA, 12 bp, Homo sapiens
ccctggagggca

SEQ ID NO: 6735786 - DNA, 15 bp, Homo sapiens
ccctggagggcaagc

SEQ ID NO: 6735787 - DNA, 20 bp, Homo sapiens
ccctggagggcaagccctgc

SEQ ID NO: 6735788 - DNA, 12 bp, Homo sapiens
ccctggaggggc

SEQ ID NO: 6735789 - DNA, 15 bp, Homo sapiens
ccctggaggggccca

SEQ ID NO: 6735790 - DNA, 17 bp, Homo sapiens
ccctggaggtctccagg

SEQ ID NO: 6735791 - DNA, 19 bp, Homo sapiens
ccctggaggtctccagggg

SEQ ID NO: 6735792 - DNA, 21 bp, Homo sapiens
ccctggaggtctccaggggcc

SEQ ID NO: 6735793 - DNA, 18 bp, Homo sapiens
ccctggaggtgccagcaa

SEQ ID NO: 6735794 - DNA, 22 bp, Homo sapiens
ccctggaggtgccagcaaagcc

SEQ ID NO: 6735795 - DNA, 18 bp, Homo sapiens
ccctggagtatttggaag

SEQ ID NO: 6735796 - DNA, 14 bp, Homo sapiens
ccctggagtcaggg

SEQ ID NO: 6735797 - DNA, 22 bp, Homo sapiens
ccctggagtcccctgggcctgg

SEQ ID NO: 6735798 - DNA, 19 bp, Homo sapiens
ccctggagtgtgtcagagc

SEQ ID NO: 6735799 - DNA, 24 bp, Homo sapiens
ccctggatcacgacgctgcagagc

SEQ ID NO: 6735800 - DNA, 19 bp, Homo sapiens
ccctggatcagcgtggcct

SEQ ID NO: 6735801 - DNA, 19 bp, Homo sapiens
ccctggatctacctggagg

SEQ ID NO: 6735802 - DNA, 21 bp, Homo sapiens
ccctggatctacctggaggga

SEQ ID NO: 6735803 - DNA, 17 bp, Homo sapiens
ccctggatgcagcctca

SEQ ID NO: 6735804 - DNA, 15 bp, Homo sapiens
ccctggatgcccagg

SEQ ID NO: 6735805 - DNA, 16 bp, Homo sapiens
ccctggatgcccagga

SEQ ID NO: 6735806 - DNA, 13 bp, Homo sapiens
ccctggatggcct

SEQ ID NO: 6735807 - DNA, 18 bp, Homo sapiens
ccctggatggcctctggg

SEQ ID NO: 6735808 - DNA, 19 bp, Homo sapiens
ccctggatggcctctgggg

SEQ ID NO: 6735809 - DNA, 20 bp, Homo sapiens
ccctggatggcctctggggc

SEQ ID NO: 6735810 - DNA, 22 bp, Homo sapiens
ccctggatggcctctggggcag

SEQ ID NO: 6735811 - DNA, 13 bp, Homo sapiens
ccctggatgtccc

SEQ ID NO: 6735812 - DNA, 21 bp, Homo sapiens
ccctggatgtcccctgtccca

SEQ ID NO: 6735813 - DNA, 19 bp, Homo sapiens
ccctggatgtgaagctcac

SEQ ID NO: 6735814 - DNA, 18 bp, Homo sapiens
ccctggatgtgcccacag

SEQ ID NO: 6735815 - DNA, 13 bp, Homo sapiens
ccctggatgtgtg

SEQ ID NO: 6735816 - DNA, 19 bp, Homo sapiens
ccctggatgtgtggggcat

SEQ ID NO: 6735817 - DNA, 16 bp, Homo sapiens
ccctggatttttacca

SEQ ID NO: 6735818 - DNA, 11 bp, Homo sapiens
ccctggcaaat

SEQ ID NO: 6735819 - DNA, 23 bp, Homo sapiens
ccctggcaaatgcacacacctca

SEQ ID NO: 6735820 - DNA, 22 bp, Homo sapiens
ccctggcaatcccaccaaatca

SEQ ID NO: 6735821 - DNA, 21 bp, Homo sapiens
ccctggcacccccacaagctg

SEQ ID NO: 6735822 - DNA, 19 bp, Homo sapiens
ccctggcacctgtgttcca

SEQ ID NO: 6735823 - DNA, 17 bp, Homo sapiens
ccctggcacgtcctcca

SEQ ID NO: 6735824 - DNA, 13 bp, Homo sapiens
ccctggcactgca

SEQ ID NO: 6735825 - DNA, 22 bp, Homo sapiens
ccctggcagagatgcctccctg

SEQ ID NO: 6735826 - DNA, 18 bp, Homo sapiens
ccctggcagcacagccca

SEQ ID NO: 6735827 - DNA, 16 bp, Homo sapiens
ccctggcagcagcagg

SEQ ID NO: 6735828 - DNA, 12 bp, Homo sapiens
ccctggcagccc

SEQ ID NO: 6735829 - DNA, 13 bp, Homo sapiens
ccctggcagtgct

SEQ ID NO: 6735830 - DNA, 16 bp, Homo sapiens
ccctggcagtgctgag

SEQ ID NO: 6735831 - DNA, 16 bp, Homo sapiens
ccctggcatgtcagag

SEQ ID NO: 6735832 - DNA, 23 bp, Homo sapiens
ccctggcattatgtccactgtgt

SEQ ID NO: 6735833 - DNA, 19 bp, Homo sapiens
ccctggccacagaccccca

SEQ ID NO: 6735834 - DNA, 13 bp, Homo sapiens
ccctggccacagc

SEQ ID NO: 6735835 - DNA, 23 bp, Homo sapiens
ccctggccacagccttccctctg

SEQ ID NO: 6735836 - DNA, 12 bp, Homo sapiens
ccctggccacca

SEQ ID NO: 6735837 - DNA, 13 bp, Homo sapiens
ccctggccaccac

SEQ ID NO: 6735838 - DNA, 20 bp, Homo sapiens
ccctggccaccacccaacct

SEQ ID NO: 6735839 - DNA, 20 bp, Homo sapiens
ccctggccaccaccccccac

SEQ ID NO: 6735840 - DNA, 23 bp, Homo sapiens
ccctggccaccaccccccactct

SEQ ID NO: 6735841 - DNA, 13 bp, Homo sapiens
ccctggccactga

SEQ ID NO: 6735842 - DNA, 23 bp, Homo sapiens
ccctggccactgaaaagctttcc

SEQ ID NO: 6735843 - DNA, 17 bp, Homo sapiens
ccctggccactggccct

SEQ ID NO: 6735844 - DNA, 18 bp, Homo sapiens
ccctggccactggccctg

SEQ ID NO: 6735845 - DNA, 13 bp, Homo sapiens
ccctggccagagg

SEQ ID NO: 6735846 - DNA, 15 bp, Homo sapiens
ccctggccagaggct

SEQ ID NO: 6735847 - DNA, 15 bp, Homo sapiens
ccctggccagccctt

SEQ ID NO: 6735848 - DNA, 17 bp, Homo sapiens
ccctggccagcccttcc

SEQ ID NO: 6735849 - DNA, 15 bp, Homo sapiens
ccctggccagctctg

SEQ ID NO: 6735850 - DNA, 12 bp, Homo sapiens
ccctggcccagc

SEQ ID NO: 6735851 - DNA, 18 bp, Homo sapiens
ccctggcccagccagcca

SEQ ID NO: 6735852 - DNA, 16 bp, Homo sapiens
ccctggcccagcctgt

SEQ ID NO: 6735853 - DNA, 15 bp, Homo sapiens
ccctggcccaggagg

SEQ ID NO: 6735854 - DNA, 13 bp, Homo sapiens
ccctggcccaggt

SEQ ID NO: 6735855 - DNA, 14 bp, Homo sapiens
ccctggccccagga

SEQ ID NO: 6735856 - DNA, 20 bp, Homo sapiens
ccctggccccagtgaccggg

SEQ ID NO: 6735857 - DNA, 17 bp, Homo sapiens
ccctggcccccacatgg

SEQ ID NO: 6735858 - DNA, 14 bp, Homo sapiens
ccctggccccgccg

SEQ ID NO: 6735859 - DNA, 18 bp, Homo sapiens
ccctggcccctctccctt

SEQ ID NO: 6735860 - DNA, 23 bp, Homo sapiens
ccctggcccgcaagagggacaga

SEQ ID NO: 6735861 - DNA, 20 bp, Homo sapiens
ccctggcccgcccctcgctg

SEQ ID NO: 6735862 - DNA, 10 bp, Homo sapiens
ccctggccct

SEQ ID NO: 6735863 - DNA, 16 bp, Homo sapiens
ccctggccctgaggtg

SEQ ID NO: 6735864 - DNA, 13 bp, Homo sapiens
ccctggccctgcc

SEQ ID NO: 6735865 - DNA, 15 bp, Homo sapiens
ccctggccctgccca

SEQ ID NO: 6735866 - DNA, 20 bp, Homo sapiens
ccctggccctgcccagccca

SEQ ID NO: 6735867 - DNA, 15 bp, Homo sapiens
ccctggccctgcctc

SEQ ID NO: 6735868 - DNA, 17 bp, Homo sapiens
ccctggccctgcctcac

SEQ ID NO: 6735869 - DNA, 15 bp, Homo sapiens
ccctggcccttcctt

SEQ ID NO: 6735870 - DNA, 17 bp, Homo sapiens
ccctggcccttccttca

SEQ ID NO: 6735871 - DNA, 21 bp, Homo sapiens
ccctggcccttccttcaccca

SEQ ID NO: 6735872 - DNA, 17 bp, Homo sapiens
ccctggccctttcccct

SEQ ID NO: 6735873 - DNA, 22 bp, Homo sapiens
ccctggcctaccacagctgcct

SEQ ID NO: 6735874 - DNA, 10 bp, Homo sapiens
ccctggcctc

SEQ ID NO: 6735875 - DNA, 11 bp, Homo sapiens
ccctggcctca

SEQ ID NO: 6735876 - DNA, 21 bp, Homo sapiens
ccctggcctcagttcccagct

SEQ ID NO: 6735877 - DNA, 15 bp, Homo sapiens
ccctggcctccccca

SEQ ID NO: 6735878 - DNA, 21 bp, Homo sapiens
ccctggcctctgtgccttctt

SEQ ID NO: 6735879 - DNA, 14 bp, Homo sapiens
ccctggcctgaact

SEQ ID NO: 6735880 - DNA, 20 bp, Homo sapiens
ccctggcctgaactgaggag

SEQ ID NO: 6735881 - DNA, 21 bp, Homo sapiens
ccctggcctgaactgaggaga

SEQ ID NO: 6735882 - DNA, 14 bp, Homo sapiens
ccctggcctgctgg

SEQ ID NO: 6735883 - DNA, 21 bp, Homo sapiens
ccctggcctgctgggctctcc

SEQ ID NO: 6735884 - DNA, 15 bp, Homo sapiens
ccctggcctggctgg

SEQ ID NO: 6735885 - DNA, 13 bp, Homo sapiens
ccctggcctggtc

SEQ ID NO: 6735886 - DNA, 22 bp, Homo sapiens
ccctggccttaaaaggggccca

SEQ ID NO: 6735887 - DNA, 17 bp, Homo sapiens
ccctggctaccttgtgg

SEQ ID NO: 6735888 - DNA, 19 bp, Homo sapiens
ccctggctacttcccttcc

SEQ ID NO: 6735889 - DNA, 21 bp, Homo sapiens
ccctggctacttcccttcctc

SEQ ID NO: 6735890 - DNA, 12 bp, Homo sapiens
ccctggctccat

SEQ ID NO: 6735891 - DNA, 16 bp, Homo sapiens
ccctggctccatgctt

SEQ ID NO: 6735892 - DNA, 17 bp, Homo sapiens
ccctggctcccacaggc

SEQ ID NO: 6735893 - DNA, 13 bp, Homo sapiens
ccctggctcccat

SEQ ID NO: 6735894 - DNA, 15 bp, Homo sapiens
ccctggctcccatga

SEQ ID NO: 6735895 - DNA, 23 bp, Homo sapiens
ccctggctcccatgaccatactg

SEQ ID NO: 6735896 - DNA, 13 bp, Homo sapiens
ccctggctccctc

SEQ ID NO: 6735897 - DNA, 15 bp, Homo sapiens
ccctggctccctcct

SEQ ID NO: 6735898 - DNA, 18 bp, Homo sapiens
ccctggctccctcctcca

SEQ ID NO: 6735899 - DNA, 14 bp, Homo sapiens
ccctggctcctccg

SEQ ID NO: 6735900 - DNA, 18 bp, Homo sapiens
ccctggctcctccgtctg

SEQ ID NO: 6735901 - DNA, 21 bp, Homo sapiens
ccctggctcctccgtctgacc

SEQ ID NO: 6735902 - DNA, 14 bp, Homo sapiens
ccctggctccttca

SEQ ID NO: 6735903 - DNA, 14 bp, Homo sapiens
ccctggctccttgc

SEQ ID NO: 6735904 - DNA, 19 bp, Homo sapiens
ccctggctccttgcagcag

SEQ ID NO: 6735905 - DNA, 19 bp, Homo sapiens
ccctggctctcagaaggta

SEQ ID NO: 6735906 - DNA, 15 bp, Homo sapiens
ccctggctctgcccc

SEQ ID NO: 6735907 - DNA, 18 bp, Homo sapiens
ccctggctctgcccctca

SEQ ID NO: 6735908 - DNA, 19 bp, Homo sapiens
ccctggctgaacagtgctc

SEQ ID NO: 6735909 - DNA, 23 bp, Homo sapiens
ccctggctgaacagtgctctgcc

SEQ ID NO: 6735910 - DNA, 15 bp, Homo sapiens
ccctggctgaaggac

SEQ ID NO: 6735911 - DNA, 19 bp, Homo sapiens
ccctggctgaccccaaaga

SEQ ID NO: 6735912 - DNA, 23 bp, Homo sapiens
ccctggctgaccccaaagagcct

SEQ ID NO: 6735913 - DNA, 21 bp, Homo sapiens
ccctggctgactggccagttg

SEQ ID NO: 6735914 - DNA, 17 bp, Homo sapiens
ccctggctgagggcagc

SEQ ID NO: 6735915 - DNA, 18 bp, Homo sapiens
ccctggctgccctggccc

SEQ ID NO: 6735916 - DNA, 19 bp, Homo sapiens
ccctggctgccctggccct

SEQ ID NO: 6735917 - DNA, 20 bp, Homo sapiens
ccctggctgccctggccctg

SEQ ID NO: 6735918 - DNA, 14 bp, Homo sapiens
ccctggctgccggc

SEQ ID NO: 6735919 - DNA, 13 bp, Homo sapiens
ccctggctgctgc

SEQ ID NO: 6735920 - DNA, 14 bp, Homo sapiens
ccctggctgctgcc

SEQ ID NO: 6735921 - DNA, 15 bp, Homo sapiens
ccctggctgctgccc

SEQ ID NO: 6735922 - DNA, 18 bp, Homo sapiens
ccctggctgctgccccca

SEQ ID NO: 6735923 - DNA, 20 bp, Homo sapiens
ccctggctggtaagggccaa

SEQ ID NO: 6735924 - DNA, 21 bp, Homo sapiens
ccctggctgtactgctcaggc

SEQ ID NO: 6735925 - DNA, 12 bp, Homo sapiens
ccctggctgtgg

SEQ ID NO: 6735926 - DNA, 18 bp, Homo sapiens
ccctggcttccccttcag

SEQ ID NO: 6735927 - DNA, 13 bp, Homo sapiens
ccctggcttctgt

SEQ ID NO: 6735928 - DNA, 14 bp, Homo sapiens
ccctggcttctgtg

SEQ ID NO: 6735929 - DNA, 10 bp, Homo sapiens
ccctggcttg

SEQ ID NO: 6735930 - DNA, 13 bp, Homo sapiens
ccctggctttgcc

SEQ ID NO: 6735931 - DNA, 18 bp, Homo sapiens
ccctggctttgcctcttc

SEQ ID NO: 6735932 - DNA, 19 bp, Homo sapiens
ccctggctttgcctcttct

SEQ ID NO: 6735933 - DNA, 20 bp, Homo sapiens
ccctggctttgcctcttctt

SEQ ID NO: 6735934 - DNA, 13 bp, Homo sapiens
ccctggcttttca

SEQ ID NO: 6735935 - DNA, 18 bp, Homo sapiens
ccctggcttttcactgct

SEQ ID NO: 6735936 - DNA, 21 bp, Homo sapiens
ccctgggaaccgccctcctga

SEQ ID NO: 6735937 - DNA, 18 bp, Homo sapiens
ccctgggaaggcctcttg

SEQ ID NO: 6735938 - DNA, 18 bp, Homo sapiens
ccctgggacacagaccca

SEQ ID NO: 6735939 - DNA, 11 bp, Homo sapiens
ccctgggacct

SEQ ID NO: 6735940 - DNA, 22 bp, Homo sapiens
ccctgggactaaagccaggaac

SEQ ID NO: 6735941 - DNA, 14 bp, Homo sapiens
ccctgggagagtga

SEQ ID NO: 6735942 - DNA, 21 bp, Homo sapiens
ccctgggagagtgctcaacct

SEQ ID NO: 6735943 - DNA, 22 bp, Homo sapiens
ccctgggagagtgctcaaccta

SEQ ID NO: 6735944 - DNA, 18 bp, Homo sapiens
ccctgggagcaagttgca

SEQ ID NO: 6735945 - DNA, 19 bp, Homo sapiens
ccctgggagccagtcctcc

SEQ ID NO: 6735946 - DNA, 16 bp, Homo sapiens
ccctgggaggcccctt

SEQ ID NO: 6735947 - DNA, 15 bp, Homo sapiens
ccctgggaggctctg

SEQ ID NO: 6735948 - DNA, 18 bp, Homo sapiens
ccctgggagggacatgct

SEQ ID NO: 6735949 - DNA, 23 bp, Homo sapiens
ccctgggagggacatgcttagca

SEQ ID NO: 6735950 - DNA, 20 bp, Homo sapiens
ccctgggatccgagggcccc

SEQ ID NO: 6735951 - DNA, 18 bp, Homo sapiens
ccctgggatctggtggtc

SEQ ID NO: 6735952 - DNA, 20 bp, Homo sapiens
ccctgggatctggtggtcag

SEQ ID NO: 6735953 - DNA, 20 bp, Homo sapiens
ccctgggatgctgacccagg

SEQ ID NO: 6735954 - DNA, 21 bp, Homo sapiens
ccctgggatgctgacccagga

SEQ ID NO: 6735955 - DNA, 15 bp, Homo sapiens
ccctgggatgtccac

SEQ ID NO: 6735956 - DNA, 18 bp, Homo sapiens
ccctgggcaaacagagct

SEQ ID NO: 6735957 - DNA, 13 bp, Homo sapiens
ccctgggcacata

SEQ ID NO: 6735958 - DNA, 16 bp, Homo sapiens
ccctgggcagatgtcc

SEQ ID NO: 6735959 - DNA, 23 bp, Homo sapiens
ccctgggcagatgtcccccactg

SEQ ID NO: 6735960 - DNA, 11 bp, Homo sapiens
ccctgggcagg

SEQ ID NO: 6735961 - DNA, 12 bp, Homo sapiens
ccctgggcaggg

SEQ ID NO: 6735962 - DNA, 15 bp, Homo sapiens
ccctgggcaggtgtg

SEQ ID NO: 6735963 - DNA, 19 bp, Homo sapiens
ccctgggcatcttctggct

SEQ ID NO: 6735964 - DNA, 20 bp, Homo sapiens
ccctgggccacccttcacgc

SEQ ID NO: 6735965 - DNA, 13 bp, Homo sapiens
ccctgggccacct

SEQ ID NO: 6735966 - DNA, 17 bp, Homo sapiens
ccctgggccacctccta

SEQ ID NO: 6735967 - DNA, 18 bp, Homo sapiens
ccctgggccacctcctac

SEQ ID NO: 6735968 - DNA, 13 bp, Homo sapiens
ccctgggccacgc

SEQ ID NO: 6735969 - DNA, 17 bp, Homo sapiens
ccctgggccagcccagg

SEQ ID NO: 6735970 - DNA, 21 bp, Homo sapiens
ccctgggccagcggggctgct

SEQ ID NO: 6735971 - DNA, 20 bp, Homo sapiens
ccctgggccaggcaggcgat

SEQ ID NO: 6735972 - DNA, 13 bp, Homo sapiens
ccctgggccaggg

SEQ ID NO: 6735973 - DNA, 22 bp, Homo sapiens
ccctgggccagggtctgtgtga

SEQ ID NO: 6735974 - DNA, 15 bp, Homo sapiens
ccctgggccccgcct

SEQ ID NO: 6735975 - DNA, 19 bp, Homo sapiens
ccctgggcccctccacgcc

SEQ ID NO: 6735976 - DNA, 13 bp, Homo sapiens
ccctgggccctgg

SEQ ID NO: 6735977 - DNA, 18 bp, Homo sapiens
ccctgggcctcagcctcc

SEQ ID NO: 6735978 - DNA, 23 bp, Homo sapiens
ccctgggcctcagttcaacctgg

SEQ ID NO: 6735979 - DNA, 18 bp, Homo sapiens
ccctgggcctcatcacag

SEQ ID NO: 6735980 - DNA, 22 bp, Homo sapiens
ccctgggcctccacctctgtgc

SEQ ID NO: 6735981 - DNA, 20 bp, Homo sapiens
ccctgggcctgcacctctcc

SEQ ID NO: 6735982 - DNA, 13 bp, Homo sapiens
ccctgggcctgcc

SEQ ID NO: 6735983 - DNA, 19 bp, Homo sapiens
ccctgggcctgcctcacca

SEQ ID NO: 6735984 - DNA, 13 bp, Homo sapiens
ccctgggcctgct

SEQ ID NO: 6735985 - DNA, 15 bp, Homo sapiens
ccctgggcctgctgc

SEQ ID NO: 6735986 - DNA, 17 bp, Homo sapiens
ccctgggcctgctgctg

SEQ ID NO: 6735987 - DNA, 23 bp, Homo sapiens
ccctgggcctggaccgcttccca

SEQ ID NO: 6735988 - DNA, 15 bp, Homo sapiens
ccctgggcctgggga

SEQ ID NO: 6735989 - DNA, 15 bp, Homo sapiens
ccctgggcctgtctc

SEQ ID NO: 6735990 - DNA, 23 bp, Homo sapiens
ccctgggcgagcccctccttctc

SEQ ID NO: 6735991 - DNA, 21 bp, Homo sapiens
ccctgggcgcagctgaagcct

SEQ ID NO: 6735992 - DNA, 17 bp, Homo sapiens
ccctgggctattgctgc

SEQ ID NO: 6735993 - DNA, 14 bp, Homo sapiens
ccctgggctccaca

SEQ ID NO: 6735994 - DNA, 20 bp, Homo sapiens
ccctgggctccacacagcag

SEQ ID NO: 6735995 - DNA, 20 bp, Homo sapiens
ccctgggctccctggaggac

SEQ ID NO: 6735996 - DNA, 15 bp, Homo sapiens
ccctgggctcctctt

SEQ ID NO: 6735997 - DNA, 13 bp, Homo sapiens
ccctgggctctgg

SEQ ID NO: 6735998 - DNA, 17 bp, Homo sapiens
ccctgggctctggtctg

SEQ ID NO: 6735999 - DNA, 21 bp, Homo sapiens
ccctgggctgccaccagcccc

SEQ ID NO: 6736000 - DNA, 14 bp, Homo sapiens
ccctgggctgcctc

SEQ ID NO: 6736001 - DNA, 20 bp, Homo sapiens
ccctgggctgcctcctcctg

SEQ ID NO: 6736002 - DNA, 11 bp, Homo sapiens
ccctgggctgg

SEQ ID NO: 6736003 - DNA, 15 bp, Homo sapiens
ccctgggctggactg

SEQ ID NO: 6736004 - DNA, 14 bp, Homo sapiens
ccctgggctggaga

SEQ ID NO: 6736005 - DNA, 14 bp, Homo sapiens
ccctgggctgggga

SEQ ID NO: 6736006 - DNA, 20 bp, Homo sapiens
ccctgggctggggcctcaga

SEQ ID NO: 6736007 - DNA, 15 bp, Homo sapiens
ccctgggctgtccag

SEQ ID NO: 6736008 - DNA, 16 bp, Homo sapiens
ccctgggctgtctgtc

SEQ ID NO: 6736009 - DNA, 15 bp, Homo sapiens
ccctggggaccagga

SEQ ID NO: 6736010 - DNA, 20 bp, Homo sapiens
ccctggggaccaggagctag

SEQ ID NO: 6736011 - DNA, 17 bp, Homo sapiens
ccctggggacccccacg

SEQ ID NO: 6736012 - DNA, 18 bp, Homo sapiens
ccctggggagaacccttc

SEQ ID NO: 6736013 - DNA, 11 bp, Homo sapiens
ccctggggagc

SEQ ID NO: 6736014 - DNA, 17 bp, Homo sapiens
ccctggggagccctcag

SEQ ID NO: 6736015 - DNA, 19 bp, Homo sapiens
ccctggggagccctcaggc

SEQ ID NO: 6736016 - DNA, 20 bp, Homo sapiens
ccctggggagccctcaggct

SEQ ID NO: 6736017 - DNA, 19 bp, Homo sapiens
ccctggggaggacccctgc

SEQ ID NO: 6736018 - DNA, 20 bp, Homo sapiens
ccctggggaggacccctgcc

SEQ ID NO: 6736019 - DNA, 21 bp, Homo sapiens
ccctggggaggacccctgccc

SEQ ID NO: 6736020 - DNA, 23 bp, Homo sapiens
ccctggggatcttcccacaggag

SEQ ID NO: 6736021 - DNA, 20 bp, Homo sapiens
ccctggggcactcccccagg

SEQ ID NO: 6736022 - DNA, 13 bp, Homo sapiens
ccctggggcccag

SEQ ID NO: 6736023 - DNA, 21 bp, Homo sapiens
ccctggggcctggacctgcct

SEQ ID NO: 6736024 - DNA, 23 bp, Homo sapiens
ccctggggcctgtactgcctgct

SEQ ID NO: 6736025 - DNA, 21 bp, Homo sapiens
ccctggggcgggcagccaggc

SEQ ID NO: 6736026 - DNA, 14 bp, Homo sapiens
ccctggggctgagt

SEQ ID NO: 6736027 - DNA, 22 bp, Homo sapiens
ccctggggctgagtctccaggg

SEQ ID NO: 6736028 - DNA, 12 bp, Homo sapiens
ccctggggctgc

SEQ ID NO: 6736029 - DNA, 18 bp, Homo sapiens
ccctggggctgccctcgg

SEQ ID NO: 6736030 - DNA, 19 bp, Homo sapiens
ccctggggctgccctcggc

SEQ ID NO: 6736031 - DNA, 20 bp, Homo sapiens
ccctggggctgccctcggca

SEQ ID NO: 6736032 - DNA, 18 bp, Homo sapiens
ccctggggctggcttttc

SEQ ID NO: 6736033 - DNA, 14 bp, Homo sapiens
ccctggggctgggc

SEQ ID NO: 6736034 - DNA, 13 bp, Homo sapiens
ccctggggctgta

SEQ ID NO: 6736035 - DNA, 14 bp, Homo sapiens
ccctggggctgtgc

SEQ ID NO: 6736036 - DNA, 15 bp, Homo sapiens
ccctgggggagcctc

SEQ ID NO: 6736037 - DNA, 18 bp, Homo sapiens
ccctgggggaggcttcca

SEQ ID NO: 6736038 - DNA, 21 bp, Homo sapiens
ccctgggggcacaggaggcag

SEQ ID NO: 6736039 - DNA, 21 bp, Homo sapiens
ccctgggggcatcctgcttcc

SEQ ID NO: 6736040 - DNA, 14 bp, Homo sapiens
ccctgggggcggga

SEQ ID NO: 6736041 - DNA, 16 bp, Homo sapiens
ccctgggggcgggact

SEQ ID NO: 6736042 - DNA, 20 bp, Homo sapiens
ccctgggggcgggactcctc

SEQ ID NO: 6736043 - DNA, 16 bp, Homo sapiens
ccctggggggcacagc

SEQ ID NO: 6736044 - DNA, 20 bp, Homo sapiens
ccctggggggcacagccaga

SEQ ID NO: 6736045 - DNA, 21 bp, Homo sapiens
ccctggggggcacagccagaa

SEQ ID NO: 6736046 - DNA, 16 bp, Homo sapiens
ccctgggggtcccagg

SEQ ID NO: 6736047 - DNA, 20 bp, Homo sapiens
ccctgggggtggggctccta

SEQ ID NO: 6736048 - DNA, 21 bp, Homo sapiens
ccctgggggtttaagctctgc

SEQ ID NO: 6736049 - DNA, 17 bp, Homo sapiens
ccctggggtccccactc

SEQ ID NO: 6736050 - DNA, 18 bp, Homo sapiens
ccctggggtccccactcc

SEQ ID NO: 6736051 - DNA, 21 bp, Homo sapiens
ccctggggtctctgagcagtg

SEQ ID NO: 6736052 - DNA, 12 bp, Homo sapiens
ccctggggtggc

SEQ ID NO: 6736053 - DNA, 18 bp, Homo sapiens
ccctggggtggccagggc

SEQ ID NO: 6736054 - DNA, 22 bp, Homo sapiens
ccctggggtggcgtctgcctag

SEQ ID NO: 6736055 - DNA, 20 bp, Homo sapiens
ccctggggtgggatctgagc

SEQ ID NO: 6736056 - DNA, 16 bp, Homo sapiens
ccctggggtgtgtctc

SEQ ID NO: 6736057 - DNA, 21 bp, Homo sapiens
ccctggggtttccacacaggc

SEQ ID NO: 6736058 - DNA, 18 bp, Homo sapiens
ccctgggtaagaagggtg

SEQ ID NO: 6736059 - DNA, 20 bp, Homo sapiens
ccctgggtaagaagggtggg

SEQ ID NO: 6736060 - DNA, 18 bp, Homo sapiens
ccctgggtcctcgggccc

SEQ ID NO: 6736061 - DNA, 15 bp, Homo sapiens
ccctgggtcctgcct

SEQ ID NO: 6736062 - DNA, 19 bp, Homo sapiens
ccctgggtcctgcctgcag

SEQ ID NO: 6736063 - DNA, 20 bp, Homo sapiens
ccctgggtcctgcctgcagt

SEQ ID NO: 6736064 - DNA, 20 bp, Homo sapiens
ccctgggtcgggacagacca

SEQ ID NO: 6736065 - DNA, 22 bp, Homo sapiens
ccctgggtcgggacagaccagc

SEQ ID NO: 6736066 - DNA, 22 bp, Homo sapiens
ccctgggtctggggacaggccc

SEQ ID NO: 6736067 - DNA, 23 bp, Homo sapiens
ccctgggtctggggacaggcccg

SEQ ID NO: 6736068 - DNA, 14 bp, Homo sapiens
ccctgggtgccatt

SEQ ID NO: 6736069 - DNA, 19 bp, Homo sapiens
ccctgggtgccattcccag

SEQ ID NO: 6736070 - DNA, 10 bp, Homo sapiens
ccctgggtgg

SEQ ID NO: 6736071 - DNA, 17 bp, Homo sapiens
ccctgggtggagcagga

SEQ ID NO: 6736072 - DNA, 16 bp, Homo sapiens
ccctgggtgggccctg

SEQ ID NO: 6736073 - DNA, 18 bp, Homo sapiens
ccctgggtgggctctgtg

SEQ ID NO: 6736074 - DNA, 23 bp, Homo sapiens
ccctgggtgtccccgctgctgtg

SEQ ID NO: 6736075 - DNA, 22 bp, Homo sapiens
ccctgggttagactgccagctc

SEQ ID NO: 6736076 - DNA, 23 bp, Homo sapiens
ccctgggttagactgccagctct

SEQ ID NO: 6736077 - DNA, 16 bp, Homo sapiens
ccctgggtttggcccc

SEQ ID NO: 6736078 - DNA, 20 bp, Homo sapiens
ccctgggtttggcccctgga

SEQ ID NO: 6736079 - DNA, 23 bp, Homo sapiens
ccctgggtttggcccctggaacc

SEQ ID NO: 6736080 - DNA, 18 bp, Homo sapiens
ccctgggtttgggagcca

SEQ ID NO: 6736081 - DNA, 22 bp, Homo sapiens
ccctgggtttgggagccaggac

SEQ ID NO: 6736082 - DNA, 23 bp, Homo sapiens
ccctgggtttgggagccaggact

SEQ ID NO: 6736083 - DNA, 23 bp, Homo sapiens
ccctggtaaagaaaagcctcagc

SEQ ID NO: 6736084 - DNA, 15 bp, Homo sapiens
ccctggtaagaaaaa

SEQ ID NO: 6736085 - DNA, 18 bp, Homo sapiens
ccctggtaaggctggtga

SEQ ID NO: 6736086 - DNA, 23 bp, Homo sapiens
ccctggtactcccccagccctca

SEQ ID NO: 6736087 - DNA, 15 bp, Homo sapiens
ccctggtagggcagt

SEQ ID NO: 6736088 - DNA, 20 bp, Homo sapiens
ccctggtcaccaaggcagtg

SEQ ID NO: 6736089 - DNA, 21 bp, Homo sapiens
ccctggtcaccaaggcagtgc

SEQ ID NO: 6736090 - DNA, 14 bp, Homo sapiens
ccctggtcaccgag

SEQ ID NO: 6736091 - DNA, 22 bp, Homo sapiens
ccctggtcaccgagactcagcc

SEQ ID NO: 6736092 - DNA, 23 bp, Homo sapiens
ccctggtcaccgagactcagcct

SEQ ID NO: 6736093 - DNA, 19 bp, Homo sapiens
ccctggtccagattgtagc

SEQ ID NO: 6736094 - DNA, 22 bp, Homo sapiens
ccctggtccagtcgggaggagc

SEQ ID NO: 6736095 - DNA, 21 bp, Homo sapiens
ccctggtcccctccttcccaa

SEQ ID NO: 6736096 - DNA, 14 bp, Homo sapiens
ccctggtcccttgt

SEQ ID NO: 6736097 - DNA, 22 bp, Homo sapiens
ccctggtcctgacttccctgga

SEQ ID NO: 6736098 - DNA, 12 bp, Homo sapiens
ccctggtcctgc

SEQ ID NO: 6736099 - DNA, 17 bp, Homo sapiens
ccctggtcctggcctcc

SEQ ID NO: 6736100 - DNA, 13 bp, Homo sapiens
ccctggtccttcc

SEQ ID NO: 6736101 - DNA, 17 bp, Homo sapiens
ccctggtccttccaggc

SEQ ID NO: 6736102 - DNA, 20 bp, Homo sapiens
ccctggtctcagcagcgacc

SEQ ID NO: 6736103 - DNA, 15 bp, Homo sapiens
ccctggtctctggtc

SEQ ID NO: 6736104 - DNA, 15 bp, Homo sapiens
ccctggtcttctcta

SEQ ID NO: 6736105 - DNA, 15 bp, Homo sapiens
ccctggtgaatcacc

SEQ ID NO: 6736106 - DNA, 18 bp, Homo sapiens
ccctggtgaatcacctgg

SEQ ID NO: 6736107 - DNA, 22 bp, Homo sapiens
ccctggtgaatcacctggctga

SEQ ID NO: 6736108 - DNA, 17 bp, Homo sapiens
ccctggtgacctcctgt

SEQ ID NO: 6736109 - DNA, 18 bp, Homo sapiens
ccctggtgacctcctgtc

SEQ ID NO: 6736110 - DNA, 15 bp, Homo sapiens
ccctggtgagggagc

SEQ ID NO: 6736111 - DNA, 16 bp, Homo sapiens
ccctggtgcctctgtg

SEQ ID NO: 6736112 - DNA, 19 bp, Homo sapiens
ccctggtgcctctgtgcac

SEQ ID NO: 6736113 - DNA, 15 bp, Homo sapiens
ccctggtgctcctgc

SEQ ID NO: 6736114 - DNA, 13 bp, Homo sapiens
ccctggtgctgcc

SEQ ID NO: 6736115 - DNA, 18 bp, Homo sapiens
ccctggtggacagtcctg

SEQ ID NO: 6736116 - DNA, 23 bp, Homo sapiens
ccctggtggagaaagcactgacc

SEQ ID NO: 6736117 - DNA, 14 bp, Homo sapiens
ccctggtggaggct

SEQ ID NO: 6736118 - DNA, 20 bp, Homo sapiens
ccctggtggaggcttcttgc

SEQ ID NO: 6736119 - DNA, 15 bp, Homo sapiens
ccctggtggcagctc

SEQ ID NO: 6736120 - DNA, 16 bp, Homo sapiens
ccctggtggcagctca

SEQ ID NO: 6736121 - DNA, 21 bp, Homo sapiens
ccctggtggcagctcacctct

SEQ ID NO: 6736122 - DNA, 13 bp, Homo sapiens
ccctggtggcagt

SEQ ID NO: 6736123 - DNA, 22 bp, Homo sapiens
ccctggtggcagtgggagctgc

SEQ ID NO: 6736124 - DNA, 23 bp, Homo sapiens
ccctggtggccaagcctgccccg

SEQ ID NO: 6736125 - DNA, 21 bp, Homo sapiens
ccctggtggccctctcccctg

SEQ ID NO: 6736126 - DNA, 23 bp, Homo sapiens
ccctggtgggcctcgacgtccct

SEQ ID NO: 6736127 - DNA, 21 bp, Homo sapiens
ccctggtggtcacaggctgtg

SEQ ID NO: 6736128 - DNA, 20 bp, Homo sapiens
ccctggtgtccctgcctggc

SEQ ID NO: 6736129 - DNA, 16 bp, Homo sapiens
ccctggtgtgtaaata

SEQ ID NO: 6736130 - DNA, 20 bp, Homo sapiens
ccctggtgtttctagcactg

SEQ ID NO: 6736131 - DNA, 18 bp, Homo sapiens
ccctggttagctgacagt

SEQ ID NO: 6736132 - DNA, 21 bp, Homo sapiens
ccctggttcccccaggaccct

SEQ ID NO: 6736133 - DNA, 15 bp, Homo sapiens
ccctggttcctgctg

SEQ ID NO: 6736134 - DNA, 16 bp, Homo sapiens
ccctggttcctgctgt

SEQ ID NO: 6736135 - DNA, 18 bp, Homo sapiens
ccctggttcctgctgtcc

SEQ ID NO: 6736136 - DNA, 19 bp, Homo sapiens
ccctggttcctgctgtcct

SEQ ID NO: 6736137 - DNA, 14 bp, Homo sapiens
ccctggttctcatc

SEQ ID NO: 6736138 - DNA, 16 bp, Homo sapiens
ccctggttctcatctt

SEQ ID NO: 6736139 - DNA, 15 bp, Homo sapiens
ccctggttctccatc

SEQ ID NO: 6736140 - DNA, 18 bp, Homo sapiens
ccctggttctccatcccc

SEQ ID NO: 6736141 - DNA, 12 bp, Homo sapiens
ccctggttgcct

SEQ ID NO: 6736142 - DNA, 17 bp, Homo sapiens
ccctggttgcctctctt

SEQ ID NO: 6736143 - DNA, 18 bp, Homo sapiens
ccctggttgcctctcttg

SEQ ID NO: 6736144 - DNA, 19 bp, Homo sapiens
ccctggttgcctctcttgc

SEQ ID NO: 6736145 - DNA, 20 bp, Homo sapiens
ccctggttgggtggcaattc

SEQ ID NO: 6736146 - DNA, 18 bp, Homo sapiens
ccctggtttcctgccctg

SEQ ID NO: 6736147 - DNA, 21 bp, Homo sapiens
ccctggtttcctgccctggga

SEQ ID NO: 6736148 - DNA, 21 bp, Homo sapiens
ccctggttttaccccagctcc

SEQ ID NO: 6736149 - DNA, 20 bp, Homo sapiens
ccctgtaaacacagtgctgc

SEQ ID NO: 6736150 - DNA, 21 bp, Homo sapiens
ccctgtaaggggccagagcct

SEQ ID NO: 6736151 - DNA, 19 bp, Homo sapiens
ccctgtaatcaggcaagga

SEQ ID NO: 6736152 - DNA, 22 bp, Homo sapiens
ccctgtaatcaggcaaggagga

SEQ ID NO: 6736153 - DNA, 19 bp, Homo sapiens
ccctgtaatgcactcctgc

SEQ ID NO: 6736154 - DNA, 17 bp, Homo sapiens
ccctgtacaatatttaa

SEQ ID NO: 6736155 - DNA, 20 bp, Homo sapiens
ccctgtacacagtgccccct

SEQ ID NO: 6736156 - DNA, 15 bp, Homo sapiens
ccctgtacagtgtta

SEQ ID NO: 6736157 - DNA, 20 bp, Homo sapiens
ccctgtacagtgttaccatc

SEQ ID NO: 6736158 - DNA, 13 bp, Homo sapiens
ccctgtacccacc

SEQ ID NO: 6736159 - DNA, 16 bp, Homo sapiens
ccctgtacccacccca

SEQ ID NO: 6736160 - DNA, 22 bp, Homo sapiens
ccctgtacccaccccagcacag

SEQ ID NO: 6736161 - DNA, 15 bp, Homo sapiens
ccctgtacccagcca

SEQ ID NO: 6736162 - DNA, 19 bp, Homo sapiens
ccctgtacccagccacctt

SEQ ID NO: 6736163 - DNA, 20 bp, Homo sapiens
ccctgtacccagccaccttc

SEQ ID NO: 6736164 - DNA, 21 bp, Homo sapiens
ccctgtacccagccaccttcc

SEQ ID NO: 6736165 - DNA, 17 bp, Homo sapiens
ccctgtacctcatccca

SEQ ID NO: 6736166 - DNA, 13 bp, Homo sapiens
ccctgtacctctc

SEQ ID NO: 6736167 - DNA, 13 bp, Homo sapiens
ccctgtagccctg

SEQ ID NO: 6736168 - DNA, 14 bp, Homo sapiens
ccctgtagccctgg

SEQ ID NO: 6736169 - DNA, 15 bp, Homo sapiens
ccctgtagccctggc

SEQ ID NO: 6736170 - DNA, 17 bp, Homo sapiens
ccctgtagccctggccc

SEQ ID NO: 6736171 - DNA, 12 bp, Homo sapiens
ccctgtagctcc

SEQ ID NO: 6736172 - DNA, 21 bp, Homo sapiens
ccctgtagctccttagctagt

SEQ ID NO: 6736173 - DNA, 22 bp, Homo sapiens
ccctgtagtgaatcctctgttt

SEQ ID NO: 6736174 - DNA, 22 bp, Homo sapiens
ccctgtatataatactaaagtg

SEQ ID NO: 6736175 - DNA, 17 bp, Homo sapiens
ccctgtatatagcccag

SEQ ID NO: 6736176 - DNA, 23 bp, Homo sapiens
ccctgtattcccacccctggact

SEQ ID NO: 6736177 - DNA, 14 bp, Homo sapiens
ccctgtcacacact

SEQ ID NO: 6736178 - DNA, 18 bp, Homo sapiens
ccctgtcacacactggac

SEQ ID NO: 6736179 - DNA, 13 bp, Homo sapiens
ccctgtcacctct

SEQ ID NO: 6736180 - DNA, 15 bp, Homo sapiens
ccctgtcactgtcca

SEQ ID NO: 6736181 - DNA, 21 bp, Homo sapiens
ccctgtcagaatcatgctgtt

SEQ ID NO: 6736182 - DNA, 22 bp, Homo sapiens
ccctgtcagaatcatgctgttc

SEQ ID NO: 6736183 - DNA, 21 bp, Homo sapiens
ccctgtcagacgttggtccca

SEQ ID NO: 6736184 - DNA, 15 bp, Homo sapiens
ccctgtcagcatgaa

SEQ ID NO: 6736185 - DNA, 22 bp, Homo sapiens
ccctgtcagtgcagcccgtgtg

SEQ ID NO: 6736186 - DNA, 20 bp, Homo sapiens
ccctgtcatttgaacctgga

SEQ ID NO: 6736187 - DNA, 12 bp, Homo sapiens
ccctgtccagcg

SEQ ID NO: 6736188 - DNA, 11 bp, Homo sapiens
ccctgtccagg

SEQ ID NO: 6736189 - DNA, 23 bp, Homo sapiens
ccctgtccaggatggagggtcca

SEQ ID NO: 6736190 - DNA, 14 bp, Homo sapiens
ccctgtccagggca

SEQ ID NO: 6736191 - DNA, 14 bp, Homo sapiens
ccctgtcccaccca

SEQ ID NO: 6736192 - DNA, 22 bp, Homo sapiens
ccctgtcccacccacacagctg

SEQ ID NO: 6736193 - DNA, 23 bp, Homo sapiens
ccctgtcccacccacacagctgc

SEQ ID NO: 6736194 - DNA, 15 bp, Homo sapiens
ccctgtcccaccccc

SEQ ID NO: 6736195 - DNA, 15 bp, Homo sapiens
ccctgtcccaggcag

SEQ ID NO: 6736196 - DNA, 15 bp, Homo sapiens
ccctgtcccaggccg

SEQ ID NO: 6736197 - DNA, 21 bp, Homo sapiens
ccctgtcccaggccggcccag

SEQ ID NO: 6736198 - DNA, 16 bp, Homo sapiens
ccctgtcccagggccc

SEQ ID NO: 6736199 - DNA, 22 bp, Homo sapiens
ccctgtcccagggccctcccag

SEQ ID NO: 6736200 - DNA, 15 bp, Homo sapiens
ccctgtcccatgcag

SEQ ID NO: 6736201 - DNA, 23 bp, Homo sapiens
ccctgtcccatgcaggccctttg

SEQ ID NO: 6736202 - DNA, 18 bp, Homo sapiens
ccctgtcccattctagat

SEQ ID NO: 6736203 - DNA, 20 bp, Homo sapiens
ccctgtccccaggcccagcc

SEQ ID NO: 6736204 - DNA, 16 bp, Homo sapiens
ccctgtccccagtccc

SEQ ID NO: 6736205 - DNA, 20 bp, Homo sapiens
ccctgtccccagtccccagc

SEQ ID NO: 6736206 - DNA, 21 bp, Homo sapiens
ccctgtccccagtccccagcc

SEQ ID NO: 6736207 - DNA, 14 bp, Homo sapiens
ccctgtcccccagc

SEQ ID NO: 6736208 - DNA, 15 bp, Homo sapiens
ccctgtcccccagca

SEQ ID NO: 6736209 - DNA, 15 bp, Homo sapiens
ccctgtcccccagct

SEQ ID NO: 6736210 - DNA, 18 bp, Homo sapiens
ccctgtcccccagctctg

SEQ ID NO: 6736211 - DNA, 18 bp, Homo sapiens
ccctgtcccctcagctcc

SEQ ID NO: 6736212 - DNA, 19 bp, Homo sapiens
ccctgtcccctcagctcca

SEQ ID NO: 6736213 - DNA, 18 bp, Homo sapiens
ccctgtcccctcctcgcc

SEQ ID NO: 6736214 - DNA, 12 bp, Homo sapiens
ccctgtcccctg

SEQ ID NO: 6736215 - DNA, 18 bp, Homo sapiens
ccctgtcccctgaaaaac

SEQ ID NO: 6736216 - DNA, 13 bp, Homo sapiens
ccctgtcccctgg

SEQ ID NO: 6736217 - DNA, 14 bp, Homo sapiens
ccctgtcccctgga

SEQ ID NO: 6736218 - DNA, 19 bp, Homo sapiens
ccctgtcccctggggctgg

SEQ ID NO: 6736219 - DNA, 16 bp, Homo sapiens
ccctgtccctagctca

SEQ ID NO: 6736220 - DNA, 17 bp, Homo sapiens
ccctgtccctagctcac

SEQ ID NO: 6736221 - DNA, 20 bp, Homo sapiens
ccctgtccctcccacctctg

SEQ ID NO: 6736222 - DNA, 13 bp, Homo sapiens
ccctgtccctcta

SEQ ID NO: 6736223 - DNA, 22 bp, Homo sapiens
ccctgtccctctagtgccttct

SEQ ID NO: 6736224 - DNA, 13 bp, Homo sapiens
ccctgtccctgcc

SEQ ID NO: 6736225 - DNA, 22 bp, Homo sapiens
ccctgtccggaatgccacccac

SEQ ID NO: 6736226 - DNA, 22 bp, Homo sapiens
ccctgtccggcccagtgccact

SEQ ID NO: 6736227 - DNA, 17 bp, Homo sapiens
ccctgtcctcactgctc

SEQ ID NO: 6736228 - DNA, 15 bp, Homo sapiens
ccctgtcctcctcgg

SEQ ID NO: 6736229 - DNA, 20 bp, Homo sapiens
ccctgtcctctctggctggg

SEQ ID NO: 6736230 - DNA, 15 bp, Homo sapiens
ccctgtcctgccatg

SEQ ID NO: 6736231 - DNA, 14 bp, Homo sapiens
ccctgtcctgtgaa

SEQ ID NO: 6736232 - DNA, 15 bp, Homo sapiens
ccctgtcctgtgaat

SEQ ID NO: 6736233 - DNA, 23 bp, Homo sapiens
ccctgtccttcccacggccactg

SEQ ID NO: 6736234 - DNA, 12 bp, Homo sapiens
ccctgtcctttg

SEQ ID NO: 6736235 - DNA, 21 bp, Homo sapiens
ccctgtcgagttcggctctgg

SEQ ID NO: 6736236 - DNA, 23 bp, Homo sapiens
ccctgtcgcccacccagctggtc

SEQ ID NO: 6736237 - DNA, 17 bp, Homo sapiens
ccctgtcgggctttgtg

SEQ ID NO: 6736238 - DNA, 14 bp, Homo sapiens
ccctgtctaaaaaa

SEQ ID NO: 6736239 - DNA, 16 bp, Homo sapiens
ccctgtctaatgaaac

SEQ ID NO: 6736240 - DNA, 16 bp, Homo sapiens
ccctgtctagagaggg

SEQ ID NO: 6736241 - DNA, 13 bp, Homo sapiens
ccctgtctccagc

SEQ ID NO: 6736242 - DNA, 15 bp, Homo sapiens
ccctgtctccagctg

SEQ ID NO: 6736243 - DNA, 23 bp, Homo sapiens
ccctgtctccagggcccccaccg

SEQ ID NO: 6736244 - DNA, 18 bp, Homo sapiens
ccctgtctcccggctccc

SEQ ID NO: 6736245 - DNA, 23 bp, Homo sapiens
ccctgtctctactaaaaatgcaa

SEQ ID NO: 6736246 - DNA, 15 bp, Homo sapiens
ccctgtctctgcatc

SEQ ID NO: 6736247 - DNA, 15 bp, Homo sapiens
ccctgtctctggcta

SEQ ID NO: 6736248 - DNA, 21 bp, Homo sapiens
ccctgtctctggctactccct

SEQ ID NO: 6736249 - DNA, 19 bp, Homo sapiens
ccctgtctgaaaccagaag

SEQ ID NO: 6736250 - DNA, 23 bp, Homo sapiens
ccctgtctgaaggacacttcctg

SEQ ID NO: 6736251 - DNA, 14 bp, Homo sapiens
ccctgtctgcaggc

SEQ ID NO: 6736252 - DNA, 13 bp, Homo sapiens
ccctgtctggaag

SEQ ID NO: 6736253 - DNA, 20 bp, Homo sapiens
ccctgtctgtagagggccct

SEQ ID NO: 6736254 - DNA, 21 bp, Homo sapiens
ccctgtctgtagagggccctg

SEQ ID NO: 6736255 - DNA, 15 bp, Homo sapiens
ccctgtctgtgtccc

SEQ ID NO: 6736256 - DNA, 17 bp, Homo sapiens
ccctgtctgtgtcccag

SEQ ID NO: 6736257 - DNA, 18 bp, Homo sapiens
ccctgtctgttcccagcc

SEQ ID NO: 6736258 - DNA, 21 bp, Homo sapiens
ccctgtctgttcccagcccct

SEQ ID NO: 6736259 - DNA, 20 bp, Homo sapiens
ccctgtcttcctctgcaagt

SEQ ID NO: 6736260 - DNA, 16 bp, Homo sapiens
ccctgtcttctgggca

SEQ ID NO: 6736261 - DNA, 23 bp, Homo sapiens
ccctgtgaaacgtcccacacttt

SEQ ID NO: 6736262 - DNA, 14 bp, Homo sapiens
ccctgtgacaaaat

SEQ ID NO: 6736263 - DNA, 20 bp, Homo sapiens
ccctgtgacatggtgcctga

SEQ ID NO: 6736264 - DNA, 18 bp, Homo sapiens
ccctgtgaccctctcact

SEQ ID NO: 6736265 - DNA, 15 bp, Homo sapiens
ccctgtgagagccac

SEQ ID NO: 6736266 - DNA, 23 bp, Homo sapiens
ccctgtgagagccacgctggcct

SEQ ID NO: 6736267 - DNA, 23 bp, Homo sapiens
ccctgtgagattttgcttttcca

SEQ ID NO: 6736268 - DNA, 13 bp, Homo sapiens
ccctgtgatgcct

SEQ ID NO: 6736269 - DNA, 14 bp, Homo sapiens
ccctgtgatgcctg

SEQ ID NO: 6736270 - DNA, 19 bp, Homo sapiens
ccctgtgatggggccctgc

SEQ ID NO: 6736271 - DNA, 20 bp, Homo sapiens
ccctgtgatggggccctgcc

SEQ ID NO: 6736272 - DNA, 21 bp, Homo sapiens
ccctgtgatggggccctgcct

SEQ ID NO: 6736273 - DNA, 22 bp, Homo sapiens
ccctgtgatggggccctgcctc

SEQ ID NO: 6736274 - DNA, 14 bp, Homo sapiens
ccctgtgcagacct

SEQ ID NO: 6736275 - DNA, 11 bp, Homo sapiens
ccctgtgccag

SEQ ID NO: 6736276 - DNA, 14 bp, Homo sapiens
ccctgtgccagctc

SEQ ID NO: 6736277 - DNA, 15 bp, Homo sapiens
ccctgtgccagctca

SEQ ID NO: 6736278 - DNA, 13 bp, Homo sapiens
ccctgtgcccacc

SEQ ID NO: 6736279 - DNA, 11 bp, Homo sapiens
ccctgtgcccc

SEQ ID NO: 6736280 - DNA, 20 bp, Homo sapiens
ccctgtgcccccagcctcag

SEQ ID NO: 6736281 - DNA, 15 bp, Homo sapiens
ccctgtgccccgcct

SEQ ID NO: 6736282 - DNA, 15 bp, Homo sapiens
ccctgtgccctctca

SEQ ID NO: 6736283 - DNA, 14 bp, Homo sapiens
ccctgtgccctgca

SEQ ID NO: 6736284 - DNA, 20 bp, Homo sapiens
ccctgtgccctgcacgtata

SEQ ID NO: 6736285 - DNA, 17 bp, Homo sapiens
ccctgtgcctcctccct

SEQ ID NO: 6736286 - DNA, 19 bp, Homo sapiens
ccctgtgcctcctccctcc

SEQ ID NO: 6736287 - DNA, 21 bp, Homo sapiens
ccctgtgcctgctgggcactg

SEQ ID NO: 6736288 - DNA, 12 bp, Homo sapiens
ccctgtgcctgg

SEQ ID NO: 6736289 - DNA, 12 bp, Homo sapiens
ccctgtgcctgt

SEQ ID NO: 6736290 - DNA, 13 bp, Homo sapiens
ccctgtgcctgtg

SEQ ID NO: 6736291 - DNA, 24 bp, Homo sapiens
ccctgtgccttggtgtgctgtatc

SEQ ID NO: 6736292 - DNA, 22 bp, Homo sapiens
ccctgtgccttgtcacgccaga

SEQ ID NO: 6736293 - DNA, 20 bp, Homo sapiens
ccctgtgctcccctgccaca

SEQ ID NO: 6736294 - DNA, 22 bp, Homo sapiens
ccctgtgctcccctgccacact

SEQ ID NO: 6736295 - DNA, 19 bp, Homo sapiens
ccctgtgctgcggggcctt

SEQ ID NO: 6736296 - DNA, 12 bp, Homo sapiens
ccctgtgctggt

SEQ ID NO: 6736297 - DNA, 13 bp, Homo sapiens
ccctgtgctggtg

SEQ ID NO: 6736298 - DNA, 23 bp, Homo sapiens
ccctgtgctggtgtcctgaccac

SEQ ID NO: 6736299 - DNA, 16 bp, Homo sapiens
ccctgtggagactggg

SEQ ID NO: 6736300 - DNA, 18 bp, Homo sapiens
ccctgtggagtccagctc

SEQ ID NO: 6736301 - DNA, 16 bp, Homo sapiens
ccctgtggccaactgc

SEQ ID NO: 6736302 - DNA, 22 bp, Homo sapiens
ccctgtggccgactctgcactc

SEQ ID NO: 6736303 - DNA, 13 bp, Homo sapiens
ccctgtgggaccg

SEQ ID NO: 6736304 - DNA, 18 bp, Homo sapiens
ccctgtgggactcatcct

SEQ ID NO: 6736305 - DNA, 19 bp, Homo sapiens
ccctgtgggagccgcagag

SEQ ID NO: 6736306 - DNA, 21 bp, Homo sapiens
ccctgtgggagccgcagagcc

SEQ ID NO: 6736307 - DNA, 18 bp, Homo sapiens
ccctgtgggcccccaaat

SEQ ID NO: 6736308 - DNA, 13 bp, Homo sapiens
ccctgtgggctca

SEQ ID NO: 6736309 - DNA, 17 bp, Homo sapiens
ccctgtgggctcacacc

SEQ ID NO: 6736310 - DNA, 23 bp, Homo sapiens
ccctgtgggcttatgtctctgcc

SEQ ID NO: 6736311 - DNA, 20 bp, Homo sapiens
ccctgtggggatctcagggg

SEQ ID NO: 6736312 - DNA, 17 bp, Homo sapiens
ccctgtggggcaggagt

SEQ ID NO: 6736313 - DNA, 23 bp, Homo sapiens
ccctgtggggcaggagtgccagg

SEQ ID NO: 6736314 - DNA, 23 bp, Homo sapiens
ccctgtgggggtggccatccctg

SEQ ID NO: 6736315 - DNA, 21 bp, Homo sapiens
ccctgtgggtgtctccctcgg

SEQ ID NO: 6736316 - DNA, 17 bp, Homo sapiens
ccctgtggtaccctggc

SEQ ID NO: 6736317 - DNA, 19 bp, Homo sapiens
ccctgtggtaccctggcag

SEQ ID NO: 6736318 - DNA, 17 bp, Homo sapiens
ccctgtggtctattgtc

SEQ ID NO: 6736319 - DNA, 14 bp, Homo sapiens
ccctgtggtctgtg

SEQ ID NO: 6736320 - DNA, 20 bp, Homo sapiens
ccctgtggtctgtgtgtgac

SEQ ID NO: 6736321 - DNA, 18 bp, Homo sapiens
ccctgtgtaggggcaggg

SEQ ID NO: 6736322 - DNA, 19 bp, Homo sapiens
ccctgtgtatacagccctg

SEQ ID NO: 6736323 - DNA, 15 bp, Homo sapiens
ccctgtgtcagagcc

SEQ ID NO: 6736324 - DNA, 20 bp, Homo sapiens
ccctgtgtcagagcctacct

SEQ ID NO: 6736325 - DNA, 15 bp, Homo sapiens
ccctgtgtccacagt

SEQ ID NO: 6736326 - DNA, 19 bp, Homo sapiens
ccctgtgtcctccaccatg

SEQ ID NO: 6736327 - DNA, 21 bp, Homo sapiens
ccctgtgtctgtcacaggctg

SEQ ID NO: 6736328 - DNA, 23 bp, Homo sapiens
ccctgtgtctgtcacaggctggg

SEQ ID NO: 6736329 - DNA, 12 bp, Homo sapiens
ccctgtgtcttt

SEQ ID NO: 6736330 - DNA, 21 bp, Homo sapiens
ccctgtgtggatgctgagctg

SEQ ID NO: 6736331 - DNA, 13 bp, Homo sapiens
ccctgtgtggccc

SEQ ID NO: 6736332 - DNA, 19 bp, Homo sapiens
ccctgtgtggccctggaca

SEQ ID NO: 6736333 - DNA, 19 bp, Homo sapiens
ccctgtgtgtcgttccctt

SEQ ID NO: 6736334 - DNA, 13 bp, Homo sapiens
ccctgtgttaatt

SEQ ID NO: 6736335 - DNA, 20 bp, Homo sapiens
ccctgtgttagtaaaggggc

SEQ ID NO: 6736336 - DNA, 17 bp, Homo sapiens
ccctgtgttctgggctg

SEQ ID NO: 6736337 - DNA, 23 bp, Homo sapiens
ccctgtgttctgggctggggcca

SEQ ID NO: 6736338 - DNA, 18 bp, Homo sapiens
ccctgtgttctttcccca

SEQ ID NO: 6736339 - DNA, 13 bp, Homo sapiens
ccctgtgttgtct

SEQ ID NO: 6736340 - DNA, 17 bp, Homo sapiens
ccctgtgttgtctctag

SEQ ID NO: 6736341 - DNA, 23 bp, Homo sapiens
ccctgtgttgtctctagagcagg

SEQ ID NO: 6736342 - DNA, 21 bp, Homo sapiens
ccctgttattttcaagtagct

SEQ ID NO: 6736343 - DNA, 20 bp, Homo sapiens
ccctgttatttttctgccct

SEQ ID NO: 6736344 - DNA, 21 bp, Homo sapiens
ccctgttatttttctgccctg

SEQ ID NO: 6736345 - DNA, 13 bp, Homo sapiens
ccctgttcactct

SEQ ID NO: 6736346 - DNA, 22 bp, Homo sapiens
ccctgttcactctacttagcat

SEQ ID NO: 6736347 - DNA, 17 bp, Homo sapiens
ccctgttcagctactcc

SEQ ID NO: 6736348 - DNA, 17 bp, Homo sapiens
ccctgttcatgtgcctc

SEQ ID NO: 6736349 - DNA, 12 bp, Homo sapiens
ccctgttcattg

SEQ ID NO: 6736350 - DNA, 16 bp, Homo sapiens
ccctgttccccacagg

SEQ ID NO: 6736351 - DNA, 17 bp, Homo sapiens
ccctgttccccagagaa

SEQ ID NO: 6736352 - DNA, 13 bp, Homo sapiens
ccctgttccctgg

SEQ ID NO: 6736353 - DNA, 17 bp, Homo sapiens
ccctgttccgcctcact

SEQ ID NO: 6736354 - DNA, 22 bp, Homo sapiens
ccctgttccgcctcactgggtg

SEQ ID NO: 6736355 - DNA, 13 bp, Homo sapiens
ccctgttcctgct

SEQ ID NO: 6736356 - DNA, 15 bp, Homo sapiens
ccctgttcctggagg

SEQ ID NO: 6736357 - DNA, 21 bp, Homo sapiens
ccctgttctaagggggagggg

SEQ ID NO: 6736358 - DNA, 23 bp, Homo sapiens
ccctgttctaagggggaggggaa

SEQ ID NO: 6736359 - DNA, 16 bp, Homo sapiens
ccctgttctcagctcc

SEQ ID NO: 6736360 - DNA, 17 bp, Homo sapiens
ccctgttctcagctccg

SEQ ID NO: 6736361 - DNA, 12 bp, Homo sapiens
ccctgttctctt

SEQ ID NO: 6736362 - DNA, 14 bp, Homo sapiens
ccctgttctggaca

SEQ ID NO: 6736363 - DNA, 20 bp, Homo sapiens
ccctgttgaattggtgaata

SEQ ID NO: 6736364 - DNA, 22 bp, Homo sapiens
ccctgttgaattggtgaataaa

SEQ ID NO: 6736365 - DNA, 12 bp, Homo sapiens
ccctgttgacct

SEQ ID NO: 6736366 - DNA, 17 bp, Homo sapiens
ccctgttgacctaccct

SEQ ID NO: 6736367 - DNA, 16 bp, Homo sapiens
ccctgttgacctgccc

SEQ ID NO: 6736368 - DNA, 20 bp, Homo sapiens
ccctgttgacgaagtctctt

SEQ ID NO: 6736369 - DNA, 20 bp, Homo sapiens
ccctgttgctacatcagagt

SEQ ID NO: 6736370 - DNA, 22 bp, Homo sapiens
ccctgttgctacatcagagtgt

SEQ ID NO: 6736371 - DNA, 18 bp, Homo sapiens
ccctgttggaggtgagtg

SEQ ID NO: 6736372 - DNA, 18 bp, Homo sapiens
ccctgttgggggcttcag

SEQ ID NO: 6736373 - DNA, 14 bp, Homo sapiens
ccctgtttaatatt

SEQ ID NO: 6736374 - DNA, 17 bp, Homo sapiens
ccctgtttaatatttaa

SEQ ID NO: 6736375 - DNA, 19 bp, Homo sapiens
ccctgtttactggttcttg

SEQ ID NO: 6736376 - DNA, 19 bp, Homo sapiens
ccctgtttcagaggctcag

SEQ ID NO: 6736377 - DNA, 14 bp, Homo sapiens
ccctgtttctccac

SEQ ID NO: 6736378 - DNA, 15 bp, Homo sapiens
ccctgtttctcccca

SEQ ID NO: 6736379 - DNA, 17 bp, Homo sapiens
ccctgtttctcctccat

SEQ ID NO: 6736380 - DNA, 19 bp, Homo sapiens
ccctgtttgtttctgaaag

SEQ ID NO: 6736381 - DNA, 22 bp, Homo sapiens
ccctgttttagtttctgaactc

SEQ ID NO: 6736382 - DNA, 23 bp, Homo sapiens
ccctgttttagtttctgaactct

SEQ ID NO: 6736383 - DNA, 14 bp, Homo sapiens
ccctgttttccaca

SEQ ID NO: 6736384 - DNA, 19 bp, Homo sapiens
ccctgttttccacaccatc

SEQ ID NO: 6736385 - DNA, 16 bp, Homo sapiens
ccctgttttcccccca

SEQ ID NO: 6736386 - DNA, 20 bp, Homo sapiens
ccctgttttccccccaaggg

SEQ ID NO: 6736387 - DNA, 23 bp, Homo sapiens
ccctgttttctgagcccgggctg

SEQ ID NO: 6736388 - DNA, 15 bp, Homo sapiens
ccctgttttttgtag

SEQ ID NO: 6736389 - DNA, 14 bp, Homo sapiens
cccttaaaaccaaa

SEQ ID NO: 6736390 - DNA, 14 bp, Homo sapiens
cccttaaaatagaa

SEQ ID NO: 6736391 - DNA, 14 bp, Homo sapiens
cccttaaacttcca

SEQ ID NO: 6736392 - DNA, 21 bp, Homo sapiens
cccttaaagaaaattgcatga

SEQ ID NO: 6736393 - DNA, 14 bp, Homo sapiens
cccttaaaggggag

SEQ ID NO: 6736394 - DNA, 19 bp, Homo sapiens
cccttaaatttctgccctg

SEQ ID NO: 6736395 - DNA, 16 bp, Homo sapiens
cccttaacccaaggag

SEQ ID NO: 6736396 - DNA, 14 bp, Homo sapiens
cccttaactccaag

SEQ ID NO: 6736397 - DNA, 14 bp, Homo sapiens
cccttaactgacat

SEQ ID NO: 6736398 - DNA, 22 bp, Homo sapiens
cccttaagcagcaacagcctac

SEQ ID NO: 6736399 - DNA, 15 bp, Homo sapiens
cccttaagcatgctt

SEQ ID NO: 6736400 - DNA, 13 bp, Homo sapiens
cccttaagccaac

SEQ ID NO: 6736401 - DNA, 23 bp, Homo sapiens
cccttaagtccttaatgaagagc

SEQ ID NO: 6736402 - DNA, 20 bp, Homo sapiens
cccttaattacttaaaaaaa

SEQ ID NO: 6736403 - DNA, 19 bp, Homo sapiens
cccttacacactcaggcct

SEQ ID NO: 6736404 - DNA, 15 bp, Homo sapiens
cccttacacgtacct

SEQ ID NO: 6736405 - DNA, 17 bp, Homo sapiens
cccttaccactgctctg

SEQ ID NO: 6736406 - DNA, 12 bp, Homo sapiens
cccttacccatc

SEQ ID NO: 6736407 - DNA, 17 bp, Homo sapiens
cccttaccctcctctgc

SEQ ID NO: 6736408 - DNA, 19 bp, Homo sapiens
cccttaccctcctctgctg

SEQ ID NO: 6736409 - DNA, 15 bp, Homo sapiens
cccttacctgtgacc

SEQ ID NO: 6736410 - DNA, 15 bp, Homo sapiens
cccttacgtgagtcc

SEQ ID NO: 6736411 - DNA, 19 bp, Homo sapiens
cccttactatgatctcagg

SEQ ID NO: 6736412 - DNA, 20 bp, Homo sapiens
cccttactatgatctcagga

SEQ ID NO: 6736413 - DNA, 14 bp, Homo sapiens
cccttacttagcat

SEQ ID NO: 6736414 - DNA, 19 bp, Homo sapiens
cccttacttcctggcctct

SEQ ID NO: 6736415 - DNA, 20 bp, Homo sapiens
cccttacttcctggcctctt

SEQ ID NO: 6736416 - DNA, 23 bp, Homo sapiens
cccttacttcctggcctcttctg

SEQ ID NO: 6736417 - DNA, 20 bp, Homo sapiens
cccttactttaaccctttct

SEQ ID NO: 6736418 - DNA, 18 bp, Homo sapiens
cccttagaatgtttctat

SEQ ID NO: 6736419 - DNA, 15 bp, Homo sapiens
cccttagacagaggc

SEQ ID NO: 6736420 - DNA, 20 bp, Homo sapiens
cccttagagattgccccaga

SEQ ID NO: 6736421 - DNA, 21 bp, Homo sapiens
cccttagagattgccccagag

SEQ ID NO: 6736422 - DNA, 12 bp, Homo sapiens
cccttagcacag

SEQ ID NO: 6736423 - DNA, 17 bp, Homo sapiens
cccttagcacagagagg

SEQ ID NO: 6736424 - DNA, 17 bp, Homo sapiens
cccttagcagcccagca

SEQ ID NO: 6736425 - DNA, 14 bp, Homo sapiens
cccttagcccccac

SEQ ID NO: 6736426 - DNA, 14 bp, Homo sapiens
cccttagccccgag

SEQ ID NO: 6736427 - DNA, 18 bp, Homo sapiens
cccttagcctccagcacc

SEQ ID NO: 6736428 - DNA, 14 bp, Homo sapiens
cccttagcctccct

SEQ ID NO: 6736429 - DNA, 17 bp, Homo sapiens
cccttagcctccctgaa

SEQ ID NO: 6736430 - DNA, 20 bp, Homo sapiens
cccttagccttgctgtagag

SEQ ID NO: 6736431 - DNA, 19 bp, Homo sapiens
cccttagcttttagcctgg

SEQ ID NO: 6736432 - DNA, 20 bp, Homo sapiens
cccttagcttttagcctggc

SEQ ID NO: 6736433 - DNA, 19 bp, Homo sapiens
cccttaggcattatttaat

SEQ ID NO: 6736434 - DNA, 20 bp, Homo sapiens
cccttaggccccgtggtgac

SEQ ID NO: 6736435 - DNA, 22 bp, Homo sapiens
cccttagggaagttgtctcctt

SEQ ID NO: 6736436 - DNA, 15 bp, Homo sapiens
cccttagtcccccaa

SEQ ID NO: 6736437 - DNA, 18 bp, Homo sapiens
cccttagtcccccaactc

SEQ ID NO: 6736438 - DNA, 14 bp, Homo sapiens
cccttatccaggac

SEQ ID NO: 6736439 - DNA, 16 bp, Homo sapiens
cccttatccaggactc

SEQ ID NO: 6736440 - DNA, 14 bp, Homo sapiens
cccttatcctccct

SEQ ID NO: 6736441 - DNA, 16 bp, Homo sapiens
cccttatctgtgctca

SEQ ID NO: 6736442 - DNA, 19 bp, Homo sapiens
cccttatgcggttaatttt

SEQ ID NO: 6736443 - DNA, 16 bp, Homo sapiens
cccttattacacggaa

SEQ ID NO: 6736444 - DNA, 17 bp, Homo sapiens
cccttattagttacaaa

SEQ ID NO: 6736445 - DNA, 21 bp, Homo sapiens
cccttattgctgccaaaacca

SEQ ID NO: 6736446 - DNA, 19 bp, Homo sapiens
cccttattgctgtcctgga

SEQ ID NO: 6736447 - DNA, 12 bp, Homo sapiens
cccttatttaaa

SEQ ID NO: 6736448 - DNA, 22 bp, Homo sapiens
cccttatttaaaactcacctcc

SEQ ID NO: 6736449 - DNA, 12 bp, Homo sapiens
cccttatttcct

SEQ ID NO: 6736450 - DNA, 12 bp, Homo sapiens
cccttattttca

SEQ ID NO: 6736451 - DNA, 22 bp, Homo sapiens
cccttcaacgtttcttcacttt

SEQ ID NO: 6736452 - DNA, 15 bp, Homo sapiens
cccttcaactcctgg

SEQ ID NO: 6736453 - DNA, 16 bp, Homo sapiens
cccttcaactcctggc

SEQ ID NO: 6736454 - DNA, 18 bp, Homo sapiens
cccttcaactcctggctc

SEQ ID NO: 6736455 - DNA, 23 bp, Homo sapiens
cccttcaaggaagtgataacact

SEQ ID NO: 6736456 - DNA, 15 bp, Homo sapiens
cccttcaaggcctcc

SEQ ID NO: 6736457 - DNA, 20 bp, Homo sapiens
cccttcacaaagcccaaggg

SEQ ID NO: 6736458 - DNA, 15 bp, Homo sapiens
cccttcacatagttt

SEQ ID NO: 6736459 - DNA, 22 bp, Homo sapiens
cccttcacttctgaccacactt

SEQ ID NO: 6736460 - DNA, 23 bp, Homo sapiens
cccttcacttctgaccacacttc

SEQ ID NO: 6736461 - DNA, 17 bp, Homo sapiens
cccttcactttctcctg

SEQ ID NO: 6736462 - DNA, 19 bp, Homo sapiens
cccttcagaacagaggcat

SEQ ID NO: 6736463 - DNA, 20 bp, Homo sapiens
cccttcagcccccagcccct

SEQ ID NO: 6736464 - DNA, 23 bp, Homo sapiens
cccttcagccgagcccagacctc

SEQ ID NO: 6736465 - DNA, 12 bp, Homo sapiens
cccttcagctcc

SEQ ID NO: 6736466 - DNA, 21 bp, Homo sapiens
cccttcaggaagcaggtgtcc

SEQ ID NO: 6736467 - DNA, 15 bp, Homo sapiens
cccttcaggagcctg

SEQ ID NO: 6736468 - DNA, 22 bp, Homo sapiens
cccttcagggattccctgtccc

SEQ ID NO: 6736469 - DNA, 12 bp, Homo sapiens
cccttcagggcc

SEQ ID NO: 6736470 - DNA, 19 bp, Homo sapiens
cccttcagggccagaagga

SEQ ID NO: 6736471 - DNA, 20 bp, Homo sapiens
cccttcagtaccctctcagc

SEQ ID NO: 6736472 - DNA, 12 bp, Homo sapiens
cccttcagtctg

SEQ ID NO: 6736473 - DNA, 16 bp, Homo sapiens
cccttcagtctgctcc

SEQ ID NO: 6736474 - DNA, 17 bp, Homo sapiens
cccttcagtctgctcca

SEQ ID NO: 6736475 - DNA, 17 bp, Homo sapiens
cccttcagtgcccacca

SEQ ID NO: 6736476 - DNA, 14 bp, Homo sapiens
cccttcataccctc

SEQ ID NO: 6736477 - DNA, 19 bp, Homo sapiens
cccttcatccatcctgagc

SEQ ID NO: 6736478 - DNA, 21 bp, Homo sapiens
cccttcatccatcctgagcca

SEQ ID NO: 6736479 - DNA, 20 bp, Homo sapiens
cccttcatccgcctgtgggc

SEQ ID NO: 6736480 - DNA, 18 bp, Homo sapiens
cccttcatctccagggag

SEQ ID NO: 6736481 - DNA, 17 bp, Homo sapiens
cccttcatcttcctgtg

SEQ ID NO: 6736482 - DNA, 20 bp, Homo sapiens
cccttcatcttcctgtgtcc

SEQ ID NO: 6736483 - DNA, 22 bp, Homo sapiens
cccttcattcagccttgctgac

SEQ ID NO: 6736484 - DNA, 11 bp, Homo sapiens
cccttcatttg

SEQ ID NO: 6736485 - DNA, 18 bp, Homo sapiens
cccttccaaataataaag

SEQ ID NO: 6736486 - DNA, 22 bp, Homo sapiens
cccttccaaatgtccctccaac

SEQ ID NO: 6736487 - DNA, 17 bp, Homo sapiens
cccttccacacccccac

SEQ ID NO: 6736488 - DNA, 16 bp, Homo sapiens
cccttccacagctggc

SEQ ID NO: 6736489 - DNA, 17 bp, Homo sapiens
cccttccacctgctctg

SEQ ID NO: 6736490 - DNA, 16 bp, Homo sapiens
cccttccactgagggc

SEQ ID NO: 6736491 - DNA, 13 bp, Homo sapiens
cccttccactgcc

SEQ ID NO: 6736492 - DNA, 18 bp, Homo sapiens
cccttccactgcctctgc

SEQ ID NO: 6736493 - DNA, 13 bp, Homo sapiens
cccttccagatca

SEQ ID NO: 6736494 - DNA, 19 bp, Homo sapiens
cccttccagcctgggacac

SEQ ID NO: 6736495 - DNA, 23 bp, Homo sapiens
cccttccagcctgggacacacac

SEQ ID NO: 6736496 - DNA, 13 bp, Homo sapiens
cccttccagctcc

SEQ ID NO: 6736497 - DNA, 15 bp, Homo sapiens
cccttccagctccct

SEQ ID NO: 6736498 - DNA, 18 bp, Homo sapiens
cccttccagctccctccc

SEQ ID NO: 6736499 - DNA, 22 bp, Homo sapiens
cccttccagctccctcccctgc

SEQ ID NO: 6736500 - DNA, 12 bp, Homo sapiens
cccttccaggaa

SEQ ID NO: 6736501 - DNA, 14 bp, Homo sapiens
cccttccaggtggg

SEQ ID NO: 6736502 - DNA, 17 bp, Homo sapiens
cccttccatctcttcct

SEQ ID NO: 6736503 - DNA, 23 bp, Homo sapiens
cccttccatctgattccagcaca

SEQ ID NO: 6736504 - DNA, 21 bp, Homo sapiens
cccttccatgccccaggatca

SEQ ID NO: 6736505 - DNA, 20 bp, Homo sapiens
cccttccatgtcgcctctgc

SEQ ID NO: 6736506 - DNA, 17 bp, Homo sapiens
cccttccatgtgccttt

SEQ ID NO: 6736507 - DNA, 20 bp, Homo sapiens
cccttccatgtgcctttctt

SEQ ID NO: 6736508 - DNA, 19 bp, Homo sapiens
cccttccatttctactgta

SEQ ID NO: 6736509 - DNA, 20 bp, Homo sapiens
cccttccatttctgcctttt

SEQ ID NO: 6736510 - DNA, 14 bp, Homo sapiens
cccttcccacgtcc

SEQ ID NO: 6736511 - DNA, 13 bp, Homo sapiens
cccttcccagacc

SEQ ID NO: 6736512 - DNA, 14 bp, Homo sapiens
cccttcccagccct

SEQ ID NO: 6736513 - DNA, 13 bp, Homo sapiens
cccttcccaggcc

SEQ ID NO: 6736514 - DNA, 16 bp, Homo sapiens
cccttcccaggccagc

SEQ ID NO: 6736515 - DNA, 17 bp, Homo sapiens
cccttcccaggccagcg

SEQ ID NO: 6736516 - DNA, 22 bp, Homo sapiens
cccttcccagggcacccaggca

SEQ ID NO: 6736517 - DNA, 18 bp, Homo sapiens
cccttcccatctcttcct

SEQ ID NO: 6736518 - DNA, 15 bp, Homo sapiens
cccttccccactccc

SEQ ID NO: 6736519 - DNA, 16 bp, Homo sapiens
cccttccccactcccg

SEQ ID NO: 6736520 - DNA, 17 bp, Homo sapiens
cccttccccactctgct

SEQ ID NO: 6736521 - DNA, 21 bp, Homo sapiens
cccttccccactgcctgccca

SEQ ID NO: 6736522 - DNA, 11 bp, Homo sapiens
cccttccccat

SEQ ID NO: 6736523 - DNA, 15 bp, Homo sapiens
cccttccccatcctg

SEQ ID NO: 6736524 - DNA, 16 bp, Homo sapiens
cccttccccatcctgg

SEQ ID NO: 6736525 - DNA, 12 bp, Homo sapiens
cccttccccatg

SEQ ID NO: 6736526 - DNA, 15 bp, Homo sapiens
cccttccccatggga

SEQ ID NO: 6736527 - DNA, 21 bp, Homo sapiens
cccttccccatttcctcttcc

SEQ ID NO: 6736528 - DNA, 13 bp, Homo sapiens
cccttcccccacc

SEQ ID NO: 6736529 - DNA, 16 bp, Homo sapiens
cccttcccccagccca

SEQ ID NO: 6736530 - DNA, 21 bp, Homo sapiens
cccttcccccatccctaccac

SEQ ID NO: 6736531 - DNA, 21 bp, Homo sapiens
cccttccccgtcccctgcagc

SEQ ID NO: 6736532 - DNA, 22 bp, Homo sapiens
cccttccccgtcccctgcagcc

SEQ ID NO: 6736533 - DNA, 21 bp, Homo sapiens
cccttcccctaccccctcctc

SEQ ID NO: 6736534 - DNA, 12 bp, Homo sapiens
cccttcccctcc

SEQ ID NO: 6736535 - DNA, 21 bp, Homo sapiens
cccttcccctcccccactcct

SEQ ID NO: 6736536 - DNA, 22 bp, Homo sapiens
cccttcccctcccgacagccca

SEQ ID NO: 6736537 - DNA, 16 bp, Homo sapiens
cccttcccctccctgg

SEQ ID NO: 6736538 - DNA, 19 bp, Homo sapiens
cccttcccctgctgacctt

SEQ ID NO: 6736539 - DNA, 15 bp, Homo sapiens
cccttcccctgggaa

SEQ ID NO: 6736540 - DNA, 19 bp, Homo sapiens
cccttcccctgtgactcct

SEQ ID NO: 6736541 - DNA, 11 bp, Homo sapiens
cccttcccctt

SEQ ID NO: 6736542 - DNA, 18 bp, Homo sapiens
cccttccccttccttctt

SEQ ID NO: 6736543 - DNA, 13 bp, Homo sapiens
cccttccccttct

SEQ ID NO: 6736544 - DNA, 16 bp, Homo sapiens
cccttcccgcctccct

SEQ ID NO: 6736545 - DNA, 19 bp, Homo sapiens
cccttccctataggaacag

SEQ ID NO: 6736546 - DNA, 13 bp, Homo sapiens
cccttccctcacc

SEQ ID NO: 6736547 - DNA, 20 bp, Homo sapiens
cccttccctctctccctgcc

SEQ ID NO: 6736548 - DNA, 14 bp, Homo sapiens
cccttccctctgtt

SEQ ID NO: 6736549 - DNA, 13 bp, Homo sapiens
cccttccctgcaa

SEQ ID NO: 6736550 - DNA, 12 bp, Homo sapiens
cccttccctgcc

SEQ ID NO: 6736551 - DNA, 12 bp, Homo sapiens
cccttccctgct

SEQ ID NO: 6736552 - DNA, 14 bp, Homo sapiens
cccttccctggcag

SEQ ID NO: 6736553 - DNA, 16 bp, Homo sapiens
cccttccctggccccg

SEQ ID NO: 6736554 - DNA, 12 bp, Homo sapiens
cccttccctggg

SEQ ID NO: 6736555 - DNA, 13 bp, Homo sapiens
cccttccctggga

SEQ ID NO: 6736556 - DNA, 12 bp, Homo sapiens
cccttccctggt

SEQ ID NO: 6736557 - DNA, 13 bp, Homo sapiens
cccttccctgtcc

SEQ ID NO: 6736558 - DNA, 15 bp, Homo sapiens
cccttccctgtccct

SEQ ID NO: 6736559 - DNA, 17 bp, Homo sapiens
cccttcccttattttta

SEQ ID NO: 6736560 - DNA, 15 bp, Homo sapiens
cccttccgacaggag

SEQ ID NO: 6736561 - DNA, 18 bp, Homo sapiens
cccttccgacaggagcac

SEQ ID NO: 6736562 - DNA, 21 bp, Homo sapiens
cccttccgaccctctgggaac

SEQ ID NO: 6736563 - DNA, 17 bp, Homo sapiens
cccttccgccttctccc

SEQ ID NO: 6736564 - DNA, 16 bp, Homo sapiens
cccttccggtgcgtgt

SEQ ID NO: 6736565 - DNA, 15 bp, Homo sapiens
cccttccgtccatcc

SEQ ID NO: 6736566 - DNA, 19 bp, Homo sapiens
cccttccgtccatccccct

SEQ ID NO: 6736567 - DNA, 18 bp, Homo sapiens
cccttcctaaatatccaa

SEQ ID NO: 6736568 - DNA, 20 bp, Homo sapiens
cccttcctaattccacagct

SEQ ID NO: 6736569 - DNA, 20 bp, Homo sapiens
cccttcctacagatagtcaa

SEQ ID NO: 6736570 - DNA, 20 bp, Homo sapiens
cccttcctagtgaaccacag

SEQ ID NO: 6736571 - DNA, 13 bp, Homo sapiens
cccttcctcaccc

SEQ ID NO: 6736572 - DNA, 16 bp, Homo sapiens
cccttcctcagcctgg

SEQ ID NO: 6736573 - DNA, 17 bp, Homo sapiens
cccttcctcagcctggg

SEQ ID NO: 6736574 - DNA, 18 bp, Homo sapiens
cccttcctcagcctgggg

SEQ ID NO: 6736575 - DNA, 23 bp, Homo sapiens
cccttcctcatctgtgcctgtct

SEQ ID NO: 6736576 - DNA, 15 bp, Homo sapiens
cccttcctccatcct

SEQ ID NO: 6736577 - DNA, 14 bp, Homo sapiens
cccttcctccccac

SEQ ID NO: 6736578 - DNA, 19 bp, Homo sapiens
cccttcctccccacactcc

SEQ ID NO: 6736579 - DNA, 14 bp, Homo sapiens
cccttcctccctgt

SEQ ID NO: 6736580 - DNA, 21 bp, Homo sapiens
cccttcctccgctcccctttc

SEQ ID NO: 6736581 - DNA, 19 bp, Homo sapiens
cccttcctcctccaccacc

SEQ ID NO: 6736582 - DNA, 17 bp, Homo sapiens
cccttcctcctcctttg

SEQ ID NO: 6736583 - DNA, 13 bp, Homo sapiens
cccttcctcctga

SEQ ID NO: 6736584 - DNA, 20 bp, Homo sapiens
cccttcctcctgatggagtg

SEQ ID NO: 6736585 - DNA, 10 bp, Homo sapiens
cccttcctct

SEQ ID NO: 6736586 - DNA, 14 bp, Homo sapiens
cccttcctctcact

SEQ ID NO: 6736587 - DNA, 18 bp, Homo sapiens
cccttcctctcactcctg

SEQ ID NO: 6736588 - DNA, 17 bp, Homo sapiens
cccttcctctccaccct

SEQ ID NO: 6736589 - DNA, 17 bp, Homo sapiens
cccttcctctccactgc

SEQ ID NO: 6736590 - DNA, 21 bp, Homo sapiens
cccttcctctccactgccttc

SEQ ID NO: 6736591 - DNA, 15 bp, Homo sapiens
cccttcctctcccat

SEQ ID NO: 6736592 - DNA, 13 bp, Homo sapiens
cccttcctctgct

SEQ ID NO: 6736593 - DNA, 12 bp, Homo sapiens
cccttcctcttc

SEQ ID NO: 6736594 - DNA, 16 bp, Homo sapiens
cccttcctcttcctgc

SEQ ID NO: 6736595 - DNA, 17 bp, Homo sapiens
cccttcctcttcctgcc

SEQ ID NO: 6736596 - DNA, 21 bp, Homo sapiens
cccttcctcttcctgcccttg

SEQ ID NO: 6736597 - DNA, 12 bp, Homo sapiens
cccttcctgacc

SEQ ID NO: 6736598 - DNA, 13 bp, Homo sapiens
cccttcctgcacc

SEQ ID NO: 6736599 - DNA, 14 bp, Homo sapiens
cccttcctgcaccc

SEQ ID NO: 6736600 - DNA, 12 bp, Homo sapiens
cccttcctgcca

SEQ ID NO: 6736601 - DNA, 22 bp, Homo sapiens
cccttcctgctgcgcagttctc

SEQ ID NO: 6736602 - DNA, 15 bp, Homo sapiens
cccttcctggaaaca

SEQ ID NO: 6736603 - DNA, 21 bp, Homo sapiens
cccttcctggaaacagcatga

SEQ ID NO: 6736604 - DNA, 16 bp, Homo sapiens
cccttcctggacagct

SEQ ID NO: 6736605 - DNA, 19 bp, Homo sapiens
cccttcctggacagctgtg

SEQ ID NO: 6736606 - DNA, 22 bp, Homo sapiens
cccttcctggacagctgtgcct

SEQ ID NO: 6736607 - DNA, 21 bp, Homo sapiens
cccttcctggactggcccttg

SEQ ID NO: 6736608 - DNA, 21 bp, Homo sapiens
cccttcctggaggctgcctat

SEQ ID NO: 6736609 - DNA, 14 bp, Homo sapiens
cccttcctggcctc

SEQ ID NO: 6736610 - DNA, 16 bp, Homo sapiens
cccttcctggctagga

SEQ ID NO: 6736611 - DNA, 14 bp, Homo sapiens
cccttcctgggtat

SEQ ID NO: 6736612 - DNA, 20 bp, Homo sapiens
cccttcctgtccccagggga

SEQ ID NO: 6736613 - DNA, 20 bp, Homo sapiens
cccttcctgtcctgcctcct

SEQ ID NO: 6736614 - DNA, 18 bp, Homo sapiens
cccttcctgtcctgctca

SEQ ID NO: 6736615 - DNA, 21 bp, Homo sapiens
cccttcctgtcctgctcacgt

SEQ ID NO: 6736616 - DNA, 15 bp, Homo sapiens
cccttcctgtctggc

SEQ ID NO: 6736617 - DNA, 11 bp, Homo sapiens
cccttcctgtg

SEQ ID NO: 6736618 - DNA, 21 bp, Homo sapiens
cccttcctgttccctcctggt

SEQ ID NO: 6736619 - DNA, 17 bp, Homo sapiens
cccttcctgttcttcct

SEQ ID NO: 6736620 - DNA, 15 bp, Homo sapiens
cccttccttccattt

SEQ ID NO: 6736621 - DNA, 11 bp, Homo sapiens
cccttccttct

SEQ ID NO: 6736622 - DNA, 11 bp, Homo sapiens
cccttccttta

SEQ ID NO: 6736623 - DNA, 14 bp, Homo sapiens
cccttcctttcctc

SEQ ID NO: 6736624 - DNA, 12 bp, Homo sapiens
cccttcctttct

SEQ ID NO: 6736625 - DNA, 21 bp, Homo sapiens
cccttcctttggtgcctcact

SEQ ID NO: 6736626 - DNA, 18 bp, Homo sapiens
cccttccttttccctgct

SEQ ID NO: 6736627 - DNA, 22 bp, Homo sapiens
cccttccttttccctgcttcca

SEQ ID NO: 6736628 - DNA, 21 bp, Homo sapiens
cccttcgacatgctgccagga

SEQ ID NO: 6736629 - DNA, 13 bp, Homo sapiens
cccttcgctcctg

SEQ ID NO: 6736630 - DNA, 15 bp, Homo sapiens
cccttcgctcctgtg

SEQ ID NO: 6736631 - DNA, 18 bp, Homo sapiens
cccttcgctcctgtgtct

SEQ ID NO: 6736632 - DNA, 13 bp, Homo sapiens
cccttcgctgcca

SEQ ID NO: 6736633 - DNA, 14 bp, Homo sapiens
cccttcgctgccag

SEQ ID NO: 6736634 - DNA, 20 bp, Homo sapiens
cccttcgctgccaggacacc

SEQ ID NO: 6736635 - DNA, 21 bp, Homo sapiens
cccttcgctgccaggacacct

SEQ ID NO: 6736636 - DNA, 14 bp, Homo sapiens
cccttcgggagggc

SEQ ID NO: 6736637 - DNA, 14 bp, Homo sapiens
cccttcgtgtgtgc

SEQ ID NO: 6736638 - DNA, 17 bp, Homo sapiens
cccttctacaaaagaag

SEQ ID NO: 6736639 - DNA, 15 bp, Homo sapiens
cccttctacaaggac

SEQ ID NO: 6736640 - DNA, 14 bp, Homo sapiens
cccttctacactct

SEQ ID NO: 6736641 - DNA, 17 bp, Homo sapiens
cccttctacactctcct

SEQ ID NO: 6736642 - DNA, 18 bp, Homo sapiens
cccttctacactctcctg

SEQ ID NO: 6736643 - DNA, 17 bp, Homo sapiens
cccttctaccccacctg

SEQ ID NO: 6736644 - DNA, 16 bp, Homo sapiens
cccttctacctgccac

SEQ ID NO: 6736645 - DNA, 18 bp, Homo sapiens
cccttctactgcttctac

SEQ ID NO: 6736646 - DNA, 21 bp, Homo sapiens
cccttctactttttccttcct

SEQ ID NO: 6736647 - DNA, 20 bp, Homo sapiens
cccttctaggggcaggtgaa

SEQ ID NO: 6736648 - DNA, 23 bp, Homo sapiens
cccttctagggttattgcatttg

SEQ ID NO: 6736649 - DNA, 19 bp, Homo sapiens
cccttctatacccacccag

SEQ ID NO: 6736650 - DNA, 20 bp, Homo sapiens
cccttctatactttctcaca

SEQ ID NO: 6736651 - DNA, 23 bp, Homo sapiens
cccttctatgcagtattgccaca

SEQ ID NO: 6736652 - DNA, 13 bp, Homo sapiens
cccttctcacagc

SEQ ID NO: 6736653 - DNA, 19 bp, Homo sapiens
cccttctcacagcacatgc

SEQ ID NO: 6736654 - DNA, 22 bp, Homo sapiens
cccttctcagaaaacttctctt

SEQ ID NO: 6736655 - DNA, 10 bp, Homo sapiens
cccttctcca

SEQ ID NO: 6736656 - DNA, 13 bp, Homo sapiens
cccttctccagca

SEQ ID NO: 6736657 - DNA, 21 bp, Homo sapiens
cccttctccatctctctggcc

SEQ ID NO: 6736658 - DNA, 17 bp, Homo sapiens
cccttctccccagccag

SEQ ID NO: 6736659 - DNA, 22 bp, Homo sapiens
cccttctccccagccagaggtg

SEQ ID NO: 6736660 - DNA, 14 bp, Homo sapiens
cccttctccccctt

SEQ ID NO: 6736661 - DNA, 15 bp, Homo sapiens
cccttctcccctcag

SEQ ID NO: 6736662 - DNA, 16 bp, Homo sapiens
cccttctcccctgccc

SEQ ID NO: 6736663 - DNA, 16 bp, Homo sapiens
cccttctcccggccct

SEQ ID NO: 6736664 - DNA, 17 bp, Homo sapiens
cccttctcccttgccct

SEQ ID NO: 6736665 - DNA, 16 bp, Homo sapiens
cccttctcctttcctt

SEQ ID NO: 6736666 - DNA, 18 bp, Homo sapiens
cccttctcctttccttcc

SEQ ID NO: 6736667 - DNA, 15 bp, Homo sapiens
cccttctctcatctc

SEQ ID NO: 6736668 - DNA, 19 bp, Homo sapiens
cccttctctccagcccctg

SEQ ID NO: 6736669 - DNA, 21 bp, Homo sapiens
cccttctctccagcccctgga

SEQ ID NO: 6736670 - DNA, 12 bp, Homo sapiens
cccttctctctc

SEQ ID NO: 6736671 - DNA, 17 bp, Homo sapiens
cccttctctctccagaa

SEQ ID NO: 6736672 - DNA, 14 bp, Homo sapiens
cccttctctgctcc

SEQ ID NO: 6736673 - DNA, 16 bp, Homo sapiens
cccttctctgctccac

SEQ ID NO: 6736674 - DNA, 13 bp, Homo sapiens
cccttctctgtga

SEQ ID NO: 6736675 - DNA, 19 bp, Homo sapiens
cccttctctgtgacccact

SEQ ID NO: 6736676 - DNA, 14 bp, Homo sapiens
cccttctcttccag

SEQ ID NO: 6736677 - DNA, 17 bp, Homo sapiens
cccttctcttccaggca

SEQ ID NO: 6736678 - DNA, 15 bp, Homo sapiens
cccttctgaagcaga

SEQ ID NO: 6736679 - DNA, 17 bp, Homo sapiens
cccttctgaagcagaga

SEQ ID NO: 6736680 - DNA, 22 bp, Homo sapiens
cccttctgacccatgctgccct

SEQ ID NO: 6736681 - DNA, 15 bp, Homo sapiens
cccttctgactgttt

SEQ ID NO: 6736682 - DNA, 23 bp, Homo sapiens
cccttctgctcagctctgggcca

SEQ ID NO: 6736683 - DNA, 14 bp, Homo sapiens
cccttctgctttct

SEQ ID NO: 6736684 - DNA, 20 bp, Homo sapiens
cccttctgggcatctgttct

SEQ ID NO: 6736685 - DNA, 22 bp, Homo sapiens
cccttctgggcatctgttctgg

SEQ ID NO: 6736686 - DNA, 19 bp, Homo sapiens
cccttctgggcttcattct

SEQ ID NO: 6736687 - DNA, 16 bp, Homo sapiens
cccttctgtctgtaag

SEQ ID NO: 6736688 - DNA, 14 bp, Homo sapiens
cccttctgtgccca

SEQ ID NO: 6736689 - DNA, 18 bp, Homo sapiens
cccttctgtgcccagctc

SEQ ID NO: 6736690 - DNA, 20 bp, Homo sapiens
cccttctgtgcccagctcag

SEQ ID NO: 6736691 - DNA, 12 bp, Homo sapiens
cccttcttcatg

SEQ ID NO: 6736692 - DNA, 19 bp, Homo sapiens
cccttcttccaaggagcag

SEQ ID NO: 6736693 - DNA, 13 bp, Homo sapiens
cccttcttgccat

SEQ ID NO: 6736694 - DNA, 19 bp, Homo sapiens
cccttcttgcctgctgggc

SEQ ID NO: 6736695 - DNA, 17 bp, Homo sapiens
cccttcttgtgtcctgg

SEQ ID NO: 6736696 - DNA, 17 bp, Homo sapiens
cccttctttccacagaa

SEQ ID NO: 6736697 - DNA, 13 bp, Homo sapiens
cccttctttcctc

SEQ ID NO: 6736698 - DNA, 15 bp, Homo sapiens
cccttctttccttcc

SEQ ID NO: 6736699 - DNA, 18 bp, Homo sapiens
cccttctttgctgctgct

SEQ ID NO: 6736700 - DNA, 19 bp, Homo sapiens
cccttctttgcttcttttt

SEQ ID NO: 6736701 - DNA, 15 bp, Homo sapiens
cccttcttttatgag

SEQ ID NO: 6736702 - DNA, 23 bp, Homo sapiens
cccttctttttccctttcctttc

SEQ ID NO: 6736703 - DNA, 14 bp, Homo sapiens
cccttgaaaactct

SEQ ID NO: 6736704 - DNA, 21 bp, Homo sapiens
cccttgaaagtcatgaacaca

SEQ ID NO: 6736705 - DNA, 12 bp, Homo sapiens
cccttgaactct

SEQ ID NO: 6736706 - DNA, 14 bp, Homo sapiens
cccttgaaggaaga

SEQ ID NO: 6736707 - DNA, 20 bp, Homo sapiens
cccttgaagttgtggaggag

SEQ ID NO: 6736708 - DNA, 15 bp, Homo sapiens
cccttgacaccgggg

SEQ ID NO: 6736709 - DNA, 15 bp, Homo sapiens
cccttgacctgctga

SEQ ID NO: 6736710 - DNA, 18 bp, Homo sapiens
cccttgactgtacagaga

SEQ ID NO: 6736711 - DNA, 23 bp, Homo sapiens
cccttgactgtacagagactcta

SEQ ID NO: 6736712 - DNA, 14 bp, Homo sapiens
cccttgactgttat

SEQ ID NO: 6736713 - DNA, 17 bp, Homo sapiens
cccttgactttgctcct

SEQ ID NO: 6736714 - DNA, 14 bp, Homo sapiens
cccttgagaaacct

SEQ ID NO: 6736715 - DNA, 18 bp, Homo sapiens
cccttgagacctcagcca

SEQ ID NO: 6736716 - DNA, 14 bp, Homo sapiens
cccttgagccctcc

SEQ ID NO: 6736717 - DNA, 17 bp, Homo sapiens
cccttgagccctctatg

SEQ ID NO: 6736718 - DNA, 11 bp, Homo sapiens
cccttgagctc

SEQ ID NO: 6736719 - DNA, 13 bp, Homo sapiens
cccttgagggaga

SEQ ID NO: 6736720 - DNA, 18 bp, Homo sapiens
cccttgaggggccccagc

SEQ ID NO: 6736721 - DNA, 15 bp, Homo sapiens
cccttgaggtctcag

SEQ ID NO: 6736722 - DNA, 19 bp, Homo sapiens
cccttgagtaggccctgct

SEQ ID NO: 6736723 - DNA, 16 bp, Homo sapiens
cccttgagtccccatt

SEQ ID NO: 6736724 - DNA, 19 bp, Homo sapiens
cccttgatcgacttcttgg

SEQ ID NO: 6736725 - DNA, 16 bp, Homo sapiens
cccttgatgaagaagt

SEQ ID NO: 6736726 - DNA, 20 bp, Homo sapiens
cccttgatttaaacacacag

SEQ ID NO: 6736727 - DNA, 17 bp, Homo sapiens
cccttgcaagccataac

SEQ ID NO: 6736728 - DNA, 14 bp, Homo sapiens
cccttgcacaggcc

SEQ ID NO: 6736729 - DNA, 22 bp, Homo sapiens
cccttgcacaggccacttgctc

SEQ ID NO: 6736730 - DNA, 16 bp, Homo sapiens
cccttgcagctagttt

SEQ ID NO: 6736731 - DNA, 19 bp, Homo sapiens
cccttgcagctagttttct

SEQ ID NO: 6736732 - DNA, 22 bp, Homo sapiens
cccttgcaggggtcccccctca

SEQ ID NO: 6736733 - DNA, 14 bp, Homo sapiens
cccttgcagggtgg

SEQ ID NO: 6736734 - DNA, 19 bp, Homo sapiens
cccttgcagttcagcacca

SEQ ID NO: 6736735 - DNA, 14 bp, Homo sapiens
cccttgccaaggcc

SEQ ID NO: 6736736 - DNA, 15 bp, Homo sapiens
cccttgccaaggccg

SEQ ID NO: 6736737 - DNA, 18 bp, Homo sapiens
cccttgccaccccaccct

SEQ ID NO: 6736738 - DNA, 15 bp, Homo sapiens
cccttgccactttgc

SEQ ID NO: 6736739 - DNA, 13 bp, Homo sapiens
cccttgccagaca

SEQ ID NO: 6736740 - DNA, 15 bp, Homo sapiens
cccttgccagacatg

SEQ ID NO: 6736741 - DNA, 21 bp, Homo sapiens
cccttgccagctgctgagccg

SEQ ID NO: 6736742 - DNA, 21 bp, Homo sapiens
cccttgccatcccaagcccag

SEQ ID NO: 6736743 - DNA, 20 bp, Homo sapiens
cccttgcccaactcccagcc

SEQ ID NO: 6736744 - DNA, 15 bp, Homo sapiens
cccttgcccagggct

SEQ ID NO: 6736745 - DNA, 19 bp, Homo sapiens
cccttgcccatgctgggct

SEQ ID NO: 6736746 - DNA, 18 bp, Homo sapiens
cccttgccccaggccagg

SEQ ID NO: 6736747 - DNA, 15 bp, Homo sapiens
cccttgcccccatcc

SEQ ID NO: 6736748 - DNA, 18 bp, Homo sapiens
cccttgcccccatccctc

SEQ ID NO: 6736749 - DNA, 22 bp, Homo sapiens
cccttgcccccctggcctcccc

SEQ ID NO: 6736750 - DNA, 19 bp, Homo sapiens
cccttgcccgccagccagt

SEQ ID NO: 6736751 - DNA, 17 bp, Homo sapiens
cccttgccctccgcctg

SEQ ID NO: 6736752 - DNA, 16 bp, Homo sapiens
cccttgccctgacctc

SEQ ID NO: 6736753 - DNA, 19 bp, Homo sapiens
cccttgccctgacctccca

SEQ ID NO: 6736754 - DNA, 15 bp, Homo sapiens
cccttgcccttcctg

SEQ ID NO: 6736755 - DNA, 19 bp, Homo sapiens
cccttgcccttcctgaccc

SEQ ID NO: 6736756 - DNA, 14 bp, Homo sapiens
cccttgcccttgga

SEQ ID NO: 6736757 - DNA, 16 bp, Homo sapiens
cccttgccctttccat

SEQ ID NO: 6736758 - DNA, 21 bp, Homo sapiens
cccttgccgccccgtgcctgt

SEQ ID NO: 6736759 - DNA, 15 bp, Homo sapiens
cccttgccggggcct

SEQ ID NO: 6736760 - DNA, 22 bp, Homo sapiens
cccttgccgtctacctgagggg

SEQ ID NO: 6736761 - DNA, 12 bp, Homo sapiens
cccttgcctccc

SEQ ID NO: 6736762 - DNA, 20 bp, Homo sapiens
cccttgcctccccatttccc

SEQ ID NO: 6736763 - DNA, 23 bp, Homo sapiens
cccttgcctccccatttcccatc

SEQ ID NO: 6736764 - DNA, 22 bp, Homo sapiens
cccttgcctctgccctggattg

SEQ ID NO: 6736765 - DNA, 20 bp, Homo sapiens
cccttgcctgcctcctaggc

SEQ ID NO: 6736766 - DNA, 22 bp, Homo sapiens
cccttgccttatgggctgaagt

SEQ ID NO: 6736767 - DNA, 14 bp, Homo sapiens
cccttgccttcccc

SEQ ID NO: 6736768 - DNA, 21 bp, Homo sapiens
cccttgcctttcgaggcctga

SEQ ID NO: 6736769 - DNA, 22 bp, Homo sapiens
cccttgctaccacggcctcctt

SEQ ID NO: 6736770 - DNA, 16 bp, Homo sapiens
cccttgctcagtgcct

SEQ ID NO: 6736771 - DNA, 19 bp, Homo sapiens
cccttgctcatgagctcct

SEQ ID NO: 6736772 - DNA, 17 bp, Homo sapiens
cccttgctccagcctga

SEQ ID NO: 6736773 - DNA, 13 bp, Homo sapiens
cccttgctctctg

SEQ ID NO: 6736774 - DNA, 17 bp, Homo sapiens
cccttgctctctgttct

SEQ ID NO: 6736775 - DNA, 20 bp, Homo sapiens
cccttgctgacatggctttg

SEQ ID NO: 6736776 - DNA, 13 bp, Homo sapiens
cccttgctgctgg

SEQ ID NO: 6736777 - DNA, 21 bp, Homo sapiens
cccttgctggccccagccctg

SEQ ID NO: 6736778 - DNA, 24 bp, Homo sapiens
cccttgctggccccagccctgctg

SEQ ID NO: 6736779 - DNA, 14 bp, Homo sapiens
cccttgctgggcct

SEQ ID NO: 6736780 - DNA, 17 bp, Homo sapiens
cccttgctgggcctggg

SEQ ID NO: 6736781 - DNA, 18 bp, Homo sapiens
cccttgctgggcctgggg

SEQ ID NO: 6736782 - DNA, 17 bp, Homo sapiens
cccttgctgggtccagg

SEQ ID NO: 6736783 - DNA, 23 bp, Homo sapiens
cccttgcttgcctgcagggccat

SEQ ID NO: 6736784 - DNA, 19 bp, Homo sapiens
cccttgctttgttttaata

SEQ ID NO: 6736785 - DNA, 11 bp, Homo sapiens
cccttgctttt

SEQ ID NO: 6736786 - DNA, 17 bp, Homo sapiens
cccttggaaacctgccc

SEQ ID NO: 6736787 - DNA, 19 bp, Homo sapiens
cccttggaaagttcagcca

SEQ ID NO: 6736788 - DNA, 20 bp, Homo sapiens
cccttggaaagttcagccag

SEQ ID NO: 6736789 - DNA, 19 bp, Homo sapiens
cccttggaaatgtctgctg

SEQ ID NO: 6736790 - DNA, 16 bp, Homo sapiens
cccttggacacgctca

SEQ ID NO: 6736791 - DNA, 19 bp, Homo sapiens
cccttggacctccaggggc

SEQ ID NO: 6736792 - DNA, 16 bp, Homo sapiens
cccttggacttgagga

SEQ ID NO: 6736793 - DNA, 17 bp, Homo sapiens
cccttggagccttccac

SEQ ID NO: 6736794 - DNA, 17 bp, Homo sapiens
cccttggaggctgtctt

SEQ ID NO: 6736795 - DNA, 20 bp, Homo sapiens
cccttggagggagaggtggc

SEQ ID NO: 6736796 - DNA, 19 bp, Homo sapiens
cccttggccacggcctggg

SEQ ID NO: 6736797 - DNA, 22 bp, Homo sapiens
cccttggcccatcccgccttct

SEQ ID NO: 6736798 - DNA, 14 bp, Homo sapiens
cccttggccccaga

SEQ ID NO: 6736799 - DNA, 13 bp, Homo sapiens
cccttggcctcag

SEQ ID NO: 6736800 - DNA, 19 bp, Homo sapiens
cccttggcctgtctcatcc

SEQ ID NO: 6736801 - DNA, 23 bp, Homo sapiens
cccttggcgggcagcccagcctc

SEQ ID NO: 6736802 - DNA, 15 bp, Homo sapiens
cccttggctcaatcc

SEQ ID NO: 6736803 - DNA, 13 bp, Homo sapiens
cccttggctgcag

SEQ ID NO: 6736804 - DNA, 14 bp, Homo sapiens
cccttggctgtgag

SEQ ID NO: 6736805 - DNA, 14 bp, Homo sapiens
cccttggcttcctc

SEQ ID NO: 6736806 - DNA, 18 bp, Homo sapiens
cccttggcttcctccgtc

SEQ ID NO: 6736807 - DNA, 15 bp, Homo sapiens
cccttggcttctgct

SEQ ID NO: 6736808 - DNA, 20 bp, Homo sapiens
cccttgggaaggacacagca

SEQ ID NO: 6736809 - DNA, 23 bp, Homo sapiens
cccttgggcagagtcctgccttc

SEQ ID NO: 6736810 - DNA, 15 bp, Homo sapiens
cccttgggcagttct

SEQ ID NO: 6736811 - DNA, 19 bp, Homo sapiens
cccttgggcatccacccag

SEQ ID NO: 6736812 - DNA, 23 bp, Homo sapiens
cccttgggcatccacccagtgct

SEQ ID NO: 6736813 - DNA, 15 bp, Homo sapiens
cccttgggccagaag

SEQ ID NO: 6736814 - DNA, 16 bp, Homo sapiens
cccttgggccagaagt

SEQ ID NO: 6736815 - DNA, 21 bp, Homo sapiens
cccttgggccagaagtaccag

SEQ ID NO: 6736816 - DNA, 15 bp, Homo sapiens
cccttgggcccacac

SEQ ID NO: 6736817 - DNA, 16 bp, Homo sapiens
cccttgggcctcccac

SEQ ID NO: 6736818 - DNA, 22 bp, Homo sapiens
cccttgggcctccccccagccc

SEQ ID NO: 6736819 - DNA, 18 bp, Homo sapiens
cccttgggcggctgagag

SEQ ID NO: 6736820 - DNA, 18 bp, Homo sapiens
cccttggggagcaggctc

SEQ ID NO: 6736821 - DNA, 14 bp, Homo sapiens
cccttggggcctgg

SEQ ID NO: 6736822 - DNA, 21 bp, Homo sapiens
cccttgggggtcctcctccag

SEQ ID NO: 6736823 - DNA, 22 bp, Homo sapiens
cccttgggggtcctcctccagg

SEQ ID NO: 6736824 - DNA, 23 bp, Homo sapiens
cccttgggggtcctcctccaggg

SEQ ID NO: 6736825 - DNA, 22 bp, Homo sapiens
cccttggggtaagccagagcct

SEQ ID NO: 6736826 - DNA, 18 bp, Homo sapiens
cccttggtagagtttatt

SEQ ID NO: 6736827 - DNA, 17 bp, Homo sapiens
cccttggtagcagcctg

SEQ ID NO: 6736828 - DNA, 16 bp, Homo sapiens
cccttggtcctggcag

SEQ ID NO: 6736829 - DNA, 16 bp, Homo sapiens
cccttggtctcatgcc

SEQ ID NO: 6736830 - DNA, 14 bp, Homo sapiens
cccttggttctgca

SEQ ID NO: 6736831 - DNA, 22 bp, Homo sapiens
cccttgtacagtgtctgtgcca

SEQ ID NO: 6736832 - DNA, 16 bp, Homo sapiens
cccttgtaccccatcc

SEQ ID NO: 6736833 - DNA, 19 bp, Homo sapiens
cccttgtaccccatccctt

SEQ ID NO: 6736834 - DNA, 21 bp, Homo sapiens
cccttgtagctcctcccctgg

SEQ ID NO: 6736835 - DNA, 21 bp, Homo sapiens
cccttgtattttgttaaagct

SEQ ID NO: 6736836 - DNA, 15 bp, Homo sapiens
cccttgtcccactca

SEQ ID NO: 6736837 - DNA, 14 bp, Homo sapiens
cccttgtccctttt

SEQ ID NO: 6736838 - DNA, 20 bp, Homo sapiens
cccttgtcctctcagagcct

SEQ ID NO: 6736839 - DNA, 16 bp, Homo sapiens
cccttgtcctctcccg

SEQ ID NO: 6736840 - DNA, 14 bp, Homo sapiens
cccttgtcctgcca

SEQ ID NO: 6736841 - DNA, 19 bp, Homo sapiens
cccttgtcggccccaccag

SEQ ID NO: 6736842 - DNA, 16 bp, Homo sapiens
cccttgtctccctggt

SEQ ID NO: 6736843 - DNA, 15 bp, Homo sapiens
cccttgtctgctgct

SEQ ID NO: 6736844 - DNA, 22 bp, Homo sapiens
cccttgtgcattgtgtgtcaca

SEQ ID NO: 6736845 - DNA, 17 bp, Homo sapiens
cccttgtgcgtgggtga

SEQ ID NO: 6736846 - DNA, 23 bp, Homo sapiens
cccttgtgcgtgggtgaagccgc

SEQ ID NO: 6736847 - DNA, 10 bp, Homo sapiens
cccttgtggg

SEQ ID NO: 6736848 - DNA, 14 bp, Homo sapiens
cccttgtgtcagag

SEQ ID NO: 6736849 - DNA, 12 bp, Homo sapiens
cccttgtgtctg

SEQ ID NO: 6736850 - DNA, 19 bp, Homo sapiens
cccttgtgtgtaccacacc

SEQ ID NO: 6736851 - DNA, 23 bp, Homo sapiens
cccttgtgtgtaccacaccctgc

SEQ ID NO: 6736852 - DNA, 23 bp, Homo sapiens
cccttgtgtgtgccctgggccag

SEQ ID NO: 6736853 - DNA, 14 bp, Homo sapiens
cccttgtgttcctt

SEQ ID NO: 6736854 - DNA, 19 bp, Homo sapiens
cccttgtgttccttctgtg

SEQ ID NO: 6736855 - DNA, 20 bp, Homo sapiens
cccttgtgttccttctgtga

SEQ ID NO: 6736856 - DNA, 19 bp, Homo sapiens
cccttgttgcactgccccc

SEQ ID NO: 6736857 - DNA, 21 bp, Homo sapiens
cccttgttgtaaaaagcccag

SEQ ID NO: 6736858 - DNA, 20 bp, Homo sapiens
cccttgtttggggcaggagt

SEQ ID NO: 6736859 - DNA, 15 bp, Homo sapiens
cccttgttttgaaac

SEQ ID NO: 6736860 - DNA, 15 bp, Homo sapiens
ccctttaagccaaga

SEQ ID NO: 6736861 - DNA, 15 bp, Homo sapiens
ccctttactcagccc

SEQ ID NO: 6736862 - DNA, 23 bp, Homo sapiens
ccctttagcacgtttaaagttct

SEQ ID NO: 6736863 - DNA, 21 bp, Homo sapiens
ccctttagccaaacccttgtc

SEQ ID NO: 6736864 - DNA, 18 bp, Homo sapiens
ccctttagctaagcacag

SEQ ID NO: 6736865 - DNA, 17 bp, Homo sapiens
ccctttagggctgttgc

SEQ ID NO: 6736866 - DNA, 10 bp, Homo sapiens
ccctttcaca

SEQ ID NO: 6736867 - DNA, 16 bp, Homo sapiens
ccctttcacactggat

SEQ ID NO: 6736868 - DNA, 18 bp, Homo sapiens
ccctttcacactgtggtg

SEQ ID NO: 6736869 - DNA, 16 bp, Homo sapiens
ccctttcagagacagc

SEQ ID NO: 6736870 - DNA, 20 bp, Homo sapiens
ccctttcagatgtcttctgc

SEQ ID NO: 6736871 - DNA, 20 bp, Homo sapiens
ccctttcatcggtgcctggt

SEQ ID NO: 6736872 - DNA, 20 bp, Homo sapiens
ccctttcccaccccaacctg

SEQ ID NO: 6736873 - DNA, 20 bp, Homo sapiens
ccctttccccacgcccaccc

SEQ ID NO: 6736874 - DNA, 14 bp, Homo sapiens
ccctttccccactc

SEQ ID NO: 6736875 - DNA, 16 bp, Homo sapiens
ccctttccccactcag

SEQ ID NO: 6736876 - DNA, 21 bp, Homo sapiens
ccctttcccccaccccagagt

SEQ ID NO: 6736877 - DNA, 14 bp, Homo sapiens
ccctttcccctaga

SEQ ID NO: 6736878 - DNA, 12 bp, Homo sapiens
ccctttcccggg

SEQ ID NO: 6736879 - DNA, 15 bp, Homo sapiens
ccctttccctcgcta

SEQ ID NO: 6736880 - DNA, 12 bp, Homo sapiens
ccctttccctgc

SEQ ID NO: 6736881 - DNA, 14 bp, Homo sapiens
ccctttccctgcat

SEQ ID NO: 6736882 - DNA, 15 bp, Homo sapiens
ccctttccctgcatc

SEQ ID NO: 6736883 - DNA, 14 bp, Homo sapiens
ccctttcctaggcc

SEQ ID NO: 6736884 - DNA, 20 bp, Homo sapiens
ccctttcctaggcccaggcc

SEQ ID NO: 6736885 - DNA, 13 bp, Homo sapiens
ccctttcctcccc

SEQ ID NO: 6736886 - DNA, 22 bp, Homo sapiens
ccctttcctccccatacacaca

SEQ ID NO: 6736887 - DNA, 14 bp, Homo sapiens
ccctttcctcctca

SEQ ID NO: 6736888 - DNA, 12 bp, Homo sapiens
ccctttcctggc

SEQ ID NO: 6736889 - DNA, 15 bp, Homo sapiens
ccctttcctggcagt

SEQ ID NO: 6736890 - DNA, 12 bp, Homo sapiens
ccctttcctgtc

SEQ ID NO: 6736891 - DNA, 20 bp, Homo sapiens
ccctttccttcactgcccca

SEQ ID NO: 6736892 - DNA, 13 bp, Homo sapiens
ccctttccttcca

SEQ ID NO: 6736893 - DNA, 18 bp, Homo sapiens
ccctttccttccatccct

SEQ ID NO: 6736894 - DNA, 14 bp, Homo sapiens
ccctttccttgcct

SEQ ID NO: 6736895 - DNA, 14 bp, Homo sapiens
ccctttcctttgga

SEQ ID NO: 6736896 - DNA, 18 bp, Homo sapiens
ccctttcggatccaggga

SEQ ID NO: 6736897 - DNA, 14 bp, Homo sapiens
ccctttctaagcag

SEQ ID NO: 6736898 - DNA, 16 bp, Homo sapiens
ccctttctagaccaat

SEQ ID NO: 6736899 - DNA, 9 bp, Homo sapiens
ccctttctc

SEQ ID NO: 6736900 - DNA, 17 bp, Homo sapiens
ccctttctccagccctg

SEQ ID NO: 6736901 - DNA, 14 bp, Homo sapiens
ccctttctcccctg

SEQ ID NO: 6736902 - DNA, 13 bp, Homo sapiens
ccctttctctctc

SEQ ID NO: 6736903 - DNA, 14 bp, Homo sapiens
ccctttctctctcc

SEQ ID NO: 6736904 - DNA, 23 bp, Homo sapiens
ccctttctctctcctctctgctt

SEQ ID NO: 6736905 - DNA, 17 bp, Homo sapiens
ccctttctctgcctggc

SEQ ID NO: 6736906 - DNA, 19 bp, Homo sapiens
ccctttctctgcctggcaa

SEQ ID NO: 6736907 - DNA, 14 bp, Homo sapiens
ccctttctcttctt

SEQ ID NO: 6736908 - DNA, 15 bp, Homo sapiens
ccctttctcttgctg

SEQ ID NO: 6736909 - DNA, 14 bp, Homo sapiens
ccctttctgccagg

SEQ ID NO: 6736910 - DNA, 15 bp, Homo sapiens
ccctttctgtcccac

SEQ ID NO: 6736911 - DNA, 12 bp, Homo sapiens
ccctttctgtgt

SEQ ID NO: 6736912 - DNA, 19 bp, Homo sapiens
ccctttcttccccaccctg

SEQ ID NO: 6736913 - DNA, 21 bp, Homo sapiens
ccctttcttctcccccatcct

SEQ ID NO: 6736914 - DNA, 15 bp, Homo sapiens
ccctttcttggccag

SEQ ID NO: 6736915 - DNA, 21 bp, Homo sapiens
ccctttgaagcctcagctacc

SEQ ID NO: 6736916 - DNA, 18 bp, Homo sapiens
ccctttgcacctgagacc

SEQ ID NO: 6736917 - DNA, 20 bp, Homo sapiens
ccctttgcaggcccagcaga

SEQ ID NO: 6736918 - DNA, 22 bp, Homo sapiens
ccctttgcatagctctccttcc

SEQ ID NO: 6736919 - DNA, 21 bp, Homo sapiens
ccctttgcatcgtcccctccc

SEQ ID NO: 6736920 - DNA, 14 bp, Homo sapiens
ccctttgccagcca

SEQ ID NO: 6736921 - DNA, 17 bp, Homo sapiens
ccctttgcccagaaaga

SEQ ID NO: 6736922 - DNA, 20 bp, Homo sapiens
ccctttgctctgatttcctt

SEQ ID NO: 6736923 - DNA, 24 bp, Homo sapiens
ccctttggagaacgccagtctccc

SEQ ID NO: 6736924 - DNA, 23 bp, Homo sapiens
ccctttggagatgctgagggtgt

SEQ ID NO: 6736925 - DNA, 20 bp, Homo sapiens
ccctttgggaggctgaggcg

SEQ ID NO: 6736926 - DNA, 18 bp, Homo sapiens
ccctttgggcccagggac

SEQ ID NO: 6736927 - DNA, 22 bp, Homo sapiens
ccctttggggagcaggaggcca

SEQ ID NO: 6736928 - DNA, 13 bp, Homo sapiens
ccctttggggata

SEQ ID NO: 6736929 - DNA, 22 bp, Homo sapiens
ccctttggggatagtctggaaa

SEQ ID NO: 6736930 - DNA, 22 bp, Homo sapiens
ccctttggggttgcccagcctg

SEQ ID NO: 6736931 - DNA, 23 bp, Homo sapiens
ccctttgggtactactgctgcaa

SEQ ID NO: 6736932 - DNA, 16 bp, Homo sapiens
ccctttggtttgacaa

SEQ ID NO: 6736933 - DNA, 17 bp, Homo sapiens
ccctttggtttgacaat

SEQ ID NO: 6736934 - DNA, 19 bp, Homo sapiens
ccctttggtttggcctcca

SEQ ID NO: 6736935 - DNA, 21 bp, Homo sapiens
ccctttgtattataattgttg

SEQ ID NO: 6736936 - DNA, 22 bp, Homo sapiens
ccctttgtcctcctgctgccag

SEQ ID NO: 6736937 - DNA, 12 bp, Homo sapiens
ccctttgtcctg

SEQ ID NO: 6736938 - DNA, 14 bp, Homo sapiens
ccctttgtcctgcg

SEQ ID NO: 6736939 - DNA, 13 bp, Homo sapiens
ccctttgtttgaa

SEQ ID NO: 6736940 - DNA, 21 bp, Homo sapiens
cccttttaaagaatttttgcc

SEQ ID NO: 6736941 - DNA, 16 bp, Homo sapiens
cccttttaaagttgat

SEQ ID NO: 6736942 - DNA, 13 bp, Homo sapiens
cccttttaatata

SEQ ID NO: 6736943 - DNA, 23 bp, Homo sapiens
cccttttacagctcttggcattt

SEQ ID NO: 6736944 - DNA, 22 bp, Homo sapiens
cccttttagaatttacctctta

SEQ ID NO: 6736945 - DNA, 18 bp, Homo sapiens
cccttttcagctgagccc

SEQ ID NO: 6736946 - DNA, 22 bp, Homo sapiens
cccttttcatggtaccaggccc

SEQ ID NO: 6736947 - DNA, 23 bp, Homo sapiens
cccttttcatggtaccaggcccg

SEQ ID NO: 6736948 - DNA, 13 bp, Homo sapiens
cccttttccccta

SEQ ID NO: 6736949 - DNA, 11 bp, Homo sapiens
cccttttcctg

SEQ ID NO: 6736950 - DNA, 12 bp, Homo sapiens
cccttttcctgg

SEQ ID NO: 6736951 - DNA, 18 bp, Homo sapiens
cccttttcctttctggcc

SEQ ID NO: 6736952 - DNA, 13 bp, Homo sapiens
cccttttcctttt

SEQ ID NO: 6736953 - DNA, 16 bp, Homo sapiens
cccttttctacagtta

SEQ ID NO: 6736954 - DNA, 14 bp, Homo sapiens
cccttttctcccca

SEQ ID NO: 6736955 - DNA, 16 bp, Homo sapiens
cccttttctctgctct

SEQ ID NO: 6736956 - DNA, 18 bp, Homo sapiens
cccttttctctgctcttg

SEQ ID NO: 6736957 - DNA, 19 bp, Homo sapiens
cccttttctctgctcttgt

SEQ ID NO: 6736958 - DNA, 13 bp, Homo sapiens
cccttttctgatc

SEQ ID NO: 6736959 - DNA, 14 bp, Homo sapiens
cccttttctggctc

SEQ ID NO: 6736960 - DNA, 18 bp, Homo sapiens
cccttttctggctcctgt

SEQ ID NO: 6736961 - DNA, 13 bp, Homo sapiens
cccttttctgttc

SEQ ID NO: 6736962 - DNA, 14 bp, Homo sapiens
cccttttctgttta

SEQ ID NO: 6736963 - DNA, 17 bp, Homo sapiens
cccttttgcccactgtc

SEQ ID NO: 6736964 - DNA, 15 bp, Homo sapiens
cccttttgcctggct

SEQ ID NO: 6736965 - DNA, 16 bp, Homo sapiens
cccttttgcctggctg

SEQ ID NO: 6736966 - DNA, 20 bp, Homo sapiens
cccttttgggtttctgccct

SEQ ID NO: 6736967 - DNA, 22 bp, Homo sapiens
cccttttgtgggtttctctgtg

SEQ ID NO: 6736968 - DNA, 21 bp, Homo sapiens
cccttttgttccccagcccta

SEQ ID NO: 6736969 - DNA, 15 bp, Homo sapiens
ccctttttaaaaaat

SEQ ID NO: 6736970 - DNA, 22 bp, Homo sapiens
ccctttttaaaaaataccattg

SEQ ID NO: 6736971 - DNA, 16 bp, Homo sapiens
ccctttttacacttta

SEQ ID NO: 6736972 - DNA, 23 bp, Homo sapiens
ccctttttactccccttgagctg

SEQ ID NO: 6736973 - DNA, 11 bp, Homo sapiens
ccctttttcat

SEQ ID NO: 6736974 - DNA, 15 bp, Homo sapiens
ccctttttcccttcc

SEQ ID NO: 6736975 - DNA, 23 bp, Homo sapiens
ccctttttccttgtccccacact

SEQ ID NO: 6736976 - DNA, 15 bp, Homo sapiens
ccctttttctccagc

SEQ ID NO: 6736977 - DNA, 15 bp, Homo sapiens
ccctttttgaaatca

SEQ ID NO: 6736978 - DNA, 23 bp, Homo sapiens
ccctttttgaagtgtaggcagac

SEQ ID NO: 6736979 - DNA, 23 bp, Homo sapiens
ccctttttgcaggggactgggcc

SEQ ID NO: 6736980 - DNA, 15 bp, Homo sapiens
cccttttttcctttc

SEQ ID NO: 6736981 - DNA, 21 bp, Homo sapiens
cccttttttcctttccacctt

SEQ ID NO: 6736982 - DNA, 14 bp, Homo sapiens
cccttttttctgcc

SEQ ID NO: 6736983 - DNA, 17 bp, Homo sapiens
cccttttttggctgctg

SEQ ID NO: 6736984 - DNA, 19 bp, Homo sapiens
cccttttttggctgctgaa

SEQ ID NO: 6736985 - DNA, 19 bp, Homo sapiens
cccttttttgtcccccaac

SEQ ID NO: 6736986 - DNA, 23 bp, Homo sapiens
cccttttttttttaaatttttat

SEQ ID NO: 6736987 - DNA, 16 bp, Homo sapiens
ccgaaaacgtggctgc

SEQ ID NO: 6736988 - DNA, 15 bp, Homo sapiens
ccgaaaatcatataa

SEQ ID NO: 6736989 - DNA, 15 bp, Homo sapiens
ccgaaactgacttgc

SEQ ID NO: 6736990 - DNA, 17 bp, Homo sapiens
ccgaaagcatcactgcc

SEQ ID NO: 6736991 - DNA, 19 bp, Homo sapiens
ccgaaagcatcactgcctt

SEQ ID NO: 6736992 - DNA, 21 bp, Homo sapiens
ccgaaagcatcactgccttgg

SEQ ID NO: 6736993 - DNA, 19 bp, Homo sapiens
ccgaaagggacttggaagc

SEQ ID NO: 6736994 - DNA, 23 bp, Homo sapiens
ccgaaagtctgaatctcccaagg

SEQ ID NO: 6736995 - DNA, 12 bp, Homo sapiens
ccgaacagggac

SEQ ID NO: 6736996 - DNA, 17 bp, Homo sapiens
ccgaacatgaccaaaaa

SEQ ID NO: 6736997 - DNA, 15 bp, Homo sapiens
ccgaaccccccactc

SEQ ID NO: 6736998 - DNA, 16 bp, Homo sapiens
ccgaaccccccactcc

SEQ ID NO: 6736999 - DNA, 21 bp, Homo sapiens
ccgaacgctctgcaccttctg

SEQ ID NO: 6737000 - DNA, 15 bp, Homo sapiens
ccgaactccaggctg

SEQ ID NO: 6737001 - DNA, 21 bp, Homo sapiens
ccgaactgtgccttcgcttgg

SEQ ID NO: 6737002 - DNA, 19 bp, Homo sapiens
ccgaagaagggtccttccc

SEQ ID NO: 6737003 - DNA, 14 bp, Homo sapiens
ccgaagagccctga

SEQ ID NO: 6737004 - DNA, 16 bp, Homo sapiens
ccgaagagccctgagc

SEQ ID NO: 6737005 - DNA, 23 bp, Homo sapiens
ccgaagatggtggccacagactg

SEQ ID NO: 6737006 - DNA, 11 bp, Homo sapiens
ccgaagcccag

SEQ ID NO: 6737007 - DNA, 15 bp, Homo sapiens
ccgaagcccaggggc

SEQ ID NO: 6737008 - DNA, 18 bp, Homo sapiens
ccgaagcccagtttccct

SEQ ID NO: 6737009 - DNA, 16 bp, Homo sapiens
ccgaagctctggctga

SEQ ID NO: 6737010 - DNA, 17 bp, Homo sapiens
ccgaagctctggctgaa

SEQ ID NO: 6737011 - DNA, 19 bp, Homo sapiens
ccgaagctctggctgaacc

SEQ ID NO: 6737012 - DNA, 17 bp, Homo sapiens
ccgaagggcagccccgc

SEQ ID NO: 6737013 - DNA, 16 bp, Homo sapiens
ccgaaggggctctgag

SEQ ID NO: 6737014 - DNA, 18 bp, Homo sapiens
ccgaaggtctctctggct

SEQ ID NO: 6737015 - DNA, 15 bp, Homo sapiens
ccgaaggtgcctcag

SEQ ID NO: 6737016 - DNA, 23 bp, Homo sapiens
ccgaaggtgctggaggtgggagc

SEQ ID NO: 6737017 - DNA, 18 bp, Homo sapiens
ccgaagtccagctttctg

SEQ ID NO: 6737018 - DNA, 11 bp, Homo sapiens
ccgaataaatg

SEQ ID NO: 6737019 - DNA, 17 bp, Homo sapiens
ccgaatagctgggacta

SEQ ID NO: 6737020 - DNA, 20 bp, Homo sapiens
ccgaatagctgggactacag

SEQ ID NO: 6737021 - DNA, 14 bp, Homo sapiens
ccgaatatattact

SEQ ID NO: 6737022 - DNA, 19 bp, Homo sapiens
ccgaatatattactgattt

SEQ ID NO: 6737023 - DNA, 22 bp, Homo sapiens
ccgaatattgagcaatatgtca

SEQ ID NO: 6737024 - DNA, 13 bp, Homo sapiens
ccgaatcccccag

SEQ ID NO: 6737025 - DNA, 19 bp, Homo sapiens
ccgaatcccctccctgtca

SEQ ID NO: 6737026 - DNA, 12 bp, Homo sapiens
ccgaatcccgtc

SEQ ID NO: 6737027 - DNA, 13 bp, Homo sapiens
ccgaatgtgcagg

SEQ ID NO: 6737028 - DNA, 20 bp, Homo sapiens
ccgaatgtgcaggtttgtta

SEQ ID NO: 6737029 - DNA, 14 bp, Homo sapiens
ccgaatgtgtcttt

SEQ ID NO: 6737030 - DNA, 19 bp, Homo sapiens
ccgaatttggtacacatgt

SEQ ID NO: 6737031 - DNA, 22 bp, Homo sapiens
ccgaatttggtacacatgtgtt

SEQ ID NO: 6737032 - DNA, 21 bp, Homo sapiens
ccgacaaagggaaggctgctg

SEQ ID NO: 6737033 - DNA, 17 bp, Homo sapiens
ccgacaccactcctgcc

SEQ ID NO: 6737034 - DNA, 22 bp, Homo sapiens
ccgacaccactcctgccagccc

SEQ ID NO: 6737035 - DNA, 17 bp, Homo sapiens
ccgacactctcaccccc

SEQ ID NO: 6737036 - DNA, 16 bp, Homo sapiens
ccgacactgagctgtg

SEQ ID NO: 6737037 - DNA, 16 bp, Homo sapiens
ccgacactgctgcacc

SEQ ID NO: 6737038 - DNA, 17 bp, Homo sapiens
ccgacagagagatgaag

SEQ ID NO: 6737039 - DNA, 13 bp, Homo sapiens
ccgacagagggaa

SEQ ID NO: 6737040 - DNA, 12 bp, Homo sapiens
ccgacagcccag

SEQ ID NO: 6737041 - DNA, 14 bp, Homo sapiens
ccgacagcccagcc

SEQ ID NO: 6737042 - DNA, 22 bp, Homo sapiens
ccgacagcctggcacagggcag

SEQ ID NO: 6737043 - DNA, 19 bp, Homo sapiens
ccgacaggtgggcctggga

SEQ ID NO: 6737044 - DNA, 20 bp, Homo sapiens
ccgacagtcggtgaccccat

SEQ ID NO: 6737045 - DNA, 19 bp, Homo sapiens
ccgacatttttcaataaag

SEQ ID NO: 6737046 - DNA, 16 bp, Homo sapiens
ccgaccaactccagac

SEQ ID NO: 6737047 - DNA, 17 bp, Homo sapiens
ccgaccaactccagact

SEQ ID NO: 6737048 - DNA, 23 bp, Homo sapiens
ccgaccaatccccagcctaggac

SEQ ID NO: 6737049 - DNA, 18 bp, Homo sapiens
ccgaccagacaccttgac

SEQ ID NO: 6737050 - DNA, 13 bp, Homo sapiens
ccgaccagagccc

SEQ ID NO: 6737051 - DNA, 14 bp, Homo sapiens
ccgaccagatcctt

SEQ ID NO: 6737052 - DNA, 19 bp, Homo sapiens
ccgaccatcgtccagccct

SEQ ID NO: 6737053 - DNA, 22 bp, Homo sapiens
ccgaccatcgtccagccctcct

SEQ ID NO: 6737054 - DNA, 21 bp, Homo sapiens
ccgacccagccagctgcaggg

SEQ ID NO: 6737055 - DNA, 16 bp, Homo sapiens
ccgaccccaagagttt

SEQ ID NO: 6737056 - DNA, 22 bp, Homo sapiens
ccgaccccatccacctatccac

SEQ ID NO: 6737057 - DNA, 14 bp, Homo sapiens
ccgaccccatctca

SEQ ID NO: 6737058 - DNA, 13 bp, Homo sapiens
ccgacccccctac

SEQ ID NO: 6737059 - DNA, 16 bp, Homo sapiens
ccgacccctgtccagc

SEQ ID NO: 6737060 - DNA, 14 bp, Homo sapiens
ccgacccgaggccc

SEQ ID NO: 6737061 - DNA, 14 bp, Homo sapiens
ccgaccctcctggc

SEQ ID NO: 6737062 - DNA, 15 bp, Homo sapiens
ccgaccctcctggcc

SEQ ID NO: 6737063 - DNA, 15 bp, Homo sapiens
ccgaccctctgggaa

SEQ ID NO: 6737064 - DNA, 16 bp, Homo sapiens
ccgaccctctgggaac

SEQ ID NO: 6737065 - DNA, 13 bp, Homo sapiens
ccgaccctgccct

SEQ ID NO: 6737066 - DNA, 19 bp, Homo sapiens
ccgaccgaggctggagctg

SEQ ID NO: 6737067 - DNA, 23 bp, Homo sapiens
ccgaccgcctgcttcacacccct

SEQ ID NO: 6737068 - DNA, 12 bp, Homo sapiens
ccgacctcagcc

SEQ ID NO: 6737069 - DNA, 14 bp, Homo sapiens
ccgacctcagcctt

SEQ ID NO: 6737070 - DNA, 19 bp, Homo sapiens
ccgacctcgtcctccccct

SEQ ID NO: 6737071 - DNA, 14 bp, Homo sapiens
ccgacctggctgag

SEQ ID NO: 6737072 - DNA, 17 bp, Homo sapiens
ccgacctggctgcccct

SEQ ID NO: 6737073 - DNA, 16 bp, Homo sapiens
ccgaccttagatttag

SEQ ID NO: 6737074 - DNA, 17 bp, Homo sapiens
ccgacgcccctccgggc

SEQ ID NO: 6737075 - DNA, 24 bp, Homo sapiens
ccgacgccgtcccaccagcttcac

SEQ ID NO: 6737076 - DNA, 13 bp, Homo sapiens
ccgacggagccac

SEQ ID NO: 6737077 - DNA, 14 bp, Homo sapiens
ccgacggagccact

SEQ ID NO: 6737078 - DNA, 14 bp, Homo sapiens
ccgacggagccggg

SEQ ID NO: 6737079 - DNA, 20 bp, Homo sapiens
ccgacggcctccaggagggg

SEQ ID NO: 6737080 - DNA, 23 bp, Homo sapiens
ccgacggtgggcatttgtgaggc

SEQ ID NO: 6737081 - DNA, 21 bp, Homo sapiens
ccgacgtctatcctttcctgc

SEQ ID NO: 6737082 - DNA, 17 bp, Homo sapiens
ccgacgttccacctggg

SEQ ID NO: 6737083 - DNA, 20 bp, Homo sapiens
ccgactagacacacaaagca

SEQ ID NO: 6737084 - DNA, 13 bp, Homo sapiens
ccgactcacctgc

SEQ ID NO: 6737085 - DNA, 11 bp, Homo sapiens
ccgactcagca

SEQ ID NO: 6737086 - DNA, 15 bp, Homo sapiens
ccgactcagggacct

SEQ ID NO: 6737087 - DNA, 10 bp, Homo sapiens
ccgactccag

SEQ ID NO: 6737088 - DNA, 11 bp, Homo sapiens
ccgactccagc

SEQ ID NO: 6737089 - DNA, 14 bp, Homo sapiens
ccgactccagccag

SEQ ID NO: 6737090 - DNA, 19 bp, Homo sapiens
ccgactcccccaaccaagg

SEQ ID NO: 6737091 - DNA, 20 bp, Homo sapiens
ccgactcccccaaccaagga

SEQ ID NO: 6737092 - DNA, 23 bp, Homo sapiens
ccgactcccccaaccaaggaagg

SEQ ID NO: 6737093 - DNA, 14 bp, Homo sapiens
ccgactctaagctg

SEQ ID NO: 6737094 - DNA, 17 bp, Homo sapiens
ccgactctaagctgtgt

SEQ ID NO: 6737095 - DNA, 20 bp, Homo sapiens
ccgactctaagctgtgtgca

SEQ ID NO: 6737096 - DNA, 22 bp, Homo sapiens
ccgactctaagctgtgtgcagg

SEQ ID NO: 6737097 - DNA, 18 bp, Homo sapiens
ccgactctgcacccgcct

SEQ ID NO: 6737098 - DNA, 20 bp, Homo sapiens
ccgactgaaaatattgtttt

SEQ ID NO: 6737099 - DNA, 22 bp, Homo sapiens
ccgactgaccctgaggaggccg

SEQ ID NO: 6737100 - DNA, 18 bp, Homo sapiens
ccgactgactggaggagg

SEQ ID NO: 6737101 - DNA, 12 bp, Homo sapiens
ccgactgcccag

SEQ ID NO: 6737102 - DNA, 21 bp, Homo sapiens
ccgactgcccagccactccaa

SEQ ID NO: 6737103 - DNA, 13 bp, Homo sapiens
ccgactgcccctg

SEQ ID NO: 6737104 - DNA, 19 bp, Homo sapiens
ccgactgcctgtctccatg

SEQ ID NO: 6737105 - DNA, 14 bp, Homo sapiens
ccgactggctgtga

SEQ ID NO: 6737106 - DNA, 19 bp, Homo sapiens
ccgactgggctgctggggc

SEQ ID NO: 6737107 - DNA, 19 bp, Homo sapiens
ccgacttcaatttcccacc

SEQ ID NO: 6737108 - DNA, 20 bp, Homo sapiens
ccgacttgaattttcccact

SEQ ID NO: 6737109 - DNA, 22 bp, Homo sapiens
ccgacttgaattttcccactgc

SEQ ID NO: 6737110 - DNA, 17 bp, Homo sapiens
ccgacttggagactcct

SEQ ID NO: 6737111 - DNA, 19 bp, Homo sapiens
ccgacttggagactcctgg

SEQ ID NO: 6737112 - DNA, 22 bp, Homo sapiens
ccgactttgtaccccccaaccc

SEQ ID NO: 6737113 - DNA, 11 bp, Homo sapiens
ccgagaaaagg

SEQ ID NO: 6737114 - DNA, 12 bp, Homo sapiens
ccgagaaccctg

SEQ ID NO: 6737115 - DNA, 15 bp, Homo sapiens
ccgagaaccctgagc

SEQ ID NO: 6737116 - DNA, 13 bp, Homo sapiens
ccgagaagaacag

SEQ ID NO: 6737117 - DNA, 13 bp, Homo sapiens
ccgagaagcaaga

SEQ ID NO: 6737118 - DNA, 16 bp, Homo sapiens
ccgagacaccatcctg

SEQ ID NO: 6737119 - DNA, 23 bp, Homo sapiens
ccgagacaccatcctgagccagg

SEQ ID NO: 6737120 - DNA, 16 bp, Homo sapiens
ccgagaccgcagaggg

SEQ ID NO: 6737121 - DNA, 17 bp, Homo sapiens
ccgagacctcactttat

SEQ ID NO: 6737122 - DNA, 20 bp, Homo sapiens
ccgagactcagcctctgctg

SEQ ID NO: 6737123 - DNA, 22 bp, Homo sapiens
ccgagactcagcctctgctgga

SEQ ID NO: 6737124 - DNA, 18 bp, Homo sapiens
ccgagagagctctggccc

SEQ ID NO: 6737125 - DNA, 20 bp, Homo sapiens
ccgagagcagtgggcaggtg

SEQ ID NO: 6737126 - DNA, 13 bp, Homo sapiens
ccgagagcctgct

SEQ ID NO: 6737127 - DNA, 13 bp, Homo sapiens
ccgagagctctta

SEQ ID NO: 6737128 - DNA, 22 bp, Homo sapiens
ccgagagctcttagtttttaaa

SEQ ID NO: 6737129 - DNA, 16 bp, Homo sapiens
ccgagagctgggactc

SEQ ID NO: 6737130 - DNA, 20 bp, Homo sapiens
ccgagagtccatcagcctcc

SEQ ID NO: 6737131 - DNA, 21 bp, Homo sapiens
ccgagagtccatcagcctcca

SEQ ID NO: 6737132 - DNA, 18 bp, Homo sapiens
ccgagatagccaaggcca

SEQ ID NO: 6737133 - DNA, 11 bp, Homo sapiens
ccgagattgca

SEQ ID NO: 6737134 - DNA, 12 bp, Homo sapiens
ccgagattgcac

SEQ ID NO: 6737135 - DNA, 15 bp, Homo sapiens
ccgagattgcaccac

SEQ ID NO: 6737136 - DNA, 23 bp, Homo sapiens
ccgagcaaagatcaaaataaaaa

SEQ ID NO: 6737137 - DNA, 20 bp, Homo sapiens
ccgagcaaagtctaaagttt

SEQ ID NO: 6737138 - DNA, 12 bp, Homo sapiens
ccgagcagctga

SEQ ID NO: 6737139 - DNA, 21 bp, Homo sapiens
ccgagcagctgagcagggccg

SEQ ID NO: 6737140 - DNA, 14 bp, Homo sapiens
ccgagccagctctg

SEQ ID NO: 6737141 - DNA, 21 bp, Homo sapiens
ccgagcccacaccatctggcc

SEQ ID NO: 6737142 - DNA, 10 bp, Homo sapiens
ccgagcccag

SEQ ID NO: 6737143 - DNA, 12 bp, Homo sapiens
ccgagcccagct

SEQ ID NO: 6737144 - DNA, 16 bp, Homo sapiens
ccgagccccaggagcc

SEQ ID NO: 6737145 - DNA, 16 bp, Homo sapiens
ccgagccccctgtcct

SEQ ID NO: 6737146 - DNA, 17 bp, Homo sapiens
ccgagccccctgtcctt

SEQ ID NO: 6737147 - DNA, 18 bp, Homo sapiens
ccgagccctcacaccctg

SEQ ID NO: 6737148 - DNA, 16 bp, Homo sapiens
ccgagccctgactcct

SEQ ID NO: 6737149 - DNA, 12 bp, Homo sapiens
ccgagccctgga

SEQ ID NO: 6737150 - DNA, 21 bp, Homo sapiens
ccgagccctggagagccccat

SEQ ID NO: 6737151 - DNA, 13 bp, Homo sapiens
ccgagccgagctc

SEQ ID NO: 6737152 - DNA, 19 bp, Homo sapiens
ccgagccgggcctggggct

SEQ ID NO: 6737153 - DNA, 19 bp, Homo sapiens
ccgagcctggctccaaacc

SEQ ID NO: 6737154 - DNA, 20 bp, Homo sapiens
ccgagcgacggctcctcccc

SEQ ID NO: 6737155 - DNA, 14 bp, Homo sapiens
ccgagcgcgtgcct

SEQ ID NO: 6737156 - DNA, 19 bp, Homo sapiens
ccgagcgcgtgccttcccc

SEQ ID NO: 6737157 - DNA, 21 bp, Homo sapiens
ccgagcgggtgcaagcactcg

SEQ ID NO: 6737158 - DNA, 16 bp, Homo sapiens
ccgagctcctcttcca

SEQ ID NO: 6737159 - DNA, 17 bp, Homo sapiens
ccgagctcctcttccat

SEQ ID NO: 6737160 - DNA, 18 bp, Homo sapiens
ccgagctcctcttccatg

SEQ ID NO: 6737161 - DNA, 14 bp, Homo sapiens
ccgagctcctgggg

SEQ ID NO: 6737162 - DNA, 22 bp, Homo sapiens
ccgagctctcctgggccagggt

SEQ ID NO: 6737163 - DNA, 14 bp, Homo sapiens
ccgagctctggtgc

SEQ ID NO: 6737164 - DNA, 19 bp, Homo sapiens
ccgagctctgtgggaaaaa

SEQ ID NO: 6737165 - DNA, 11 bp, Homo sapiens
ccgagctcttg

SEQ ID NO: 6737166 - DNA, 14 bp, Homo sapiens
ccgagctggaaaac

SEQ ID NO: 6737167 - DNA, 13 bp, Homo sapiens
ccgagctggagcg

SEQ ID NO: 6737168 - DNA, 21 bp, Homo sapiens
ccgagctgggggccatgagct

SEQ ID NO: 6737169 - DNA, 16 bp, Homo sapiens
ccgagctggtgcatta

SEQ ID NO: 6737170 - DNA, 17 bp, Homo sapiens
ccgagctggtgcattac

SEQ ID NO: 6737171 - DNA, 20 bp, Homo sapiens
ccgagctggtgcattacaga

SEQ ID NO: 6737172 - DNA, 15 bp, Homo sapiens
ccgagctggtttcct

SEQ ID NO: 6737173 - DNA, 16 bp, Homo sapiens
ccgagctggtttcctg

SEQ ID NO: 6737174 - DNA, 18 bp, Homo sapiens
ccgagctgtcggagggct

SEQ ID NO: 6737175 - DNA, 16 bp, Homo sapiens
ccgagcttgcctcagg

SEQ ID NO: 6737176 - DNA, 20 bp, Homo sapiens
ccgagcttgcctcagggcca

SEQ ID NO: 6737177 - DNA, 21 bp, Homo sapiens
ccgaggaaacgaaacccactc

SEQ ID NO: 6737178 - DNA, 21 bp, Homo sapiens
ccgaggaagcacagcttgggt

SEQ ID NO: 6737179 - DNA, 23 bp, Homo sapiens
ccgaggaagctggacagcggcag

SEQ ID NO: 6737180 - DNA, 17 bp, Homo sapiens
ccgaggacagcctgcct

SEQ ID NO: 6737181 - DNA, 20 bp, Homo sapiens
ccgaggacagcctgcctctg

SEQ ID NO: 6737182 - DNA, 22 bp, Homo sapiens
ccgaggacagcctgcctctgcc

SEQ ID NO: 6737183 - DNA, 19 bp, Homo sapiens
ccgaggaccaccagcaggc

SEQ ID NO: 6737184 - DNA, 13 bp, Homo sapiens
ccgaggacccagg

SEQ ID NO: 6737185 - DNA, 14 bp, Homo sapiens
ccgaggacccatga

SEQ ID NO: 6737186 - DNA, 21 bp, Homo sapiens
ccgaggaccgggctggggttt

SEQ ID NO: 6737187 - DNA, 19 bp, Homo sapiens
ccgaggacgctccctgctc

SEQ ID NO: 6737188 - DNA, 19 bp, Homo sapiens
ccgaggactggactgtttt

SEQ ID NO: 6737189 - DNA, 13 bp, Homo sapiens
ccgaggagcccca

SEQ ID NO: 6737190 - DNA, 16 bp, Homo sapiens
ccgaggagccccagcc

SEQ ID NO: 6737191 - DNA, 18 bp, Homo sapiens
ccgaggagccccagcccc

SEQ ID NO: 6737192 - DNA, 20 bp, Homo sapiens
ccgaggagccccagccccgt

SEQ ID NO: 6737193 - DNA, 17 bp, Homo sapiens
ccgaggagggagagtct

SEQ ID NO: 6737194 - DNA, 12 bp, Homo sapiens
ccgaggaggggc

SEQ ID NO: 6737195 - DNA, 15 bp, Homo sapiens
ccgaggaggtgcctg

SEQ ID NO: 6737196 - DNA, 20 bp, Homo sapiens
ccgaggaggtgtctcaggct

SEQ ID NO: 6737197 - DNA, 21 bp, Homo sapiens
ccgaggaggtgtctcaggctg

SEQ ID NO: 6737198 - DNA, 23 bp, Homo sapiens
ccgaggaggtgtctcaggctgcc

SEQ ID NO: 6737199 - DNA, 14 bp, Homo sapiens
ccgaggcagcaaca

SEQ ID NO: 6737200 - DNA, 22 bp, Homo sapiens
ccgaggcaggggctgggcagag

SEQ ID NO: 6737201 - DNA, 11 bp, Homo sapiens
ccgaggcaggt

SEQ ID NO: 6737202 - DNA, 14 bp, Homo sapiens
ccgaggcaggtgga

SEQ ID NO: 6737203 - DNA, 16 bp, Homo sapiens
ccgaggcccagcgggc

SEQ ID NO: 6737204 - DNA, 14 bp, Homo sapiens
ccgaggcccccctc

SEQ ID NO: 6737205 - DNA, 20 bp, Homo sapiens
ccgaggcccccctctgcctt

SEQ ID NO: 6737206 - DNA, 22 bp, Homo sapiens
ccgaggcctaccccgcagacac

SEQ ID NO: 6737207 - DNA, 12 bp, Homo sapiens
ccgaggcctggc

SEQ ID NO: 6737208 - DNA, 14 bp, Homo sapiens
ccgaggcctggcca

SEQ ID NO: 6737209 - DNA, 15 bp, Homo sapiens
ccgaggcctggccaa

SEQ ID NO: 6737210 - DNA, 14 bp, Homo sapiens
ccgaggccttctct

SEQ ID NO: 6737211 - DNA, 20 bp, Homo sapiens
ccgaggcgggcggatcacga

SEQ ID NO: 6737212 - DNA, 17 bp, Homo sapiens
ccgaggctacagctcca

SEQ ID NO: 6737213 - DNA, 18 bp, Homo sapiens
ccgaggctcgagctcggg

SEQ ID NO: 6737214 - DNA, 12 bp, Homo sapiens
ccgaggctgaga

SEQ ID NO: 6737215 - DNA, 14 bp, Homo sapiens
ccgaggctggagct

SEQ ID NO: 6737216 - DNA, 14 bp, Homo sapiens
ccgaggctgggaca

SEQ ID NO: 6737217 - DNA, 15 bp, Homo sapiens
ccgaggctgggacac

SEQ ID NO: 6737218 - DNA, 23 bp, Homo sapiens
ccgagggaggggaagcttctgtc

SEQ ID NO: 6737219 - DNA, 16 bp, Homo sapiens
ccgagggatgatgcca

SEQ ID NO: 6737220 - DNA, 17 bp, Homo sapiens
ccgagggcagccccctc

SEQ ID NO: 6737221 - DNA, 15 bp, Homo sapiens
ccgagggccaggcag

SEQ ID NO: 6737222 - DNA, 16 bp, Homo sapiens
ccgagggccaggcaga

SEQ ID NO: 6737223 - DNA, 15 bp, Homo sapiens
ccgagggcgaccccg

SEQ ID NO: 6737224 - DNA, 15 bp, Homo sapiens
ccgagggcgcctggg

SEQ ID NO: 6737225 - DNA, 18 bp, Homo sapiens
ccgagggctcagaagagc

SEQ ID NO: 6737226 - DNA, 13 bp, Homo sapiens
ccgagggctgagc

SEQ ID NO: 6737227 - DNA, 16 bp, Homo sapiens
ccgagggctgagcctg

SEQ ID NO: 6737228 - DNA, 22 bp, Homo sapiens
ccgagggctgagcctggtccca

SEQ ID NO: 6737229 - DNA, 17 bp, Homo sapiens
ccgagggctgaggagca

SEQ ID NO: 6737230 - DNA, 17 bp, Homo sapiens
ccgagggctggccggga

SEQ ID NO: 6737231 - DNA, 19 bp, Homo sapiens
ccgaggggagagagggact

SEQ ID NO: 6737232 - DNA, 22 bp, Homo sapiens
ccgaggggagagagggactcaa

SEQ ID NO: 6737233 - DNA, 16 bp, Homo sapiens
ccgaggggccagggtg

SEQ ID NO: 6737234 - DNA, 14 bp, Homo sapiens
ccgaggggcctttg

SEQ ID NO: 6737235 - DNA, 19 bp, Homo sapiens
ccgagggggctgctcccac

SEQ ID NO: 6737236 - DNA, 18 bp, Homo sapiens
ccgaggggggccccggga

SEQ ID NO: 6737237 - DNA, 21 bp, Homo sapiens
ccgaggggtggaatgccgctg

SEQ ID NO: 6737238 - DNA, 16 bp, Homo sapiens
ccgagggtcctggctc

SEQ ID NO: 6737239 - DNA, 22 bp, Homo sapiens
ccgagggtggtttacctgcacc

SEQ ID NO: 6737240 - DNA, 21 bp, Homo sapiens
ccgagggttgattaaggcagt

SEQ ID NO: 6737241 - DNA, 17 bp, Homo sapiens
ccgaggtatggcagagg

SEQ ID NO: 6737242 - DNA, 14 bp, Homo sapiens
ccgaggtgttgcca

SEQ ID NO: 6737243 - DNA, 23 bp, Homo sapiens
ccgaggttgtggggaggctgcac

SEQ ID NO: 6737244 - DNA, 21 bp, Homo sapiens
ccgagtacaaggacagacagc

SEQ ID NO: 6737245 - DNA, 20 bp, Homo sapiens
ccgagtagctgagattatag

SEQ ID NO: 6737246 - DNA, 20 bp, Homo sapiens
ccgagtagctgggactacag

SEQ ID NO: 6737247 - DNA, 19 bp, Homo sapiens
ccgagtagctgggattacg

SEQ ID NO: 6737248 - DNA, 20 bp, Homo sapiens
ccgagtagttgggattacag

SEQ ID NO: 6737249 - DNA, 19 bp, Homo sapiens
ccgagtcattcgttctgtg

SEQ ID NO: 6737250 - DNA, 12 bp, Homo sapiens
ccgagtccaagc

SEQ ID NO: 6737251 - DNA, 15 bp, Homo sapiens
ccgagtccaagctgg

SEQ ID NO: 6737252 - DNA, 14 bp, Homo sapiens
ccgagtccaggagc

SEQ ID NO: 6737253 - DNA, 15 bp, Homo sapiens
ccgagtcctcaggta

SEQ ID NO: 6737254 - DNA, 17 bp, Homo sapiens
ccgagtcctcaggtaca

SEQ ID NO: 6737255 - DNA, 14 bp, Homo sapiens
ccgagtctgggaca

SEQ ID NO: 6737256 - DNA, 14 bp, Homo sapiens
ccgagtctgtctct

SEQ ID NO: 6737257 - DNA, 20 bp, Homo sapiens
ccgagtctttctcactgcct

SEQ ID NO: 6737258 - DNA, 14 bp, Homo sapiens
ccgagtgactctgg

SEQ ID NO: 6737259 - DNA, 23 bp, Homo sapiens
ccgagtgagtcagtgatgaggcc

SEQ ID NO: 6737260 - DNA, 14 bp, Homo sapiens
ccgagtgatttcca

SEQ ID NO: 6737261 - DNA, 16 bp, Homo sapiens
ccgagtgcggcgtgga

SEQ ID NO: 6737262 - DNA, 23 bp, Homo sapiens
ccgagtgcggcgtggagactggc

SEQ ID NO: 6737263 - DNA, 21 bp, Homo sapiens
ccgagtggatagatgccctgc

SEQ ID NO: 6737264 - DNA, 22 bp, Homo sapiens
ccgagtggtctcctctcagctt

SEQ ID NO: 6737265 - DNA, 16 bp, Homo sapiens
ccgagtgtggagctgc

SEQ ID NO: 6737266 - DNA, 15 bp, Homo sapiens
ccgataatgcatgaa

SEQ ID NO: 6737267 - DNA, 20 bp, Homo sapiens
ccgataatgcatgaagcaac

SEQ ID NO: 6737268 - DNA, 18 bp, Homo sapiens
ccgatagggtatttgacc

SEQ ID NO: 6737269 - DNA, 17 bp, Homo sapiens
ccgatatcagaatttgt

SEQ ID NO: 6737270 - DNA, 18 bp, Homo sapiens
ccgatccagattcccagg

SEQ ID NO: 6737271 - DNA, 22 bp, Homo sapiens
ccgatccagattcccaggccag

SEQ ID NO: 6737272 - DNA, 18 bp, Homo sapiens
ccgatgatactgtttctt

SEQ ID NO: 6737273 - DNA, 17 bp, Homo sapiens
ccgatgattcttaacac

SEQ ID NO: 6737274 - DNA, 23 bp, Homo sapiens
ccgatgattcttaacacagcctt

SEQ ID NO: 6737275 - DNA, 17 bp, Homo sapiens
ccgatgcaaacattgga

SEQ ID NO: 6737276 - DNA, 12 bp, Homo sapiens
ccgatgccagcc

SEQ ID NO: 6737277 - DNA, 16 bp, Homo sapiens
ccgatgcccagagaca

SEQ ID NO: 6737278 - DNA, 15 bp, Homo sapiens
ccgatgctccagcca

SEQ ID NO: 6737279 - DNA, 19 bp, Homo sapiens
ccgatgctccagccaaccc

SEQ ID NO: 6737280 - DNA, 19 bp, Homo sapiens
ccgatgctgaggccaccca

SEQ ID NO: 6737281 - DNA, 11 bp, Homo sapiens
ccgatgctgct

SEQ ID NO: 6737282 - DNA, 13 bp, Homo sapiens
ccgatgctgcttt

SEQ ID NO: 6737283 - DNA, 21 bp, Homo sapiens
ccgatgctgctttcccctgtg

SEQ ID NO: 6737284 - DNA, 22 bp, Homo sapiens
ccgatgctgctttcccctgtgg

SEQ ID NO: 6737285 - DNA, 23 bp, Homo sapiens
ccgatgctgctttcccctgtggg

SEQ ID NO: 6737286 - DNA, 22 bp, Homo sapiens
ccgatgctttaccaaacagcaa

SEQ ID NO: 6737287 - DNA, 16 bp, Homo sapiens
ccgatggactcctgac

SEQ ID NO: 6737288 - DNA, 18 bp, Homo sapiens
ccgatggcccgagagctg

SEQ ID NO: 6737289 - DNA, 24 bp, Homo sapiens
ccgatggggaaaaaaaaactactg

SEQ ID NO: 6737290 - DNA, 18 bp, Homo sapiens
ccgatggtctctctccct

SEQ ID NO: 6737291 - DNA, 21 bp, Homo sapiens
ccgatggtgggtggggctgca

SEQ ID NO: 6737292 - DNA, 16 bp, Homo sapiens
ccgatgtccctgtccc

SEQ ID NO: 6737293 - DNA, 15 bp, Homo sapiens
ccgatgtgtctccca

SEQ ID NO: 6737294 - DNA, 19 bp, Homo sapiens
ccgatgttattagatgtta

SEQ ID NO: 6737295 - DNA, 19 bp, Homo sapiens
ccgattcctccagccctgg

SEQ ID NO: 6737296 - DNA, 13 bp, Homo sapiens
ccgatttctgtaa

SEQ ID NO: 6737297 - DNA, 16 bp, Homo sapiens
ccgatttctgtaaact

SEQ ID NO: 6737298 - DNA, 17 bp, Homo sapiens
ccgcaaaacccactgac

SEQ ID NO: 6737299 - DNA, 15 bp, Homo sapiens
ccgcaaatccatacc

SEQ ID NO: 6737300 - DNA, 16 bp, Homo sapiens
ccgcaaatccataccc

SEQ ID NO: 6737301 - DNA, 17 bp, Homo sapiens
ccgcaacctgcaggctc

SEQ ID NO: 6737302 - DNA, 16 bp, Homo sapiens
ccgcaactctccagcc

SEQ ID NO: 6737303 - DNA, 16 bp, Homo sapiens
ccgcaacttcccaggc

SEQ ID NO: 6737304 - DNA, 17 bp, Homo sapiens
ccgcaacttcccaggcc

SEQ ID NO: 6737305 - DNA, 19 bp, Homo sapiens
ccgcaagagggacagagcc

SEQ ID NO: 6737306 - DNA, 14 bp, Homo sapiens
ccgcaagcgcaggg

SEQ ID NO: 6737307 - DNA, 12 bp, Homo sapiens
ccgcaaggagca

SEQ ID NO: 6737308 - DNA, 13 bp, Homo sapiens
ccgcaaggccctg

SEQ ID NO: 6737309 - DNA, 18 bp, Homo sapiens
ccgcaaggccctgtccca

SEQ ID NO: 6737310 - DNA, 22 bp, Homo sapiens
ccgcaaggccctgtcccagcag

SEQ ID NO: 6737311 - DNA, 14 bp, Homo sapiens
ccgcaagggcctgg

SEQ ID NO: 6737312 - DNA, 15 bp, Homo sapiens
ccgcaagggcctgga

SEQ ID NO: 6737313 - DNA, 16 bp, Homo sapiens
ccgcaagggcctggac

SEQ ID NO: 6737314 - DNA, 22 bp, Homo sapiens
ccgcaaggggaccgccccaggc

SEQ ID NO: 6737315 - DNA, 17 bp, Homo sapiens
ccgcaagtccccagccc

SEQ ID NO: 6737316 - DNA, 17 bp, Homo sapiens
ccgcaagttcagggaag

SEQ ID NO: 6737317 - DNA, 21 bp, Homo sapiens
ccgcaatgtggagcagcagcc

SEQ ID NO: 6737318 - DNA, 17 bp, Homo sapiens
ccgcacaaagcggctct

SEQ ID NO: 6737319 - DNA, 17 bp, Homo sapiens
ccgcacacctctggctg

SEQ ID NO: 6737320 - DNA, 16 bp, Homo sapiens
ccgcacagcagcctgc

SEQ ID NO: 6737321 - DNA, 13 bp, Homo sapiens
ccgcacagctcag

SEQ ID NO: 6737322 - DNA, 16 bp, Homo sapiens
ccgcacagctcaggag

SEQ ID NO: 6737323 - DNA, 14 bp, Homo sapiens
ccgcacatgaaaca

SEQ ID NO: 6737324 - DNA, 17 bp, Homo sapiens
ccgcacatggtgtgggg

SEQ ID NO: 6737325 - DNA, 20 bp, Homo sapiens
ccgcacatggtgtggggggc

SEQ ID NO: 6737326 - DNA, 21 bp, Homo sapiens
ccgcaccagcccgaacaccat

SEQ ID NO: 6737327 - DNA, 17 bp, Homo sapiens
ccgcaccaggccgggct

SEQ ID NO: 6737328 - DNA, 11 bp, Homo sapiens
ccgcaccccag

SEQ ID NO: 6737329 - DNA, 13 bp, Homo sapiens
ccgcaccccagag

SEQ ID NO: 6737330 - DNA, 17 bp, Homo sapiens
ccgcaccccagagtgtg

SEQ ID NO: 6737331 - DNA, 16 bp, Homo sapiens
ccgcacccccaccctt

SEQ ID NO: 6737332 - DNA, 13 bp, Homo sapiens
ccgcaccccccaa

SEQ ID NO: 6737333 - DNA, 19 bp, Homo sapiens
ccgcacccccgccaggcgc

SEQ ID NO: 6737334 - DNA, 18 bp, Homo sapiens
ccgcaccccggcctcagg

SEQ ID NO: 6737335 - DNA, 13 bp, Homo sapiens
ccgcacccggctc

SEQ ID NO: 6737336 - DNA, 11 bp, Homo sapiens
ccgcaccctgc

SEQ ID NO: 6737337 - DNA, 13 bp, Homo sapiens
ccgcaccctgcac

SEQ ID NO: 6737338 - DNA, 15 bp, Homo sapiens
ccgcaccctgcacct

SEQ ID NO: 6737339 - DNA, 17 bp, Homo sapiens
ccgcaccctgcacctgc

SEQ ID NO: 6737340 - DNA, 23 bp, Homo sapiens
ccgcaccctgcacctgctgcgtc

SEQ ID NO: 6737341 - DNA, 12 bp, Homo sapiens
ccgcaccctgcc

SEQ ID NO: 6737342 - DNA, 13 bp, Homo sapiens
ccgcaccctggcc

SEQ ID NO: 6737343 - DNA, 13 bp, Homo sapiens
ccgcaccctggct

SEQ ID NO: 6737344 - DNA, 16 bp, Homo sapiens
ccgcaccctgtcctgc

SEQ ID NO: 6737345 - DNA, 23 bp, Homo sapiens
ccgcaccgaccacggggccgaca

SEQ ID NO: 6737346 - DNA, 19 bp, Homo sapiens
ccgcaccgggccctccttg

SEQ ID NO: 6737347 - DNA, 17 bp, Homo sapiens
ccgcacctaaagcagcc

SEQ ID NO: 6737348 - DNA, 21 bp, Homo sapiens
ccgcacctgaccgctgcccag

SEQ ID NO: 6737349 - DNA, 14 bp, Homo sapiens
ccgcaccttcctcc

SEQ ID NO: 6737350 - DNA, 21 bp, Homo sapiens
ccgcacgcggccgctctccgc

SEQ ID NO: 6737351 - DNA, 18 bp, Homo sapiens
ccgcactagcctccctct

SEQ ID NO: 6737352 - DNA, 14 bp, Homo sapiens
ccgcactaggggat

SEQ ID NO: 6737353 - DNA, 19 bp, Homo sapiens
ccgcactcaggagcacagc

SEQ ID NO: 6737354 - DNA, 20 bp, Homo sapiens
ccgcactcaggagcacagcc

SEQ ID NO: 6737355 - DNA, 13 bp, Homo sapiens
ccgcactgggagc

SEQ ID NO: 6737356 - DNA, 15 bp, Homo sapiens
ccgcactgggagcag

SEQ ID NO: 6737357 - DNA, 14 bp, Homo sapiens
ccgcactgggcttg

SEQ ID NO: 6737358 - DNA, 19 bp, Homo sapiens
ccgcactgggcttggggac

SEQ ID NO: 6737359 - DNA, 17 bp, Homo sapiens
ccgcactttccacttct

SEQ ID NO: 6737360 - DNA, 13 bp, Homo sapiens
ccgcagaagcagc

SEQ ID NO: 6737361 - DNA, 15 bp, Homo sapiens
ccgcagaagcagccc

SEQ ID NO: 6737362 - DNA, 14 bp, Homo sapiens
ccgcagaagccctg

SEQ ID NO: 6737363 - DNA, 13 bp, Homo sapiens
ccgcagaaggaag

SEQ ID NO: 6737364 - DNA, 20 bp, Homo sapiens
ccgcagaaggggaatgtgtc

SEQ ID NO: 6737365 - DNA, 24 bp, Homo sapiens
ccgcagaaggggaatgtgtcctcc

SEQ ID NO: 6737366 - DNA, 14 bp, Homo sapiens
ccgcagacaccttg

SEQ ID NO: 6737367 - DNA, 16 bp, Homo sapiens
ccgcagacaccttgga

SEQ ID NO: 6737368 - DNA, 17 bp, Homo sapiens
ccgcagacaggaccagg

SEQ ID NO: 6737369 - DNA, 15 bp, Homo sapiens
ccgcagacctcccca

SEQ ID NO: 6737370 - DNA, 16 bp, Homo sapiens
ccgcagacctccccag

SEQ ID NO: 6737371 - DNA, 17 bp, Homo sapiens
ccgcagacctccccagc

SEQ ID NO: 6737372 - DNA, 20 bp, Homo sapiens
ccgcagacctccccagcccc

SEQ ID NO: 6737373 - DNA, 15 bp, Homo sapiens
ccgcagacctctgga

SEQ ID NO: 6737374 - DNA, 18 bp, Homo sapiens
ccgcagacgggcacagac

SEQ ID NO: 6737375 - DNA, 17 bp, Homo sapiens
ccgcagactgcttggcc

SEQ ID NO: 6737376 - DNA, 18 bp, Homo sapiens
ccgcagactgcttggcca

SEQ ID NO: 6737377 - DNA, 12 bp, Homo sapiens
ccgcagagaaat

SEQ ID NO: 6737378 - DNA, 13 bp, Homo sapiens
ccgcagagaaatg

SEQ ID NO: 6737379 - DNA, 18 bp, Homo sapiens
ccgcagagaaatgcccca

SEQ ID NO: 6737380 - DNA, 21 bp, Homo sapiens
ccgcagagactggggcctgga

SEQ ID NO: 6737381 - DNA, 22 bp, Homo sapiens
ccgcagagactggggcctggac

SEQ ID NO: 6737382 - DNA, 18 bp, Homo sapiens
ccgcagaggtggggtgct

SEQ ID NO: 6737383 - DNA, 16 bp, Homo sapiens
ccgcagatcctgtccc

SEQ ID NO: 6737384 - DNA, 23 bp, Homo sapiens
ccgcagatgacacgcgctctcca

SEQ ID NO: 6737385 - DNA, 15 bp, Homo sapiens
ccgcagcaccagcct

SEQ ID NO: 6737386 - DNA, 11 bp, Homo sapiens
ccgcagcaccc

SEQ ID NO: 6737387 - DNA, 16 bp, Homo sapiens
ccgcagccacaccgct

SEQ ID NO: 6737388 - DNA, 20 bp, Homo sapiens
ccgcagccagccggtgcctg

SEQ ID NO: 6737389 - DNA, 21 bp, Homo sapiens
ccgcagccagccggtgcctgg

SEQ ID NO: 6737390 - DNA, 23 bp, Homo sapiens
ccgcagccagccggtgcctggcg

SEQ ID NO: 6737391 - DNA, 13 bp, Homo sapiens
ccgcagcccccac

SEQ ID NO: 6737392 - DNA, 17 bp, Homo sapiens
ccgcagcccccactgac

SEQ ID NO: 6737393 - DNA, 13 bp, Homo sapiens
ccgcagccccttt

SEQ ID NO: 6737394 - DNA, 16 bp, Homo sapiens
ccgcagcccctttccc

SEQ ID NO: 6737395 - DNA, 17 bp, Homo sapiens
ccgcagcccgcctgccg

SEQ ID NO: 6737396 - DNA, 20 bp, Homo sapiens
ccgcagcccgtgaagcagtg

SEQ ID NO: 6737397 - DNA, 22 bp, Homo sapiens
ccgcagcccgtgaagcagtgcc

SEQ ID NO: 6737398 - DNA, 23 bp, Homo sapiens
ccgcagcccgtgaagcagtgcct

SEQ ID NO: 6737399 - DNA, 15 bp, Homo sapiens
ccgcagccctctcca

SEQ ID NO: 6737400 - DNA, 18 bp, Homo sapiens
ccgcagccctgcagaggg

SEQ ID NO: 6737401 - DNA, 14 bp, Homo sapiens
ccgcagcctccctc

SEQ ID NO: 6737402 - DNA, 15 bp, Homo sapiens
ccgcagcctctgccc

SEQ ID NO: 6737403 - DNA, 20 bp, Homo sapiens
ccgcagctcttgcccttccc

SEQ ID NO: 6737404 - DNA, 22 bp, Homo sapiens
ccgcagctcttgcccttccctg

SEQ ID NO: 6737405 - DNA, 15 bp, Homo sapiens
ccgcagctgctgcca

SEQ ID NO: 6737406 - DNA, 17 bp, Homo sapiens
ccgcagctgctgccact

SEQ ID NO: 6737407 - DNA, 23 bp, Homo sapiens
ccgcaggagggaggcggggagga

SEQ ID NO: 6737408 - DNA, 23 bp, Homo sapiens
ccgcaggatttgggctcttggaa

SEQ ID NO: 6737409 - DNA, 14 bp, Homo sapiens
ccgcaggcccggac

SEQ ID NO: 6737410 - DNA, 22 bp, Homo sapiens
ccgcaggcgcggcggctctgcc

SEQ ID NO: 6737411 - DNA, 20 bp, Homo sapiens
ccgcaggctgcccggcctcc

SEQ ID NO: 6737412 - DNA, 17 bp, Homo sapiens
ccgcagggagggctgtg

SEQ ID NO: 6737413 - DNA, 17 bp, Homo sapiens
ccgcagggccatgcaga

SEQ ID NO: 6737414 - DNA, 11 bp, Homo sapiens
ccgcagggccc

SEQ ID NO: 6737415 - DNA, 23 bp, Homo sapiens
ccgcagggcgctccggcagaggc

SEQ ID NO: 6737416 - DNA, 23 bp, Homo sapiens
ccgcaggggcccctcctccagag

SEQ ID NO: 6737417 - DNA, 12 bp, Homo sapiens
ccgcaggtgctc

SEQ ID NO: 6737418 - DNA, 20 bp, Homo sapiens
ccgcaggtgctcatgctgct

SEQ ID NO: 6737419 - DNA, 20 bp, Homo sapiens
ccgcaggtgggtgctgccct

SEQ ID NO: 6737420 - DNA, 21 bp, Homo sapiens
ccgcaggtgtttggcacccaa

SEQ ID NO: 6737421 - DNA, 18 bp, Homo sapiens
ccgcagtccccagccctt

SEQ ID NO: 6737422 - DNA, 20 bp, Homo sapiens
ccgcagtcgtcagcctccct

SEQ ID NO: 6737423 - DNA, 22 bp, Homo sapiens
ccgcagtcgtcgcacagtctct

SEQ ID NO: 6737424 - DNA, 19 bp, Homo sapiens
ccgcagtgcccccacccag

SEQ ID NO: 6737425 - DNA, 15 bp, Homo sapiens
ccgcagtgctgggac

SEQ ID NO: 6737426 - DNA, 20 bp, Homo sapiens
ccgcagtgctgggaccagag

SEQ ID NO: 6737427 - DNA, 21 bp, Homo sapiens
ccgcagtgctgggaccagagc

SEQ ID NO: 6737428 - DNA, 18 bp, Homo sapiens
ccgcagtgtggccaggct

SEQ ID NO: 6737429 - DNA, 11 bp, Homo sapiens
ccgcagtgttt

SEQ ID NO: 6737430 - DNA, 15 bp, Homo sapiens
ccgcagttgtagcag

SEQ ID NO: 6737431 - DNA, 18 bp, Homo sapiens
ccgcatatgcatgccagg

SEQ ID NO: 6737432 - DNA, 19 bp, Homo sapiens
ccgcatcagctgctcagat

SEQ ID NO: 6737433 - DNA, 14 bp, Homo sapiens
ccgcatcccctgcc

SEQ ID NO: 6737434 - DNA, 15 bp, Homo sapiens
ccgcatcccctgcct

SEQ ID NO: 6737435 - DNA, 16 bp, Homo sapiens
ccgcatcccctgcctc

SEQ ID NO: 6737436 - DNA, 20 bp, Homo sapiens
ccgcatccctgcttctggcg

SEQ ID NO: 6737437 - DNA, 13 bp, Homo sapiens
ccgcatcctcact

SEQ ID NO: 6737438 - DNA, 14 bp, Homo sapiens
ccgcatcctcactg

SEQ ID NO: 6737439 - DNA, 20 bp, Homo sapiens
ccgcatcctcactgggctca

SEQ ID NO: 6737440 - DNA, 13 bp, Homo sapiens
ccgcatctgcctg

SEQ ID NO: 6737441 - DNA, 19 bp, Homo sapiens
ccgcatctgcctggagcct

SEQ ID NO: 6737442 - DNA, 15 bp, Homo sapiens
ccgcatcttctccat

SEQ ID NO: 6737443 - DNA, 20 bp, Homo sapiens
ccgcatcttctccatctggc

SEQ ID NO: 6737444 - DNA, 16 bp, Homo sapiens
ccgcatgcggcccagg

SEQ ID NO: 6737445 - DNA, 18 bp, Homo sapiens
ccgcatgctgcctgcctc

SEQ ID NO: 6737446 - DNA, 22 bp, Homo sapiens
ccgcatgctgcctgcctccggc

SEQ ID NO: 6737447 - DNA, 16 bp, Homo sapiens
ccgcatggcagctggg

SEQ ID NO: 6737448 - DNA, 13 bp, Homo sapiens
ccgcatggcccct

SEQ ID NO: 6737449 - DNA, 15 bp, Homo sapiens
ccgcatggcccctcc

SEQ ID NO: 6737450 - DNA, 17 bp, Homo sapiens
ccgcatgtctgcatggc

SEQ ID NO: 6737451 - DNA, 13 bp, Homo sapiens
ccgcatgtgcatt

SEQ ID NO: 6737452 - DNA, 20 bp, Homo sapiens
ccgcatgtgtgcctggccgc

SEQ ID NO: 6737453 - DNA, 14 bp, Homo sapiens
ccgcattccaggct

SEQ ID NO: 6737454 - DNA, 13 bp, Homo sapiens
ccgcattccctga

SEQ ID NO: 6737455 - DNA, 18 bp, Homo sapiens
ccgcattggaagagcccg

SEQ ID NO: 6737456 - DNA, 18 bp, Homo sapiens
ccgcatttctcatgcttc

SEQ ID NO: 6737457 - DNA, 21 bp, Homo sapiens
ccgccaaaagctgctcaggga

SEQ ID NO: 6737458 - DNA, 20 bp, Homo sapiens
ccgccaagatctacaggaca

SEQ ID NO: 6737459 - DNA, 23 bp, Homo sapiens
ccgccaaggtagccatcccatga

SEQ ID NO: 6737460 - DNA, 16 bp, Homo sapiens
ccgccaatctggccct

SEQ ID NO: 6737461 - DNA, 21 bp, Homo sapiens
ccgccacatccccgctggctg

SEQ ID NO: 6737462 - DNA, 23 bp, Homo sapiens
ccgccacatggcttcctcctgcg

SEQ ID NO: 6737463 - DNA, 15 bp, Homo sapiens
ccgccaccacacccg

SEQ ID NO: 6737464 - DNA, 14 bp, Homo sapiens
ccgccaccacggca

SEQ ID NO: 6737465 - DNA, 15 bp, Homo sapiens
ccgccaccctgcccc

SEQ ID NO: 6737466 - DNA, 20 bp, Homo sapiens
ccgccaccgtgtgcctttcc

SEQ ID NO: 6737467 - DNA, 17 bp, Homo sapiens
ccgccacctatctcgtg

SEQ ID NO: 6737468 - DNA, 23 bp, Homo sapiens
ccgccacctccccactccagcag

SEQ ID NO: 6737469 - DNA, 13 bp, Homo sapiens
ccgccacggcctg

SEQ ID NO: 6737470 - DNA, 16 bp, Homo sapiens
ccgccacggcctggct

SEQ ID NO: 6737471 - DNA, 17 bp, Homo sapiens
ccgccacggcctggctg

SEQ ID NO: 6737472 - DNA, 21 bp, Homo sapiens
ccgccacgtcccagcatccct

SEQ ID NO: 6737473 - DNA, 20 bp, Homo sapiens
ccgccactaggtgtccccaa

SEQ ID NO: 6737474 - DNA, 20 bp, Homo sapiens
ccgccagaccccgtggctct

SEQ ID NO: 6737475 - DNA, 21 bp, Homo sapiens
ccgccagaccccgtggctctg

SEQ ID NO: 6737476 - DNA, 17 bp, Homo sapiens
ccgccagaggacaagga

SEQ ID NO: 6737477 - DNA, 16 bp, Homo sapiens
ccgccagagtgtcctg

SEQ ID NO: 6737478 - DNA, 17 bp, Homo sapiens
ccgccagccacaggacc

SEQ ID NO: 6737479 - DNA, 16 bp, Homo sapiens
ccgccagccagtggcc

SEQ ID NO: 6737480 - DNA, 17 bp, Homo sapiens
ccgccagccccaagctg

SEQ ID NO: 6737481 - DNA, 14 bp, Homo sapiens
ccgccagccctgtt

SEQ ID NO: 6737482 - DNA, 19 bp, Homo sapiens
ccgccagcctacactgcca

SEQ ID NO: 6737483 - DNA, 11 bp, Homo sapiens
ccgccagcctc

SEQ ID NO: 6737484 - DNA, 12 bp, Homo sapiens
ccgccagcctcc

SEQ ID NO: 6737485 - DNA, 13 bp, Homo sapiens
ccgccagcctcct

SEQ ID NO: 6737486 - DNA, 23 bp, Homo sapiens
ccgccagcctcctctggacggca

SEQ ID NO: 6737487 - DNA, 16 bp, Homo sapiens
ccgccagcgtgtggag

SEQ ID NO: 6737488 - DNA, 13 bp, Homo sapiens
ccgccagctctgt

SEQ ID NO: 6737489 - DNA, 14 bp, Homo sapiens
ccgccagctctgtt

SEQ ID NO: 6737490 - DNA, 14 bp, Homo sapiens
ccgccagctgccgc

SEQ ID NO: 6737491 - DNA, 17 bp, Homo sapiens
ccgccagctgccgcacc

SEQ ID NO: 6737492 - DNA, 22 bp, Homo sapiens
ccgccagctgccgcaccagccc

SEQ ID NO: 6737493 - DNA, 17 bp, Homo sapiens
ccgccaggcgcatgtct

SEQ ID NO: 6737494 - DNA, 23 bp, Homo sapiens
ccgccaggtgcccgcgccaggcc

SEQ ID NO: 6737495 - DNA, 14 bp, Homo sapiens
ccgccagtgtttct

SEQ ID NO: 6737496 - DNA, 16 bp, Homo sapiens
ccgccatagccccagt

SEQ ID NO: 6737497 - DNA, 22 bp, Homo sapiens
ccgccatccgggacgcttccag

SEQ ID NO: 6737498 - DNA, 15 bp, Homo sapiens
ccgccatcctctgcc

SEQ ID NO: 6737499 - DNA, 20 bp, Homo sapiens
ccgccatgcaactccatgcc

SEQ ID NO: 6737500 - DNA, 16 bp, Homo sapiens
ccgccatgctcctggc

SEQ ID NO: 6737501 - DNA, 19 bp, Homo sapiens
ccgccatgcttctgtgccg

SEQ ID NO: 6737502 - DNA, 15 bp, Homo sapiens
ccgccatggcttcca

SEQ ID NO: 6737503 - DNA, 20 bp, Homo sapiens
ccgccatggggtcggctcct

SEQ ID NO: 6737504 - DNA, 22 bp, Homo sapiens
ccgccatggggtcggctcctga

SEQ ID NO: 6737505 - DNA, 21 bp, Homo sapiens
ccgccatggtcaccctcagga

SEQ ID NO: 6737506 - DNA, 17 bp, Homo sapiens
ccgccatggtgtcccgg

SEQ ID NO: 6737507 - DNA, 21 bp, Homo sapiens
ccgccattctcaagccctgca

SEQ ID NO: 6737508 - DNA, 18 bp, Homo sapiens
ccgcccaaacctttcccc

SEQ ID NO: 6737509 - DNA, 23 bp, Homo sapiens
ccgcccaaagagaaatcacaggg

SEQ ID NO: 6737510 - DNA, 18 bp, Homo sapiens
ccgcccaacccccacctc

SEQ ID NO: 6737511 - DNA, 17 bp, Homo sapiens
ccgcccaaggccttccc

SEQ ID NO: 6737512 - DNA, 17 bp, Homo sapiens
ccgcccacaccctcggg

SEQ ID NO: 6737513 - DNA, 23 bp, Homo sapiens
ccgcccacaggaagcctgcagtc

SEQ ID NO: 6737514 - DNA, 21 bp, Homo sapiens
ccgcccacatcgggctcacct

SEQ ID NO: 6737515 - DNA, 14 bp, Homo sapiens
ccgcccacccagca

SEQ ID NO: 6737516 - DNA, 15 bp, Homo sapiens
ccgcccacctctgct

SEQ ID NO: 6737517 - DNA, 18 bp, Homo sapiens
ccgcccacctctgctgcc

SEQ ID NO: 6737518 - DNA, 13 bp, Homo sapiens
ccgcccacctggg

SEQ ID NO: 6737519 - DNA, 16 bp, Homo sapiens
ccgcccacgccggcct

SEQ ID NO: 6737520 - DNA, 18 bp, Homo sapiens
ccgcccacgccggcctct

SEQ ID NO: 6737521 - DNA, 19 bp, Homo sapiens
ccgcccacgccggcctctg

SEQ ID NO: 6737522 - DNA, 21 bp, Homo sapiens
ccgcccacgccggcctctgct

SEQ ID NO: 6737523 - DNA, 16 bp, Homo sapiens
ccgcccactcctggga

SEQ ID NO: 6737524 - DNA, 19 bp, Homo sapiens
ccgcccagacaccacagac

SEQ ID NO: 6737525 - DNA, 20 bp, Homo sapiens
ccgcccagaggagcccagcg

SEQ ID NO: 6737526 - DNA, 17 bp, Homo sapiens
ccgcccagatcatgccg

SEQ ID NO: 6737527 - DNA, 13 bp, Homo sapiens
ccgcccagcctca

SEQ ID NO: 6737528 - DNA, 15 bp, Homo sapiens
ccgcccagcctcact

SEQ ID NO: 6737529 - DNA, 15 bp, Homo sapiens
ccgcccagctctccc

SEQ ID NO: 6737530 - DNA, 17 bp, Homo sapiens
ccgcccagctgcacctg

SEQ ID NO: 6737531 - DNA, 20 bp, Homo sapiens
ccgcccaggctggccagccc

SEQ ID NO: 6737532 - DNA, 20 bp, Homo sapiens
ccgcccaggcttagtcactg

SEQ ID NO: 6737533 - DNA, 14 bp, Homo sapiens
ccgcccatgctgtc

SEQ ID NO: 6737534 - DNA, 17 bp, Homo sapiens
ccgccccaaccctcgga

SEQ ID NO: 6737535 - DNA, 23 bp, Homo sapiens
ccgccccaaccctcggagccccc

SEQ ID NO: 6737536 - DNA, 13 bp, Homo sapiens
ccgccccacattc

SEQ ID NO: 6737537 - DNA, 16 bp, Homo sapiens
ccgccccacctcccat

SEQ ID NO: 6737538 - DNA, 22 bp, Homo sapiens
ccgccccagagactgcccaccc

SEQ ID NO: 6737539 - DNA, 13 bp, Homo sapiens
ccgccccagagtg

SEQ ID NO: 6737540 - DNA, 11 bp, Homo sapiens
ccgccccagcc

SEQ ID NO: 6737541 - DNA, 16 bp, Homo sapiens
ccgccccagccctcag

SEQ ID NO: 6737542 - DNA, 14 bp, Homo sapiens
ccgccccagcctct

SEQ ID NO: 6737543 - DNA, 11 bp, Homo sapiens
ccgccccaggc

SEQ ID NO: 6737544 - DNA, 14 bp, Homo sapiens
ccgccccaggcttc

SEQ ID NO: 6737545 - DNA, 12 bp, Homo sapiens
ccgccccagggt

SEQ ID NO: 6737546 - DNA, 21 bp, Homo sapiens
ccgccccatgggcccctcacc

SEQ ID NO: 6737547 - DNA, 17 bp, Homo sapiens
ccgcccccacccctaca

SEQ ID NO: 6737548 - DNA, 12 bp, Homo sapiens
ccgcccccaccg

SEQ ID NO: 6737549 - DNA, 13 bp, Homo sapiens
ccgcccccaccgg

SEQ ID NO: 6737550 - DNA, 12 bp, Homo sapiens
ccgcccccagcc

SEQ ID NO: 6737551 - DNA, 13 bp, Homo sapiens
ccgcccccagcct

SEQ ID NO: 6737552 - DNA, 14 bp, Homo sapiens
ccgcccccaggtag

SEQ ID NO: 6737553 - DNA, 17 bp, Homo sapiens
ccgccccccagagccag

SEQ ID NO: 6737554 - DNA, 20 bp, Homo sapiens
ccgccccccagagccagggc

SEQ ID NO: 6737555 - DNA, 16 bp, Homo sapiens
ccgcccccgcccaggc

SEQ ID NO: 6737556 - DNA, 14 bp, Homo sapiens
ccgcccccgcctgg

SEQ ID NO: 6737557 - DNA, 14 bp, Homo sapiens
ccgccccctcctga

SEQ ID NO: 6737558 - DNA, 13 bp, Homo sapiens
ccgccccctgaaa

SEQ ID NO: 6737559 - DNA, 16 bp, Homo sapiens
ccgccccctgccctcc

SEQ ID NO: 6737560 - DNA, 17 bp, Homo sapiens
ccgccccctgccctccc

SEQ ID NO: 6737561 - DNA, 15 bp, Homo sapiens
ccgccccgccccaga

SEQ ID NO: 6737562 - DNA, 24 bp, Homo sapiens
ccgccccgcgcaccccacgccctg

SEQ ID NO: 6737563 - DNA, 17 bp, Homo sapiens
ccgccccggacagggtg

SEQ ID NO: 6737564 - DNA, 21 bp, Homo sapiens
ccgccccggacagggtggcac

SEQ ID NO: 6737565 - DNA, 15 bp, Homo sapiens
ccgccccgggctggc

SEQ ID NO: 6737566 - DNA, 22 bp, Homo sapiens
ccgccccggggactcgcagcac

SEQ ID NO: 6737567 - DNA, 17 bp, Homo sapiens
ccgccccgtgctcctct

SEQ ID NO: 6737568 - DNA, 16 bp, Homo sapiens
ccgcccctccacccat

SEQ ID NO: 6737569 - DNA, 15 bp, Homo sapiens
ccgcccctcccacgc

SEQ ID NO: 6737570 - DNA, 15 bp, Homo sapiens
ccgcccctcgcccgc

SEQ ID NO: 6737571 - DNA, 18 bp, Homo sapiens
ccgcccctcgctgctgct

SEQ ID NO: 6737572 - DNA, 18 bp, Homo sapiens
ccgcccctctccaaacac

SEQ ID NO: 6737573 - DNA, 12 bp, Homo sapiens
ccgcccctgagg

SEQ ID NO: 6737574 - DNA, 13 bp, Homo sapiens
ccgcccctgcagc

SEQ ID NO: 6737575 - DNA, 17 bp, Homo sapiens
ccgcccctgcagcacgg

SEQ ID NO: 6737576 - DNA, 12 bp, Homo sapiens
ccgcccctgcat

SEQ ID NO: 6737577 - DNA, 22 bp, Homo sapiens
ccgcccctgggctaccatctgc

SEQ ID NO: 6737578 - DNA, 13 bp, Homo sapiens
ccgcccctgggga

SEQ ID NO: 6737579 - DNA, 21 bp, Homo sapiens
ccgcccctgtggccctggcca

SEQ ID NO: 6737580 - DNA, 17 bp, Homo sapiens
ccgccccttccccgagg

SEQ ID NO: 6737581 - DNA, 15 bp, Homo sapiens
ccgcccgagcccctg

SEQ ID NO: 6737582 - DNA, 22 bp, Homo sapiens
ccgcccgagggatggtgcccct

SEQ ID NO: 6737583 - DNA, 19 bp, Homo sapiens
ccgcccgaggtggctgcct

SEQ ID NO: 6737584 - DNA, 14 bp, Homo sapiens
ccgcccgccctcct

SEQ ID NO: 6737585 - DNA, 17 bp, Homo sapiens
ccgcccgcttccctcct

SEQ ID NO: 6737586 - DNA, 15 bp, Homo sapiens
ccgcccggcagcccc

SEQ ID NO: 6737587 - DNA, 16 bp, Homo sapiens
ccgcccggcctcctag

SEQ ID NO: 6737588 - DNA, 15 bp, Homo sapiens
ccgcccgggcccaga

SEQ ID NO: 6737589 - DNA, 19 bp, Homo sapiens
ccgcccgtagatcatcccc

SEQ ID NO: 6737590 - DNA, 17 bp, Homo sapiens
ccgcccgtctctgctct

SEQ ID NO: 6737591 - DNA, 15 bp, Homo sapiens
ccgccctcacctctg

SEQ ID NO: 6737592 - DNA, 14 bp, Homo sapiens
ccgccctccaccca

SEQ ID NO: 6737593 - DNA, 23 bp, Homo sapiens
ccgccctccacccactaggtgaa

SEQ ID NO: 6737594 - DNA, 21 bp, Homo sapiens
ccgccctccccctgccagagg

SEQ ID NO: 6737595 - DNA, 21 bp, Homo sapiens
ccgccctccgtcgggcccctg

SEQ ID NO: 6737596 - DNA, 13 bp, Homo sapiens
ccgccctcctcca

SEQ ID NO: 6737597 - DNA, 14 bp, Homo sapiens
ccgccctcctcgct

SEQ ID NO: 6737598 - DNA, 13 bp, Homo sapiens
ccgccctcctcgg

SEQ ID NO: 6737599 - DNA, 14 bp, Homo sapiens
ccgccctcctcggg

SEQ ID NO: 6737600 - DNA, 22 bp, Homo sapiens
ccgccctcctcgggccgaggcc

SEQ ID NO: 6737601 - DNA, 15 bp, Homo sapiens
ccgccctcctctgcc

SEQ ID NO: 6737602 - DNA, 16 bp, Homo sapiens
ccgccctcctctgccc

SEQ ID NO: 6737603 - DNA, 13 bp, Homo sapiens
ccgccctcgctcc

SEQ ID NO: 6737604 - DNA, 13 bp, Homo sapiens
ccgccctctgccc

SEQ ID NO: 6737605 - DNA, 13 bp, Homo sapiens
ccgccctcttcct

SEQ ID NO: 6737606 - DNA, 15 bp, Homo sapiens
ccgccctcttcctga

SEQ ID NO: 6737607 - DNA, 13 bp, Homo sapiens
ccgccctgagaga

SEQ ID NO: 6737608 - DNA, 17 bp, Homo sapiens
ccgccctgatttgctgt

SEQ ID NO: 6737609 - DNA, 12 bp, Homo sapiens
ccgccctgccac

SEQ ID NO: 6737610 - DNA, 14 bp, Homo sapiens
ccgccctgccactc

SEQ ID NO: 6737611 - DNA, 19 bp, Homo sapiens
ccgccctgcgggccacagg

SEQ ID NO: 6737612 - DNA, 21 bp, Homo sapiens
ccgccctgctcctccctggct

SEQ ID NO: 6737613 - DNA, 17 bp, Homo sapiens
ccgccctggacagatgg

SEQ ID NO: 6737614 - DNA, 16 bp, Homo sapiens
ccgccctgggctctgg

SEQ ID NO: 6737615 - DNA, 14 bp, Homo sapiens
ccgccctgggctgg

SEQ ID NO: 6737616 - DNA, 19 bp, Homo sapiens
ccgccctgggctggactgg

SEQ ID NO: 6737617 - DNA, 20 bp, Homo sapiens
ccgccctgtgggagccgcag

SEQ ID NO: 6737618 - DNA, 23 bp, Homo sapiens
ccgccctgtgggagccgcagagc

SEQ ID NO: 6737619 - DNA, 17 bp, Homo sapiens
ccgcccttcccacagca

SEQ ID NO: 6737620 - DNA, 18 bp, Homo sapiens
ccgcccttccctgacact

SEQ ID NO: 6737621 - DNA, 15 bp, Homo sapiens
ccgcccttcctggag

SEQ ID NO: 6737622 - DNA, 23 bp, Homo sapiens
ccgcccttcctggaggctgccta

SEQ ID NO: 6737623 - DNA, 16 bp, Homo sapiens
ccgccgaagggcagcc

SEQ ID NO: 6737624 - DNA, 22 bp, Homo sapiens
ccgccgaagggcagccccgcga

SEQ ID NO: 6737625 - DNA, 15 bp, Homo sapiens
ccgccgatcccaggt

SEQ ID NO: 6737626 - DNA, 20 bp, Homo sapiens
ccgccgcagaagcagcccct

SEQ ID NO: 6737627 - DNA, 12 bp, Homo sapiens
ccgccgcagctg

SEQ ID NO: 6737628 - DNA, 13 bp, Homo sapiens
ccgccgccaccag

SEQ ID NO: 6737629 - DNA, 15 bp, Homo sapiens
ccgccgcccgctggg

SEQ ID NO: 6737630 - DNA, 14 bp, Homo sapiens
ccgccgccgcgcgc

SEQ ID NO: 6737631 - DNA, 15 bp, Homo sapiens
ccgccgcctcccacg

SEQ ID NO: 6737632 - DNA, 18 bp, Homo sapiens
ccgccgcctcccacggca

SEQ ID NO: 6737633 - DNA, 15 bp, Homo sapiens
ccgccgcgccagtcc

SEQ ID NO: 6737634 - DNA, 19 bp, Homo sapiens
ccgccgcgcctggcctaga

SEQ ID NO: 6737635 - DNA, 15 bp, Homo sapiens
ccgccgcgcgcccct

SEQ ID NO: 6737636 - DNA, 15 bp, Homo sapiens
ccgccgctgaccctg

SEQ ID NO: 6737637 - DNA, 15 bp, Homo sapiens
ccgccggaggaaggt

SEQ ID NO: 6737638 - DNA, 17 bp, Homo sapiens
ccgccggaggaaggtcc

SEQ ID NO: 6737639 - DNA, 22 bp, Homo sapiens
ccgccggaggccagctatctgc

SEQ ID NO: 6737640 - DNA, 21 bp, Homo sapiens
ccgccggcaataaaagcccag

SEQ ID NO: 6737641 - DNA, 22 bp, Homo sapiens
ccgccggcaataaaagcccagg

SEQ ID NO: 6737642 - DNA, 16 bp, Homo sapiens
ccgccggcaggggccc

SEQ ID NO: 6737643 - DNA, 23 bp, Homo sapiens
ccgccggccgcgcaccgccatgc

SEQ ID NO: 6737644 - DNA, 24 bp, Homo sapiens
ccgccggggtcctgggaggctgca

SEQ ID NO: 6737645 - DNA, 22 bp, Homo sapiens
ccgccggttggccggctggccg

SEQ ID NO: 6737646 - DNA, 15 bp, Homo sapiens
ccgccgtctgcaggg

SEQ ID NO: 6737647 - DNA, 20 bp, Homo sapiens
ccgccgtctgcaggggcctg

SEQ ID NO: 6737648 - DNA, 14 bp, Homo sapiens
ccgccgtgccggcg

SEQ ID NO: 6737649 - DNA, 15 bp, Homo sapiens
ccgccgtgcctgcat

SEQ ID NO: 6737650 - DNA, 16 bp, Homo sapiens
ccgcctagtttactgt

SEQ ID NO: 6737651 - DNA, 14 bp, Homo sapiens
ccgcctcaaaatgt

SEQ ID NO: 6737652 - DNA, 20 bp, Homo sapiens
ccgcctcaaggaagagccag

SEQ ID NO: 6737653 - DNA, 22 bp, Homo sapiens
ccgcctcaaggaagagccagcc

SEQ ID NO: 6737654 - DNA, 23 bp, Homo sapiens
ccgcctcaaggaagagccagccg

SEQ ID NO: 6737655 - DNA, 12 bp, Homo sapiens
ccgcctcagcct

SEQ ID NO: 6737656 - DNA, 23 bp, Homo sapiens
ccgcctcagggttttggggtcct

SEQ ID NO: 6737657 - DNA, 13 bp, Homo sapiens
ccgcctccacact

SEQ ID NO: 6737658 - DNA, 14 bp, Homo sapiens
ccgcctccactcta

SEQ ID NO: 6737659 - DNA, 13 bp, Homo sapiens
ccgcctccaggag

SEQ ID NO: 6737660 - DNA, 15 bp, Homo sapiens
ccgcctccccaagtc

SEQ ID NO: 6737661 - DNA, 23 bp, Homo sapiens
ccgcctccccatacttcctggga

SEQ ID NO: 6737662 - DNA, 23 bp, Homo sapiens
ccgcctcccgccaccctgtctca

SEQ ID NO: 6737663 - DNA, 23 bp, Homo sapiens
ccgcctccctagttagcatccag

SEQ ID NO: 6737664 - DNA, 21 bp, Homo sapiens
ccgcctccgggacccccagga

SEQ ID NO: 6737665 - DNA, 13 bp, Homo sapiens
ccgcctcctccca

SEQ ID NO: 6737666 - DNA, 15 bp, Homo sapiens
ccgcctcctccctgc

SEQ ID NO: 6737667 - DNA, 16 bp, Homo sapiens
ccgcctcctccctgcc

SEQ ID NO: 6737668 - DNA, 23 bp, Homo sapiens
ccgcctcgacctccccacccgct

SEQ ID NO: 6737669 - DNA, 17 bp, Homo sapiens
ccgcctcgcccaccgca

SEQ ID NO: 6737670 - DNA, 21 bp, Homo sapiens
ccgcctcgcccaccgcatgcc

SEQ ID NO: 6737671 - DNA, 18 bp, Homo sapiens
ccgcctcgcccccgggcc

SEQ ID NO: 6737672 - DNA, 20 bp, Homo sapiens
ccgcctcggagtgtggcctg

SEQ ID NO: 6737673 - DNA, 21 bp, Homo sapiens
ccgcctcggagtgtggcctgg

SEQ ID NO: 6737674 - DNA, 22 bp, Homo sapiens
ccgcctcggagtgtggcctgga

SEQ ID NO: 6737675 - DNA, 23 bp, Homo sapiens
ccgcctcggagtgtggcctggat

SEQ ID NO: 6737676 - DNA, 18 bp, Homo sapiens
ccgcctcgggccgcctcc

SEQ ID NO: 6737677 - DNA, 21 bp, Homo sapiens
ccgcctcgggccgcctcctcc

SEQ ID NO: 6737678 - DNA, 14 bp, Homo sapiens
ccgcctctgcccgc

SEQ ID NO: 6737679 - DNA, 19 bp, Homo sapiens
ccgcctctggccgccaccc

SEQ ID NO: 6737680 - DNA, 21 bp, Homo sapiens
ccgcctgcagaggacagagct

SEQ ID NO: 6737681 - DNA, 20 bp, Homo sapiens
ccgcctgccacctctcccag

SEQ ID NO: 6737682 - DNA, 17 bp, Homo sapiens
ccgcctgcccacctgcc

SEQ ID NO: 6737683 - DNA, 22 bp, Homo sapiens
ccgcctgcccgtctctctccca

SEQ ID NO: 6737684 - DNA, 16 bp, Homo sapiens
ccgcctgccctcatgg

SEQ ID NO: 6737685 - DNA, 15 bp, Homo sapiens
ccgcctgccctgcct

SEQ ID NO: 6737686 - DNA, 17 bp, Homo sapiens
ccgcctgcctcctggct

SEQ ID NO: 6737687 - DNA, 19 bp, Homo sapiens
ccgcctgcctcctggctca

SEQ ID NO: 6737688 - DNA, 14 bp, Homo sapiens
ccgcctgcctctgc

SEQ ID NO: 6737689 - DNA, 15 bp, Homo sapiens
ccgcctgccttagca

SEQ ID NO: 6737690 - DNA, 19 bp, Homo sapiens
ccgcctgctacacaggcag

SEQ ID NO: 6737691 - DNA, 20 bp, Homo sapiens
ccgcctgctacacaggcagg

SEQ ID NO: 6737692 - DNA, 22 bp, Homo sapiens
ccgcctgctcctcactggagga

SEQ ID NO: 6737693 - DNA, 16 bp, Homo sapiens
ccgcctgctgggaaga

SEQ ID NO: 6737694 - DNA, 22 bp, Homo sapiens
ccgcctgcttcacacccctcag

SEQ ID NO: 6737695 - DNA, 22 bp, Homo sapiens
ccgcctgcttcttctctccaca

SEQ ID NO: 6737696 - DNA, 16 bp, Homo sapiens
ccgcctggcagaactg

SEQ ID NO: 6737697 - DNA, 12 bp, Homo sapiens
ccgcctggccag

SEQ ID NO: 6737698 - DNA, 15 bp, Homo sapiens
ccgcctggccaggag

SEQ ID NO: 6737699 - DNA, 17 bp, Homo sapiens
ccgcctggccaggagca

SEQ ID NO: 6737700 - DNA, 23 bp, Homo sapiens
ccgcctggccaggagcaggcacg

SEQ ID NO: 6737701 - DNA, 14 bp, Homo sapiens
ccgcctggccaggg

SEQ ID NO: 6737702 - DNA, 15 bp, Homo sapiens
ccgcctggccagggc

SEQ ID NO: 6737703 - DNA, 13 bp, Homo sapiens
ccgcctggccggc

SEQ ID NO: 6737704 - DNA, 14 bp, Homo sapiens
ccgcctggccggct

SEQ ID NO: 6737705 - DNA, 18 bp, Homo sapiens
ccgcctggccggctccag

SEQ ID NO: 6737706 - DNA, 11 bp, Homo sapiens
ccgcctgggat

SEQ ID NO: 6737707 - DNA, 18 bp, Homo sapiens
ccgcctgggtcatgggcc

SEQ ID NO: 6737708 - DNA, 23 bp, Homo sapiens
ccgcctgggtcatgggcctgtgg

SEQ ID NO: 6737709 - DNA, 13 bp, Homo sapiens
ccgcctgtcaata

SEQ ID NO: 6737710 - DNA, 17 bp, Homo sapiens
ccgcctgtcacaataaa

SEQ ID NO: 6737711 - DNA, 11 bp, Homo sapiens
ccgcctgtcct

SEQ ID NO: 6737712 - DNA, 15 bp, Homo sapiens
ccgcctgtccttggt

SEQ ID NO: 6737713 - DNA, 23 bp, Homo sapiens
ccgcctgtctctttaagggcatg

SEQ ID NO: 6737714 - DNA, 12 bp, Homo sapiens
ccgcctgtgccc

SEQ ID NO: 6737715 - DNA, 19 bp, Homo sapiens
ccgcctgtgcccacgtgtg

SEQ ID NO: 6737716 - DNA, 11 bp, Homo sapiens
ccgcctgtggg

SEQ ID NO: 6737717 - DNA, 13 bp, Homo sapiens
ccgccttaccagg

SEQ ID NO: 6737718 - DNA, 20 bp, Homo sapiens
ccgccttcaggttcctccta

SEQ ID NO: 6737719 - DNA, 16 bp, Homo sapiens
ccgccttccaaaacct

SEQ ID NO: 6737720 - DNA, 14 bp, Homo sapiens
ccgccttccctcac

SEQ ID NO: 6737721 - DNA, 23 bp, Homo sapiens
ccgccttccctcactcttcctca

SEQ ID NO: 6737722 - DNA, 13 bp, Homo sapiens
ccgccttccggtg

SEQ ID NO: 6737723 - DNA, 17 bp, Homo sapiens
ccgccttcgtgtgctgc

SEQ ID NO: 6737724 - DNA, 19 bp, Homo sapiens
ccgccttcgtgtgctgctg

SEQ ID NO: 6737725 - DNA, 16 bp, Homo sapiens
ccgccttctcccacat

SEQ ID NO: 6737726 - DNA, 14 bp, Homo sapiens
ccgccttctcccct

SEQ ID NO: 6737727 - DNA, 16 bp, Homo sapiens
ccgccttctcccctct

SEQ ID NO: 6737728 - DNA, 23 bp, Homo sapiens
ccgccttgagtgacatgcggctg

SEQ ID NO: 6737729 - DNA, 22 bp, Homo sapiens
ccgccttgcccagcctggatgc

SEQ ID NO: 6737730 - DNA, 18 bp, Homo sapiens
ccgccttggcctcccaaa

SEQ ID NO: 6737731 - DNA, 19 bp, Homo sapiens
ccgccttgtgagatggaat

SEQ ID NO: 6737732 - DNA, 16 bp, Homo sapiens
ccgcctttacaaggga

SEQ ID NO: 6737733 - DNA, 23 bp, Homo sapiens
ccgcctttgcgctctcgggtcac

SEQ ID NO: 6737734 - DNA, 22 bp, Homo sapiens
ccgcctttgggttccatcttgc

SEQ ID NO: 6737735 - DNA, 17 bp, Homo sapiens
ccgccttttagttttgg

SEQ ID NO: 6737736 - DNA, 19 bp, Homo sapiens
ccgccttttcccccaccct

SEQ ID NO: 6737737 - DNA, 18 bp, Homo sapiens
ccgcgaagtccgaggcct

SEQ ID NO: 6737738 - DNA, 18 bp, Homo sapiens
ccgcgagactgagaggca

SEQ ID NO: 6737739 - DNA, 15 bp, Homo sapiens
ccgcgagggcctgcg

SEQ ID NO: 6737740 - DNA, 19 bp, Homo sapiens
ccgcgagggctactcagca

SEQ ID NO: 6737741 - DNA, 18 bp, Homo sapiens
ccgcgcaccccacgccct

SEQ ID NO: 6737742 - DNA, 18 bp, Homo sapiens
ccgcgccacccgggcaag

SEQ ID NO: 6737743 - DNA, 13 bp, Homo sapiens
ccgcgccagtccc

SEQ ID NO: 6737744 - DNA, 17 bp, Homo sapiens
ccgcgccagtccccgct

SEQ ID NO: 6737745 - DNA, 12 bp, Homo sapiens
ccgcgcccagca

SEQ ID NO: 6737746 - DNA, 23 bp, Homo sapiens
ccgcgcccagcgctcgccacgct

SEQ ID NO: 6737747 - DNA, 14 bp, Homo sapiens
ccgcgcccctctgc

SEQ ID NO: 6737748 - DNA, 17 bp, Homo sapiens
ccgcgcccctgggacta

SEQ ID NO: 6737749 - DNA, 12 bp, Homo sapiens
ccgcgcccgccg

SEQ ID NO: 6737750 - DNA, 16 bp, Homo sapiens
ccgcgcccgcgccctc

SEQ ID NO: 6737751 - DNA, 17 bp, Homo sapiens
ccgcgccctccgacctc

SEQ ID NO: 6737752 - DNA, 16 bp, Homo sapiens
ccgcgccctcctgccc

SEQ ID NO: 6737753 - DNA, 16 bp, Homo sapiens
ccgcgcctccttcctt

SEQ ID NO: 6737754 - DNA, 20 bp, Homo sapiens
ccgcgcgccggtccggcgcc

SEQ ID NO: 6737755 - DNA, 18 bp, Homo sapiens
ccgcgcggagacctcctg

SEQ ID NO: 6737756 - DNA, 18 bp, Homo sapiens
ccgcgcgtgcccccagcg

SEQ ID NO: 6737757 - DNA, 13 bp, Homo sapiens
ccgcgctcaggag

SEQ ID NO: 6737758 - DNA, 19 bp, Homo sapiens
ccgcgctcgcccagcagga

SEQ ID NO: 6737759 - DNA, 18 bp, Homo sapiens
ccgcgctcggggctgggc

SEQ ID NO: 6737760 - DNA, 19 bp, Homo sapiens
ccgcgctctgcccctccgt

SEQ ID NO: 6737761 - DNA, 20 bp, Homo sapiens
ccgcgctctgcccctccgtc

SEQ ID NO: 6737762 - DNA, 17 bp, Homo sapiens
ccgcggacgtgctggcc

SEQ ID NO: 6737763 - DNA, 19 bp, Homo sapiens
ccgcggacgtgctggcctt

SEQ ID NO: 6737764 - DNA, 13 bp, Homo sapiens
ccgcggagccccc

SEQ ID NO: 6737765 - DNA, 14 bp, Homo sapiens
ccgcggagcccccg

SEQ ID NO: 6737766 - DNA, 15 bp, Homo sapiens
ccgcggagcctgcat

SEQ ID NO: 6737767 - DNA, 18 bp, Homo sapiens
ccgcggaggcccctgagg

SEQ ID NO: 6737768 - DNA, 12 bp, Homo sapiens
ccgcggcccaga

SEQ ID NO: 6737769 - DNA, 19 bp, Homo sapiens
ccgcggcccagacccagcc

SEQ ID NO: 6737770 - DNA, 16 bp, Homo sapiens
ccgcggcctgcaccga

SEQ ID NO: 6737771 - DNA, 12 bp, Homo sapiens
ccgcggcctgga

SEQ ID NO: 6737772 - DNA, 18 bp, Homo sapiens
ccgcggcgcgaccctccc

SEQ ID NO: 6737773 - DNA, 15 bp, Homo sapiens
ccgcggcgggccctg

SEQ ID NO: 6737774 - DNA, 13 bp, Homo sapiens
ccgcggctggagc

SEQ ID NO: 6737775 - DNA, 14 bp, Homo sapiens
ccgcggctggagcg

SEQ ID NO: 6737776 - DNA, 17 bp, Homo sapiens
ccgcgggacagccaagc

SEQ ID NO: 6737777 - DNA, 16 bp, Homo sapiens
ccgcgggactgacacc

SEQ ID NO: 6737778 - DNA, 23 bp, Homo sapiens
ccgcgggagacagcttctctgca

SEQ ID NO: 6737779 - DNA, 19 bp, Homo sapiens
ccgcggggaagctggcttt

SEQ ID NO: 6737780 - DNA, 21 bp, Homo sapiens
ccgcggggctgtcggcgctgc

SEQ ID NO: 6737781 - DNA, 15 bp, Homo sapiens
ccgcgggtcccggcc

SEQ ID NO: 6737782 - DNA, 20 bp, Homo sapiens
ccgcgggtcccggccgcgcc

SEQ ID NO: 6737783 - DNA, 19 bp, Homo sapiens
ccgcgggtggctggagccc

SEQ ID NO: 6737784 - DNA, 15 bp, Homo sapiens
ccgcggtgctctggc

SEQ ID NO: 6737785 - DNA, 23 bp, Homo sapiens
ccgcggtgctgactgaggcctgc

SEQ ID NO: 6737786 - DNA, 21 bp, Homo sapiens
ccgcggttcatacgcatccca

SEQ ID NO: 6737787 - DNA, 15 bp, Homo sapiens
ccgcgtcccggcaag

SEQ ID NO: 6737788 - DNA, 17 bp, Homo sapiens
ccgcgtcgccctcccag

SEQ ID NO: 6737789 - DNA, 18 bp, Homo sapiens
ccgcgtgacggacatcca

SEQ ID NO: 6737790 - DNA, 17 bp, Homo sapiens
ccgcgtgcaaaggaaag

SEQ ID NO: 6737791 - DNA, 12 bp, Homo sapiens
ccgcgtgccggg

SEQ ID NO: 6737792 - DNA, 14 bp, Homo sapiens
ccgcgtgccgggcc

SEQ ID NO: 6737793 - DNA, 16 bp, Homo sapiens
ccgcgtgccgggcccc

SEQ ID NO: 6737794 - DNA, 17 bp, Homo sapiens
ccgcgtgccgggccccc

SEQ ID NO: 6737795 - DNA, 19 bp, Homo sapiens
ccgcgtgcgaccagaggtg

SEQ ID NO: 6737796 - DNA, 22 bp, Homo sapiens
ccgcgtgtccccggggcccagg

SEQ ID NO: 6737797 - DNA, 14 bp, Homo sapiens
ccgcgtgtgcctgt

SEQ ID NO: 6737798 - DNA, 22 bp, Homo sapiens
ccgcgttcaagacttgagcgga

SEQ ID NO: 6737799 - DNA, 13 bp, Homo sapiens
ccgcgttgtaaaa

SEQ ID NO: 6737800 - DNA, 17 bp, Homo sapiens
ccgcgttgtaaaatata

SEQ ID NO: 6737801 - DNA, 16 bp, Homo sapiens
ccgcgtttagaccaag

SEQ ID NO: 6737802 - DNA, 18 bp, Homo sapiens
ccgctaaaagaaactttc

SEQ ID NO: 6737803 - DNA, 10 bp, Homo sapiens
ccgctaattc

SEQ ID NO: 6737804 - DNA, 21 bp, Homo sapiens
ccgctacaagagggcaaagct

SEQ ID NO: 6737805 - DNA, 17 bp, Homo sapiens
ccgctacaccactctgg

SEQ ID NO: 6737806 - DNA, 19 bp, Homo sapiens
ccgctacaccactctggca

SEQ ID NO: 6737807 - DNA, 16 bp, Homo sapiens
ccgctacagtttttat

SEQ ID NO: 6737808 - DNA, 15 bp, Homo sapiens
ccgctagaggcctga

SEQ ID NO: 6737809 - DNA, 22 bp, Homo sapiens
ccgctaggctcgccttccctcc

SEQ ID NO: 6737810 - DNA, 22 bp, Homo sapiens
ccgctagtgcttgtggagatca

SEQ ID NO: 6737811 - DNA, 14 bp, Homo sapiens
ccgctatgcagggt

SEQ ID NO: 6737812 - DNA, 16 bp, Homo sapiens
ccgctcacctagagcc

SEQ ID NO: 6737813 - DNA, 11 bp, Homo sapiens
ccgctcagccc

SEQ ID NO: 6737814 - DNA, 16 bp, Homo sapiens
ccgctcaggggcctgg

SEQ ID NO: 6737815 - DNA, 18 bp, Homo sapiens
ccgctcaggggcctggag

SEQ ID NO: 6737816 - DNA, 19 bp, Homo sapiens
ccgctcaggggcctggagg

SEQ ID NO: 6737817 - DNA, 11 bp, Homo sapiens
ccgctccagag

SEQ ID NO: 6737818 - DNA, 18 bp, Homo sapiens
ccgctccagatctgcact

SEQ ID NO: 6737819 - DNA, 13 bp, Homo sapiens
ccgctccagcgtc

SEQ ID NO: 6737820 - DNA, 20 bp, Homo sapiens
ccgctccaggtaccttgacc

SEQ ID NO: 6737821 - DNA, 20 bp, Homo sapiens
ccgctcccaacccccctcct

SEQ ID NO: 6737822 - DNA, 14 bp, Homo sapiens
ccgctcccacagct

SEQ ID NO: 6737823 - DNA, 19 bp, Homo sapiens
ccgctcccacagcttcctg

SEQ ID NO: 6737824 - DNA, 22 bp, Homo sapiens
ccgctcccacagcttcctgagg

SEQ ID NO: 6737825 - DNA, 20 bp, Homo sapiens
ccgctcccaccgcccccacc

SEQ ID NO: 6737826 - DNA, 22 bp, Homo sapiens
ccgctcccacctagtgccccag

SEQ ID NO: 6737827 - DNA, 14 bp, Homo sapiens
ccgctcccagtgtc

SEQ ID NO: 6737828 - DNA, 15 bp, Homo sapiens
ccgctccccacagct

SEQ ID NO: 6737829 - DNA, 23 bp, Homo sapiens
ccgctccccacagctttgcaccc

SEQ ID NO: 6737830 - DNA, 15 bp, Homo sapiens
ccgctccccagccca

SEQ ID NO: 6737831 - DNA, 20 bp, Homo sapiens
ccgctcccctctcctccgcc

SEQ ID NO: 6737832 - DNA, 19 bp, Homo sapiens
ccgctcccgcagcgggcgc

SEQ ID NO: 6737833 - DNA, 18 bp, Homo sapiens
ccgctcccgctcccaggt

SEQ ID NO: 6737834 - DNA, 21 bp, Homo sapiens
ccgctcccggttccctcccca

SEQ ID NO: 6737835 - DNA, 22 bp, Homo sapiens
ccgctcccggttccctccccag

SEQ ID NO: 6737836 - DNA, 13 bp, Homo sapiens
ccgctccctggat

SEQ ID NO: 6737837 - DNA, 15 bp, Homo sapiens
ccgctccgtctctgt

SEQ ID NO: 6737838 - DNA, 17 bp, Homo sapiens
ccgctccgtctctgtcc

SEQ ID NO: 6737839 - DNA, 21 bp, Homo sapiens
ccgctcctccctgctcctcat

SEQ ID NO: 6737840 - DNA, 15 bp, Homo sapiens
ccgctcctgccgcag

SEQ ID NO: 6737841 - DNA, 13 bp, Homo sapiens
ccgctcctgcttc

SEQ ID NO: 6737842 - DNA, 19 bp, Homo sapiens
ccgctcctttacctaccac

SEQ ID NO: 6737843 - DNA, 21 bp, Homo sapiens
ccgctcggacttactgcctga

SEQ ID NO: 6737844 - DNA, 21 bp, Homo sapiens
ccgctcgttcctgcagccaga

SEQ ID NO: 6737845 - DNA, 12 bp, Homo sapiens
ccgctctaaatt

SEQ ID NO: 6737846 - DNA, 20 bp, Homo sapiens
ccgctctacatcttctgcct

SEQ ID NO: 6737847 - DNA, 16 bp, Homo sapiens
ccgctctcccagacct

SEQ ID NO: 6737848 - DNA, 20 bp, Homo sapiens
ccgctctccccctgcagccg

SEQ ID NO: 6737849 - DNA, 14 bp, Homo sapiens
ccgctctcctgcca

SEQ ID NO: 6737850 - DNA, 17 bp, Homo sapiens
ccgctctcctgccacat

SEQ ID NO: 6737851 - DNA, 13 bp, Homo sapiens
ccgctctcttcct

SEQ ID NO: 6737852 - DNA, 21 bp, Homo sapiens
ccgctctcttttctgtacttc

SEQ ID NO: 6737853 - DNA, 18 bp, Homo sapiens
ccgctctgaggcaacccc

SEQ ID NO: 6737854 - DNA, 22 bp, Homo sapiens
ccgctctgcatgcggcccagcc

SEQ ID NO: 6737855 - DNA, 14 bp, Homo sapiens
ccgctctggaccaa

SEQ ID NO: 6737856 - DNA, 21 bp, Homo sapiens
ccgctcttggggacatgggtc

SEQ ID NO: 6737857 - DNA, 20 bp, Homo sapiens
ccgctgaccctgggcctgga

SEQ ID NO: 6737858 - DNA, 22 bp, Homo sapiens
ccgctgaccctgggcctggagg

SEQ ID NO: 6737859 - DNA, 13 bp, Homo sapiens
ccgctgaggggtc

SEQ ID NO: 6737860 - DNA, 18 bp, Homo sapiens
ccgctgatggagccccac

SEQ ID NO: 6737861 - DNA, 19 bp, Homo sapiens
ccgctgatggagccccacc

SEQ ID NO: 6737862 - DNA, 16 bp, Homo sapiens
ccgctgcaatgcctag

SEQ ID NO: 6737863 - DNA, 19 bp, Homo sapiens
ccgctgcaatgcctagact

SEQ ID NO: 6737864 - DNA, 15 bp, Homo sapiens
ccgctgcaccacggc

SEQ ID NO: 6737865 - DNA, 15 bp, Homo sapiens
ccgctgcaggaaaca

SEQ ID NO: 6737866 - DNA, 14 bp, Homo sapiens
ccgctgcagggctc

SEQ ID NO: 6737867 - DNA, 16 bp, Homo sapiens
ccgctgcagggctccc

SEQ ID NO: 6737868 - DNA, 15 bp, Homo sapiens
ccgctgcagggtggc

SEQ ID NO: 6737869 - DNA, 24 bp, Homo sapiens
ccgctgccaccacgtctgccaggc

SEQ ID NO: 6737870 - DNA, 21 bp, Homo sapiens
ccgctgccacccgcccacccg

SEQ ID NO: 6737871 - DNA, 24 bp, Homo sapiens
ccgctgccacccgcccacccgcct

SEQ ID NO: 6737872 - DNA, 12 bp, Homo sapiens
ccgctgccagca

SEQ ID NO: 6737873 - DNA, 13 bp, Homo sapiens
ccgctgccagcac

SEQ ID NO: 6737874 - DNA, 17 bp, Homo sapiens
ccgctgccatgctttga

SEQ ID NO: 6737875 - DNA, 16 bp, Homo sapiens
ccgctgcccagccctc

SEQ ID NO: 6737876 - DNA, 21 bp, Homo sapiens
ccgctgcccagccctcccagc

SEQ ID NO: 6737877 - DNA, 14 bp, Homo sapiens
ccgctgcccccacc

SEQ ID NO: 6737878 - DNA, 13 bp, Homo sapiens
ccgctgcccctcc

SEQ ID NO: 6737879 - DNA, 16 bp, Homo sapiens
ccgctgcccctccccg

SEQ ID NO: 6737880 - DNA, 19 bp, Homo sapiens
ccgctgcccggcgccctct

SEQ ID NO: 6737881 - DNA, 15 bp, Homo sapiens
ccgctgccgctgcac

SEQ ID NO: 6737882 - DNA, 15 bp, Homo sapiens
ccgctgcctcctgct

SEQ ID NO: 6737883 - DNA, 20 bp, Homo sapiens
ccgctgcctcctgctctctg

SEQ ID NO: 6737884 - DNA, 22 bp, Homo sapiens
ccgctgcctcgtagagtgacct

SEQ ID NO: 6737885 - DNA, 12 bp, Homo sapiens
ccgctgcctgga

SEQ ID NO: 6737886 - DNA, 17 bp, Homo sapiens
ccgctgcgctgccctgc

SEQ ID NO: 6737887 - DNA, 19 bp, Homo sapiens
ccgctgctcactttccacc

SEQ ID NO: 6737888 - DNA, 15 bp, Homo sapiens
ccgctgctccacgcg

SEQ ID NO: 6737889 - DNA, 17 bp, Homo sapiens
ccgctgctccacgcgct

SEQ ID NO: 6737890 - DNA, 14 bp, Homo sapiens
ccgctgctgctgct

SEQ ID NO: 6737891 - DNA, 14 bp, Homo sapiens
ccgctgctgtgctc

SEQ ID NO: 6737892 - DNA, 15 bp, Homo sapiens
ccgctgctgtgctct

SEQ ID NO: 6737893 - DNA, 21 bp, Homo sapiens
ccgctgctgtgctctggggat

SEQ ID NO: 6737894 - DNA, 17 bp, Homo sapiens
ccgctggagcccacagc

SEQ ID NO: 6737895 - DNA, 23 bp, Homo sapiens
ccgctggagcccacagcgagcct

SEQ ID NO: 6737896 - DNA, 11 bp, Homo sapiens
ccgctggagga

SEQ ID NO: 6737897 - DNA, 21 bp, Homo sapiens
ccgctggaggatgtgggcagc

SEQ ID NO: 6737898 - DNA, 20 bp, Homo sapiens
ccgctggatggggagtctca

SEQ ID NO: 6737899 - DNA, 21 bp, Homo sapiens
ccgctggatggggagtctcat

SEQ ID NO: 6737900 - DNA, 18 bp, Homo sapiens
ccgctggcagccaccccc

SEQ ID NO: 6737901 - DNA, 11 bp, Homo sapiens
ccgctggccca

SEQ ID NO: 6737902 - DNA, 16 bp, Homo sapiens
ccgctggcccagggta

SEQ ID NO: 6737903 - DNA, 20 bp, Homo sapiens
ccgctggccgggggaggtgg

SEQ ID NO: 6737904 - DNA, 14 bp, Homo sapiens
ccgctggctcctcc

SEQ ID NO: 6737905 - DNA, 12 bp, Homo sapiens
ccgctggctggg

SEQ ID NO: 6737906 - DNA, 18 bp, Homo sapiens
ccgctgggagaaaagcca

SEQ ID NO: 6737907 - DNA, 21 bp, Homo sapiens
ccgctgggctgagcccctacc

SEQ ID NO: 6737908 - DNA, 14 bp, Homo sapiens
ccgctggggaacag

SEQ ID NO: 6737909 - DNA, 22 bp, Homo sapiens
ccgctggggaccggttcccaca

SEQ ID NO: 6737910 - DNA, 17 bp, Homo sapiens
ccgctgggttctgactc

SEQ ID NO: 6737911 - DNA, 20 bp, Homo sapiens
ccgctggtccctgccctccc

SEQ ID NO: 6737912 - DNA, 23 bp, Homo sapiens
ccgctggtgcccaccagctggct

SEQ ID NO: 6737913 - DNA, 20 bp, Homo sapiens
ccgctgtataaagcatgtgg

SEQ ID NO: 6737914 - DNA, 24 bp, Homo sapiens
ccgctgtcaaggccgagggccagg

SEQ ID NO: 6737915 - DNA, 15 bp, Homo sapiens
ccgctgtcgccccag

SEQ ID NO: 6737916 - DNA, 21 bp, Homo sapiens
ccgctgtcgccccaggccctc

SEQ ID NO: 6737917 - DNA, 15 bp, Homo sapiens
ccgctgtctccctcc

SEQ ID NO: 6737918 - DNA, 17 bp, Homo sapiens
ccgctgtctccctcctg

SEQ ID NO: 6737919 - DNA, 13 bp, Homo sapiens
ccgctgtctctga

SEQ ID NO: 6737920 - DNA, 18 bp, Homo sapiens
ccgctgtggccggtgcca

SEQ ID NO: 6737921 - DNA, 17 bp, Homo sapiens
ccgctgtgtcctccctc

SEQ ID NO: 6737922 - DNA, 15 bp, Homo sapiens
ccgctgtgtctatga

SEQ ID NO: 6737923 - DNA, 16 bp, Homo sapiens
ccgctgttcacccaca

SEQ ID NO: 6737924 - DNA, 21 bp, Homo sapiens
ccgctgttcacccacagggct

SEQ ID NO: 6737925 - DNA, 15 bp, Homo sapiens
ccgcttcaagctctc

SEQ ID NO: 6737926 - DNA, 17 bp, Homo sapiens
ccgcttcacccctgcac

SEQ ID NO: 6737927 - DNA, 13 bp, Homo sapiens
ccgcttcccagag

SEQ ID NO: 6737928 - DNA, 14 bp, Homo sapiens
ccgcttccccacag

SEQ ID NO: 6737929 - DNA, 15 bp, Homo sapiens
ccgcttccccagctc

SEQ ID NO: 6737930 - DNA, 16 bp, Homo sapiens
ccgcttccccagctca

SEQ ID NO: 6737931 - DNA, 20 bp, Homo sapiens
ccgcttccctacccacaggg

SEQ ID NO: 6737932 - DNA, 23 bp, Homo sapiens
ccgcttccctacccacagggcct

SEQ ID NO: 6737933 - DNA, 18 bp, Homo sapiens
ccgcttccctccttcatg

SEQ ID NO: 6737934 - DNA, 19 bp, Homo sapiens
ccgcttcctccggctggac

SEQ ID NO: 6737935 - DNA, 15 bp, Homo sapiens
ccgcttcctggcctc

SEQ ID NO: 6737936 - DNA, 16 bp, Homo sapiens
ccgcttcctggcctcc

SEQ ID NO: 6737937 - DNA, 19 bp, Homo sapiens
ccgcttcctggcctccctt

SEQ ID NO: 6737938 - DNA, 13 bp, Homo sapiens
ccgcttccttaga

SEQ ID NO: 6737939 - DNA, 15 bp, Homo sapiens
ccgcttcgccatgtg

SEQ ID NO: 6737940 - DNA, 22 bp, Homo sapiens
ccgcttcgccatgtgctgtgca

SEQ ID NO: 6737941 - DNA, 14 bp, Homo sapiens
ccgcttctccccag

SEQ ID NO: 6737942 - DNA, 14 bp, Homo sapiens
ccgcttctcctgca

SEQ ID NO: 6737943 - DNA, 17 bp, Homo sapiens
ccgcttctcctgcagtg

SEQ ID NO: 6737944 - DNA, 13 bp, Homo sapiens
ccgcttctgaagc

SEQ ID NO: 6737945 - DNA, 13 bp, Homo sapiens
ccgcttgcctcgg

SEQ ID NO: 6737946 - DNA, 21 bp, Homo sapiens
ccgcttgcctcggctcctgct

SEQ ID NO: 6737947 - DNA, 19 bp, Homo sapiens
ccgcttgctcgcttgctgg

SEQ ID NO: 6737948 - DNA, 21 bp, Homo sapiens
ccgcttgctcgcttgctggaa

SEQ ID NO: 6737949 - DNA, 22 bp, Homo sapiens
ccgcttgctctcctggagcaag

SEQ ID NO: 6737950 - DNA, 23 bp, Homo sapiens
ccgcttggagctattttccaggc

SEQ ID NO: 6737951 - DNA, 21 bp, Homo sapiens
ccgcttggcgatgccagccaa

SEQ ID NO: 6737952 - DNA, 13 bp, Homo sapiens
ccgctttcctgga

SEQ ID NO: 6737953 - DNA, 14 bp, Homo sapiens
ccgctttcctggag

SEQ ID NO: 6737954 - DNA, 23 bp, Homo sapiens
ccgctttctacccagcgagccct

SEQ ID NO: 6737955 - DNA, 13 bp, Homo sapiens
ccgctttggcctg

SEQ ID NO: 6737956 - DNA, 14 bp, Homo sapiens
ccgctttggcctga

SEQ ID NO: 6737957 - DNA, 16 bp, Homo sapiens
ccgctttggcctgagt

SEQ ID NO: 6737958 - DNA, 16 bp, Homo sapiens
ccgctttgtctgtcca

SEQ ID NO: 6737959 - DNA, 16 bp, Homo sapiens
ccgctttgtgattcca

SEQ ID NO: 6737960 - DNA, 13 bp, Homo sapiens
ccgcttttgttct

SEQ ID NO: 6737961 - DNA, 20 bp, Homo sapiens
ccggaaacaaaatccttttc

SEQ ID NO: 6737962 - DNA, 17 bp, Homo sapiens
ccggaacagccaaagaa

SEQ ID NO: 6737963 - DNA, 21 bp, Homo sapiens
ccggaacagccaaagaaactc

SEQ ID NO: 6737964 - DNA, 21 bp, Homo sapiens
ccggaaccacagggccagagg

SEQ ID NO: 6737965 - DNA, 17 bp, Homo sapiens
ccggaagaaccagaagt

SEQ ID NO: 6737966 - DNA, 22 bp, Homo sapiens
ccggaagccaaacctctgtgag

SEQ ID NO: 6737967 - DNA, 21 bp, Homo sapiens
ccggaaggaatgtcagggcca

SEQ ID NO: 6737968 - DNA, 22 bp, Homo sapiens
ccggaaggggcgctcctcccag

SEQ ID NO: 6737969 - DNA, 19 bp, Homo sapiens
ccggaatagagcctcgtct

SEQ ID NO: 6737970 - DNA, 22 bp, Homo sapiens
ccggaatagatgtcttcatcac

SEQ ID NO: 6737971 - DNA, 19 bp, Homo sapiens
ccggaatcctgtcctcagc

SEQ ID NO: 6737972 - DNA, 20 bp, Homo sapiens
ccggaatcctgtcctcagct

SEQ ID NO: 6737973 - DNA, 14 bp, Homo sapiens
ccggaatgaatgag

SEQ ID NO: 6737974 - DNA, 16 bp, Homo sapiens
ccggaatgccacccac

SEQ ID NO: 6737975 - DNA, 23 bp, Homo sapiens
ccggacaagcccaggacactgcc

SEQ ID NO: 6737976 - DNA, 14 bp, Homo sapiens
ccggacacggcttc

SEQ ID NO: 6737977 - DNA, 16 bp, Homo sapiens
ccggacactcctagag

SEQ ID NO: 6737978 - DNA, 17 bp, Homo sapiens
ccggacactcctagaga

SEQ ID NO: 6737979 - DNA, 16 bp, Homo sapiens
ccggacacttctcagg

SEQ ID NO: 6737980 - DNA, 20 bp, Homo sapiens
ccggacacttctcaggaaat

SEQ ID NO: 6737981 - DNA, 13 bp, Homo sapiens
ccggacagctgcc

SEQ ID NO: 6737982 - DNA, 17 bp, Homo sapiens
ccggacagctgcccaga

SEQ ID NO: 6737983 - DNA, 16 bp, Homo sapiens
ccggacaggtggggcc

SEQ ID NO: 6737984 - DNA, 19 bp, Homo sapiens
ccggacaggtggggcctca

SEQ ID NO: 6737985 - DNA, 19 bp, Homo sapiens
ccggacatactctctgcct

SEQ ID NO: 6737986 - DNA, 13 bp, Homo sapiens
ccggaccagcctg

SEQ ID NO: 6737987 - DNA, 14 bp, Homo sapiens
ccggaccagcctgg

SEQ ID NO: 6737988 - DNA, 18 bp, Homo sapiens
ccggaccagcctggccca

SEQ ID NO: 6737989 - DNA, 17 bp, Homo sapiens
ccggacccccgtcagct

SEQ ID NO: 6737990 - DNA, 20 bp, Homo sapiens
ccggacccccgtcagctgct

SEQ ID NO: 6737991 - DNA, 15 bp, Homo sapiens
ccggacctacctccc

SEQ ID NO: 6737992 - DNA, 19 bp, Homo sapiens
ccggacctacctccctccc

SEQ ID NO: 6737993 - DNA, 23 bp, Homo sapiens
ccggacctgagcccgcagcccag

SEQ ID NO: 6737994 - DNA, 21 bp, Homo sapiens
ccggacctgtggggccccaga

SEQ ID NO: 6737995 - DNA, 22 bp, Homo sapiens
ccggacctgtggggccccagag

SEQ ID NO: 6737996 - DNA, 18 bp, Homo sapiens
ccggacgcatgcagggcc

SEQ ID NO: 6737997 - DNA, 18 bp, Homo sapiens
ccggacgctggagaccct

SEQ ID NO: 6737998 - DNA, 20 bp, Homo sapiens
ccggacgctggagaccctgc

SEQ ID NO: 6737999 - DNA, 13 bp, Homo sapiens
ccggacgctggct

SEQ ID NO: 6738000 - DNA, 18 bp, Homo sapiens
ccggacgctggctcggga

SEQ ID NO: 6738001 - DNA, 23 bp, Homo sapiens
ccggactttcggagttgggggtc

SEQ ID NO: 6738002 - DNA, 14 bp, Homo sapiens
ccggagaaactgag

SEQ ID NO: 6738003 - DNA, 16 bp, Homo sapiens
ccggagaattgcctct

SEQ ID NO: 6738004 - DNA, 13 bp, Homo sapiens
ccggagacccaca

SEQ ID NO: 6738005 - DNA, 23 bp, Homo sapiens
ccggagacccacagccctgaaac

SEQ ID NO: 6738006 - DNA, 20 bp, Homo sapiens
ccggagaggaagagacactc

SEQ ID NO: 6738007 - DNA, 16 bp, Homo sapiens
ccggagagggagtcag

SEQ ID NO: 6738008 - DNA, 16 bp, Homo sapiens
ccggagagtgggggtg

SEQ ID NO: 6738009 - DNA, 20 bp, Homo sapiens
ccggagattggacggcctga

SEQ ID NO: 6738010 - DNA, 17 bp, Homo sapiens
ccggagcaaactctgct

SEQ ID NO: 6738011 - DNA, 18 bp, Homo sapiens
ccggagcaagcaggagtg

SEQ ID NO: 6738012 - DNA, 21 bp, Homo sapiens
ccggagcacagccctgggagg

SEQ ID NO: 6738013 - DNA, 14 bp, Homo sapiens
ccggagcagcagga

SEQ ID NO: 6738014 - DNA, 21 bp, Homo sapiens
ccggagccatcaccctcaccc

SEQ ID NO: 6738015 - DNA, 12 bp, Homo sapiens
ccggagcccaga

SEQ ID NO: 6738016 - DNA, 20 bp, Homo sapiens
ccggagccccaagactctgc

SEQ ID NO: 6738017 - DNA, 18 bp, Homo sapiens
ccggagccggcactgcat

SEQ ID NO: 6738018 - DNA, 14 bp, Homo sapiens
ccggagcctccagc

SEQ ID NO: 6738019 - DNA, 16 bp, Homo sapiens
ccggagcgaccctggc

SEQ ID NO: 6738020 - DNA, 17 bp, Homo sapiens
ccggagcgaccctggct

SEQ ID NO: 6738021 - DNA, 16 bp, Homo sapiens
ccggagcgcacctgct

SEQ ID NO: 6738022 - DNA, 17 bp, Homo sapiens
ccggagcgcacctgctt

SEQ ID NO: 6738023 - DNA, 17 bp, Homo sapiens
ccggagcgccctgcagg

SEQ ID NO: 6738024 - DNA, 20 bp, Homo sapiens
ccggagcggctgaggacggg

SEQ ID NO: 6738025 - DNA, 19 bp, Homo sapiens
ccggagctaagtcacccag

SEQ ID NO: 6738026 - DNA, 17 bp, Homo sapiens
ccggagctccagtttct

SEQ ID NO: 6738027 - DNA, 19 bp, Homo sapiens
ccggagctgcccctctctg

SEQ ID NO: 6738028 - DNA, 21 bp, Homo sapiens
ccggagctgcccctctctggg

SEQ ID NO: 6738029 - DNA, 22 bp, Homo sapiens
ccggagctgcccctctctgggc

SEQ ID NO: 6738030 - DNA, 14 bp, Homo sapiens
ccggaggaaatctg

SEQ ID NO: 6738031 - DNA, 14 bp, Homo sapiens
ccggaggaaggtcc

SEQ ID NO: 6738032 - DNA, 15 bp, Homo sapiens
ccggaggactgagcc

SEQ ID NO: 6738033 - DNA, 17 bp, Homo sapiens
ccggaggactgagcccc

SEQ ID NO: 6738034 - DNA, 18 bp, Homo sapiens
ccggaggactgagccccc

SEQ ID NO: 6738035 - DNA, 15 bp, Homo sapiens
ccggaggagcagcct

SEQ ID NO: 6738036 - DNA, 16 bp, Homo sapiens
ccggaggagcagcctc

SEQ ID NO: 6738037 - DNA, 20 bp, Homo sapiens
ccggaggagcatgcgcagag

SEQ ID NO: 6738038 - DNA, 23 bp, Homo sapiens
ccggaggagcatgcgcagaggcc

SEQ ID NO: 6738039 - DNA, 19 bp, Homo sapiens
ccggaggatattaaaatgc

SEQ ID NO: 6738040 - DNA, 13 bp, Homo sapiens
ccggaggcagcag

SEQ ID NO: 6738041 - DNA, 14 bp, Homo sapiens
ccggaggccagcta

SEQ ID NO: 6738042 - DNA, 16 bp, Homo sapiens
ccggaggcgcccacct

SEQ ID NO: 6738043 - DNA, 22 bp, Homo sapiens
ccggaggcgcccacctgcccag

SEQ ID NO: 6738044 - DNA, 19 bp, Homo sapiens
ccggaggcgtggaggagag

SEQ ID NO: 6738045 - DNA, 19 bp, Homo sapiens
ccggagggaaactgtgaat

SEQ ID NO: 6738046 - DNA, 20 bp, Homo sapiens
ccggagggaaactgtgaatg

SEQ ID NO: 6738047 - DNA, 21 bp, Homo sapiens
ccggagggacgcggaggagga

SEQ ID NO: 6738048 - DNA, 18 bp, Homo sapiens
ccggagggagccctgagc

SEQ ID NO: 6738049 - DNA, 16 bp, Homo sapiens
ccggagggcaggaccc

SEQ ID NO: 6738050 - DNA, 12 bp, Homo sapiens
ccggagggccct

SEQ ID NO: 6738051 - DNA, 16 bp, Homo sapiens
ccggaggggacccagc

SEQ ID NO: 6738052 - DNA, 18 bp, Homo sapiens
ccggaggggacccagctc

SEQ ID NO: 6738053 - DNA, 20 bp, Homo sapiens
ccggaggggacccagctcct

SEQ ID NO: 6738054 - DNA, 21 bp, Homo sapiens
ccggaggggacccagctcctc

SEQ ID NO: 6738055 - DNA, 15 bp, Homo sapiens
ccggaggggcctggc

SEQ ID NO: 6738056 - DNA, 21 bp, Homo sapiens
ccggaggggttgcgggggagc

SEQ ID NO: 6738057 - DNA, 23 bp, Homo sapiens
ccggagggtgacccatttcagga

SEQ ID NO: 6738058 - DNA, 17 bp, Homo sapiens
ccggaggtagaggttgt

SEQ ID NO: 6738059 - DNA, 18 bp, Homo sapiens
ccggagtcactgcctgga

SEQ ID NO: 6738060 - DNA, 13 bp, Homo sapiens
ccggatcagagca

SEQ ID NO: 6738061 - DNA, 18 bp, Homo sapiens
ccggatccaggattctgg

SEQ ID NO: 6738062 - DNA, 15 bp, Homo sapiens
ccggatctccaggcc

SEQ ID NO: 6738063 - DNA, 14 bp, Homo sapiens
ccggatctgggctg

SEQ ID NO: 6738064 - DNA, 15 bp, Homo sapiens
ccggatcttggagac

SEQ ID NO: 6738065 - DNA, 15 bp, Homo sapiens
ccggatgcccacccc

SEQ ID NO: 6738066 - DNA, 20 bp, Homo sapiens
ccggatgcccacccctgctg

SEQ ID NO: 6738067 - DNA, 20 bp, Homo sapiens
ccggatggaatcacagccaa

SEQ ID NO: 6738068 - DNA, 13 bp, Homo sapiens
ccggatgtgcttt

SEQ ID NO: 6738069 - DNA, 15 bp, Homo sapiens
ccggattggccctgc

SEQ ID NO: 6738070 - DNA, 16 bp, Homo sapiens
ccggattggcttgtgt

SEQ ID NO: 6738071 - DNA, 23 bp, Homo sapiens
ccggcaaccccagttctgctcct

SEQ ID NO: 6738072 - DNA, 19 bp, Homo sapiens
ccggcaagcagcgggctaa

SEQ ID NO: 6738073 - DNA, 19 bp, Homo sapiens
ccggcaagcgagcacagta

SEQ ID NO: 6738074 - DNA, 15 bp, Homo sapiens
ccggcaaggggcgcg

SEQ ID NO: 6738075 - DNA, 19 bp, Homo sapiens
ccggcacagatgctccagg

SEQ ID NO: 6738076 - DNA, 19 bp, Homo sapiens
ccggcacagggtctgctct

SEQ ID NO: 6738077 - DNA, 15 bp, Homo sapiens
ccggcaccccctgca

SEQ ID NO: 6738078 - DNA, 20 bp, Homo sapiens
ccggcaccccctgcagcttg

SEQ ID NO: 6738079 - DNA, 21 bp, Homo sapiens
ccggcaccccctgcagcttgt

SEQ ID NO: 6738080 - DNA, 19 bp, Homo sapiens
ccggcacctacatccccag

SEQ ID NO: 6738081 - DNA, 16 bp, Homo sapiens
ccggcacctcccttgg

SEQ ID NO: 6738082 - DNA, 20 bp, Homo sapiens
ccggcactcatgacggcctg

SEQ ID NO: 6738083 - DNA, 20 bp, Homo sapiens
ccggcactgtgcactctact

SEQ ID NO: 6738084 - DNA, 13 bp, Homo sapiens
ccggcagaaggga

SEQ ID NO: 6738085 - DNA, 12 bp, Homo sapiens
ccggcagagctc

SEQ ID NO: 6738086 - DNA, 15 bp, Homo sapiens
ccggcagagctctac

SEQ ID NO: 6738087 - DNA, 18 bp, Homo sapiens
ccggcagagctctacagg

SEQ ID NO: 6738088 - DNA, 21 bp, Homo sapiens
ccggcagagctctacaggcct

SEQ ID NO: 6738089 - DNA, 14 bp, Homo sapiens
ccggcagaggcagg

SEQ ID NO: 6738090 - DNA, 15 bp, Homo sapiens
ccggcagaggcaggg

SEQ ID NO: 6738091 - DNA, 16 bp, Homo sapiens
ccggcagaggcagggc

SEQ ID NO: 6738092 - DNA, 21 bp, Homo sapiens
ccggcagaggcagggccctgg

SEQ ID NO: 6738093 - DNA, 20 bp, Homo sapiens
ccggcagccccagcctgcta

SEQ ID NO: 6738094 - DNA, 16 bp, Homo sapiens
ccggcagccccttctg

SEQ ID NO: 6738095 - DNA, 18 bp, Homo sapiens
ccggcagccccttctggc

SEQ ID NO: 6738096 - DNA, 16 bp, Homo sapiens
ccggcagcctctcttc

SEQ ID NO: 6738097 - DNA, 12 bp, Homo sapiens
ccggcagcctgg

SEQ ID NO: 6738098 - DNA, 14 bp, Homo sapiens
ccggcagcctggtt

SEQ ID NO: 6738099 - DNA, 15 bp, Homo sapiens
ccggcagcgggcgga

SEQ ID NO: 6738100 - DNA, 20 bp, Homo sapiens
ccggcagcgggcggagggga

SEQ ID NO: 6738101 - DNA, 18 bp, Homo sapiens
ccggcagcttctgccccc

SEQ ID NO: 6738102 - DNA, 19 bp, Homo sapiens
ccggcagcttctgccccct

SEQ ID NO: 6738103 - DNA, 20 bp, Homo sapiens
ccggcagcttctgccccctg

SEQ ID NO: 6738104 - DNA, 22 bp, Homo sapiens
ccggcagcttctgccccctgca

SEQ ID NO: 6738105 - DNA, 12 bp, Homo sapiens
ccggcaggccct

SEQ ID NO: 6738106 - DNA, 15 bp, Homo sapiens
ccggcaggccctgca

SEQ ID NO: 6738107 - DNA, 18 bp, Homo sapiens
ccggcaggccctgcagtg

SEQ ID NO: 6738108 - DNA, 17 bp, Homo sapiens
ccggcaggcctgagaat

SEQ ID NO: 6738109 - DNA, 17 bp, Homo sapiens
ccggcagggcccccaat

SEQ ID NO: 6738110 - DNA, 20 bp, Homo sapiens
ccggcagggcccccaataaa

SEQ ID NO: 6738111 - DNA, 21 bp, Homo sapiens
ccggcagggcccccaataaac

SEQ ID NO: 6738112 - DNA, 23 bp, Homo sapiens
ccggcagggcccccaataaacca

SEQ ID NO: 6738113 - DNA, 21 bp, Homo sapiens
ccggcagggcgggcagagggc

SEQ ID NO: 6738114 - DNA, 15 bp, Homo sapiens
ccggcaggggcccct

SEQ ID NO: 6738115 - DNA, 21 bp, Homo sapiens
ccggcaggggcccctcctctg

SEQ ID NO: 6738116 - DNA, 15 bp, Homo sapiens
ccggcatccttgcct

SEQ ID NO: 6738117 - DNA, 20 bp, Homo sapiens
ccggcatgagactcagtgca

SEQ ID NO: 6738118 - DNA, 15 bp, Homo sapiens
ccggcatgaggcccc

SEQ ID NO: 6738119 - DNA, 15 bp, Homo sapiens
ccggcatgctggcct

SEQ ID NO: 6738120 - DNA, 19 bp, Homo sapiens
ccggcatgctggcctgtgg

SEQ ID NO: 6738121 - DNA, 18 bp, Homo sapiens
ccggcatggacaatggac

SEQ ID NO: 6738122 - DNA, 22 bp, Homo sapiens
ccggcatggacaatggaccgga

SEQ ID NO: 6738123 - DNA, 19 bp, Homo sapiens
ccggcattttattaaactt

SEQ ID NO: 6738124 - DNA, 18 bp, Homo sapiens
ccggccaaggacactgat

SEQ ID NO: 6738125 - DNA, 19 bp, Homo sapiens
ccggccaaggacactgatg

SEQ ID NO: 6738126 - DNA, 18 bp, Homo sapiens
ccggccaatggaaacctc

SEQ ID NO: 6738127 - DNA, 21 bp, Homo sapiens
ccggccacactggtcacaggc

SEQ ID NO: 6738128 - DNA, 20 bp, Homo sapiens
ccggccacccaggaggcagg

SEQ ID NO: 6738129 - DNA, 16 bp, Homo sapiens
ccggccacgctccctc

SEQ ID NO: 6738130 - DNA, 17 bp, Homo sapiens
ccggccacgtctgtgct

SEQ ID NO: 6738131 - DNA, 19 bp, Homo sapiens
ccggccacgtctgtgctct

SEQ ID NO: 6738132 - DNA, 12 bp, Homo sapiens
ccggccactccc

SEQ ID NO: 6738133 - DNA, 13 bp, Homo sapiens
ccggccactctgt

SEQ ID NO: 6738134 - DNA, 11 bp, Homo sapiens
ccggccagcca

SEQ ID NO: 6738135 - DNA, 17 bp, Homo sapiens
ccggccagccagccact

SEQ ID NO: 6738136 - DNA, 19 bp, Homo sapiens
ccggccagcgggcacaggg

SEQ ID NO: 6738137 - DNA, 21 bp, Homo sapiens
ccggccagcgggcacagggca

SEQ ID NO: 6738138 - DNA, 22 bp, Homo sapiens
ccggccagcgggcacagggcac

SEQ ID NO: 6738139 - DNA, 12 bp, Homo sapiens
ccggccagctcc

SEQ ID NO: 6738140 - DNA, 14 bp, Homo sapiens
ccggccagctctgg

SEQ ID NO: 6738141 - DNA, 13 bp, Homo sapiens
ccggccaggccac

SEQ ID NO: 6738142 - DNA, 13 bp, Homo sapiens
ccggccaggccgc

SEQ ID NO: 6738143 - DNA, 13 bp, Homo sapiens
ccggccagggcct

SEQ ID NO: 6738144 - DNA, 15 bp, Homo sapiens
ccggccagggcctgg

SEQ ID NO: 6738145 - DNA, 12 bp, Homo sapiens
ccggcccaacct

SEQ ID NO: 6738146 - DNA, 18 bp, Homo sapiens
ccggcccaacctcgccct

SEQ ID NO: 6738147 - DNA, 22 bp, Homo sapiens
ccggcccaacctcgccctctct

SEQ ID NO: 6738148 - DNA, 16 bp, Homo sapiens
ccggcccacgcagagc

SEQ ID NO: 6738149 - DNA, 19 bp, Homo sapiens
ccggcccacgtcctgggtg

SEQ ID NO: 6738150 - DNA, 20 bp, Homo sapiens
ccggcccacgtcctgggtgc

SEQ ID NO: 6738151 - DNA, 18 bp, Homo sapiens
ccggcccagagacccctt

SEQ ID NO: 6738152 - DNA, 12 bp, Homo sapiens
ccggcccagatg

SEQ ID NO: 6738153 - DNA, 14 bp, Homo sapiens
ccggcccagatgtg

SEQ ID NO: 6738154 - DNA, 18 bp, Homo sapiens
ccggcccagcctaggccc

SEQ ID NO: 6738155 - DNA, 13 bp, Homo sapiens
ccggcccaggagc

SEQ ID NO: 6738156 - DNA, 16 bp, Homo sapiens
ccggcccaggagcgca

SEQ ID NO: 6738157 - DNA, 18 bp, Homo sapiens
ccggcccagtgccactgc

SEQ ID NO: 6738158 - DNA, 20 bp, Homo sapiens
ccggcccagtgccagctcca

SEQ ID NO: 6738159 - DNA, 18 bp, Homo sapiens
ccggcccatatccctggt

SEQ ID NO: 6738160 - DNA, 20 bp, Homo sapiens
ccggcccatatccctggttg

SEQ ID NO: 6738161 - DNA, 16 bp, Homo sapiens
ccggccccagccagag

SEQ ID NO: 6738162 - DNA, 21 bp, Homo sapiens
ccggccccaggctcccctggt

SEQ ID NO: 6738163 - DNA, 17 bp, Homo sapiens
ccggcccccagagcgcc

SEQ ID NO: 6738164 - DNA, 16 bp, Homo sapiens
ccggcccccctctcgg

SEQ ID NO: 6738165 - DNA, 22 bp, Homo sapiens
ccggccccctccccccagactc

SEQ ID NO: 6738166 - DNA, 13 bp, Homo sapiens
ccggccccctggt

SEQ ID NO: 6738167 - DNA, 14 bp, Homo sapiens
ccggcccccttcct

SEQ ID NO: 6738168 - DNA, 20 bp, Homo sapiens
ccggcccccttcctggcccc

SEQ ID NO: 6738169 - DNA, 23 bp, Homo sapiens
ccggcccccttcctggcccctca

SEQ ID NO: 6738170 - DNA, 17 bp, Homo sapiens
ccggccccgcgcgtgcc

SEQ ID NO: 6738171 - DNA, 16 bp, Homo sapiens
ccggccccggccccag

SEQ ID NO: 6738172 - DNA, 12 bp, Homo sapiens
ccggcccctacc

SEQ ID NO: 6738173 - DNA, 18 bp, Homo sapiens
ccggcccctaccagccac

SEQ ID NO: 6738174 - DNA, 13 bp, Homo sapiens
ccggcccctcacc

SEQ ID NO: 6738175 - DNA, 15 bp, Homo sapiens
ccggcccctcaccct

SEQ ID NO: 6738176 - DNA, 23 bp, Homo sapiens
ccggcccctcaccctctgtcccc

SEQ ID NO: 6738177 - DNA, 15 bp, Homo sapiens
ccggcccctcctgac

SEQ ID NO: 6738178 - DNA, 12 bp, Homo sapiens
ccggcccctggc

SEQ ID NO: 6738179 - DNA, 17 bp, Homo sapiens
ccggcccggctgagccc

SEQ ID NO: 6738180 - DNA, 17 bp, Homo sapiens
ccggccctccagagccc

SEQ ID NO: 6738181 - DNA, 20 bp, Homo sapiens
ccggccctcccccagctcct

SEQ ID NO: 6738182 - DNA, 21 bp, Homo sapiens
ccggccctcccccagctcctt

SEQ ID NO: 6738183 - DNA, 11 bp, Homo sapiens
ccggccctgcc

SEQ ID NO: 6738184 - DNA, 13 bp, Homo sapiens
ccggccctgcccc

SEQ ID NO: 6738185 - DNA, 22 bp, Homo sapiens
ccggccctgccccccacattct

SEQ ID NO: 6738186 - DNA, 15 bp, Homo sapiens
ccggccctgcccctc

SEQ ID NO: 6738187 - DNA, 18 bp, Homo sapiens
ccggccctgcccctccct

SEQ ID NO: 6738188 - DNA, 19 bp, Homo sapiens
ccggccctggcttggaggc

SEQ ID NO: 6738189 - DNA, 19 bp, Homo sapiens
ccggccctgggctcggagg

SEQ ID NO: 6738190 - DNA, 22 bp, Homo sapiens
ccggccctgggctcggaggctg

SEQ ID NO: 6738191 - DNA, 15 bp, Homo sapiens
ccggccgagctgcct

SEQ ID NO: 6738192 - DNA, 17 bp, Homo sapiens
ccggccgagctgcctgg

SEQ ID NO: 6738193 - DNA, 17 bp, Homo sapiens
ccggccgcactgggagc

SEQ ID NO: 6738194 - DNA, 14 bp, Homo sapiens
ccggccgcagcccc

SEQ ID NO: 6738195 - DNA, 21 bp, Homo sapiens
ccggccgccccgccccagagc

SEQ ID NO: 6738196 - DNA, 15 bp, Homo sapiens
ccggccgcgccgccg

SEQ ID NO: 6738197 - DNA, 20 bp, Homo sapiens
ccggccgcgccgccgccgcg

SEQ ID NO: 6738198 - DNA, 16 bp, Homo sapiens
ccggccggacctctga

SEQ ID NO: 6738199 - DNA, 14 bp, Homo sapiens
ccggccggagaaca

SEQ ID NO: 6738200 - DNA, 17 bp, Homo sapiens
ccggccggagggcagga

SEQ ID NO: 6738201 - DNA, 17 bp, Homo sapiens
ccggccggccctggctt

SEQ ID NO: 6738202 - DNA, 14 bp, Homo sapiens
ccggccgggagacc

SEQ ID NO: 6738203 - DNA, 21 bp, Homo sapiens
ccggccgtggaaggagggatg

SEQ ID NO: 6738204 - DNA, 23 bp, Homo sapiens
ccggcctattgcttgggtctctc

SEQ ID NO: 6738205 - DNA, 16 bp, Homo sapiens
ccggcctcagggcgct

SEQ ID NO: 6738206 - DNA, 20 bp, Homo sapiens
ccggcctccaggctggggcc

SEQ ID NO: 6738207 - DNA, 14 bp, Homo sapiens
ccggcctcctagcc

SEQ ID NO: 6738208 - DNA, 11 bp, Homo sapiens
ccggcctcctc

SEQ ID NO: 6738209 - DNA, 21 bp, Homo sapiens
ccggcctcctcctcacccttc

SEQ ID NO: 6738210 - DNA, 14 bp, Homo sapiens
ccggcctctccagc

SEQ ID NO: 6738211 - DNA, 21 bp, Homo sapiens
ccggcctctccagcctcagcc

SEQ ID NO: 6738212 - DNA, 15 bp, Homo sapiens
ccggcctctccctgc

SEQ ID NO: 6738213 - DNA, 15 bp, Homo sapiens
ccggcctctctgccc

SEQ ID NO: 6738214 - DNA, 21 bp, Homo sapiens
ccggcctgatgacagagcgag

SEQ ID NO: 6738215 - DNA, 18 bp, Homo sapiens
ccggcctgccaggaggac

SEQ ID NO: 6738216 - DNA, 12 bp, Homo sapiens
ccggcctggacc

SEQ ID NO: 6738217 - DNA, 19 bp, Homo sapiens
ccggcctggatgccagctg

SEQ ID NO: 6738218 - DNA, 22 bp, Homo sapiens
ccggcctgggtgacagagtgag

SEQ ID NO: 6738219 - DNA, 22 bp, Homo sapiens
ccggccttgtgacattcactca

SEQ ID NO: 6738220 - DNA, 13 bp, Homo sapiens
ccggcgccccgca

SEQ ID NO: 6738221 - DNA, 16 bp, Homo sapiens
ccggcgccccgcaccc

SEQ ID NO: 6738222 - DNA, 13 bp, Homo sapiens
ccggcgccccgga

SEQ ID NO: 6738223 - DNA, 17 bp, Homo sapiens
ccggcgccctctgtcct

SEQ ID NO: 6738224 - DNA, 21 bp, Homo sapiens
ccggcgccctctgtcctgact

SEQ ID NO: 6738225 - DNA, 12 bp, Homo sapiens
ccggcgcctgcc

SEQ ID NO: 6738226 - DNA, 17 bp, Homo sapiens
ccggcgcctgccctgcc

SEQ ID NO: 6738227 - DNA, 20 bp, Homo sapiens
ccggcgcctgccctgcccaa

SEQ ID NO: 6738228 - DNA, 15 bp, Homo sapiens
ccggcgctgcaggta

SEQ ID NO: 6738229 - DNA, 20 bp, Homo sapiens
ccggcggaaagcctctgtcc

SEQ ID NO: 6738230 - DNA, 19 bp, Homo sapiens
ccggcggagctctggcttt

SEQ ID NO: 6738231 - DNA, 20 bp, Homo sapiens
ccggcggcagccccacttca

SEQ ID NO: 6738232 - DNA, 19 bp, Homo sapiens
ccggcggcccaagcccgac

SEQ ID NO: 6738233 - DNA, 16 bp, Homo sapiens
ccggcggccctgctga

SEQ ID NO: 6738234 - DNA, 12 bp, Homo sapiens
ccggcggctctg

SEQ ID NO: 6738235 - DNA, 13 bp, Homo sapiens
ccggcggctctga

SEQ ID NO: 6738236 - DNA, 15 bp, Homo sapiens
ccggcggctctgagc

SEQ ID NO: 6738237 - DNA, 22 bp, Homo sapiens
ccggcggctctgagcaggggca

SEQ ID NO: 6738238 - DNA, 16 bp, Homo sapiens
ccggcgggcgggccgg

SEQ ID NO: 6738239 - DNA, 14 bp, Homo sapiens
ccggcggggcccac

SEQ ID NO: 6738240 - DNA, 20 bp, Homo sapiens
ccggcgtcagcctccagcct

SEQ ID NO: 6738241 - DNA, 23 bp, Homo sapiens
ccggcgtcagcctccagcctctg

SEQ ID NO: 6738242 - DNA, 21 bp, Homo sapiens
ccggctaagcaggcgcaaggg

SEQ ID NO: 6738243 - DNA, 18 bp, Homo sapiens
ccggctaatttttgtaat

SEQ ID NO: 6738244 - DNA, 15 bp, Homo sapiens
ccggctccagagcag

SEQ ID NO: 6738245 - DNA, 12 bp, Homo sapiens
ccggctccaggc

SEQ ID NO: 6738246 - DNA, 13 bp, Homo sapiens
ccggctccaggct

SEQ ID NO: 6738247 - DNA, 15 bp, Homo sapiens
ccggctccaggctcc

SEQ ID NO: 6738248 - DNA, 19 bp, Homo sapiens
ccggctcccaccgaggcgc

SEQ ID NO: 6738249 - DNA, 18 bp, Homo sapiens
ccggctcccaccggtgcc

SEQ ID NO: 6738250 - DNA, 15 bp, Homo sapiens
ccggctcctggtcac

SEQ ID NO: 6738251 - DNA, 17 bp, Homo sapiens
ccggctcctggtcacct

SEQ ID NO: 6738252 - DNA, 19 bp, Homo sapiens
ccggctcggcctcttgaga

SEQ ID NO: 6738253 - DNA, 19 bp, Homo sapiens
ccggctcgtgtatttatta

SEQ ID NO: 6738254 - DNA, 17 bp, Homo sapiens
ccggctcgttcccccag

SEQ ID NO: 6738255 - DNA, 17 bp, Homo sapiens
ccggctctggtggccac

SEQ ID NO: 6738256 - DNA, 17 bp, Homo sapiens
ccggctctttccttgct

SEQ ID NO: 6738257 - DNA, 16 bp, Homo sapiens
ccggctgacacctccc

SEQ ID NO: 6738258 - DNA, 14 bp, Homo sapiens
ccggctgaccctgt

SEQ ID NO: 6738259 - DNA, 14 bp, Homo sapiens
ccggctgagccccc

SEQ ID NO: 6738260 - DNA, 17 bp, Homo sapiens
ccggctgagctgtgcca

SEQ ID NO: 6738261 - DNA, 21 bp, Homo sapiens
ccggctgagctgtgccagctg

SEQ ID NO: 6738262 - DNA, 18 bp, Homo sapiens
ccggctgagtggcagcag

SEQ ID NO: 6738263 - DNA, 22 bp, Homo sapiens
ccggctgagtggcagcagcccc

SEQ ID NO: 6738264 - DNA, 22 bp, Homo sapiens
ccggctgcatacccgggcaggg

SEQ ID NO: 6738265 - DNA, 18 bp, Homo sapiens
ccggctgctcctccagcc

SEQ ID NO: 6738266 - DNA, 20 bp, Homo sapiens
ccggctgctcctccagccct

SEQ ID NO: 6738267 - DNA, 17 bp, Homo sapiens
ccggctgctgcttggat

SEQ ID NO: 6738268 - DNA, 22 bp, Homo sapiens
ccggctgcttttccctaagcca

SEQ ID NO: 6738269 - DNA, 15 bp, Homo sapiens
ccggctggacttttg

SEQ ID NO: 6738270 - DNA, 15 bp, Homo sapiens
ccggctggcctggcc

SEQ ID NO: 6738271 - DNA, 17 bp, Homo sapiens
ccggctggcctggcccc

SEQ ID NO: 6738272 - DNA, 13 bp, Homo sapiens
ccggctgggcccg

SEQ ID NO: 6738273 - DNA, 20 bp, Homo sapiens
ccggctgggtcggccctgcc

SEQ ID NO: 6738274 - DNA, 22 bp, Homo sapiens
ccggctgggtcggccctgccca

SEQ ID NO: 6738275 - DNA, 11 bp, Homo sapiens
ccggctggtga

SEQ ID NO: 6738276 - DNA, 19 bp, Homo sapiens
ccggctggttgtgggcact

SEQ ID NO: 6738277 - DNA, 17 bp, Homo sapiens
ccggctgtgattgctgc

SEQ ID NO: 6738278 - DNA, 20 bp, Homo sapiens
ccggctgtgcagtcctgggt

SEQ ID NO: 6738279 - DNA, 15 bp, Homo sapiens
ccggctgtgctggga

SEQ ID NO: 6738280 - DNA, 13 bp, Homo sapiens
ccggctgtggagc

SEQ ID NO: 6738281 - DNA, 17 bp, Homo sapiens
ccggctgtttcctgaca

SEQ ID NO: 6738282 - DNA, 15 bp, Homo sapiens
ccggcttcctttccc

SEQ ID NO: 6738283 - DNA, 23 bp, Homo sapiens
ccggcttcctttcccaagccttc

SEQ ID NO: 6738284 - DNA, 17 bp, Homo sapiens
ccggcttgccacacccc

SEQ ID NO: 6738285 - DNA, 21 bp, Homo sapiens
ccggctttgcagggagaccag

SEQ ID NO: 6738286 - DNA, 19 bp, Homo sapiens
ccggctttgtggcactggg

SEQ ID NO: 6738287 - DNA, 17 bp, Homo sapiens
ccgggaacctccccagc

SEQ ID NO: 6738288 - DNA, 13 bp, Homo sapiens
ccgggaagagcca

SEQ ID NO: 6738289 - DNA, 16 bp, Homo sapiens
ccgggaagagccacct

SEQ ID NO: 6738290 - DNA, 14 bp, Homo sapiens
ccgggaagcaaatg

SEQ ID NO: 6738291 - DNA, 15 bp, Homo sapiens
ccgggaagcatcctc

SEQ ID NO: 6738292 - DNA, 20 bp, Homo sapiens
ccgggaagcatcctccccac

SEQ ID NO: 6738293 - DNA, 14 bp, Homo sapiens
ccgggaaggaaggc

SEQ ID NO: 6738294 - DNA, 17 bp, Homo sapiens
ccgggaagggggctggg

SEQ ID NO: 6738295 - DNA, 15 bp, Homo sapiens
ccgggacaccgtggg

SEQ ID NO: 6738296 - DNA, 20 bp, Homo sapiens
ccgggacaccgtggggaagg

SEQ ID NO: 6738297 - DNA, 20 bp, Homo sapiens
ccgggacacctaggctaggg

SEQ ID NO: 6738298 - DNA, 15 bp, Homo sapiens
ccgggacagacctgg

SEQ ID NO: 6738299 - DNA, 18 bp, Homo sapiens
ccgggacagacctggaca

SEQ ID NO: 6738300 - DNA, 18 bp, Homo sapiens
ccgggaccacagctgctg

SEQ ID NO: 6738301 - DNA, 21 bp, Homo sapiens
ccgggaccacagctgctggcc

SEQ ID NO: 6738302 - DNA, 20 bp, Homo sapiens
ccgggaccaccctgagccgg

SEQ ID NO: 6738303 - DNA, 21 bp, Homo sapiens
ccgggaccattgacctcagct

SEQ ID NO: 6738304 - DNA, 16 bp, Homo sapiens
ccgggacccacggagc

SEQ ID NO: 6738305 - DNA, 20 bp, Homo sapiens
ccgggacccacggagccctc

SEQ ID NO: 6738306 - DNA, 20 bp, Homo sapiens
ccgggacgcttccagaccac

SEQ ID NO: 6738307 - DNA, 21 bp, Homo sapiens
ccgggacgtggcacctcctcg

SEQ ID NO: 6738308 - DNA, 20 bp, Homo sapiens
ccgggactcactggcagccc

SEQ ID NO: 6738309 - DNA, 23 bp, Homo sapiens
ccgggactcactggcagccccag

SEQ ID NO: 6738310 - DNA, 17 bp, Homo sapiens
ccgggactgctgctctc

SEQ ID NO: 6738311 - DNA, 21 bp, Homo sapiens
ccgggactgctgctctcccaa

SEQ ID NO: 6738312 - DNA, 23 bp, Homo sapiens
ccgggagaaggcatgagaaagaa

SEQ ID NO: 6738313 - DNA, 15 bp, Homo sapiens
ccgggagactgccag

SEQ ID NO: 6738314 - DNA, 17 bp, Homo sapiens
ccgggagatccgccctg

SEQ ID NO: 6738315 - DNA, 24 bp, Homo sapiens
ccgggagatccgccctgggctctg

SEQ ID NO: 6738316 - DNA, 23 bp, Homo sapiens
ccgggagcctaggaccactcagc

SEQ ID NO: 6738317 - DNA, 16 bp, Homo sapiens
ccgggagcctccccct

SEQ ID NO: 6738318 - DNA, 19 bp, Homo sapiens
ccgggagcctccccctcag

SEQ ID NO: 6738319 - DNA, 20 bp, Homo sapiens
ccgggagcctccccctcaga

SEQ ID NO: 6738320 - DNA, 23 bp, Homo sapiens
ccgggagcctgatcacctgccct

SEQ ID NO: 6738321 - DNA, 14 bp, Homo sapiens
ccgggagctggcgg

SEQ ID NO: 6738322 - DNA, 13 bp, Homo sapiens
ccgggagctgggc

SEQ ID NO: 6738323 - DNA, 17 bp, Homo sapiens
ccgggagctgggccctg

SEQ ID NO: 6738324 - DNA, 19 bp, Homo sapiens
ccgggagctgggccctgcc

SEQ ID NO: 6738325 - DNA, 21 bp, Homo sapiens
ccgggagctgggccctgcctg

SEQ ID NO: 6738326 - DNA, 22 bp, Homo sapiens
ccgggagctgggccctgcctgc

SEQ ID NO: 6738327 - DNA, 20 bp, Homo sapiens
ccgggagctggtgacagcct

SEQ ID NO: 6738328 - DNA, 19 bp, Homo sapiens
ccgggagctttgagacagg

SEQ ID NO: 6738329 - DNA, 19 bp, Homo sapiens
ccgggaggcagccacaggg

SEQ ID NO: 6738330 - DNA, 14 bp, Homo sapiens
ccgggaggcagtgc

SEQ ID NO: 6738331 - DNA, 22 bp, Homo sapiens
ccgggagggtgcggctgtgcag

SEQ ID NO: 6738332 - DNA, 23 bp, Homo sapiens
ccgggaggtggagcttgcaatga

SEQ ID NO: 6738333 - DNA, 23 bp, Homo sapiens
ccgggataaactgagcctgttca

SEQ ID NO: 6738334 - DNA, 14 bp, Homo sapiens
ccgggatcctgccc

SEQ ID NO: 6738335 - DNA, 21 bp, Homo sapiens
ccgggatcctgcccccaagtc

SEQ ID NO: 6738336 - DNA, 16 bp, Homo sapiens
ccgggatgggagccgg

SEQ ID NO: 6738337 - DNA, 13 bp, Homo sapiens
ccgggatgggtgg

SEQ ID NO: 6738338 - DNA, 17 bp, Homo sapiens
ccgggcaaactggccgc

SEQ ID NO: 6738339 - DNA, 12 bp, Homo sapiens
ccgggcaaaggg

SEQ ID NO: 6738340 - DNA, 18 bp, Homo sapiens
ccgggcaaatgccagggc

SEQ ID NO: 6738341 - DNA, 22 bp, Homo sapiens
ccgggcacggtcacacggccac

SEQ ID NO: 6738342 - DNA, 23 bp, Homo sapiens
ccgggcacggtggctcacacctg

SEQ ID NO: 6738343 - DNA, 20 bp, Homo sapiens
ccgggcactcccgggatggg

SEQ ID NO: 6738344 - DNA, 17 bp, Homo sapiens
ccgggcagagaccaccg

SEQ ID NO: 6738345 - DNA, 15 bp, Homo sapiens
ccgggcagaggggca

SEQ ID NO: 6738346 - DNA, 13 bp, Homo sapiens
ccgggcaggccag

SEQ ID NO: 6738347 - DNA, 14 bp, Homo sapiens
ccgggcaggccagc

SEQ ID NO: 6738348 - DNA, 11 bp, Homo sapiens
ccgggcaggcg

SEQ ID NO: 6738349 - DNA, 15 bp, Homo sapiens
ccgggcaggtcctgc

SEQ ID NO: 6738350 - DNA, 21 bp, Homo sapiens
ccgggcatggtggcaggcgcc

SEQ ID NO: 6738351 - DNA, 23 bp, Homo sapiens
ccgggcatggtggcatgtgcctg

SEQ ID NO: 6738352 - DNA, 22 bp, Homo sapiens
ccgggcatggtggcgcaagcct

SEQ ID NO: 6738353 - DNA, 18 bp, Homo sapiens
ccgggccacgccccagcc

SEQ ID NO: 6738354 - DNA, 19 bp, Homo sapiens
ccgggccactccttcctgc

SEQ ID NO: 6738355 - DNA, 20 bp, Homo sapiens
ccgggccactccttcctgcc

SEQ ID NO: 6738356 - DNA, 14 bp, Homo sapiens
ccgggccagggctg

SEQ ID NO: 6738357 - DNA, 15 bp, Homo sapiens
ccgggccagggctgc

SEQ ID NO: 6738358 - DNA, 15 bp, Homo sapiens
ccgggcccaggcaga

SEQ ID NO: 6738359 - DNA, 14 bp, Homo sapiens
ccgggcccagggcc

SEQ ID NO: 6738360 - DNA, 20 bp, Homo sapiens
ccgggcccagggcctctggc

SEQ ID NO: 6738361 - DNA, 13 bp, Homo sapiens
ccgggcccccgcc

SEQ ID NO: 6738362 - DNA, 14 bp, Homo sapiens
ccgggcccctctct

SEQ ID NO: 6738363 - DNA, 22 bp, Homo sapiens
ccgggcccctctctagggaccc

SEQ ID NO: 6738364 - DNA, 15 bp, Homo sapiens
ccgggccctcagccc

SEQ ID NO: 6738365 - DNA, 13 bp, Homo sapiens
ccgggccctccct

SEQ ID NO: 6738366 - DNA, 15 bp, Homo sapiens
ccgggccctcctggg

SEQ ID NO: 6738367 - DNA, 21 bp, Homo sapiens
ccgggccgaccctgcggcctc

SEQ ID NO: 6738368 - DNA, 12 bp, Homo sapiens
ccgggccggggc

SEQ ID NO: 6738369 - DNA, 11 bp, Homo sapiens
ccgggcctccc

SEQ ID NO: 6738370 - DNA, 14 bp, Homo sapiens
ccgggcctcggcct

SEQ ID NO: 6738371 - DNA, 17 bp, Homo sapiens
ccgggcctcggcctggc

SEQ ID NO: 6738372 - DNA, 23 bp, Homo sapiens
ccgggcctgacccggcccctacc

SEQ ID NO: 6738373 - DNA, 17 bp, Homo sapiens
ccgggcctgcacagata

SEQ ID NO: 6738374 - DNA, 18 bp, Homo sapiens
ccgggcctgcctctgact

SEQ ID NO: 6738375 - DNA, 15 bp, Homo sapiens
ccgggcctgctgtca

SEQ ID NO: 6738376 - DNA, 14 bp, Homo sapiens
ccgggcctggactg

SEQ ID NO: 6738377 - DNA, 17 bp, Homo sapiens
ccgggcctgggcctcct

SEQ ID NO: 6738378 - DNA, 12 bp, Homo sapiens
ccgggcgcagcc

SEQ ID NO: 6738379 - DNA, 15 bp, Homo sapiens
ccgggcgcagccctc

SEQ ID NO: 6738380 - DNA, 14 bp, Homo sapiens
ccgggcgcatgcct

SEQ ID NO: 6738381 - DNA, 20 bp, Homo sapiens
ccgggcgcatgcctcccagg

SEQ ID NO: 6738382 - DNA, 14 bp, Homo sapiens
ccgggcgccaggac

SEQ ID NO: 6738383 - DNA, 16 bp, Homo sapiens
ccgggcgccaggacag

SEQ ID NO: 6738384 - DNA, 17 bp, Homo sapiens
ccgggcgcggccagccc

SEQ ID NO: 6738385 - DNA, 19 bp, Homo sapiens
ccgggcgcggccagccccg

SEQ ID NO: 6738386 - DNA, 16 bp, Homo sapiens
ccgggcgtggtggtga

SEQ ID NO: 6738387 - DNA, 16 bp, Homo sapiens
ccgggcgtgtgaagaa

SEQ ID NO: 6738388 - DNA, 20 bp, Homo sapiens
ccgggcgtgtgaagaacacc

SEQ ID NO: 6738389 - DNA, 18 bp, Homo sapiens
ccgggctccagggagtgg

SEQ ID NO: 6738390 - DNA, 22 bp, Homo sapiens
ccgggctccagggagtggggag

SEQ ID NO: 6738391 - DNA, 20 bp, Homo sapiens
ccgggctccatgcctctgga

SEQ ID NO: 6738392 - DNA, 14 bp, Homo sapiens
ccgggctctctgct

SEQ ID NO: 6738393 - DNA, 15 bp, Homo sapiens
ccgggctctgcctcc

SEQ ID NO: 6738394 - DNA, 11 bp, Homo sapiens
ccgggctgcag

SEQ ID NO: 6738395 - DNA, 19 bp, Homo sapiens
ccgggctgcccttcgctgc

SEQ ID NO: 6738396 - DNA, 22 bp, Homo sapiens
ccgggctgcccttcgctgccag

SEQ ID NO: 6738397 - DNA, 12 bp, Homo sapiens
ccgggctgcctg

SEQ ID NO: 6738398 - DNA, 19 bp, Homo sapiens
ccgggctgcctgcccctgc

SEQ ID NO: 6738399 - DNA, 23 bp, Homo sapiens
ccgggctgcctgcccctgctgct

SEQ ID NO: 6738400 - DNA, 12 bp, Homo sapiens
ccgggctgctgc

SEQ ID NO: 6738401 - DNA, 23 bp, Homo sapiens
ccgggctgctgctgatgtaggag

SEQ ID NO: 6738402 - DNA, 14 bp, Homo sapiens
ccgggctggccctg

SEQ ID NO: 6738403 - DNA, 15 bp, Homo sapiens
ccgggctggccctgt

SEQ ID NO: 6738404 - DNA, 17 bp, Homo sapiens
ccgggctggccctgtgc

SEQ ID NO: 6738405 - DNA, 18 bp, Homo sapiens
ccgggctggcctgacaca

SEQ ID NO: 6738406 - DNA, 20 bp, Homo sapiens
ccgggctgtagatcaggttt

SEQ ID NO: 6738407 - DNA, 20 bp, Homo sapiens
ccgggcttgggccctgcaca

SEQ ID NO: 6738408 - DNA, 15 bp, Homo sapiens
ccggggaaaggcaag

SEQ ID NO: 6738409 - DNA, 16 bp, Homo sapiens
ccggggaactggccaa

SEQ ID NO: 6738410 - DNA, 18 bp, Homo sapiens
ccggggaactggccaagc

SEQ ID NO: 6738411 - DNA, 20 bp, Homo sapiens
ccggggaactggccaagctg

SEQ ID NO: 6738412 - DNA, 20 bp, Homo sapiens
ccggggaagctgccagccca

SEQ ID NO: 6738413 - DNA, 21 bp, Homo sapiens
ccggggaagctggcagcactc

SEQ ID NO: 6738414 - DNA, 20 bp, Homo sapiens
ccggggaccttgtgggacca

SEQ ID NO: 6738415 - DNA, 17 bp, Homo sapiens
ccggggactcgcagcac

SEQ ID NO: 6738416 - DNA, 18 bp, Homo sapiens
ccggggagaaacccagag

SEQ ID NO: 6738417 - DNA, 19 bp, Homo sapiens
ccggggagaaacccagaga

SEQ ID NO: 6738418 - DNA, 15 bp, Homo sapiens
ccggggagcgcccgc

SEQ ID NO: 6738419 - DNA, 14 bp, Homo sapiens
ccggggagctgagg

SEQ ID NO: 6738420 - DNA, 18 bp, Homo sapiens
ccggggagctgaggggca

SEQ ID NO: 6738421 - DNA, 13 bp, Homo sapiens
ccggggagctgca

SEQ ID NO: 6738422 - DNA, 15 bp, Homo sapiens
ccggggagctgcaga

SEQ ID NO: 6738423 - DNA, 23 bp, Homo sapiens
ccggggaggagagagcagcttct

SEQ ID NO: 6738424 - DNA, 17 bp, Homo sapiens
ccggggaggagccttgg

SEQ ID NO: 6738425 - DNA, 15 bp, Homo sapiens
ccggggaggggcgct

SEQ ID NO: 6738426 - DNA, 20 bp, Homo sapiens
ccggggagggggcacggcag

SEQ ID NO: 6738427 - DNA, 23 bp, Homo sapiens
ccggggcaaggtctccttactct

SEQ ID NO: 6738428 - DNA, 14 bp, Homo sapiens
ccggggcagccccc

SEQ ID NO: 6738429 - DNA, 12 bp, Homo sapiens
ccggggcagctg

SEQ ID NO: 6738430 - DNA, 20 bp, Homo sapiens
ccggggcagctgccagagaa

SEQ ID NO: 6738431 - DNA, 14 bp, Homo sapiens
ccggggcagggcag

SEQ ID NO: 6738432 - DNA, 16 bp, Homo sapiens
ccggggccagagacat

SEQ ID NO: 6738433 - DNA, 16 bp, Homo sapiens
ccggggccagcaccac

SEQ ID NO: 6738434 - DNA, 19 bp, Homo sapiens
ccggggccatggaagctgg

SEQ ID NO: 6738435 - DNA, 15 bp, Homo sapiens
ccggggccccctggt

SEQ ID NO: 6738436 - DNA, 19 bp, Homo sapiens
ccggggcccctcaccccaa

SEQ ID NO: 6738437 - DNA, 23 bp, Homo sapiens
ccggggccctctctgcaccggac

SEQ ID NO: 6738438 - DNA, 14 bp, Homo sapiens
ccggggcccttcct

SEQ ID NO: 6738439 - DNA, 17 bp, Homo sapiens
ccggggcctgcctagca

SEQ ID NO: 6738440 - DNA, 15 bp, Homo sapiens
ccggggcctggacag

SEQ ID NO: 6738441 - DNA, 17 bp, Homo sapiens
ccggggcctggacaggc

SEQ ID NO: 6738442 - DNA, 20 bp, Homo sapiens
ccggggcctggacctatgca

SEQ ID NO: 6738443 - DNA, 15 bp, Homo sapiens
ccggggcctggactg

SEQ ID NO: 6738444 - DNA, 20 bp, Homo sapiens
ccggggcctgggcaggaggg

SEQ ID NO: 6738445 - DNA, 24 bp, Homo sapiens
ccggggccttggtcccagacagct

SEQ ID NO: 6738446 - DNA, 18 bp, Homo sapiens
ccggggcgcctagagcgc

SEQ ID NO: 6738447 - DNA, 16 bp, Homo sapiens
ccggggctgaagccac

SEQ ID NO: 6738448 - DNA, 18 bp, Homo sapiens
ccggggctgaagccacac

SEQ ID NO: 6738449 - DNA, 21 bp, Homo sapiens
ccggggctgaagccacacagc

SEQ ID NO: 6738450 - DNA, 24 bp, Homo sapiens
ccggggctgccgcatctgcctgga

SEQ ID NO: 6738451 - DNA, 13 bp, Homo sapiens
ccggggctgctgg

SEQ ID NO: 6738452 - DNA, 18 bp, Homo sapiens
ccggggctgctggcctgg

SEQ ID NO: 6738453 - DNA, 12 bp, Homo sapiens
ccggggctggcc

SEQ ID NO: 6738454 - DNA, 13 bp, Homo sapiens
ccggggctggccc

SEQ ID NO: 6738455 - DNA, 14 bp, Homo sapiens
ccggggctggccct

SEQ ID NO: 6738456 - DNA, 15 bp, Homo sapiens
ccggggctggccctg

SEQ ID NO: 6738457 - DNA, 16 bp, Homo sapiens
ccggggctggccctgc

SEQ ID NO: 6738458 - DNA, 14 bp, Homo sapiens
ccgggggagcccag

SEQ ID NO: 6738459 - DNA, 20 bp, Homo sapiens
ccgggggaggggcgcgggag

SEQ ID NO: 6738460 - DNA, 21 bp, Homo sapiens
ccgggggcagtctgagagagg

SEQ ID NO: 6738461 - DNA, 15 bp, Homo sapiens
ccgggggccaactca

SEQ ID NO: 6738462 - DNA, 17 bp, Homo sapiens
ccgggggccagacacag

SEQ ID NO: 6738463 - DNA, 18 bp, Homo sapiens
ccgggggccagacacaga

SEQ ID NO: 6738464 - DNA, 11 bp, Homo sapiens
ccgggggctgc

SEQ ID NO: 6738465 - DNA, 13 bp, Homo sapiens
ccggggggagcag

SEQ ID NO: 6738466 - DNA, 15 bp, Homo sapiens
ccggggggaggggac

SEQ ID NO: 6738467 - DNA, 21 bp, Homo sapiens
ccggggggaggggacagagct

SEQ ID NO: 6738468 - DNA, 16 bp, Homo sapiens
ccggggggctgggaca

SEQ ID NO: 6738469 - DNA, 16 bp, Homo sapiens
ccggggggtctcttct

SEQ ID NO: 6738470 - DNA, 15 bp, Homo sapiens
ccgggggtggctctg

SEQ ID NO: 6738471 - DNA, 20 bp, Homo sapiens
ccgggggtgggggcctgctg

SEQ ID NO: 6738472 - DNA, 21 bp, Homo sapiens
ccgggggtgggggcctgctgt

SEQ ID NO: 6738473 - DNA, 18 bp, Homo sapiens
ccggggtcctgaggctgg

SEQ ID NO: 6738474 - DNA, 13 bp, Homo sapiens
ccggggtcctggg

SEQ ID NO: 6738475 - DNA, 21 bp, Homo sapiens
ccggggtcctgtggcaggcag

SEQ ID NO: 6738476 - DNA, 22 bp, Homo sapiens
ccggggtctccacctcagggga

SEQ ID NO: 6738477 - DNA, 17 bp, Homo sapiens
ccggggtctcctggacc

SEQ ID NO: 6738478 - DNA, 13 bp, Homo sapiens
ccggggtctgtgc

SEQ ID NO: 6738479 - DNA, 15 bp, Homo sapiens
ccggggtctgtgctg

SEQ ID NO: 6738480 - DNA, 20 bp, Homo sapiens
ccggggtctgtgctgtgcct

SEQ ID NO: 6738481 - DNA, 20 bp, Homo sapiens
ccggggtggagtcagggctg

SEQ ID NO: 6738482 - DNA, 21 bp, Homo sapiens
ccggggtggccacagcgccag

SEQ ID NO: 6738483 - DNA, 14 bp, Homo sapiens
ccggggtggggtgc

SEQ ID NO: 6738484 - DNA, 23 bp, Homo sapiens
ccggggtggggtgcactcgccat

SEQ ID NO: 6738485 - DNA, 20 bp, Homo sapiens
ccggggtggggtgcctgagc

SEQ ID NO: 6738486 - DNA, 20 bp, Homo sapiens
ccggggtggggtggctgcag

SEQ ID NO: 6738487 - DNA, 16 bp, Homo sapiens
ccggggtggtggacag

SEQ ID NO: 6738488 - DNA, 20 bp, Homo sapiens
ccggggtgtaacttcctgct

SEQ ID NO: 6738489 - DNA, 22 bp, Homo sapiens
ccggggtgtaacttcctgctgc

SEQ ID NO: 6738490 - DNA, 14 bp, Homo sapiens
ccggggtgtggaat

SEQ ID NO: 6738491 - DNA, 18 bp, Homo sapiens
ccggggttcagcctcctg

SEQ ID NO: 6738492 - DNA, 20 bp, Homo sapiens
ccggggttccccacacaggg

SEQ ID NO: 6738493 - DNA, 18 bp, Homo sapiens
ccggggttcccgtgtgcc

SEQ ID NO: 6738494 - DNA, 20 bp, Homo sapiens
ccgggtactcagtcagccca

SEQ ID NO: 6738495 - DNA, 22 bp, Homo sapiens
ccgggtccggcctctccctgcc

SEQ ID NO: 6738496 - DNA, 14 bp, Homo sapiens
ccgggtctgcctct

SEQ ID NO: 6738497 - DNA, 21 bp, Homo sapiens
ccgggtgccccccatgccctc

SEQ ID NO: 6738498 - DNA, 21 bp, Homo sapiens
ccgggtgcctcagagcaggct

SEQ ID NO: 6738499 - DNA, 15 bp, Homo sapiens
ccgggtgcctgtgac

SEQ ID NO: 6738500 - DNA, 21 bp, Homo sapiens
ccgggtgcgtgaccggcccgc

SEQ ID NO: 6738501 - DNA, 22 bp, Homo sapiens
ccgggtgcgtgaccggcccgcc

SEQ ID NO: 6738502 - DNA, 17 bp, Homo sapiens
ccgggtgggcctggcct

SEQ ID NO: 6738503 - DNA, 20 bp, Homo sapiens
ccgggtgggcggcacagcct

SEQ ID NO: 6738504 - DNA, 18 bp, Homo sapiens
ccgggtggggggagggca

SEQ ID NO: 6738505 - DNA, 22 bp, Homo sapiens
ccgggtgtccccaacagcgccc

SEQ ID NO: 6738506 - DNA, 20 bp, Homo sapiens
ccgggtgtgcctgccctgga

SEQ ID NO: 6738507 - DNA, 22 bp, Homo sapiens
ccgggtgtggcacgcacctgta

SEQ ID NO: 6738508 - DNA, 13 bp, Homo sapiens
ccgggtgtggcct

SEQ ID NO: 6738509 - DNA, 14 bp, Homo sapiens
ccgggtgtggcctc

SEQ ID NO: 6738510 - DNA, 17 bp, Homo sapiens
ccgggtgtggcctcagc

SEQ ID NO: 6738511 - DNA, 18 bp, Homo sapiens
ccgggtgtggcctcagcc

SEQ ID NO: 6738512 - DNA, 14 bp, Homo sapiens
ccgggttcagcctg

SEQ ID NO: 6738513 - DNA, 17 bp, Homo sapiens
ccgggttcagcctggcc

SEQ ID NO: 6738514 - DNA, 16 bp, Homo sapiens
ccgggttcatgccatt

SEQ ID NO: 6738515 - DNA, 16 bp, Homo sapiens
ccgggttggaggcctc

SEQ ID NO: 6738516 - DNA, 24 bp, Homo sapiens
ccgggttggaggcctcaccctgct

SEQ ID NO: 6738517 - DNA, 19 bp, Homo sapiens
ccgggtttggctgagcctg

SEQ ID NO: 6738518 - DNA, 22 bp, Homo sapiens
ccggtaaaatgaggccggacag

SEQ ID NO: 6738519 - DNA, 19 bp, Homo sapiens
ccggtaagagcaaaagaat

SEQ ID NO: 6738520 - DNA, 14 bp, Homo sapiens
ccggtaatgtcact

SEQ ID NO: 6738521 - DNA, 15 bp, Homo sapiens
ccggtagaggctccc

SEQ ID NO: 6738522 - DNA, 24 bp, Homo sapiens
ccggtagaggctccccagggctcc

SEQ ID NO: 6738523 - DNA, 17 bp, Homo sapiens
ccggtaggctgctggcg

SEQ ID NO: 6738524 - DNA, 18 bp, Homo sapiens
ccggtagggaggcagcct

SEQ ID NO: 6738525 - DNA, 16 bp, Homo sapiens
ccggtcacccaggctc

SEQ ID NO: 6738526 - DNA, 20 bp, Homo sapiens
ccggtcagaggagcgcaggc

SEQ ID NO: 6738527 - DNA, 14 bp, Homo sapiens
ccggtcagccaagt

SEQ ID NO: 6738528 - DNA, 21 bp, Homo sapiens
ccggtcagccaagtgcagagt

SEQ ID NO: 6738529 - DNA, 12 bp, Homo sapiens
ccggtcagtgcc

SEQ ID NO: 6738530 - DNA, 13 bp, Homo sapiens
ccggtccaccccg

SEQ ID NO: 6738531 - DNA, 13 bp, Homo sapiens
ccggtcccagcct

SEQ ID NO: 6738532 - DNA, 14 bp, Homo sapiens
ccggtcccagcctg

SEQ ID NO: 6738533 - DNA, 16 bp, Homo sapiens
ccggtcccaggccgca

SEQ ID NO: 6738534 - DNA, 13 bp, Homo sapiens
ccggtccccacag

SEQ ID NO: 6738535 - DNA, 21 bp, Homo sapiens
ccggtccccacagactgcccc

SEQ ID NO: 6738536 - DNA, 15 bp, Homo sapiens
ccggtcccccagagc

SEQ ID NO: 6738537 - DNA, 17 bp, Homo sapiens
ccggtcccccagagcat

SEQ ID NO: 6738538 - DNA, 22 bp, Homo sapiens
ccggtcccccagagcatctgcc

SEQ ID NO: 6738539 - DNA, 16 bp, Homo sapiens
ccggtcccctctgccc

SEQ ID NO: 6738540 - DNA, 23 bp, Homo sapiens
ccggtcccctctgccccaccctc

SEQ ID NO: 6738541 - DNA, 19 bp, Homo sapiens
ccggtcccttccatgccct

SEQ ID NO: 6738542 - DNA, 14 bp, Homo sapiens
ccggtcctggcccc

SEQ ID NO: 6738543 - DNA, 20 bp, Homo sapiens
ccggtcgggcagccagcaga

SEQ ID NO: 6738544 - DNA, 21 bp, Homo sapiens
ccggtcgggcagccagcagag

SEQ ID NO: 6738545 - DNA, 22 bp, Homo sapiens
ccggtctatgtcgagagctggc

SEQ ID NO: 6738546 - DNA, 23 bp, Homo sapiens
ccggtctatgtcgagagctggcc

SEQ ID NO: 6738547 - DNA, 17 bp, Homo sapiens
ccggtctgcaagtcaga

SEQ ID NO: 6738548 - DNA, 19 bp, Homo sapiens
ccggtctgcaagtcagagg

SEQ ID NO: 6738549 - DNA, 21 bp, Homo sapiens
ccggtgaggggaggggcctcc

SEQ ID NO: 6738550 - DNA, 16 bp, Homo sapiens
ccggtgcacaggcctc

SEQ ID NO: 6738551 - DNA, 21 bp, Homo sapiens
ccggtgcacaggcctctgcct

SEQ ID NO: 6738552 - DNA, 14 bp, Homo sapiens
ccggtgcagcctct

SEQ ID NO: 6738553 - DNA, 19 bp, Homo sapiens
ccggtgccaaacccagccc

SEQ ID NO: 6738554 - DNA, 16 bp, Homo sapiens
ccggtgccagctgccc

SEQ ID NO: 6738555 - DNA, 21 bp, Homo sapiens
ccggtgcccacctaagggcta

SEQ ID NO: 6738556 - DNA, 14 bp, Homo sapiens
ccggtgcctgggtg

SEQ ID NO: 6738557 - DNA, 18 bp, Homo sapiens
ccggtgccttccaccctg

SEQ ID NO: 6738558 - DNA, 16 bp, Homo sapiens
ccggtgctgcaggagt

SEQ ID NO: 6738559 - DNA, 15 bp, Homo sapiens
ccggtgctgggggca

SEQ ID NO: 6738560 - DNA, 18 bp, Homo sapiens
ccggtgctgggggcacag

SEQ ID NO: 6738561 - DNA, 12 bp, Homo sapiens
ccggtgctgggt

SEQ ID NO: 6738562 - DNA, 17 bp, Homo sapiens
ccggtgcttctggaaac

SEQ ID NO: 6738563 - DNA, 15 bp, Homo sapiens
ccggtggaaggcctt

SEQ ID NO: 6738564 - DNA, 18 bp, Homo sapiens
ccggtggcggccccagca

SEQ ID NO: 6738565 - DNA, 15 bp, Homo sapiens
ccggtgggcagtggg

SEQ ID NO: 6738566 - DNA, 13 bp, Homo sapiens
ccggtggggccag

SEQ ID NO: 6738567 - DNA, 16 bp, Homo sapiens
ccggtgggggggcaga

SEQ ID NO: 6738568 - DNA, 19 bp, Homo sapiens
ccggtggttttgtgcttta

SEQ ID NO: 6738569 - DNA, 16 bp, Homo sapiens
ccggtgtatcctggcc

SEQ ID NO: 6738570 - DNA, 19 bp, Homo sapiens
ccggtgtatcctggccctg

SEQ ID NO: 6738571 - DNA, 22 bp, Homo sapiens
ccggtgtatcctggccctgggg

SEQ ID NO: 6738572 - DNA, 21 bp, Homo sapiens
ccggtgtgcctgactgcccag

SEQ ID NO: 6738573 - DNA, 17 bp, Homo sapiens
ccggtgtgggggccccg

SEQ ID NO: 6738574 - DNA, 21 bp, Homo sapiens
ccggtgtggtggctcacgcct

SEQ ID NO: 6738575 - DNA, 12 bp, Homo sapiens
ccggtgttctaa

SEQ ID NO: 6738576 - DNA, 19 bp, Homo sapiens
ccggttaaattccatatgc

SEQ ID NO: 6738577 - DNA, 22 bp, Homo sapiens
ccggttcactcttctcagccac

SEQ ID NO: 6738578 - DNA, 17 bp, Homo sapiens
ccggttcagacccctgc

SEQ ID NO: 6738579 - DNA, 20 bp, Homo sapiens
ccggttcagacccctgcctg

SEQ ID NO: 6738580 - DNA, 15 bp, Homo sapiens
ccggttcaggaccac

SEQ ID NO: 6738581 - DNA, 17 bp, Homo sapiens
ccggttcccacaagcct

SEQ ID NO: 6738582 - DNA, 22 bp, Homo sapiens
ccggttccccgcaacccacagc

SEQ ID NO: 6738583 - DNA, 19 bp, Homo sapiens
ccggttcctgtccctgcgc

SEQ ID NO: 6738584 - DNA, 16 bp, Homo sapiens
ccggttcttccagtgg

SEQ ID NO: 6738585 - DNA, 16 bp, Homo sapiens
ccggttcttcttgtct

SEQ ID NO: 6738586 - DNA, 18 bp, Homo sapiens
ccggttgcagtcactgtg

SEQ ID NO: 6738587 - DNA, 18 bp, Homo sapiens
ccggttgccactctcctc

SEQ ID NO: 6738588 - DNA, 20 bp, Homo sapiens
ccggttgctctcaaaaccct

SEQ ID NO: 6738589 - DNA, 19 bp, Homo sapiens
ccggttgctggtcaggtcc

SEQ ID NO: 6738590 - DNA, 17 bp, Homo sapiens
ccggttgcttctgggaa

SEQ ID NO: 6738591 - DNA, 23 bp, Homo sapiens
ccggtttagtcatccaacaagaa

SEQ ID NO: 6738592 - DNA, 15 bp, Homo sapiens
ccggtttctttttaa

SEQ ID NO: 6738593 - DNA, 18 bp, Homo sapiens
ccggttttcctcagctct

SEQ ID NO: 6738594 - DNA, 21 bp, Homo sapiens
ccgtaaacacgcctgcaaacg

SEQ ID NO: 6738595 - DNA, 18 bp, Homo sapiens
ccgtaaagtgagcatgct

SEQ ID NO: 6738596 - DNA, 19 bp, Homo sapiens
ccgtaagaccaccttccct

SEQ ID NO: 6738597 - DNA, 12 bp, Homo sapiens
ccgtaaggctgt

SEQ ID NO: 6738598 - DNA, 17 bp, Homo sapiens
ccgtaataattattatt

SEQ ID NO: 6738599 - DNA, 20 bp, Homo sapiens
ccgtaatggggactctccag

SEQ ID NO: 6738600 - DNA, 23 bp, Homo sapiens
ccgtaattctttctgtctccctt

SEQ ID NO: 6738601 - DNA, 12 bp, Homo sapiens
ccgtaatttaac

SEQ ID NO: 6738602 - DNA, 15 bp, Homo sapiens
ccgtacatctctgtg

SEQ ID NO: 6738603 - DNA, 18 bp, Homo sapiens
ccgtacattcaatgttta

SEQ ID NO: 6738604 - DNA, 12 bp, Homo sapiens
ccgtaccccacc

SEQ ID NO: 6738605 - DNA, 18 bp, Homo sapiens
ccgtaccccaccctcagc

SEQ ID NO: 6738606 - DNA, 20 bp, Homo sapiens
ccgtaccccaccctcagcac

SEQ ID NO: 6738607 - DNA, 20 bp, Homo sapiens
ccgtacccccgtggtctttg

SEQ ID NO: 6738608 - DNA, 22 bp, Homo sapiens
ccgtacccccgtggtctttgaa

SEQ ID NO: 6738609 - DNA, 22 bp, Homo sapiens
ccgtacctcttcccatgactgc

SEQ ID NO: 6738610 - DNA, 14 bp, Homo sapiens
ccgtacctgtcatg

SEQ ID NO: 6738611 - DNA, 23 bp, Homo sapiens
ccgtacgactcttttccaaacac

SEQ ID NO: 6738612 - DNA, 12 bp, Homo sapiens
ccgtactctcac

SEQ ID NO: 6738613 - DNA, 18 bp, Homo sapiens
ccgtagagggtggccgac

SEQ ID NO: 6738614 - DNA, 17 bp, Homo sapiens
ccgtagatcatccccga

SEQ ID NO: 6738615 - DNA, 18 bp, Homo sapiens
ccgtagatcatccccgag

SEQ ID NO: 6738616 - DNA, 19 bp, Homo sapiens
ccgtagccactctctgccc

SEQ ID NO: 6738617 - DNA, 21 bp, Homo sapiens
ccgtagccactctctgcccac

SEQ ID NO: 6738618 - DNA, 15 bp, Homo sapiens
ccgtagctcccctgg

SEQ ID NO: 6738619 - DNA, 20 bp, Homo sapiens
ccgtagggtctttcttggga

SEQ ID NO: 6738620 - DNA, 18 bp, Homo sapiens
ccgtagggtggcactggg

SEQ ID NO: 6738621 - DNA, 16 bp, Homo sapiens
ccgtaggttattttca

SEQ ID NO: 6738622 - DNA, 22 bp, Homo sapiens
ccgtagtagatgttctactttg

SEQ ID NO: 6738623 - DNA, 14 bp, Homo sapiens
ccgtagtctcctgg

SEQ ID NO: 6738624 - DNA, 16 bp, Homo sapiens
ccgtagttattttgca

SEQ ID NO: 6738625 - DNA, 14 bp, Homo sapiens
ccgtagttccctga

SEQ ID NO: 6738626 - DNA, 17 bp, Homo sapiens
ccgtataataaaaccaa

SEQ ID NO: 6738627 - DNA, 12 bp, Homo sapiens
ccgtatcaaatg

SEQ ID NO: 6738628 - DNA, 12 bp, Homo sapiens
ccgtatccagag

SEQ ID NO: 6738629 - DNA, 21 bp, Homo sapiens
ccgtatctgagggctgctccc

SEQ ID NO: 6738630 - DNA, 13 bp, Homo sapiens
ccgtatctgccct

SEQ ID NO: 6738631 - DNA, 14 bp, Homo sapiens
ccgtatctgtcaca

SEQ ID NO: 6738632 - DNA, 21 bp, Homo sapiens
ccgtatctgtcacaataaatg

SEQ ID NO: 6738633 - DNA, 14 bp, Homo sapiens
ccgtattgaatttg

SEQ ID NO: 6738634 - DNA, 12 bp, Homo sapiens
ccgtatttcaga

SEQ ID NO: 6738635 - DNA, 23 bp, Homo sapiens
ccgtcaaggaaagggcagtggac

SEQ ID NO: 6738636 - DNA, 13 bp, Homo sapiens
ccgtcacagcctc

SEQ ID NO: 6738637 - DNA, 16 bp, Homo sapiens
ccgtcaccaccacccc

SEQ ID NO: 6738638 - DNA, 20 bp, Homo sapiens
ccgtcaccaccacccctacc

SEQ ID NO: 6738639 - DNA, 20 bp, Homo sapiens
ccgtcacccactctgcactg

SEQ ID NO: 6738640 - DNA, 14 bp, Homo sapiens
ccgtcaccccgcca

SEQ ID NO: 6738641 - DNA, 18 bp, Homo sapiens
ccgtcaccccgctcttcc

SEQ ID NO: 6738642 - DNA, 20 bp, Homo sapiens
ccgtcacccttggtagagtt

SEQ ID NO: 6738643 - DNA, 16 bp, Homo sapiens
ccgtcacctctccctc

SEQ ID NO: 6738644 - DNA, 13 bp, Homo sapiens
ccgtcagcctgtg

SEQ ID NO: 6738645 - DNA, 15 bp, Homo sapiens
ccgtcagcctgtgaa

SEQ ID NO: 6738646 - DNA, 23 bp, Homo sapiens
ccgtcagggagaggtcaccagct

SEQ ID NO: 6738647 - DNA, 12 bp, Homo sapiens
ccgtcagggccc

SEQ ID NO: 6738648 - DNA, 20 bp, Homo sapiens
ccgtcagtatcaggcctgcc

SEQ ID NO: 6738649 - DNA, 23 bp, Homo sapiens
ccgtcatccatgccctcccagga

SEQ ID NO: 6738650 - DNA, 22 bp, Homo sapiens
ccgtcatctgcggggcttctgg

SEQ ID NO: 6738651 - DNA, 21 bp, Homo sapiens
ccgtcatggcttaatgtttat

SEQ ID NO: 6738652 - DNA, 16 bp, Homo sapiens
ccgtcatgttcctcaa

SEQ ID NO: 6738653 - DNA, 17 bp, Homo sapiens
ccgtcatgttcctcaaa

SEQ ID NO: 6738654 - DNA, 17 bp, Homo sapiens
ccgtcattgctgctgct

SEQ ID NO: 6738655 - DNA, 12 bp, Homo sapiens
ccgtcatttcat

SEQ ID NO: 6738656 - DNA, 23 bp, Homo sapiens
ccgtccacccaggctgcactgca

SEQ ID NO: 6738657 - DNA, 15 bp, Homo sapiens
ccgtccaggggagat

SEQ ID NO: 6738658 - DNA, 21 bp, Homo sapiens
ccgtccatatcagaactgtgc

SEQ ID NO: 6738659 - DNA, 19 bp, Homo sapiens
ccgtccatcccccttcttc

SEQ ID NO: 6738660 - DNA, 13 bp, Homo sapiens
ccgtccatggcac

SEQ ID NO: 6738661 - DNA, 14 bp, Homo sapiens
ccgtccatggcacc

SEQ ID NO: 6738662 - DNA, 16 bp, Homo sapiens
ccgtccatggtgctaa

SEQ ID NO: 6738663 - DNA, 19 bp, Homo sapiens
ccgtcccagaggccgctgc

SEQ ID NO: 6738664 - DNA, 17 bp, Homo sapiens
ccgtccccccatcccgt

SEQ ID NO: 6738665 - DNA, 16 bp, Homo sapiens
ccgtccccccccaggc

SEQ ID NO: 6738666 - DNA, 18 bp, Homo sapiens
ccgtcccctaacccccag

SEQ ID NO: 6738667 - DNA, 24 bp, Homo sapiens
ccgtcccctaacccccagtcctca

SEQ ID NO: 6738668 - DNA, 18 bp, Homo sapiens
ccgtcccctagagtccca

SEQ ID NO: 6738669 - DNA, 15 bp, Homo sapiens
ccgtcccctcccagg

SEQ ID NO: 6738670 - DNA, 17 bp, Homo sapiens
ccgtcccctcccaggga

SEQ ID NO: 6738671 - DNA, 13 bp, Homo sapiens
ccgtcccctctcc

SEQ ID NO: 6738672 - DNA, 14 bp, Homo sapiens
ccgtcccctgcagc

SEQ ID NO: 6738673 - DNA, 21 bp, Homo sapiens
ccgtcccctgcagcctgggtc

SEQ ID NO: 6738674 - DNA, 15 bp, Homo sapiens
ccgtcccctgcccac

SEQ ID NO: 6738675 - DNA, 18 bp, Homo sapiens
ccgtccctctgccttgca

SEQ ID NO: 6738676 - DNA, 15 bp, Homo sapiens
ccgtccctgtccccc

SEQ ID NO: 6738677 - DNA, 20 bp, Homo sapiens
ccgtccctttttctccacac

SEQ ID NO: 6738678 - DNA, 15 bp, Homo sapiens
ccgtccgcccgccca

SEQ ID NO: 6738679 - DNA, 18 bp, Homo sapiens
ccgtccgcccgcccaccc

SEQ ID NO: 6738680 - DNA, 24 bp, Homo sapiens
ccgtcctcacccctgtcctcactg

SEQ ID NO: 6738681 - DNA, 14 bp, Homo sapiens
ccgtcctccctcag

SEQ ID NO: 6738682 - DNA, 15 bp, Homo sapiens
ccgtcctccctcagc

SEQ ID NO: 6738683 - DNA, 12 bp, Homo sapiens
ccgtcctgaggg

SEQ ID NO: 6738684 - DNA, 13 bp, Homo sapiens
ccgtcctgagggg

SEQ ID NO: 6738685 - DNA, 13 bp, Homo sapiens
ccgtcctgcctgt

SEQ ID NO: 6738686 - DNA, 16 bp, Homo sapiens
ccgtcctgcctgtggc

SEQ ID NO: 6738687 - DNA, 17 bp, Homo sapiens
ccgtcctgctggagtga

SEQ ID NO: 6738688 - DNA, 20 bp, Homo sapiens
ccgtcctgctgtccctgtca

SEQ ID NO: 6738689 - DNA, 19 bp, Homo sapiens
ccgtcctgtcactgatgga

SEQ ID NO: 6738690 - DNA, 21 bp, Homo sapiens
ccgtcgaggggctctcagctc

SEQ ID NO: 6738691 - DNA, 22 bp, Homo sapiens
ccgtcgaggggctctcagctca

SEQ ID NO: 6738692 - DNA, 15 bp, Homo sapiens
ccgtcgcgctggaca

SEQ ID NO: 6738693 - DNA, 17 bp, Homo sapiens
ccgtcgcgctggacagc

SEQ ID NO: 6738694 - DNA, 15 bp, Homo sapiens
ccgtcggaatggtaa

SEQ ID NO: 6738695 - DNA, 17 bp, Homo sapiens
ccgtcggactgccccca

SEQ ID NO: 6738696 - DNA, 19 bp, Homo sapiens
ccgtcggactgcccccaga

SEQ ID NO: 6738697 - DNA, 13 bp, Homo sapiens
ccgtcgtgtgctg

SEQ ID NO: 6738698 - DNA, 15 bp, Homo sapiens
ccgtctacagctccc

SEQ ID NO: 6738699 - DNA, 11 bp, Homo sapiens
ccgtctacatt

SEQ ID NO: 6738700 - DNA, 14 bp, Homo sapiens
ccgtctacatttca

SEQ ID NO: 6738701 - DNA, 15 bp, Homo sapiens
ccgtctacctgaggg

SEQ ID NO: 6738702 - DNA, 17 bp, Homo sapiens
ccgtctacctgaggggc

SEQ ID NO: 6738703 - DNA, 19 bp, Homo sapiens
ccgtctaggattgggcctc

SEQ ID NO: 6738704 - DNA, 19 bp, Homo sapiens
ccgtctagttaacatttca

SEQ ID NO: 6738705 - DNA, 18 bp, Homo sapiens
ccgtctcatatttttaca

SEQ ID NO: 6738706 - DNA, 16 bp, Homo sapiens
ccgtctcatgaggggc

SEQ ID NO: 6738707 - DNA, 16 bp, Homo sapiens
ccgtctcccaaagtgc

SEQ ID NO: 6738708 - DNA, 18 bp, Homo sapiens
ccgtctccctaaaataaa

SEQ ID NO: 6738709 - DNA, 16 bp, Homo sapiens
ccgtctcggccctgaa

SEQ ID NO: 6738710 - DNA, 17 bp, Homo sapiens
ccgtctcggccctgaac

SEQ ID NO: 6738711 - DNA, 23 bp, Homo sapiens
ccgtctcggccctgaaccacgag

SEQ ID NO: 6738712 - DNA, 14 bp, Homo sapiens
ccgtctctctccca

SEQ ID NO: 6738713 - DNA, 22 bp, Homo sapiens
ccgtctctctcccatggagccc

SEQ ID NO: 6738714 - DNA, 16 bp, Homo sapiens
ccgtctctgctctgct

SEQ ID NO: 6738715 - DNA, 13 bp, Homo sapiens
ccgtctctgtccg

SEQ ID NO: 6738716 - DNA, 14 bp, Homo sapiens
ccgtctctgtcctc

SEQ ID NO: 6738717 - DNA, 16 bp, Homo sapiens
ccgtctgaccccagcc

SEQ ID NO: 6738718 - DNA, 17 bp, Homo sapiens
ccgtctgaccctctgcg

SEQ ID NO: 6738719 - DNA, 14 bp, Homo sapiens
ccgtctgactccag

SEQ ID NO: 6738720 - DNA, 22 bp, Homo sapiens
ccgtctgactccagagtctgag

SEQ ID NO: 6738721 - DNA, 20 bp, Homo sapiens
ccgtctgcacttctgttcca

SEQ ID NO: 6738722 - DNA, 16 bp, Homo sapiens
ccgtctgcaggggcct

SEQ ID NO: 6738723 - DNA, 11 bp, Homo sapiens
ccgtctgcccc

SEQ ID NO: 6738724 - DNA, 21 bp, Homo sapiens
ccgtctgccccttgaccccac

SEQ ID NO: 6738725 - DNA, 17 bp, Homo sapiens
ccgtctgctcctccctc

SEQ ID NO: 6738726 - DNA, 16 bp, Homo sapiens
ccgtctggcccaccag

SEQ ID NO: 6738727 - DNA, 17 bp, Homo sapiens
ccgtctggcgagccctt

SEQ ID NO: 6738728 - DNA, 21 bp, Homo sapiens
ccgtctgggaatcctggacag

SEQ ID NO: 6738729 - DNA, 22 bp, Homo sapiens
ccgtctggggttcagcccctcc

SEQ ID NO: 6738730 - DNA, 15 bp, Homo sapiens
ccgtctgtccatctg

SEQ ID NO: 6738731 - DNA, 22 bp, Homo sapiens
ccgtctgtccatctgcccgcct

SEQ ID NO: 6738732 - DNA, 14 bp, Homo sapiens
ccgtctgtcctgcg

SEQ ID NO: 6738733 - DNA, 16 bp, Homo sapiens
ccgtctgtctcgatgc

SEQ ID NO: 6738734 - DNA, 20 bp, Homo sapiens
ccgtctgtctcgatgcctga

SEQ ID NO: 6738735 - DNA, 11 bp, Homo sapiens
ccgtctgtctg

SEQ ID NO: 6738736 - DNA, 12 bp, Homo sapiens
ccgtctgttttt

SEQ ID NO: 6738737 - DNA, 17 bp, Homo sapiens
ccgtcttcaatctctgt

SEQ ID NO: 6738738 - DNA, 14 bp, Homo sapiens
ccgtcttcacactg

SEQ ID NO: 6738739 - DNA, 19 bp, Homo sapiens
ccgtctttacccctgctga

SEQ ID NO: 6738740 - DNA, 18 bp, Homo sapiens
ccgtctttggttcctcat

SEQ ID NO: 6738741 - DNA, 21 bp, Homo sapiens
ccgtctttggttcctcatggc

SEQ ID NO: 6738742 - DNA, 23 bp, Homo sapiens
ccgtctttggttcctcatggctg

SEQ ID NO: 6738743 - DNA, 18 bp, Homo sapiens
ccgtgaaaacggagctga

SEQ ID NO: 6738744 - DNA, 17 bp, Homo sapiens
ccgtgaaaatgcaagtg

SEQ ID NO: 6738745 - DNA, 15 bp, Homo sapiens
ccgtgaaccagaggg

SEQ ID NO: 6738746 - DNA, 21 bp, Homo sapiens
ccgtgaactctggtgctcctg

SEQ ID NO: 6738747 - DNA, 14 bp, Homo sapiens
ccgtgaagggcacc

SEQ ID NO: 6738748 - DNA, 12 bp, Homo sapiens
ccgtgaattgct

SEQ ID NO: 6738749 - DNA, 17 bp, Homo sapiens
ccgtgacaaaggtagag

SEQ ID NO: 6738750 - DNA, 20 bp, Homo sapiens
ccgtgacagactcctgagga

SEQ ID NO: 6738751 - DNA, 23 bp, Homo sapiens
ccgtgacagatgccaacttccca

SEQ ID NO: 6738752 - DNA, 14 bp, Homo sapiens
ccgtgacgaggctc

SEQ ID NO: 6738753 - DNA, 22 bp, Homo sapiens
ccgtgagcaggaaggcctgggt

SEQ ID NO: 6738754 - DNA, 21 bp, Homo sapiens
ccgtgagcgcctgtgcacaca

SEQ ID NO: 6738755 - DNA, 22 bp, Homo sapiens
ccgtgagcgcctgtgcacacac

SEQ ID NO: 6738756 - DNA, 14 bp, Homo sapiens
ccgtgaggaggggg

SEQ ID NO: 6738757 - DNA, 19 bp, Homo sapiens
ccgtgaggagggggagaag

SEQ ID NO: 6738758 - DNA, 14 bp, Homo sapiens
ccgtgaggatgtca

SEQ ID NO: 6738759 - DNA, 16 bp, Homo sapiens
ccgtgaggccagagac

SEQ ID NO: 6738760 - DNA, 16 bp, Homo sapiens
ccgtgaggctgctgcc

SEQ ID NO: 6738761 - DNA, 18 bp, Homo sapiens
ccgtgaggctgctgccat

SEQ ID NO: 6738762 - DNA, 14 bp, Homo sapiens
ccgtgagttctcag

SEQ ID NO: 6738763 - DNA, 23 bp, Homo sapiens
ccgtgagttctcagggctcctgc

SEQ ID NO: 6738764 - DNA, 20 bp, Homo sapiens
ccgtgatccatccatctcca

SEQ ID NO: 6738765 - DNA, 14 bp, Homo sapiens
ccgtgatctcccct

SEQ ID NO: 6738766 - DNA, 16 bp, Homo sapiens
ccgtgatctcccctca

SEQ ID NO: 6738767 - DNA, 19 bp, Homo sapiens
ccgtgatggagaggacaga

SEQ ID NO: 6738768 - DNA, 23 bp, Homo sapiens
ccgtgatggagaggacagagcag

SEQ ID NO: 6738769 - DNA, 19 bp, Homo sapiens
ccgtgatttggaagagagg

SEQ ID NO: 6738770 - DNA, 22 bp, Homo sapiens
ccgtgatttggaagagaggcac

SEQ ID NO: 6738771 - DNA, 22 bp, Homo sapiens
ccgtgcaacggaagccaggcca

SEQ ID NO: 6738772 - DNA, 21 bp, Homo sapiens
ccgtgcaacgtgtaacttgtg

SEQ ID NO: 6738773 - DNA, 22 bp, Homo sapiens
ccgtgcacggttcaatggtaga

SEQ ID NO: 6738774 - DNA, 17 bp, Homo sapiens
ccgtgcactccctaaga

SEQ ID NO: 6738775 - DNA, 12 bp, Homo sapiens
ccgtgcagctgg

SEQ ID NO: 6738776 - DNA, 19 bp, Homo sapiens
ccgtgcagcttctgtcctg

SEQ ID NO: 6738777 - DNA, 15 bp, Homo sapiens
ccgtgcagtacaggc

SEQ ID NO: 6738778 - DNA, 16 bp, Homo sapiens
ccgtgcagtacaggca

SEQ ID NO: 6738779 - DNA, 17 bp, Homo sapiens
ccgtgcatgctctgcag

SEQ ID NO: 6738780 - DNA, 14 bp, Homo sapiens
ccgtgcatggctcc

SEQ ID NO: 6738781 - DNA, 18 bp, Homo sapiens
ccgtgcattagcacagat

SEQ ID NO: 6738782 - DNA, 16 bp, Homo sapiens
ccgtgccaaccccacc

SEQ ID NO: 6738783 - DNA, 23 bp, Homo sapiens
ccgtgccaaccccacccagctcc

SEQ ID NO: 6738784 - DNA, 21 bp, Homo sapiens
ccgtgccacccccagccctgg

SEQ ID NO: 6738785 - DNA, 17 bp, Homo sapiens
ccgtgccactttccacc

SEQ ID NO: 6738786 - DNA, 16 bp, Homo sapiens
ccgtgcccaggccctt

SEQ ID NO: 6738787 - DNA, 13 bp, Homo sapiens
ccgtgccccacct

SEQ ID NO: 6738788 - DNA, 14 bp, Homo sapiens
ccgtgccccacctc

SEQ ID NO: 6738789 - DNA, 15 bp, Homo sapiens
ccgtgccccacctcc

SEQ ID NO: 6738790 - DNA, 20 bp, Homo sapiens
ccgtgcccccgcctgccacc

SEQ ID NO: 6738791 - DNA, 12 bp, Homo sapiens
ccgtgcccctgt

SEQ ID NO: 6738792 - DNA, 17 bp, Homo sapiens
ccgtgcccctttccttc

SEQ ID NO: 6738793 - DNA, 23 bp, Homo sapiens
ccgtgcccgcaggaactgggctg

SEQ ID NO: 6738794 - DNA, 22 bp, Homo sapiens
ccgtgccctggtgaatcacctg

SEQ ID NO: 6738795 - DNA, 17 bp, Homo sapiens
ccgtgccgcctgcactc

SEQ ID NO: 6738796 - DNA, 22 bp, Homo sapiens
ccgtgccggcggcagccccact

SEQ ID NO: 6738797 - DNA, 19 bp, Homo sapiens
ccgtgcctgcattcgcagc

SEQ ID NO: 6738798 - DNA, 14 bp, Homo sapiens
ccgtgcctggccag

SEQ ID NO: 6738799 - DNA, 15 bp, Homo sapiens
ccgtgcctggccaga

SEQ ID NO: 6738800 - DNA, 16 bp, Homo sapiens
ccgtgcctggccagat

SEQ ID NO: 6738801 - DNA, 14 bp, Homo sapiens
ccgtgcctgggccc

SEQ ID NO: 6738802 - DNA, 14 bp, Homo sapiens
ccgtgcctggtggg

SEQ ID NO: 6738803 - DNA, 16 bp, Homo sapiens
ccgtgccttcagctct

SEQ ID NO: 6738804 - DNA, 17 bp, Homo sapiens
ccgtgccttcagctcta

SEQ ID NO: 6738805 - DNA, 23 bp, Homo sapiens
ccgtgcctttctctggctccaga

SEQ ID NO: 6738806 - DNA, 15 bp, Homo sapiens
ccgtgcgagctgccg

SEQ ID NO: 6738807 - DNA, 19 bp, Homo sapiens
ccgtgcgcagccgcgctct

SEQ ID NO: 6738808 - DNA, 13 bp, Homo sapiens
ccgtgctaaggac

SEQ ID NO: 6738809 - DNA, 15 bp, Homo sapiens
ccgtgctaaggactt

SEQ ID NO: 6738810 - DNA, 18 bp, Homo sapiens
ccgtgctgacagctgctc

SEQ ID NO: 6738811 - DNA, 21 bp, Homo sapiens
ccgtgcttttaaggaaaggca

SEQ ID NO: 6738812 - DNA, 15 bp, Homo sapiens
ccgtggacaggccca

SEQ ID NO: 6738813 - DNA, 17 bp, Homo sapiens
ccgtggacaggcccagc

SEQ ID NO: 6738814 - DNA, 16 bp, Homo sapiens
ccgtggagactgagat

SEQ ID NO: 6738815 - DNA, 18 bp, Homo sapiens
ccgtggagcttggagccc

SEQ ID NO: 6738816 - DNA, 23 bp, Homo sapiens
ccgtggagcttggagccccctgg

SEQ ID NO: 6738817 - DNA, 20 bp, Homo sapiens
ccgtggaggaggaaggcaag

SEQ ID NO: 6738818 - DNA, 12 bp, Homo sapiens
ccgtggaggctg

SEQ ID NO: 6738819 - DNA, 18 bp, Homo sapiens
ccgtggagtcgagctggc

SEQ ID NO: 6738820 - DNA, 22 bp, Homo sapiens
ccgtggagtcggagtggacacc

SEQ ID NO: 6738821 - DNA, 13 bp, Homo sapiens
ccgtggatctggg

SEQ ID NO: 6738822 - DNA, 11 bp, Homo sapiens
ccgtggatgcg

SEQ ID NO: 6738823 - DNA, 23 bp, Homo sapiens
ccgtggattgcacgtggcctctt

SEQ ID NO: 6738824 - DNA, 15 bp, Homo sapiens
ccgtggcactgcata

SEQ ID NO: 6738825 - DNA, 17 bp, Homo sapiens
ccgtggcagcttgctgg

SEQ ID NO: 6738826 - DNA, 22 bp, Homo sapiens
ccgtggcagcttgctgggcttt

SEQ ID NO: 6738827 - DNA, 19 bp, Homo sapiens
ccgtggccatccctgtgag

SEQ ID NO: 6738828 - DNA, 20 bp, Homo sapiens
ccgtggccatccctgtgagg

SEQ ID NO: 6738829 - DNA, 15 bp, Homo sapiens
ccgtggccccagcct

SEQ ID NO: 6738830 - DNA, 16 bp, Homo sapiens
ccgtggccccagcctg

SEQ ID NO: 6738831 - DNA, 17 bp, Homo sapiens
ccgtggccccagcctgg

SEQ ID NO: 6738832 - DNA, 20 bp, Homo sapiens
ccgtggccccagcctggccc

SEQ ID NO: 6738833 - DNA, 21 bp, Homo sapiens
ccgtggccccagcctggccca

SEQ ID NO: 6738834 - DNA, 20 bp, Homo sapiens
ccgtggccctgccctctcct

SEQ ID NO: 6738835 - DNA, 22 bp, Homo sapiens
ccgtggcctcgtgctccgcagg

SEQ ID NO: 6738836 - DNA, 11 bp, Homo sapiens
ccgtggctacc

SEQ ID NO: 6738837 - DNA, 20 bp, Homo sapiens
ccgtggctaggcctttcctg

SEQ ID NO: 6738838 - DNA, 23 bp, Homo sapiens
ccgtggctccagaatgtgctgcc

SEQ ID NO: 6738839 - DNA, 21 bp, Homo sapiens
ccgtggctctgggagagccag

SEQ ID NO: 6738840 - DNA, 22 bp, Homo sapiens
ccgtggctctgggagagccagc

SEQ ID NO: 6738841 - DNA, 23 bp, Homo sapiens
ccgtggctgttgacgcacctgtg

SEQ ID NO: 6738842 - DNA, 11 bp, Homo sapiens
ccgtggcttcc

SEQ ID NO: 6738843 - DNA, 14 bp, Homo sapiens
ccgtggcttcccgc

SEQ ID NO: 6738844 - DNA, 23 bp, Homo sapiens
ccgtggcttcccgctcagccctc

SEQ ID NO: 6738845 - DNA, 18 bp, Homo sapiens
ccgtggcttggcatctgt

SEQ ID NO: 6738846 - DNA, 22 bp, Homo sapiens
ccgtggcttgggctggtcagag

SEQ ID NO: 6738847 - DNA, 15 bp, Homo sapiens
ccgtggctttggttt

SEQ ID NO: 6738848 - DNA, 16 bp, Homo sapiens
ccgtgggacccaggct

SEQ ID NO: 6738849 - DNA, 18 bp, Homo sapiens
ccgtgggacccaggctcc

SEQ ID NO: 6738850 - DNA, 19 bp, Homo sapiens
ccgtgggcactgaaggctt

SEQ ID NO: 6738851 - DNA, 22 bp, Homo sapiens
ccgtgggccctcaagctttcct

SEQ ID NO: 6738852 - DNA, 20 bp, Homo sapiens
ccgtgggccgtatctgtcac

SEQ ID NO: 6738853 - DNA, 12 bp, Homo sapiens
ccgtgggcgggg

SEQ ID NO: 6738854 - DNA, 23 bp, Homo sapiens
ccgtggggaggccatttgctgcc

SEQ ID NO: 6738855 - DNA, 17 bp, Homo sapiens
ccgtggggccgccgcct

SEQ ID NO: 6738856 - DNA, 21 bp, Homo sapiens
ccgtggggctcccggcatcct

SEQ ID NO: 6738857 - DNA, 22 bp, Homo sapiens
ccgtggggctcccggcatcctg

SEQ ID NO: 6738858 - DNA, 23 bp, Homo sapiens
ccgtggggctcccggcatcctga

SEQ ID NO: 6738859 - DNA, 18 bp, Homo sapiens
ccgtggggtctgcgcttg

SEQ ID NO: 6738860 - DNA, 19 bp, Homo sapiens
ccgtggggtgctgccctta

SEQ ID NO: 6738861 - DNA, 21 bp, Homo sapiens
ccgtgggtcatcccagcacct

SEQ ID NO: 6738862 - DNA, 17 bp, Homo sapiens
ccgtgggtcattacaaa

SEQ ID NO: 6738863 - DNA, 21 bp, Homo sapiens
ccgtgggtgggcctggccctg

SEQ ID NO: 6738864 - DNA, 22 bp, Homo sapiens
ccgtgggtgggcctggccctgc

SEQ ID NO: 6738865 - DNA, 18 bp, Homo sapiens
ccgtgggttgctaactga

SEQ ID NO: 6738866 - DNA, 18 bp, Homo sapiens
ccgtggtagaggcctggg

SEQ ID NO: 6738867 - DNA, 14 bp, Homo sapiens
ccgtggtccagctc

SEQ ID NO: 6738868 - DNA, 20 bp, Homo sapiens
ccgtggtccagctcttggcc

SEQ ID NO: 6738869 - DNA, 14 bp, Homo sapiens
ccgtggtccctgag

SEQ ID NO: 6738870 - DNA, 16 bp, Homo sapiens
ccgtggtctttgaata

SEQ ID NO: 6738871 - DNA, 14 bp, Homo sapiens
ccgtggtgacccct

SEQ ID NO: 6738872 - DNA, 18 bp, Homo sapiens
ccgtggtgtcctctgtcc

SEQ ID NO: 6738873 - DNA, 17 bp, Homo sapiens
ccgtgtaaaaagcctcc

SEQ ID NO: 6738874 - DNA, 19 bp, Homo sapiens
ccgtgtaaaaagcctcctt

SEQ ID NO: 6738875 - DNA, 14 bp, Homo sapiens
ccgtgtagtttctg

SEQ ID NO: 6738876 - DNA, 23 bp, Homo sapiens
ccgtgtattcaggaccccatctg

SEQ ID NO: 6738877 - DNA, 22 bp, Homo sapiens
ccgtgtcatccgaaagtgagga

SEQ ID NO: 6738878 - DNA, 15 bp, Homo sapiens
ccgtgtccaccccca

SEQ ID NO: 6738879 - DNA, 16 bp, Homo sapiens
ccgtgtcccaaggagc

SEQ ID NO: 6738880 - DNA, 17 bp, Homo sapiens
ccgtgtcccaaggagct

SEQ ID NO: 6738881 - DNA, 18 bp, Homo sapiens
ccgtgtccccccaggtgc

SEQ ID NO: 6738882 - DNA, 17 bp, Homo sapiens
ccgtgtcccctgacagg

SEQ ID NO: 6738883 - DNA, 19 bp, Homo sapiens
ccgtgtcccctgacagggc

SEQ ID NO: 6738884 - DNA, 18 bp, Homo sapiens
ccgtgtcccgcggtgctg

SEQ ID NO: 6738885 - DNA, 23 bp, Homo sapiens
ccgtgtcccgcggtgctgactga

SEQ ID NO: 6738886 - DNA, 12 bp, Homo sapiens
ccgtgtcctcct

SEQ ID NO: 6738887 - DNA, 15 bp, Homo sapiens
ccgtgtcctcctctg

SEQ ID NO: 6738888 - DNA, 14 bp, Homo sapiens
ccgtgtcctctccc

SEQ ID NO: 6738889 - DNA, 19 bp, Homo sapiens
ccgtgtcctctccctgcca

SEQ ID NO: 6738890 - DNA, 13 bp, Homo sapiens
ccgtgtcctgcct

SEQ ID NO: 6738891 - DNA, 14 bp, Homo sapiens
ccgtgtcctgcctt

SEQ ID NO: 6738892 - DNA, 15 bp, Homo sapiens
ccgtgtcctgccttg

SEQ ID NO: 6738893 - DNA, 13 bp, Homo sapiens
ccgtgtcgggcag

SEQ ID NO: 6738894 - DNA, 16 bp, Homo sapiens
ccgtgtcgggcaggtc

SEQ ID NO: 6738895 - DNA, 19 bp, Homo sapiens
ccgtgtctcagcctctgcc

SEQ ID NO: 6738896 - DNA, 20 bp, Homo sapiens
ccgtgtctcagcctctgcca

SEQ ID NO: 6738897 - DNA, 17 bp, Homo sapiens
ccgtgtctgtctggcac

SEQ ID NO: 6738898 - DNA, 21 bp, Homo sapiens
ccgtgtctgtggccctctctt

SEQ ID NO: 6738899 - DNA, 15 bp, Homo sapiens
ccgtgtgaatgtagc

SEQ ID NO: 6738900 - DNA, 23 bp, Homo sapiens
ccgtgtgagaagtgaatgctggg

SEQ ID NO: 6738901 - DNA, 15 bp, Homo sapiens
ccgtgtgcctcctgt

SEQ ID NO: 6738902 - DNA, 13 bp, Homo sapiens
ccgtgtggacaca

SEQ ID NO: 6738903 - DNA, 20 bp, Homo sapiens
ccgtgtggagggctgcagag

SEQ ID NO: 6738904 - DNA, 15 bp, Homo sapiens
ccgtgtggccccttc

SEQ ID NO: 6738905 - DNA, 12 bp, Homo sapiens
ccgtgtggcctg

SEQ ID NO: 6738906 - DNA, 13 bp, Homo sapiens
ccgtgtggcctgg

SEQ ID NO: 6738907 - DNA, 14 bp, Homo sapiens
ccgtgtggcctggg

SEQ ID NO: 6738908 - DNA, 21 bp, Homo sapiens
ccgtgtggtaccttcagccct

SEQ ID NO: 6738909 - DNA, 15 bp, Homo sapiens
ccgtgtgtatttcta

SEQ ID NO: 6738910 - DNA, 22 bp, Homo sapiens
ccgtgtgtcccagatgctgtca

SEQ ID NO: 6738911 - DNA, 15 bp, Homo sapiens
ccgtgtgtgtactga

SEQ ID NO: 6738912 - DNA, 12 bp, Homo sapiens
ccgtgtgtgtgt

SEQ ID NO: 6738913 - DNA, 20 bp, Homo sapiens
ccgtgtgtgtgtatgtgtgt

SEQ ID NO: 6738914 - DNA, 21 bp, Homo sapiens
ccgtgtgttctccgtccctgc

SEQ ID NO: 6738915 - DNA, 19 bp, Homo sapiens
ccgtgtgtttagaagccta

SEQ ID NO: 6738916 - DNA, 18 bp, Homo sapiens
ccgtgttggtctgtactg

SEQ ID NO: 6738917 - DNA, 15 bp, Homo sapiens
ccgtgtttctctaag

SEQ ID NO: 6738918 - DNA, 19 bp, Homo sapiens
ccgtgtttgcgcttgacca

SEQ ID NO: 6738919 - DNA, 15 bp, Homo sapiens
ccgttaacctttttg

SEQ ID NO: 6738920 - DNA, 13 bp, Homo sapiens
ccgttaatttaaa

SEQ ID NO: 6738921 - DNA, 13 bp, Homo sapiens
ccgttactctcca

SEQ ID NO: 6738922 - DNA, 19 bp, Homo sapiens
ccgttaggaataacactgc

SEQ ID NO: 6738923 - DNA, 19 bp, Homo sapiens
ccgttagggaaatccaact

SEQ ID NO: 6738924 - DNA, 14 bp, Homo sapiens
ccgttcacatgtgt

SEQ ID NO: 6738925 - DNA, 14 bp, Homo sapiens
ccgttcacattttt

SEQ ID NO: 6738926 - DNA, 13 bp, Homo sapiens
ccgttcacttccc

SEQ ID NO: 6738927 - DNA, 23 bp, Homo sapiens
ccgttcatgggggagggggcaga

SEQ ID NO: 6738928 - DNA, 18 bp, Homo sapiens
ccgttccaccccaagaga

SEQ ID NO: 6738929 - DNA, 21 bp, Homo sapiens
ccgttccaccccaagagaact

SEQ ID NO: 6738930 - DNA, 22 bp, Homo sapiens
ccgttccaccccaagagaactc

SEQ ID NO: 6738931 - DNA, 16 bp, Homo sapiens
ccgttccctgcgcttc

SEQ ID NO: 6738932 - DNA, 13 bp, Homo sapiens
ccgttccctgtca

SEQ ID NO: 6738933 - DNA, 14 bp, Homo sapiens
ccgttcccttctgc

SEQ ID NO: 6738934 - DNA, 12 bp, Homo sapiens
ccgttcctcctc

SEQ ID NO: 6738935 - DNA, 24 bp, Homo sapiens
ccgttcctgacatcacagcagcct

SEQ ID NO: 6738936 - DNA, 21 bp, Homo sapiens
ccgttctctgtccccaggtcc

SEQ ID NO: 6738937 - DNA, 18 bp, Homo sapiens
ccgttctgctggcctgga

SEQ ID NO: 6738938 - DNA, 14 bp, Homo sapiens
ccgttctgttccaa

SEQ ID NO: 6738939 - DNA, 19 bp, Homo sapiens
ccgttgaatctgggaggga

SEQ ID NO: 6738940 - DNA, 16 bp, Homo sapiens
ccgttgagtccttttg

SEQ ID NO: 6738941 - DNA, 18 bp, Homo sapiens
ccgttgatgttggctggg

SEQ ID NO: 6738942 - DNA, 15 bp, Homo sapiens
ccgttgccgggcctg

SEQ ID NO: 6738943 - DNA, 18 bp, Homo sapiens
ccgttgccgggcctggac

SEQ ID NO: 6738944 - DNA, 19 bp, Homo sapiens
ccgttgcctctctgccagc

SEQ ID NO: 6738945 - DNA, 16 bp, Homo sapiens
ccgttgggtcccttgc

SEQ ID NO: 6738946 - DNA, 22 bp, Homo sapiens
ccgttgtctaggagacagagcc

SEQ ID NO: 6738947 - DNA, 18 bp, Homo sapiens
ccgttgtctccctggccc

SEQ ID NO: 6738948 - DNA, 19 bp, Homo sapiens
ccgttgtctccctggccct

SEQ ID NO: 6738949 - DNA, 21 bp, Homo sapiens
ccgttgtctccctggccctca

SEQ ID NO: 6738950 - DNA, 15 bp, Homo sapiens
ccgttgtgagctgga

SEQ ID NO: 6738951 - DNA, 23 bp, Homo sapiens
ccgttgtgtgggtttactctgtg

SEQ ID NO: 6738952 - DNA, 18 bp, Homo sapiens
ccgttgttgtccctgcag

SEQ ID NO: 6738953 - DNA, 15 bp, Homo sapiens
ccgtttatgggcctt

SEQ ID NO: 6738954 - DNA, 12 bp, Homo sapiens
ccgtttcagaag

SEQ ID NO: 6738955 - DNA, 15 bp, Homo sapiens
ccgtttcaggaccac

SEQ ID NO: 6738956 - DNA, 14 bp, Homo sapiens
ccgtttccaagcct

SEQ ID NO: 6738957 - DNA, 12 bp, Homo sapiens
ccgtttcccggt

SEQ ID NO: 6738958 - DNA, 15 bp, Homo sapiens
ccgtttccctccagg

SEQ ID NO: 6738959 - DNA, 18 bp, Homo sapiens
ccgtttcgcgctggccgg

SEQ ID NO: 6738960 - DNA, 14 bp, Homo sapiens
ccgtttctcctttt

SEQ ID NO: 6738961 - DNA, 17 bp, Homo sapiens
ccgtttctccttttcct

SEQ ID NO: 6738962 - DNA, 15 bp, Homo sapiens
ccgtttgaccaattt

SEQ ID NO: 6738963 - DNA, 18 bp, Homo sapiens
ccgtttgctttttcaggt

SEQ ID NO: 6738964 - DNA, 19 bp, Homo sapiens
ccgtttggtgtctgatgtg

SEQ ID NO: 6738965 - DNA, 18 bp, Homo sapiens
ccgttttcatcctggcct

SEQ ID NO: 6738966 - DNA, 19 bp, Homo sapiens
ccgttttcatcctggcctc

SEQ ID NO: 6738967 - DNA, 12 bp, Homo sapiens
ccgttttcccca

SEQ ID NO: 6738968 - DNA, 13 bp, Homo sapiens
ccgttttcctcat

SEQ ID NO: 6738969 - DNA, 13 bp, Homo sapiens
ccgttttcttaca

SEQ ID NO: 6738970 - DNA, 12 bp, Homo sapiens
ccgtttttcaag

SEQ ID NO: 6738971 - DNA, 21 bp, Homo sapiens
cctaaaaacatttactgacca

SEQ ID NO: 6738972 - DNA, 15 bp, Homo sapiens
cctaaaaataaagca

SEQ ID NO: 6738973 - DNA, 19 bp, Homo sapiens
cctaaaaattcccttcctg

SEQ ID NO: 6738974 - DNA, 17 bp, Homo sapiens
cctaaaacttggatgga

SEQ ID NO: 6738975 - DNA, 20 bp, Homo sapiens
cctaaaagagatctgggcat

SEQ ID NO: 6738976 - DNA, 15 bp, Homo sapiens
cctaaaaggcccaga

SEQ ID NO: 6738977 - DNA, 22 bp, Homo sapiens
cctaaaagtgggcttgattctg

SEQ ID NO: 6738978 - DNA, 23 bp, Homo sapiens
cctaaaagttcataacagtgcca

SEQ ID NO: 6738979 - DNA, 19 bp, Homo sapiens
cctaaaataacagtatgtg

SEQ ID NO: 6738980 - DNA, 13 bp, Homo sapiens
cctaaaatataat

SEQ ID NO: 6738981 - DNA, 17 bp, Homo sapiens
cctaaaatataattttt

SEQ ID NO: 6738982 - DNA, 20 bp, Homo sapiens
cctaaaatataatttttaat

SEQ ID NO: 6738983 - DNA, 14 bp, Homo sapiens
cctaaaatgacagc

SEQ ID NO: 6738984 - DNA, 15 bp, Homo sapiens
cctaaaattgtttcc

SEQ ID NO: 6738985 - DNA, 19 bp, Homo sapiens
cctaaacacacttttcttt

SEQ ID NO: 6738986 - DNA, 23 bp, Homo sapiens
cctaaacagatataaatggctgg

SEQ ID NO: 6738987 - DNA, 17 bp, Homo sapiens
cctaaacatagtggtat

SEQ ID NO: 6738988 - DNA, 21 bp, Homo sapiens
cctaaacatagtggtatttta

SEQ ID NO: 6738989 - DNA, 13 bp, Homo sapiens
cctaaacatatga

SEQ ID NO: 6738990 - DNA, 15 bp, Homo sapiens
cctaaacccctgtcc

SEQ ID NO: 6738991 - DNA, 18 bp, Homo sapiens
cctaaaccctctgtgaaa

SEQ ID NO: 6738992 - DNA, 14 bp, Homo sapiens
cctaaactccaggg

SEQ ID NO: 6738993 - DNA, 15 bp, Homo sapiens
cctaaactgcagcct

SEQ ID NO: 6738994 - DNA, 12 bp, Homo sapiens
cctaaagaaaaa

SEQ ID NO: 6738995 - DNA, 16 bp, Homo sapiens
cctaaagaaaaacaaa

SEQ ID NO: 6738996 - DNA, 14 bp, Homo sapiens
cctaaagaacaaag

SEQ ID NO: 6738997 - DNA, 18 bp, Homo sapiens
cctaaagaccatttaatc

SEQ ID NO: 6738998 - DNA, 18 bp, Homo sapiens
cctaaagacgtctctttt

SEQ ID NO: 6738999 - DNA, 13 bp, Homo sapiens
cctaaagagagta

SEQ ID NO: 6739000 - DNA, 23 bp, Homo sapiens
cctaaagagagtatttttataca

SEQ ID NO: 6739001 - DNA, 12 bp, Homo sapiens
cctaaagagata

SEQ ID NO: 6739002 - DNA, 15 bp, Homo sapiens
cctaaagaggaaaag

SEQ ID NO: 6739003 - DNA, 20 bp, Homo sapiens
cctaaagaggaaaagtgcaa

SEQ ID NO: 6739004 - DNA, 17 bp, Homo sapiens
cctaaagatgggaggag

SEQ ID NO: 6739005 - DNA, 18 bp, Homo sapiens
cctaaagatgggaggaga

SEQ ID NO: 6739006 - DNA, 16 bp, Homo sapiens
cctaaagcagtaaaat

SEQ ID NO: 6739007 - DNA, 21 bp, Homo sapiens
cctaaagcagtaaaataaaaa

SEQ ID NO: 6739008 - DNA, 19 bp, Homo sapiens
cctaaagccaggctcagga

SEQ ID NO: 6739009 - DNA, 15 bp, Homo sapiens
cctaaagccatcatg

SEQ ID NO: 6739010 - DNA, 16 bp, Homo sapiens
cctaaagccctcttca

SEQ ID NO: 6739011 - DNA, 22 bp, Homo sapiens
cctaaagccctcttcaggggtc

SEQ ID NO: 6739012 - DNA, 23 bp, Homo sapiens
cctaaagggactacctctgtgcc

SEQ ID NO: 6739013 - DNA, 14 bp, Homo sapiens
cctaaagggcaggg

SEQ ID NO: 6739014 - DNA, 22 bp, Homo sapiens
cctaaagggtatgagctggagc

SEQ ID NO: 6739015 - DNA, 22 bp, Homo sapiens
cctaaaggttatagtagaacaa

SEQ ID NO: 6739016 - DNA, 21 bp, Homo sapiens
cctaaagtacagcctggacca

SEQ ID NO: 6739017 - DNA, 18 bp, Homo sapiens
cctaaagtgcttgctttt

SEQ ID NO: 6739018 - DNA, 19 bp, Homo sapiens
cctaaataaacacatagat

SEQ ID NO: 6739019 - DNA, 18 bp, Homo sapiens
cctaaataaagtcttact

SEQ ID NO: 6739020 - DNA, 17 bp, Homo sapiens
cctaaataaatgagctg

SEQ ID NO: 6739021 - DNA, 22 bp, Homo sapiens
cctaaataaatgagctgttgga

SEQ ID NO: 6739022 - DNA, 14 bp, Homo sapiens
cctaaataaattat

SEQ ID NO: 6739023 - DNA, 22 bp, Homo sapiens
cctaaataatatcctgaataac

SEQ ID NO: 6739024 - DNA, 11 bp, Homo sapiens
cctaaataatt

SEQ ID NO: 6739025 - DNA, 19 bp, Homo sapiens
cctaaatacttttttctat

SEQ ID NO: 6739026 - DNA, 22 bp, Homo sapiens
cctaaatatacatctgtgtatt

SEQ ID NO: 6739027 - DNA, 16 bp, Homo sapiens
cctaaatatattttaa

SEQ ID NO: 6739028 - DNA, 18 bp, Homo sapiens
cctaaatatattttaaga

SEQ ID NO: 6739029 - DNA, 14 bp, Homo sapiens
cctaaatattttca

SEQ ID NO: 6739030 - DNA, 22 bp, Homo sapiens
cctaaatcaagcatctttctgt

SEQ ID NO: 6739031 - DNA, 15 bp, Homo sapiens
cctaaatccaaagaa

SEQ ID NO: 6739032 - DNA, 20 bp, Homo sapiens
cctaaatcgtgatattgaaa

SEQ ID NO: 6739033 - DNA, 12 bp, Homo sapiens
cctaaatgcaaa

SEQ ID NO: 6739034 - DNA, 13 bp, Homo sapiens
cctaaatgcaaag

SEQ ID NO: 6739035 - DNA, 16 bp, Homo sapiens
cctaaattaaattggg

SEQ ID NO: 6739036 - DNA, 15 bp, Homo sapiens
cctaaattatttact

SEQ ID NO: 6739037 - DNA, 13 bp, Homo sapiens
cctaaatttaatg

SEQ ID NO: 6739038 - DNA, 16 bp, Homo sapiens
cctaaatttaatgctg

SEQ ID NO: 6739039 - DNA, 20 bp, Homo sapiens
cctaaatttaatgctgcctt

SEQ ID NO: 6739040 - DNA, 14 bp, Homo sapiens
cctaaatttattaa

SEQ ID NO: 6739041 - DNA, 18 bp, Homo sapiens
cctaaatttttgtaagaa

SEQ ID NO: 6739042 - DNA, 13 bp, Homo sapiens
cctaacaaaagaa

SEQ ID NO: 6739043 - DNA, 21 bp, Homo sapiens
cctaacaacattgtagcctca

SEQ ID NO: 6739044 - DNA, 22 bp, Homo sapiens
cctaacaacattgtagcctcaa

SEQ ID NO: 6739045 - DNA, 19 bp, Homo sapiens
cctaacaattttttattaa

SEQ ID NO: 6739046 - DNA, 14 bp, Homo sapiens
cctaacaggaattt

SEQ ID NO: 6739047 - DNA, 15 bp, Homo sapiens
cctaacaggctgtag

SEQ ID NO: 6739048 - DNA, 16 bp, Homo sapiens
cctaacatgcaccttg

SEQ ID NO: 6739049 - DNA, 17 bp, Homo sapiens
cctaacattcgatctca

SEQ ID NO: 6739050 - DNA, 11 bp, Homo sapiens
cctaaccaagt

SEQ ID NO: 6739051 - DNA, 14 bp, Homo sapiens
cctaaccaggccca

SEQ ID NO: 6739052 - DNA, 16 bp, Homo sapiens
cctaaccaggcccagc

SEQ ID NO: 6739053 - DNA, 21 bp, Homo sapiens
cctaaccatgggctcagggcc

SEQ ID NO: 6739054 - DNA, 13 bp, Homo sapiens
cctaaccccaggg

SEQ ID NO: 6739055 - DNA, 23 bp, Homo sapiens
cctaaccccagggcactgccagc

SEQ ID NO: 6739056 - DNA, 17 bp, Homo sapiens
cctaacccccagtcctc

SEQ ID NO: 6739057 - DNA, 12 bp, Homo sapiens
cctaaccccttt

SEQ ID NO: 6739058 - DNA, 13 bp, Homo sapiens
cctaaccctttgt

SEQ ID NO: 6739059 - DNA, 14 bp, Homo sapiens
cctaacctgggttg

SEQ ID NO: 6739060 - DNA, 18 bp, Homo sapiens
cctaacctgtgtctgcga

SEQ ID NO: 6739061 - DNA, 13 bp, Homo sapiens
cctaacctttcgc

SEQ ID NO: 6739062 - DNA, 13 bp, Homo sapiens
cctaacctttggg

SEQ ID NO: 6739063 - DNA, 15 bp, Homo sapiens
cctaacgaagtatcc

SEQ ID NO: 6739064 - DNA, 23 bp, Homo sapiens
cctaacgttttctactttgaaat

SEQ ID NO: 6739065 - DNA, 17 bp, Homo sapiens
cctaactagaattagta

SEQ ID NO: 6739066 - DNA, 23 bp, Homo sapiens
cctaactagaattagtatgtctg

SEQ ID NO: 6739067 - DNA, 19 bp, Homo sapiens
cctaactctgcccaccctc

SEQ ID NO: 6739068 - DNA, 14 bp, Homo sapiens
cctaactcttgctc

SEQ ID NO: 6739069 - DNA, 19 bp, Homo sapiens
cctaactcttttctatttt

SEQ ID NO: 6739070 - DNA, 19 bp, Homo sapiens
cctaactgagaattttcta

SEQ ID NO: 6739071 - DNA, 14 bp, Homo sapiens
cctaactgagctgc

SEQ ID NO: 6739072 - DNA, 21 bp, Homo sapiens
cctaactgatttccatccaaa

SEQ ID NO: 6739073 - DNA, 21 bp, Homo sapiens
cctaactgtgaacaatcagat

SEQ ID NO: 6739074 - DNA, 14 bp, Homo sapiens
cctaactgttccct

SEQ ID NO: 6739075 - DNA, 16 bp, Homo sapiens
cctaacttattgcctg

SEQ ID NO: 6739076 - DNA, 20 bp, Homo sapiens
cctaacttattgcctgggca

SEQ ID NO: 6739077 - DNA, 12 bp, Homo sapiens
cctaagaaaaag

SEQ ID NO: 6739078 - DNA, 15 bp, Homo sapiens
cctaagaaatatgtg

SEQ ID NO: 6739079 - DNA, 14 bp, Homo sapiens
cctaagaagaaggc

SEQ ID NO: 6739080 - DNA, 20 bp, Homo sapiens
cctaagaagaaggccagaga

SEQ ID NO: 6739081 - DNA, 14 bp, Homo sapiens
cctaagaagctctg

SEQ ID NO: 6739082 - DNA, 18 bp, Homo sapiens
cctaagaagttattttct

SEQ ID NO: 6739083 - DNA, 19 bp, Homo sapiens
cctaagaagttattttctt

SEQ ID NO: 6739084 - DNA, 14 bp, Homo sapiens
cctaagaatcagag

SEQ ID NO: 6739085 - DNA, 12 bp, Homo sapiens
cctaagacatgt

SEQ ID NO: 6739086 - DNA, 22 bp, Homo sapiens
cctaagacatgtgaggaggaaa

SEQ ID NO: 6739087 - DNA, 13 bp, Homo sapiens
cctaagacatttt

SEQ ID NO: 6739088 - DNA, 14 bp, Homo sapiens
cctaagactgcctt

SEQ ID NO: 6739089 - DNA, 22 bp, Homo sapiens
cctaagagactgcgttctgcaa

SEQ ID NO: 6739090 - DNA, 17 bp, Homo sapiens
cctaagagatttatctt

SEQ ID NO: 6739091 - DNA, 18 bp, Homo sapiens
cctaagagatttatcttt

SEQ ID NO: 6739092 - DNA, 24 bp, Homo sapiens
cctaagaggcgacttcctctccag

SEQ ID NO: 6739093 - DNA, 15 bp, Homo sapiens
cctaagaggctgccc

SEQ ID NO: 6739094 - DNA, 19 bp, Homo sapiens
cctaagaggctgccctcct

SEQ ID NO: 6739095 - DNA, 20 bp, Homo sapiens
cctaagaggtttttcctctt

SEQ ID NO: 6739096 - DNA, 21 bp, Homo sapiens
cctaagagtgtcactgagctg

SEQ ID NO: 6739097 - DNA, 21 bp, Homo sapiens
cctaagatgaagctgagcttt

SEQ ID NO: 6739098 - DNA, 21 bp, Homo sapiens
cctaagatttattttgttaaa

SEQ ID NO: 6739099 - DNA, 23 bp, Homo sapiens
cctaagcaatcactgggcccaga

SEQ ID NO: 6739100 - DNA, 20 bp, Homo sapiens
cctaagcagaaagtgccttt

SEQ ID NO: 6739101 - DNA, 16 bp, Homo sapiens
cctaagcatctaagtt

SEQ ID NO: 6739102 - DNA, 18 bp, Homo sapiens
cctaagccactcccgcca

SEQ ID NO: 6739103 - DNA, 16 bp, Homo sapiens
cctaagccagctgccc

SEQ ID NO: 6739104 - DNA, 18 bp, Homo sapiens
cctaagcccccagggcct

SEQ ID NO: 6739105 - DNA, 19 bp, Homo sapiens
cctaagctggagtgcagtg

SEQ ID NO: 6739106 - DNA, 11 bp, Homo sapiens
cctaaggaaac

SEQ ID NO: 6739107 - DNA, 16 bp, Homo sapiens
cctaaggaagccagtc

SEQ ID NO: 6739108 - DNA, 14 bp, Homo sapiens
cctaaggacacact

SEQ ID NO: 6739109 - DNA, 20 bp, Homo sapiens
tctatgtgaatatttgtaaa

SEQ ID NO: 6739110 - DNA, 17 bp, Homo sapiens
tctatgtgcttgtaaaa

SEQ ID NO: 6739111 - DNA, 19 bp, Homo sapiens
tctatgtgggaaaaaagaa

SEQ ID NO: 6739112 - DNA, 13 bp, Homo sapiens
tctatgtgtatgt

SEQ ID NO: 6739113 - DNA, 17 bp, Homo sapiens
tctatgtgtttctgtaa

SEQ ID NO: 6739114 - DNA, 21 bp, Homo sapiens
tctatgtgtttctgtaacaaa

SEQ ID NO: 6739115 - DNA, 14 bp, Homo sapiens
tctatgttaaatac

SEQ ID NO: 6739116 - DNA, 15 bp, Homo sapiens
tctatgttaaatact

SEQ ID NO: 6739117 - DNA, 18 bp, Homo sapiens
tctatgttaaatactgtg

SEQ ID NO: 6739118 - DNA, 22 bp, Homo sapiens
tctatgttaaatactgtgcaga

SEQ ID NO: 6739119 - DNA, 22 bp, Homo sapiens
tctatgttgcatgataaacatt

SEQ ID NO: 6739120 - DNA, 18 bp, Homo sapiens
tctatgttggtttcagtg

SEQ ID NO: 6739121 - DNA, 12 bp, Homo sapiens
tctatgtttata

SEQ ID NO: 6739122 - DNA, 18 bp, Homo sapiens
tctatgtttgtatttgga

SEQ ID NO: 6739123 - DNA, 12 bp, Homo sapiens
tctattaaaaga

SEQ ID NO: 6739124 - DNA, 14 bp, Homo sapiens
tctattaaaggttc

SEQ ID NO: 6739125 - DNA, 13 bp, Homo sapiens
tctattaaagtga

SEQ ID NO: 6739126 - DNA, 21 bp, Homo sapiens
tctattaaagtgactttctat

SEQ ID NO: 6739127 - DNA, 22 bp, Homo sapiens
tctattaaagtgctaaggttct

SEQ ID NO: 6739128 - DNA, 23 bp, Homo sapiens
tctattaaagtgctaaggttcta

SEQ ID NO: 6739129 - DNA, 17 bp, Homo sapiens
tctattaagatttccaa

SEQ ID NO: 6739130 - DNA, 18 bp, Homo sapiens
tctattaagatttccaag

SEQ ID NO: 6739131 - DNA, 18 bp, Homo sapiens
tctattaagccattgaaa

SEQ ID NO: 6739132 - DNA, 13 bp, Homo sapiens
tctattaagggat

SEQ ID NO: 6739133 - DNA, 10 bp, Homo sapiens
tctattaata

SEQ ID NO: 6739134 - DNA, 21 bp, Homo sapiens
tctattaatatcaactctgaa

SEQ ID NO: 6739135 - DNA, 22 bp, Homo sapiens
tctattaatatcaactctgaag

SEQ ID NO: 6739136 - DNA, 16 bp, Homo sapiens
tctattaatattcagg

SEQ ID NO: 6739137 - DNA, 21 bp, Homo sapiens
tctattaatcaagagaaactt

SEQ ID NO: 6739138 - DNA, 21 bp, Homo sapiens
tctattaatgaggtctttaaa

SEQ ID NO: 6739139 - DNA, 15 bp, Homo sapiens
tctattaattactgt

SEQ ID NO: 6739140 - DNA, 17 bp, Homo sapiens
tctattacattttcagt

SEQ ID NO: 6739141 - DNA, 14 bp, Homo sapiens
tctattacccctca

SEQ ID NO: 6739142 - DNA, 16 bp, Homo sapiens
tctattacccctcatt

SEQ ID NO: 6739143 - DNA, 16 bp, Homo sapiens
tctattagctgggttc

SEQ ID NO: 6739144 - DNA, 15 bp, Homo sapiens
tctattagtttcaat

SEQ ID NO: 6739145 - DNA, 21 bp, Homo sapiens
tctattatactttatcaaaga

SEQ ID NO: 6739146 - DNA, 15 bp, Homo sapiens
tctattatggaaaac

SEQ ID NO: 6739147 - DNA, 19 bp, Homo sapiens
tctattattcaaaaaatca

SEQ ID NO: 6739148 - DNA, 16 bp, Homo sapiens
tctattattgaaatag

SEQ ID NO: 6739149 - DNA, 17 bp, Homo sapiens
tctattatttagaaatg

SEQ ID NO: 6739150 - DNA, 16 bp, Homo sapiens
tctattatttttataa

SEQ ID NO: 6739151 - DNA, 20 bp, Homo sapiens
tctattcataagtctttggt

SEQ ID NO: 6739152 - DNA, 14 bp, Homo sapiens
tctattccaataaa

SEQ ID NO: 6739153 - DNA, 15 bp, Homo sapiens
tctattccaataaac

SEQ ID NO: 6739154 - DNA, 20 bp, Homo sapiens
tctattccagctcattcatt

SEQ ID NO: 6739155 - DNA, 23 bp, Homo sapiens
tctattccatgtccatactatga

SEQ ID NO: 6739156 - DNA, 15 bp, Homo sapiens
tctattccctggaat

SEQ ID NO: 6739157 - DNA, 22 bp, Homo sapiens
tctattccctggaattcaccct

SEQ ID NO: 6739158 - DNA, 17 bp, Homo sapiens
tctattcctgaccctcc

SEQ ID NO: 6739159 - DNA, 23 bp, Homo sapiens
tctattcctgtaaataagagttg

SEQ ID NO: 6739160 - DNA, 18 bp, Homo sapiens
tctattccttatgggatc

SEQ ID NO: 6739161 - DNA, 17 bp, Homo sapiens
tctattccttctggcct

SEQ ID NO: 6739162 - DNA, 17 bp, Homo sapiens
tctattctcaaagtttc

SEQ ID NO: 6739163 - DNA, 21 bp, Homo sapiens
tctattctccagacatggagg

SEQ ID NO: 6739164 - DNA, 14 bp, Homo sapiens
tctattctctgcaa

SEQ ID NO: 6739165 - DNA, 18 bp, Homo sapiens
tctattctgagaaaacaa

SEQ ID NO: 6739166 - DNA, 14 bp, Homo sapiens
tctattctgagcct

SEQ ID NO: 6739167 - DNA, 15 bp, Homo sapiens
tctattctgagcctt

SEQ ID NO: 6739168 - DNA, 17 bp, Homo sapiens
tctattctgagccttga

SEQ ID NO: 6739169 - DNA, 13 bp, Homo sapiens
tctattctgtcag

SEQ ID NO: 6739170 - DNA, 18 bp, Homo sapiens
tctattctgtcagtgtta

SEQ ID NO: 6739171 - DNA, 17 bp, Homo sapiens
tctattctgtgttgcat

SEQ ID NO: 6739172 - DNA, 17 bp, Homo sapiens
tctattcttgggaaaca

SEQ ID NO: 6739173 - DNA, 13 bp, Homo sapiens
tctattctttaac

SEQ ID NO: 6739174 - DNA, 15 bp, Homo sapiens
tctattctttccatg

SEQ ID NO: 6739175 - DNA, 15 bp, Homo sapiens
tctattgaaaacagt

SEQ ID NO: 6739176 - DNA, 18 bp, Homo sapiens
tctattgaccaccagtta

SEQ ID NO: 6739177 - DNA, 22 bp, Homo sapiens
tctattgacttcaatgatagta

SEQ ID NO: 6739178 - DNA, 17 bp, Homo sapiens
tctattgactttcttaa

SEQ ID NO: 6739179 - DNA, 16 bp, Homo sapiens
tctattgatgtacagt

SEQ ID NO: 6739180 - DNA, 20 bp, Homo sapiens
tctattgatgtacagtctgt

SEQ ID NO: 6739181 - DNA, 12 bp, Homo sapiens
tctattgcctct

SEQ ID NO: 6739182 - DNA, 18 bp, Homo sapiens
tctattgccttctttgaa

SEQ ID NO: 6739183 - DNA, 19 bp, Homo sapiens
tctattgccttctttgaag

SEQ ID NO: 6739184 - DNA, 21 bp, Homo sapiens
tctattgccttctttgaagaa

SEQ ID NO: 6739185 - DNA, 16 bp, Homo sapiens
tctattgcttcaccat

SEQ ID NO: 6739186 - DNA, 13 bp, Homo sapiens
tctattgtaagat

SEQ ID NO: 6739187 - DNA, 21 bp, Homo sapiens
tctattgtaattttgttcctg

SEQ ID NO: 6739188 - DNA, 18 bp, Homo sapiens
tctattgtactctgcttt

SEQ ID NO: 6739189 - DNA, 15 bp, Homo sapiens
tctattgtagcattt

SEQ ID NO: 6739190 - DNA, 18 bp, Homo sapiens
tctattgtagcatttctt

SEQ ID NO: 6739191 - DNA, 20 bp, Homo sapiens
tctattgtagcatttcttga

SEQ ID NO: 6739192 - DNA, 16 bp, Homo sapiens
tctattgtttattctt

SEQ ID NO: 6739193 - DNA, 17 bp, Homo sapiens
tctatttaaaaaactgt

SEQ ID NO: 6739194 - DNA, 17 bp, Homo sapiens
tctatttaaaaaataaa

SEQ ID NO: 6739195 - DNA, 14 bp, Homo sapiens
tctatttaaattct

SEQ ID NO: 6739196 - DNA, 17 bp, Homo sapiens
tctatttaaattctttt

SEQ ID NO: 6739197 - DNA, 12 bp, Homo sapiens
tctatttaagcc

SEQ ID NO: 6739198 - DNA, 23 bp, Homo sapiens
tctatttaattttgacactgaaa

SEQ ID NO: 6739199 - DNA, 22 bp, Homo sapiens
tctatttataagtgactttaaa

SEQ ID NO: 6739200 - DNA, 13 bp, Homo sapiens
tctatttatatgt

SEQ ID NO: 6739201 - DNA, 19 bp, Homo sapiens
tctatttatcttcatttga

SEQ ID NO: 6739202 - DNA, 15 bp, Homo sapiens
tctatttatgtttgc

SEQ ID NO: 6739203 - DNA, 14 bp, Homo sapiens
tctatttattaagt

SEQ ID NO: 6739204 - DNA, 16 bp, Homo sapiens
tctatttattaatatt

SEQ ID NO: 6739205 - DNA, 22 bp, Homo sapiens
tctatttattatcgcatacaga

SEQ ID NO: 6739206 - DNA, 13 bp, Homo sapiens
tctatttattgga

SEQ ID NO: 6739207 - DNA, 14 bp, Homo sapiens
tctatttcactgga

SEQ ID NO: 6739208 - DNA, 21 bp, Homo sapiens
tctatttcatcagaacagctg

SEQ ID NO: 6739209 - DNA, 13 bp, Homo sapiens
tctatttccataa

SEQ ID NO: 6739210 - DNA, 19 bp, Homo sapiens
tctatttccccctttcttc

SEQ ID NO: 6739211 - DNA, 14 bp, Homo sapiens
tctatttctatctg

SEQ ID NO: 6739212 - DNA, 16 bp, Homo sapiens
tctatttctatctgca

SEQ ID NO: 6739213 - DNA, 14 bp, Homo sapiens
tctatttctcctcc

SEQ ID NO: 6739214 - DNA, 14 bp, Homo sapiens
tctatttctctatg

SEQ ID NO: 6739215 - DNA, 18 bp, Homo sapiens
tctatttctctatgttta

SEQ ID NO: 6739216 - DNA, 13 bp, Homo sapiens
tctatttctctgt

SEQ ID NO: 6739217 - DNA, 16 bp, Homo sapiens
tctatttctctgtgta

SEQ ID NO: 6739218 - DNA, 15 bp, Homo sapiens
tctatttctgaaaga

SEQ ID NO: 6739219 - DNA, 12 bp, Homo sapiens
tctatttctgag

SEQ ID NO: 6739220 - DNA, 13 bp, Homo sapiens
tctatttctgaga

SEQ ID NO: 6739221 - DNA, 13 bp, Homo sapiens
tctatttctgctg

SEQ ID NO: 6739222 - DNA, 14 bp, Homo sapiens
tctatttcttgaag

SEQ ID NO: 6739223 - DNA, 18 bp, Homo sapiens
tctatttgaattatttct

SEQ ID NO: 6739224 - DNA, 14 bp, Homo sapiens
tctatttgacttgt

SEQ ID NO: 6739225 - DNA, 12 bp, Homo sapiens
tctatttgagaa

SEQ ID NO: 6739226 - DNA, 21 bp, Homo sapiens
tctatttgagaagttctcaga

SEQ ID NO: 6739227 - DNA, 12 bp, Homo sapiens
tctatttggaac

SEQ ID NO: 6739228 - DNA, 12 bp, Homo sapiens
tctatttgtaca

SEQ ID NO: 6739229 - DNA, 16 bp, Homo sapiens
tctatttgtacaattt

SEQ ID NO: 6739230 - DNA, 15 bp, Homo sapiens
tctatttgtagatta

SEQ ID NO: 6739231 - DNA, 22 bp, Homo sapiens
tctatttgtatatatacataac

SEQ ID NO: 6739232 - DNA, 22 bp, Homo sapiens
tctatttgtatatctcaacaga

SEQ ID NO: 6739233 - DNA, 14 bp, Homo sapiens
tctattttaaagac

SEQ ID NO: 6739234 - DNA, 12 bp, Homo sapiens
tctattttaaga

SEQ ID NO: 6739235 - DNA, 12 bp, Homo sapiens
tctattttaatc

SEQ ID NO: 6739236 - DNA, 17 bp, Homo sapiens
tctattttaattactgc

SEQ ID NO: 6739237 - DNA, 20 bp, Homo sapiens
tctattttaccactaatttt

SEQ ID NO: 6739238 - DNA, 13 bp, Homo sapiens
tctattttactgt

SEQ ID NO: 6739239 - DNA, 16 bp, Homo sapiens
tctattttactgtctt

SEQ ID NO: 6739240 - DNA, 21 bp, Homo sapiens
tctattttactgtcttgaatt

SEQ ID NO: 6739241 - DNA, 17 bp, Homo sapiens
tctattttattttattg

SEQ ID NO: 6739242 - DNA, 13 bp, Homo sapiens
tctattttcacaa

SEQ ID NO: 6739243 - DNA, 16 bp, Homo sapiens
tctattttctatgtac

SEQ ID NO: 6739244 - DNA, 18 bp, Homo sapiens
tctattttcttaaaccaa

SEQ ID NO: 6739245 - DNA, 23 bp, Homo sapiens
tctattttcttgaggaaaatatt

SEQ ID NO: 6739246 - DNA, 22 bp, Homo sapiens
tctattttgctggagactattt

SEQ ID NO: 6739247 - DNA, 15 bp, Homo sapiens
tctattttggattgt

SEQ ID NO: 6739248 - DNA, 17 bp, Homo sapiens
tctattttgtaactgta

SEQ ID NO: 6739249 - DNA, 13 bp, Homo sapiens
tctatttttaatg

SEQ ID NO: 6739250 - DNA, 14 bp, Homo sapiens
tctatttttaatgc

SEQ ID NO: 6739251 - DNA, 13 bp, Homo sapiens
tctatttttacat

SEQ ID NO: 6739252 - DNA, 22 bp, Homo sapiens
tctatttttacctactgtgtct

SEQ ID NO: 6739253 - DNA, 15 bp, Homo sapiens
tctatttttaggaga

SEQ ID NO: 6739254 - DNA, 12 bp, Homo sapiens
tctatttttatg

SEQ ID NO: 6739255 - DNA, 18 bp, Homo sapiens
tctatttttatgatgaca

SEQ ID NO: 6739256 - DNA, 16 bp, Homo sapiens
tctatttttctcttca

SEQ ID NO: 6739257 - DNA, 19 bp, Homo sapiens
tctatttttcttcagactg

SEQ ID NO: 6739258 - DNA, 14 bp, Homo sapiens
tctatttttcttct

SEQ ID NO: 6739259 - DNA, 18 bp, Homo sapiens
tctatttttggaggttta

SEQ ID NO: 6739260 - DNA, 19 bp, Homo sapiens
tctatttttggaggtttat

SEQ ID NO: 6739261 - DNA, 21 bp, Homo sapiens
tctatttttggaggtttatta

SEQ ID NO: 6739262 - DNA, 22 bp, Homo sapiens
tctatttttggaggtttattac

SEQ ID NO: 6739263 - DNA, 11 bp, Homo sapiens
tctatttttgt

SEQ ID NO: 6739264 - DNA, 23 bp, Homo sapiens
tctatttttgtttacaaacatgg

SEQ ID NO: 6739265 - DNA, 17 bp, Homo sapiens
tctattttttctgagga

SEQ ID NO: 6739266 - DNA, 19 bp, Homo sapiens
tctatttttttaactgaaa

SEQ ID NO: 6739267 - DNA, 21 bp, Homo sapiens
tctatttttttttctttttaa

SEQ ID NO: 6739268 - DNA, 21 bp, Homo sapiens
tctcaaaaaaaaaaaagtgtc

SEQ ID NO: 6739269 - DNA, 16 bp, Homo sapiens
tctcaaaaaaagaaaa

SEQ ID NO: 6739270 - DNA, 16 bp, Homo sapiens
tctcaaaaatacaaaa

SEQ ID NO: 6739271 - DNA, 17 bp, Homo sapiens
tctcaaaacagagggct

SEQ ID NO: 6739272 - DNA, 23 bp, Homo sapiens
tctcaaaacagagggctgcattc

SEQ ID NO: 6739273 - DNA, 17 bp, Homo sapiens
tctcaaaactgcactgt

SEQ ID NO: 6739274 - DNA, 21 bp, Homo sapiens
tctcaaaactggacagtcact

SEQ ID NO: 6739275 - DNA, 13 bp, Homo sapiens
tctcaaaagaact

SEQ ID NO: 6739276 - DNA, 18 bp, Homo sapiens
tctcaaaagaacttaccc

SEQ ID NO: 6739277 - DNA, 19 bp, Homo sapiens
tctcaaaagaacttacccc

SEQ ID NO: 6739278 - DNA, 14 bp, Homo sapiens
tctcaaaagcattt

SEQ ID NO: 6739279 - DNA, 16 bp, Homo sapiens
tctcaaaagtctattt

SEQ ID NO: 6739280 - DNA, 17 bp, Homo sapiens
tctcaaaatatcctaag

SEQ ID NO: 6739281 - DNA, 15 bp, Homo sapiens
tctcaaaatctttgt

SEQ ID NO: 6739282 - DNA, 13 bp, Homo sapiens
tctcaaacacagt

SEQ ID NO: 6739283 - DNA, 19 bp, Homo sapiens
tctcaaacacagttacact

SEQ ID NO: 6739284 - DNA, 22 bp, Homo sapiens
tctcaaacacagttacacttgt

SEQ ID NO: 6739285 - DNA, 20 bp, Homo sapiens
tctcaaaccaagcaaaggaa

SEQ ID NO: 6739286 - DNA, 18 bp, Homo sapiens
tctcaaacctccaaaagc

SEQ ID NO: 6739287 - DNA, 18 bp, Homo sapiens
tctcaaactcttagtttt

SEQ ID NO: 6739288 - DNA, 22 bp, Homo sapiens
tctcaaactcttgacctcaggt

SEQ ID NO: 6739289 - DNA, 14 bp, Homo sapiens
tctcatgtaaaata

SEQ ID NO: 6739290 - DNA, 22 bp, Homo sapiens
tctcatgtaacacataaacaat

SEQ ID NO: 6739291 - DNA, 17 bp, Homo sapiens
tctcatgtaatttgcat

SEQ ID NO: 6739292 - DNA, 15 bp, Homo sapiens
tctcatgtagaacaa

SEQ ID NO: 6739293 - DNA, 17 bp, Homo sapiens
tctcatgtccccttcct

SEQ ID NO: 6739294 - DNA, 18 bp, Homo sapiens
tctcatgtcctgctggct

SEQ ID NO: 6739295 - DNA, 16 bp, Homo sapiens
tctcatgtctcagcct

SEQ ID NO: 6739296 - DNA, 21 bp, Homo sapiens
tctcatgtctctttggggaga

SEQ ID NO: 6739297 - DNA, 15 bp, Homo sapiens
tctcatgtgatcctt

SEQ ID NO: 6739298 - DNA, 15 bp, Homo sapiens
tctcatgtgtttgca

SEQ ID NO: 6739299 - DNA, 16 bp, Homo sapiens
tctcatgttaaatatt

SEQ ID NO: 6739300 - DNA, 17 bp, Homo sapiens
tctcatgttccttttga

SEQ ID NO: 6739301 - DNA, 17 bp, Homo sapiens
tctcatgttttcaactg

SEQ ID NO: 6739302 - DNA, 16 bp, Homo sapiens
tctcattaaaagaata

SEQ ID NO: 6739303 - DNA, 12 bp, Homo sapiens
tctcattaaagt

SEQ ID NO: 6739304 - DNA, 15 bp, Homo sapiens
tctcattaacaatat

SEQ ID NO: 6739305 - DNA, 19 bp, Homo sapiens
tctcattaattcaattaaa

SEQ ID NO: 6739306 - DNA, 19 bp, Homo sapiens
tctcattacccttttctgg

SEQ ID NO: 6739307 - DNA, 14 bp, Homo sapiens
tctcattacttgtt

SEQ ID NO: 6739308 - DNA, 15 bp, Homo sapiens
tctcattagaaaggc

SEQ ID NO: 6739309 - DNA, 18 bp, Homo sapiens
tctcattagggctttttt

SEQ ID NO: 6739310 - DNA, 16 bp, Homo sapiens
tctcattatgaagatg

SEQ ID NO: 6739311 - DNA, 21 bp, Homo sapiens
tctcattattctctaactatt

SEQ ID NO: 6739312 - DNA, 23 bp, Homo sapiens
tctcattcagaagatgcttagct

SEQ ID NO: 6739313 - DNA, 17 bp, Homo sapiens
tctcattcccatgtgga

SEQ ID NO: 6739314 - DNA, 13 bp, Homo sapiens
tctcattccccag

SEQ ID NO: 6739315 - DNA, 16 bp, Homo sapiens
tctcattccccaggtg

SEQ ID NO: 6739316 - DNA, 21 bp, Homo sapiens
tctcattccgttgtctgtgga

SEQ ID NO: 6739317 - DNA, 15 bp, Homo sapiens
tctcattcctctgtc

SEQ ID NO: 6739318 - DNA, 16 bp, Homo sapiens
tctcattcctgttctt

SEQ ID NO: 6739319 - DNA, 19 bp, Homo sapiens
tctcattcgcctttgtctt

SEQ ID NO: 6739320 - DNA, 21 bp, Homo sapiens
tctcattcgcctttgtcttgt

SEQ ID NO: 6739321 - DNA, 12 bp, Homo sapiens
tctcattctctt

SEQ ID NO: 6739322 - DNA, 12 bp, Homo sapiens
tctcattctgtg

SEQ ID NO: 6739323 - DNA, 13 bp, Homo sapiens
tctcattctgtgc

SEQ ID NO: 6739324 - DNA, 13 bp, Homo sapiens
tctcattcttcta

SEQ ID NO: 6739325 - DNA, 18 bp, Homo sapiens
tctcattctttgaacatg

SEQ ID NO: 6739326 - DNA, 13 bp, Homo sapiens
tctcattgccaag

SEQ ID NO: 6739327 - DNA, 17 bp, Homo sapiens
tctcattgcctcttcta

SEQ ID NO: 6739328 - DNA, 22 bp, Homo sapiens
tctcattgctgttttaatttgt

SEQ ID NO: 6739329 - DNA, 15 bp, Homo sapiens
tctcattgcttacaa

SEQ ID NO: 6739330 - DNA, 14 bp, Homo sapiens
tctcattgcttctg

SEQ ID NO: 6739331 - DNA, 14 bp, Homo sapiens
tctcattggaaatt

SEQ ID NO: 6739332 - DNA, 17 bp, Homo sapiens
tctcattggaaatttag

SEQ ID NO: 6739333 - DNA, 19 bp, Homo sapiens
tctcattggacccttccat

SEQ ID NO: 6739334 - DNA, 23 bp, Homo sapiens
tctcattgtcttgttatgtacaa

SEQ ID NO: 6739335 - DNA, 21 bp, Homo sapiens
tctcattgtttgtttgtaagt

SEQ ID NO: 6739336 - DNA, 15 bp, Homo sapiens
tctcatttaagggaa

SEQ ID NO: 6739337 - DNA, 17 bp, Homo sapiens
tctcatttaagggaaaa

SEQ ID NO: 6739338 - DNA, 18 bp, Homo sapiens
tctcatttaagggaaaaa

SEQ ID NO: 6739339 - DNA, 16 bp, Homo sapiens
tctcatttaatttgtt

SEQ ID NO: 6739340 - DNA, 18 bp, Homo sapiens
tctcatttagaacttgca

SEQ ID NO: 6739341 - DNA, 18 bp, Homo sapiens
tctcatttagcctgtcct

SEQ ID NO: 6739342 - DNA, 12 bp, Homo sapiens
tctcatttagtg

SEQ ID NO: 6739343 - DNA, 20 bp, Homo sapiens
tctcatttatgttatttatg

SEQ ID NO: 6739344 - DNA, 19 bp, Homo sapiens
tctcatttcacccctccct

SEQ ID NO: 6739345 - DNA, 16 bp, Homo sapiens
tctcatttccagcttc

SEQ ID NO: 6739346 - DNA, 16 bp, Homo sapiens
tctcatttgaaatgtt

SEQ ID NO: 6739347 - DNA, 15 bp, Homo sapiens
tctcatttgggggcg

SEQ ID NO: 6739348 - DNA, 20 bp, Homo sapiens
tctcatttggtctgccagaa

SEQ ID NO: 6739349 - DNA, 16 bp, Homo sapiens
tctcatttgtcacaca

SEQ ID NO: 6739350 - DNA, 15 bp, Homo sapiens
tctcattttaaacaa

SEQ ID NO: 6739351 - DNA, 17 bp, Homo sapiens
tctcattttggtctgtt

SEQ ID NO: 6739352 - DNA, 17 bp, Homo sapiens
tctcattttggtttgtt

SEQ ID NO: 6739353 - DNA, 23 bp, Homo sapiens
tctccaaaaaaaaaaaaaataca

SEQ ID NO: 6739354 - DNA, 20 bp, Homo sapiens
tctccaaaaatctgcctggg

SEQ ID NO: 6739355 - DNA, 16 bp, Homo sapiens
tctccaaaacatttct

SEQ ID NO: 6739356 - DNA, 19 bp, Homo sapiens
tctccaaaacatttctaag

SEQ ID NO: 6739357 - DNA, 14 bp, Homo sapiens
tctccaaaccactt

SEQ ID NO: 6739358 - DNA, 23 bp, Homo sapiens
tctccaaaccagacggtgacgcc

SEQ ID NO: 6739359 - DNA, 18 bp, Homo sapiens
tctccaaaggccctacca

SEQ ID NO: 6739360 - DNA, 12 bp, Homo sapiens
tctccaaataca

SEQ ID NO: 6739361 - DNA, 15 bp, Homo sapiens
tctccaaatcaagga

SEQ ID NO: 6739362 - DNA, 21 bp, Homo sapiens
tctccaaatcaaggatctttt

SEQ ID NO: 6739363 - DNA, 19 bp, Homo sapiens
tctccaaatgattttcatc

SEQ ID NO: 6739364 - DNA, 15 bp, Homo sapiens
tctccaacagagtgg

SEQ ID NO: 6739365 - DNA, 13 bp, Homo sapiens
tctccaaccactg

SEQ ID NO: 6739366 - DNA, 21 bp, Homo sapiens
tctccaaccccccagcactga

SEQ ID NO: 6739367 - DNA, 22 bp, Homo sapiens
tctccaaccccccagcactgag

SEQ ID NO: 6739368 - DNA, 16 bp, Homo sapiens
tctccaagaatgctga

SEQ ID NO: 6739369 - DNA, 17 bp, Homo sapiens
tctccaagaatggaagc

SEQ ID NO: 6739370 - DNA, 13 bp, Homo sapiens
tctccaagacaga

SEQ ID NO: 6739371 - DNA, 20 bp, Homo sapiens
tctccaagacagcagcagcc

SEQ ID NO: 6739372 - DNA, 22 bp, Homo sapiens
tctccaagacagcagcagcctg

SEQ ID NO: 6739373 - DNA, 24 bp, Homo sapiens
tctccaagacagcagcagcctgca

SEQ ID NO: 6739374 - DNA, 18 bp, Homo sapiens
tctccaagataagcctga

SEQ ID NO: 6739375 - DNA, 20 bp, Homo sapiens
tctccaagataagcctgagc

SEQ ID NO: 6739376 - DNA, 13 bp, Homo sapiens
tctccaagcagct

SEQ ID NO: 6739377 - DNA, 19 bp, Homo sapiens
tctccaagcagcttagagt

SEQ ID NO: 6739378 - DNA, 16 bp, Homo sapiens
tctccaagcaggacat

SEQ ID NO: 6739379 - DNA, 18 bp, Homo sapiens
tctccaagcaggacatgg

SEQ ID NO: 6739380 - DNA, 22 bp, Homo sapiens
tctccaagcctctgtcttttct

SEQ ID NO: 6739381 - DNA, 15 bp, Homo sapiens
tctccaagcgcctgg

SEQ ID NO: 6739382 - DNA, 19 bp, Homo sapiens
tctccaaggatcctctcca

SEQ ID NO: 6739383 - DNA, 21 bp, Homo sapiens
tctccaagggcttctgcaccc

SEQ ID NO: 6739384 - DNA, 14 bp, Homo sapiens
tctccaagtacttt

SEQ ID NO: 6739385 - DNA, 19 bp, Homo sapiens
tctccaagtctctctgtga

SEQ ID NO: 6739386 - DNA, 20 bp, Homo sapiens
tctccaagtgccagaggtgg

SEQ ID NO: 6739387 - DNA, 23 bp, Homo sapiens
tctccaagtgccagaggtgggca

SEQ ID NO: 6739388 - DNA, 14 bp, Homo sapiens
tctccaatgctctg

SEQ ID NO: 6739389 - DNA, 13 bp, Homo sapiens
tctccaattgtaa

SEQ ID NO: 6739390 - DNA, 16 bp, Homo sapiens
tctccaattgtaaaaa

SEQ ID NO: 6739391 - DNA, 20 bp, Homo sapiens
tctccaatttttttttcctt

SEQ ID NO: 6739392 - DNA, 19 bp, Homo sapiens
tctccacaacagcctgggg

SEQ ID NO: 6739393 - DNA, 13 bp, Homo sapiens
tctccacacccag

SEQ ID NO: 6739394 - DNA, 16 bp, Homo sapiens
tctccacacccagcct

SEQ ID NO: 6739395 - DNA, 18 bp, Homo sapiens
tctccacacccagcctgt

SEQ ID NO: 6739396 - DNA, 21 bp, Homo sapiens
tctccacacccatgactgccc

SEQ ID NO: 6739397 - DNA, 22 bp, Homo sapiens
tctccacacccatgactgcccc

SEQ ID NO: 6739398 - DNA, 14 bp, Homo sapiens
tctccacaggagcc

SEQ ID NO: 6739399 - DNA, 22 bp, Homo sapiens
tctccacagggcttgttttcca

SEQ ID NO: 6739400 - DNA, 15 bp, Homo sapiens
tctccacagtgttca

SEQ ID NO: 6739401 - DNA, 14 bp, Homo sapiens
tctccacagtgttg

SEQ ID NO: 6739402 - DNA, 23 bp, Homo sapiens
tctccaccacccaacccaaacca

SEQ ID NO: 6739403 - DNA, 14 bp, Homo sapiens
tctccaccagcccc

SEQ ID NO: 6739404 - DNA, 15 bp, Homo sapiens
tctccaccagcccct

SEQ ID NO: 6739405 - DNA, 22 bp, Homo sapiens
tctccaccagccctactcctgc

SEQ ID NO: 6739406 - DNA, 16 bp, Homo sapiens
tctccaccaggaacct

SEQ ID NO: 6739407 - DNA, 21 bp, Homo sapiens
tctccacccaaaccccttccc

SEQ ID NO: 6739408 - DNA, 19 bp, Homo sapiens
tctccacccagaggtctcc

SEQ ID NO: 6739409 - DNA, 17 bp, Homo sapiens
tctccaccccagggtca

SEQ ID NO: 6739410 - DNA, 16 bp, Homo sapiens
tctccacccctacaca

SEQ ID NO: 6739411 - DNA, 23 bp, Homo sapiens
tctccacccctcaagccaggaga

SEQ ID NO: 6739412 - DNA, 23 bp, Homo sapiens
tctccaccctccggccagcgagt

SEQ ID NO: 6739413 - DNA, 23 bp, Homo sapiens
tctccaccctcctctagccatcc

SEQ ID NO: 6739414 - DNA, 14 bp, Homo sapiens
tctccaccctgagc

SEQ ID NO: 6739415 - DNA, 21 bp, Homo sapiens
tctccaccctgagcctgacct

SEQ ID NO: 6739416 - DNA, 12 bp, Homo sapiens
tctccaccctgc

SEQ ID NO: 6739417 - DNA, 17 bp, Homo sapiens
tctccaccctgctctcc

SEQ ID NO: 6739418 - DNA, 14 bp, Homo sapiens
tctccacctagtgg

SEQ ID NO: 6739419 - DNA, 23 bp, Homo sapiens
tctccacctagtggctgtccagt

SEQ ID NO: 6739420 - DNA, 13 bp, Homo sapiens
tctccacctcagc

SEQ ID NO: 6739421 - DNA, 15 bp, Homo sapiens
tctccacctcagcct

SEQ ID NO: 6739422 - DNA, 17 bp, Homo sapiens
tctccacctcagccttg

SEQ ID NO: 6739423 - DNA, 12 bp, Homo sapiens
tctccacctccc

SEQ ID NO: 6739424 - DNA, 17 bp, Homo sapiens
tctccacctgaagtgat

SEQ ID NO: 6739425 - DNA, 22 bp, Homo sapiens
tctccacctgccagggacagag

SEQ ID NO: 6739426 - DNA, 15 bp, Homo sapiens
tctccacctgtgctt

SEQ ID NO: 6739427 - DNA, 16 bp, Homo sapiens
tctccaccttccaaag

SEQ ID NO: 6739428 - DNA, 19 bp, Homo sapiens
tctccacgtctttcctgct

SEQ ID NO: 6739429 - DNA, 20 bp, Homo sapiens
tctccactaaatgagctcct

SEQ ID NO: 6739430 - DNA, 21 bp, Homo sapiens
tctccactaaatgagctcctg

SEQ ID NO: 6739431 - DNA, 14 bp, Homo sapiens
tctccactcaatgt

SEQ ID NO: 6739432 - DNA, 15 bp, Homo sapiens
tctccactcactgca

SEQ ID NO: 6739433 - DNA, 17 bp, Homo sapiens
tctccactcagttgcaa

SEQ ID NO: 6739434 - DNA, 22 bp, Homo sapiens
tctccactcttctctcctttct

SEQ ID NO: 6739435 - DNA, 17 bp, Homo sapiens
tctccactgacctggtt

SEQ ID NO: 6739436 - DNA, 16 bp, Homo sapiens
tctccactgctctcag

SEQ ID NO: 6739437 - DNA, 17 bp, Homo sapiens
tctccactgctggacat

SEQ ID NO: 6739438 - DNA, 18 bp, Homo sapiens
tctccactgctggacatg

SEQ ID NO: 6739439 - DNA, 13 bp, Homo sapiens
tctccactggacc

SEQ ID NO: 6739440 - DNA, 15 bp, Homo sapiens
tctccactggaccct

SEQ ID NO: 6739441 - DNA, 12 bp, Homo sapiens
tctccactgtgc

SEQ ID NO: 6739442 - DNA, 21 bp, Homo sapiens
tctccactgtgcacacccacc

SEQ ID NO: 6739443 - DNA, 18 bp, Homo sapiens
tctccactgtgctttcag

SEQ ID NO: 6739444 - DNA, 19 bp, Homo sapiens
tctccactgtttcatgagc

SEQ ID NO: 6739445 - DNA, 20 bp, Homo sapiens
tctccactgtttcatgagcc

SEQ ID NO: 6739446 - DNA, 14 bp, Homo sapiens
tctccacttctggt

SEQ ID NO: 6739447 - DNA, 23 bp, Homo sapiens
tctccacttctggtcccctgtgg

SEQ ID NO: 6739448 - DNA, 14 bp, Homo sapiens
tctccactttcagc

SEQ ID NO: 6739449 - DNA, 16 bp, Homo sapiens
tctccactttcagctg

SEQ ID NO: 6739450 - DNA, 18 bp, Homo sapiens
tctccactttcagctgtc

SEQ ID NO: 6739451 - DNA, 19 bp, Homo sapiens
tctccagaaacagctgctt

SEQ ID NO: 6739452 - DNA, 20 bp, Homo sapiens
tctccagaaacagctgcttc

SEQ ID NO: 6739453 - DNA, 16 bp, Homo sapiens
tctccagaaccagtgt

SEQ ID NO: 6739454 - DNA, 15 bp, Homo sapiens
tctccagaatgtaag

SEQ ID NO: 6739455 - DNA, 19 bp, Homo sapiens
tctccagaatgtaagaaaa

SEQ ID NO: 6739456 - DNA, 16 bp, Homo sapiens
tctccagacctgagct

SEQ ID NO: 6739457 - DNA, 23 bp, Homo sapiens
tctccagagagaaatcaggcctg

SEQ ID NO: 6739458 - DNA, 21 bp, Homo sapiens
tctccagatgttaatttactt

SEQ ID NO: 6739459 - DNA, 18 bp, Homo sapiens
tctccagatgtttccaga

SEQ ID NO: 6739460 - DNA, 18 bp, Homo sapiens
tctccagcatcccagcct

SEQ ID NO: 6739461 - DNA, 15 bp, Homo sapiens
tctccagcattctca

SEQ ID NO: 6739462 - DNA, 18 bp, Homo sapiens
tctccagcattctcagcc

SEQ ID NO: 6739463 - DNA, 12 bp, Homo sapiens
tctccagcccac

SEQ ID NO: 6739464 - DNA, 18 bp, Homo sapiens
tctccagcccacacccct

SEQ ID NO: 6739465 - DNA, 22 bp, Homo sapiens
tctccagcccacacccctccaa

SEQ ID NO: 6739466 - DNA, 14 bp, Homo sapiens
tctccagcccacgt

SEQ ID NO: 6739467 - DNA, 13 bp, Homo sapiens
tctcctcttgcca

SEQ ID NO: 6739468 - DNA, 14 bp, Homo sapiens
tctcctcttgtaaa

SEQ ID NO: 6739469 - DNA, 15 bp, Homo sapiens
tctcctcttgtaaat

SEQ ID NO: 6739470 - DNA, 14 bp, Homo sapiens
tctcctctttaaaa

SEQ ID NO: 6739471 - DNA, 13 bp, Homo sapiens
tctcctctttgaa

SEQ ID NO: 6739472 - DNA, 20 bp, Homo sapiens
tctcctctttgaacatggtc

SEQ ID NO: 6739473 - DNA, 15 bp, Homo sapiens
tctcctctttgagac

SEQ ID NO: 6739474 - DNA, 16 bp, Homo sapiens
tctcctcttttatctt

SEQ ID NO: 6739475 - DNA, 21 bp, Homo sapiens
tctcctgaaatctacaggcct

SEQ ID NO: 6739476 - DNA, 22 bp, Homo sapiens
tctcctgaaatctacaggcctc

SEQ ID NO: 6739477 - DNA, 14 bp, Homo sapiens
tctcctgaatattt

SEQ ID NO: 6739478 - DNA, 17 bp, Homo sapiens
tctcctgacccctgcct

SEQ ID NO: 6739479 - DNA, 14 bp, Homo sapiens
tctcctgaccctcc

SEQ ID NO: 6739480 - DNA, 15 bp, Homo sapiens
tctcctgaccctccc

SEQ ID NO: 6739481 - DNA, 21 bp, Homo sapiens
tctcctgacctcgtgatgggc

SEQ ID NO: 6739482 - DNA, 16 bp, Homo sapiens
tctcctgagaggtgct

SEQ ID NO: 6739483 - DNA, 17 bp, Homo sapiens
tctcctgagttgtataa

SEQ ID NO: 6739484 - DNA, 19 bp, Homo sapiens
tctcctgagttgtataaaa

SEQ ID NO: 6739485 - DNA, 15 bp, Homo sapiens
tctcctgattattta

SEQ ID NO: 6739486 - DNA, 17 bp, Homo sapiens
tctcctgatttctctga

SEQ ID NO: 6739487 - DNA, 23 bp, Homo sapiens
tctcctgcaaatttagtttgtta

SEQ ID NO: 6739488 - DNA, 16 bp, Homo sapiens
tctcctgcagtctgtg

SEQ ID NO: 6739489 - DNA, 14 bp, Homo sapiens
tctcctgcatccct

SEQ ID NO: 6739490 - DNA, 20 bp, Homo sapiens
tctcctgccagcccagctgg

SEQ ID NO: 6739491 - DNA, 22 bp, Homo sapiens
tctcctgcccaagcacttcaca

SEQ ID NO: 6739492 - DNA, 16 bp, Homo sapiens
tctcctgcccccacac

SEQ ID NO: 6739493 - DNA, 15 bp, Homo sapiens
tctcctgccctctgc

SEQ ID NO: 6739494 - DNA, 19 bp, Homo sapiens
tctcctgccctctgctctg

SEQ ID NO: 6739495 - DNA, 16 bp, Homo sapiens
tctcctgccctgccct

SEQ ID NO: 6739496 - DNA, 18 bp, Homo sapiens
tctcctgcctacatccca

SEQ ID NO: 6739497 - DNA, 23 bp, Homo sapiens
tctcctgcctacattccctggcc

SEQ ID NO: 6739498 - DNA, 13 bp, Homo sapiens
tctcctgcctcac

SEQ ID NO: 6739499 - DNA, 20 bp, Homo sapiens
tctcctgcctgtagcagtga

SEQ ID NO: 6739500 - DNA, 20 bp, Homo sapiens
tctcctgcctgtgctgtgac

SEQ ID NO: 6739501 - DNA, 18 bp, Homo sapiens
tctcctgccttcctcctg

SEQ ID NO: 6739502 - DNA, 15 bp, Homo sapiens
tctcctgcgccccgc

SEQ ID NO: 6739503 - DNA, 19 bp, Homo sapiens
tctcctgcgccccgcccac

SEQ ID NO: 6739504 - DNA, 21 bp, Homo sapiens
tctcctgcgtgtgcccactga

SEQ ID NO: 6739505 - DNA, 19 bp, Homo sapiens
tctcctgcgtgttctcaga

SEQ ID NO: 6739506 - DNA, 17 bp, Homo sapiens
tctcctgctcaccacct

SEQ ID NO: 6739507 - DNA, 17 bp, Homo sapiens
tctcctgctcctcagga

SEQ ID NO: 6739508 - DNA, 15 bp, Homo sapiens
tctcctgctgccttt

SEQ ID NO: 6739509 - DNA, 17 bp, Homo sapiens
tctcctgctgccttttc

SEQ ID NO: 6739510 - DNA, 12 bp, Homo sapiens
tctcctgctgcg

SEQ ID NO: 6739511 - DNA, 18 bp, Homo sapiens
tctcctgctgctccctca

SEQ ID NO: 6739512 - DNA, 16 bp, Homo sapiens
tctcctgctgctcctg

SEQ ID NO: 6739513 - DNA, 21 bp, Homo sapiens
tctcctggaccctggaagcag

SEQ ID NO: 6739514 - DNA, 17 bp, Homo sapiens
tctcctggaccttgaca

SEQ ID NO: 6739515 - DNA, 24 bp, Homo sapiens
tctcctggaccttgacagagcagc

SEQ ID NO: 6739516 - DNA, 20 bp, Homo sapiens
tctcctggagggcgcccagc

SEQ ID NO: 6739517 - DNA, 22 bp, Homo sapiens
tctcctggagggcgcccagcag

SEQ ID NO: 6739518 - DNA, 19 bp, Homo sapiens
tctcctggagttgcattga

SEQ ID NO: 6739519 - DNA, 16 bp, Homo sapiens
tctcctggcccctgcc

SEQ ID NO: 6739520 - DNA, 20 bp, Homo sapiens
tctcctggcccctgcctgct

SEQ ID NO: 6739521 - DNA, 20 bp, Homo sapiens
tctcctggcctggccatctc

SEQ ID NO: 6739522 - DNA, 20 bp, Homo sapiens
tctcctggctaagcctctgc

SEQ ID NO: 6739523 - DNA, 13 bp, Homo sapiens
tctcctggctgtc

SEQ ID NO: 6739524 - DNA, 11 bp, Homo sapiens
tctcctggctt

SEQ ID NO: 6739525 - DNA, 13 bp, Homo sapiens
tctcctggcttcc

SEQ ID NO: 6739526 - DNA, 22 bp, Homo sapiens
tctcctggcttcccatccccag

SEQ ID NO: 6739527 - DNA, 21 bp, Homo sapiens
tctcctgggaaacctgccttt

SEQ ID NO: 6739528 - DNA, 13 bp, Homo sapiens
tctcctgggaaag

SEQ ID NO: 6739529 - DNA, 14 bp, Homo sapiens
tctcctgggaaagg

SEQ ID NO: 6739530 - DNA, 13 bp, Homo sapiens
tctcctgggcagc

SEQ ID NO: 6739531 - DNA, 14 bp, Homo sapiens
tctcctgggcagct

SEQ ID NO: 6739532 - DNA, 15 bp, Homo sapiens
tctcctgggcagctg

SEQ ID NO: 6739533 - DNA, 18 bp, Homo sapiens
tctcctgggcagctgcct

SEQ ID NO: 6739534 - DNA, 17 bp, Homo sapiens
tctcctgggcatctggc

SEQ ID NO: 6739535 - DNA, 18 bp, Homo sapiens
tctcctgggcatctggcc

SEQ ID NO: 6739536 - DNA, 19 bp, Homo sapiens
tctcctgggcatctggccc

SEQ ID NO: 6739537 - DNA, 13 bp, Homo sapiens
tctcctgggccag

SEQ ID NO: 6739538 - DNA, 22 bp, Homo sapiens
tctcctgggggtggcaggcaca

SEQ ID NO: 6739539 - DNA, 11 bp, Homo sapiens
tctcctggtgt

SEQ ID NO: 6739540 - DNA, 16 bp, Homo sapiens
tctcctggtgtgggta

SEQ ID NO: 6739541 - DNA, 19 bp, Homo sapiens
tctcctggtgtttttctct

SEQ ID NO: 6739542 - DNA, 20 bp, Homo sapiens
tctcctggtgtttttctctc

SEQ ID NO: 6739543 - DNA, 22 bp, Homo sapiens
tctcctggtgtttttctctctg

SEQ ID NO: 6739544 - DNA, 19 bp, Homo sapiens
tctcctgtaattttgtagt

SEQ ID NO: 6739545 - DNA, 21 bp, Homo sapiens
tctcctgtagcacaaagaggg

SEQ ID NO: 6739546 - DNA, 17 bp, Homo sapiens
tctcctgtagccactgg

SEQ ID NO: 6739547 - DNA, 18 bp, Homo sapiens
tctcctgtagccactggc

SEQ ID NO: 6739548 - DNA, 19 bp, Homo sapiens
tctcctgtataaccccacc

SEQ ID NO: 6739549 - DNA, 22 bp, Homo sapiens
tctcctgtataaccccaccttg

SEQ ID NO: 6739550 - DNA, 14 bp, Homo sapiens
tctcctgtatcatt

SEQ ID NO: 6739551 - DNA, 14 bp, Homo sapiens
tctcctgtccaacc

SEQ ID NO: 6739552 - DNA, 14 bp, Homo sapiens
tctcctgtccccgg

SEQ ID NO: 6739553 - DNA, 15 bp, Homo sapiens
tctcctgtccccggc

SEQ ID NO: 6739554 - DNA, 12 bp, Homo sapiens
tctcctgtccct

SEQ ID NO: 6739555 - DNA, 19 bp, Homo sapiens
tctcctgtccctccatccc

SEQ ID NO: 6739556 - DNA, 16 bp, Homo sapiens
tctcctgtctacagtt

SEQ ID NO: 6739557 - DNA, 19 bp, Homo sapiens
tctcctgtctcagcctcct

SEQ ID NO: 6739558 - DNA, 16 bp, Homo sapiens
tctcctgtctgccctc

SEQ ID NO: 6739559 - DNA, 12 bp, Homo sapiens
tctcctgtgacc

SEQ ID NO: 6739560 - DNA, 12 bp, Homo sapiens
tctcctgtgcac

SEQ ID NO: 6739561 - DNA, 17 bp, Homo sapiens
tctcctgtgcatgggtg

SEQ ID NO: 6739562 - DNA, 12 bp, Homo sapiens
tctcctgtgccc

SEQ ID NO: 6739563 - DNA, 13 bp, Homo sapiens
tctcctgtgccca

SEQ ID NO: 6739564 - DNA, 15 bp, Homo sapiens
tctcctgtgcccctc

SEQ ID NO: 6739565 - DNA, 21 bp, Homo sapiens
tctcctgtggtttgctccaga

SEQ ID NO: 6739566 - DNA, 18 bp, Homo sapiens
tctcctgtttcccttccc

SEQ ID NO: 6739567 - DNA, 14 bp, Homo sapiens
tctcctgtttggaa

SEQ ID NO: 6739568 - DNA, 14 bp, Homo sapiens
tctcctgttttata

SEQ ID NO: 6739569 - DNA, 18 bp, Homo sapiens
tctcctgttttatatatt

SEQ ID NO: 6739570 - DNA, 19 bp, Homo sapiens
tctcctgtttttctgggtg

SEQ ID NO: 6739571 - DNA, 15 bp, Homo sapiens
tctccttaaccccca

SEQ ID NO: 6739572 - DNA, 15 bp, Homo sapiens
tctccttacctctgg

SEQ ID NO: 6739573 - DNA, 18 bp, Homo sapiens
tctccttactctgagccc

SEQ ID NO: 6739574 - DNA, 21 bp, Homo sapiens
tctccttactctgagcccagg

SEQ ID NO: 6739575 - DNA, 17 bp, Homo sapiens
tctccttactgtgtttc

SEQ ID NO: 6739576 - DNA, 14 bp, Homo sapiens
tctccttagtcttc

SEQ ID NO: 6739577 - DNA, 18 bp, Homo sapiens
tctccttagttggctgga

SEQ ID NO: 6739578 - DNA, 14 bp, Homo sapiens
tctccttcaccttt

SEQ ID NO: 6739579 - DNA, 18 bp, Homo sapiens
tctccttcacctttgtcc

SEQ ID NO: 6739580 - DNA, 20 bp, Homo sapiens
tctccttcacctttgtcccc

SEQ ID NO: 6739581 - DNA, 12 bp, Homo sapiens
tctccttcactc

SEQ ID NO: 6739582 - DNA, 17 bp, Homo sapiens
tctccttcactctgaca

SEQ ID NO: 6739583 - DNA, 14 bp, Homo sapiens
tctccttcagcacg

SEQ ID NO: 6739584 - DNA, 19 bp, Homo sapiens
tctccttcagccctcaccc

SEQ ID NO: 6739585 - DNA, 12 bp, Homo sapiens
tctccttcccaa

SEQ ID NO: 6739586 - DNA, 18 bp, Homo sapiens
tctccttcccaaggcagc

SEQ ID NO: 6739587 - DNA, 12 bp, Homo sapiens
tctccttcccac

SEQ ID NO: 6739588 - DNA, 18 bp, Homo sapiens
tctccttcccacaaaaga

SEQ ID NO: 6739589 - DNA, 13 bp, Homo sapiens
tctccttcccacc

SEQ ID NO: 6739590 - DNA, 14 bp, Homo sapiens
tctccttcccaccc

SEQ ID NO: 6739591 - DNA, 14 bp, Homo sapiens
tctccttcccactg

SEQ ID NO: 6739592 - DNA, 19 bp, Homo sapiens
tctccttcccactgtcctt

SEQ ID NO: 6739593 - DNA, 15 bp, Homo sapiens
tctccttccccagga

SEQ ID NO: 6739594 - DNA, 16 bp, Homo sapiens
tctccttccccaggat

SEQ ID NO: 6739595 - DNA, 18 bp, Homo sapiens
tctccttcccctacacct

SEQ ID NO: 6739596 - DNA, 12 bp, Homo sapiens
tctccttccctc

SEQ ID NO: 6739597 - DNA, 14 bp, Homo sapiens
tctccttcccttct

SEQ ID NO: 6739598 - DNA, 16 bp, Homo sapiens
tctccttcccttctct

SEQ ID NO: 6739599 - DNA, 17 bp, Homo sapiens
tctccttcccttctctt

SEQ ID NO: 6739600 - DNA, 16 bp, Homo sapiens
tctccttcctgtgtgt

SEQ ID NO: 6739601 - DNA, 11 bp, Homo sapiens
tctccttcctt

SEQ ID NO: 6739602 - DNA, 14 bp, Homo sapiens
tctccttccttacc

SEQ ID NO: 6739603 - DNA, 19 bp, Homo sapiens
tctccttcgtatcccgagt

SEQ ID NO: 6739604 - DNA, 19 bp, Homo sapiens
tctccttcgtgtctctccc

SEQ ID NO: 6739605 - DNA, 16 bp, Homo sapiens
tctccttctcctagct

SEQ ID NO: 6739606 - DNA, 13 bp, Homo sapiens
tctccttctcttc

SEQ ID NO: 6739607 - DNA, 14 bp, Homo sapiens
tctccttctcttct

SEQ ID NO: 6739608 - DNA, 20 bp, Homo sapiens
tctccttgaagcaaatgtgt

SEQ ID NO: 6739609 - DNA, 14 bp, Homo sapiens
tctccttgactgcc

SEQ ID NO: 6739610 - DNA, 18 bp, Homo sapiens
tctccttgataacagcta

SEQ ID NO: 6739611 - DNA, 13 bp, Homo sapiens
tctccttgatttt

SEQ ID NO: 6739612 - DNA, 14 bp, Homo sapiens
tctccttgcagttc

SEQ ID NO: 6739613 - DNA, 13 bp, Homo sapiens
tctccttgcccta

SEQ ID NO: 6739614 - DNA, 16 bp, Homo sapiens
tctccttgccctgggc

SEQ ID NO: 6739615 - DNA, 15 bp, Homo sapiens
tctccttgctaccca

SEQ ID NO: 6739616 - DNA, 14 bp, Homo sapiens
tctccttggaaggt

SEQ ID NO: 6739617 - DNA, 18 bp, Homo sapiens
tctccttggaaggtcttt

SEQ ID NO: 6739618 - DNA, 12 bp, Homo sapiens
tctccttggagg

SEQ ID NO: 6739619 - DNA, 14 bp, Homo sapiens
tctccttggaggac

SEQ ID NO: 6739620 - DNA, 14 bp, Homo sapiens
tctccttggccaca

SEQ ID NO: 6739621 - DNA, 19 bp, Homo sapiens
tctccttggcctttcctgg

SEQ ID NO: 6739622 - DNA, 20 bp, Homo sapiens
tctccttggcctttcctgga

SEQ ID NO: 6739623 - DNA, 15 bp, Homo sapiens
tctccttggctgaga

SEQ ID NO: 6739624 - DNA, 17 bp, Homo sapiens
tctccttggctgtctgt

SEQ ID NO: 6739625 - DNA, 13 bp, Homo sapiens
tctccttgggccc

SEQ ID NO: 6739626 - DNA, 14 bp, Homo sapiens
tctccttgggccct

SEQ ID NO: 6739627 - DNA, 17 bp, Homo sapiens
tctccttgggctcctgg

SEQ ID NO: 6739628 - DNA, 20 bp, Homo sapiens
tctccttgggctcctggctg

SEQ ID NO: 6739629 - DNA, 23 bp, Homo sapiens
tctccttgggctcctggctgcca

SEQ ID NO: 6739630 - DNA, 17 bp, Homo sapiens
tctccttgggctgggac

SEQ ID NO: 6739631 - DNA, 12 bp, Homo sapiens
tctccttgtact

SEQ ID NO: 6739632 - DNA, 20 bp, Homo sapiens
tctccttgtggcctgggcct

SEQ ID NO: 6739633 - DNA, 21 bp, Homo sapiens
tctccttgtgttactaagttt

SEQ ID NO: 6739634 - DNA, 16 bp, Homo sapiens
tctccttgttctgata

SEQ ID NO: 6739635 - DNA, 18 bp, Homo sapiens
tctccttgttctgataat

SEQ ID NO: 6739636 - DNA, 15 bp, Homo sapiens
tctcctttattgctc

SEQ ID NO: 6739637 - DNA, 14 bp, Homo sapiens
tctcctttcaggga

SEQ ID NO: 6739638 - DNA, 19 bp, Homo sapiens
tctcctttccttcccaggc

SEQ ID NO: 6739639 - DNA, 20 bp, Homo sapiens
tctcctttccttcccaggcc

SEQ ID NO: 6739640 - DNA, 21 bp, Homo sapiens
tctcctttctccctgcagcct

SEQ ID NO: 6739641 - DNA, 16 bp, Homo sapiens
tctcctttctgactgt

SEQ ID NO: 6739642 - DNA, 19 bp, Homo sapiens
tctcctttctgactgtccc

SEQ ID NO: 6739643 - DNA, 20 bp, Homo sapiens
tctcctttctgactgtccct

SEQ ID NO: 6739644 - DNA, 15 bp, Homo sapiens
tctcctttgaagtgg

SEQ ID NO: 6739645 - DNA, 19 bp, Homo sapiens
tctcctttgcaatagcagt

SEQ ID NO: 6739646 - DNA, 17 bp, Homo sapiens
tctcctttgcactgagg

SEQ ID NO: 6739647 - DNA, 22 bp, Homo sapiens
tctcctttgcactgagggccac

SEQ ID NO: 6739648 - DNA, 20 bp, Homo sapiens
tctctgcctgcttcctggac

SEQ ID NO: 6739649 - DNA, 13 bp, Homo sapiens
tctctgcctggca

SEQ ID NO: 6739650 - DNA, 23 bp, Homo sapiens
tctctgcctggcaacatcttact

SEQ ID NO: 6739651 - DNA, 11 bp, Homo sapiens
tctctgcctgt

SEQ ID NO: 6739652 - DNA, 14 bp, Homo sapiens
tctctgcctgtaaa

SEQ ID NO: 6739653 - DNA, 13 bp, Homo sapiens
tctctgcctgtca

SEQ ID NO: 6739654 - DNA, 21 bp, Homo sapiens
tctctgcctgtgagccagtct

SEQ ID NO: 6739655 - DNA, 18 bp, Homo sapiens
tctctgcctgttcctccc

SEQ ID NO: 6739656 - DNA, 11 bp, Homo sapiens
tctctgccttt

SEQ ID NO: 6739657 - DNA, 14 bp, Homo sapiens
tctctgcgctgagg

SEQ ID NO: 6739658 - DNA, 13 bp, Homo sapiens
tctctgctatata

SEQ ID NO: 6739659 - DNA, 12 bp, Homo sapiens
tctctgctcagt

SEQ ID NO: 6739660 - DNA, 16 bp, Homo sapiens
tctctgctcatgggtg

SEQ ID NO: 6739661 - DNA, 14 bp, Homo sapiens
tctctgctccagca

SEQ ID NO: 6739662 - DNA, 14 bp, Homo sapiens
tctctgctccctgc

SEQ ID NO: 6739663 - DNA, 11 bp, Homo sapiens
tctctgctcct

SEQ ID NO: 6739664 - DNA, 22 bp, Homo sapiens
tctctgctcgccctcctttctg

SEQ ID NO: 6739665 - DNA, 13 bp, Homo sapiens
tctctgctctagc

SEQ ID NO: 6739666 - DNA, 17 bp, Homo sapiens
tctctgctctagccagg

SEQ ID NO: 6739667 - DNA, 18 bp, Homo sapiens
tctctgctctagccagga

SEQ ID NO: 6739668 - DNA, 20 bp, Homo sapiens
tctctgctctagccaggagt

SEQ ID NO: 6739669 - DNA, 11 bp, Homo sapiens
tctctgctctg

SEQ ID NO: 6739670 - DNA, 14 bp, Homo sapiens
tctctgctcttgcc

SEQ ID NO: 6739671 - DNA, 21 bp, Homo sapiens
tctctgctcttgcctgcaccc

SEQ ID NO: 6739672 - DNA, 14 bp, Homo sapiens
tctctgctgagcag

SEQ ID NO: 6739673 - DNA, 20 bp, Homo sapiens
tctctgctgagcagcccagc

SEQ ID NO: 6739674 - DNA, 14 bp, Homo sapiens
tctctgctgagctg

SEQ ID NO: 6739675 - DNA, 19 bp, Homo sapiens
tctctgctgagctgggccc

SEQ ID NO: 6739676 - DNA, 21 bp, Homo sapiens
tctctgctgagctgggcccag

SEQ ID NO: 6739677 - DNA, 15 bp, Homo sapiens
tctctgctgcatctt

SEQ ID NO: 6739678 - DNA, 12 bp, Homo sapiens
tctctgctgccg

SEQ ID NO: 6739679 - DNA, 15 bp, Homo sapiens
tctctgctgcctctg

SEQ ID NO: 6739680 - DNA, 20 bp, Homo sapiens
tctctgctgcctctgtggaa

SEQ ID NO: 6739681 - DNA, 17 bp, Homo sapiens
tctctgctgcttctggg

SEQ ID NO: 6739682 - DNA, 19 bp, Homo sapiens
tctctgctgcttctgggcc

SEQ ID NO: 6739683 - DNA, 20 bp, Homo sapiens
tctctgctgcttctgggcct

SEQ ID NO: 6739684 - DNA, 10 bp, Homo sapiens
tctctgctgg

SEQ ID NO: 6739685 - DNA, 12 bp, Homo sapiens
tctctgctggcc

SEQ ID NO: 6739686 - DNA, 14 bp, Homo sapiens
tctctgctggccca

SEQ ID NO: 6739687 - DNA, 19 bp, Homo sapiens
tctctgcttacccttcacc

SEQ ID NO: 6739688 - DNA, 11 bp, Homo sapiens
tctctgcttcc

SEQ ID NO: 6739689 - DNA, 22 bp, Homo sapiens
tctctgcttccatggcttcctg

SEQ ID NO: 6739690 - DNA, 19 bp, Homo sapiens
tctctgcttgagtcaggtt

SEQ ID NO: 6739691 - DNA, 18 bp, Homo sapiens
tctctgcttggcttcccc

SEQ ID NO: 6739692 - DNA, 13 bp, Homo sapiens
tctctggaagaag

SEQ ID NO: 6739693 - DNA, 20 bp, Homo sapiens
tctctggaagcccctgggcc

SEQ ID NO: 6739694 - DNA, 23 bp, Homo sapiens
tctctggaaggccccttccctgg

SEQ ID NO: 6739695 - DNA, 21 bp, Homo sapiens
tctctggaaggggcagccctg

SEQ ID NO: 6739696 - DNA, 15 bp, Homo sapiens
tctctggaatttgaa

SEQ ID NO: 6739697 - DNA, 17 bp, Homo sapiens
tctctggacctgaccag

SEQ ID NO: 6739698 - DNA, 12 bp, Homo sapiens
tctctggagcca

SEQ ID NO: 6739699 - DNA, 15 bp, Homo sapiens
tctctggagccagag

SEQ ID NO: 6739700 - DNA, 22 bp, Homo sapiens
tctctggagtgatggtgtcctt

SEQ ID NO: 6739701 - DNA, 14 bp, Homo sapiens
tctctggagtgtgt

SEQ ID NO: 6739702 - DNA, 14 bp, Homo sapiens
tctctggatgcctg

SEQ ID NO: 6739703 - DNA, 15 bp, Homo sapiens
tctctggatgcctga

SEQ ID NO: 6739704 - DNA, 22 bp, Homo sapiens
tctctggatggaacgggcatgg

SEQ ID NO: 6739705 - DNA, 18 bp, Homo sapiens
tctctggattcctgtcat

SEQ ID NO: 6739706 - DNA, 15 bp, Homo sapiens
tctctggcaaacttt

SEQ ID NO: 6739707 - DNA, 15 bp, Homo sapiens
tctctggccactctg

SEQ ID NO: 6739708 - DNA, 17 bp, Homo sapiens
tctctggccactctgct

SEQ ID NO: 6739709 - DNA, 22 bp, Homo sapiens
tctctggcccagaaagcctctc

SEQ ID NO: 6739710 - DNA, 11 bp, Homo sapiens
tctctggcctc

SEQ ID NO: 6739711 - DNA, 12 bp, Homo sapiens
tctctggcctcc

SEQ ID NO: 6739712 - DNA, 19 bp, Homo sapiens
tctctggcctcccacccga

SEQ ID NO: 6739713 - DNA, 15 bp, Homo sapiens
tctctggcctcctgg

SEQ ID NO: 6739714 - DNA, 17 bp, Homo sapiens
tctctggcctcctgggg

SEQ ID NO: 6739715 - DNA, 17 bp, Homo sapiens
tctctggccttcggcct

SEQ ID NO: 6739716 - DNA, 21 bp, Homo sapiens
tctctggccttcggcctccat

SEQ ID NO: 6739717 - DNA, 17 bp, Homo sapiens
tctctggccttttccta

SEQ ID NO: 6739718 - DNA, 17 bp, Homo sapiens
tctctggctaaggacag

SEQ ID NO: 6739719 - DNA, 14 bp, Homo sapiens
tctctggctactcc

SEQ ID NO: 6739720 - DNA, 18 bp, Homo sapiens
tctctggctactccctgg

SEQ ID NO: 6739721 - DNA, 23 bp, Homo sapiens
tctctggctactccctggaccac

SEQ ID NO: 6739722 - DNA, 17 bp, Homo sapiens
tctctggctcaggtgtg

SEQ ID NO: 6739723 - DNA, 13 bp, Homo sapiens
tctctggctccag

SEQ ID NO: 6739724 - DNA, 19 bp, Homo sapiens
tctctggctctaggacccc

SEQ ID NO: 6739725 - DNA, 15 bp, Homo sapiens
tctctggctggtctt

SEQ ID NO: 6739726 - DNA, 20 bp, Homo sapiens
tctctggctgtaaggctcta

SEQ ID NO: 6739727 - DNA, 23 bp, Homo sapiens
tctctggctgtaaggctctagat

SEQ ID NO: 6739728 - DNA, 23 bp, Homo sapiens
tctctggcttccatgctccgcct

SEQ ID NO: 6739729 - DNA, 13 bp, Homo sapiens
tctctggcttctc

SEQ ID NO: 6739730 - DNA, 20 bp, Homo sapiens
tctctggcttctctcttttc

SEQ ID NO: 6739731 - DNA, 16 bp, Homo sapiens
tctctggcttctgaag

SEQ ID NO: 6739732 - DNA, 15 bp, Homo sapiens
tctctgggacctagg

SEQ ID NO: 6739733 - DNA, 14 bp, Homo sapiens
tctctgggactctc

SEQ ID NO: 6739734 - DNA, 19 bp, Homo sapiens
tctctgggactctcctcct

SEQ ID NO: 6739735 - DNA, 21 bp, Homo sapiens
tctctgggactctcctcctcc

SEQ ID NO: 6739736 - DNA, 13 bp, Homo sapiens
tctctgggagaaa

SEQ ID NO: 6739737 - DNA, 14 bp, Homo sapiens
tctctgggagaaaa

SEQ ID NO: 6739738 - DNA, 16 bp, Homo sapiens
tctctgggagaaaatc

SEQ ID NO: 6739739 - DNA, 18 bp, Homo sapiens
tctctgggagaaaatcat

SEQ ID NO: 6739740 - DNA, 22 bp, Homo sapiens
tctctgggagaaaatcatcaag

SEQ ID NO: 6739741 - DNA, 14 bp, Homo sapiens
tctctgggagccca

SEQ ID NO: 6739742 - DNA, 15 bp, Homo sapiens
tctctgggagcccag

SEQ ID NO: 6739743 - DNA, 20 bp, Homo sapiens
tctctgggagcccagaaccc

SEQ ID NO: 6739744 - DNA, 13 bp, Homo sapiens
tctctgggcacag

SEQ ID NO: 6739745 - DNA, 18 bp, Homo sapiens
tctctgggccccaggcac

SEQ ID NO: 6739746 - DNA, 17 bp, Homo sapiens
tctctgggcctcagagg

SEQ ID NO: 6739747 - DNA, 17 bp, Homo sapiens
tctctgggcctcagttt

SEQ ID NO: 6739748 - DNA, 13 bp, Homo sapiens
tctctgggcctgt

SEQ ID NO: 6739749 - DNA, 12 bp, Homo sapiens
tctctgggctga

SEQ ID NO: 6739750 - DNA, 13 bp, Homo sapiens
tctctgggctgag

SEQ ID NO: 6739751 - DNA, 16 bp, Homo sapiens
tctctgggctgagcct

SEQ ID NO: 6739752 - DNA, 23 bp, Homo sapiens
tctctgggctgagcctactgtct

SEQ ID NO: 6739753 - DNA, 15 bp, Homo sapiens
tctctgggctggatg

SEQ ID NO: 6739754 - DNA, 17 bp, Homo sapiens
tctctgggctggatgag

SEQ ID NO: 6739755 - DNA, 22 bp, Homo sapiens
tctctgggctggatgagctccc

SEQ ID NO: 6739756 - DNA, 18 bp, Homo sapiens
tctctgggctgtcagctt

SEQ ID NO: 6739757 - DNA, 21 bp, Homo sapiens
tctctgggcttggggcttcct

SEQ ID NO: 6739758 - DNA, 20 bp, Homo sapiens
tctctggggaccctccagag

SEQ ID NO: 6739759 - DNA, 16 bp, Homo sapiens
tctctggggcaggctg

SEQ ID NO: 6739760 - DNA, 16 bp, Homo sapiens
tctctggggctgtgtt

SEQ ID NO: 6739761 - DNA, 18 bp, Homo sapiens
tctctgggggaggcaggg

SEQ ID NO: 6739762 - DNA, 23 bp, Homo sapiens
tctctgggggaggcagggctgga

SEQ ID NO: 6739763 - DNA, 18 bp, Homo sapiens
tctctgggggctgaggag

SEQ ID NO: 6739764 - DNA, 16 bp, Homo sapiens
tctctgggtcagaacc

SEQ ID NO: 6739765 - DNA, 14 bp, Homo sapiens
tctctgggtcccgg

SEQ ID NO: 6739766 - DNA, 16 bp, Homo sapiens
tctctgggtcccgggg

SEQ ID NO: 6739767 - DNA, 19 bp, Homo sapiens
tctctgggtctgattttct

SEQ ID NO: 6739768 - DNA, 21 bp, Homo sapiens
tctctgggtttacaacaaaca

SEQ ID NO: 6739769 - DNA, 22 bp, Homo sapiens
tctctggtaaagttacactttt

SEQ ID NO: 6739770 - DNA, 15 bp, Homo sapiens
tctctggtctacctg

SEQ ID NO: 6739771 - DNA, 17 bp, Homo sapiens
tctctggtgagcgagga

SEQ ID NO: 6739772 - DNA, 16 bp, Homo sapiens
tctctggtggctgggc

SEQ ID NO: 6739773 - DNA, 14 bp, Homo sapiens
tctctggttgtcta

SEQ ID NO: 6739774 - DNA, 13 bp, Homo sapiens
tctctgtaagtgt

SEQ ID NO: 6739775 - DNA, 18 bp, Homo sapiens
tctctgtaataaactcat

SEQ ID NO: 6739776 - DNA, 22 bp, Homo sapiens
tctctgtaataaactcatttct

SEQ ID NO: 6739777 - DNA, 18 bp, Homo sapiens
tctctgtacaaaaacaaa

SEQ ID NO: 6739778 - DNA, 22 bp, Homo sapiens
tctctgtactaaggagaaatga

SEQ ID NO: 6739779 - DNA, 22 bp, Homo sapiens
tctctgtagttcctaatggatt

SEQ ID NO: 6739780 - DNA, 15 bp, Homo sapiens
tctctgtataaacat

SEQ ID NO: 6739781 - DNA, 22 bp, Homo sapiens
tctctgtataaacattaaatgt

SEQ ID NO: 6739782 - DNA, 22 bp, Homo sapiens
tctctgtatattgggctcagag

SEQ ID NO: 6739783 - DNA, 16 bp, Homo sapiens
tctctgtatatttatg

SEQ ID NO: 6739784 - DNA, 14 bp, Homo sapiens
tctctgtcaaggta

SEQ ID NO: 6739785 - DNA, 14 bp, Homo sapiens
tctctgtcagtgtg

SEQ ID NO: 6739786 - DNA, 14 bp, Homo sapiens
tctctgtccagggc

SEQ ID NO: 6739787 - DNA, 19 bp, Homo sapiens
tctctgtcccattccctgg

SEQ ID NO: 6739788 - DNA, 21 bp, Homo sapiens
tctctgtcccattccctggga

SEQ ID NO: 6739789 - DNA, 19 bp, Homo sapiens
tctctgtccctcactgcct

SEQ ID NO: 6739790 - DNA, 14 bp, Homo sapiens
tctctgtccctgta

SEQ ID NO: 6739791 - DNA, 16 bp, Homo sapiens
tctctgtccctgtaaa

SEQ ID NO: 6739792 - DNA, 16 bp, Homo sapiens
tctctgtcccttgctg

SEQ ID NO: 6739793 - DNA, 15 bp, Homo sapiens
tctctgtccgagtgt

SEQ ID NO: 6739794 - DNA, 11 bp, Homo sapiens
tctctgtcctc

SEQ ID NO: 6739795 - DNA, 15 bp, Homo sapiens
tctctgtcgtgcttc

SEQ ID NO: 6739796 - DNA, 16 bp, Homo sapiens
tctctgtcgtggacac

SEQ ID NO: 6739797 - DNA, 17 bp, Homo sapiens
tctctgtcgtggacacg

SEQ ID NO: 6739798 - DNA, 14 bp, Homo sapiens
tctctgtctcatcc

SEQ ID NO: 6739799 - DNA, 23 bp, Homo sapiens
tctctgtctcatccatcatcatg

SEQ ID NO: 6739800 - DNA, 18 bp, Homo sapiens
tctctgtctccaggcagt

SEQ ID NO: 6739801 - DNA, 14 bp, Homo sapiens
tctctgtctctcct

SEQ ID NO: 6739802 - DNA, 17 bp, Homo sapiens
tctctgtctctgtggaa

SEQ ID NO: 6739803 - DNA, 12 bp, Homo sapiens
tctctgtctggg

SEQ ID NO: 6739804 - DNA, 14 bp, Homo sapiens
tctctgtctgtctc

SEQ ID NO: 6739805 - DNA, 23 bp, Homo sapiens
tctctgtctgtctctccccctct

SEQ ID NO: 6739806 - DNA, 14 bp, Homo sapiens
tctctgtcttctct

SEQ ID NO: 6739807 - DNA, 19 bp, Homo sapiens
tctctgtcttctctccact

SEQ ID NO: 6739808 - DNA, 22 bp, Homo sapiens
tctctgtctttttccttcctga

SEQ ID NO: 6739809 - DNA, 21 bp, Homo sapiens
tctctgtgaaagctttggaaa

SEQ ID NO: 6739810 - DNA, 15 bp, Homo sapiens
tctctgtgaatacaa

SEQ ID NO: 6739811 - DNA, 18 bp, Homo sapiens
tctctgtgaatacaatta

SEQ ID NO: 6739812 - DNA, 19 bp, Homo sapiens
tctctgtgaatacaattaa

SEQ ID NO: 6739813 - DNA, 20 bp, Homo sapiens
tctctgtgaatacaattaaa

SEQ ID NO: 6739814 - DNA, 17 bp, Homo sapiens
tctctgtgaatccatgg

SEQ ID NO: 6739815 - DNA, 18 bp, Homo sapiens
tctctgtgacccacttct

SEQ ID NO: 6739816 - DNA, 22 bp, Homo sapiens
tctctgtgagactcgagaactt

SEQ ID NO: 6739817 - DNA, 12 bp, Homo sapiens
tctctgtgcctt

SEQ ID NO: 6739818 - DNA, 11 bp, Homo sapiens
tctctgtgctt

SEQ ID NO: 6739819 - DNA, 16 bp, Homo sapiens
tctctgtgctttgact

SEQ ID NO: 6739820 - DNA, 21 bp, Homo sapiens
tctctgtggtggttcattcca

SEQ ID NO: 6739821 - DNA, 22 bp, Homo sapiens
tctctgtggtggttcattccac

SEQ ID NO: 6739822 - DNA, 11 bp, Homo sapiens
tctctgtgtat

SEQ ID NO: 6739823 - DNA, 21 bp, Homo sapiens
tctctgtgtatttatataaaa

SEQ ID NO: 6739824 - DNA, 15 bp, Homo sapiens
tctctgtgtctaaga

SEQ ID NO: 6739825 - DNA, 17 bp, Homo sapiens
tctctgtgtctaagatt

SEQ ID NO: 6739826 - DNA, 20 bp, Homo sapiens
tctctgtgtctaagattcta

SEQ ID NO: 6739827 - DNA, 21 bp, Homo sapiens
tctctgtgtctaagattctag

SEQ ID NO: 6739828 - DNA, 20 bp, Homo sapiens
tctgacgtgccttttgcacc

SEQ ID NO: 6739829 - DNA, 13 bp, Homo sapiens
tctgactaattag

SEQ ID NO: 6739830 - DNA, 15 bp, Homo sapiens
tctgactaattaggc

SEQ ID NO: 6739831 - DNA, 22 bp, Homo sapiens
tctgactactgggcaaagagtg

SEQ ID NO: 6739832 - DNA, 14 bp, Homo sapiens
tctgactaggctga

SEQ ID NO: 6739833 - DNA, 21 bp, Homo sapiens
tctgactagtagatttctatg

SEQ ID NO: 6739834 - DNA, 13 bp, Homo sapiens
tctgactagttta

SEQ ID NO: 6739835 - DNA, 17 bp, Homo sapiens
tctgactagtttaaaga

SEQ ID NO: 6739836 - DNA, 22 bp, Homo sapiens
tctgactcaggcgcctggcaca

SEQ ID NO: 6739837 - DNA, 15 bp, Homo sapiens
tctgactcagggctc

SEQ ID NO: 6739838 - DNA, 16 bp, Homo sapiens
tctgactcatccccac

SEQ ID NO: 6739839 - DNA, 22 bp, Homo sapiens
tctgactcatccccacagctgg

SEQ ID NO: 6739840 - DNA, 16 bp, Homo sapiens
tctgactccaaagctg

SEQ ID NO: 6739841 - DNA, 16 bp, Homo sapiens
tctgactctaaaatat

SEQ ID NO: 6739842 - DNA, 13 bp, Homo sapiens
tctgactctggac

SEQ ID NO: 6739843 - DNA, 13 bp, Homo sapiens
tctgactcttatt

SEQ ID NO: 6739844 - DNA, 16 bp, Homo sapiens
tctgactcttccccag

SEQ ID NO: 6739845 - DNA, 15 bp, Homo sapiens
tctgactcttgcctt

SEQ ID NO: 6739846 - DNA, 21 bp, Homo sapiens
tctgactgaaggggcttggct

SEQ ID NO: 6739847 - DNA, 23 bp, Homo sapiens
tctgactgatcctgaacaagaaa

SEQ ID NO: 6739848 - DNA, 21 bp, Homo sapiens
tctgactgatggtttggaaaa

SEQ ID NO: 6739849 - DNA, 20 bp, Homo sapiens
tctgactgcacgtggcttct

SEQ ID NO: 6739850 - DNA, 12 bp, Homo sapiens
tctgactgccaa

SEQ ID NO: 6739851 - DNA, 13 bp, Homo sapiens
tctgactgccaag

SEQ ID NO: 6739852 - DNA, 21 bp, Homo sapiens
tctgactgtccaggagctaat

SEQ ID NO: 6739853 - DNA, 13 bp, Homo sapiens
tctgactgtccct

SEQ ID NO: 6739854 - DNA, 17 bp, Homo sapiens
tctgactgtccctgcca

SEQ ID NO: 6739855 - DNA, 13 bp, Homo sapiens
tctgactgtttat

SEQ ID NO: 6739856 - DNA, 14 bp, Homo sapiens
tctgactgtttatt

SEQ ID NO: 6739857 - DNA, 18 bp, Homo sapiens
tctgactgtttatttaag

SEQ ID NO: 6739858 - DNA, 20 bp, Homo sapiens
tctgactgtttatttaagga

SEQ ID NO: 6739859 - DNA, 14 bp, Homo sapiens
tctgacttcctctg

SEQ ID NO: 6739860 - DNA, 15 bp, Homo sapiens
tctgacttcctctga

SEQ ID NO: 6739861 - DNA, 18 bp, Homo sapiens
tctgacttctcacttcct

SEQ ID NO: 6739862 - DNA, 14 bp, Homo sapiens
tctgacttctccca

SEQ ID NO: 6739863 - DNA, 16 bp, Homo sapiens
tctgacttctgcctgg

SEQ ID NO: 6739864 - DNA, 15 bp, Homo sapiens
tctgacttctgtggt

SEQ ID NO: 6739865 - DNA, 18 bp, Homo sapiens
tctgactttacactcggc

SEQ ID NO: 6739866 - DNA, 15 bp, Homo sapiens
tctgactttacttgt

SEQ ID NO: 6739867 - DNA, 18 bp, Homo sapiens
tctgactttacttgtggt

SEQ ID NO: 6739868 - DNA, 13 bp, Homo sapiens
tctgactttctct

SEQ ID NO: 6739869 - DNA, 16 bp, Homo sapiens
tctgactttgaattta

SEQ ID NO: 6739870 - DNA, 15 bp, Homo sapiens
tctgactttttctgt

SEQ ID NO: 6739871 - DNA, 9 bp, Homo sapiens
tctgagaaa

SEQ ID NO: 6739872 - DNA, 15 bp, Homo sapiens
tctgagaaacaatga

SEQ ID NO: 6739873 - DNA, 21 bp, Homo sapiens
tctgagaaacctgttgaagat

SEQ ID NO: 6739874 - DNA, 14 bp, Homo sapiens
tctgagaaagacta

SEQ ID NO: 6739875 - DNA, 20 bp, Homo sapiens
tctgagaaagactattcaaa

SEQ ID NO: 6739876 - DNA, 21 bp, Homo sapiens
tctgagaaataggtatcaaaa

SEQ ID NO: 6739877 - DNA, 16 bp, Homo sapiens
tctgagaactgacttt

SEQ ID NO: 6739878 - DNA, 18 bp, Homo sapiens
tctgagaagacacaaggt

SEQ ID NO: 6739879 - DNA, 15 bp, Homo sapiens
tctgagaagaggagc

SEQ ID NO: 6739880 - DNA, 17 bp, Homo sapiens
tctgagaagaggtcctt

SEQ ID NO: 6739881 - DNA, 21 bp, Homo sapiens
tctgagaagcgctgccctgtg

SEQ ID NO: 6739882 - DNA, 24 bp, Homo sapiens
tctgagaagctctgaagaactctc

SEQ ID NO: 6739883 - DNA, 18 bp, Homo sapiens
tctgagaaggtccttaat

SEQ ID NO: 6739884 - DNA, 14 bp, Homo sapiens
tctgagaagtgtat

SEQ ID NO: 6739885 - DNA, 16 bp, Homo sapiens
tctgagaagtgtatat

SEQ ID NO: 6739886 - DNA, 21 bp, Homo sapiens
tctgagaatcacggtggtaaa

SEQ ID NO: 6739887 - DNA, 12 bp, Homo sapiens
tctgagaatctt

SEQ ID NO: 6739888 - DNA, 16 bp, Homo sapiens
tctgagaatgaacaaa

SEQ ID NO: 6739889 - DNA, 16 bp, Homo sapiens
tctgagaattgcaaaa

SEQ ID NO: 6739890 - DNA, 15 bp, Homo sapiens
tctgagacacacccc

SEQ ID NO: 6739891 - DNA, 15 bp, Homo sapiens
tctgagacagagagc

SEQ ID NO: 6739892 - DNA, 16 bp, Homo sapiens
tctgagacagagagcc

SEQ ID NO: 6739893 - DNA, 15 bp, Homo sapiens
tctgagacaggtgcc

SEQ ID NO: 6739894 - DNA, 22 bp, Homo sapiens
tctgagacggagtctcagtctg

SEQ ID NO: 6739895 - DNA, 22 bp, Homo sapiens
tctgagactcgcgacaatgcaa

SEQ ID NO: 6739896 - DNA, 19 bp, Homo sapiens
tctgagagacctgtgtgaa

SEQ ID NO: 6739897 - DNA, 15 bp, Homo sapiens
tctgagagagatgat

SEQ ID NO: 6739898 - DNA, 14 bp, Homo sapiens
tctgagagaggcca

SEQ ID NO: 6739899 - DNA, 16 bp, Homo sapiens
tctgagagcacagcgt

SEQ ID NO: 6739900 - DNA, 21 bp, Homo sapiens
tctgagagccccaggactggc

SEQ ID NO: 6739901 - DNA, 12 bp, Homo sapiens
tctgagagctgt

SEQ ID NO: 6739902 - DNA, 18 bp, Homo sapiens
tctgagaggacttttctt

SEQ ID NO: 6739903 - DNA, 16 bp, Homo sapiens
tctgagaggccctgga

SEQ ID NO: 6739904 - DNA, 19 bp, Homo sapiens
tctgagaggctctccgtgc

SEQ ID NO: 6739905 - DNA, 18 bp, Homo sapiens
tctgagagtctagattct

SEQ ID NO: 6739906 - DNA, 18 bp, Homo sapiens
tctgagagttggctcagg

SEQ ID NO: 6739907 - DNA, 20 bp, Homo sapiens
tctgagagttggctcaggca

SEQ ID NO: 6739908 - DNA, 21 bp, Homo sapiens
tctgagagttggctcaggcag

SEQ ID NO: 6739909 - DNA, 24 bp, Homo sapiens
tctgagatcaaaacggttttactg

SEQ ID NO: 6739910 - DNA, 22 bp, Homo sapiens
tctgagatgctaatttatttcc

SEQ ID NO: 6739911 - DNA, 18 bp, Homo sapiens
tctgagatggctcccagg

SEQ ID NO: 6739912 - DNA, 19 bp, Homo sapiens
tctgagatggctcccaggg

SEQ ID NO: 6739913 - DNA, 18 bp, Homo sapiens
tctgagatgtggagactg

SEQ ID NO: 6739914 - DNA, 15 bp, Homo sapiens
tctgagattctaaga

SEQ ID NO: 6739915 - DNA, 14 bp, Homo sapiens
tctgagattctggt

SEQ ID NO: 6739916 - DNA, 22 bp, Homo sapiens
tctgagatttttttgtgtatgt

SEQ ID NO: 6739917 - DNA, 17 bp, Homo sapiens
tctgagcaactgtgcag

SEQ ID NO: 6739918 - DNA, 22 bp, Homo sapiens
tctgagcaactgtgcagcaccc

SEQ ID NO: 6739919 - DNA, 18 bp, Homo sapiens
tctgagcaataacttcta

SEQ ID NO: 6739920 - DNA, 15 bp, Homo sapiens
tctgagcacacttta

SEQ ID NO: 6739921 - DNA, 12 bp, Homo sapiens
tctgagcacaga

SEQ ID NO: 6739922 - DNA, 14 bp, Homo sapiens
tctgagcacaggtg

SEQ ID NO: 6739923 - DNA, 20 bp, Homo sapiens
tctgagcacatagtgtcctg

SEQ ID NO: 6739924 - DNA, 22 bp, Homo sapiens
tctgagcacatttgactccact

SEQ ID NO: 6739925 - DNA, 19 bp, Homo sapiens
tctgagcaccccctcattc

SEQ ID NO: 6739926 - DNA, 21 bp, Homo sapiens
tctgagcacgggcaaagaaaa

SEQ ID NO: 6739927 - DNA, 22 bp, Homo sapiens
tctgagcagacagggcgtcctc

SEQ ID NO: 6739928 - DNA, 11 bp, Homo sapiens
tctgagcagcc

SEQ ID NO: 6739929 - DNA, 18 bp, Homo sapiens
tctgagcagcgagcctgc

SEQ ID NO: 6739930 - DNA, 12 bp, Homo sapiens
tctgagcagggg

SEQ ID NO: 6739931 - DNA, 13 bp, Homo sapiens
tctgagcaggggc

SEQ ID NO: 6739932 - DNA, 22 bp, Homo sapiens
tctgagcaggggcccctgggga

SEQ ID NO: 6739933 - DNA, 16 bp, Homo sapiens
tctgagcataatgctc

SEQ ID NO: 6739934 - DNA, 20 bp, Homo sapiens
tctgagcattagatttctca

SEQ ID NO: 6739935 - DNA, 23 bp, Homo sapiens
tctgagcattcgctgtacccttt

SEQ ID NO: 6739936 - DNA, 19 bp, Homo sapiens
tctgagccaagggagggaa

SEQ ID NO: 6739937 - DNA, 21 bp, Homo sapiens
tctgagccaagggagggaagg

SEQ ID NO: 6739938 - DNA, 21 bp, Homo sapiens
tctgagccaccgcgagggcct

SEQ ID NO: 6739939 - DNA, 14 bp, Homo sapiens
tctgagccagatta

SEQ ID NO: 6739940 - DNA, 15 bp, Homo sapiens
tctgagccaggagcc

SEQ ID NO: 6739941 - DNA, 17 bp, Homo sapiens
tctgagcccagctgcct

SEQ ID NO: 6739942 - DNA, 22 bp, Homo sapiens
tctgagcccagctgcctggaga

SEQ ID NO: 6739943 - DNA, 14 bp, Homo sapiens
tctgagcccatttc

SEQ ID NO: 6739944 - DNA, 16 bp, Homo sapiens
tctgagcccatttctg

SEQ ID NO: 6739945 - DNA, 19 bp, Homo sapiens
tctgagcccatttctgggg

SEQ ID NO: 6739946 - DNA, 21 bp, Homo sapiens
tctgagccccctgtgcccacc

SEQ ID NO: 6739947 - DNA, 19 bp, Homo sapiens
tctgagccctccctcttcc

SEQ ID NO: 6739948 - DNA, 24 bp, Homo sapiens
tctgagccctccctcttcccagca

SEQ ID NO: 6739949 - DNA, 11 bp, Homo sapiens
tctgagccctg

SEQ ID NO: 6739950 - DNA, 18 bp, Homo sapiens
tctgagccctgccctcac

SEQ ID NO: 6739951 - DNA, 22 bp, Homo sapiens
tctgagccctgccctcactcca

SEQ ID NO: 6739952 - DNA, 21 bp, Homo sapiens
tctgagccttagtttcagctg

SEQ ID NO: 6739953 - DNA, 21 bp, Homo sapiens
tctgagcgcctccatccaagg

SEQ ID NO: 6739954 - DNA, 15 bp, Homo sapiens
tctgagcggccgcct

SEQ ID NO: 6739955 - DNA, 20 bp, Homo sapiens
tctgagcggccgcctgtcct

SEQ ID NO: 6739956 - DNA, 20 bp, Homo sapiens
tctgagcggcgcagagccct

SEQ ID NO: 6739957 - DNA, 22 bp, Homo sapiens
tctgagcgtttaaagtactgag

SEQ ID NO: 6739958 - DNA, 19 bp, Homo sapiens
tctgagctagctagcgcac

SEQ ID NO: 6739959 - DNA, 22 bp, Homo sapiens
tctgagctatttcatctatttt

SEQ ID NO: 6739960 - DNA, 17 bp, Homo sapiens
tctgagctccacctctg

SEQ ID NO: 6739961 - DNA, 18 bp, Homo sapiens
tctgagctctttgcacta

SEQ ID NO: 6739962 - DNA, 18 bp, Homo sapiens
tctgagctgcagcctggc

SEQ ID NO: 6739963 - DNA, 16 bp, Homo sapiens
tctgagctgctaggaa

SEQ ID NO: 6739964 - DNA, 15 bp, Homo sapiens
tctgagctgctctga

SEQ ID NO: 6739965 - DNA, 17 bp, Homo sapiens
tctgagctgctctgaat

SEQ ID NO: 6739966 - DNA, 12 bp, Homo sapiens
tctgagctgctg

SEQ ID NO: 6739967 - DNA, 15 bp, Homo sapiens
tctgagctgtaattt

SEQ ID NO: 6739968 - DNA, 14 bp, Homo sapiens
tctgagctgtctaa

SEQ ID NO: 6739969 - DNA, 18 bp, Homo sapiens
tctgagctttgttactga

SEQ ID NO: 6739970 - DNA, 17 bp, Homo sapiens
tctgaggaagcagttgg

SEQ ID NO: 6739971 - DNA, 22 bp, Homo sapiens
tctgaggaagcagttggggccc

SEQ ID NO: 6739972 - DNA, 17 bp, Homo sapiens
tctgaggaatccagacc

SEQ ID NO: 6739973 - DNA, 22 bp, Homo sapiens
tctgaggaatccagacccggct

SEQ ID NO: 6739974 - DNA, 23 bp, Homo sapiens
tctgaggaatccagacccggctg

SEQ ID NO: 6739975 - DNA, 14 bp, Homo sapiens
tctgaggaattctg

SEQ ID NO: 6739976 - DNA, 15 bp, Homo sapiens
tctgaggaattctgt

SEQ ID NO: 6739977 - DNA, 17 bp, Homo sapiens
tctgaggacaagagaaa

SEQ ID NO: 6739978 - DNA, 18 bp, Homo sapiens
tctgaggacaagagaaaa

SEQ ID NO: 6739979 - DNA, 17 bp, Homo sapiens
tctgaggacaaggaaat

SEQ ID NO: 6739980 - DNA, 22 bp, Homo sapiens
tctgaggacaccagtgaaagaa

SEQ ID NO: 6739981 - DNA, 23 bp, Homo sapiens
tctgaggacaggctctagagaga

SEQ ID NO: 6739982 - DNA, 20 bp, Homo sapiens
tctgaggactgtcctcccac

SEQ ID NO: 6739983 - DNA, 16 bp, Homo sapiens
tctgaggagtaaaaag

SEQ ID NO: 6739984 - DNA, 20 bp, Homo sapiens
tctgaggagtaagtgtacaa

SEQ ID NO: 6739985 - DNA, 23 bp, Homo sapiens
tctgaggatagtagttaaataac

SEQ ID NO: 6739986 - DNA, 12 bp, Homo sapiens
tctgaggcaagg

SEQ ID NO: 6739987 - DNA, 17 bp, Homo sapiens
tctgaggcaaggcccag

SEQ ID NO: 6739988 - DNA, 23 bp, Homo sapiens
tctgaggcaaggcccagacctgg

SEQ ID NO: 6739989 - DNA, 15 bp, Homo sapiens
tctgaggcatcctct

SEQ ID NO: 6739990 - DNA, 12 bp, Homo sapiens
tctgaggccaga

SEQ ID NO: 6739991 - DNA, 15 bp, Homo sapiens
tctgaggccagaaag

SEQ ID NO: 6739992 - DNA, 15 bp, Homo sapiens
tctgaggccagcctg

SEQ ID NO: 6739993 - DNA, 18 bp, Homo sapiens
tctgaggccagcctggcc

SEQ ID NO: 6739994 - DNA, 19 bp, Homo sapiens
tctgaggccagcctggcct

SEQ ID NO: 6739995 - DNA, 15 bp, Homo sapiens
tctgaggcccctgcc

SEQ ID NO: 6739996 - DNA, 21 bp, Homo sapiens
tctgaggccccttaactcatc

SEQ ID NO: 6739997 - DNA, 22 bp, Homo sapiens
tctgaggccgttgctgacttag

SEQ ID NO: 6739998 - DNA, 23 bp, Homo sapiens
tctgaggcctcctctctcagttt

SEQ ID NO: 6739999 - DNA, 15 bp, Homo sapiens
tctgaggctcagccc

SEQ ID NO: 6740000 - DNA, 11 bp, Homo sapiens
tctgaggctga

SEQ ID NO: 6740001 - DNA, 23 bp, Homo sapiens
tctgaggctgaaattcagaatat

SEQ ID NO: 6740002 - DNA, 22 bp, Homo sapiens
tctgaggctggatcctagcctt

SEQ ID NO: 6740003 - DNA, 12 bp, Homo sapiens
tctgaggctgta

SEQ ID NO: 6740004 - DNA, 15 bp, Homo sapiens
tctgaggcttccaga

SEQ ID NO: 6740005 - DNA, 15 bp, Homo sapiens
tctgcaggtccctaa

SEQ ID NO: 6740006 - DNA, 16 bp, Homo sapiens
tctgcaggtccctaat

SEQ ID NO: 6740007 - DNA, 19 bp, Homo sapiens
tctgcaggtccctaataaa

SEQ ID NO: 6740008 - DNA, 16 bp, Homo sapiens
tctgcagtagtctctg

SEQ ID NO: 6740009 - DNA, 19 bp, Homo sapiens
tctgcagtagtctctgtgc

SEQ ID NO: 6740010 - DNA, 21 bp, Homo sapiens
tctgcagtagtctctgtgctt

SEQ ID NO: 6740011 - DNA, 14 bp, Homo sapiens
tctgcagtcagact

SEQ ID NO: 6740012 - DNA, 21 bp, Homo sapiens
tctgcagtcctcggcagctcc

SEQ ID NO: 6740013 - DNA, 19 bp, Homo sapiens
tctgcagtcgcttgccaaa

SEQ ID NO: 6740014 - DNA, 16 bp, Homo sapiens
tctgcagtctcatttc

SEQ ID NO: 6740015 - DNA, 13 bp, Homo sapiens
tctgcagtgcctt

SEQ ID NO: 6740016 - DNA, 22 bp, Homo sapiens
tctgcagtgtggcaagcaagag

SEQ ID NO: 6740017 - DNA, 20 bp, Homo sapiens
tctgcagttctttttgtaca

SEQ ID NO: 6740018 - DNA, 13 bp, Homo sapiens
tctgcagtttgtg

SEQ ID NO: 6740019 - DNA, 16 bp, Homo sapiens
tctgcagtttgtgaac

SEQ ID NO: 6740020 - DNA, 13 bp, Homo sapiens
tctgcataaactt

SEQ ID NO: 6740021 - DNA, 17 bp, Homo sapiens
tctgcataaacttcatc

SEQ ID NO: 6740022 - DNA, 19 bp, Homo sapiens
tctgcataaacttcatctt

SEQ ID NO: 6740023 - DNA, 13 bp, Homo sapiens
tctgcatacacat

SEQ ID NO: 6740024 - DNA, 18 bp, Homo sapiens
tctgcataccctcatcaa

SEQ ID NO: 6740025 - DNA, 21 bp, Homo sapiens
tctgcatagcgaaataaaaat

SEQ ID NO: 6740026 - DNA, 18 bp, Homo sapiens
tctgcatatgttgaatac

SEQ ID NO: 6740027 - DNA, 23 bp, Homo sapiens
tctgcatatgttttccacataaa

SEQ ID NO: 6740028 - DNA, 16 bp, Homo sapiens
tctgcatatttctgta

SEQ ID NO: 6740029 - DNA, 14 bp, Homo sapiens
tctgcatcagctgc

SEQ ID NO: 6740030 - DNA, 14 bp, Homo sapiens
tctgcatcagcttt

SEQ ID NO: 6740031 - DNA, 22 bp, Homo sapiens
tctgcatcagttcactgctgca

SEQ ID NO: 6740032 - DNA, 14 bp, Homo sapiens
tctgcatcatcatc

SEQ ID NO: 6740033 - DNA, 20 bp, Homo sapiens
tctgcatcatcatcacaacc

SEQ ID NO: 6740034 - DNA, 16 bp, Homo sapiens
tctgcatcatctgtag

SEQ ID NO: 6740035 - DNA, 22 bp, Homo sapiens
tctgcatcccagcacctgcctc

SEQ ID NO: 6740036 - DNA, 16 bp, Homo sapiens
tctgcatctcattgta

SEQ ID NO: 6740037 - DNA, 15 bp, Homo sapiens
tctgcatcttaacat

SEQ ID NO: 6740038 - DNA, 22 bp, Homo sapiens
tctgcatcttgctctgtggcct

SEQ ID NO: 6740039 - DNA, 19 bp, Homo sapiens
tctgcatgattagtgcaat

SEQ ID NO: 6740040 - DNA, 19 bp, Homo sapiens
tctgcatgcggcccagccc

SEQ ID NO: 6740041 - DNA, 22 bp, Homo sapiens
tctgcatgcggcccagcccggc

SEQ ID NO: 6740042 - DNA, 13 bp, Homo sapiens
tctgcatgctcct

SEQ ID NO: 6740043 - DNA, 19 bp, Homo sapiens
tctgcatgctcctctgcct

SEQ ID NO: 6740044 - DNA, 21 bp, Homo sapiens
tctgcatgctcctctgcctgt

SEQ ID NO: 6740045 - DNA, 12 bp, Homo sapiens
tctgcatggaaa

SEQ ID NO: 6740046 - DNA, 22 bp, Homo sapiens
tctgcatgtaaaatcttcagct

SEQ ID NO: 6740047 - DNA, 14 bp, Homo sapiens
tctgcatgtactag

SEQ ID NO: 6740048 - DNA, 13 bp, Homo sapiens
tctgcatgtttga

SEQ ID NO: 6740049 - DNA, 15 bp, Homo sapiens
tctgcatgtttgatt

SEQ ID NO: 6740050 - DNA, 13 bp, Homo sapiens
tctgcattaataa

SEQ ID NO: 6740051 - DNA, 13 bp, Homo sapiens
tctgcattatcta

SEQ ID NO: 6740052 - DNA, 22 bp, Homo sapiens
tctgcattatctatgcagcatg

SEQ ID NO: 6740053 - DNA, 22 bp, Homo sapiens
tctgcattcacagcgcctcctg

SEQ ID NO: 6740054 - DNA, 16 bp, Homo sapiens
tctgcattcattttta

SEQ ID NO: 6740055 - DNA, 15 bp, Homo sapiens
tctgcattccccgct

SEQ ID NO: 6740056 - DNA, 15 bp, Homo sapiens
tctgcattgacctgg

SEQ ID NO: 6740057 - DNA, 18 bp, Homo sapiens
tctgcattgcccagtctt

SEQ ID NO: 6740058 - DNA, 18 bp, Homo sapiens
tctgcattgctagataaa

SEQ ID NO: 6740059 - DNA, 21 bp, Homo sapiens
tctgcattgctagataaaagc

SEQ ID NO: 6740060 - DNA, 23 bp, Homo sapiens
tctgcattgttattgtggaagat

SEQ ID NO: 6740061 - DNA, 16 bp, Homo sapiens
tctgcatttagctgta

SEQ ID NO: 6740062 - DNA, 17 bp, Homo sapiens
tctgcatttataaatgt

SEQ ID NO: 6740063 - DNA, 17 bp, Homo sapiens
tctgcatttcatattat

SEQ ID NO: 6740064 - DNA, 21 bp, Homo sapiens
tctgcattttcaccccaccct

SEQ ID NO: 6740065 - DNA, 14 bp, Homo sapiens
tctgcattttctca

SEQ ID NO: 6740066 - DNA, 16 bp, Homo sapiens
tctgcattttctcagg

SEQ ID NO: 6740067 - DNA, 22 bp, Homo sapiens
tctgcattttgctattgtaaat

SEQ ID NO: 6740068 - DNA, 14 bp, Homo sapiens
tctgccaaacacat

SEQ ID NO: 6740069 - DNA, 16 bp, Homo sapiens
tctgccaacatgagga

SEQ ID NO: 6740070 - DNA, 18 bp, Homo sapiens
tctgccaacctaaaactc

SEQ ID NO: 6740071 - DNA, 13 bp, Homo sapiens
tctgccaagccct

SEQ ID NO: 6740072 - DNA, 21 bp, Homo sapiens
tctgccaaggccagcccacac

SEQ ID NO: 6740073 - DNA, 20 bp, Homo sapiens
tctgccaatgtgggctgccc

SEQ ID NO: 6740074 - DNA, 19 bp, Homo sapiens
tctgccaatttttgccttc

SEQ ID NO: 6740075 - DNA, 20 bp, Homo sapiens
tctgccacaaaaatgttcac

SEQ ID NO: 6740076 - DNA, 13 bp, Homo sapiens
tctgccacagaga

SEQ ID NO: 6740077 - DNA, 12 bp, Homo sapiens
tctgccacagca

SEQ ID NO: 6740078 - DNA, 21 bp, Homo sapiens
tctgccacagcaaggctgtcg

SEQ ID NO: 6740079 - DNA, 15 bp, Homo sapiens
tctgccaccagagac

SEQ ID NO: 6740080 - DNA, 14 bp, Homo sapiens
tctgccaccagccc

SEQ ID NO: 6740081 - DNA, 13 bp, Homo sapiens
tctgccaccagcg

SEQ ID NO: 6740082 - DNA, 15 bp, Homo sapiens
tctgccaccagcgcc

SEQ ID NO: 6740083 - DNA, 23 bp, Homo sapiens
tctgccaccagcgcccccactcc

SEQ ID NO: 6740084 - DNA, 15 bp, Homo sapiens
tctgccacccactca

SEQ ID NO: 6740085 - DNA, 13 bp, Homo sapiens
tctgccacccagg

SEQ ID NO: 6740086 - DNA, 22 bp, Homo sapiens
tctgccaccccaggtttttcat

SEQ ID NO: 6740087 - DNA, 18 bp, Homo sapiens
tctgccacctctgacgca

SEQ ID NO: 6740088 - DNA, 12 bp, Homo sapiens
tctgccacctgc

SEQ ID NO: 6740089 - DNA, 16 bp, Homo sapiens
tctgccactgaggaga

SEQ ID NO: 6740090 - DNA, 16 bp, Homo sapiens
tctgccacttctgcgg

SEQ ID NO: 6740091 - DNA, 21 bp, Homo sapiens
tctgccacttctgcgggctcc

SEQ ID NO: 6740092 - DNA, 17 bp, Homo sapiens
tctgccacttgcactgt

SEQ ID NO: 6740093 - DNA, 20 bp, Homo sapiens
tctgccacttgcactgtgct

SEQ ID NO: 6740094 - DNA, 22 bp, Homo sapiens
tctgccagatgtcctaatggtg

SEQ ID NO: 6740095 - DNA, 16 bp, Homo sapiens
tctgccagcaggaata

SEQ ID NO: 6740096 - DNA, 19 bp, Homo sapiens
tctgccagcaggaataaag

SEQ ID NO: 6740097 - DNA, 23 bp, Homo sapiens
tctgccagcaggaataaagactt

SEQ ID NO: 6740098 - DNA, 13 bp, Homo sapiens
tctgccagccaca

SEQ ID NO: 6740099 - DNA, 17 bp, Homo sapiens
tctgccagccgctggtg

SEQ ID NO: 6740100 - DNA, 20 bp, Homo sapiens
tctgccagctgggcccagca

SEQ ID NO: 6740101 - DNA, 13 bp, Homo sapiens
tctgccaggcact

SEQ ID NO: 6740102 - DNA, 19 bp, Homo sapiens
tctgccaggcactctcatc

SEQ ID NO: 6740103 - DNA, 13 bp, Homo sapiens
tctgccaggccca

SEQ ID NO: 6740104 - DNA, 14 bp, Homo sapiens
tctgccaggcccat

SEQ ID NO: 6740105 - DNA, 13 bp, Homo sapiens
tctgccagggagc

SEQ ID NO: 6740106 - DNA, 19 bp, Homo sapiens
tctgccagggagcttgaaa

SEQ ID NO: 6740107 - DNA, 12 bp, Homo sapiens
tctgccagggca

SEQ ID NO: 6740108 - DNA, 17 bp, Homo sapiens
tctgccagggcagtgct

SEQ ID NO: 6740109 - DNA, 18 bp, Homo sapiens
tctgccaggtgcttggct

SEQ ID NO: 6740110 - DNA, 19 bp, Homo sapiens
tctgccagtcgggagagcc

SEQ ID NO: 6740111 - DNA, 19 bp, Homo sapiens
tctgccagtgacagacagg

SEQ ID NO: 6740112 - DNA, 15 bp, Homo sapiens
tctgccagtggatcc

SEQ ID NO: 6740113 - DNA, 21 bp, Homo sapiens
tctgccagtggatcccctgcg

SEQ ID NO: 6740114 - DNA, 19 bp, Homo sapiens
tctgccagttacttgggct

SEQ ID NO: 6740115 - DNA, 22 bp, Homo sapiens
tctgccagttacttgggcttca

SEQ ID NO: 6740116 - DNA, 22 bp, Homo sapiens
tctgccataacagattatgtat

SEQ ID NO: 6740117 - DNA, 16 bp, Homo sapiens
tctgccatcagcccct

SEQ ID NO: 6740118 - DNA, 14 bp, Homo sapiens
tctgccatcctccc

SEQ ID NO: 6740119 - DNA, 18 bp, Homo sapiens
tctgccatgatgtttaca

SEQ ID NO: 6740120 - DNA, 21 bp, Homo sapiens
tctgccatgatgtttacaaga

SEQ ID NO: 6740121 - DNA, 16 bp, Homo sapiens
tctgccatgcccagag

SEQ ID NO: 6740122 - DNA, 17 bp, Homo sapiens
tctgccatgcccagaga

SEQ ID NO: 6740123 - DNA, 21 bp, Homo sapiens
tctgccatgggagagtccagg

SEQ ID NO: 6740124 - DNA, 14 bp, Homo sapiens
tctgccatgtccat

SEQ ID NO: 6740125 - DNA, 19 bp, Homo sapiens
tctgccatgtttttgcaaa

SEQ ID NO: 6740126 - DNA, 16 bp, Homo sapiens
tctgccattctgtgca

SEQ ID NO: 6740127 - DNA, 21 bp, Homo sapiens
tctgcccaaccaggttgcagt

SEQ ID NO: 6740128 - DNA, 17 bp, Homo sapiens
tctgcccaactttcatt

SEQ ID NO: 6740129 - DNA, 20 bp, Homo sapiens
tctgcccaactttcattggt

SEQ ID NO: 6740130 - DNA, 22 bp, Homo sapiens
tctgcccaagcagcctggagac

SEQ ID NO: 6740131 - DNA, 13 bp, Homo sapiens
tctgcccaccccg

SEQ ID NO: 6740132 - DNA, 13 bp, Homo sapiens
tctgcccaccctc

SEQ ID NO: 6740133 - DNA, 22 bp, Homo sapiens
tctgcccaccgaccccctttct

SEQ ID NO: 6740134 - DNA, 20 bp, Homo sapiens
tctgcccacctcggcctccc

SEQ ID NO: 6740135 - DNA, 14 bp, Homo sapiens
tctgcccacctggg

SEQ ID NO: 6740136 - DNA, 21 bp, Homo sapiens
tctgcccacctggggtctctc

SEQ ID NO: 6740137 - DNA, 17 bp, Homo sapiens
tctgcccaccttggcct

SEQ ID NO: 6740138 - DNA, 21 bp, Homo sapiens
tctgcccacgcagaggacgca

SEQ ID NO: 6740139 - DNA, 23 bp, Homo sapiens
tctgcccacgcagaggacgcacg

SEQ ID NO: 6740140 - DNA, 13 bp, Homo sapiens
tctgcccactccc

SEQ ID NO: 6740141 - DNA, 16 bp, Homo sapiens
tctgcccactccctgc

SEQ ID NO: 6740142 - DNA, 16 bp, Homo sapiens
tctgcccagagctggg

SEQ ID NO: 6740143 - DNA, 18 bp, Homo sapiens
tctgcccagagctgggtg

SEQ ID NO: 6740144 - DNA, 19 bp, Homo sapiens
tctgcccagagctgggtga

SEQ ID NO: 6740145 - DNA, 12 bp, Homo sapiens
tctgcccagccc

SEQ ID NO: 6740146 - DNA, 18 bp, Homo sapiens
tctgcccagccctctgtg

SEQ ID NO: 6740147 - DNA, 16 bp, Homo sapiens
tctgcccagcctgccc

SEQ ID NO: 6740148 - DNA, 13 bp, Homo sapiens
tctgcccagcttt

SEQ ID NO: 6740149 - DNA, 18 bp, Homo sapiens
tctgcccagcttttcatt

SEQ ID NO: 6740150 - DNA, 13 bp, Homo sapiens
tctgcccaggcac

SEQ ID NO: 6740151 - DNA, 20 bp, Homo sapiens
tctgcccaggggtgccccct

SEQ ID NO: 6740152 - DNA, 21 bp, Homo sapiens
tctgcccaggggtgccccctc

SEQ ID NO: 6740153 - DNA, 13 bp, Homo sapiens
tctgcccatgcct

SEQ ID NO: 6740154 - DNA, 14 bp, Homo sapiens
tctgccccaagccc

SEQ ID NO: 6740155 - DNA, 13 bp, Homo sapiens
tctgccccaaggg

SEQ ID NO: 6740156 - DNA, 16 bp, Homo sapiens
tctgccccaaggggcc

SEQ ID NO: 6740157 - DNA, 20 bp, Homo sapiens
tctgccccaaggggcccaca

SEQ ID NO: 6740158 - DNA, 15 bp, Homo sapiens
tctgccccaagtttt

SEQ ID NO: 6740159 - DNA, 16 bp, Homo sapiens
tctgccccacccacct

SEQ ID NO: 6740160 - DNA, 13 bp, Homo sapiens
tctgccccaccct

SEQ ID NO: 6740161 - DNA, 15 bp, Homo sapiens
tctgccccaccctca

SEQ ID NO: 6740162 - DNA, 22 bp, Homo sapiens
tctgccccaccttgccagggca

SEQ ID NO: 6740163 - DNA, 17 bp, Homo sapiens
tctgccccacgctgtgg

SEQ ID NO: 6740164 - DNA, 10 bp, Homo sapiens
tctgccccag

SEQ ID NO: 6740165 - DNA, 18 bp, Homo sapiens
tctgccccagaggcctct

SEQ ID NO: 6740166 - DNA, 15 bp, Homo sapiens
tctgccccagcctgt

SEQ ID NO: 6740167 - DNA, 14 bp, Homo sapiens
tctgccccagctct

SEQ ID NO: 6740168 - DNA, 20 bp, Homo sapiens
tctgccccagctctggcttc

SEQ ID NO: 6740169 - DNA, 15 bp, Homo sapiens
tctgccccaggccct

SEQ ID NO: 6740170 - DNA, 11 bp, Homo sapiens
tctgccccagt

SEQ ID NO: 6740171 - DNA, 16 bp, Homo sapiens
tctgccccagtagtca

SEQ ID NO: 6740172 - DNA, 21 bp, Homo sapiens
tctgccccatcctccagcagg

SEQ ID NO: 6740173 - DNA, 9 bp, Homo sapiens
tctgccccc

SEQ ID NO: 6740174 - DNA, 16 bp, Homo sapiens
tctgcccccagctgct

SEQ ID NO: 6740175 - DNA, 18 bp, Homo sapiens
tctgccccccagggctag

SEQ ID NO: 6740176 - DNA, 19 bp, Homo sapiens
tctgcccccgttccagctg

SEQ ID NO: 6740177 - DNA, 16 bp, Homo sapiens
tctgccccctagttca

SEQ ID NO: 6740178 - DNA, 14 bp, Homo sapiens
tctgccccctcccc

SEQ ID NO: 6740179 - DNA, 23 bp, Homo sapiens
tctgccccctcccccgcagacag

SEQ ID NO: 6740180 - DNA, 20 bp, Homo sapiens
tctgcccctaaagatgggag

SEQ ID NO: 6740181 - DNA, 17 bp, Homo sapiens
tctgcccctcagggggc

SEQ ID NO: 6740182 - DNA, 23 bp, Homo sapiens
tctgcccctcagggggccagctg

SEQ ID NO: 6740183 - DNA, 14 bp, Homo sapiens
tctgcccctccccc

SEQ ID NO: 6740184 - DNA, 17 bp, Homo sapiens
tctggacctccatccct

SEQ ID NO: 6740185 - DNA, 22 bp, Homo sapiens
tctggacctccatccctgctct

SEQ ID NO: 6740186 - DNA, 15 bp, Homo sapiens
tctggacctgaccag

SEQ ID NO: 6740187 - DNA, 13 bp, Homo sapiens
tctggacctgccc

SEQ ID NO: 6740188 - DNA, 21 bp, Homo sapiens
tctggacggcaggctcactgc

SEQ ID NO: 6740189 - DNA, 15 bp, Homo sapiens
tctggacggggatgg

SEQ ID NO: 6740190 - DNA, 19 bp, Homo sapiens
tctggacgtgaaatacttc

SEQ ID NO: 6740191 - DNA, 20 bp, Homo sapiens
tctggactaaccctgtggtt

SEQ ID NO: 6740192 - DNA, 22 bp, Homo sapiens
tctggactacacccaagcctga

SEQ ID NO: 6740193 - DNA, 22 bp, Homo sapiens
tctggactagaaaatctgagtt

SEQ ID NO: 6740194 - DNA, 13 bp, Homo sapiens
tctggactatatt

SEQ ID NO: 6740195 - DNA, 19 bp, Homo sapiens
tctggactcccactctttg

SEQ ID NO: 6740196 - DNA, 15 bp, Homo sapiens
tctggactcctctgt

SEQ ID NO: 6740197 - DNA, 16 bp, Homo sapiens
tctggactcctctgtc

SEQ ID NO: 6740198 - DNA, 22 bp, Homo sapiens
tctggactcctctgtccaggca

SEQ ID NO: 6740199 - DNA, 18 bp, Homo sapiens
tctggactctaaagacca

SEQ ID NO: 6740200 - DNA, 12 bp, Homo sapiens
tctggactctgg

SEQ ID NO: 6740201 - DNA, 15 bp, Homo sapiens
tctggactctggact

SEQ ID NO: 6740202 - DNA, 20 bp, Homo sapiens
tctggactgaagcctgcagg

SEQ ID NO: 6740203 - DNA, 17 bp, Homo sapiens
tctggactgacagcatg

SEQ ID NO: 6740204 - DNA, 14 bp, Homo sapiens
tctggactggaaag

SEQ ID NO: 6740205 - DNA, 22 bp, Homo sapiens
tctggactggcgttcacctccc

SEQ ID NO: 6740206 - DNA, 14 bp, Homo sapiens
tctggactggctag

SEQ ID NO: 6740207 - DNA, 14 bp, Homo sapiens
tctggactgttctg

SEQ ID NO: 6740208 - DNA, 20 bp, Homo sapiens
tctggacttatttttggact

SEQ ID NO: 6740209 - DNA, 20 bp, Homo sapiens
tctggactttctctaataat

SEQ ID NO: 6740210 - DNA, 11 bp, Homo sapiens
tctggagaagc

SEQ ID NO: 6740211 - DNA, 20 bp, Homo sapiens
tctggagaagctcccaggaa

SEQ ID NO: 6740212 - DNA, 18 bp, Homo sapiens
tctggagaaggcctggaa

SEQ ID NO: 6740213 - DNA, 16 bp, Homo sapiens
tctggagacagaacca

SEQ ID NO: 6740214 - DNA, 12 bp, Homo sapiens
tctggagacagc

SEQ ID NO: 6740215 - DNA, 16 bp, Homo sapiens
tctggagacagcccca

SEQ ID NO: 6740216 - DNA, 17 bp, Homo sapiens
tctggagacagccccag

SEQ ID NO: 6740217 - DNA, 20 bp, Homo sapiens
tctggagacagccccagagc

SEQ ID NO: 6740218 - DNA, 19 bp, Homo sapiens
tctggagaccaccagggca

SEQ ID NO: 6740219 - DNA, 15 bp, Homo sapiens
tctggagaccaggga

SEQ ID NO: 6740220 - DNA, 21 bp, Homo sapiens
tctggagaccagggagccttt

SEQ ID NO: 6740221 - DNA, 12 bp, Homo sapiens
tctggagagaaa

SEQ ID NO: 6740222 - DNA, 14 bp, Homo sapiens
tctggagagaacag

SEQ ID NO: 6740223 - DNA, 20 bp, Homo sapiens
tctggagagctagaacctgg

SEQ ID NO: 6740224 - DNA, 21 bp, Homo sapiens
tctggagagctagaacctgga

SEQ ID NO: 6740225 - DNA, 22 bp, Homo sapiens
tctggagagctagaacctggag

SEQ ID NO: 6740226 - DNA, 14 bp, Homo sapiens
tctggagcaaagca

SEQ ID NO: 6740227 - DNA, 23 bp, Homo sapiens
tctggagcaaagcagactatgca

SEQ ID NO: 6740228 - DNA, 17 bp, Homo sapiens
tctggagcaagagagag

SEQ ID NO: 6740229 - DNA, 22 bp, Homo sapiens
tctggagcaggtggcttgttaa

SEQ ID NO: 6740230 - DNA, 15 bp, Homo sapiens
tctggagccagagag

SEQ ID NO: 6740231 - DNA, 22 bp, Homo sapiens
tctggagccagccgagcaggag

SEQ ID NO: 6740232 - DNA, 16 bp, Homo sapiens
tctggagcccactgta

SEQ ID NO: 6740233 - DNA, 13 bp, Homo sapiens
tctggagcccctc

SEQ ID NO: 6740234 - DNA, 13 bp, Homo sapiens
tctggagcccttg

SEQ ID NO: 6740235 - DNA, 12 bp, Homo sapiens
tctggagcctgc

SEQ ID NO: 6740236 - DNA, 20 bp, Homo sapiens
tctggagcgcttcagttcag

SEQ ID NO: 6740237 - DNA, 15 bp, Homo sapiens
tctggagcggctgct

SEQ ID NO: 6740238 - DNA, 14 bp, Homo sapiens
tctggagctgtccg

SEQ ID NO: 6740239 - DNA, 14 bp, Homo sapiens
tctggaggaaaggg

SEQ ID NO: 6740240 - DNA, 18 bp, Homo sapiens
tctggaggaaagggagga

SEQ ID NO: 6740241 - DNA, 19 bp, Homo sapiens
tctggaggaagttctccag

SEQ ID NO: 6740242 - DNA, 18 bp, Homo sapiens
tctggaggcctctggccc

SEQ ID NO: 6740243 - DNA, 16 bp, Homo sapiens
tctggaggcctctggg

SEQ ID NO: 6740244 - DNA, 17 bp, Homo sapiens
tctggaggcctctgggc

SEQ ID NO: 6740245 - DNA, 16 bp, Homo sapiens
tctggaggccttccag

SEQ ID NO: 6740246 - DNA, 16 bp, Homo sapiens
tctggagggaaacacc

SEQ ID NO: 6740247 - DNA, 16 bp, Homo sapiens
tctggagggctggtgg

SEQ ID NO: 6740248 - DNA, 21 bp, Homo sapiens
tctggaggggagagctttgtg

SEQ ID NO: 6740249 - DNA, 22 bp, Homo sapiens
tctggaggggagctctgtctgt

SEQ ID NO: 6740250 - DNA, 15 bp, Homo sapiens
tctggaggggcccct

SEQ ID NO: 6740251 - DNA, 23 bp, Homo sapiens
tctggaggggcccctgcttctcc

SEQ ID NO: 6740252 - DNA, 21 bp, Homo sapiens
tctggaggtactgagacaggg

SEQ ID NO: 6740253 - DNA, 18 bp, Homo sapiens
tctggaggtcatctggcg

SEQ ID NO: 6740254 - DNA, 24 bp, Homo sapiens
tctggaggtcccagacatgctgcc

SEQ ID NO: 6740255 - DNA, 23 bp, Homo sapiens
tctggagtcacatcagtgaggag

SEQ ID NO: 6740256 - DNA, 19 bp, Homo sapiens
tctggagtcccctcctcca

SEQ ID NO: 6740257 - DNA, 14 bp, Homo sapiens
tctggagtccctcc

SEQ ID NO: 6740258 - DNA, 21 bp, Homo sapiens
tctggagtctcacttgtctca

SEQ ID NO: 6740259 - DNA, 19 bp, Homo sapiens
tctggagtctccagtggtt

SEQ ID NO: 6740260 - DNA, 15 bp, Homo sapiens
tctggagtctgaagg

SEQ ID NO: 6740261 - DNA, 23 bp, Homo sapiens
tctggagtgatggtgtccttccc

SEQ ID NO: 6740262 - DNA, 14 bp, Homo sapiens
tctggagtgattct

SEQ ID NO: 6740263 - DNA, 15 bp, Homo sapiens
tctggagtgattcta

SEQ ID NO: 6740264 - DNA, 21 bp, Homo sapiens
tctggagtgcccccagcccag

SEQ ID NO: 6740265 - DNA, 20 bp, Homo sapiens
tctggagtggtaacagctct

SEQ ID NO: 6740266 - DNA, 18 bp, Homo sapiens
tctggagttcccacccaa

SEQ ID NO: 6740267 - DNA, 21 bp, Homo sapiens
tctggagttgatctggaaccc

SEQ ID NO: 6740268 - DNA, 18 bp, Homo sapiens
tctggataacttccacag

SEQ ID NO: 6740269 - DNA, 23 bp, Homo sapiens
tctggataacttccacagggtcc

SEQ ID NO: 6740270 - DNA, 23 bp, Homo sapiens
tctggataattttgcataaaatt

SEQ ID NO: 6740271 - DNA, 21 bp, Homo sapiens
tctggataggagcctgctggt

SEQ ID NO: 6740272 - DNA, 22 bp, Homo sapiens
tctggatatatttaaaaaaaga

SEQ ID NO: 6740273 - DNA, 22 bp, Homo sapiens
tctggatatcaaggtggaaatg

SEQ ID NO: 6740274 - DNA, 18 bp, Homo sapiens
tctggatatttgcactta

SEQ ID NO: 6740275 - DNA, 19 bp, Homo sapiens
tctggatatttgcacttat

SEQ ID NO: 6740276 - DNA, 23 bp, Homo sapiens
tctggatatttgcacttatgtac

SEQ ID NO: 6740277 - DNA, 21 bp, Homo sapiens
tctggatcccgttcagaaaac

SEQ ID NO: 6740278 - DNA, 15 bp, Homo sapiens
tctggatcctgcact

SEQ ID NO: 6740279 - DNA, 19 bp, Homo sapiens
tctggatcctgctgtggcc

SEQ ID NO: 6740280 - DNA, 23 bp, Homo sapiens
tctggatcctgctgtggcctcac

SEQ ID NO: 6740281 - DNA, 17 bp, Homo sapiens
tctggatcgttatctac

SEQ ID NO: 6740282 - DNA, 23 bp, Homo sapiens
tctggatctatctgtattttcat

SEQ ID NO: 6740283 - DNA, 13 bp, Homo sapiens
tctggatctcctg

SEQ ID NO: 6740284 - DNA, 17 bp, Homo sapiens
tctggatctcctgctgc

SEQ ID NO: 6740285 - DNA, 17 bp, Homo sapiens
tctggatctgaccctcc

SEQ ID NO: 6740286 - DNA, 20 bp, Homo sapiens
tctggatctgaccctcccag

SEQ ID NO: 6740287 - DNA, 14 bp, Homo sapiens
tctggatctgggac

SEQ ID NO: 6740288 - DNA, 23 bp, Homo sapiens
tctggatgcacagatgccatggc

SEQ ID NO: 6740289 - DNA, 17 bp, Homo sapiens
tctggatgcatttctct

SEQ ID NO: 6740290 - DNA, 18 bp, Homo sapiens
tctggatgcatttctctg

SEQ ID NO: 6740291 - DNA, 19 bp, Homo sapiens
tctggatggcaccagaggc

SEQ ID NO: 6740292 - DNA, 13 bp, Homo sapiens
tctggatggccgg

SEQ ID NO: 6740293 - DNA, 21 bp, Homo sapiens
tctggatggccgggctgctgc

SEQ ID NO: 6740294 - DNA, 22 bp, Homo sapiens
tctggatggccgggctgctgct

SEQ ID NO: 6740295 - DNA, 22 bp, Homo sapiens
tctggatgggaggagagccact

SEQ ID NO: 6740296 - DNA, 23 bp, Homo sapiens
tctggatgggaggagagccactg

SEQ ID NO: 6740297 - DNA, 15 bp, Homo sapiens
tctggatgtaaatcc

SEQ ID NO: 6740298 - DNA, 13 bp, Homo sapiens
tctggatgtctgg

SEQ ID NO: 6740299 - DNA, 16 bp, Homo sapiens
tctggattagcttttc

SEQ ID NO: 6740300 - DNA, 18 bp, Homo sapiens
tctggattataaaaatga

SEQ ID NO: 6740301 - DNA, 12 bp, Homo sapiens
tctggattatat

SEQ ID NO: 6740302 - DNA, 24 bp, Homo sapiens
tctggattcaaatgtcagttcata

SEQ ID NO: 6740303 - DNA, 16 bp, Homo sapiens
tctggattcacagacc

SEQ ID NO: 6740304 - DNA, 14 bp, Homo sapiens
tctggattcagcct

SEQ ID NO: 6740305 - DNA, 15 bp, Homo sapiens
tctggattcagcctt

SEQ ID NO: 6740306 - DNA, 19 bp, Homo sapiens
tctggattcatatttaatt

SEQ ID NO: 6740307 - DNA, 19 bp, Homo sapiens
tctggattcccttttgact

SEQ ID NO: 6740308 - DNA, 20 bp, Homo sapiens
tctggattctgcctaataaa

SEQ ID NO: 6740309 - DNA, 15 bp, Homo sapiens
tctggattctgggag

SEQ ID NO: 6740310 - DNA, 20 bp, Homo sapiens
tctggattttcaaagattgt

SEQ ID NO: 6740311 - DNA, 14 bp, Homo sapiens
tctggattttgaat

SEQ ID NO: 6740312 - DNA, 18 bp, Homo sapiens
tctggcaaacgtttctca

SEQ ID NO: 6740313 - DNA, 22 bp, Homo sapiens
tctggcaaacgtttctcaaatc

SEQ ID NO: 6740314 - DNA, 18 bp, Homo sapiens
tctggcaaacttttcttt

SEQ ID NO: 6740315 - DNA, 20 bp, Homo sapiens
tctggcaaacttttctttct

SEQ ID NO: 6740316 - DNA, 14 bp, Homo sapiens
tctggcaaatgatg

SEQ ID NO: 6740317 - DNA, 15 bp, Homo sapiens
tctggcaacatcttt

SEQ ID NO: 6740318 - DNA, 14 bp, Homo sapiens
tctggcaagagcag

SEQ ID NO: 6740319 - DNA, 22 bp, Homo sapiens
tctggcaagagcagatactgtc

SEQ ID NO: 6740320 - DNA, 12 bp, Homo sapiens
tctggcaaggac

SEQ ID NO: 6740321 - DNA, 15 bp, Homo sapiens
tctggcaatgccaca

SEQ ID NO: 6740322 - DNA, 16 bp, Homo sapiens
tctggcaatgccacag

SEQ ID NO: 6740323 - DNA, 17 bp, Homo sapiens
tctggcaatgccacagc

SEQ ID NO: 6740324 - DNA, 13 bp, Homo sapiens
tctggcacagtga

SEQ ID NO: 6740325 - DNA, 13 bp, Homo sapiens
tctggcaccatgt

SEQ ID NO: 6740326 - DNA, 18 bp, Homo sapiens
tctggcaccatgttggcc

SEQ ID NO: 6740327 - DNA, 13 bp, Homo sapiens
tctggcacctggc

SEQ ID NO: 6740328 - DNA, 20 bp, Homo sapiens
tctggcacgtggccaggagc

SEQ ID NO: 6740329 - DNA, 21 bp, Homo sapiens
tctggcacgtggccaggagcc

SEQ ID NO: 6740330 - DNA, 21 bp, Homo sapiens
tctggcactattataagtgct

SEQ ID NO: 6740331 - DNA, 20 bp, Homo sapiens
tctggcagagttgaagacag

SEQ ID NO: 6740332 - DNA, 22 bp, Homo sapiens
tctggcagcaccgcctcttccc

SEQ ID NO: 6740333 - DNA, 18 bp, Homo sapiens
tctggcagccacacttct

SEQ ID NO: 6740334 - DNA, 16 bp, Homo sapiens
tctggcagcctcagag

SEQ ID NO: 6740335 - DNA, 21 bp, Homo sapiens
tctggcagcctcccatccagg

SEQ ID NO: 6740336 - DNA, 15 bp, Homo sapiens
tctggcagctcagag

SEQ ID NO: 6740337 - DNA, 17 bp, Homo sapiens
tctggcagctcagagag

SEQ ID NO: 6740338 - DNA, 18 bp, Homo sapiens
tctggcagctcagagagg

SEQ ID NO: 6740339 - DNA, 17 bp, Homo sapiens
tctggcaggacctgcct

SEQ ID NO: 6740340 - DNA, 14 bp, Homo sapiens
tctggcagggcagc

SEQ ID NO: 6740341 - DNA, 20 bp, Homo sapiens
tctggcagggtgggatggag

SEQ ID NO: 6740342 - DNA, 19 bp, Homo sapiens
tctggcaggtggccagggc

SEQ ID NO: 6740343 - DNA, 20 bp, Homo sapiens
tctggcaggtggccagggct

SEQ ID NO: 6740344 - DNA, 18 bp, Homo sapiens
tctggcagttctggaatg

SEQ ID NO: 6740345 - DNA, 23 bp, Homo sapiens
tctggcagttttgacatcagcca

SEQ ID NO: 6740346 - DNA, 18 bp, Homo sapiens
tctggcatgggacagggg

SEQ ID NO: 6740347 - DNA, 21 bp, Homo sapiens
tctggccaaatatgcactttc

SEQ ID NO: 6740348 - DNA, 13 bp, Homo sapiens
tctggccaagggc

SEQ ID NO: 6740349 - DNA, 15 bp, Homo sapiens
tctggccaagggcca

SEQ ID NO: 6740350 - DNA, 13 bp, Homo sapiens
tctggccaccctg

SEQ ID NO: 6740351 - DNA, 15 bp, Homo sapiens
tctggccaccctggc

SEQ ID NO: 6740352 - DNA, 18 bp, Homo sapiens
tctggccaccctggcccg

SEQ ID NO: 6740353 - DNA, 22 bp, Homo sapiens
tctggccactctgctctgcaca

SEQ ID NO: 6740354 - DNA, 17 bp, Homo sapiens
tctggccaggaagcttt

SEQ ID NO: 6740355 - DNA, 19 bp, Homo sapiens
tctggccaggagctggagg

SEQ ID NO: 6740356 - DNA, 11 bp, Homo sapiens
tctggccaggc

SEQ ID NO: 6740357 - DNA, 23 bp, Homo sapiens
tctggccaggcactgccttctcc

SEQ ID NO: 6740358 - DNA, 14 bp, Homo sapiens
tctggccaggcatg

SEQ ID NO: 6740359 - DNA, 17 bp, Homo sapiens
tctggcccaagctgggc

SEQ ID NO: 6740360 - DNA, 16 bp, Homo sapiens
tctgtccccaggtcct

SEQ ID NO: 6740361 - DNA, 14 bp, Homo sapiens
tctgtccccgggtt

SEQ ID NO: 6740362 - DNA, 16 bp, Homo sapiens
tctgtcccctctcccc

SEQ ID NO: 6740363 - DNA, 17 bp, Homo sapiens
tctgtcccctctcccct

SEQ ID NO: 6740364 - DNA, 19 bp, Homo sapiens
tctgtcccggggtcctgtg

SEQ ID NO: 6740365 - DNA, 17 bp, Homo sapiens
tctgtccctaaacatag

SEQ ID NO: 6740366 - DNA, 18 bp, Homo sapiens
tctgtccctaaacatagt

SEQ ID NO: 6740367 - DNA, 22 bp, Homo sapiens
tctgtccctaaacatagtggta

SEQ ID NO: 6740368 - DNA, 16 bp, Homo sapiens
tctgtccctcactgcc

SEQ ID NO: 6740369 - DNA, 12 bp, Homo sapiens
tctgtccctctt

SEQ ID NO: 6740370 - DNA, 18 bp, Homo sapiens
tctgtccctctttgcctg

SEQ ID NO: 6740371 - DNA, 14 bp, Homo sapiens
tctgtcccttcccc

SEQ ID NO: 6740372 - DNA, 17 bp, Homo sapiens
tctgtcccttccccttc

SEQ ID NO: 6740373 - DNA, 20 bp, Homo sapiens
tctgtcccttctgtccctca

SEQ ID NO: 6740374 - DNA, 23 bp, Homo sapiens
tctgtcccttctgtccctcacag

SEQ ID NO: 6740375 - DNA, 19 bp, Homo sapiens
tctgtcccttgcccccctg

SEQ ID NO: 6740376 - DNA, 15 bp, Homo sapiens
tctgtcccttgctgt

SEQ ID NO: 6740377 - DNA, 20 bp, Homo sapiens
tctgtcccttgtttttgatg

SEQ ID NO: 6740378 - DNA, 21 bp, Homo sapiens
tctgtcccttgtttttgatgt

SEQ ID NO: 6740379 - DNA, 17 bp, Homo sapiens
tctgtcccttttctttg

SEQ ID NO: 6740380 - DNA, 18 bp, Homo sapiens
tctgtcccttttctttga

SEQ ID NO: 6740381 - DNA, 15 bp, Homo sapiens
tctgtccgagtgtgc

SEQ ID NO: 6740382 - DNA, 16 bp, Homo sapiens
tctgtccgtctgtcct

SEQ ID NO: 6740383 - DNA, 17 bp, Homo sapiens
tctgtccgtctgtcctg

SEQ ID NO: 6740384 - DNA, 18 bp, Homo sapiens
tctgtccgtctgtcctgc

SEQ ID NO: 6740385 - DNA, 16 bp, Homo sapiens
tctgtccgtgcccctt

SEQ ID NO: 6740386 - DNA, 20 bp, Homo sapiens
tctgtccgtgccccttccct

SEQ ID NO: 6740387 - DNA, 20 bp, Homo sapiens
tctgtccgttcacatgtgtg

SEQ ID NO: 6740388 - DNA, 20 bp, Homo sapiens
tctgtccgtttactccaagg

SEQ ID NO: 6740389 - DNA, 14 bp, Homo sapiens
tctgtcctactctg

SEQ ID NO: 6740390 - DNA, 13 bp, Homo sapiens
tctgtcctacttc

SEQ ID NO: 6740391 - DNA, 20 bp, Homo sapiens
tctgtcctatggagcctctg

SEQ ID NO: 6740392 - DNA, 19 bp, Homo sapiens
tctgtcctcaccctgtggg

SEQ ID NO: 6740393 - DNA, 21 bp, Homo sapiens
tctgtcctcaccctgtgggac

SEQ ID NO: 6740394 - DNA, 14 bp, Homo sapiens
tctgtcctcacgcc

SEQ ID NO: 6740395 - DNA, 15 bp, Homo sapiens
tctgtcctcagagca

SEQ ID NO: 6740396 - DNA, 14 bp, Homo sapiens
tctgtcctcagcct

SEQ ID NO: 6740397 - DNA, 15 bp, Homo sapiens
tctgtcctcagcctt

SEQ ID NO: 6740398 - DNA, 22 bp, Homo sapiens
tctgtcctcccatcccctcaac

SEQ ID NO: 6740399 - DNA, 16 bp, Homo sapiens
tctgtcctctgctttg

SEQ ID NO: 6740400 - DNA, 13 bp, Homo sapiens
tctgtcctctgtc

SEQ ID NO: 6740401 - DNA, 19 bp, Homo sapiens
tctgtcctcttctgtgagt

SEQ ID NO: 6740402 - DNA, 10 bp, Homo sapiens
tctgtcctga

SEQ ID NO: 6740403 - DNA, 18 bp, Homo sapiens
tctgtcctgaaggcctga

SEQ ID NO: 6740404 - DNA, 16 bp, Homo sapiens
tctgtcctgcttctga

SEQ ID NO: 6740405 - DNA, 13 bp, Homo sapiens
tctgtcctgggca

SEQ ID NO: 6740406 - DNA, 10 bp, Homo sapiens
tctgtcctgt

SEQ ID NO: 6740407 - DNA, 21 bp, Homo sapiens
tctgtcctgtgaggtttccca

SEQ ID NO: 6740408 - DNA, 15 bp, Homo sapiens
tctgtccttccccca

SEQ ID NO: 6740409 - DNA, 17 bp, Homo sapiens
tctgtccttccttccat

SEQ ID NO: 6740410 - DNA, 13 bp, Homo sapiens
tctgtccttctga

SEQ ID NO: 6740411 - DNA, 13 bp, Homo sapiens
tctgtccttgtgt

SEQ ID NO: 6740412 - DNA, 12 bp, Homo sapiens
tctgtcctttcc

SEQ ID NO: 6740413 - DNA, 14 bp, Homo sapiens
tctgtcctttccca

SEQ ID NO: 6740414 - DNA, 14 bp, Homo sapiens
tctgtcgcccagtc

SEQ ID NO: 6740415 - DNA, 16 bp, Homo sapiens
tctgtcgcccttctcc

SEQ ID NO: 6740416 - DNA, 21 bp, Homo sapiens
tctgtcgcccttctcccggcc

SEQ ID NO: 6740417 - DNA, 23 bp, Homo sapiens
tctgtcgcccttctcccggccct

SEQ ID NO: 6740418 - DNA, 19 bp, Homo sapiens
tctgtcgccttagcatgtt

SEQ ID NO: 6740419 - DNA, 14 bp, Homo sapiens
tctgtcgtccccag

SEQ ID NO: 6740420 - DNA, 17 bp, Homo sapiens
tctgtcgtccccagacc

SEQ ID NO: 6740421 - DNA, 18 bp, Homo sapiens
tctgtcgtggagccattg

SEQ ID NO: 6740422 - DNA, 16 bp, Homo sapiens
tctgtctaccatctcc

SEQ ID NO: 6740423 - DNA, 17 bp, Homo sapiens
tctgtctactgtggtga

SEQ ID NO: 6740424 - DNA, 23 bp, Homo sapiens
tctgtctacttgctcaggtactt

SEQ ID NO: 6740425 - DNA, 13 bp, Homo sapiens
tctgtctactttc

SEQ ID NO: 6740426 - DNA, 23 bp, Homo sapiens
tctgtctactttctcttgtttaa

SEQ ID NO: 6740427 - DNA, 22 bp, Homo sapiens
tctgtctcagacttttgtacat

SEQ ID NO: 6740428 - DNA, 17 bp, Homo sapiens
tctgtctcataattgtc

SEQ ID NO: 6740429 - DNA, 17 bp, Homo sapiens
tctgtctcatccatcat

SEQ ID NO: 6740430 - DNA, 17 bp, Homo sapiens
tctgtctccagcttccc

SEQ ID NO: 6740431 - DNA, 15 bp, Homo sapiens
tctgtctccaggcag

SEQ ID NO: 6740432 - DNA, 17 bp, Homo sapiens
tctgtctcccaggctgg

SEQ ID NO: 6740433 - DNA, 22 bp, Homo sapiens
tctgtctcccagttatgaatca

SEQ ID NO: 6740434 - DNA, 16 bp, Homo sapiens
tctgtctcctgtcttc

SEQ ID NO: 6740435 - DNA, 14 bp, Homo sapiens
tctgtctccttaac

SEQ ID NO: 6740436 - DNA, 19 bp, Homo sapiens
tctgtctccttaacactga

SEQ ID NO: 6740437 - DNA, 22 bp, Homo sapiens
tctgtctccttaacactgagct

SEQ ID NO: 6740438 - DNA, 16 bp, Homo sapiens
tctgtctcgatgcctg

SEQ ID NO: 6740439 - DNA, 18 bp, Homo sapiens
tctgtctcggctctgcat

SEQ ID NO: 6740440 - DNA, 19 bp, Homo sapiens
tctgtctcggctctgcatg

SEQ ID NO: 6740441 - DNA, 22 bp, Homo sapiens
tctgtctctagtttctttctgt

SEQ ID NO: 6740442 - DNA, 23 bp, Homo sapiens
tctgtctctagtttctttctgtt

SEQ ID NO: 6740443 - DNA, 23 bp, Homo sapiens
tctgtctctccccctctgtcttc

SEQ ID NO: 6740444 - DNA, 17 bp, Homo sapiens
tctgtctctctctcttt

SEQ ID NO: 6740445 - DNA, 18 bp, Homo sapiens
tctgtctctcttgctttg

SEQ ID NO: 6740446 - DNA, 13 bp, Homo sapiens
tctgtctctgaag

SEQ ID NO: 6740447 - DNA, 12 bp, Homo sapiens
tctgtctctgcc

SEQ ID NO: 6740448 - DNA, 22 bp, Homo sapiens
tctgtctctgctcttgcctgca

SEQ ID NO: 6740449 - DNA, 22 bp, Homo sapiens
tctgtctcttggctttgtcact

SEQ ID NO: 6740450 - DNA, 18 bp, Homo sapiens
tctgtctgaatgatcttg

SEQ ID NO: 6740451 - DNA, 21 bp, Homo sapiens
tctgtctgaatgatcttgtgt

SEQ ID NO: 6740452 - DNA, 11 bp, Homo sapiens
tctgtctgagc

SEQ ID NO: 6740453 - DNA, 15 bp, Homo sapiens
tctgtctgagccctg

SEQ ID NO: 6740454 - DNA, 14 bp, Homo sapiens
tctgtctgaggtga

SEQ ID NO: 6740455 - DNA, 22 bp, Homo sapiens
tctgtctgcccttcaccccagt

SEQ ID NO: 6740456 - DNA, 14 bp, Homo sapiens
tctgtctgctcaat

SEQ ID NO: 6740457 - DNA, 15 bp, Homo sapiens
tctgtctgctctgca

SEQ ID NO: 6740458 - DNA, 22 bp, Homo sapiens
tctgtctgctggtcacttcttc

SEQ ID NO: 6740459 - DNA, 19 bp, Homo sapiens
tctgtctggaagatgggga

SEQ ID NO: 6740460 - DNA, 18 bp, Homo sapiens
tctgtctggctgtacgtc

SEQ ID NO: 6740461 - DNA, 12 bp, Homo sapiens
tctgtctgggga

SEQ ID NO: 6740462 - DNA, 14 bp, Homo sapiens
tctgtctgtatcta

SEQ ID NO: 6740463 - DNA, 16 bp, Homo sapiens
tctgtctgtcccaaag

SEQ ID NO: 6740464 - DNA, 20 bp, Homo sapiens
tctgtctgtcctacccgccc

SEQ ID NO: 6740465 - DNA, 17 bp, Homo sapiens
tctgtctgtcgcccttc

SEQ ID NO: 6740466 - DNA, 16 bp, Homo sapiens
tctgtctgtctctccc

SEQ ID NO: 6740467 - DNA, 15 bp, Homo sapiens
tctgtctgtctgtcc

SEQ ID NO: 6740468 - DNA, 18 bp, Homo sapiens
tctgtctgtctgtcccaa

SEQ ID NO: 6740469 - DNA, 15 bp, Homo sapiens
tctgtctgtctgtgg

SEQ ID NO: 6740470 - DNA, 13 bp, Homo sapiens
tctgtctgtgcac

SEQ ID NO: 6740471 - DNA, 16 bp, Homo sapiens
tctgtctgtgggcttc

SEQ ID NO: 6740472 - DNA, 17 bp, Homo sapiens
tctgtctgtgggcttca

SEQ ID NO: 6740473 - DNA, 15 bp, Homo sapiens
tctgtcttaaagaat

SEQ ID NO: 6740474 - DNA, 17 bp, Homo sapiens
tctgtcttcaagggctt

SEQ ID NO: 6740475 - DNA, 15 bp, Homo sapiens
tctgtcttcacaaca

SEQ ID NO: 6740476 - DNA, 14 bp, Homo sapiens
tctgtcttcacagc

SEQ ID NO: 6740477 - DNA, 15 bp, Homo sapiens
tctgtcttcacctga

SEQ ID NO: 6740478 - DNA, 13 bp, Homo sapiens
tctgtcttctcct

SEQ ID NO: 6740479 - DNA, 13 bp, Homo sapiens
tctgtcttggcat

SEQ ID NO: 6740480 - DNA, 15 bp, Homo sapiens
tctgtcttggcatta

SEQ ID NO: 6740481 - DNA, 17 bp, Homo sapiens
tctgtcttggcattaaa

SEQ ID NO: 6740482 - DNA, 12 bp, Homo sapiens
tctgtcttgtaa

SEQ ID NO: 6740483 - DNA, 11 bp, Homo sapiens
tctgtctttcc

SEQ ID NO: 6740484 - DNA, 21 bp, Homo sapiens
tctgtctttcctgaaccatgt

SEQ ID NO: 6740485 - DNA, 14 bp, Homo sapiens
tctgtctttctata

SEQ ID NO: 6740486 - DNA, 23 bp, Homo sapiens
tctgtctttgcggggcctgtctc

SEQ ID NO: 6740487 - DNA, 24 bp, Homo sapiens
tctgtctttgcggggcctgtctca

SEQ ID NO: 6740488 - DNA, 17 bp, Homo sapiens
tctgtcttttctcctcc

SEQ ID NO: 6740489 - DNA, 15 bp, Homo sapiens
tctgtctttttcctt

SEQ ID NO: 6740490 - DNA, 20 bp, Homo sapiens
tctgtctttttccttcctga

SEQ ID NO: 6740491 - DNA, 14 bp, Homo sapiens
tctgtgaaactatc

SEQ ID NO: 6740492 - DNA, 13 bp, Homo sapiens
tctgtgaaagcct

SEQ ID NO: 6740493 - DNA, 14 bp, Homo sapiens
tctgtgaaagcctt

SEQ ID NO: 6740494 - DNA, 23 bp, Homo sapiens
tctgtgaaagtctcctgtatcat

SEQ ID NO: 6740495 - DNA, 14 bp, Homo sapiens
tctgtgaaatcaga

SEQ ID NO: 6740496 - DNA, 19 bp, Homo sapiens
tctgtgaaattctcagagt

SEQ ID NO: 6740497 - DNA, 21 bp, Homo sapiens
tctgtgaaattctcagagtgt

SEQ ID NO: 6740498 - DNA, 16 bp, Homo sapiens
tctgtgaacatgttaa

SEQ ID NO: 6740499 - DNA, 21 bp, Homo sapiens
tctgtgaacgatttagaaaga

SEQ ID NO: 6740500 - DNA, 13 bp, Homo sapiens
tctgtgaactgtg

SEQ ID NO: 6740501 - DNA, 14 bp, Homo sapiens
tctgtgaacttgaa

SEQ ID NO: 6740502 - DNA, 21 bp, Homo sapiens
tctgtgaagaagccctgttct

SEQ ID NO: 6740503 - DNA, 15 bp, Homo sapiens
tctgtgaagaatgaa

SEQ ID NO: 6740504 - DNA, 18 bp, Homo sapiens
tctgtgaagcctttatct

SEQ ID NO: 6740505 - DNA, 20 bp, Homo sapiens
tctgtgaagcctttatctat

SEQ ID NO: 6740506 - DNA, 21 bp, Homo sapiens
tctgtgaagttgaataaacat

SEQ ID NO: 6740507 - DNA, 13 bp, Homo sapiens
tctgtgaatagca

SEQ ID NO: 6740508 - DNA, 18 bp, Homo sapiens
tctgtgaatccatgggtc

SEQ ID NO: 6740509 - DNA, 15 bp, Homo sapiens
tctgtgaatgctaag

SEQ ID NO: 6740510 - DNA, 22 bp, Homo sapiens
tctgtgaattaaaaaagctcaa

SEQ ID NO: 6740511 - DNA, 19 bp, Homo sapiens
tctgtgaatttcagaggtc

SEQ ID NO: 6740512 - DNA, 23 bp, Homo sapiens
tctgtgacaaatgttgacctttg

SEQ ID NO: 6740513 - DNA, 16 bp, Homo sapiens
tctgtgacatttatgt

SEQ ID NO: 6740514 - DNA, 16 bp, Homo sapiens
tctgtgaccaactgtt

SEQ ID NO: 6740515 - DNA, 18 bp, Homo sapiens
tctgtgaccaatgtcttg

SEQ ID NO: 6740516 - DNA, 19 bp, Homo sapiens
tctgtgaccaatgtcttga

SEQ ID NO: 6740517 - DNA, 16 bp, Homo sapiens
tctgtgacccatctgt

SEQ ID NO: 6740518 - DNA, 20 bp, Homo sapiens
tctgtgacccatctgtagta

SEQ ID NO: 6740519 - DNA, 14 bp, Homo sapiens
tctgtgacctcagg

SEQ ID NO: 6740520 - DNA, 15 bp, Homo sapiens
tctgtgacctcaggc

SEQ ID NO: 6740521 - DNA, 14 bp, Homo sapiens
tctgtgacctctga

SEQ ID NO: 6740522 - DNA, 21 bp, Homo sapiens
tctgtgacgcagacagagggg

SEQ ID NO: 6740523 - DNA, 17 bp, Homo sapiens
tctgtgactataaagct

SEQ ID NO: 6740524 - DNA, 18 bp, Homo sapiens
tctgtgactataaagctg

SEQ ID NO: 6740525 - DNA, 19 bp, Homo sapiens
tctgtgactataaagctgt

SEQ ID NO: 6740526 - DNA, 21 bp, Homo sapiens
tctgtgactcgcttagctgaa

SEQ ID NO: 6740527 - DNA, 14 bp, Homo sapiens
tctgtgactggatc

SEQ ID NO: 6740528 - DNA, 15 bp, Homo sapiens
tctgtgactggatct

SEQ ID NO: 6740529 - DNA, 14 bp, Homo sapiens
tctgtgagaagttt

SEQ ID NO: 6740530 - DNA, 17 bp, Homo sapiens
tctgtgagactcgagaa

SEQ ID NO: 6740531 - DNA, 14 bp, Homo sapiens
tctgtgagatgcta

SEQ ID NO: 6740532 - DNA, 17 bp, Homo sapiens
tctgtgagatgctagaa

SEQ ID NO: 6740533 - DNA, 23 bp, Homo sapiens
tctgtgagatgctagaactccct

SEQ ID NO: 6740534 - DNA, 20 bp, Homo sapiens
tctgtgagcatcacagtttt

SEQ ID NO: 6740535 - DNA, 18 bp, Homo sapiens
tctgtgaggtgctgatga

SEQ ID NO: 6740536 - DNA, 22 bp, Homo sapiens
tctgtgagtgaaagttgccatt

SEQ ID NO: 6740537 - DNA, 20 bp, Homo sapiens
tctgtgagtgcgtctgaggg

SEQ ID NO: 6740538 - DNA, 18 bp, Homo sapiens
tctgtgatccttggtgct

SEQ ID NO: 6740539 - DNA, 19 bp, Homo sapiens
tcttaatctcacttcatca

SEQ ID NO: 6740540 - DNA, 12 bp, Homo sapiens
tcttaatctgtg

SEQ ID NO: 6740541 - DNA, 17 bp, Homo sapiens
tcttaatcttttcacaa

SEQ ID NO: 6740542 - DNA, 18 bp, Homo sapiens
tcttaatcttttcacaaa

SEQ ID NO: 6740543 - DNA, 18 bp, Homo sapiens
tcttaatgaagtttgaat

SEQ ID NO: 6740544 - DNA, 21 bp, Homo sapiens
tcttaatgctttcctccctgg

SEQ ID NO: 6740545 - DNA, 19 bp, Homo sapiens
tcttaatggatgaaatcat

SEQ ID NO: 6740546 - DNA, 17 bp, Homo sapiens
tcttaatgtatcaaact

SEQ ID NO: 6740547 - DNA, 15 bp, Homo sapiens
tcttaatgtctcaaa

SEQ ID NO: 6740548 - DNA, 13 bp, Homo sapiens
tcttaatgtctgt

SEQ ID NO: 6740549 - DNA, 18 bp, Homo sapiens
tcttaatgtctgtcagaa

SEQ ID NO: 6740550 - DNA, 15 bp, Homo sapiens
tcttaatgttcctca

SEQ ID NO: 6740551 - DNA, 14 bp, Homo sapiens
tcttaattaagtaa

SEQ ID NO: 6740552 - DNA, 19 bp, Homo sapiens
tcttaattaagtaaactaa

SEQ ID NO: 6740553 - DNA, 15 bp, Homo sapiens
tcttaattaatttga

SEQ ID NO: 6740554 - DNA, 23 bp, Homo sapiens
tcttaattaatttgattaacaaa

SEQ ID NO: 6740555 - DNA, 22 bp, Homo sapiens
tcttaattattataaaaatatt

SEQ ID NO: 6740556 - DNA, 20 bp, Homo sapiens
tcttaattattatttgtgtt

SEQ ID NO: 6740557 - DNA, 14 bp, Homo sapiens
tcttaattctctgc

SEQ ID NO: 6740558 - DNA, 14 bp, Homo sapiens
tcttaattctgatg

SEQ ID NO: 6740559 - DNA, 18 bp, Homo sapiens
tcttaattctgatgctag

SEQ ID NO: 6740560 - DNA, 17 bp, Homo sapiens
tcttaattctttgttct

SEQ ID NO: 6740561 - DNA, 20 bp, Homo sapiens
tcttaattctttgttctgtt

SEQ ID NO: 6740562 - DNA, 11 bp, Homo sapiens
tcttaattgcc

SEQ ID NO: 6740563 - DNA, 13 bp, Homo sapiens
tcttaattgtgtt

SEQ ID NO: 6740564 - DNA, 18 bp, Homo sapiens
tcttaattgtgtttattt

SEQ ID NO: 6740565 - DNA, 22 bp, Homo sapiens
tcttaattgtgtttatttttta

SEQ ID NO: 6740566 - DNA, 18 bp, Homo sapiens
tcttaatttggaaactaa

SEQ ID NO: 6740567 - DNA, 19 bp, Homo sapiens
tcttaatttggaaactaat

SEQ ID NO: 6740568 - DNA, 17 bp, Homo sapiens
tcttaatttggataata

SEQ ID NO: 6740569 - DNA, 16 bp, Homo sapiens
tcttaattttaaagac

SEQ ID NO: 6740570 - DNA, 16 bp, Homo sapiens
tcttaattttctaaaa

SEQ ID NO: 6740571 - DNA, 19 bp, Homo sapiens
tcttaattttggttgtatt

SEQ ID NO: 6740572 - DNA, 20 bp, Homo sapiens
tcttaattttggttgtattc

SEQ ID NO: 6740573 - DNA, 16 bp, Homo sapiens
tcttacaaaatacaca

SEQ ID NO: 6740574 - DNA, 14 bp, Homo sapiens
tcttacaaacatgt

SEQ ID NO: 6740575 - DNA, 14 bp, Homo sapiens
tcttacaagcttaa

SEQ ID NO: 6740576 - DNA, 19 bp, Homo sapiens
tcttacaagcttaaagctt

SEQ ID NO: 6740577 - DNA, 21 bp, Homo sapiens
tcttacaaggcaggcctttcc

SEQ ID NO: 6740578 - DNA, 21 bp, Homo sapiens
tcttacaatattgattgggaa

SEQ ID NO: 6740579 - DNA, 16 bp, Homo sapiens
tcttacacaagagctg

SEQ ID NO: 6740580 - DNA, 18 bp, Homo sapiens
tcttacacacccccagag

SEQ ID NO: 6740581 - DNA, 13 bp, Homo sapiens
tcttacacactgt

SEQ ID NO: 6740582 - DNA, 16 bp, Homo sapiens
tcttacacactgtctg

SEQ ID NO: 6740583 - DNA, 16 bp, Homo sapiens
tcttacacatacagtt

SEQ ID NO: 6740584 - DNA, 21 bp, Homo sapiens
tcttacacccgacgcttacca

SEQ ID NO: 6740585 - DNA, 20 bp, Homo sapiens
tcttacaccgtgaggccaag

SEQ ID NO: 6740586 - DNA, 17 bp, Homo sapiens
tcttacacgaagaaata

SEQ ID NO: 6740587 - DNA, 17 bp, Homo sapiens
tcttacactgcctgtat

SEQ ID NO: 6740588 - DNA, 22 bp, Homo sapiens
tcttacactgcctgtatacttt

SEQ ID NO: 6740589 - DNA, 13 bp, Homo sapiens
tcttacagagcct

SEQ ID NO: 6740590 - DNA, 16 bp, Homo sapiens
tcttacagagccttga

SEQ ID NO: 6740591 - DNA, 19 bp, Homo sapiens
tcttacagcacatcacctc

SEQ ID NO: 6740592 - DNA, 21 bp, Homo sapiens
tcttacagcacatcacctctt

SEQ ID NO: 6740593 - DNA, 13 bp, Homo sapiens
tcttacagccaga

SEQ ID NO: 6740594 - DNA, 12 bp, Homo sapiens
tcttacatgtat

SEQ ID NO: 6740595 - DNA, 14 bp, Homo sapiens
tcttacatgttttc

SEQ ID NO: 6740596 - DNA, 17 bp, Homo sapiens
tcttacatttctcaccc

SEQ ID NO: 6740597 - DNA, 19 bp, Homo sapiens
tcttacattttcgtcctgt

SEQ ID NO: 6740598 - DNA, 19 bp, Homo sapiens
tcttaccaattgtgaatgt

SEQ ID NO: 6740599 - DNA, 23 bp, Homo sapiens
tcttaccactaagccattctgtc

SEQ ID NO: 6740600 - DNA, 17 bp, Homo sapiens
tcttaccactagttgct

SEQ ID NO: 6740601 - DNA, 14 bp, Homo sapiens
tcttaccagatgct

SEQ ID NO: 6740602 - DNA, 15 bp, Homo sapiens
tcttaccagatgcta

SEQ ID NO: 6740603 - DNA, 20 bp, Homo sapiens
tcttaccagggagatttgct

SEQ ID NO: 6740604 - DNA, 14 bp, Homo sapiens
tcttaccagtctcc

SEQ ID NO: 6740605 - DNA, 18 bp, Homo sapiens
tcttaccatgcatttctc

SEQ ID NO: 6740606 - DNA, 16 bp, Homo sapiens
tcttacccaatttccc

SEQ ID NO: 6740607 - DNA, 14 bp, Homo sapiens
tcttacccacttcc

SEQ ID NO: 6740608 - DNA, 15 bp, Homo sapiens
tcttacccacttccc

SEQ ID NO: 6740609 - DNA, 17 bp, Homo sapiens
tcttacccagattgtgt

SEQ ID NO: 6740610 - DNA, 18 bp, Homo sapiens
tcttacccagattgtgta

SEQ ID NO: 6740611 - DNA, 20 bp, Homo sapiens
tcttaccctagttctcttat

SEQ ID NO: 6740612 - DNA, 15 bp, Homo sapiens
tcttaccctctcttt

SEQ ID NO: 6740613 - DNA, 18 bp, Homo sapiens
tcttacccttctgtgccc

SEQ ID NO: 6740614 - DNA, 14 bp, Homo sapiens
tcttaccgaaatga

SEQ ID NO: 6740615 - DNA, 22 bp, Homo sapiens
tcttaccgacaagcacagtcag

SEQ ID NO: 6740616 - DNA, 23 bp, Homo sapiens
tcttaccgagaaaaggagaaagg

SEQ ID NO: 6740617 - DNA, 20 bp, Homo sapiens
tcttacctgtaatagcctca

SEQ ID NO: 6740618 - DNA, 21 bp, Homo sapiens
tcttacctgttatttatcaat

SEQ ID NO: 6740619 - DNA, 15 bp, Homo sapiens
tcttacgaatatttt

SEQ ID NO: 6740620 - DNA, 15 bp, Homo sapiens
tcttacgctctctgt

SEQ ID NO: 6740621 - DNA, 18 bp, Homo sapiens
tcttacgctctgctcaat

SEQ ID NO: 6740622 - DNA, 24 bp, Homo sapiens
tcttactaaacattttgttattgg

SEQ ID NO: 6740623 - DNA, 21 bp, Homo sapiens
tcttactcaagatactggact

SEQ ID NO: 6740624 - DNA, 20 bp, Homo sapiens
tcttactcattactgcaaat

SEQ ID NO: 6740625 - DNA, 17 bp, Homo sapiens
tcttactcctcctcttt

SEQ ID NO: 6740626 - DNA, 15 bp, Homo sapiens
tcttactctttccta

SEQ ID NO: 6740627 - DNA, 13 bp, Homo sapiens
tcttactgaaggt

SEQ ID NO: 6740628 - DNA, 14 bp, Homo sapiens
tcttactgcaaatg

SEQ ID NO: 6740629 - DNA, 22 bp, Homo sapiens
tcttactgcaaatgtcatcaga

SEQ ID NO: 6740630 - DNA, 16 bp, Homo sapiens
tcttactgttttgtgc

SEQ ID NO: 6740631 - DNA, 17 bp, Homo sapiens
tcttactgttttgtgcg

SEQ ID NO: 6740632 - DNA, 13 bp, Homo sapiens
tcttacttaaaaa

SEQ ID NO: 6740633 - DNA, 19 bp, Homo sapiens
tcttacttgagtatcataa

SEQ ID NO: 6740634 - DNA, 21 bp, Homo sapiens
tcttacttgagtatcataata

SEQ ID NO: 6740635 - DNA, 22 bp, Homo sapiens
tcttacttgagtatcataatat

SEQ ID NO: 6740636 - DNA, 18 bp, Homo sapiens
tcttacttgcaaaatgga

SEQ ID NO: 6740637 - DNA, 15 bp, Homo sapiens
tcttacttggaactg

SEQ ID NO: 6740638 - DNA, 15 bp, Homo sapiens
tcttactttcagttt

SEQ ID NO: 6740639 - DNA, 19 bp, Homo sapiens
tcttactttcctgaaaata

SEQ ID NO: 6740640 - DNA, 22 bp, Homo sapiens
tcttactttcctttccccagcc

SEQ ID NO: 6740641 - DNA, 13 bp, Homo sapiens
tcttactttgctt

SEQ ID NO: 6740642 - DNA, 15 bp, Homo sapiens
tcttactttgcttga

SEQ ID NO: 6740643 - DNA, 14 bp, Homo sapiens
tcttactttgtaaa

SEQ ID NO: 6740644 - DNA, 19 bp, Homo sapiens
tcttactttgtgcaaaagc

SEQ ID NO: 6740645 - DNA, 15 bp, Homo sapiens
tcttactttgttaat

SEQ ID NO: 6740646 - DNA, 16 bp, Homo sapiens
tcttactttgttaatt

SEQ ID NO: 6740647 - DNA, 17 bp, Homo sapiens
tcttacttttaaatgca

SEQ ID NO: 6740648 - DNA, 12 bp, Homo sapiens
tcttacttttat

SEQ ID NO: 6740649 - DNA, 16 bp, Homo sapiens
tcttactttttgtaaa

SEQ ID NO: 6740650 - DNA, 14 bp, Homo sapiens
tcttagaaactcag

SEQ ID NO: 6740651 - DNA, 14 bp, Homo sapiens
tcttagaaatgaag

SEQ ID NO: 6740652 - DNA, 15 bp, Homo sapiens
tcttagaaatgaagg

SEQ ID NO: 6740653 - DNA, 11 bp, Homo sapiens
tcttagaaatt

SEQ ID NO: 6740654 - DNA, 19 bp, Homo sapiens
tcttagaacagatggctgt

SEQ ID NO: 6740655 - DNA, 23 bp, Homo sapiens
tcttagaacagatggctgtgaaa

SEQ ID NO: 6740656 - DNA, 21 bp, Homo sapiens
tcttagaacagtggaaactat

SEQ ID NO: 6740657 - DNA, 15 bp, Homo sapiens
tcttagaactctgct

SEQ ID NO: 6740658 - DNA, 13 bp, Homo sapiens
tcttagaagaata

SEQ ID NO: 6740659 - DNA, 15 bp, Homo sapiens
tcttagaagaatatt

SEQ ID NO: 6740660 - DNA, 20 bp, Homo sapiens
tcttagaagaatattgtatt

SEQ ID NO: 6740661 - DNA, 19 bp, Homo sapiens
tcttagaagctcacgcctt

SEQ ID NO: 6740662 - DNA, 21 bp, Homo sapiens
tcttagaagtggaccaggaca

SEQ ID NO: 6740663 - DNA, 18 bp, Homo sapiens
tcttagaatttgtttcat

SEQ ID NO: 6740664 - DNA, 20 bp, Homo sapiens
tcttagactacatttagaga

SEQ ID NO: 6740665 - DNA, 17 bp, Homo sapiens
tcttagagccttagcag

SEQ ID NO: 6740666 - DNA, 22 bp, Homo sapiens
tcttagagccttagcagccctg

SEQ ID NO: 6740667 - DNA, 23 bp, Homo sapiens
tcttagagccttttatctgcaga

SEQ ID NO: 6740668 - DNA, 19 bp, Homo sapiens
tcttagaggtccatggaga

SEQ ID NO: 6740669 - DNA, 16 bp, Homo sapiens
tcttagagtttacagt

SEQ ID NO: 6740670 - DNA, 20 bp, Homo sapiens
tcttagagtttacagtttgt

SEQ ID NO: 6740671 - DNA, 12 bp, Homo sapiens
tcttagataact

SEQ ID NO: 6740672 - DNA, 22 bp, Homo sapiens
tcttagataacttcttgaaaaa

SEQ ID NO: 6740673 - DNA, 21 bp, Homo sapiens
tcttagatatctttttattga

SEQ ID NO: 6740674 - DNA, 23 bp, Homo sapiens
tcttagatattcactaaggactt

SEQ ID NO: 6740675 - DNA, 22 bp, Homo sapiens
tcttagatgcagttctgaagaa

SEQ ID NO: 6740676 - DNA, 14 bp, Homo sapiens
tcttagattcttaa

SEQ ID NO: 6740677 - DNA, 17 bp, Homo sapiens
tcttagcaataaatgct

SEQ ID NO: 6740678 - DNA, 19 bp, Homo sapiens
tcttagcaataaatgcttt

SEQ ID NO: 6740679 - DNA, 16 bp, Homo sapiens
tcttagcagcttccag

SEQ ID NO: 6740680 - DNA, 18 bp, Homo sapiens
tcttagcagtgattttta

SEQ ID NO: 6740681 - DNA, 11 bp, Homo sapiens
tcttagcatgg

SEQ ID NO: 6740682 - DNA, 22 bp, Homo sapiens
tcttagcctgtggcagtaaaga

SEQ ID NO: 6740683 - DNA, 18 bp, Homo sapiens
tcttagctatccttggct

SEQ ID NO: 6740684 - DNA, 18 bp, Homo sapiens
tcttagctcaatgagcat

SEQ ID NO: 6740685 - DNA, 14 bp, Homo sapiens
tcttagctcccctc

SEQ ID NO: 6740686 - DNA, 12 bp, Homo sapiens
tcttagctctgg

SEQ ID NO: 6740687 - DNA, 19 bp, Homo sapiens
tcttagctctggacgtgaa

SEQ ID NO: 6740688 - DNA, 23 bp, Homo sapiens
tcttagctgaggctgagaaagct

SEQ ID NO: 6740689 - DNA, 16 bp, Homo sapiens
tcttagctgatgtctt

SEQ ID NO: 6740690 - DNA, 14 bp, Homo sapiens
tcttagctgccaag

SEQ ID NO: 6740691 - DNA, 22 bp, Homo sapiens
tcttagctggatataatgtatt

SEQ ID NO: 6740692 - DNA, 23 bp, Homo sapiens
tcttagctgtctgctcagacaga

SEQ ID NO: 6740693 - DNA, 16 bp, Homo sapiens
tcttagcttacaggaa

SEQ ID NO: 6740694 - DNA, 17 bp, Homo sapiens
tcttagcttacaggaag

SEQ ID NO: 6740695 - DNA, 15 bp, Homo sapiens
tcttagctttacatt

SEQ ID NO: 6740696 - DNA, 14 bp, Homo sapiens
tcttagctttttaa

SEQ ID NO: 6740697 - DNA, 16 bp, Homo sapiens
tcttagctttttaatt

SEQ ID NO: 6740698 - DNA, 21 bp, Homo sapiens
tcttagctttttaattgttgt

SEQ ID NO: 6740699 - DNA, 20 bp, Homo sapiens
tcttaggaattgaattaata

SEQ ID NO: 6740700 - DNA, 14 bp, Homo sapiens
tcttaggagcagag

SEQ ID NO: 6740701 - DNA, 19 bp, Homo sapiens
tcttaggagcagagctctg

SEQ ID NO: 6740702 - DNA, 16 bp, Homo sapiens
tcttaggatatttgag

SEQ ID NO: 6740703 - DNA, 17 bp, Homo sapiens
tcttaggccaggcgtgg

SEQ ID NO: 6740704 - DNA, 17 bp, Homo sapiens
tcttagggaactttgat

SEQ ID NO: 6740705 - DNA, 18 bp, Homo sapiens
tcttagggtacagcccag

SEQ ID NO: 6740706 - DNA, 15 bp, Homo sapiens
tcttaggtcagatgg

SEQ ID NO: 6740707 - DNA, 17 bp, Homo sapiens
tcttaggtcccgggagg

SEQ ID NO: 6740708 - DNA, 18 bp, Homo sapiens
tcttaggtcttcctgtgg

SEQ ID NO: 6740709 - DNA, 19 bp, Homo sapiens
tcttaggtttactgtgaag

SEQ ID NO: 6740710 - DNA, 20 bp, Homo sapiens
tcttaggtttgttttttcat

SEQ ID NO: 6740711 - DNA, 14 bp, Homo sapiens
tcttagtagatttt

SEQ ID NO: 6740712 - DNA, 23 bp, Homo sapiens
tcttagtccctaatcatgtttct

SEQ ID NO: 6740713 - DNA, 17 bp, Homo sapiens
tcttagtctaggtcctt

SEQ ID NO: 6740714 - DNA, 17 bp, Homo sapiens
tcttagtgcaaaaaaca

SEQ ID NO: 6740715 - DNA, 15 bp, Homo sapiens
tcttagtgcccgcct

SEQ ID NO: 6740716 - DNA, 17 bp, Homo sapiens
tcttagtggaagacaat

SEQ ID NO: 6740717 - DNA, 22 bp, Homo sapiens
tcttccttgaagaactgcaggc

SEQ ID NO: 6740718 - DNA, 14 bp, Homo sapiens
tcttccttgagggg

SEQ ID NO: 6740719 - DNA, 15 bp, Homo sapiens
tcttccttgatgttt

SEQ ID NO: 6740720 - DNA, 15 bp, Homo sapiens
tcttccttgccacaa

SEQ ID NO: 6740721 - DNA, 18 bp, Homo sapiens
tcttccttggagggggga

SEQ ID NO: 6740722 - DNA, 19 bp, Homo sapiens
tcttccttgtggaatgctg

SEQ ID NO: 6740723 - DNA, 21 bp, Homo sapiens
tcttccttgttgtttgctttg

SEQ ID NO: 6740724 - DNA, 13 bp, Homo sapiens
tcttcctttactt

SEQ ID NO: 6740725 - DNA, 18 bp, Homo sapiens
tcttcctttactttccct

SEQ ID NO: 6740726 - DNA, 14 bp, Homo sapiens
tcttcctttcagaa

SEQ ID NO: 6740727 - DNA, 13 bp, Homo sapiens
tcttcctttcatt

SEQ ID NO: 6740728 - DNA, 15 bp, Homo sapiens
tcttcctttccctgg

SEQ ID NO: 6740729 - DNA, 18 bp, Homo sapiens
tcttcctttccctggagc

SEQ ID NO: 6740730 - DNA, 19 bp, Homo sapiens
tcttcctttccctggagct

SEQ ID NO: 6740731 - DNA, 15 bp, Homo sapiens
tcttcctttctcctt

SEQ ID NO: 6740732 - DNA, 13 bp, Homo sapiens
tcttcctttgtaa

SEQ ID NO: 6740733 - DNA, 10 bp, Homo sapiens
tcttcctttt

SEQ ID NO: 6740734 - DNA, 15 bp, Homo sapiens
tcttccttttcactg

SEQ ID NO: 6740735 - DNA, 19 bp, Homo sapiens
tcttccttttgtatcctcc

SEQ ID NO: 6740736 - DNA, 20 bp, Homo sapiens
tcttccttttttaaaataaa

SEQ ID NO: 6740737 - DNA, 22 bp, Homo sapiens
tcttccttttttaaaataaaat

SEQ ID NO: 6740738 - DNA, 18 bp, Homo sapiens
tcttcgaagccttgccta

SEQ ID NO: 6740739 - DNA, 20 bp, Homo sapiens
tcttcgatcaagctacttta

SEQ ID NO: 6740740 - DNA, 18 bp, Homo sapiens
tcttcgccctctgaaatt

SEQ ID NO: 6740741 - DNA, 23 bp, Homo sapiens
tcttcgcgcccgcccctgcagca

SEQ ID NO: 6740742 - DNA, 19 bp, Homo sapiens
tcttcgctggactattgtg

SEQ ID NO: 6740743 - DNA, 20 bp, Homo sapiens
tcttcgctgtgatgcatgag

SEQ ID NO: 6740744 - DNA, 14 bp, Homo sapiens
tcttcggaaacctt

SEQ ID NO: 6740745 - DNA, 14 bp, Homo sapiens
tcttcggaggtggc

SEQ ID NO: 6740746 - DNA, 19 bp, Homo sapiens
tcttcggccgagctggttt

SEQ ID NO: 6740747 - DNA, 20 bp, Homo sapiens
tcttcggccgagctggtttc

SEQ ID NO: 6740748 - DNA, 16 bp, Homo sapiens
tcttcgggaagagagg

SEQ ID NO: 6740749 - DNA, 19 bp, Homo sapiens
tcttcggtctgaattttag

SEQ ID NO: 6740750 - DNA, 16 bp, Homo sapiens
tcttcggtggccttga

SEQ ID NO: 6740751 - DNA, 16 bp, Homo sapiens
tcttcggtgttcttct

SEQ ID NO: 6740752 - DNA, 17 bp, Homo sapiens
tcttcggtttctgagca

SEQ ID NO: 6740753 - DNA, 18 bp, Homo sapiens
tcttcgtcttcactctta

SEQ ID NO: 6740754 - DNA, 19 bp, Homo sapiens
tcttctaaaactactgcct

SEQ ID NO: 6740755 - DNA, 18 bp, Homo sapiens
tcttctaaaatagcaata

SEQ ID NO: 6740756 - DNA, 18 bp, Homo sapiens
tcttctaaaatgctttta

SEQ ID NO: 6740757 - DNA, 15 bp, Homo sapiens
tcttctaaaattgaa

SEQ ID NO: 6740758 - DNA, 22 bp, Homo sapiens
tcttctaaacattttttcttca

SEQ ID NO: 6740759 - DNA, 22 bp, Homo sapiens
tcttctaaacttccccatcttc

SEQ ID NO: 6740760 - DNA, 18 bp, Homo sapiens
tcttctaaagcagacttt

SEQ ID NO: 6740761 - DNA, 22 bp, Homo sapiens
tcttctaaatgagctaaataag

SEQ ID NO: 6740762 - DNA, 14 bp, Homo sapiens
tcttctaaattaaa

SEQ ID NO: 6740763 - DNA, 18 bp, Homo sapiens
tcttctaacccaactgac

SEQ ID NO: 6740764 - DNA, 18 bp, Homo sapiens
tcttctaagaagacattt

SEQ ID NO: 6740765 - DNA, 20 bp, Homo sapiens
tcttctaagaagacattttg

SEQ ID NO: 6740766 - DNA, 24 bp, Homo sapiens
tcttctaatcataacatagttgaa

SEQ ID NO: 6740767 - DNA, 18 bp, Homo sapiens
tcttctaatgtaaatttt

SEQ ID NO: 6740768 - DNA, 20 bp, Homo sapiens
tcttctaatttcaaaaatat

SEQ ID NO: 6740769 - DNA, 17 bp, Homo sapiens
tcttctacaaccagagc

SEQ ID NO: 6740770 - DNA, 18 bp, Homo sapiens
tcttctacccttttcctt

SEQ ID NO: 6740771 - DNA, 22 bp, Homo sapiens
tcttctactcacttttcccact

SEQ ID NO: 6740772 - DNA, 14 bp, Homo sapiens
tcttctactgcctt

SEQ ID NO: 6740773 - DNA, 15 bp, Homo sapiens
tcttctacttcttgt

SEQ ID NO: 6740774 - DNA, 16 bp, Homo sapiens
tcttctactttcatct

SEQ ID NO: 6740775 - DNA, 13 bp, Homo sapiens
tcttctactttta

SEQ ID NO: 6740776 - DNA, 14 bp, Homo sapiens
tcttctagaagata

SEQ ID NO: 6740777 - DNA, 20 bp, Homo sapiens
tcttctagagagcttagtgt

SEQ ID NO: 6740778 - DNA, 17 bp, Homo sapiens
tcttctagagtaattat

SEQ ID NO: 6740779 - DNA, 12 bp, Homo sapiens
tcttctagagtt

SEQ ID NO: 6740780 - DNA, 13 bp, Homo sapiens
tcttctagcattt

SEQ ID NO: 6740781 - DNA, 17 bp, Homo sapiens
tcttctagccacagttc

SEQ ID NO: 6740782 - DNA, 23 bp, Homo sapiens
tcttctaggcattactggccttt

SEQ ID NO: 6740783 - DNA, 14 bp, Homo sapiens
tcttctaggcccat

SEQ ID NO: 6740784 - DNA, 21 bp, Homo sapiens
tcttctagtatttttttctta

SEQ ID NO: 6740785 - DNA, 19 bp, Homo sapiens
tcttctagtgcttttcagt

SEQ ID NO: 6740786 - DNA, 17 bp, Homo sapiens
tcttctatatccaaaat

SEQ ID NO: 6740787 - DNA, 14 bp, Homo sapiens
tcttctatcctgca

SEQ ID NO: 6740788 - DNA, 22 bp, Homo sapiens
tcttctatctaatccttaaaag

SEQ ID NO: 6740789 - DNA, 14 bp, Homo sapiens
tcttctatgaccca

SEQ ID NO: 6740790 - DNA, 16 bp, Homo sapiens
tcttctattgcctctg

SEQ ID NO: 6740791 - DNA, 15 bp, Homo sapiens
tcttctattgtgctt

SEQ ID NO: 6740792 - DNA, 13 bp, Homo sapiens
tcttctatttaaa

SEQ ID NO: 6740793 - DNA, 16 bp, Homo sapiens
tcttctatttaaaaaa

SEQ ID NO: 6740794 - DNA, 18 bp, Homo sapiens
tcttctatttaaaaaata

SEQ ID NO: 6740795 - DNA, 13 bp, Homo sapiens
tcttctatttatt

SEQ ID NO: 6740796 - DNA, 13 bp, Homo sapiens
tcttctattttgt

SEQ ID NO: 6740797 - DNA, 17 bp, Homo sapiens
tcttctcaaacctccaa

SEQ ID NO: 6740798 - DNA, 16 bp, Homo sapiens
tcttctcaaagctggg

SEQ ID NO: 6740799 - DNA, 16 bp, Homo sapiens
tcttctcaagtgcctt

SEQ ID NO: 6740800 - DNA, 14 bp, Homo sapiens
tcttctcaagttct

SEQ ID NO: 6740801 - DNA, 18 bp, Homo sapiens
tcttctcaagttctaaga

SEQ ID NO: 6740802 - DNA, 17 bp, Homo sapiens
tcttctcacagtcaaaa

SEQ ID NO: 6740803 - DNA, 23 bp, Homo sapiens
tcttctcagaaggcaaatgactt

SEQ ID NO: 6740804 - DNA, 14 bp, Homo sapiens
tcttctcagagtgg

SEQ ID NO: 6740805 - DNA, 15 bp, Homo sapiens
tcttctcagctccac

SEQ ID NO: 6740806 - DNA, 16 bp, Homo sapiens
tcttctcagctcttcc

SEQ ID NO: 6740807 - DNA, 19 bp, Homo sapiens
tcttctcagttcatttcct

SEQ ID NO: 6740808 - DNA, 14 bp, Homo sapiens
tcttctcataaatc

SEQ ID NO: 6740809 - DNA, 21 bp, Homo sapiens
tcttctcataaatctttttac

SEQ ID NO: 6740810 - DNA, 16 bp, Homo sapiens
tcttctcatagcatta

SEQ ID NO: 6740811 - DNA, 18 bp, Homo sapiens
tcttctcatagcattaac

SEQ ID NO: 6740812 - DNA, 18 bp, Homo sapiens
tcttctcatcttttatct

SEQ ID NO: 6740813 - DNA, 13 bp, Homo sapiens
tcttctcattgtt

SEQ ID NO: 6740814 - DNA, 18 bp, Homo sapiens
tcttctcatttcacccct

SEQ ID NO: 6740815 - DNA, 20 bp, Homo sapiens
tcttctcatttcacccctcc

SEQ ID NO: 6740816 - DNA, 20 bp, Homo sapiens
tcttctccaattctgaaata

SEQ ID NO: 6740817 - DNA, 14 bp, Homo sapiens
tcttctccacgtct

SEQ ID NO: 6740818 - DNA, 23 bp, Homo sapiens
tcttctccacgtctttcctgcta

SEQ ID NO: 6740819 - DNA, 13 bp, Homo sapiens
tcttctccactgg

SEQ ID NO: 6740820 - DNA, 21 bp, Homo sapiens
tcttctccactttctagccag

SEQ ID NO: 6740821 - DNA, 15 bp, Homo sapiens
tcttctccagatttt

SEQ ID NO: 6740822 - DNA, 14 bp, Homo sapiens
tcttctccaggatg

SEQ ID NO: 6740823 - DNA, 13 bp, Homo sapiens
tcttctccaggct

SEQ ID NO: 6740824 - DNA, 19 bp, Homo sapiens
tcttctccattccctagca

SEQ ID NO: 6740825 - DNA, 14 bp, Homo sapiens
tcttctcccaactc

SEQ ID NO: 6740826 - DNA, 16 bp, Homo sapiens
tcttctcccaactcag

SEQ ID NO: 6740827 - DNA, 16 bp, Homo sapiens
tcttctcccaattcat

SEQ ID NO: 6740828 - DNA, 14 bp, Homo sapiens
tcttctcccagagc

SEQ ID NO: 6740829 - DNA, 20 bp, Homo sapiens
tcttctccccacagcctctg

SEQ ID NO: 6740830 - DNA, 12 bp, Homo sapiens
tcttctccccag

SEQ ID NO: 6740831 - DNA, 13 bp, Homo sapiens
tcttctcccccat

SEQ ID NO: 6740832 - DNA, 20 bp, Homo sapiens
tcttctccccgaggctgccc

SEQ ID NO: 6740833 - DNA, 16 bp, Homo sapiens
tcttctccccttccat

SEQ ID NO: 6740834 - DNA, 15 bp, Homo sapiens
tcttctccctggaat

SEQ ID NO: 6740835 - DNA, 13 bp, Homo sapiens
tcttctccctgtc

SEQ ID NO: 6740836 - DNA, 16 bp, Homo sapiens
tcttctcctatgtgta

SEQ ID NO: 6740837 - DNA, 14 bp, Homo sapiens
tcttctcctcagct

SEQ ID NO: 6740838 - DNA, 13 bp, Homo sapiens
tcttctcctctgg

SEQ ID NO: 6740839 - DNA, 15 bp, Homo sapiens
tcttctcctgcagcc

SEQ ID NO: 6740840 - DNA, 12 bp, Homo sapiens
tcttctcctgtg

SEQ ID NO: 6740841 - DNA, 17 bp, Homo sapiens
tcttctccttcaaaaca

SEQ ID NO: 6740842 - DNA, 15 bp, Homo sapiens
tcttctccttgattt

SEQ ID NO: 6740843 - DNA, 13 bp, Homo sapiens
tcttctcctttca

SEQ ID NO: 6740844 - DNA, 21 bp, Homo sapiens
tcttctcctttgtcaaatggt

SEQ ID NO: 6740845 - DNA, 18 bp, Homo sapiens
tcttctcgcctaggattt

SEQ ID NO: 6740846 - DNA, 23 bp, Homo sapiens
tcttctcggctcaggctctgctg

SEQ ID NO: 6740847 - DNA, 22 bp, Homo sapiens
tcttctctaacaagctatggga

SEQ ID NO: 6740848 - DNA, 23 bp, Homo sapiens
tcttctctatatttttatttcat

SEQ ID NO: 6740849 - DNA, 14 bp, Homo sapiens
tcttctctatcctc

SEQ ID NO: 6740850 - DNA, 19 bp, Homo sapiens
tcttctctatcctctctct

SEQ ID NO: 6740851 - DNA, 14 bp, Homo sapiens
tcttctctcaacct

SEQ ID NO: 6740852 - DNA, 21 bp, Homo sapiens
tcttctctcaaccttggcctt

SEQ ID NO: 6740853 - DNA, 16 bp, Homo sapiens
tcttctctccacttct

SEQ ID NO: 6740854 - DNA, 12 bp, Homo sapiens
tcttctctccat

SEQ ID NO: 6740855 - DNA, 15 bp, Homo sapiens
tcttctctccccagc

SEQ ID NO: 6740856 - DNA, 16 bp, Homo sapiens
tcttctctccccagcc

SEQ ID NO: 6740857 - DNA, 20 bp, Homo sapiens
tcttctctccccttttcctt

SEQ ID NO: 6740858 - DNA, 12 bp, Homo sapiens
tcttctctctgc

SEQ ID NO: 6740859 - DNA, 16 bp, Homo sapiens
tcttctctctggctca

SEQ ID NO: 6740860 - DNA, 15 bp, Homo sapiens
tcttctctctgtgct

SEQ ID NO: 6740861 - DNA, 13 bp, Homo sapiens
tcttctctgcaat

SEQ ID NO: 6740862 - DNA, 16 bp, Homo sapiens
tcttctctgcaatgct

SEQ ID NO: 6740863 - DNA, 11 bp, Homo sapiens
tcttctctgga

SEQ ID NO: 6740864 - DNA, 21 bp, Homo sapiens
tcttctctggcgacagttttc

SEQ ID NO: 6740865 - DNA, 15 bp, Homo sapiens
tcttctctgggccca

SEQ ID NO: 6740866 - DNA, 19 bp, Homo sapiens
tcttctctgggcccagaga

SEQ ID NO: 6740867 - DNA, 12 bp, Homo sapiens
tcttctctgtct

SEQ ID NO: 6740868 - DNA, 14 bp, Homo sapiens
tcttctctgtgaga

SEQ ID NO: 6740869 - DNA, 18 bp, Homo sapiens
tcttctctgtgagaaggt

SEQ ID NO: 6740870 - DNA, 20 bp, Homo sapiens
tcttctcttacgctctctgt

SEQ ID NO: 6740871 - DNA, 21 bp, Homo sapiens
tcttctcttatcctctctctc

SEQ ID NO: 6740872 - DNA, 17 bp, Homo sapiens
tcttctcttctctgcaa

SEQ ID NO: 6740873 - DNA, 19 bp, Homo sapiens
tcttctcttgacagtctga

SEQ ID NO: 6740874 - DNA, 14 bp, Homo sapiens
tcttctctttactt

SEQ ID NO: 6740875 - DNA, 13 bp, Homo sapiens
tcttctctttagt

SEQ ID NO: 6740876 - DNA, 14 bp, Homo sapiens
tcttctctttctct

SEQ ID NO: 6740877 - DNA, 11 bp, Homo sapiens
tcttctgaaat

SEQ ID NO: 6740878 - DNA, 24 bp, Homo sapiens
tcttctgaactcaaactgaggaat

SEQ ID NO: 6740879 - DNA, 17 bp, Homo sapiens
tcttctgaataaagcaa

SEQ ID NO: 6740880 - DNA, 18 bp, Homo sapiens
tcttctgaataaagcaat

SEQ ID NO: 6740881 - DNA, 16 bp, Homo sapiens
tcttctgaatatttta

SEQ ID NO: 6740882 - DNA, 22 bp, Homo sapiens
tcttctgacaaactgtgtacat

SEQ ID NO: 6740883 - DNA, 15 bp, Homo sapiens
tcttctgagcactgt

SEQ ID NO: 6740884 - DNA, 16 bp, Homo sapiens
tcttctgagcactgtt

SEQ ID NO: 6740885 - DNA, 20 bp, Homo sapiens
tcttctgagcttacgtagtt

SEQ ID NO: 6740886 - DNA, 21 bp, Homo sapiens
tcttctgaggaccgctgataa

SEQ ID NO: 6740887 - DNA, 21 bp, Homo sapiens
tcttctgagtggctaaaactt

SEQ ID NO: 6740888 - DNA, 17 bp, Homo sapiens
tcttctgcaacatttga

SEQ ID NO: 6740889 - DNA, 19 bp, Homo sapiens
tcttctgcacagctcctcc

SEQ ID NO: 6740890 - DNA, 13 bp, Homo sapiens
tcttctgccaaga

SEQ ID NO: 6740891 - DNA, 11 bp, Homo sapiens
tcttctgccct

SEQ ID NO: 6740892 - DNA, 22 bp, Homo sapiens
tcttctgccctaacctgacaga

SEQ ID NO: 6740893 - DNA, 12 bp, Homo sapiens
tcttctgccctt

SEQ ID NO: 6740894 - DNA, 20 bp, Homo sapiens
tcttctgccctttcctaggc

SEQ ID NO: 6740895 - DNA, 19 bp, Homo sapiens
tcttctgccggccctgggg

SEQ ID NO: 6740896 - DNA, 15 bp, Homo sapiens
tcttctgcctgttat

SEQ ID NO: 6740897 - DNA, 19 bp, Homo sapiens
tcttggtgaaataataaaa

SEQ ID NO: 6740898 - DNA, 16 bp, Homo sapiens
tcttggtgactgtccc

SEQ ID NO: 6740899 - DNA, 13 bp, Homo sapiens
tcttggtgcccag

SEQ ID NO: 6740900 - DNA, 16 bp, Homo sapiens
tcttggtgctctgtgt

SEQ ID NO: 6740901 - DNA, 18 bp, Homo sapiens
tcttggtgctctgtgttc

SEQ ID NO: 6740902 - DNA, 20 bp, Homo sapiens
tcttggtggatgggccctgc

SEQ ID NO: 6740903 - DNA, 17 bp, Homo sapiens
tcttggtgggcccaggg

SEQ ID NO: 6740904 - DNA, 14 bp, Homo sapiens
tcttggtgtaattt

SEQ ID NO: 6740905 - DNA, 20 bp, Homo sapiens
tcttggtgtttgactgtaat

SEQ ID NO: 6740906 - DNA, 18 bp, Homo sapiens
tcttggttagagaagtaa

SEQ ID NO: 6740907 - DNA, 18 bp, Homo sapiens
tcttggttcataaatgaa

SEQ ID NO: 6740908 - DNA, 17 bp, Homo sapiens
tcttggttccagcctgc

SEQ ID NO: 6740909 - DNA, 12 bp, Homo sapiens
tcttggttcctg

SEQ ID NO: 6740910 - DNA, 13 bp, Homo sapiens
tcttggttcctgt

SEQ ID NO: 6740911 - DNA, 14 bp, Homo sapiens
tcttggttctaaag

SEQ ID NO: 6740912 - DNA, 17 bp, Homo sapiens
tcttggttggctggcct

SEQ ID NO: 6740913 - DNA, 17 bp, Homo sapiens
tcttggtttatgtcttg

SEQ ID NO: 6740914 - DNA, 21 bp, Homo sapiens
tcttggtttctggataaacca

SEQ ID NO: 6740915 - DNA, 22 bp, Homo sapiens
tcttggtttctggataaaccac

SEQ ID NO: 6740916 - DNA, 16 bp, Homo sapiens
tcttggttttctctct

SEQ ID NO: 6740917 - DNA, 20 bp, Homo sapiens
tcttgtaaaaatagcaaaat

SEQ ID NO: 6740918 - DNA, 17 bp, Homo sapiens
tcttgtaaacctggagg

SEQ ID NO: 6740919 - DNA, 14 bp, Homo sapiens
tcttgtaaagactg

SEQ ID NO: 6740920 - DNA, 15 bp, Homo sapiens
tcttgtaaagactgg

SEQ ID NO: 6740921 - DNA, 15 bp, Homo sapiens
tcttgtaaatctttt

SEQ ID NO: 6740922 - DNA, 14 bp, Homo sapiens
tcttgtaaatgttt

SEQ ID NO: 6740923 - DNA, 16 bp, Homo sapiens
tcttgtaaatgtttct

SEQ ID NO: 6740924 - DNA, 23 bp, Homo sapiens
tcttgtaactgggttcaaaaaga

SEQ ID NO: 6740925 - DNA, 11 bp, Homo sapiens
tcttgtaagat

SEQ ID NO: 6740926 - DNA, 16 bp, Homo sapiens
tcttgtaagattttga

SEQ ID NO: 6740927 - DNA, 19 bp, Homo sapiens
tcttgtaatattttgtatt

SEQ ID NO: 6740928 - DNA, 16 bp, Homo sapiens
tcttgtaatttggatc

SEQ ID NO: 6740929 - DNA, 15 bp, Homo sapiens
tcttgtaattttaca

SEQ ID NO: 6740930 - DNA, 14 bp, Homo sapiens
tcttgtacaaactt

SEQ ID NO: 6740931 - DNA, 19 bp, Homo sapiens
tcttgtacaaactttgttt

SEQ ID NO: 6740932 - DNA, 14 bp, Homo sapiens
tcttgtacatgtgt

SEQ ID NO: 6740933 - DNA, 24 bp, Homo sapiens
tcttgtacatgtgtagcctgtgca

SEQ ID NO: 6740934 - DNA, 18 bp, Homo sapiens
tcttgtaccagcccaggc

SEQ ID NO: 6740935 - DNA, 20 bp, Homo sapiens
tcttgtaccatagaaaaatg

SEQ ID NO: 6740936 - DNA, 16 bp, Homo sapiens
tcttgtacttctgtgt

SEQ ID NO: 6740937 - DNA, 21 bp, Homo sapiens
tcttgtagaagatggactctg

SEQ ID NO: 6740938 - DNA, 23 bp, Homo sapiens
tcttgtagcggatgattcttcaa

SEQ ID NO: 6740939 - DNA, 23 bp, Homo sapiens
tcttgtaggatctactttttgaa

SEQ ID NO: 6740940 - DNA, 15 bp, Homo sapiens
tcttgtattaagaat

SEQ ID NO: 6740941 - DNA, 16 bp, Homo sapiens
tcttgtattaagttgt

SEQ ID NO: 6740942 - DNA, 22 bp, Homo sapiens
tcttgtattaagttgttaataa

SEQ ID NO: 6740943 - DNA, 16 bp, Homo sapiens
tcttgtattatcataa

SEQ ID NO: 6740944 - DNA, 17 bp, Homo sapiens
tcttgtatttaaaaaca

SEQ ID NO: 6740945 - DNA, 18 bp, Homo sapiens
tcttgtattttcttccca

SEQ ID NO: 6740946 - DNA, 16 bp, Homo sapiens
tcttgtcaacatgcat

SEQ ID NO: 6740947 - DNA, 17 bp, Homo sapiens
tcttgtcaacatgcatt

SEQ ID NO: 6740948 - DNA, 12 bp, Homo sapiens
tcttgtcacatg

SEQ ID NO: 6740949 - DNA, 21 bp, Homo sapiens
tcttgtcacccaggctggagt

SEQ ID NO: 6740950 - DNA, 18 bp, Homo sapiens
tcttgtcagacataaagc

SEQ ID NO: 6740951 - DNA, 23 bp, Homo sapiens
tcttgtcaggtggaccctgtaaa

SEQ ID NO: 6740952 - DNA, 13 bp, Homo sapiens
tcttgtcagtgta

SEQ ID NO: 6740953 - DNA, 23 bp, Homo sapiens
tcttgtcagtgtagacacaggtc

SEQ ID NO: 6740954 - DNA, 16 bp, Homo sapiens
tcttgtcatcagtaag

SEQ ID NO: 6740955 - DNA, 17 bp, Homo sapiens
tcttgtcattctcatcc

SEQ ID NO: 6740956 - DNA, 12 bp, Homo sapiens
tcttgtcatttt

SEQ ID NO: 6740957 - DNA, 15 bp, Homo sapiens
tcttgtccacattct

SEQ ID NO: 6740958 - DNA, 16 bp, Homo sapiens
tcttgtccacattcta

SEQ ID NO: 6740959 - DNA, 22 bp, Homo sapiens
tcttgtccagagacaagacttc

SEQ ID NO: 6740960 - DNA, 20 bp, Homo sapiens
tcttgtcccacgtgtcttcc

SEQ ID NO: 6740961 - DNA, 21 bp, Homo sapiens
tcttgtccccaacaccccaca

SEQ ID NO: 6740962 - DNA, 19 bp, Homo sapiens
tcttgtccccacccatgcg

SEQ ID NO: 6740963 - DNA, 23 bp, Homo sapiens
tcttgtcccctcttgacccatct

SEQ ID NO: 6740964 - DNA, 13 bp, Homo sapiens
tcttgtcccttgg

SEQ ID NO: 6740965 - DNA, 15 bp, Homo sapiens
tcttgtcccttggca

SEQ ID NO: 6740966 - DNA, 18 bp, Homo sapiens
tcttgtctcaatgctcat

SEQ ID NO: 6740967 - DNA, 20 bp, Homo sapiens
tcttgtctcaatgctcataa

SEQ ID NO: 6740968 - DNA, 14 bp, Homo sapiens
tcttgtctctgagg

SEQ ID NO: 6740969 - DNA, 14 bp, Homo sapiens
tcttgtctgaggga

SEQ ID NO: 6740970 - DNA, 16 bp, Homo sapiens
tcttgtctgtgtgatt

SEQ ID NO: 6740971 - DNA, 13 bp, Homo sapiens
tcttgtcttacca

SEQ ID NO: 6740972 - DNA, 19 bp, Homo sapiens
tcttgtcttagctctggac

SEQ ID NO: 6740973 - DNA, 19 bp, Homo sapiens
tcttgtcttcctatttcag

SEQ ID NO: 6740974 - DNA, 12 bp, Homo sapiens
tcttgtctttcc

SEQ ID NO: 6740975 - DNA, 16 bp, Homo sapiens
tcttgtctttgtccct

SEQ ID NO: 6740976 - DNA, 23 bp, Homo sapiens
tcttgtcttttcccctcattgca

SEQ ID NO: 6740977 - DNA, 14 bp, Homo sapiens
tcttgtgaaatggc

SEQ ID NO: 6740978 - DNA, 12 bp, Homo sapiens
tcttgtgaaatt

SEQ ID NO: 6740979 - DNA, 18 bp, Homo sapiens
tcttgtgaagttgttttt

SEQ ID NO: 6740980 - DNA, 22 bp, Homo sapiens
tcttgtgaatattgtggctccc

SEQ ID NO: 6740981 - DNA, 21 bp, Homo sapiens
tcttgtgactagtgctgaagc

SEQ ID NO: 6740982 - DNA, 22 bp, Homo sapiens
tcttgtgagtggataatcagga

SEQ ID NO: 6740983 - DNA, 21 bp, Homo sapiens
tcttgtgatattgcccaggct

SEQ ID NO: 6740984 - DNA, 16 bp, Homo sapiens
tcttgtgatgtattct

SEQ ID NO: 6740985 - DNA, 13 bp, Homo sapiens
tcttgtgatgttt

SEQ ID NO: 6740986 - DNA, 21 bp, Homo sapiens
tcttgtgcactttatcttggg

SEQ ID NO: 6740987 - DNA, 22 bp, Homo sapiens
tcttgtgcatgcaaaaatgaat

SEQ ID NO: 6740988 - DNA, 14 bp, Homo sapiens
tcttgtgcatgttt

SEQ ID NO: 6740989 - DNA, 17 bp, Homo sapiens
tcttgtgcatgtttact

SEQ ID NO: 6740990 - DNA, 12 bp, Homo sapiens
tcttgtgcctca

SEQ ID NO: 6740991 - DNA, 13 bp, Homo sapiens
tcttgtgcctcag

SEQ ID NO: 6740992 - DNA, 14 bp, Homo sapiens
tcttgtgcctcagc

SEQ ID NO: 6740993 - DNA, 23 bp, Homo sapiens
tcttgtgctatgaaacaatcttc

SEQ ID NO: 6740994 - DNA, 15 bp, Homo sapiens
tcttgtgctcacgct

SEQ ID NO: 6740995 - DNA, 12 bp, Homo sapiens
tcttgtgctgag

SEQ ID NO: 6740996 - DNA, 21 bp, Homo sapiens
tcttgtgcttttcctatttgt

SEQ ID NO: 6740997 - DNA, 18 bp, Homo sapiens
tcttgtgcttttcctgat

SEQ ID NO: 6740998 - DNA, 13 bp, Homo sapiens
tcttgtggacccc

SEQ ID NO: 6740999 - DNA, 23 bp, Homo sapiens
tcttgtggagattttttttttaa

SEQ ID NO: 6741000 - DNA, 15 bp, Homo sapiens
tcttgtggggccagg

SEQ ID NO: 6741001 - DNA, 16 bp, Homo sapiens
tcttgtggggccagga

SEQ ID NO: 6741002 - DNA, 13 bp, Homo sapiens
tcttgtggtgagg

SEQ ID NO: 6741003 - DNA, 15 bp, Homo sapiens
tcttgtggtgtaaag

SEQ ID NO: 6741004 - DNA, 22 bp, Homo sapiens
tcttgtggtgtaaagctggccc

SEQ ID NO: 6741005 - DNA, 23 bp, Homo sapiens
tcttgtggttataacttaatgaa

SEQ ID NO: 6741006 - DNA, 21 bp, Homo sapiens
tcttgtggttgtgtgtgttct

SEQ ID NO: 6741007 - DNA, 23 bp, Homo sapiens
tcttgtggttgtgtgtgttctgt

SEQ ID NO: 6741008 - DNA, 17 bp, Homo sapiens
tcttgtgtagatttgaa

SEQ ID NO: 6741009 - DNA, 19 bp, Homo sapiens
tcttgtgtagatttgaaaa

SEQ ID NO: 6741010 - DNA, 20 bp, Homo sapiens
tcttgtgtagatttgaaaat

SEQ ID NO: 6741011 - DNA, 11 bp, Homo sapiens
tcttgtgtatt

SEQ ID NO: 6741012 - DNA, 22 bp, Homo sapiens
tcttgtgtatttctctgtgaat

SEQ ID NO: 6741013 - DNA, 15 bp, Homo sapiens
tcttgtgtcctggct

SEQ ID NO: 6741014 - DNA, 13 bp, Homo sapiens
tcttgtgtctgtt

SEQ ID NO: 6741015 - DNA, 21 bp, Homo sapiens
tcttgtgtggtttggcccttc

SEQ ID NO: 6741016 - DNA, 15 bp, Homo sapiens
tcttgtgtgtatgca

SEQ ID NO: 6741017 - DNA, 22 bp, Homo sapiens
tcttgtgtgtatgcacatgaac

SEQ ID NO: 6741018 - DNA, 20 bp, Homo sapiens
tcttgtgttaacttgcctcc

SEQ ID NO: 6741019 - DNA, 23 bp, Homo sapiens
tcttgtgttaacttgcctccatc

SEQ ID NO: 6741020 - DNA, 13 bp, Homo sapiens
tcttgtgttggct

SEQ ID NO: 6741021 - DNA, 14 bp, Homo sapiens
tcttgtgtttgaaa

SEQ ID NO: 6741022 - DNA, 22 bp, Homo sapiens
tcttgtgtttgacactaagaaa

SEQ ID NO: 6741023 - DNA, 16 bp, Homo sapiens
tcttgtgtttgagaac

SEQ ID NO: 6741024 - DNA, 22 bp, Homo sapiens
tcttgttaatgtcattgctaaa

SEQ ID NO: 6741025 - DNA, 17 bp, Homo sapiens
tcttgttaatttcattc

SEQ ID NO: 6741026 - DNA, 22 bp, Homo sapiens
tcttgttaatttcattccaaac

SEQ ID NO: 6741027 - DNA, 18 bp, Homo sapiens
tcttgttactgctgattc

SEQ ID NO: 6741028 - DNA, 20 bp, Homo sapiens
tcttgttactgctgattctt

SEQ ID NO: 6741029 - DNA, 15 bp, Homo sapiens
tcttgttactgtgat

SEQ ID NO: 6741030 - DNA, 24 bp, Homo sapiens
tcttgttagagagcttttcactgt

SEQ ID NO: 6741031 - DNA, 18 bp, Homo sapiens
tcttgttattaatgtttc

SEQ ID NO: 6741032 - DNA, 12 bp, Homo sapiens
tcttgttattat

SEQ ID NO: 6741033 - DNA, 14 bp, Homo sapiens
tcttgttcactgca

SEQ ID NO: 6741034 - DNA, 15 bp, Homo sapiens
tcttgttccaaggcc

SEQ ID NO: 6741035 - DNA, 12 bp, Homo sapiens
tcttgttcctga

SEQ ID NO: 6741036 - DNA, 22 bp, Homo sapiens
tcttgttcgcacaatctacact

SEQ ID NO: 6741037 - DNA, 20 bp, Homo sapiens
tcttgttctgagattcaata

SEQ ID NO: 6741038 - DNA, 15 bp, Homo sapiens
tcttgttctgtcact

SEQ ID NO: 6741039 - DNA, 18 bp, Homo sapiens
tcttgttctgtcccttcc

SEQ ID NO: 6741040 - DNA, 14 bp, Homo sapiens
tcttgttcttgaga

SEQ ID NO: 6741041 - DNA, 22 bp, Homo sapiens
tcttgttctttgctggaccatc

SEQ ID NO: 6741042 - DNA, 13 bp, Homo sapiens
tcttgttgagccg

SEQ ID NO: 6741043 - DNA, 15 bp, Homo sapiens
tcttgttgcatcttt

SEQ ID NO: 6741044 - DNA, 17 bp, Homo sapiens
tcttgttgcatcttttc

SEQ ID NO: 6741045 - DNA, 13 bp, Homo sapiens
tcttgttgctttg

SEQ ID NO: 6741046 - DNA, 14 bp, Homo sapiens
tcttgttgctttgt

SEQ ID NO: 6741047 - DNA, 24 bp, Homo sapiens
tcttgttggtacctttctagcctt

SEQ ID NO: 6741048 - DNA, 16 bp, Homo sapiens
tcttgttgtacccttg

SEQ ID NO: 6741049 - DNA, 22 bp, Homo sapiens
tcttgttgtttatatgaaaaca

SEQ ID NO: 6741050 - DNA, 21 bp, Homo sapiens
tcttgtttaaaaaaagaaaaa

SEQ ID NO: 6741051 - DNA, 11 bp, Homo sapiens
tcttgtttaac

SEQ ID NO: 6741052 - DNA, 17 bp, Homo sapiens
tcttgtttaacatatat

SEQ ID NO: 6741053 - DNA, 18 bp, Homo sapiens
tcttgtttaacatatata

SEQ ID NO: 6741054 - DNA, 15 bp, Homo sapiens
tcttgtttacaataa

SEQ ID NO: 6741055 - DNA, 14 bp, Homo sapiens
tcttgtttatagca

SEQ ID NO: 6741056 - DNA, 15 bp, Homo sapiens
tcttgtttcactcca

SEQ ID NO: 6741057 - DNA, 14 bp, Homo sapiens
tcttgtttcagtga

SEQ ID NO: 6741058 - DNA, 12 bp, Homo sapiens
tcttgtttctga

SEQ ID NO: 6741059 - DNA, 18 bp, Homo sapiens
tcttgtttctgcatcttt

SEQ ID NO: 6741060 - DNA, 11 bp, Homo sapiens
tcttgtttctt

SEQ ID NO: 6741061 - DNA, 22 bp, Homo sapiens
tcttgtttggagggatcatttt

SEQ ID NO: 6741062 - DNA, 13 bp, Homo sapiens
tcttgtttgtcag

SEQ ID NO: 6741063 - DNA, 23 bp, Homo sapiens
tcttgtttgtcagcatctgacca

SEQ ID NO: 6741064 - DNA, 21 bp, Homo sapiens
tcttgttttaagcaaatgcat

SEQ ID NO: 6741065 - DNA, 22 bp, Homo sapiens
tcttgttttcaaagggactttt

SEQ ID NO: 6741066 - DNA, 22 bp, Homo sapiens
tcttgttttgtcttgaaagtgg

SEQ ID NO: 6741067 - DNA, 14 bp, Homo sapiens
tcttgttttgtttg

SEQ ID NO: 6741068 - DNA, 15 bp, Homo sapiens
tcttgtttttattaa

SEQ ID NO: 6741069 - DNA, 17 bp, Homo sapiens
tcttgtttttattaatt

SEQ ID NO: 6741070 - DNA, 22 bp, Homo sapiens
tctttaaaaaaaaatcttgtgt

SEQ ID NO: 6741071 - DNA, 16 bp, Homo sapiens
tctttaaaaaagaaat

SEQ ID NO: 6741072 - DNA, 20 bp, Homo sapiens
tctttaaaaataaaagctat

SEQ ID NO: 6741073 - DNA, 12 bp, Homo sapiens
tctttaaaacaa

SEQ ID NO: 6741074 - DNA, 13 bp, Homo sapiens
tctttaaaacaaa

SEQ ID NO: 6741075 - DNA, 23 bp, Homo sapiens
tctttgtaagagtgtagaagcat

SEQ ID NO: 6741076 - DNA, 22 bp, Homo sapiens
tctttgtaaggacttgtgcctc

SEQ ID NO: 6741077 - DNA, 21 bp, Homo sapiens
tctttgtaatcccttcacagt

SEQ ID NO: 6741078 - DNA, 12 bp, Homo sapiens
tctttgtaatga

SEQ ID NO: 6741079 - DNA, 18 bp, Homo sapiens
tctttgtaatttaatgaa

SEQ ID NO: 6741080 - DNA, 15 bp, Homo sapiens
tctttgtacagacaa

SEQ ID NO: 6741081 - DNA, 14 bp, Homo sapiens
tctttgtaccaaaa

SEQ ID NO: 6741082 - DNA, 19 bp, Homo sapiens
tctttgtaccaaaatttta

SEQ ID NO: 6741083 - DNA, 18 bp, Homo sapiens
tctttgtaccttttgtag

SEQ ID NO: 6741084 - DNA, 16 bp, Homo sapiens
tctttgtagaataaat

SEQ ID NO: 6741085 - DNA, 23 bp, Homo sapiens
tctttgtagctaacagtgaagat

SEQ ID NO: 6741086 - DNA, 22 bp, Homo sapiens
tctttgtataaataaatatttt

SEQ ID NO: 6741087 - DNA, 15 bp, Homo sapiens
tctttgtcattcagt

SEQ ID NO: 6741088 - DNA, 18 bp, Homo sapiens
tctttgtcattcagttct

SEQ ID NO: 6741089 - DNA, 23 bp, Homo sapiens
tctttgtcattcagttctaggcc

SEQ ID NO: 6741090 - DNA, 14 bp, Homo sapiens
tctttgtccctgtt

SEQ ID NO: 6741091 - DNA, 23 bp, Homo sapiens
tctttgtcctgaatggctttgtc

SEQ ID NO: 6741092 - DNA, 16 bp, Homo sapiens
tctttgtctcaccagc

SEQ ID NO: 6741093 - DNA, 23 bp, Homo sapiens
tctttgtgacaggaaagccctcc

SEQ ID NO: 6741094 - DNA, 16 bp, Homo sapiens
tctttgtgctttggct

SEQ ID NO: 6741095 - DNA, 14 bp, Homo sapiens
tctttgtggccaag

SEQ ID NO: 6741096 - DNA, 22 bp, Homo sapiens
tctttgtggccaaggagctgct

SEQ ID NO: 6741097 - DNA, 23 bp, Homo sapiens
tctttgtggccaaggagctgcta

SEQ ID NO: 6741098 - DNA, 18 bp, Homo sapiens
tctttgtggggcttggcg

SEQ ID NO: 6741099 - DNA, 21 bp, Homo sapiens
tctttgtgggttggccaggag

SEQ ID NO: 6741100 - DNA, 19 bp, Homo sapiens
tctttgtgggtttttcatc

SEQ ID NO: 6741101 - DNA, 20 bp, Homo sapiens
tctttgtgggtttttcatct

SEQ ID NO: 6741102 - DNA, 13 bp, Homo sapiens
tctttgtgtaatc

SEQ ID NO: 6741103 - DNA, 13 bp, Homo sapiens
tctttgtgtagct

SEQ ID NO: 6741104 - DNA, 15 bp, Homo sapiens
tctttgtgtagcttt

SEQ ID NO: 6741105 - DNA, 18 bp, Homo sapiens
tctttgtgtagctttgct

SEQ ID NO: 6741106 - DNA, 14 bp, Homo sapiens
tctttgtgtagtat

SEQ ID NO: 6741107 - DNA, 17 bp, Homo sapiens
tctttgtgtcaacatga

SEQ ID NO: 6741108 - DNA, 13 bp, Homo sapiens
tctttgtgtgctg

SEQ ID NO: 6741109 - DNA, 13 bp, Homo sapiens
tctttgtgtgtta

SEQ ID NO: 6741110 - DNA, 14 bp, Homo sapiens
tctttgtgtgttat

SEQ ID NO: 6741111 - DNA, 16 bp, Homo sapiens
tctttgtgtgttatat

SEQ ID NO: 6741112 - DNA, 18 bp, Homo sapiens
tctttgtgttgataagct

SEQ ID NO: 6741113 - DNA, 14 bp, Homo sapiens
tctttgttaatttg

SEQ ID NO: 6741114 - DNA, 16 bp, Homo sapiens
tctttgttactgtcca

SEQ ID NO: 6741115 - DNA, 16 bp, Homo sapiens
tctttgttacttcctt

SEQ ID NO: 6741116 - DNA, 18 bp, Homo sapiens
tctttgttattataacat

SEQ ID NO: 6741117 - DNA, 16 bp, Homo sapiens
tctttgttcatcattg

SEQ ID NO: 6741118 - DNA, 18 bp, Homo sapiens
tctttgttcctgctttct

SEQ ID NO: 6741119 - DNA, 18 bp, Homo sapiens
tctttgttctcagctccc

SEQ ID NO: 6741120 - DNA, 20 bp, Homo sapiens
tctttgttctcagctccccc

SEQ ID NO: 6741121 - DNA, 22 bp, Homo sapiens
tctttgttctcagctccccctg

SEQ ID NO: 6741122 - DNA, 22 bp, Homo sapiens
tctttgttctgttttgtgagaa

SEQ ID NO: 6741123 - DNA, 22 bp, Homo sapiens
tctttgttcttcaatgtgaaac

SEQ ID NO: 6741124 - DNA, 16 bp, Homo sapiens
tctttgttgaagtttg

SEQ ID NO: 6741125 - DNA, 17 bp, Homo sapiens
tctttgtttaaatgcca

SEQ ID NO: 6741126 - DNA, 15 bp, Homo sapiens
tctttgtttaacaaa

SEQ ID NO: 6741127 - DNA, 15 bp, Homo sapiens
tctttgtttatgcac

SEQ ID NO: 6741128 - DNA, 23 bp, Homo sapiens
tctttgtttccagcttgcattga

SEQ ID NO: 6741129 - DNA, 22 bp, Homo sapiens
tctttgtttctgtttcttgctc

SEQ ID NO: 6741130 - DNA, 20 bp, Homo sapiens
tctttgttttattttaatag

SEQ ID NO: 6741131 - DNA, 20 bp, Homo sapiens
tctttgttttgtgtctctta

SEQ ID NO: 6741132 - DNA, 15 bp, Homo sapiens
tctttgtttttttaa

SEQ ID NO: 6741133 - DNA, 19 bp, Homo sapiens
tcttttaaaaactcctgtt

SEQ ID NO: 6741134 - DNA, 14 bp, Homo sapiens
tcttttaaaagaca

SEQ ID NO: 6741135 - DNA, 21 bp, Homo sapiens
tcttttaaaagacaagacttc

SEQ ID NO: 6741136 - DNA, 22 bp, Homo sapiens
tcttttaaaatatcctgtaact

SEQ ID NO: 6741137 - DNA, 13 bp, Homo sapiens
tcttttaaactgg

SEQ ID NO: 6741138 - DNA, 19 bp, Homo sapiens
tcttttaaagaagtaaatt

SEQ ID NO: 6741139 - DNA, 14 bp, Homo sapiens
tcttttaaagattt

SEQ ID NO: 6741140 - DNA, 18 bp, Homo sapiens
tcttttaaagtgttactt

SEQ ID NO: 6741141 - DNA, 21 bp, Homo sapiens
tcttttaaagtgttacttttt

SEQ ID NO: 6741142 - DNA, 13 bp, Homo sapiens
tcttttaaatggg

SEQ ID NO: 6741143 - DNA, 14 bp, Homo sapiens
tcttttaaatgggt

SEQ ID NO: 6741144 - DNA, 19 bp, Homo sapiens
tcttttaaattagaaaata

SEQ ID NO: 6741145 - DNA, 12 bp, Homo sapiens
tcttttaaattg

SEQ ID NO: 6741146 - DNA, 17 bp, Homo sapiens
tcttttaagcatttgta

SEQ ID NO: 6741147 - DNA, 21 bp, Homo sapiens
tcttttaagcatttgtatatt

SEQ ID NO: 6741148 - DNA, 14 bp, Homo sapiens
tcttttaatcatga

SEQ ID NO: 6741149 - DNA, 21 bp, Homo sapiens
tcttttaatcatgagcctgtt

SEQ ID NO: 6741150 - DNA, 15 bp, Homo sapiens
tcttttaatgatact

SEQ ID NO: 6741151 - DNA, 21 bp, Homo sapiens
tcttttaatgatactgtctaa

SEQ ID NO: 6741152 - DNA, 19 bp, Homo sapiens
tcttttaatgcttcattca

SEQ ID NO: 6741153 - DNA, 18 bp, Homo sapiens
tcttttaatggcatttct

SEQ ID NO: 6741154 - DNA, 17 bp, Homo sapiens
tcttttaccctggcccc

SEQ ID NO: 6741155 - DNA, 18 bp, Homo sapiens
tcttttaccctggcccct

SEQ ID NO: 6741156 - DNA, 14 bp, Homo sapiens
tcttttacctgctg

SEQ ID NO: 6741157 - DNA, 21 bp, Homo sapiens
tcttttacctgctgcttctcc

SEQ ID NO: 6741158 - DNA, 18 bp, Homo sapiens
tcttttactcatgatctt

SEQ ID NO: 6741159 - DNA, 15 bp, Homo sapiens
tcttttactctgtgt

SEQ ID NO: 6741160 - DNA, 15 bp, Homo sapiens
tcttttactgtaatt

SEQ ID NO: 6741161 - DNA, 15 bp, Homo sapiens
tcttttacttgaaaa

SEQ ID NO: 6741162 - DNA, 13 bp, Homo sapiens
tcttttagaaaag

SEQ ID NO: 6741163 - DNA, 14 bp, Homo sapiens
tcttttagacaact

SEQ ID NO: 6741164 - DNA, 17 bp, Homo sapiens
tcttttagacaactaga

SEQ ID NO: 6741165 - DNA, 22 bp, Homo sapiens
tcttttagacaactagatttgt

SEQ ID NO: 6741166 - DNA, 15 bp, Homo sapiens
tcttttagagagggg

SEQ ID NO: 6741167 - DNA, 13 bp, Homo sapiens
tcttttagctaga

SEQ ID NO: 6741168 - DNA, 18 bp, Homo sapiens
tcttttaggacaattact

SEQ ID NO: 6741169 - DNA, 20 bp, Homo sapiens
tcttttaggacaattactgt

SEQ ID NO: 6741170 - DNA, 16 bp, Homo sapiens
tcttttagtcagaaat

SEQ ID NO: 6741171 - DNA, 19 bp, Homo sapiens
tcttttagtcagaaatgat

SEQ ID NO: 6741172 - DNA, 21 bp, Homo sapiens
tcttttagttacatgaattaa

SEQ ID NO: 6741173 - DNA, 13 bp, Homo sapiens
tcttttataaaaa

SEQ ID NO: 6741174 - DNA, 13 bp, Homo sapiens
tcttttataaata

SEQ ID NO: 6741175 - DNA, 15 bp, Homo sapiens
tcttttataaatatt

SEQ ID NO: 6741176 - DNA, 19 bp, Homo sapiens
tcttttataactagtcctt

SEQ ID NO: 6741177 - DNA, 12 bp, Homo sapiens
tcttttataata

SEQ ID NO: 6741178 - DNA, 18 bp, Homo sapiens
tcttttatactcagcttt

SEQ ID NO: 6741179 - DNA, 11 bp, Homo sapiens
tcttttatata

SEQ ID NO: 6741180 - DNA, 18 bp, Homo sapiens
tcttttatatataaaata

SEQ ID NO: 6741181 - DNA, 18 bp, Homo sapiens
tcttttatatctgtaaat

SEQ ID NO: 6741182 - DNA, 16 bp, Homo sapiens
tcttttatatttgtat

SEQ ID NO: 6741183 - DNA, 18 bp, Homo sapiens
tcttttatatttgtatcg

SEQ ID NO: 6741184 - DNA, 21 bp, Homo sapiens
tcttttatgtttgaatatgga

SEQ ID NO: 6741185 - DNA, 16 bp, Homo sapiens
tcttttattaatactt

SEQ ID NO: 6741186 - DNA, 17 bp, Homo sapiens
tcttttattaatacttt

SEQ ID NO: 6741187 - DNA, 18 bp, Homo sapiens
tcttttatttaacaaaaa

SEQ ID NO: 6741188 - DNA, 20 bp, Homo sapiens
tcttttatttcattcatatc

SEQ ID NO: 6741189 - DNA, 18 bp, Homo sapiens
tcttttattttggaacta

SEQ ID NO: 6741190 - DNA, 21 bp, Homo sapiens
tcttttcaaaattgttgcatc

SEQ ID NO: 6741191 - DNA, 15 bp, Homo sapiens
tcttttcaaacacac

SEQ ID NO: 6741192 - DNA, 18 bp, Homo sapiens
tcttttcaaaggtacttg

SEQ ID NO: 6741193 - DNA, 21 bp, Homo sapiens
tcttttcaaaggtacttggat

SEQ ID NO: 6741194 - DNA, 14 bp, Homo sapiens
tcttttcaatgcaa

SEQ ID NO: 6741195 - DNA, 15 bp, Homo sapiens
tcttttcaatgcaat

SEQ ID NO: 6741196 - DNA, 16 bp, Homo sapiens
tcttttcaatgcaatg

SEQ ID NO: 6741197 - DNA, 15 bp, Homo sapiens
tcttttcaattatat

SEQ ID NO: 6741198 - DNA, 14 bp, Homo sapiens
tcttttcacagcaa

SEQ ID NO: 6741199 - DNA, 20 bp, Homo sapiens
tcttttcacagcaacatttt

SEQ ID NO: 6741200 - DNA, 13 bp, Homo sapiens
tcttttcacatta

SEQ ID NO: 6741201 - DNA, 14 bp, Homo sapiens
tcttttcacattct

SEQ ID NO: 6741202 - DNA, 17 bp, Homo sapiens
tcttttcacattcttat

SEQ ID NO: 6741203 - DNA, 19 bp, Homo sapiens
tcttttcacattcttataa

SEQ ID NO: 6741204 - DNA, 22 bp, Homo sapiens
tcttttcacattcttataaata

SEQ ID NO: 6741205 - DNA, 14 bp, Homo sapiens
tcttttcacatttt

SEQ ID NO: 6741206 - DNA, 14 bp, Homo sapiens
tcttttcagaagca

SEQ ID NO: 6741207 - DNA, 19 bp, Homo sapiens
tcttttcagaagcaagcca

SEQ ID NO: 6741208 - DNA, 18 bp, Homo sapiens
tcttttcagcttgtttct

SEQ ID NO: 6741209 - DNA, 21 bp, Homo sapiens
tcttttcagcttgtttctata

SEQ ID NO: 6741210 - DNA, 21 bp, Homo sapiens
tcttttcataaagggttgaaa

SEQ ID NO: 6741211 - DNA, 23 bp, Homo sapiens
tcttttcataaagggttgaaaat

SEQ ID NO: 6741212 - DNA, 22 bp, Homo sapiens
tcttttcatctgggaaagacat

SEQ ID NO: 6741213 - DNA, 16 bp, Homo sapiens
tcttttcattctcatt

SEQ ID NO: 6741214 - DNA, 19 bp, Homo sapiens
tcttttccaaacacaggca

SEQ ID NO: 6741215 - DNA, 17 bp, Homo sapiens
tcttttccaagctcctt

SEQ ID NO: 6741216 - DNA, 22 bp, Homo sapiens
tcttttccacatggcagatgat

SEQ ID NO: 6741217 - DNA, 14 bp, Homo sapiens
tcttttccagaaag

SEQ ID NO: 6741218 - DNA, 15 bp, Homo sapiens
tcttttccagaaaga

SEQ ID NO: 6741219 - DNA, 22 bp, Homo sapiens
tcttttcccagagaccttctga

SEQ ID NO: 6741220 - DNA, 19 bp, Homo sapiens
tcttttcccatcaccagaa

SEQ ID NO: 6741221 - DNA, 20 bp, Homo sapiens
tcttttcccatttatctaaa

SEQ ID NO: 6741222 - DNA, 21 bp, Homo sapiens
tcttttcccatttatctaaat

SEQ ID NO: 6741223 - DNA, 24 bp, Homo sapiens
tcttttccccctttgtgcacattt

SEQ ID NO: 6741224 - DNA, 14 bp, Homo sapiens
tcttttccccgcct

SEQ ID NO: 6741225 - DNA, 18 bp, Homo sapiens
tcttttcccctcattgca

SEQ ID NO: 6741226 - DNA, 21 bp, Homo sapiens
tcttttcccctcattgcattt

SEQ ID NO: 6741227 - DNA, 17 bp, Homo sapiens
tcttttcccctttcctg

SEQ ID NO: 6741228 - DNA, 19 bp, Homo sapiens
tcttttcccctttcctgtc

SEQ ID NO: 6741229 - DNA, 17 bp, Homo sapiens
tcttttccctcctttcc

SEQ ID NO: 6741230 - DNA, 19 bp, Homo sapiens
tcttttcccttaaatacag

SEQ ID NO: 6741231 - DNA, 16 bp, Homo sapiens
tcttttcctacttttc

SEQ ID NO: 6741232 - DNA, 21 bp, Homo sapiens
tcttttcctccccattcctac

SEQ ID NO: 6741233 - DNA, 13 bp, Homo sapiens
tcttttcctctct

SEQ ID NO: 6741234 - DNA, 15 bp, Homo sapiens
tcttttcctctctct

SEQ ID NO: 6741235 - DNA, 18 bp, Homo sapiens
tcttttcctctctgtctg

SEQ ID NO: 6741236 - DNA, 17 bp, Homo sapiens
tcttttcctggcagctg

SEQ ID NO: 6741237 - DNA, 20 bp, Homo sapiens
tcttttcctgggaatggaat

SEQ ID NO: 6741238 - DNA, 13 bp, Homo sapiens
tcttttcctggtg

SEQ ID NO: 6741239 - DNA, 20 bp, Homo sapiens
tcttttccttcattcatagg

SEQ ID NO: 6741240 - DNA, 17 bp, Homo sapiens
tcttttcgttttcgttt

SEQ ID NO: 6741241 - DNA, 16 bp, Homo sapiens
tcttttctaaaagact

SEQ ID NO: 6741242 - DNA, 23 bp, Homo sapiens
tcttttctaaatgttattacttg

SEQ ID NO: 6741243 - DNA, 12 bp, Homo sapiens
tcttttctacag

SEQ ID NO: 6741244 - DNA, 18 bp, Homo sapiens
tcttttctaccctagcca

SEQ ID NO: 6741245 - DNA, 19 bp, Homo sapiens
tcttttctaccctagccat

SEQ ID NO: 6741246 - DNA, 11 bp, Homo sapiens
tcttttctaga

SEQ ID NO: 6741247 - DNA, 12 bp, Homo sapiens
tcttttctattt

SEQ ID NO: 6741248 - DNA, 14 bp, Homo sapiens
tcttttctctttaa

SEQ ID NO: 6741249 - DNA, 22 bp, Homo sapiens
tcttttctgaatcttctgaaac

SEQ ID NO: 6741250 - DNA, 22 bp, Homo sapiens
tcttttctgtcaccaaatttgt

SEQ ID NO: 6741251 - DNA, 13 bp, Homo sapiens
tcttttctgttat

SEQ ID NO: 6741252 - DNA, 17 bp, Homo sapiens
tgaaacagatgataaat

SEQ ID NO: 6741253 - DNA, 17 bp, Homo sapiens
tgaaacagcctgggtga

SEQ ID NO: 6741254 - DNA, 10 bp, Homo sapiens
tgaaacagct

SEQ ID NO: 6741255 - DNA, 14 bp, Homo sapiens
tgaaacagctgcct

SEQ ID NO: 6741256 - DNA, 15 bp, Homo sapiens
tgaaacagctgcctt

SEQ ID NO: 6741257 - DNA, 16 bp, Homo sapiens
tgaaacagctgcctta

SEQ ID NO: 6741258 - DNA, 17 bp, Homo sapiens
tgaaacagctgccttag

SEQ ID NO: 6741259 - DNA, 17 bp, Homo sapiens
tgaaacagctttctggg

SEQ ID NO: 6741260 - DNA, 18 bp, Homo sapiens
tgaaacaggccctctgtg

SEQ ID NO: 6741261 - DNA, 18 bp, Homo sapiens
tgaaacaggtctttgcca

SEQ ID NO: 6741262 - DNA, 19 bp, Homo sapiens
tgaaacaggtctttgccat

SEQ ID NO: 6741263 - DNA, 22 bp, Homo sapiens
tgaaacagtgtttggtgacata

SEQ ID NO: 6741264 - DNA, 13 bp, Homo sapiens
tgaaacatatcat

SEQ ID NO: 6741265 - DNA, 21 bp, Homo sapiens
tgaaacatcctatgaaatact

SEQ ID NO: 6741266 - DNA, 14 bp, Homo sapiens
tgaaacatcttctc

SEQ ID NO: 6741267 - DNA, 22 bp, Homo sapiens
tgaaacatgcacattttgtaca

SEQ ID NO: 6741268 - DNA, 19 bp, Homo sapiens
tgaaacatgtgcccctgcc

SEQ ID NO: 6741269 - DNA, 20 bp, Homo sapiens
tgaaacatgtggagtgtatt

SEQ ID NO: 6741270 - DNA, 16 bp, Homo sapiens
tgaaacattattttaa

SEQ ID NO: 6741271 - DNA, 21 bp, Homo sapiens
tgaaacattcacacagggctc

SEQ ID NO: 6741272 - DNA, 20 bp, Homo sapiens
tgaaacattccgaagaggga

SEQ ID NO: 6741273 - DNA, 19 bp, Homo sapiens
tgaaacattgcttttaaaa

SEQ ID NO: 6741274 - DNA, 21 bp, Homo sapiens
tgaaacattgcttttaaaact

SEQ ID NO: 6741275 - DNA, 16 bp, Homo sapiens
tgaaacattttctccc

SEQ ID NO: 6741276 - DNA, 12 bp, Homo sapiens
tgaaaccaaaac

SEQ ID NO: 6741277 - DNA, 18 bp, Homo sapiens
tgaaaccaaatgtaacta

SEQ ID NO: 6741278 - DNA, 13 bp, Homo sapiens
tgaaaccagtatt

SEQ ID NO: 6741279 - DNA, 19 bp, Homo sapiens
tgaaaccagtatttaagct

SEQ ID NO: 6741280 - DNA, 14 bp, Homo sapiens
tgaaaccattttcc

SEQ ID NO: 6741281 - DNA, 22 bp, Homo sapiens
tgaaacccacagatgtctctgg

SEQ ID NO: 6741282 - DNA, 13 bp, Homo sapiens
tgaaacccacagt

SEQ ID NO: 6741283 - DNA, 22 bp, Homo sapiens
tgaaacccagatcgctgtgtta

SEQ ID NO: 6741284 - DNA, 16 bp, Homo sapiens
tgaaacccagtaattc

SEQ ID NO: 6741285 - DNA, 16 bp, Homo sapiens
tgaaaccccatctcta

SEQ ID NO: 6741286 - DNA, 18 bp, Homo sapiens
tgaaaccccgtctctact

SEQ ID NO: 6741287 - DNA, 20 bp, Homo sapiens
tgaaacccctgtaggcctca

SEQ ID NO: 6741288 - DNA, 16 bp, Homo sapiens
tgaaaccctccaaatc

SEQ ID NO: 6741289 - DNA, 18 bp, Homo sapiens
tgaaaccctgtctctact

SEQ ID NO: 6741290 - DNA, 23 bp, Homo sapiens
tgaaaccctgtctctactaaaaa

SEQ ID NO: 6741291 - DNA, 23 bp, Homo sapiens
tgaaacctacaggaatctctgat

SEQ ID NO: 6741292 - DNA, 21 bp, Homo sapiens
tgaaacctcagggctgtccca

SEQ ID NO: 6741293 - DNA, 22 bp, Homo sapiens
tgaaacctcagggctgtcccag

SEQ ID NO: 6741294 - DNA, 19 bp, Homo sapiens
tgaaacctgttaaaacaac

SEQ ID NO: 6741295 - DNA, 15 bp, Homo sapiens
tgaaaccttcctctt

SEQ ID NO: 6741296 - DNA, 19 bp, Homo sapiens
tgaaaccttcctcttgagg

SEQ ID NO: 6741297 - DNA, 22 bp, Homo sapiens
tgaaaccttgaagttctgaaat

SEQ ID NO: 6741298 - DNA, 19 bp, Homo sapiens
tgaaacctttttcctagta

SEQ ID NO: 6741299 - DNA, 16 bp, Homo sapiens
tgaaaccttttttaag

SEQ ID NO: 6741300 - DNA, 23 bp, Homo sapiens
tgaaaccttttttaagatttttc

SEQ ID NO: 6741301 - DNA, 17 bp, Homo sapiens
tgaaacctttttttatc

SEQ ID NO: 6741302 - DNA, 18 bp, Homo sapiens
tgaaacgaatataagctt

SEQ ID NO: 6741303 - DNA, 12 bp, Homo sapiens
tgaaacgatttc

SEQ ID NO: 6741304 - DNA, 21 bp, Homo sapiens
tgaaacgcaattttacctagt

SEQ ID NO: 6741305 - DNA, 17 bp, Homo sapiens
tgaaacggatgatttct

SEQ ID NO: 6741306 - DNA, 18 bp, Homo sapiens
tgaaacggatgatttcta

SEQ ID NO: 6741307 - DNA, 14 bp, Homo sapiens
tgaaactaaagcaa

SEQ ID NO: 6741308 - DNA, 12 bp, Homo sapiens
tgaaactaatca

SEQ ID NO: 6741309 - DNA, 21 bp, Homo sapiens
tgaaactactgtatctgatgt

SEQ ID NO: 6741310 - DNA, 23 bp, Homo sapiens
tgaaactactgtatctgatgttt

SEQ ID NO: 6741311 - DNA, 21 bp, Homo sapiens
tgaaactagaaatctgtcctg

SEQ ID NO: 6741312 - DNA, 13 bp, Homo sapiens
tgaaactatattt

SEQ ID NO: 6741313 - DNA, 19 bp, Homo sapiens
tgaaactatattttgtcat

SEQ ID NO: 6741314 - DNA, 20 bp, Homo sapiens
tgaaactatttacaatgtgt

SEQ ID NO: 6741315 - DNA, 16 bp, Homo sapiens
tgaaactcacaaatga

SEQ ID NO: 6741316 - DNA, 16 bp, Homo sapiens
tgaaactcatctgtaa

SEQ ID NO: 6741317 - DNA, 12 bp, Homo sapiens
tgaaactcccac

SEQ ID NO: 6741318 - DNA, 18 bp, Homo sapiens
tgaaactcccaccctacc

SEQ ID NO: 6741319 - DNA, 18 bp, Homo sapiens
tgaaactcccttgtgttc

SEQ ID NO: 6741320 - DNA, 19 bp, Homo sapiens
tgaaactcccttgtgttcc

SEQ ID NO: 6741321 - DNA, 22 bp, Homo sapiens
tgaaactcccttgtgttccttc

SEQ ID NO: 6741322 - DNA, 23 bp, Homo sapiens
tgaaactcgcgagtgtaactttc

SEQ ID NO: 6741323 - DNA, 19 bp, Homo sapiens
tgaaactcgttaatttgta

SEQ ID NO: 6741324 - DNA, 14 bp, Homo sapiens
tgaaactctattat

SEQ ID NO: 6741325 - DNA, 23 bp, Homo sapiens
tgaaactgagaccaagtctctct

SEQ ID NO: 6741326 - DNA, 14 bp, Homo sapiens
tgaaactgagtata

SEQ ID NO: 6741327 - DNA, 18 bp, Homo sapiens
tgaaactgagtctgtgga

SEQ ID NO: 6741328 - DNA, 16 bp, Homo sapiens
tgaaactgcatttgtg

SEQ ID NO: 6741329 - DNA, 14 bp, Homo sapiens
tgaaactgcctatt

SEQ ID NO: 6741330 - DNA, 20 bp, Homo sapiens
tgaaactgcttgtttcctag

SEQ ID NO: 6741331 - DNA, 17 bp, Homo sapiens
tgaaactggggcttgca

SEQ ID NO: 6741332 - DNA, 11 bp, Homo sapiens
tgaaactgtat

SEQ ID NO: 6741333 - DNA, 14 bp, Homo sapiens
tgaaactgtattta

SEQ ID NO: 6741334 - DNA, 17 bp, Homo sapiens
tgaaactgtatttactt

SEQ ID NO: 6741335 - DNA, 18 bp, Homo sapiens
tgaaactgtcataatggt

SEQ ID NO: 6741336 - DNA, 22 bp, Homo sapiens
tgaaactgtgtacgacaaagca

SEQ ID NO: 6741337 - DNA, 17 bp, Homo sapiens
tgaaacttaattacatc

SEQ ID NO: 6741338 - DNA, 18 bp, Homo sapiens
tgaaacttacactgtttc

SEQ ID NO: 6741339 - DNA, 22 bp, Homo sapiens
tgaaacttatttttttctgatt

SEQ ID NO: 6741340 - DNA, 20 bp, Homo sapiens
tgaaacttcccaacttccct

SEQ ID NO: 6741341 - DNA, 14 bp, Homo sapiens
tgaaacttgagttt

SEQ ID NO: 6741342 - DNA, 16 bp, Homo sapiens
tgaaacttgcaacttt

SEQ ID NO: 6741343 - DNA, 15 bp, Homo sapiens
tgaaacttggtgtgt

SEQ ID NO: 6741344 - DNA, 19 bp, Homo sapiens
tgaaacttggttcccagaa

SEQ ID NO: 6741345 - DNA, 13 bp, Homo sapiens
tgaaacttgtgct

SEQ ID NO: 6741346 - DNA, 15 bp, Homo sapiens
tgaaacttgtgctat

SEQ ID NO: 6741347 - DNA, 20 bp, Homo sapiens
tgaaacttgtttcactgaaa

SEQ ID NO: 6741348 - DNA, 12 bp, Homo sapiens
tgaaactttgag

SEQ ID NO: 6741349 - DNA, 18 bp, Homo sapiens
tgaaactttgctttgggt

SEQ ID NO: 6741350 - DNA, 15 bp, Homo sapiens
tgaaactttgggaaa

SEQ ID NO: 6741351 - DNA, 21 bp, Homo sapiens
tgaaactttgggaaaacatgt

SEQ ID NO: 6741352 - DNA, 22 bp, Homo sapiens
tgaaactttgggaaaacatgtt

SEQ ID NO: 6741353 - DNA, 15 bp, Homo sapiens
tgaaacttttcaagg

SEQ ID NO: 6741354 - DNA, 17 bp, Homo sapiens
tgaaacttttctaaagt

SEQ ID NO: 6741355 - DNA, 15 bp, Homo sapiens
tgaaacttttctaga

SEQ ID NO: 6741356 - DNA, 21 bp, Homo sapiens
tgaaacttttctagaattatt

SEQ ID NO: 6741357 - DNA, 12 bp, Homo sapiens
tgaaacttttgg

SEQ ID NO: 6741358 - DNA, 12 bp, Homo sapiens
tgaaagaaaaaa

SEQ ID NO: 6741359 - DNA, 16 bp, Homo sapiens
tgaaagaaaaagtaca

SEQ ID NO: 6741360 - DNA, 15 bp, Homo sapiens
tgaaagaaaactttt

SEQ ID NO: 6741361 - DNA, 14 bp, Homo sapiens
tgaaagaaaattga

SEQ ID NO: 6741362 - DNA, 22 bp, Homo sapiens
tgaaagaaacagttaactttca

SEQ ID NO: 6741363 - DNA, 12 bp, Homo sapiens
tgaaagaaacta

SEQ ID NO: 6741364 - DNA, 20 bp, Homo sapiens
tgaaagaaagctgagaagaa

SEQ ID NO: 6741365 - DNA, 23 bp, Homo sapiens
tgaaagaaagggacccacctgct

SEQ ID NO: 6741366 - DNA, 17 bp, Homo sapiens
tgaaagaaatcatgtta

SEQ ID NO: 6741367 - DNA, 13 bp, Homo sapiens
tgaaagaagaaaa

SEQ ID NO: 6741368 - DNA, 21 bp, Homo sapiens
tgaaagaagtcaaatgaatga

SEQ ID NO: 6741369 - DNA, 16 bp, Homo sapiens
tgaaagaataaataag

SEQ ID NO: 6741370 - DNA, 23 bp, Homo sapiens
tgaaagaataggattaatgatca

SEQ ID NO: 6741371 - DNA, 13 bp, Homo sapiens
tgaaagaatatct

SEQ ID NO: 6741372 - DNA, 15 bp, Homo sapiens
tgaaagaatattagt

SEQ ID NO: 6741373 - DNA, 20 bp, Homo sapiens
tgaaagaatcagtaggacca

SEQ ID NO: 6741374 - DNA, 16 bp, Homo sapiens
tgaaagaatgtaaagc

SEQ ID NO: 6741375 - DNA, 18 bp, Homo sapiens
tgaaagaattatttttgt

SEQ ID NO: 6741376 - DNA, 21 bp, Homo sapiens
tgaaagaattctattttgctg

SEQ ID NO: 6741377 - DNA, 15 bp, Homo sapiens
tgaaagacagtaaag

SEQ ID NO: 6741378 - DNA, 15 bp, Homo sapiens
tgaaagacatcaatg

SEQ ID NO: 6741379 - DNA, 16 bp, Homo sapiens
tgaaagacatcaatga

SEQ ID NO: 6741380 - DNA, 18 bp, Homo sapiens
tgaaagacatcaatgaaa

SEQ ID NO: 6741381 - DNA, 13 bp, Homo sapiens
tgaaagacatttc

SEQ ID NO: 6741382 - DNA, 14 bp, Homo sapiens
tgaaagacatttca

SEQ ID NO: 6741383 - DNA, 17 bp, Homo sapiens
tgaaagaccagatcctt

SEQ ID NO: 6741384 - DNA, 19 bp, Homo sapiens
tgaaagaccttctccaaat

SEQ ID NO: 6741385 - DNA, 15 bp, Homo sapiens
tgaaagactgtacaa

SEQ ID NO: 6741386 - DNA, 18 bp, Homo sapiens
tgaaagactgtacaaagt

SEQ ID NO: 6741387 - DNA, 17 bp, Homo sapiens
tgaaagacttccaaaga

SEQ ID NO: 6741388 - DNA, 20 bp, Homo sapiens
tgaaagacttgaatttagtt

SEQ ID NO: 6741389 - DNA, 19 bp, Homo sapiens
tgaaagagaaaatatatat

SEQ ID NO: 6741390 - DNA, 14 bp, Homo sapiens
tgaaagagaaaatg

SEQ ID NO: 6741391 - DNA, 23 bp, Homo sapiens
tgaaagagaatttggagccagga

SEQ ID NO: 6741392 - DNA, 18 bp, Homo sapiens
tgaaagagattacttaaa

SEQ ID NO: 6741393 - DNA, 16 bp, Homo sapiens
tgaaagagtaaaggaa

SEQ ID NO: 6741394 - DNA, 17 bp, Homo sapiens
tgaaagagtaaaggaaa

SEQ ID NO: 6741395 - DNA, 17 bp, Homo sapiens
tgaaagataaatgatga

SEQ ID NO: 6741396 - DNA, 16 bp, Homo sapiens
tgaaagatatgtatat

SEQ ID NO: 6741397 - DNA, 23 bp, Homo sapiens
tgaaagatatgtatatttttgat

SEQ ID NO: 6741398 - DNA, 22 bp, Homo sapiens
tgaaagatggctgtgcctctgc

SEQ ID NO: 6741399 - DNA, 21 bp, Homo sapiens
tgaaagattatttaaatgctt

SEQ ID NO: 6741400 - DNA, 13 bp, Homo sapiens
tgaaagattcaat

SEQ ID NO: 6741401 - DNA, 21 bp, Homo sapiens
tgaaagattcaggtatgttgc

SEQ ID NO: 6741402 - DNA, 22 bp, Homo sapiens
tgaaagattgtgggggaaaaat

SEQ ID NO: 6741403 - DNA, 20 bp, Homo sapiens
tgaaagattttattgtataa

SEQ ID NO: 6741404 - DNA, 18 bp, Homo sapiens
tgaaagatttttactaat

SEQ ID NO: 6741405 - DNA, 15 bp, Homo sapiens
tgaaagcaaaaatgc

SEQ ID NO: 6741406 - DNA, 20 bp, Homo sapiens
tgaaagcaaaaatgctaata

SEQ ID NO: 6741407 - DNA, 15 bp, Homo sapiens
tgaaagcaacagctg

SEQ ID NO: 6741408 - DNA, 22 bp, Homo sapiens
tgaaagcaacagctggacaccc

SEQ ID NO: 6741409 - DNA, 11 bp, Homo sapiens
tgaaagcacag

SEQ ID NO: 6741410 - DNA, 15 bp, Homo sapiens
tgaaagcacatgaat

SEQ ID NO: 6741411 - DNA, 22 bp, Homo sapiens
tgaaagcagcacacattgtgtt

SEQ ID NO: 6741412 - DNA, 17 bp, Homo sapiens
tgaaagcagcagctagg

SEQ ID NO: 6741413 - DNA, 14 bp, Homo sapiens
tgaaagcataacat

SEQ ID NO: 6741414 - DNA, 16 bp, Homo sapiens
tgaaagcataacatgg

SEQ ID NO: 6741415 - DNA, 23 bp, Homo sapiens
tgaaagccaacaactctgccttt

SEQ ID NO: 6741416 - DNA, 21 bp, Homo sapiens
tgaaagccagcaaagcctcca

SEQ ID NO: 6741417 - DNA, 16 bp, Homo sapiens
tgaaagccatggagat

SEQ ID NO: 6741418 - DNA, 13 bp, Homo sapiens
tgaaagcccaagt

SEQ ID NO: 6741419 - DNA, 13 bp, Homo sapiens
tgaaagcctgtct

SEQ ID NO: 6741420 - DNA, 14 bp, Homo sapiens
tgaaagcctgtctc

SEQ ID NO: 6741421 - DNA, 15 bp, Homo sapiens
tgaaagcctgtctct

SEQ ID NO: 6741422 - DNA, 19 bp, Homo sapiens
tgaaagcgacttcaggtca

SEQ ID NO: 6741423 - DNA, 14 bp, Homo sapiens
tgaaagctgagaac

SEQ ID NO: 6741424 - DNA, 22 bp, Homo sapiens
tgaaagctgagaactcctgact

SEQ ID NO: 6741425 - DNA, 13 bp, Homo sapiens
tgaaagctgcttc

SEQ ID NO: 6741426 - DNA, 11 bp, Homo sapiens
tgaaagctgtg

SEQ ID NO: 6741427 - DNA, 21 bp, Homo sapiens
tgaaagctgttggatttcagt

SEQ ID NO: 6741428 - DNA, 14 bp, Homo sapiens
tgaaagctgtttca

SEQ ID NO: 6741429 - DNA, 20 bp, Homo sapiens
tgaaagctgtttcatttgtg

SEQ ID NO: 6741430 - DNA, 15 bp, Homo sapiens
tgaacattgcaatag

SEQ ID NO: 6741431 - DNA, 18 bp, Homo sapiens
tgaacattgcaatagaaa

SEQ ID NO: 6741432 - DNA, 23 bp, Homo sapiens
tgaacattggggattgaaaatca

SEQ ID NO: 6741433 - DNA, 20 bp, Homo sapiens
tgaacattggttctttcatt

SEQ ID NO: 6741434 - DNA, 19 bp, Homo sapiens
tgaacattgtactgttgct

SEQ ID NO: 6741435 - DNA, 15 bp, Homo sapiens
tgaacatttactaca

SEQ ID NO: 6741436 - DNA, 22 bp, Homo sapiens
tgaacatttactacagttttta

SEQ ID NO: 6741437 - DNA, 17 bp, Homo sapiens
tgaacatttcatggtgt

SEQ ID NO: 6741438 - DNA, 22 bp, Homo sapiens
tgaacatttgggttactatttc

SEQ ID NO: 6741439 - DNA, 18 bp, Homo sapiens
tgaacattttatcattaa

SEQ ID NO: 6741440 - DNA, 19 bp, Homo sapiens
tgaaccaaaaatagaaatt

SEQ ID NO: 6741441 - DNA, 14 bp, Homo sapiens
tgaaccaaaacatt

SEQ ID NO: 6741442 - DNA, 22 bp, Homo sapiens
tgaaccaaattgcactgaagtt

SEQ ID NO: 6741443 - DNA, 22 bp, Homo sapiens
tgaaccaagaactttccaggaa

SEQ ID NO: 6741444 - DNA, 18 bp, Homo sapiens
tgaaccaagatctataaa

SEQ ID NO: 6741445 - DNA, 17 bp, Homo sapiens
tgaaccaatagaaagca

SEQ ID NO: 6741446 - DNA, 18 bp, Homo sapiens
tgaaccaatagaaagcaa

SEQ ID NO: 6741447 - DNA, 13 bp, Homo sapiens
tgaaccaatgcaa

SEQ ID NO: 6741448 - DNA, 16 bp, Homo sapiens
tgaaccacagaaatca

SEQ ID NO: 6741449 - DNA, 21 bp, Homo sapiens
tgaaccacatcttgctctgct

SEQ ID NO: 6741450 - DNA, 23 bp, Homo sapiens
tgaaccacatcttgctctgctga

SEQ ID NO: 6741451 - DNA, 21 bp, Homo sapiens
tgaaccacctttgtctctgca

SEQ ID NO: 6741452 - DNA, 17 bp, Homo sapiens
tgaaccacgaggctgcc

SEQ ID NO: 6741453 - DNA, 20 bp, Homo sapiens
tgaaccacgtgaaactgctg

SEQ ID NO: 6741454 - DNA, 12 bp, Homo sapiens
tgaaccactgct

SEQ ID NO: 6741455 - DNA, 17 bp, Homo sapiens
tgaaccactgcttctct

SEQ ID NO: 6741456 - DNA, 20 bp, Homo sapiens
tgaaccactgcttctctttt

SEQ ID NO: 6741457 - DNA, 15 bp, Homo sapiens
tgaaccacttcattc

SEQ ID NO: 6741458 - DNA, 16 bp, Homo sapiens
tgaaccacttccctca

SEQ ID NO: 6741459 - DNA, 14 bp, Homo sapiens
tgaaccactttgcc

SEQ ID NO: 6741460 - DNA, 13 bp, Homo sapiens
tgaaccagagctg

SEQ ID NO: 6741461 - DNA, 18 bp, Homo sapiens
tgaaccagagctggaaca

SEQ ID NO: 6741462 - DNA, 22 bp, Homo sapiens
tgaaccagctcatctccaagga

SEQ ID NO: 6741463 - DNA, 14 bp, Homo sapiens
tgaaccaggccaga

SEQ ID NO: 6741464 - DNA, 16 bp, Homo sapiens
tgaaccaggccttctg

SEQ ID NO: 6741465 - DNA, 13 bp, Homo sapiens
tgaaccataaaat

SEQ ID NO: 6741466 - DNA, 18 bp, Homo sapiens
tgaaccataaaatgtcca

SEQ ID NO: 6741467 - DNA, 22 bp, Homo sapiens
tgaaccataaattcaactttgt

SEQ ID NO: 6741468 - DNA, 18 bp, Homo sapiens
tgaaccatatccatgttg

SEQ ID NO: 6741469 - DNA, 22 bp, Homo sapiens
tgaaccatccacttacatatat

SEQ ID NO: 6741470 - DNA, 22 bp, Homo sapiens
tgaaccatggtgaagtgcttgg

SEQ ID NO: 6741471 - DNA, 17 bp, Homo sapiens
tgaaccattaaagtcga

SEQ ID NO: 6741472 - DNA, 23 bp, Homo sapiens
tgaaccattccctagtcatttcc

SEQ ID NO: 6741473 - DNA, 14 bp, Homo sapiens
tgaacccaacagtc

SEQ ID NO: 6741474 - DNA, 15 bp, Homo sapiens
tgaacccacacctgg

SEQ ID NO: 6741475 - DNA, 16 bp, Homo sapiens
tgaacccacacctggg

SEQ ID NO: 6741476 - DNA, 22 bp, Homo sapiens
tgaacccaggacaagcatggtc

SEQ ID NO: 6741477 - DNA, 20 bp, Homo sapiens
tgaacccaggacgcttctga

SEQ ID NO: 6741478 - DNA, 13 bp, Homo sapiens
tgaacccaggagg

SEQ ID NO: 6741479 - DNA, 15 bp, Homo sapiens
tgaacccaggcagct

SEQ ID NO: 6741480 - DNA, 16 bp, Homo sapiens
tgaacccaggcagctg

SEQ ID NO: 6741481 - DNA, 21 bp, Homo sapiens
tgaacccaggcagctggcagg

SEQ ID NO: 6741482 - DNA, 18 bp, Homo sapiens
tgaaccccccccccccgc

SEQ ID NO: 6741483 - DNA, 21 bp, Homo sapiens
tgaaccccccgcccatgctgt

SEQ ID NO: 6741484 - DNA, 22 bp, Homo sapiens
tgaaccccccgcccatgctgtc

SEQ ID NO: 6741485 - DNA, 20 bp, Homo sapiens
tgaaccccctcaaaagccaa

SEQ ID NO: 6741486 - DNA, 22 bp, Homo sapiens
tgaaccccctcaaaagccaaaa

SEQ ID NO: 6741487 - DNA, 13 bp, Homo sapiens
tgaaccccctccc

SEQ ID NO: 6741488 - DNA, 22 bp, Homo sapiens
tgaaccccctttccccacacct

SEQ ID NO: 6741489 - DNA, 15 bp, Homo sapiens
tgaacccctggccag

SEQ ID NO: 6741490 - DNA, 16 bp, Homo sapiens
tgaacccctggccagc

SEQ ID NO: 6741491 - DNA, 14 bp, Homo sapiens
tgaacccctggctc

SEQ ID NO: 6741492 - DNA, 21 bp, Homo sapiens
tgaacccctggctccttcacc

SEQ ID NO: 6741493 - DNA, 13 bp, Homo sapiens
tgaacccctgtgt

SEQ ID NO: 6741494 - DNA, 18 bp, Homo sapiens
tgaacccgggaggcagag

SEQ ID NO: 6741495 - DNA, 16 bp, Homo sapiens
tgaacccgggggacag

SEQ ID NO: 6741496 - DNA, 19 bp, Homo sapiens
tgaaccctaaggtgagtgt

SEQ ID NO: 6741497 - DNA, 14 bp, Homo sapiens
tgaaccctcagcct

SEQ ID NO: 6741498 - DNA, 16 bp, Homo sapiens
tgaaccctcctccttt

SEQ ID NO: 6741499 - DNA, 19 bp, Homo sapiens
tgaaccctcttgccatcct

SEQ ID NO: 6741500 - DNA, 13 bp, Homo sapiens
tgaaccctgtgct

SEQ ID NO: 6741501 - DNA, 21 bp, Homo sapiens
tgaacccttcctgagctttat

SEQ ID NO: 6741502 - DNA, 21 bp, Homo sapiens
tgaaccgactgaccctgagga

SEQ ID NO: 6741503 - DNA, 20 bp, Homo sapiens
tgaaccgaggggctcaggaa

SEQ ID NO: 6741504 - DNA, 23 bp, Homo sapiens
tgaaccgccggttcattttgcac

SEQ ID NO: 6741505 - DNA, 22 bp, Homo sapiens
tgaaccggctcccaccctcaag

SEQ ID NO: 6741506 - DNA, 16 bp, Homo sapiens
tgaaccgtcaatgtga

SEQ ID NO: 6741507 - DNA, 21 bp, Homo sapiens
tgaaccgtcaatgtgaaataa

SEQ ID NO: 6741508 - DNA, 15 bp, Homo sapiens
tgaaccgtttacagt

SEQ ID NO: 6741509 - DNA, 17 bp, Homo sapiens
tgaacctacctgccttg

SEQ ID NO: 6741510 - DNA, 14 bp, Homo sapiens
tgaacctaccttca

SEQ ID NO: 6741511 - DNA, 20 bp, Homo sapiens
tgaacctaccttcatttcag

SEQ ID NO: 6741512 - DNA, 22 bp, Homo sapiens
tgaacctaggagtgccccattc

SEQ ID NO: 6741513 - DNA, 14 bp, Homo sapiens
tgaacctatccttc

SEQ ID NO: 6741514 - DNA, 17 bp, Homo sapiens
tgaacctatgaagcaat

SEQ ID NO: 6741515 - DNA, 14 bp, Homo sapiens
tgaacctattttca

SEQ ID NO: 6741516 - DNA, 15 bp, Homo sapiens
tgaacctattttcat

SEQ ID NO: 6741517 - DNA, 13 bp, Homo sapiens
tgaacctcagttt

SEQ ID NO: 6741518 - DNA, 16 bp, Homo sapiens
tgaacctcagtttcct

SEQ ID NO: 6741519 - DNA, 19 bp, Homo sapiens
tgaacctcagtttcctcat

SEQ ID NO: 6741520 - DNA, 14 bp, Homo sapiens
tgaacctcattaaa

SEQ ID NO: 6741521 - DNA, 23 bp, Homo sapiens
tgaacctgaaaagggtcagaagg

SEQ ID NO: 6741522 - DNA, 15 bp, Homo sapiens
tgaacctgatgctga

SEQ ID NO: 6741523 - DNA, 12 bp, Homo sapiens
tgaacctgccct

SEQ ID NO: 6741524 - DNA, 14 bp, Homo sapiens
tgaacctggaaatg

SEQ ID NO: 6741525 - DNA, 22 bp, Homo sapiens
tgaacctgggaaccatgaagct

SEQ ID NO: 6741526 - DNA, 20 bp, Homo sapiens
tgaacctgtcacctggcctg

SEQ ID NO: 6741527 - DNA, 20 bp, Homo sapiens
tgaacctgtgagtaaatatt

SEQ ID NO: 6741528 - DNA, 18 bp, Homo sapiens
tgaaccttgctatcaaga

SEQ ID NO: 6741529 - DNA, 13 bp, Homo sapiens
tgaacctttcaaa

SEQ ID NO: 6741530 - DNA, 14 bp, Homo sapiens
tgaacctttcaaaa

SEQ ID NO: 6741531 - DNA, 21 bp, Homo sapiens
tgaacctttgtgccctatcac

SEQ ID NO: 6741532 - DNA, 16 bp, Homo sapiens
tgaacgacagtcccag

SEQ ID NO: 6741533 - DNA, 13 bp, Homo sapiens
tgaacgagcagcc

SEQ ID NO: 6741534 - DNA, 18 bp, Homo sapiens
tgaacgagcagcccaggg

SEQ ID NO: 6741535 - DNA, 15 bp, Homo sapiens
tgaacgcaggagaat

SEQ ID NO: 6741536 - DNA, 17 bp, Homo sapiens
tgaacgctgtgatgctg

SEQ ID NO: 6741537 - DNA, 20 bp, Homo sapiens
tgaacgtacccaaggtcaca

SEQ ID NO: 6741538 - DNA, 19 bp, Homo sapiens
tgaacgtccttccttgact

SEQ ID NO: 6741539 - DNA, 16 bp, Homo sapiens
tgaacgtgccagcagc

SEQ ID NO: 6741540 - DNA, 17 bp, Homo sapiens
tgaacgtgccagcagcc

SEQ ID NO: 6741541 - DNA, 18 bp, Homo sapiens
tgaacgtgcttctttgta

SEQ ID NO: 6741542 - DNA, 20 bp, Homo sapiens
tgaacgtggattgtatttaa

SEQ ID NO: 6741543 - DNA, 21 bp, Homo sapiens
tgaacgtttggttcaaatgtg

SEQ ID NO: 6741544 - DNA, 13 bp, Homo sapiens
tgaacgttttaat

SEQ ID NO: 6741545 - DNA, 17 bp, Homo sapiens
tgaacgttttaataatt

SEQ ID NO: 6741546 - DNA, 23 bp, Homo sapiens
tgaacgttttctaattgcttatt

SEQ ID NO: 6741547 - DNA, 15 bp, Homo sapiens
tgaacgttttcttct

SEQ ID NO: 6741548 - DNA, 22 bp, Homo sapiens
tgaacgttttcttctttccctg

SEQ ID NO: 6741549 - DNA, 17 bp, Homo sapiens
tgaactaaaaagagact

SEQ ID NO: 6741550 - DNA, 15 bp, Homo sapiens
tgaactaaagtgctg

SEQ ID NO: 6741551 - DNA, 20 bp, Homo sapiens
tgaactaacataatcttaaa

SEQ ID NO: 6741552 - DNA, 18 bp, Homo sapiens
tgaactaactgccatgta

SEQ ID NO: 6741553 - DNA, 14 bp, Homo sapiens
tgaactaagaaact

SEQ ID NO: 6741554 - DNA, 22 bp, Homo sapiens
tgaactaagaaacttttgtaaa

SEQ ID NO: 6741555 - DNA, 18 bp, Homo sapiens
tgaactaagttattgctg

SEQ ID NO: 6741556 - DNA, 20 bp, Homo sapiens
tgaactaagttattgctgca

SEQ ID NO: 6741557 - DNA, 15 bp, Homo sapiens
tgaactaatatatga

SEQ ID NO: 6741558 - DNA, 15 bp, Homo sapiens
tgaactactgctatt

SEQ ID NO: 6741559 - DNA, 14 bp, Homo sapiens
tgaactagagactc

SEQ ID NO: 6741560 - DNA, 20 bp, Homo sapiens
tgaactagagactctgtgat

SEQ ID NO: 6741561 - DNA, 23 bp, Homo sapiens
tgaactagagtttagctggaaaa

SEQ ID NO: 6741562 - DNA, 22 bp, Homo sapiens
tgaactagcaattggttgttta

SEQ ID NO: 6741563 - DNA, 19 bp, Homo sapiens
tgaactagctggaattttt

SEQ ID NO: 6741564 - DNA, 21 bp, Homo sapiens
tgaactaggattgtagtccca

SEQ ID NO: 6741565 - DNA, 16 bp, Homo sapiens
tgaactataaaaagca

SEQ ID NO: 6741566 - DNA, 19 bp, Homo sapiens
tgaactatatcagtagtgt

SEQ ID NO: 6741567 - DNA, 19 bp, Homo sapiens
tgaactatcccctgcgctt

SEQ ID NO: 6741568 - DNA, 14 bp, Homo sapiens
tgaactatgaacac

SEQ ID NO: 6741569 - DNA, 23 bp, Homo sapiens
tgaactattccccagcagggtct

SEQ ID NO: 6741570 - DNA, 13 bp, Homo sapiens
tgaactattgaga

SEQ ID NO: 6741571 - DNA, 21 bp, Homo sapiens
tgaactatttattaaaaacat

SEQ ID NO: 6741572 - DNA, 17 bp, Homo sapiens
tgaactatttctacaca

SEQ ID NO: 6741573 - DNA, 14 bp, Homo sapiens
tgaactattttgaa

SEQ ID NO: 6741574 - DNA, 17 bp, Homo sapiens
tgaactattttgaagaa

SEQ ID NO: 6741575 - DNA, 19 bp, Homo sapiens
tgaactattttgaagaaaa

SEQ ID NO: 6741576 - DNA, 22 bp, Homo sapiens
tgaactattttgaagaaaacac

SEQ ID NO: 6741577 - DNA, 23 bp, Homo sapiens
tgaactattttgaagaaaacaca

SEQ ID NO: 6741578 - DNA, 17 bp, Homo sapiens
tgaactcaaactgagga

SEQ ID NO: 6741579 - DNA, 18 bp, Homo sapiens
tgaactcaaactgaggaa

SEQ ID NO: 6741580 - DNA, 17 bp, Homo sapiens
tgaactcaactttgaca

SEQ ID NO: 6741581 - DNA, 18 bp, Homo sapiens
tgaactcaagaaggaatt

SEQ ID NO: 6741582 - DNA, 19 bp, Homo sapiens
tgaactcaatataaaaaca

SEQ ID NO: 6741583 - DNA, 19 bp, Homo sapiens
tgaactcaatctaaattaa

SEQ ID NO: 6741584 - DNA, 17 bp, Homo sapiens
tgaactcaatgatagca

SEQ ID NO: 6741585 - DNA, 20 bp, Homo sapiens
tgaactcaatgcatgatgac

SEQ ID NO: 6741586 - DNA, 12 bp, Homo sapiens
tgaactcacaga

SEQ ID NO: 6741587 - DNA, 19 bp, Homo sapiens
tgaactcaccgctcaccct

SEQ ID NO: 6741588 - DNA, 17 bp, Homo sapiens
tgaactcacgagccttg

SEQ ID NO: 6741589 - DNA, 20 bp, Homo sapiens
tgaactcactttcctcctga

SEQ ID NO: 6741590 - DNA, 19 bp, Homo sapiens
tgaactcagagcccctccc

SEQ ID NO: 6741591 - DNA, 22 bp, Homo sapiens
tgaactcagagcccctccctgc

SEQ ID NO: 6741592 - DNA, 13 bp, Homo sapiens
tgaactcagccaa

SEQ ID NO: 6741593 - DNA, 14 bp, Homo sapiens
tgaactcagccaag

SEQ ID NO: 6741594 - DNA, 23 bp, Homo sapiens
tgaactcagtagctgaacctgtc

SEQ ID NO: 6741595 - DNA, 13 bp, Homo sapiens
tgaactcatccct

SEQ ID NO: 6741596 - DNA, 20 bp, Homo sapiens
tgaactcatcccttgtttat

SEQ ID NO: 6741597 - DNA, 21 bp, Homo sapiens
tgaactcattctcttcttgct

SEQ ID NO: 6741598 - DNA, 14 bp, Homo sapiens
tgaactccaccgac

SEQ ID NO: 6741599 - DNA, 11 bp, Homo sapiens
tgaactccaga

SEQ ID NO: 6741600 - DNA, 20 bp, Homo sapiens
tgaactccaggcatgtgtct

SEQ ID NO: 6741601 - DNA, 17 bp, Homo sapiens
tgaactccatcattcat

SEQ ID NO: 6741602 - DNA, 16 bp, Homo sapiens
tgaactcctaacctcg

SEQ ID NO: 6741603 - DNA, 18 bp, Homo sapiens
tgaactcctcaagggcag

SEQ ID NO: 6741604 - DNA, 11 bp, Homo sapiens
tgaactcctga

SEQ ID NO: 6741605 - DNA, 12 bp, Homo sapiens
tgaactcctgac

SEQ ID NO: 6741606 - DNA, 21 bp, Homo sapiens
tgaaggagaggatttggctcg

SEQ ID NO: 6741607 - DNA, 21 bp, Homo sapiens
tgaaggagcgggggtgtggca

SEQ ID NO: 6741608 - DNA, 18 bp, Homo sapiens
tgaaggaggcggggctct

SEQ ID NO: 6741609 - DNA, 23 bp, Homo sapiens
tgaaggaggcggggctctaggat

SEQ ID NO: 6741610 - DNA, 19 bp, Homo sapiens
tgaaggaggctccaggcag

SEQ ID NO: 6741611 - DNA, 20 bp, Homo sapiens
tgaaggaggctccaggcagc

SEQ ID NO: 6741612 - DNA, 17 bp, Homo sapiens
tgaaggaggtcaggccc

SEQ ID NO: 6741613 - DNA, 13 bp, Homo sapiens
tgaaggaggtgag

SEQ ID NO: 6741614 - DNA, 18 bp, Homo sapiens
tgaaggaggtgagagaag

SEQ ID NO: 6741615 - DNA, 17 bp, Homo sapiens
tgaaggaggtgagggat

SEQ ID NO: 6741616 - DNA, 22 bp, Homo sapiens
tgaaggattatggaaaaataaa

SEQ ID NO: 6741617 - DNA, 22 bp, Homo sapiens
tgaaggatttcttattttcttg

SEQ ID NO: 6741618 - DNA, 15 bp, Homo sapiens
tgaaggattttaaat

SEQ ID NO: 6741619 - DNA, 18 bp, Homo sapiens
tgaaggattttaaatgct

SEQ ID NO: 6741620 - DNA, 22 bp, Homo sapiens
tgaaggcaaaaactgtactgtg

SEQ ID NO: 6741621 - DNA, 22 bp, Homo sapiens
tgaaggcaaaaatctacagtgt

SEQ ID NO: 6741622 - DNA, 14 bp, Homo sapiens
tgaaggcaaaattg

SEQ ID NO: 6741623 - DNA, 16 bp, Homo sapiens
tgaaggcaaaattgca

SEQ ID NO: 6741624 - DNA, 19 bp, Homo sapiens
tgaaggcaagagatgaatt

SEQ ID NO: 6741625 - DNA, 23 bp, Homo sapiens
tgaaggcacctgcccccacagct

SEQ ID NO: 6741626 - DNA, 18 bp, Homo sapiens
tgaaggcagagaaaggga

SEQ ID NO: 6741627 - DNA, 16 bp, Homo sapiens
tgaaggcaggagttgg

SEQ ID NO: 6741628 - DNA, 14 bp, Homo sapiens
tgaaggcagggctc

SEQ ID NO: 6741629 - DNA, 20 bp, Homo sapiens
tgaaggcagggctcctccct

SEQ ID NO: 6741630 - DNA, 16 bp, Homo sapiens
tgaaggcagtctgaac

SEQ ID NO: 6741631 - DNA, 18 bp, Homo sapiens
tgaaggcagtctgaaccc

SEQ ID NO: 6741632 - DNA, 18 bp, Homo sapiens
tgaaggcatatttccaat

SEQ ID NO: 6741633 - DNA, 19 bp, Homo sapiens
tgaaggcccaagagcagag

SEQ ID NO: 6741634 - DNA, 22 bp, Homo sapiens
tgaaggcccaagagcagagtct

SEQ ID NO: 6741635 - DNA, 16 bp, Homo sapiens
tgaaggccccgcccag

SEQ ID NO: 6741636 - DNA, 19 bp, Homo sapiens
tgaaggccgagaagcaaga

SEQ ID NO: 6741637 - DNA, 14 bp, Homo sapiens
tgaaggcctccatt

SEQ ID NO: 6741638 - DNA, 18 bp, Homo sapiens
tgaaggcctggcccacag

SEQ ID NO: 6741639 - DNA, 17 bp, Homo sapiens
tgaaggcgaggctgccc

SEQ ID NO: 6741640 - DNA, 18 bp, Homo sapiens
tgaaggctaaaaagcaac

SEQ ID NO: 6741641 - DNA, 22 bp, Homo sapiens
tgaaggctcatttacttgaaat

SEQ ID NO: 6741642 - DNA, 23 bp, Homo sapiens
tgaaggctctcacccccatccct

SEQ ID NO: 6741643 - DNA, 12 bp, Homo sapiens
tgaaggctggca

SEQ ID NO: 6741644 - DNA, 13 bp, Homo sapiens
tgaaggctggcat

SEQ ID NO: 6741645 - DNA, 21 bp, Homo sapiens
tgaaggctgggttctgatcct

SEQ ID NO: 6741646 - DNA, 22 bp, Homo sapiens
tgaaggcttaattgactgaaat

SEQ ID NO: 6741647 - DNA, 13 bp, Homo sapiens
tgaaggcttctct

SEQ ID NO: 6741648 - DNA, 15 bp, Homo sapiens
tgaaggcttctctct

SEQ ID NO: 6741649 - DNA, 19 bp, Homo sapiens
tgaaggcttctctctgtgg

SEQ ID NO: 6741650 - DNA, 19 bp, Homo sapiens
tgaaggctttcagggcctc

SEQ ID NO: 6741651 - DNA, 16 bp, Homo sapiens
tgaaggcttttgatcc

SEQ ID NO: 6741652 - DNA, 20 bp, Homo sapiens
tgaaggcttttggtctccct

SEQ ID NO: 6741653 - DNA, 18 bp, Homo sapiens
tgaagggaaactgcagct

SEQ ID NO: 6741654 - DNA, 20 bp, Homo sapiens
tgaagggaacagcctgagcc

SEQ ID NO: 6741655 - DNA, 17 bp, Homo sapiens
tgaagggaagcccagcc

SEQ ID NO: 6741656 - DNA, 23 bp, Homo sapiens
tgaagggaaggcaaaggcagagg

SEQ ID NO: 6741657 - DNA, 13 bp, Homo sapiens
tgaagggaagtgg

SEQ ID NO: 6741658 - DNA, 14 bp, Homo sapiens
tgaagggaagtggg

SEQ ID NO: 6741659 - DNA, 14 bp, Homo sapiens
tgaagggacagctg

SEQ ID NO: 6741660 - DNA, 20 bp, Homo sapiens
tgaagggaccttgaagggta

SEQ ID NO: 6741661 - DNA, 21 bp, Homo sapiens
tgaagggagaagacactgcag

SEQ ID NO: 6741662 - DNA, 17 bp, Homo sapiens
tgaagggagagccagct

SEQ ID NO: 6741663 - DNA, 11 bp, Homo sapiens
tgaagggaggg

SEQ ID NO: 6741664 - DNA, 18 bp, Homo sapiens
tgaagggaggggaagaga

SEQ ID NO: 6741665 - DNA, 24 bp, Homo sapiens
tgaagggaggggaagagagaggcc

SEQ ID NO: 6741666 - DNA, 16 bp, Homo sapiens
tgaagggatgggggaa

SEQ ID NO: 6741667 - DNA, 17 bp, Homo sapiens
tgaagggatgggggaag

SEQ ID NO: 6741668 - DNA, 14 bp, Homo sapiens
tgaagggccagagc

SEQ ID NO: 6741669 - DNA, 19 bp, Homo sapiens
tgaagggccagagccaggg

SEQ ID NO: 6741670 - DNA, 15 bp, Homo sapiens
tgaagggcctcccag

SEQ ID NO: 6741671 - DNA, 16 bp, Homo sapiens
tgaagggcctcccagc

SEQ ID NO: 6741672 - DNA, 21 bp, Homo sapiens
tgaagggcctcccagccccca

SEQ ID NO: 6741673 - DNA, 20 bp, Homo sapiens
tgaagggccttgagcatctg

SEQ ID NO: 6741674 - DNA, 18 bp, Homo sapiens
tgaaggggaaaacctcag

SEQ ID NO: 6741675 - DNA, 23 bp, Homo sapiens
tgaaggggcaaattcttttgaat

SEQ ID NO: 6741676 - DNA, 22 bp, Homo sapiens
tgaaggggccaaggagggtgag

SEQ ID NO: 6741677 - DNA, 10 bp, Homo sapiens
tgaaggggcg

SEQ ID NO: 6741678 - DNA, 22 bp, Homo sapiens
tgaaggggctcttcatctgcct

SEQ ID NO: 6741679 - DNA, 11 bp, Homo sapiens
tgaaggggctg

SEQ ID NO: 6741680 - DNA, 16 bp, Homo sapiens
tgaaggggcttctaat

SEQ ID NO: 6741681 - DNA, 17 bp, Homo sapiens
tgaaggggcttctaatg

SEQ ID NO: 6741682 - DNA, 20 bp, Homo sapiens
tgaaggggcttctaatgacc

SEQ ID NO: 6741683 - DNA, 15 bp, Homo sapiens
tgaagggggcggcct

SEQ ID NO: 6741684 - DNA, 20 bp, Homo sapiens
tgaaggggtgcacccacctg

SEQ ID NO: 6741685 - DNA, 21 bp, Homo sapiens
tgaaggggtgcacccacctgt

SEQ ID NO: 6741686 - DNA, 22 bp, Homo sapiens
tgaaggggtgcacccacctgtt

SEQ ID NO: 6741687 - DNA, 14 bp, Homo sapiens
tgaagggtcctgcc

SEQ ID NO: 6741688 - DNA, 23 bp, Homo sapiens
tgaagggtgacatcccaggaggg

SEQ ID NO: 6741689 - DNA, 13 bp, Homo sapiens
tgaagggtggggt

SEQ ID NO: 6741690 - DNA, 22 bp, Homo sapiens
tgaagggttttgctatttccaa

SEQ ID NO: 6741691 - DNA, 15 bp, Homo sapiens
tgaagggttttgtgt

SEQ ID NO: 6741692 - DNA, 19 bp, Homo sapiens
tgaaggtaactaagaagtg

SEQ ID NO: 6741693 - DNA, 17 bp, Homo sapiens
tgaaggtaataaataca

SEQ ID NO: 6741694 - DNA, 18 bp, Homo sapiens
tgaaggtagaatgttttc

SEQ ID NO: 6741695 - DNA, 22 bp, Homo sapiens
tgaaggtcactcttcctgcaag

SEQ ID NO: 6741696 - DNA, 17 bp, Homo sapiens
tgaaggtcccctggcag

SEQ ID NO: 6741697 - DNA, 22 bp, Homo sapiens
tgaaggtcccctggcagtgctg

SEQ ID NO: 6741698 - DNA, 19 bp, Homo sapiens
tgaaggtctcctaaaactg

SEQ ID NO: 6741699 - DNA, 19 bp, Homo sapiens
tgaaggtctgacagtagct

SEQ ID NO: 6741700 - DNA, 16 bp, Homo sapiens
tgaaggtcttgatttg

SEQ ID NO: 6741701 - DNA, 15 bp, Homo sapiens
tgaaggtcttgcctg

SEQ ID NO: 6741702 - DNA, 16 bp, Homo sapiens
tgaaggtcttgcctga

SEQ ID NO: 6741703 - DNA, 20 bp, Homo sapiens
tgaaggtctttgttatgaca

SEQ ID NO: 6741704 - DNA, 21 bp, Homo sapiens
tgaaggtgaaacattttctcc

SEQ ID NO: 6741705 - DNA, 18 bp, Homo sapiens
tgaaggtgccattttaaa

SEQ ID NO: 6741706 - DNA, 19 bp, Homo sapiens
tgaaggtgctgacggccag

SEQ ID NO: 6741707 - DNA, 16 bp, Homo sapiens
tgaaggtgtgctacag

SEQ ID NO: 6741708 - DNA, 18 bp, Homo sapiens
tgaaggtgttgggtcagt

SEQ ID NO: 6741709 - DNA, 15 bp, Homo sapiens
tgaaggttcccaagg

SEQ ID NO: 6741710 - DNA, 15 bp, Homo sapiens
tgaaggttctggtaa

SEQ ID NO: 6741711 - DNA, 14 bp, Homo sapiens
tgaaggttgaagag

SEQ ID NO: 6741712 - DNA, 20 bp, Homo sapiens
tgaaggttgtatgtaaatct

SEQ ID NO: 6741713 - DNA, 18 bp, Homo sapiens
tgaaggtttcagatgagg

SEQ ID NO: 6741714 - DNA, 16 bp, Homo sapiens
tgaaggtttgatgcca

SEQ ID NO: 6741715 - DNA, 19 bp, Homo sapiens
tgaaggtttgatgccaaag

SEQ ID NO: 6741716 - DNA, 20 bp, Homo sapiens
tgaaggtttgatgccaaagc

SEQ ID NO: 6741717 - DNA, 21 bp, Homo sapiens
tgaaggtttgatgccaaagca

SEQ ID NO: 6741718 - DNA, 15 bp, Homo sapiens
tgaaggtttttgtaa

SEQ ID NO: 6741719 - DNA, 16 bp, Homo sapiens
tgaaggtttttgtaaa

SEQ ID NO: 6741720 - DNA, 23 bp, Homo sapiens
tgaagtaaaaccttttttcttgc

SEQ ID NO: 6741721 - DNA, 14 bp, Homo sapiens
tgaagtaaaagtta

SEQ ID NO: 6741722 - DNA, 19 bp, Homo sapiens
tgaagtaaaagttaagatc

SEQ ID NO: 6741723 - DNA, 14 bp, Homo sapiens
tgaagtaaacagct

SEQ ID NO: 6741724 - DNA, 16 bp, Homo sapiens
tgaagtaaacagctgt

SEQ ID NO: 6741725 - DNA, 15 bp, Homo sapiens
tgaagtaaactgcag

SEQ ID NO: 6741726 - DNA, 22 bp, Homo sapiens
tgaagtaaactttttgttctgg

SEQ ID NO: 6741727 - DNA, 19 bp, Homo sapiens
tgaagtaaaggattgatca

SEQ ID NO: 6741728 - DNA, 15 bp, Homo sapiens
tgaagtaaattatgt

SEQ ID NO: 6741729 - DNA, 22 bp, Homo sapiens
tgaagtaaccttataggttact

SEQ ID NO: 6741730 - DNA, 19 bp, Homo sapiens
tgaagtaactgtggaggga

SEQ ID NO: 6741731 - DNA, 17 bp, Homo sapiens
tgaagtaacttatttga

SEQ ID NO: 6741732 - DNA, 15 bp, Homo sapiens
tgaagtaagcaaaga

SEQ ID NO: 6741733 - DNA, 15 bp, Homo sapiens
tgaagtaatatgcac

SEQ ID NO: 6741734 - DNA, 21 bp, Homo sapiens
tgaagtaatatgcacacattt

SEQ ID NO: 6741735 - DNA, 19 bp, Homo sapiens
tgaagtaatttgtaaaaaa

SEQ ID NO: 6741736 - DNA, 15 bp, Homo sapiens
tgaagtacaaacatg

SEQ ID NO: 6741737 - DNA, 17 bp, Homo sapiens
tgaagtacaaacatgaa

SEQ ID NO: 6741738 - DNA, 20 bp, Homo sapiens
tgaagtacagtcccagcaca

SEQ ID NO: 6741739 - DNA, 18 bp, Homo sapiens
tgaagtacccgttcacat

SEQ ID NO: 6741740 - DNA, 21 bp, Homo sapiens
tgaagtacttgccagaagttg

SEQ ID NO: 6741741 - DNA, 13 bp, Homo sapiens
tgaagtactttta

SEQ ID NO: 6741742 - DNA, 16 bp, Homo sapiens
tgaagtacttttaacg

SEQ ID NO: 6741743 - DNA, 13 bp, Homo sapiens
tgaagtagatggt

SEQ ID NO: 6741744 - DNA, 20 bp, Homo sapiens
tgaagtagcctcttgtgtaa

SEQ ID NO: 6741745 - DNA, 23 bp, Homo sapiens
tgaagtagcctgatctttctaga

SEQ ID NO: 6741746 - DNA, 14 bp, Homo sapiens
tgaagtaggtggct

SEQ ID NO: 6741747 - DNA, 14 bp, Homo sapiens
tgaagtagtttgta

SEQ ID NO: 6741748 - DNA, 17 bp, Homo sapiens
tgaagtatacatttagt

SEQ ID NO: 6741749 - DNA, 16 bp, Homo sapiens
tgaagtatataatggt

SEQ ID NO: 6741750 - DNA, 17 bp, Homo sapiens
tgaagtatctaaaagtg

SEQ ID NO: 6741751 - DNA, 15 bp, Homo sapiens
tgaagtattaagcct

SEQ ID NO: 6741752 - DNA, 15 bp, Homo sapiens
tgaagtattacatga

SEQ ID NO: 6741753 - DNA, 15 bp, Homo sapiens
tgaagtattcacaaa

SEQ ID NO: 6741754 - DNA, 22 bp, Homo sapiens
tgaagtatttcatgtaatataa

SEQ ID NO: 6741755 - DNA, 18 bp, Homo sapiens
tgaagtattttatttgtc

SEQ ID NO: 6741756 - DNA, 13 bp, Homo sapiens
tgaagtcacacag

SEQ ID NO: 6741757 - DNA, 14 bp, Homo sapiens
tgaagtcacacagt

SEQ ID NO: 6741758 - DNA, 17 bp, Homo sapiens
tgaagtcacattagtgt

SEQ ID NO: 6741759 - DNA, 22 bp, Homo sapiens
tgaagtcacccctttctgtccc

SEQ ID NO: 6741760 - DNA, 19 bp, Homo sapiens
tgaagtcaccgggatgaac

SEQ ID NO: 6741761 - DNA, 14 bp, Homo sapiens
tgaagtcaccttgt

SEQ ID NO: 6741762 - DNA, 21 bp, Homo sapiens
tgaagtcactgcacagtgcat

SEQ ID NO: 6741763 - DNA, 23 bp, Homo sapiens
tgaagtcagatctgcctaaggac

SEQ ID NO: 6741764 - DNA, 16 bp, Homo sapiens
tgaagtcagatgtggt

SEQ ID NO: 6741765 - DNA, 20 bp, Homo sapiens
tgaagtcagccacactgggc

SEQ ID NO: 6741766 - DNA, 16 bp, Homo sapiens
tgaagtcatgctcccc

SEQ ID NO: 6741767 - DNA, 11 bp, Homo sapiens
tgaagtccaag

SEQ ID NO: 6741768 - DNA, 13 bp, Homo sapiens
tgaagtccaagca

SEQ ID NO: 6741769 - DNA, 19 bp, Homo sapiens
tgaagtccacttatgtaga

SEQ ID NO: 6741770 - DNA, 17 bp, Homo sapiens
tgaagtccagctccctt

SEQ ID NO: 6741771 - DNA, 18 bp, Homo sapiens
tgaagtccagtgaccctg

SEQ ID NO: 6741772 - DNA, 22 bp, Homo sapiens
tgaagtccagtgaccctggagc

SEQ ID NO: 6741773 - DNA, 14 bp, Homo sapiens
tgaagtccctgttc

SEQ ID NO: 6741774 - DNA, 20 bp, Homo sapiens
tgaagtccctgtttgggaat

SEQ ID NO: 6741775 - DNA, 14 bp, Homo sapiens
tgaagtcccttcct

SEQ ID NO: 6741776 - DNA, 13 bp, Homo sapiens
tgaagtccttcag

SEQ ID NO: 6741777 - DNA, 22 bp, Homo sapiens
tgaagtccttcagtgagcccct

SEQ ID NO: 6741778 - DNA, 23 bp, Homo sapiens
tgaagtccttcagtgagcccctc

SEQ ID NO: 6741779 - DNA, 22 bp, Homo sapiens
tgaagtcgagcactctaattag

SEQ ID NO: 6741780 - DNA, 17 bp, Homo sapiens
tgaagtcgttgtgaggg

SEQ ID NO: 6741781 - DNA, 12 bp, Homo sapiens
tgaagtctcccc

SEQ ID NO: 6741782 - DNA, 18 bp, Homo sapiens
tgaatctacaaaagtgaa

SEQ ID NO: 6741783 - DNA, 22 bp, Homo sapiens
tgaatctataagtagtaaatca

SEQ ID NO: 6741784 - DNA, 14 bp, Homo sapiens
tgaatctatgccaa

SEQ ID NO: 6741785 - DNA, 14 bp, Homo sapiens
tgaatctatttaag

SEQ ID NO: 6741786 - DNA, 18 bp, Homo sapiens
tgaatctatttatcttca

SEQ ID NO: 6741787 - DNA, 12 bp, Homo sapiens
tgaatctcaaag

SEQ ID NO: 6741788 - DNA, 13 bp, Homo sapiens
tgaatctcataat

SEQ ID NO: 6741789 - DNA, 20 bp, Homo sapiens
tgaatctcataatttataca

SEQ ID NO: 6741790 - DNA, 14 bp, Homo sapiens
tgaatctcccaagg

SEQ ID NO: 6741791 - DNA, 14 bp, Homo sapiens
tgaatctccttgtt

SEQ ID NO: 6741792 - DNA, 22 bp, Homo sapiens
tgaatctcgttgaggccaagga

SEQ ID NO: 6741793 - DNA, 19 bp, Homo sapiens
tgaatctctaaaatgctgt

SEQ ID NO: 6741794 - DNA, 14 bp, Homo sapiens
tgaatctctgtata

SEQ ID NO: 6741795 - DNA, 18 bp, Homo sapiens
tgaatctgaccacagaca

SEQ ID NO: 6741796 - DNA, 17 bp, Homo sapiens
tgaatctgataggaaaa

SEQ ID NO: 6741797 - DNA, 17 bp, Homo sapiens
tgaatctgattgcactg

SEQ ID NO: 6741798 - DNA, 16 bp, Homo sapiens
tgaatctgctcacttt

SEQ ID NO: 6741799 - DNA, 23 bp, Homo sapiens
tgaatctgcttttcctctgcctt

SEQ ID NO: 6741800 - DNA, 17 bp, Homo sapiens
tgaatctggacatttgt

SEQ ID NO: 6741801 - DNA, 12 bp, Homo sapiens
tgaatctgtaca

SEQ ID NO: 6741802 - DNA, 19 bp, Homo sapiens
tgaatctgtctatctgtga

SEQ ID NO: 6741803 - DNA, 14 bp, Homo sapiens
tgaatctgtgcctg

SEQ ID NO: 6741804 - DNA, 15 bp, Homo sapiens
tgaatctgttactga

SEQ ID NO: 6741805 - DNA, 22 bp, Homo sapiens
tgaatcttaatcgatgaatgta

SEQ ID NO: 6741806 - DNA, 16 bp, Homo sapiens
tgaatcttatgcaaaa

SEQ ID NO: 6741807 - DNA, 17 bp, Homo sapiens
tgaatcttatggtggaa

SEQ ID NO: 6741808 - DNA, 22 bp, Homo sapiens
tgaatcttcaccatctttctga

SEQ ID NO: 6741809 - DNA, 12 bp, Homo sapiens
tgaatcttctgg

SEQ ID NO: 6741810 - DNA, 20 bp, Homo sapiens
tgaatcttgcacatatttga

SEQ ID NO: 6741811 - DNA, 20 bp, Homo sapiens
tgaatcttgtctcaatgctc

SEQ ID NO: 6741812 - DNA, 14 bp, Homo sapiens
tgaatcttgttcaa

SEQ ID NO: 6741813 - DNA, 13 bp, Homo sapiens
tgaatctttaatt

SEQ ID NO: 6741814 - DNA, 20 bp, Homo sapiens
tgaatctttcatacatatat

SEQ ID NO: 6741815 - DNA, 17 bp, Homo sapiens
tgaatctttctcctggt

SEQ ID NO: 6741816 - DNA, 12 bp, Homo sapiens
tgaatctttgac

SEQ ID NO: 6741817 - DNA, 23 bp, Homo sapiens
tgaatctttttatcccatttagt

SEQ ID NO: 6741818 - DNA, 20 bp, Homo sapiens
tgaatgaaaaatttaagcat

SEQ ID NO: 6741819 - DNA, 21 bp, Homo sapiens
tgaatgaaaaatttaagcatt

SEQ ID NO: 6741820 - DNA, 16 bp, Homo sapiens
tgaatgaaaacatttt

SEQ ID NO: 6741821 - DNA, 16 bp, Homo sapiens
tgaatgaaaataactg

SEQ ID NO: 6741822 - DNA, 19 bp, Homo sapiens
tgaatgaaaataactgaac

SEQ ID NO: 6741823 - DNA, 16 bp, Homo sapiens
tgaatgaaacccccac

SEQ ID NO: 6741824 - DNA, 19 bp, Homo sapiens
tgaatgaaacccccacaca

SEQ ID NO: 6741825 - DNA, 14 bp, Homo sapiens
tgaatgaaagatta

SEQ ID NO: 6741826 - DNA, 11 bp, Homo sapiens
tgaatgaacac

SEQ ID NO: 6741827 - DNA, 12 bp, Homo sapiens
tgaatgaacact

SEQ ID NO: 6741828 - DNA, 21 bp, Homo sapiens
tgaatgaacccctggctcctt

SEQ ID NO: 6741829 - DNA, 19 bp, Homo sapiens
tgaatgaaccctccttttc

SEQ ID NO: 6741830 - DNA, 11 bp, Homo sapiens
tgaatgaagca

SEQ ID NO: 6741831 - DNA, 22 bp, Homo sapiens
tgaatgaagcaaatgtcatgct

SEQ ID NO: 6741832 - DNA, 22 bp, Homo sapiens
tgaatgaagccttctgacctgg

SEQ ID NO: 6741833 - DNA, 14 bp, Homo sapiens
tgaatgaataacta

SEQ ID NO: 6741834 - DNA, 18 bp, Homo sapiens
tgaatgaataactaagat

SEQ ID NO: 6741835 - DNA, 13 bp, Homo sapiens
tgaatgaatacac

SEQ ID NO: 6741836 - DNA, 13 bp, Homo sapiens
tgaatgacaagca

SEQ ID NO: 6741837 - DNA, 16 bp, Homo sapiens
tgaatgacatatttta

SEQ ID NO: 6741838 - DNA, 15 bp, Homo sapiens
tgaatgacctctcta

SEQ ID NO: 6741839 - DNA, 19 bp, Homo sapiens
tgaatgactccaggaagaa

SEQ ID NO: 6741840 - DNA, 22 bp, Homo sapiens
tgaatgacttccccaatatctt

SEQ ID NO: 6741841 - DNA, 20 bp, Homo sapiens
tgaatgagaatgtgccatgt

SEQ ID NO: 6741842 - DNA, 14 bp, Homo sapiens
tgaatgagacttaa

SEQ ID NO: 6741843 - DNA, 17 bp, Homo sapiens
tgaatgagacttaattt

SEQ ID NO: 6741844 - DNA, 21 bp, Homo sapiens
tgaatgagcattctgcagccc

SEQ ID NO: 6741845 - DNA, 16 bp, Homo sapiens
tgaatgagccaaaatg

SEQ ID NO: 6741846 - DNA, 22 bp, Homo sapiens
tgaatgagggccatatccctgt

SEQ ID NO: 6741847 - DNA, 17 bp, Homo sapiens
tgaatgaggtcccaggc

SEQ ID NO: 6741848 - DNA, 22 bp, Homo sapiens
tgaatgagtaaataaactcttc

SEQ ID NO: 6741849 - DNA, 22 bp, Homo sapiens
tgaatgagtttccagctaagcc

SEQ ID NO: 6741850 - DNA, 14 bp, Homo sapiens
tgaatgatctattc

SEQ ID NO: 6741851 - DNA, 16 bp, Homo sapiens
tgaatgattaaattat

SEQ ID NO: 6741852 - DNA, 18 bp, Homo sapiens
tgaatgattcatgttata

SEQ ID NO: 6741853 - DNA, 16 bp, Homo sapiens
tgaatgatttttcttt

SEQ ID NO: 6741854 - DNA, 20 bp, Homo sapiens
tgaatgatttttctttacaa

SEQ ID NO: 6741855 - DNA, 16 bp, Homo sapiens
tgaatgcaaaaagata

SEQ ID NO: 6741856 - DNA, 15 bp, Homo sapiens
tgaatgcaaaagaaa

SEQ ID NO: 6741857 - DNA, 21 bp, Homo sapiens
tgaatgcaatttttttttgtt

SEQ ID NO: 6741858 - DNA, 19 bp, Homo sapiens
tgaatgcacactagcctct

SEQ ID NO: 6741859 - DNA, 18 bp, Homo sapiens
tgaatgcagcactgctgc

SEQ ID NO: 6741860 - DNA, 22 bp, Homo sapiens
tgaatgcagcactgctgcctca

SEQ ID NO: 6741861 - DNA, 18 bp, Homo sapiens
tgaatgcaggttttatca

SEQ ID NO: 6741862 - DNA, 16 bp, Homo sapiens
tgaatgcagtcatgca

SEQ ID NO: 6741863 - DNA, 17 bp, Homo sapiens
tgaatgcatgtgtgaag

SEQ ID NO: 6741864 - DNA, 12 bp, Homo sapiens
tgaatgcatttt

SEQ ID NO: 6741865 - DNA, 21 bp, Homo sapiens
tgaatgcattttgtttggtat

SEQ ID NO: 6741866 - DNA, 15 bp, Homo sapiens
tgaatgccactgcct

SEQ ID NO: 6741867 - DNA, 21 bp, Homo sapiens
tgaatgccatagtcaaagaga

SEQ ID NO: 6741868 - DNA, 19 bp, Homo sapiens
tgaatgccatttagaatct

SEQ ID NO: 6741869 - DNA, 20 bp, Homo sapiens
tgaatgccatttagaatcta

SEQ ID NO: 6741870 - DNA, 17 bp, Homo sapiens
tgaatgcccccagctgg

SEQ ID NO: 6741871 - DNA, 19 bp, Homo sapiens
tgaatgcccccagctggcc

SEQ ID NO: 6741872 - DNA, 19 bp, Homo sapiens
tgaatgcctatggtggatc

SEQ ID NO: 6741873 - DNA, 13 bp, Homo sapiens
tgaatgcctcctg

SEQ ID NO: 6741874 - DNA, 19 bp, Homo sapiens
tgaatgcctcgctcccttc

SEQ ID NO: 6741875 - DNA, 23 bp, Homo sapiens
tgaatgccttatttttgaattct

SEQ ID NO: 6741876 - DNA, 20 bp, Homo sapiens
tgaatgccttccgggccggg

SEQ ID NO: 6741877 - DNA, 11 bp, Homo sapiens
tgaatgctaag

SEQ ID NO: 6741878 - DNA, 20 bp, Homo sapiens
tgaatgctaagaatgcatta

SEQ ID NO: 6741879 - DNA, 20 bp, Homo sapiens
tgaatgctatttgtgtaact

SEQ ID NO: 6741880 - DNA, 15 bp, Homo sapiens
tgaatgctgattcaa

SEQ ID NO: 6741881 - DNA, 12 bp, Homo sapiens
tgaatgctgcca

SEQ ID NO: 6741882 - DNA, 18 bp, Homo sapiens
tgaatgctgccagtgtgg

SEQ ID NO: 6741883 - DNA, 22 bp, Homo sapiens
tgaatgctgccagtgtggagtg

SEQ ID NO: 6741884 - DNA, 19 bp, Homo sapiens
tgaatgctgggactcagcc

SEQ ID NO: 6741885 - DNA, 20 bp, Homo sapiens
tgaatgctgtacctttctga

SEQ ID NO: 6741886 - DNA, 20 bp, Homo sapiens
tgaatgctgttaatatttct

SEQ ID NO: 6741887 - DNA, 22 bp, Homo sapiens
tgaatgctgttaatatttctaa

SEQ ID NO: 6741888 - DNA, 20 bp, Homo sapiens
tgaatgcttaaagcaaggca

SEQ ID NO: 6741889 - DNA, 17 bp, Homo sapiens
tgaatgcttaaatgatc

SEQ ID NO: 6741890 - DNA, 23 bp, Homo sapiens
tgaatgcttctaagtaaatacaa

SEQ ID NO: 6741891 - DNA, 21 bp, Homo sapiens
tgaatgctttgcatttggaat

SEQ ID NO: 6741892 - DNA, 23 bp, Homo sapiens
tgaatgcttttagtgtgtgcata

SEQ ID NO: 6741893 - DNA, 18 bp, Homo sapiens
tgaatgctttttgaatgt

SEQ ID NO: 6741894 - DNA, 16 bp, Homo sapiens
tgaatggaagcaaaat

SEQ ID NO: 6741895 - DNA, 17 bp, Homo sapiens
tgaatggactaagatga

SEQ ID NO: 6741896 - DNA, 19 bp, Homo sapiens
tgaatggactcatcttagt

SEQ ID NO: 6741897 - DNA, 20 bp, Homo sapiens
tgaatggattggattattta

SEQ ID NO: 6741898 - DNA, 23 bp, Homo sapiens
tgaatggattggattatttaata

SEQ ID NO: 6741899 - DNA, 16 bp, Homo sapiens
tgaatggcatggagac

SEQ ID NO: 6741900 - DNA, 12 bp, Homo sapiens
tgaatggcctgc

SEQ ID NO: 6741901 - DNA, 22 bp, Homo sapiens
tgaatggctgtgccccacctgt

SEQ ID NO: 6741902 - DNA, 21 bp, Homo sapiens
tgaatggcttggagtgcactg

SEQ ID NO: 6741903 - DNA, 18 bp, Homo sapiens
tgaatggctttgtataga

SEQ ID NO: 6741904 - DNA, 22 bp, Homo sapiens
tgaatggctttgtatagaacct

SEQ ID NO: 6741905 - DNA, 19 bp, Homo sapiens
tgaatggctttgtcttgaa

SEQ ID NO: 6741906 - DNA, 20 bp, Homo sapiens
tgaatggctttgtcttgaaa

SEQ ID NO: 6741907 - DNA, 18 bp, Homo sapiens
tgaatgggaaaagagatg

SEQ ID NO: 6741908 - DNA, 16 bp, Homo sapiens
tgaatgggaaagtatt

SEQ ID NO: 6741909 - DNA, 20 bp, Homo sapiens
tgaatgggaaagtatttttg

SEQ ID NO: 6741910 - DNA, 13 bp, Homo sapiens
tgaatgggatcat

SEQ ID NO: 6741911 - DNA, 20 bp, Homo sapiens
tgaatgggatcatgaaagta

SEQ ID NO: 6741912 - DNA, 17 bp, Homo sapiens
tgaatgggcaaaactga

SEQ ID NO: 6741913 - DNA, 21 bp, Homo sapiens
tgaatgggcatgaatggagat

SEQ ID NO: 6741914 - DNA, 19 bp, Homo sapiens
tgaatgggcatttctaaaa

SEQ ID NO: 6741915 - DNA, 14 bp, Homo sapiens
tgaatgggttgtta

SEQ ID NO: 6741916 - DNA, 16 bp, Homo sapiens
tgaatggtctctgtca

SEQ ID NO: 6741917 - DNA, 15 bp, Homo sapiens
tgaatggtgcgtgaa

SEQ ID NO: 6741918 - DNA, 21 bp, Homo sapiens
tgaatggtgttgtatgccttt

SEQ ID NO: 6741919 - DNA, 23 bp, Homo sapiens
tgaatggtttttcttttctttat

SEQ ID NO: 6741920 - DNA, 16 bp, Homo sapiens
tgaatgtaaaagaaaa

SEQ ID NO: 6741921 - DNA, 21 bp, Homo sapiens
tgaatgtaaaagacactggtg

SEQ ID NO: 6741922 - DNA, 15 bp, Homo sapiens
tgaatgtaaatttgt

SEQ ID NO: 6741923 - DNA, 14 bp, Homo sapiens
tgaatgtaaccaat

SEQ ID NO: 6741924 - DNA, 12 bp, Homo sapiens
tgaatgtacaaa

SEQ ID NO: 6741925 - DNA, 14 bp, Homo sapiens
tgaatgtacaaaga

SEQ ID NO: 6741926 - DNA, 21 bp, Homo sapiens
tgaatgtacctctattagttt

SEQ ID NO: 6741927 - DNA, 20 bp, Homo sapiens
tgaatgtaccttatttaaaa

SEQ ID NO: 6741928 - DNA, 15 bp, Homo sapiens
tgaatgtagccagcc

SEQ ID NO: 6741929 - DNA, 15 bp, Homo sapiens
tgaatgtagcttcca

SEQ ID NO: 6741930 - DNA, 22 bp, Homo sapiens
tgaatgtagcttccacctcatg

SEQ ID NO: 6741931 - DNA, 15 bp, Homo sapiens
tgaatgtatcaggaa

SEQ ID NO: 6741932 - DNA, 20 bp, Homo sapiens
tgaatgtatgcttcatacag

SEQ ID NO: 6741933 - DNA, 18 bp, Homo sapiens
tgaatgtatgtgcactgt

SEQ ID NO: 6741934 - DNA, 21 bp, Homo sapiens
tgaatgtattcttttatataa

SEQ ID NO: 6741935 - DNA, 16 bp, Homo sapiens
tgaatgtattgaactt

SEQ ID NO: 6741936 - DNA, 22 bp, Homo sapiens
tgaatgtattgttctgtttgtg

SEQ ID NO: 6741937 - DNA, 20 bp, Homo sapiens
tgaatgtatttatgtgtata

SEQ ID NO: 6741938 - DNA, 23 bp, Homo sapiens
tgaatgtatttatttgggagacc

SEQ ID NO: 6741939 - DNA, 21 bp, Homo sapiens
tgaatgtattttggttgctga

SEQ ID NO: 6741940 - DNA, 18 bp, Homo sapiens
tgaatgtcaaacagtgcc

SEQ ID NO: 6741941 - DNA, 16 bp, Homo sapiens
tgaatgtcattcacaa

SEQ ID NO: 6741942 - DNA, 14 bp, Homo sapiens
tgaatgtccaaaat

SEQ ID NO: 6741943 - DNA, 17 bp, Homo sapiens
tgaatgtccaaaattta

SEQ ID NO: 6741944 - DNA, 14 bp, Homo sapiens
tgaatgtcccagag

SEQ ID NO: 6741945 - DNA, 15 bp, Homo sapiens
tgaatgtcccagagg

SEQ ID NO: 6741946 - DNA, 20 bp, Homo sapiens
tgaatgtctaaggtcacaca

SEQ ID NO: 6741947 - DNA, 19 bp, Homo sapiens
tgaatgtcttccttttctt

SEQ ID NO: 6741948 - DNA, 20 bp, Homo sapiens
tgaatgtcttgttcctgtgc

SEQ ID NO: 6741949 - DNA, 23 bp, Homo sapiens
tgaatgtcttttgaatattccca

SEQ ID NO: 6741950 - DNA, 12 bp, Homo sapiens
tgaatgtgaata

SEQ ID NO: 6741951 - DNA, 15 bp, Homo sapiens
tgaatgtgagtcatt

SEQ ID NO: 6741952 - DNA, 20 bp, Homo sapiens
tgaatgtgagtgtgtatgtc

SEQ ID NO: 6741953 - DNA, 16 bp, Homo sapiens
tgaatgtgcatttctt

SEQ ID NO: 6741954 - DNA, 18 bp, Homo sapiens
tgaatgtgctgaagcaaa

SEQ ID NO: 6741955 - DNA, 19 bp, Homo sapiens
tgaatgtgctgaagcaaag

SEQ ID NO: 6741956 - DNA, 17 bp, Homo sapiens
tgaatgtgctggtgaac

SEQ ID NO: 6741957 - DNA, 20 bp, Homo sapiens
tgaatgtgctggtgaacact

SEQ ID NO: 6741958 - DNA, 15 bp, Homo sapiens
tgacagacatccttg

SEQ ID NO: 6741959 - DNA, 16 bp, Homo sapiens
tgacagacatccttgc

SEQ ID NO: 6741960 - DNA, 16 bp, Homo sapiens
tgacagactatttgct

SEQ ID NO: 6741961 - DNA, 17 bp, Homo sapiens
tgacagactcctgagga

SEQ ID NO: 6741962 - DNA, 23 bp, Homo sapiens
tgacagagcaggtctgcaggcca

SEQ ID NO: 6741963 - DNA, 14 bp, Homo sapiens
tgacagagccatgg

SEQ ID NO: 6741964 - DNA, 20 bp, Homo sapiens
tgacagagcctgccccagcg

SEQ ID NO: 6741965 - DNA, 23 bp, Homo sapiens
tgacagagcctgccccagcgctg

SEQ ID NO: 6741966 - DNA, 23 bp, Homo sapiens
tgacagagcgagactccatctct

SEQ ID NO: 6741967 - DNA, 22 bp, Homo sapiens
tgacagagcgagactctgtctc

SEQ ID NO: 6741968 - DNA, 13 bp, Homo sapiens
tgacagaggcagc

SEQ ID NO: 6741969 - DNA, 14 bp, Homo sapiens
tgacagaggcagcc

SEQ ID NO: 6741970 - DNA, 17 bp, Homo sapiens
tgacagaggcagcccca

SEQ ID NO: 6741971 - DNA, 13 bp, Homo sapiens
tgacagaggctgc

SEQ ID NO: 6741972 - DNA, 19 bp, Homo sapiens
tgacagagtgagactctgt

SEQ ID NO: 6741973 - DNA, 15 bp, Homo sapiens
tgacagagttcacta

SEQ ID NO: 6741974 - DNA, 20 bp, Homo sapiens
tgacagatatatttaagcct

SEQ ID NO: 6741975 - DNA, 16 bp, Homo sapiens
tgacagatcaagctgt

SEQ ID NO: 6741976 - DNA, 18 bp, Homo sapiens
tgacagatcaagctgtga

SEQ ID NO: 6741977 - DNA, 19 bp, Homo sapiens
tgacagatcaagctgtgag

SEQ ID NO: 6741978 - DNA, 23 bp, Homo sapiens
tgacagatcataggaagtggctg

SEQ ID NO: 6741979 - DNA, 21 bp, Homo sapiens
tgacagatcctccatttttgt

SEQ ID NO: 6741980 - DNA, 17 bp, Homo sapiens
tgacagatgaagaagga

SEQ ID NO: 6741981 - DNA, 14 bp, Homo sapiens
tgacagatgcctgg

SEQ ID NO: 6741982 - DNA, 15 bp, Homo sapiens
tgacagatgcctggt

SEQ ID NO: 6741983 - DNA, 18 bp, Homo sapiens
tgacagatgcctggtgag

SEQ ID NO: 6741984 - DNA, 14 bp, Homo sapiens
tgacagatgctttt

SEQ ID NO: 6741985 - DNA, 19 bp, Homo sapiens
tgacagatgcttttgctaa

SEQ ID NO: 6741986 - DNA, 11 bp, Homo sapiens
tgacagatgtc

SEQ ID NO: 6741987 - DNA, 23 bp, Homo sapiens
tgacagcaacaaagcataagaca

SEQ ID NO: 6741988 - DNA, 19 bp, Homo sapiens
tgacagcaattcatggttc

SEQ ID NO: 6741989 - DNA, 21 bp, Homo sapiens
tgacagcacctgagaagagga

SEQ ID NO: 6741990 - DNA, 21 bp, Homo sapiens
tgacagcagcctgtgagggag

SEQ ID NO: 6741991 - DNA, 20 bp, Homo sapiens
tgacagcaggccactagtga

SEQ ID NO: 6741992 - DNA, 21 bp, Homo sapiens
tgacagcaggccactagtgac

SEQ ID NO: 6741993 - DNA, 22 bp, Homo sapiens
tgacagcagtttgagcttgctg

SEQ ID NO: 6741994 - DNA, 20 bp, Homo sapiens
tgacagcatgtgccctcctg

SEQ ID NO: 6741995 - DNA, 21 bp, Homo sapiens
tgacagcatttcagctgtgag

SEQ ID NO: 6741996 - DNA, 12 bp, Homo sapiens
tgacagccacac

SEQ ID NO: 6741997 - DNA, 22 bp, Homo sapiens
tgacagccacaccgtggcagct

SEQ ID NO: 6741998 - DNA, 21 bp, Homo sapiens
tgacagccaccctcaccgcgg

SEQ ID NO: 6741999 - DNA, 12 bp, Homo sapiens
tgacagccagag

SEQ ID NO: 6742000 - DNA, 16 bp, Homo sapiens
tgacagccatttgtaa

SEQ ID NO: 6742001 - DNA, 11 bp, Homo sapiens
tgacagcccaa

SEQ ID NO: 6742002 - DNA, 23 bp, Homo sapiens
tgacagcccaacttccagaggac

SEQ ID NO: 6742003 - DNA, 17 bp, Homo sapiens
tgacagcccatgggaat

SEQ ID NO: 6742004 - DNA, 19 bp, Homo sapiens
tgacagcccctccctcctc

SEQ ID NO: 6742005 - DNA, 15 bp, Homo sapiens
tgacagcctcagtga

SEQ ID NO: 6742006 - DNA, 11 bp, Homo sapiens
tgacagcctcc

SEQ ID NO: 6742007 - DNA, 19 bp, Homo sapiens
tgacagcctccaccttgag

SEQ ID NO: 6742008 - DNA, 23 bp, Homo sapiens
tgacagcctccaccttgagcact

SEQ ID NO: 6742009 - DNA, 19 bp, Homo sapiens
tgacagcctcccaccccca

SEQ ID NO: 6742010 - DNA, 14 bp, Homo sapiens
tgacagcctcctag

SEQ ID NO: 6742011 - DNA, 16 bp, Homo sapiens
tgacagcctggggggg

SEQ ID NO: 6742012 - DNA, 20 bp, Homo sapiens
tgacagccttccccagctcc

SEQ ID NO: 6742013 - DNA, 17 bp, Homo sapiens
tgacagccttgggcctt

SEQ ID NO: 6742014 - DNA, 16 bp, Homo sapiens
tgacagcgatggcagg

SEQ ID NO: 6742015 - DNA, 19 bp, Homo sapiens
tgacagcgatggcaggcct

SEQ ID NO: 6742016 - DNA, 21 bp, Homo sapiens
tgacagcgatggcaggcctga

SEQ ID NO: 6742017 - DNA, 19 bp, Homo sapiens
tgacagcgcacagctgctc

SEQ ID NO: 6742018 - DNA, 19 bp, Homo sapiens
tgacagctctttttgtgaa

SEQ ID NO: 6742019 - DNA, 12 bp, Homo sapiens
tgacagctgcaa

SEQ ID NO: 6742020 - DNA, 13 bp, Homo sapiens
tgacagctgctcc

SEQ ID NO: 6742021 - DNA, 21 bp, Homo sapiens
tgacagctgctcctagaggga

SEQ ID NO: 6742022 - DNA, 18 bp, Homo sapiens
tgacagctggtccctgcc

SEQ ID NO: 6742023 - DNA, 13 bp, Homo sapiens
tgacagctgtccc

SEQ ID NO: 6742024 - DNA, 14 bp, Homo sapiens
tgacagctgtccct

SEQ ID NO: 6742025 - DNA, 16 bp, Homo sapiens
tgacagctgtccctgt

SEQ ID NO: 6742026 - DNA, 20 bp, Homo sapiens
tgacagctgtccctgtcacc

SEQ ID NO: 6742027 - DNA, 13 bp, Homo sapiens
tgacagctgtgct

SEQ ID NO: 6742028 - DNA, 12 bp, Homo sapiens
tgacagcttgga

SEQ ID NO: 6742029 - DNA, 13 bp, Homo sapiens
tgacagcttggaa

SEQ ID NO: 6742030 - DNA, 21 bp, Homo sapiens
tgacagcttgggaggaaacct

SEQ ID NO: 6742031 - DNA, 18 bp, Homo sapiens
tgacagctttctaactca

SEQ ID NO: 6742032 - DNA, 17 bp, Homo sapiens
tgacagctttctgggat

SEQ ID NO: 6742033 - DNA, 20 bp, Homo sapiens
tgacagctttctgggatgtc

SEQ ID NO: 6742034 - DNA, 23 bp, Homo sapiens
tgacagctttctgggatgtcaca

SEQ ID NO: 6742035 - DNA, 15 bp, Homo sapiens
tgacagctttgctgc

SEQ ID NO: 6742036 - DNA, 18 bp, Homo sapiens
tgacagctttgctgctga

SEQ ID NO: 6742037 - DNA, 19 bp, Homo sapiens
tgacaggaaagccctcccc

SEQ ID NO: 6742038 - DNA, 23 bp, Homo sapiens
tgacaggaacccatcactgtgtc

SEQ ID NO: 6742039 - DNA, 12 bp, Homo sapiens
tgacaggaagac

SEQ ID NO: 6742040 - DNA, 19 bp, Homo sapiens
tgacaggaagactggagac

SEQ ID NO: 6742041 - DNA, 15 bp, Homo sapiens
tgacaggatgtggca

SEQ ID NO: 6742042 - DNA, 19 bp, Homo sapiens
tgacaggatgtggcactgc

SEQ ID NO: 6742043 - DNA, 15 bp, Homo sapiens
tgacaggcagacaca

SEQ ID NO: 6742044 - DNA, 19 bp, Homo sapiens
tgacaggcagcagagactt

SEQ ID NO: 6742045 - DNA, 18 bp, Homo sapiens
tgacaggcagcctggaca

SEQ ID NO: 6742046 - DNA, 20 bp, Homo sapiens
tgacaggcagcctggacata

SEQ ID NO: 6742047 - DNA, 15 bp, Homo sapiens
tgacaggcccagtgg

SEQ ID NO: 6742048 - DNA, 14 bp, Homo sapiens
tgacaggcctgtcc

SEQ ID NO: 6742049 - DNA, 13 bp, Homo sapiens
tgacaggccttcc

SEQ ID NO: 6742050 - DNA, 15 bp, Homo sapiens
tgacaggctctcctg

SEQ ID NO: 6742051 - DNA, 12 bp, Homo sapiens
tgacaggctgtt

SEQ ID NO: 6742052 - DNA, 20 bp, Homo sapiens
tgacagggaagctacaggtt

SEQ ID NO: 6742053 - DNA, 23 bp, Homo sapiens
tgacagggaagctacaggttaca

SEQ ID NO: 6742054 - DNA, 16 bp, Homo sapiens
tgacagggactttgct

SEQ ID NO: 6742055 - DNA, 21 bp, Homo sapiens
tgacagggcacaccgggcact

SEQ ID NO: 6742056 - DNA, 23 bp, Homo sapiens
tgacagggcagagcaggaaggac

SEQ ID NO: 6742057 - DNA, 22 bp, Homo sapiens
tgacagggccagtggggcctgt

SEQ ID NO: 6742058 - DNA, 23 bp, Homo sapiens
tgacagggccagtggggcctgtg

SEQ ID NO: 6742059 - DNA, 15 bp, Homo sapiens
tgacaggggctcagg

SEQ ID NO: 6742060 - DNA, 17 bp, Homo sapiens
tgacaggggctcaggat

SEQ ID NO: 6742061 - DNA, 15 bp, Homo sapiens
tgacaggtaaactat

SEQ ID NO: 6742062 - DNA, 17 bp, Homo sapiens
tgacaggtaatgaagct

SEQ ID NO: 6742063 - DNA, 20 bp, Homo sapiens
tgacaggtgatgctctggct

SEQ ID NO: 6742064 - DNA, 22 bp, Homo sapiens
tgacaggtgatgctctggcttg

SEQ ID NO: 6742065 - DNA, 16 bp, Homo sapiens
tgacaggttcccagca

SEQ ID NO: 6742066 - DNA, 19 bp, Homo sapiens
tgacaggttcccagcagct

SEQ ID NO: 6742067 - DNA, 17 bp, Homo sapiens
tgacaggtttgggaccc

SEQ ID NO: 6742068 - DNA, 22 bp, Homo sapiens
tgacaggttttccaaaagtaaa

SEQ ID NO: 6742069 - DNA, 15 bp, Homo sapiens
tgacagtaattgtgt

SEQ ID NO: 6742070 - DNA, 20 bp, Homo sapiens
tgacagtaattgtgtttaca

SEQ ID NO: 6742071 - DNA, 21 bp, Homo sapiens
tgacagtaattgtgtttacat

SEQ ID NO: 6742072 - DNA, 19 bp, Homo sapiens
tgacagtagctcttagact

SEQ ID NO: 6742073 - DNA, 14 bp, Homo sapiens
tgacagtagtacca

SEQ ID NO: 6742074 - DNA, 20 bp, Homo sapiens
tgacagtagtcccctccgta

SEQ ID NO: 6742075 - DNA, 12 bp, Homo sapiens
tgacagtatatt

SEQ ID NO: 6742076 - DNA, 20 bp, Homo sapiens
tgacagtatatttgaaactg

SEQ ID NO: 6742077 - DNA, 19 bp, Homo sapiens
tgacagtatcttttttcct

SEQ ID NO: 6742078 - DNA, 12 bp, Homo sapiens
tgacagtattaa

SEQ ID NO: 6742079 - DNA, 14 bp, Homo sapiens
tgacagtattaagg

SEQ ID NO: 6742080 - DNA, 17 bp, Homo sapiens
tgacagtattaagggta

SEQ ID NO: 6742081 - DNA, 14 bp, Homo sapiens
tgacagtcactgca

SEQ ID NO: 6742082 - DNA, 14 bp, Homo sapiens
tgacagtcagctgt

SEQ ID NO: 6742083 - DNA, 21 bp, Homo sapiens
tgacagtcagctgtggggaac

SEQ ID NO: 6742084 - DNA, 21 bp, Homo sapiens
tgacagtcataaatactgtca

SEQ ID NO: 6742085 - DNA, 22 bp, Homo sapiens
tgacagtcataaatactgtcaa

SEQ ID NO: 6742086 - DNA, 14 bp, Homo sapiens
tgacagtcatcatc

SEQ ID NO: 6742087 - DNA, 14 bp, Homo sapiens
tgacagtccacagg

SEQ ID NO: 6742088 - DNA, 18 bp, Homo sapiens
tgacagtccacaggggcc

SEQ ID NO: 6742089 - DNA, 22 bp, Homo sapiens
tgacagtccgtcaaaacagatt

SEQ ID NO: 6742090 - DNA, 14 bp, Homo sapiens
tgacagtcctccat

SEQ ID NO: 6742091 - DNA, 17 bp, Homo sapiens
tgacagtcctccatcca

SEQ ID NO: 6742092 - DNA, 18 bp, Homo sapiens
tgacagtcctccatccac

SEQ ID NO: 6742093 - DNA, 20 bp, Homo sapiens
tgacagtcctccatccacgt

SEQ ID NO: 6742094 - DNA, 18 bp, Homo sapiens
tgacagtcctctccacct

SEQ ID NO: 6742095 - DNA, 11 bp, Homo sapiens
tgacagtctga

SEQ ID NO: 6742096 - DNA, 13 bp, Homo sapiens
tgacagtgaaaca

SEQ ID NO: 6742097 - DNA, 13 bp, Homo sapiens
tgacagtgaaata

SEQ ID NO: 6742098 - DNA, 14 bp, Homo sapiens
tgacagtgaagata

SEQ ID NO: 6742099 - DNA, 22 bp, Homo sapiens
tgacagtgaagcagcactgtga

SEQ ID NO: 6742100 - DNA, 23 bp, Homo sapiens
tgacagtgacgtgactcagagct

SEQ ID NO: 6742101 - DNA, 20 bp, Homo sapiens
tgacagtgaggtcctggggg

SEQ ID NO: 6742102 - DNA, 14 bp, Homo sapiens
tgacagtgcctctt

SEQ ID NO: 6742103 - DNA, 16 bp, Homo sapiens
tgacagtgccttctct

SEQ ID NO: 6742104 - DNA, 16 bp, Homo sapiens
tgacagtgctctaggc

SEQ ID NO: 6742105 - DNA, 14 bp, Homo sapiens
tgacagtgcttgca

SEQ ID NO: 6742106 - DNA, 18 bp, Homo sapiens
tgacagtggaactacatt

SEQ ID NO: 6742107 - DNA, 14 bp, Homo sapiens
tgacagtggtgggc

SEQ ID NO: 6742108 - DNA, 15 bp, Homo sapiens
tgacagtgtgggaca

SEQ ID NO: 6742109 - DNA, 17 bp, Homo sapiens
tgacagtgtgggacagg

SEQ ID NO: 6742110 - DNA, 18 bp, Homo sapiens
tgacagttacttacacac

SEQ ID NO: 6742111 - DNA, 17 bp, Homo sapiens
tgacagttcccagagtg

SEQ ID NO: 6742112 - DNA, 16 bp, Homo sapiens
tgacagttctgaagaa

SEQ ID NO: 6742113 - DNA, 23 bp, Homo sapiens
tgacagttctgttggtctacaga

SEQ ID NO: 6742114 - DNA, 14 bp, Homo sapiens
tgacagtttccaaa

SEQ ID NO: 6742115 - DNA, 17 bp, Homo sapiens
tgacagtttccaaattg

SEQ ID NO: 6742116 - DNA, 19 bp, Homo sapiens
tgacagtttcttttgtgtt

SEQ ID NO: 6742117 - DNA, 16 bp, Homo sapiens
tgacagtttttctgtt

SEQ ID NO: 6742118 - DNA, 17 bp, Homo sapiens
tgacagtttttgacatt

SEQ ID NO: 6742119 - DNA, 15 bp, Homo sapiens
tgacataaaaagaag

SEQ ID NO: 6742120 - DNA, 21 bp, Homo sapiens
tgacataaaatttacatttaa

SEQ ID NO: 6742121 - DNA, 16 bp, Homo sapiens
tgacataaacccatct

SEQ ID NO: 6742122 - DNA, 23 bp, Homo sapiens
tgacataaacccatctgtaatat

SEQ ID NO: 6742123 - DNA, 16 bp, Homo sapiens
tgacataaagttgata

SEQ ID NO: 6742124 - DNA, 17 bp, Homo sapiens
tgacataacagtgcagg

SEQ ID NO: 6742125 - DNA, 21 bp, Homo sapiens
tgacataagatggttgaccaa

SEQ ID NO: 6742126 - DNA, 17 bp, Homo sapiens
tgacataataaagtatt

SEQ ID NO: 6742127 - DNA, 15 bp, Homo sapiens
tgacataattgtcca

SEQ ID NO: 6742128 - DNA, 20 bp, Homo sapiens
tgacataattgtccagttat

SEQ ID NO: 6742129 - DNA, 20 bp, Homo sapiens
tgacatacaaaccatgattg

SEQ ID NO: 6742130 - DNA, 15 bp, Homo sapiens
tgacataccccctcc

SEQ ID NO: 6742131 - DNA, 19 bp, Homo sapiens
tgacatacctaccagtatt

SEQ ID NO: 6742132 - DNA, 21 bp, Homo sapiens
tgacataccttagactgaaaa

SEQ ID NO: 6742133 - DNA, 21 bp, Homo sapiens
tgacatacgcttttaatgaaa

SEQ ID NO: 6742134 - DNA, 13 bp, Homo sapiens
tgacatagcctca

SEQ ID NO: 6742135 - DNA, 14 bp, Homo sapiens
tgacctcactggcc

SEQ ID NO: 6742136 - DNA, 16 bp, Homo sapiens
tgacctcactggcctg

SEQ ID NO: 6742137 - DNA, 19 bp, Homo sapiens
tgacctcagcaaatcctct

SEQ ID NO: 6742138 - DNA, 20 bp, Homo sapiens
tgacctcaggcaatctgccc

SEQ ID NO: 6742139 - DNA, 20 bp, Homo sapiens
tgacctcaggtgatccgccc

SEQ ID NO: 6742140 - DNA, 18 bp, Homo sapiens
tgacctcagtcaggcact

SEQ ID NO: 6742141 - DNA, 19 bp, Homo sapiens
tgacctcatgcatctccac

SEQ ID NO: 6742142 - DNA, 12 bp, Homo sapiens
tgacctccagaa

SEQ ID NO: 6742143 - DNA, 13 bp, Homo sapiens
tgacctccagaag

SEQ ID NO: 6742144 - DNA, 22 bp, Homo sapiens
tgacctccagaagtcccttcaa

SEQ ID NO: 6742145 - DNA, 21 bp, Homo sapiens
tgacctccagagctgtcctcc

SEQ ID NO: 6742146 - DNA, 16 bp, Homo sapiens
tgacctccagtcctgc

SEQ ID NO: 6742147 - DNA, 21 bp, Homo sapiens
tgacctccagtcctgctggcc

SEQ ID NO: 6742148 - DNA, 22 bp, Homo sapiens
tgacctccagtcctgctggcct

SEQ ID NO: 6742149 - DNA, 14 bp, Homo sapiens
tgacctcccagccc

SEQ ID NO: 6742150 - DNA, 22 bp, Homo sapiens
tgacctcccctccccagcccaa

SEQ ID NO: 6742151 - DNA, 19 bp, Homo sapiens
tgacctccgccatccaccc

SEQ ID NO: 6742152 - DNA, 19 bp, Homo sapiens
tgacctccgcccctgcccc

SEQ ID NO: 6742153 - DNA, 18 bp, Homo sapiens
tgacctccgcctcctggg

SEQ ID NO: 6742154 - DNA, 15 bp, Homo sapiens
tgacctccggccagg

SEQ ID NO: 6742155 - DNA, 24 bp, Homo sapiens
tgacctccggccaggtgcctcctg

SEQ ID NO: 6742156 - DNA, 13 bp, Homo sapiens
tgacctccgtcct

SEQ ID NO: 6742157 - DNA, 19 bp, Homo sapiens
tgacctccgtcctctcccc

SEQ ID NO: 6742158 - DNA, 20 bp, Homo sapiens
tgacctccgtcctctcccca

SEQ ID NO: 6742159 - DNA, 18 bp, Homo sapiens
tgacctcctcctgccctc

SEQ ID NO: 6742160 - DNA, 20 bp, Homo sapiens
tgacctcctctgggccctgt

SEQ ID NO: 6742161 - DNA, 19 bp, Homo sapiens
tgacctcctggactgtagg

SEQ ID NO: 6742162 - DNA, 20 bp, Homo sapiens
tgacctcctggactgtagga

SEQ ID NO: 6742163 - DNA, 15 bp, Homo sapiens
tgacctcctgtcact

SEQ ID NO: 6742164 - DNA, 24 bp, Homo sapiens
tgacctcctgtcactcactgaggc

SEQ ID NO: 6742165 - DNA, 16 bp, Homo sapiens
tgacctccttctgcaa

SEQ ID NO: 6742166 - DNA, 18 bp, Homo sapiens
tgacctcgtactcaggag

SEQ ID NO: 6742167 - DNA, 19 bp, Homo sapiens
tgacctcgtactcaggagc

SEQ ID NO: 6742168 - DNA, 20 bp, Homo sapiens
tgacctcgtactcaggagcc

SEQ ID NO: 6742169 - DNA, 18 bp, Homo sapiens
tgacctcgtgatccgccc

SEQ ID NO: 6742170 - DNA, 18 bp, Homo sapiens
tgacctcgtgatgggccc

SEQ ID NO: 6742171 - DNA, 17 bp, Homo sapiens
tgacctctagagctgga

SEQ ID NO: 6742172 - DNA, 19 bp, Homo sapiens
tgacctctagccctgcccg

SEQ ID NO: 6742173 - DNA, 15 bp, Homo sapiens
tgacctctataaact

SEQ ID NO: 6742174 - DNA, 18 bp, Homo sapiens
tgacctctcagggcctgg

SEQ ID NO: 6742175 - DNA, 22 bp, Homo sapiens
tgacctctcagggcctggcagg

SEQ ID NO: 6742176 - DNA, 16 bp, Homo sapiens
tgacctctccagcatc

SEQ ID NO: 6742177 - DNA, 17 bp, Homo sapiens
tgacctctccggcctgg

SEQ ID NO: 6742178 - DNA, 18 bp, Homo sapiens
tgacctctccggcctggc

SEQ ID NO: 6742179 - DNA, 23 bp, Homo sapiens
tgacctctctacttccccttctt

SEQ ID NO: 6742180 - DNA, 20 bp, Homo sapiens
tgacctctctctctgggact

SEQ ID NO: 6742181 - DNA, 17 bp, Homo sapiens
tgacctctgaagagctg

SEQ ID NO: 6742182 - DNA, 21 bp, Homo sapiens
tgacctctgacaactgtgaag

SEQ ID NO: 6742183 - DNA, 18 bp, Homo sapiens
tgacctctgcaagacaaa

SEQ ID NO: 6742184 - DNA, 12 bp, Homo sapiens
tgacctctgcct

SEQ ID NO: 6742185 - DNA, 12 bp, Homo sapiens
tgacctctgctg

SEQ ID NO: 6742186 - DNA, 22 bp, Homo sapiens
tgacctctgctgagtgctgggc

SEQ ID NO: 6742187 - DNA, 17 bp, Homo sapiens
tgacctctgtgaccaac

SEQ ID NO: 6742188 - DNA, 19 bp, Homo sapiens
tgacctcttctctcctccc

SEQ ID NO: 6742189 - DNA, 13 bp, Homo sapiens
tgacctcttgctg

SEQ ID NO: 6742190 - DNA, 18 bp, Homo sapiens
tgacctcttgctgtctct

SEQ ID NO: 6742191 - DNA, 19 bp, Homo sapiens
tgacctcttgctgtctctg

SEQ ID NO: 6742192 - DNA, 22 bp, Homo sapiens
tgacctcttgctgtctctgctc

SEQ ID NO: 6742193 - DNA, 14 bp, Homo sapiens
tgacctgaactctg

SEQ ID NO: 6742194 - DNA, 14 bp, Homo sapiens
tgacctgaagttca

SEQ ID NO: 6742195 - DNA, 12 bp, Homo sapiens
tgacctgaattg

SEQ ID NO: 6742196 - DNA, 20 bp, Homo sapiens
tgacctgaccccattcctga

SEQ ID NO: 6742197 - DNA, 20 bp, Homo sapiens
tgacctgagatgctgggagg

SEQ ID NO: 6742198 - DNA, 15 bp, Homo sapiens
tgacctgaggccctt

SEQ ID NO: 6742199 - DNA, 19 bp, Homo sapiens
tgacctgaggcccttctct

SEQ ID NO: 6742200 - DNA, 13 bp, Homo sapiens
tgacctgatttca

SEQ ID NO: 6742201 - DNA, 20 bp, Homo sapiens
tgacctgcagtcagggccca

SEQ ID NO: 6742202 - DNA, 18 bp, Homo sapiens
tgacctgcattgtaaata

SEQ ID NO: 6742203 - DNA, 16 bp, Homo sapiens
tgacctgccagccggt

SEQ ID NO: 6742204 - DNA, 10 bp, Homo sapiens
tgacctgccc

SEQ ID NO: 6742205 - DNA, 16 bp, Homo sapiens
tgacctgcccatgtcc

SEQ ID NO: 6742206 - DNA, 23 bp, Homo sapiens
tgacctgcccgatccagattccc

SEQ ID NO: 6742207 - DNA, 18 bp, Homo sapiens
tgacctgcctctcacaca

SEQ ID NO: 6742208 - DNA, 12 bp, Homo sapiens
tgacctgctccg

SEQ ID NO: 6742209 - DNA, 13 bp, Homo sapiens
tgacctgctcctg

SEQ ID NO: 6742210 - DNA, 16 bp, Homo sapiens
tgacctgctcctgccc

SEQ ID NO: 6742211 - DNA, 17 bp, Homo sapiens
tgacctgctcctgccca

SEQ ID NO: 6742212 - DNA, 16 bp, Homo sapiens
tgacctgctgaattgt

SEQ ID NO: 6742213 - DNA, 12 bp, Homo sapiens
tgacctgctgag

SEQ ID NO: 6742214 - DNA, 13 bp, Homo sapiens
tgacctgctgagc

SEQ ID NO: 6742215 - DNA, 14 bp, Homo sapiens
tgacctgctgagct

SEQ ID NO: 6742216 - DNA, 15 bp, Homo sapiens
tgacctgctgagctc

SEQ ID NO: 6742217 - DNA, 17 bp, Homo sapiens
tgacctgctgagctctg

SEQ ID NO: 6742218 - DNA, 18 bp, Homo sapiens
tgacctgctgagctctga

SEQ ID NO: 6742219 - DNA, 21 bp, Homo sapiens
tgacctgctgggtaaactgtg

SEQ ID NO: 6742220 - DNA, 11 bp, Homo sapiens
tgacctgctgt

SEQ ID NO: 6742221 - DNA, 12 bp, Homo sapiens
tgacctgctgtg

SEQ ID NO: 6742222 - DNA, 17 bp, Homo sapiens
tgacctggaagagctgg

SEQ ID NO: 6742223 - DNA, 20 bp, Homo sapiens
tgacctggaaggcccagcac

SEQ ID NO: 6742224 - DNA, 22 bp, Homo sapiens
tgacctggataacttaggtggc

SEQ ID NO: 6742225 - DNA, 20 bp, Homo sapiens
tgacctggcatcttggaaat

SEQ ID NO: 6742226 - DNA, 21 bp, Homo sapiens
tgacctgggcccacagagcct

SEQ ID NO: 6742227 - DNA, 22 bp, Homo sapiens
tgacctgggtatcccctgcctc

SEQ ID NO: 6742228 - DNA, 15 bp, Homo sapiens
tgacctggtctggtc

SEQ ID NO: 6742229 - DNA, 18 bp, Homo sapiens
tgacctggtctggtcagg

SEQ ID NO: 6742230 - DNA, 19 bp, Homo sapiens
tgacctggtctggtcaggc

SEQ ID NO: 6742231 - DNA, 21 bp, Homo sapiens
tgacctggtctggtcaggcaa

SEQ ID NO: 6742232 - DNA, 16 bp, Homo sapiens
tgacctgtcagaataa

SEQ ID NO: 6742233 - DNA, 15 bp, Homo sapiens
tgacctgtcatgccc

SEQ ID NO: 6742234 - DNA, 15 bp, Homo sapiens
tgacctgtgaccagc

SEQ ID NO: 6742235 - DNA, 20 bp, Homo sapiens
tgacctgtgagcccagctgg

SEQ ID NO: 6742236 - DNA, 22 bp, Homo sapiens
tgacctgtggggatttctccca

SEQ ID NO: 6742237 - DNA, 21 bp, Homo sapiens
tgacctgttaggtctcatgcc

SEQ ID NO: 6742238 - DNA, 15 bp, Homo sapiens
tgacctgtttctctt

SEQ ID NO: 6742239 - DNA, 16 bp, Homo sapiens
tgaccttaaatgcaac

SEQ ID NO: 6742240 - DNA, 20 bp, Homo sapiens
tgaccttaaggaaaagtaag

SEQ ID NO: 6742241 - DNA, 14 bp, Homo sapiens
tgaccttagcccca

SEQ ID NO: 6742242 - DNA, 22 bp, Homo sapiens
tgaccttagccccattgctcca

SEQ ID NO: 6742243 - DNA, 19 bp, Homo sapiens
tgaccttagcgttctggac

SEQ ID NO: 6742244 - DNA, 15 bp, Homo sapiens
tgaccttagtgtttc

SEQ ID NO: 6742245 - DNA, 16 bp, Homo sapiens
tgaccttagtgtttct

SEQ ID NO: 6742246 - DNA, 23 bp, Homo sapiens
tgaccttagtgtttctgtgcatg

SEQ ID NO: 6742247 - DNA, 23 bp, Homo sapiens
tgaccttcacagggacagatctg

SEQ ID NO: 6742248 - DNA, 12 bp, Homo sapiens
tgaccttcagct

SEQ ID NO: 6742249 - DNA, 19 bp, Homo sapiens
tgaccttcagctcacgctt

SEQ ID NO: 6742250 - DNA, 14 bp, Homo sapiens
tgaccttcatgacc

SEQ ID NO: 6742251 - DNA, 17 bp, Homo sapiens
tgaccttccaaagacta

SEQ ID NO: 6742252 - DNA, 20 bp, Homo sapiens
tgaccttccaagagcctgag

SEQ ID NO: 6742253 - DNA, 21 bp, Homo sapiens
tgaccttcctcgcagagaggc

SEQ ID NO: 6742254 - DNA, 23 bp, Homo sapiens
tgaccttcctcgcagagaggcca

SEQ ID NO: 6742255 - DNA, 14 bp, Homo sapiens
tgaccttcctctgg

SEQ ID NO: 6742256 - DNA, 17 bp, Homo sapiens
tgaccttcctctggggc

SEQ ID NO: 6742257 - DNA, 16 bp, Homo sapiens
tgaccttccttcctgt

SEQ ID NO: 6742258 - DNA, 14 bp, Homo sapiens
tgaccttctctata

SEQ ID NO: 6742259 - DNA, 15 bp, Homo sapiens
tgaccttctcttaga

SEQ ID NO: 6742260 - DNA, 14 bp, Homo sapiens
tgaccttctgaaca

SEQ ID NO: 6742261 - DNA, 14 bp, Homo sapiens
tgaccttctgggaa

SEQ ID NO: 6742262 - DNA, 20 bp, Homo sapiens
tgaccttctgtcgtccccag

SEQ ID NO: 6742263 - DNA, 22 bp, Homo sapiens
tgaccttctgtcgtccccagac

SEQ ID NO: 6742264 - DNA, 23 bp, Homo sapiens
tgaccttctgtcgtccccagacc

SEQ ID NO: 6742265 - DNA, 15 bp, Homo sapiens
tgaccttgaatcttt

SEQ ID NO: 6742266 - DNA, 21 bp, Homo sapiens
tgaccttgaggagtcttgtgt

SEQ ID NO: 6742267 - DNA, 18 bp, Homo sapiens
tgaccttgatgagctgtg

SEQ ID NO: 6742268 - DNA, 16 bp, Homo sapiens
tgaccttgatgtcttg

SEQ ID NO: 6742269 - DNA, 20 bp, Homo sapiens
tgaccttgatgtcttgagag

SEQ ID NO: 6742270 - DNA, 17 bp, Homo sapiens
tgaccttggagagacac

SEQ ID NO: 6742271 - DNA, 18 bp, Homo sapiens
tgaccttggctgactggg

SEQ ID NO: 6742272 - DNA, 21 bp, Homo sapiens
tgaccttgggaccaaaggggg

SEQ ID NO: 6742273 - DNA, 12 bp, Homo sapiens
tgaccttgtaat

SEQ ID NO: 6742274 - DNA, 13 bp, Homo sapiens
tgaccttgtaatg

SEQ ID NO: 6742275 - DNA, 14 bp, Homo sapiens
tgaccttgtaatgt

SEQ ID NO: 6742276 - DNA, 16 bp, Homo sapiens
tgaccttgtaatgtaa

SEQ ID NO: 6742277 - DNA, 21 bp, Homo sapiens
tgaccttgtacctctctttga

SEQ ID NO: 6742278 - DNA, 15 bp, Homo sapiens
tgacctttaggtatt

SEQ ID NO: 6742279 - DNA, 13 bp, Homo sapiens
tgacctttagtgc

SEQ ID NO: 6742280 - DNA, 18 bp, Homo sapiens
tgacctttagtgccaact

SEQ ID NO: 6742281 - DNA, 23 bp, Homo sapiens
tgacctttatttattaaacttca

SEQ ID NO: 6742282 - DNA, 12 bp, Homo sapiens
tgacctttcaaa

SEQ ID NO: 6742283 - DNA, 22 bp, Homo sapiens
tgacctttcaataggaaaaact

SEQ ID NO: 6742284 - DNA, 22 bp, Homo sapiens
tgacctttcatcgtaaagtgct

SEQ ID NO: 6742285 - DNA, 20 bp, Homo sapiens
tgacctttgaggtctaaaca

SEQ ID NO: 6742286 - DNA, 15 bp, Homo sapiens
tgacctttgtctaga

SEQ ID NO: 6742287 - DNA, 16 bp, Homo sapiens
tgaccttttaatcaga

SEQ ID NO: 6742288 - DNA, 23 bp, Homo sapiens
tgaccttttaatcagagcccagg

SEQ ID NO: 6742289 - DNA, 17 bp, Homo sapiens
tgaccttttatgtagta

SEQ ID NO: 6742290 - DNA, 17 bp, Homo sapiens
tgaccttttcttcattt

SEQ ID NO: 6742291 - DNA, 18 bp, Homo sapiens
tgaccttttcttcatttt

SEQ ID NO: 6742292 - DNA, 20 bp, Homo sapiens
tgaccttttgacttaaagca

SEQ ID NO: 6742293 - DNA, 20 bp, Homo sapiens
tgaccttttggcctttgtaa

SEQ ID NO: 6742294 - DNA, 17 bp, Homo sapiens
tgacctttttaatccag

SEQ ID NO: 6742295 - DNA, 20 bp, Homo sapiens
tgacctttttaatccaggcc

SEQ ID NO: 6742296 - DNA, 18 bp, Homo sapiens
tgacgaaactggccccgg

SEQ ID NO: 6742297 - DNA, 19 bp, Homo sapiens
tgacgaaactggccccgga

SEQ ID NO: 6742298 - DNA, 19 bp, Homo sapiens
tgacgaactggctacagta

SEQ ID NO: 6742299 - DNA, 19 bp, Homo sapiens
tgacgaacttccatggccc

SEQ ID NO: 6742300 - DNA, 20 bp, Homo sapiens
tgacgacaaagctgctaaat

SEQ ID NO: 6742301 - DNA, 21 bp, Homo sapiens
tgacgacctacatctgaaatc

SEQ ID NO: 6742302 - DNA, 19 bp, Homo sapiens
tgacgatcccatgttagct

SEQ ID NO: 6742303 - DNA, 14 bp, Homo sapiens
tgacgatcttcccc

SEQ ID NO: 6742304 - DNA, 17 bp, Homo sapiens
tgacgatcttccccctt

SEQ ID NO: 6742305 - DNA, 16 bp, Homo sapiens
tgacgattccttctct

SEQ ID NO: 6742306 - DNA, 17 bp, Homo sapiens
tgacgattccttctctg

SEQ ID NO: 6742307 - DNA, 14 bp, Homo sapiens
tgacgcaatgaaaa

SEQ ID NO: 6742308 - DNA, 16 bp, Homo sapiens
tgacgcaccactgcca

SEQ ID NO: 6742309 - DNA, 18 bp, Homo sapiens
tgacgcagacagagggga

SEQ ID NO: 6742310 - DNA, 20 bp, Homo sapiens
tgacgcagacagaggggatg

SEQ ID NO: 6742311 - DNA, 13 bp, Homo sapiens
tgacgcagcctga

SEQ ID NO: 6742312 - DNA, 23 bp, Homo sapiens
tgactttcacatttggaatttaa

SEQ ID NO: 6742313 - DNA, 21 bp, Homo sapiens
tgactttcaggaattgcccat

SEQ ID NO: 6742314 - DNA, 17 bp, Homo sapiens
tgactttcataataaat

SEQ ID NO: 6742315 - DNA, 15 bp, Homo sapiens
tgactttcattggaa

SEQ ID NO: 6742316 - DNA, 12 bp, Homo sapiens
tgactttcccca

SEQ ID NO: 6742317 - DNA, 15 bp, Homo sapiens
tgactttcctcccat

SEQ ID NO: 6742318 - DNA, 16 bp, Homo sapiens
tgactttcctctttgg

SEQ ID NO: 6742319 - DNA, 15 bp, Homo sapiens
tgactttctgattgg

SEQ ID NO: 6742320 - DNA, 14 bp, Homo sapiens
tgactttgaactga

SEQ ID NO: 6742321 - DNA, 18 bp, Homo sapiens
tgactttgaatttatata

SEQ ID NO: 6742322 - DNA, 15 bp, Homo sapiens
tgactttgcacctgc

SEQ ID NO: 6742323 - DNA, 16 bp, Homo sapiens
tgactttgcacctgca

SEQ ID NO: 6742324 - DNA, 14 bp, Homo sapiens
tgactttgctttga

SEQ ID NO: 6742325 - DNA, 16 bp, Homo sapiens
tgactttggataataa

SEQ ID NO: 6742326 - DNA, 15 bp, Homo sapiens
tgactttggggacag

SEQ ID NO: 6742327 - DNA, 19 bp, Homo sapiens
tgactttggtttttccaac

SEQ ID NO: 6742328 - DNA, 16 bp, Homo sapiens
tgactttgtctctcct

SEQ ID NO: 6742329 - DNA, 18 bp, Homo sapiens
tgactttgtctctcctgg

SEQ ID NO: 6742330 - DNA, 16 bp, Homo sapiens
tgacttttaaaaataa

SEQ ID NO: 6742331 - DNA, 18 bp, Homo sapiens
tgacttttaaagatttag

SEQ ID NO: 6742332 - DNA, 18 bp, Homo sapiens
tgacttttattatgggta

SEQ ID NO: 6742333 - DNA, 13 bp, Homo sapiens
tgacttttccaaa

SEQ ID NO: 6742334 - DNA, 21 bp, Homo sapiens
tgacttttccaaataaacatt

SEQ ID NO: 6742335 - DNA, 20 bp, Homo sapiens
tgacttttctgattaatata

SEQ ID NO: 6742336 - DNA, 18 bp, Homo sapiens
tgacttttctggaagaca

SEQ ID NO: 6742337 - DNA, 19 bp, Homo sapiens
tgacttttctgtaattcag

SEQ ID NO: 6742338 - DNA, 22 bp, Homo sapiens
tgacttttctgtaattcaggtt

SEQ ID NO: 6742339 - DNA, 22 bp, Homo sapiens
tgacttttctgtccgagctttg

SEQ ID NO: 6742340 - DNA, 14 bp, Homo sapiens
tgacttttctgtgg

SEQ ID NO: 6742341 - DNA, 12 bp, Homo sapiens
tgacttttgtat

SEQ ID NO: 6742342 - DNA, 17 bp, Homo sapiens
tgacttttgttaaattc

SEQ ID NO: 6742343 - DNA, 22 bp, Homo sapiens
tgactttttaaaaaatgctggg

SEQ ID NO: 6742344 - DNA, 23 bp, Homo sapiens
tgactttttaaacgattagtgat

SEQ ID NO: 6742345 - DNA, 15 bp, Homo sapiens
tgactttttaaattt

SEQ ID NO: 6742346 - DNA, 14 bp, Homo sapiens
tgactttttataaa

SEQ ID NO: 6742347 - DNA, 15 bp, Homo sapiens
tgactttttataatg

SEQ ID NO: 6742348 - DNA, 22 bp, Homo sapiens
tgactttttctaagagctcccg

SEQ ID NO: 6742349 - DNA, 15 bp, Homo sapiens
tgactttttctgtgc

SEQ ID NO: 6742350 - DNA, 15 bp, Homo sapiens
tgactttttggaatt

SEQ ID NO: 6742351 - DNA, 19 bp, Homo sapiens
tgagaaaaaaaaaaaagac

SEQ ID NO: 6742352 - DNA, 14 bp, Homo sapiens
tgagaaaaaaagaa

SEQ ID NO: 6742353 - DNA, 18 bp, Homo sapiens
tgagaaaaactaacttga

SEQ ID NO: 6742354 - DNA, 16 bp, Homo sapiens
tgagaaaaagctcctg

SEQ ID NO: 6742355 - DNA, 13 bp, Homo sapiens
tgagaaaaataaa

SEQ ID NO: 6742356 - DNA, 17 bp, Homo sapiens
tgagaaaaatgtaaaat

SEQ ID NO: 6742357 - DNA, 13 bp, Homo sapiens
tgagaaaacaagc

SEQ ID NO: 6742358 - DNA, 14 bp, Homo sapiens
tgagaaaacaagca

SEQ ID NO: 6742359 - DNA, 23 bp, Homo sapiens
tgagaaaacaagcaagttctgag

SEQ ID NO: 6742360 - DNA, 18 bp, Homo sapiens
tgagaaaaccccttccca

SEQ ID NO: 6742361 - DNA, 17 bp, Homo sapiens
tgagaaaacgaagtctt

SEQ ID NO: 6742362 - DNA, 14 bp, Homo sapiens
tgagaaaactgtga

SEQ ID NO: 6742363 - DNA, 16 bp, Homo sapiens
tgagaaaacttctttt

SEQ ID NO: 6742364 - DNA, 17 bp, Homo sapiens
tgagaaaacttctttta

SEQ ID NO: 6742365 - DNA, 14 bp, Homo sapiens
tgagaaaaggcaaa

SEQ ID NO: 6742366 - DNA, 21 bp, Homo sapiens
tgagaaaagtattctcaaaga

SEQ ID NO: 6742367 - DNA, 23 bp, Homo sapiens
tgagaaaagtattctcaaagatg

SEQ ID NO: 6742368 - DNA, 20 bp, Homo sapiens
tgagaaaatataataaaaga

SEQ ID NO: 6742369 - DNA, 13 bp, Homo sapiens
tgagaaaatatat

SEQ ID NO: 6742370 - DNA, 20 bp, Homo sapiens
tgagaaaatgcgagactctg

SEQ ID NO: 6742371 - DNA, 15 bp, Homo sapiens
tgagaaacagctcag

SEQ ID NO: 6742372 - DNA, 21 bp, Homo sapiens
tgagaaacagctcagccagtg

SEQ ID NO: 6742373 - DNA, 15 bp, Homo sapiens
tgagaaacagttcca

SEQ ID NO: 6742374 - DNA, 13 bp, Homo sapiens
tgagaaacatgaa

SEQ ID NO: 6742375 - DNA, 17 bp, Homo sapiens
tgagaaacccaccagcc

SEQ ID NO: 6742376 - DNA, 24 bp, Homo sapiens
tgagaaacctgtatctttctatgc

SEQ ID NO: 6742377 - DNA, 14 bp, Homo sapiens
tgagaaagaaagta

SEQ ID NO: 6742378 - DNA, 21 bp, Homo sapiens
tgagaaagaatttgagacgca

SEQ ID NO: 6742379 - DNA, 15 bp, Homo sapiens
tgagaaagactattc

SEQ ID NO: 6742380 - DNA, 17 bp, Homo sapiens
tgagaaagactattcaa

SEQ ID NO: 6742381 - DNA, 20 bp, Homo sapiens
tgagaaagagagagatacat

SEQ ID NO: 6742382 - DNA, 22 bp, Homo sapiens
tgagaaagagagagatacatct

SEQ ID NO: 6742383 - DNA, 18 bp, Homo sapiens
tgagaaagcccacctggg

SEQ ID NO: 6742384 - DNA, 20 bp, Homo sapiens
tgagaaagcccacctgggct

SEQ ID NO: 6742385 - DNA, 22 bp, Homo sapiens
tgagaaagcccacctgggctgg

SEQ ID NO: 6742386 - DNA, 23 bp, Homo sapiens
tgagaaagcccacctgggctggg

SEQ ID NO: 6742387 - DNA, 21 bp, Homo sapiens
tgagaaagccctgtcgggctt

SEQ ID NO: 6742388 - DNA, 13 bp, Homo sapiens
tgagaaaggaaaa

SEQ ID NO: 6742389 - DNA, 15 bp, Homo sapiens
tgagaaaggaaaaat

SEQ ID NO: 6742390 - DNA, 16 bp, Homo sapiens
tgagaaaggacagagc

SEQ ID NO: 6742391 - DNA, 23 bp, Homo sapiens
tgagaaaggacagagccagcggc

SEQ ID NO: 6742392 - DNA, 19 bp, Homo sapiens
tgagaaagggatggtggag

SEQ ID NO: 6742393 - DNA, 21 bp, Homo sapiens
tgagaaagggattgctgaggc

SEQ ID NO: 6742394 - DNA, 19 bp, Homo sapiens
tgagaaaggtgaggagggc

SEQ ID NO: 6742395 - DNA, 21 bp, Homo sapiens
tgagaaagtcagattcttgca

SEQ ID NO: 6742396 - DNA, 15 bp, Homo sapiens
tgagaaataaagttt

SEQ ID NO: 6742397 - DNA, 17 bp, Homo sapiens
tgagaaatacagtgctt

SEQ ID NO: 6742398 - DNA, 20 bp, Homo sapiens
tgagaaatacagtgctttat

SEQ ID NO: 6742399 - DNA, 20 bp, Homo sapiens
tgagaaatagctgaaaaggg

SEQ ID NO: 6742400 - DNA, 22 bp, Homo sapiens
tgagaaatagcttatgaaaaga

SEQ ID NO: 6742401 - DNA, 15 bp, Homo sapiens
tgagaaatataaaaa

SEQ ID NO: 6742402 - DNA, 18 bp, Homo sapiens
tgagaaatataaaaataa

SEQ ID NO: 6742403 - DNA, 15 bp, Homo sapiens
tgagaaatatggaca

SEQ ID NO: 6742404 - DNA, 17 bp, Homo sapiens
tgagaaatatggacact

SEQ ID NO: 6742405 - DNA, 20 bp, Homo sapiens
tgagaaatcagaattggcat

SEQ ID NO: 6742406 - DNA, 14 bp, Homo sapiens
tgagaaatgaaata

SEQ ID NO: 6742407 - DNA, 15 bp, Homo sapiens
tgagaaatgaataat

SEQ ID NO: 6742408 - DNA, 20 bp, Homo sapiens
tgagaaatgaataatttccc

SEQ ID NO: 6742409 - DNA, 13 bp, Homo sapiens
tgagaaatgatga

SEQ ID NO: 6742410 - DNA, 12 bp, Homo sapiens
tgagaaatgggg

SEQ ID NO: 6742411 - DNA, 14 bp, Homo sapiens
tgagaaatgtaatg

SEQ ID NO: 6742412 - DNA, 14 bp, Homo sapiens
tgagaaatgtgaac

SEQ ID NO: 6742413 - DNA, 17 bp, Homo sapiens
tgagaaattattagatt

SEQ ID NO: 6742414 - DNA, 22 bp, Homo sapiens
tgagaaattcaacgttaataat

SEQ ID NO: 6742415 - DNA, 14 bp, Homo sapiens
tgagaaattgaatg

SEQ ID NO: 6742416 - DNA, 23 bp, Homo sapiens
tgagaaattgaatgtaccttatt

SEQ ID NO: 6742417 - DNA, 16 bp, Homo sapiens
tgagaaatttgaaagg

SEQ ID NO: 6742418 - DNA, 12 bp, Homo sapiens
tgagaacaaagc

SEQ ID NO: 6742419 - DNA, 14 bp, Homo sapiens
tgagaacaagctat

SEQ ID NO: 6742420 - DNA, 20 bp, Homo sapiens
tgagaacaagtcacagctgc

SEQ ID NO: 6742421 - DNA, 22 bp, Homo sapiens
tgagaacaagtcacagctgcag

SEQ ID NO: 6742422 - DNA, 17 bp, Homo sapiens
tgagaacagataaagat

SEQ ID NO: 6742423 - DNA, 22 bp, Homo sapiens
tgagaacagatctccaaagctt

SEQ ID NO: 6742424 - DNA, 17 bp, Homo sapiens
tgagaacagtgcacaag

SEQ ID NO: 6742425 - DNA, 20 bp, Homo sapiens
tgagaacatccataatttgg

SEQ ID NO: 6742426 - DNA, 21 bp, Homo sapiens
tgagaacatggtgtgtgtctc

SEQ ID NO: 6742427 - DNA, 16 bp, Homo sapiens
tgagaacatgttggta

SEQ ID NO: 6742428 - DNA, 19 bp, Homo sapiens
tgagaacattaggccccag

SEQ ID NO: 6742429 - DNA, 22 bp, Homo sapiens
tgagaacattaggccccagcaa

SEQ ID NO: 6742430 - DNA, 18 bp, Homo sapiens
tgagaacatttacacatt

SEQ ID NO: 6742431 - DNA, 18 bp, Homo sapiens
tgagaaccctgcgtgggg

SEQ ID NO: 6742432 - DNA, 21 bp, Homo sapiens
tgagaaccctgcgtggggaca

SEQ ID NO: 6742433 - DNA, 20 bp, Homo sapiens
tgagaaccgtagatgatttc

SEQ ID NO: 6742434 - DNA, 16 bp, Homo sapiens
tgagaaccgtgacatc

SEQ ID NO: 6742435 - DNA, 12 bp, Homo sapiens
tgagaacctggg

SEQ ID NO: 6742436 - DNA, 21 bp, Homo sapiens
tgagaacctgggttgcagaca

SEQ ID NO: 6742437 - DNA, 22 bp, Homo sapiens
tgagaacctgggttgcagacag

SEQ ID NO: 6742438 - DNA, 22 bp, Homo sapiens
tgagaacggtgaccgcctcctg

SEQ ID NO: 6742439 - DNA, 15 bp, Homo sapiens
tgagaactaaataga

SEQ ID NO: 6742440 - DNA, 16 bp, Homo sapiens
tgagaactaaatagat

SEQ ID NO: 6742441 - DNA, 18 bp, Homo sapiens
tgagaactacagctttta

SEQ ID NO: 6742442 - DNA, 19 bp, Homo sapiens
tgagaactactcagggaat

SEQ ID NO: 6742443 - DNA, 14 bp, Homo sapiens
tgagaactcagaag

SEQ ID NO: 6742444 - DNA, 15 bp, Homo sapiens
tgagaactccagctg

SEQ ID NO: 6742445 - DNA, 16 bp, Homo sapiens
tgagaactctctccct

SEQ ID NO: 6742446 - DNA, 19 bp, Homo sapiens
tgagaactctctccctggt

SEQ ID NO: 6742447 - DNA, 23 bp, Homo sapiens
tgagaactctctccctggtctct

SEQ ID NO: 6742448 - DNA, 14 bp, Homo sapiens
tgagaactgacttt

SEQ ID NO: 6742449 - DNA, 15 bp, Homo sapiens
tgagaactgaggagc

SEQ ID NO: 6742450 - DNA, 18 bp, Homo sapiens
tgagaactggttcttgcc

SEQ ID NO: 6742451 - DNA, 12 bp, Homo sapiens
tgagaactgtga

SEQ ID NO: 6742452 - DNA, 14 bp, Homo sapiens
tgagaacttccaac

SEQ ID NO: 6742453 - DNA, 14 bp, Homo sapiens
tgagaagaaaaatg

SEQ ID NO: 6742454 - DNA, 20 bp, Homo sapiens
tgagaagaaaaatggaaaaa

SEQ ID NO: 6742455 - DNA, 14 bp, Homo sapiens
tgagaagaaaacat

SEQ ID NO: 6742456 - DNA, 18 bp, Homo sapiens
tgagaagaagctgaggat

SEQ ID NO: 6742457 - DNA, 19 bp, Homo sapiens
tgagaagaagtggctgcca

SEQ ID NO: 6742458 - DNA, 13 bp, Homo sapiens
tgagaagaatatt

SEQ ID NO: 6742459 - DNA, 13 bp, Homo sapiens
tgagaagactagc

SEQ ID NO: 6742460 - DNA, 18 bp, Homo sapiens
tgagaagagcttgcacag

SEQ ID NO: 6742461 - DNA, 21 bp, Homo sapiens
tgagaagagcttgcacagcca

SEQ ID NO: 6742462 - DNA, 23 bp, Homo sapiens
tgagaagaggaaccgttttacac

SEQ ID NO: 6742463 - DNA, 20 bp, Homo sapiens
tgagaagagggcctgtggga

SEQ ID NO: 6742464 - DNA, 21 bp, Homo sapiens
tgagaagagggcctgtgggag

SEQ ID NO: 6742465 - DNA, 19 bp, Homo sapiens
tgagaagagttttctcaga

SEQ ID NO: 6742466 - DNA, 17 bp, Homo sapiens
tgagaagatcattgcca

SEQ ID NO: 6742467 - DNA, 16 bp, Homo sapiens
tgagaagatcattgga

SEQ ID NO: 6742468 - DNA, 15 bp, Homo sapiens
tgagaagatggcact

SEQ ID NO: 6742469 - DNA, 19 bp, Homo sapiens
tgagaagatggcactgtcc

SEQ ID NO: 6742470 - DNA, 21 bp, Homo sapiens
tgagaagatggcactgtccag

SEQ ID NO: 6742471 - DNA, 20 bp, Homo sapiens
tgagaagatgttaattactt

SEQ ID NO: 6742472 - DNA, 22 bp, Homo sapiens
tgagaagattcttcccattctc

SEQ ID NO: 6742473 - DNA, 16 bp, Homo sapiens
tgagaagattgtgaat

SEQ ID NO: 6742474 - DNA, 12 bp, Homo sapiens
tgagaagccaag

SEQ ID NO: 6742475 - DNA, 16 bp, Homo sapiens
tgagaagccaagcctg

SEQ ID NO: 6742476 - DNA, 20 bp, Homo sapiens
tgagaagcctcatgggagtc

SEQ ID NO: 6742477 - DNA, 17 bp, Homo sapiens
tgagaagcgctgccctg

SEQ ID NO: 6742478 - DNA, 14 bp, Homo sapiens
tgagaagcggtcat

SEQ ID NO: 6742479 - DNA, 20 bp, Homo sapiens
tgagaagcggtcatgagcac

SEQ ID NO: 6742480 - DNA, 21 bp, Homo sapiens
tgagaagcgtttttaacctgt

SEQ ID NO: 6742481 - DNA, 13 bp, Homo sapiens
tgagaagctgagg

SEQ ID NO: 6742482 - DNA, 14 bp, Homo sapiens
tgagaagctgctca

SEQ ID NO: 6742483 - DNA, 21 bp, Homo sapiens
tgagaagctgctcaacttgca

SEQ ID NO: 6742484 - DNA, 22 bp, Homo sapiens
tgagaagctgctccaggcctgc

SEQ ID NO: 6742485 - DNA, 19 bp, Homo sapiens
tgagaagctgggcatgaac

SEQ ID NO: 6742486 - DNA, 12 bp, Homo sapiens
tgagaaggaaat

SEQ ID NO: 6742487 - DNA, 17 bp, Homo sapiens
tgagaaggaatttgagt

SEQ ID NO: 6742488 - DNA, 13 bp, Homo sapiens
tgagaaggagaga

SEQ ID NO: 6742489 - DNA, 17 bp, Homo sapiens
tgagcaataaagtggaa

SEQ ID NO: 6742490 - DNA, 20 bp, Homo sapiens
tgagcaatggtaactgcacc

SEQ ID NO: 6742491 - DNA, 16 bp, Homo sapiens
tgagcaattcatttca

SEQ ID NO: 6742492 - DNA, 21 bp, Homo sapiens
tgagcacaaacttctgtggca

SEQ ID NO: 6742493 - DNA, 14 bp, Homo sapiens
tgagcacaaagaag

SEQ ID NO: 6742494 - DNA, 16 bp, Homo sapiens
tgagcacaaagaagaa

SEQ ID NO: 6742495 - DNA, 21 bp, Homo sapiens
tgagcacaaagaagaaagctg

SEQ ID NO: 6742496 - DNA, 22 bp, Homo sapiens
tgagcacaactttaagaggaca

SEQ ID NO: 6742497 - DNA, 15 bp, Homo sapiens
tgagcacaatctgtt

SEQ ID NO: 6742498 - DNA, 16 bp, Homo sapiens
tgagcacaatctgttc

SEQ ID NO: 6742499 - DNA, 14 bp, Homo sapiens
tgagcacacaacag

SEQ ID NO: 6742500 - DNA, 20 bp, Homo sapiens
tgagcacacaacaggctgtg

SEQ ID NO: 6742501 - DNA, 21 bp, Homo sapiens
tgagcacagagaaaagtcagg

SEQ ID NO: 6742502 - DNA, 13 bp, Homo sapiens
tgagcacagagtg

SEQ ID NO: 6742503 - DNA, 14 bp, Homo sapiens
tgagcacaggtgac

SEQ ID NO: 6742504 - DNA, 14 bp, Homo sapiens
tgagcacagtcagg

SEQ ID NO: 6742505 - DNA, 21 bp, Homo sapiens
tgagcacatagtgtcctgccc

SEQ ID NO: 6742506 - DNA, 14 bp, Homo sapiens
tgagcacatctggg

SEQ ID NO: 6742507 - DNA, 15 bp, Homo sapiens
tgagcaccagcccca

SEQ ID NO: 6742508 - DNA, 17 bp, Homo sapiens
tgagcaccgtcatggct

SEQ ID NO: 6742509 - DNA, 21 bp, Homo sapiens
tgagcacctctcagagcaagc

SEQ ID NO: 6742510 - DNA, 23 bp, Homo sapiens
tgagcacctgcaggcgtgacctg

SEQ ID NO: 6742511 - DNA, 21 bp, Homo sapiens
tgagcaccttacagatatttt

SEQ ID NO: 6742512 - DNA, 19 bp, Homo sapiens
tgagcacctttcctgaaat

SEQ ID NO: 6742513 - DNA, 24 bp, Homo sapiens
tgagcacctttggaaacaacattt

SEQ ID NO: 6742514 - DNA, 20 bp, Homo sapiens
tgagcacgggcaaagaaaac

SEQ ID NO: 6742515 - DNA, 23 bp, Homo sapiens
tgagcactaaggtgtgctctgat

SEQ ID NO: 6742516 - DNA, 19 bp, Homo sapiens
tgagcactatctttcagga

SEQ ID NO: 6742517 - DNA, 23 bp, Homo sapiens
tgagcactcccaagtctacagag

SEQ ID NO: 6742518 - DNA, 19 bp, Homo sapiens
tgagcactctggggtggga

SEQ ID NO: 6742519 - DNA, 22 bp, Homo sapiens
tgagcactctggggtgggaggg

SEQ ID NO: 6742520 - DNA, 13 bp, Homo sapiens
tgagcactgaaac

SEQ ID NO: 6742521 - DNA, 14 bp, Homo sapiens
tgagcacttttcaa

SEQ ID NO: 6742522 - DNA, 13 bp, Homo sapiens
tgagcagaacagg

SEQ ID NO: 6742523 - DNA, 14 bp, Homo sapiens
tgagcagaaggaaa

SEQ ID NO: 6742524 - DNA, 18 bp, Homo sapiens
tgagcagaaggaaacaaa

SEQ ID NO: 6742525 - DNA, 23 bp, Homo sapiens
tgagcagactggtgagcagactg

SEQ ID NO: 6742526 - DNA, 18 bp, Homo sapiens
tgagcagagaacctgctc

SEQ ID NO: 6742527 - DNA, 19 bp, Homo sapiens
tgagcagagcccggagctc

SEQ ID NO: 6742528 - DNA, 20 bp, Homo sapiens
tgagcagaggagtccagggc

SEQ ID NO: 6742529 - DNA, 17 bp, Homo sapiens
tgagcagagggaggaag

SEQ ID NO: 6742530 - DNA, 17 bp, Homo sapiens
tgagcagatcgtgccgt

SEQ ID NO: 6742531 - DNA, 12 bp, Homo sapiens
tgagcagcaccc

SEQ ID NO: 6742532 - DNA, 20 bp, Homo sapiens
tgagcagcaggcgtgcctcg

SEQ ID NO: 6742533 - DNA, 21 bp, Homo sapiens
tgagcagcaggcgtgcctcgt

SEQ ID NO: 6742534 - DNA, 15 bp, Homo sapiens
tgagcagcccagcac

SEQ ID NO: 6742535 - DNA, 23 bp, Homo sapiens
tgagcagccgccagctgggagca

SEQ ID NO: 6742536 - DNA, 13 bp, Homo sapiens
tgagcagcctcca

SEQ ID NO: 6742537 - DNA, 17 bp, Homo sapiens
tgagcagcctctgccag

SEQ ID NO: 6742538 - DNA, 16 bp, Homo sapiens
tgagcagcctggagcc

SEQ ID NO: 6742539 - DNA, 11 bp, Homo sapiens
tgagcagctac

SEQ ID NO: 6742540 - DNA, 17 bp, Homo sapiens
tgagcagctactgtaac

SEQ ID NO: 6742541 - DNA, 17 bp, Homo sapiens
tgagcagctagtggtgg

SEQ ID NO: 6742542 - DNA, 23 bp, Homo sapiens
tgagcaggaagcgagcagaggct

SEQ ID NO: 6742543 - DNA, 14 bp, Homo sapiens
tgagcaggacagcc

SEQ ID NO: 6742544 - DNA, 18 bp, Homo sapiens
tgagcaggacagccagca

SEQ ID NO: 6742545 - DNA, 19 bp, Homo sapiens
tgagcaggacagccagcag

SEQ ID NO: 6742546 - DNA, 15 bp, Homo sapiens
tgagcaggagcttgg

SEQ ID NO: 6742547 - DNA, 16 bp, Homo sapiens
tgagcaggagcttggg

SEQ ID NO: 6742548 - DNA, 20 bp, Homo sapiens
tgagcaggattttaatcttt

SEQ ID NO: 6742549 - DNA, 21 bp, Homo sapiens
tgagcaggcagggctgggcca

SEQ ID NO: 6742550 - DNA, 18 bp, Homo sapiens
tgagcaggcggggaggag

SEQ ID NO: 6742551 - DNA, 18 bp, Homo sapiens
tgagcaggctgtggggtg

SEQ ID NO: 6742552 - DNA, 22 bp, Homo sapiens
tgagcagggagatcctggttgg

SEQ ID NO: 6742553 - DNA, 19 bp, Homo sapiens
tgagcagggctcagcgggg

SEQ ID NO: 6742554 - DNA, 20 bp, Homo sapiens
tgagcagggctcagcgggga

SEQ ID NO: 6742555 - DNA, 14 bp, Homo sapiens
tgagcaggggcagg

SEQ ID NO: 6742556 - DNA, 20 bp, Homo sapiens
tgagcagggtcaagcctctt

SEQ ID NO: 6742557 - DNA, 21 bp, Homo sapiens
tgagcagggtcagtggaagcc

SEQ ID NO: 6742558 - DNA, 19 bp, Homo sapiens
tgagcagggtgacccctca

SEQ ID NO: 6742559 - DNA, 15 bp, Homo sapiens
tgagcagggtggggt

SEQ ID NO: 6742560 - DNA, 19 bp, Homo sapiens
tgagcagggtggggtctgg

SEQ ID NO: 6742561 - DNA, 21 bp, Homo sapiens
tgagcagggtggggtctggga

SEQ ID NO: 6742562 - DNA, 23 bp, Homo sapiens
tgagcagggtggggtctgggagg

SEQ ID NO: 6742563 - DNA, 18 bp, Homo sapiens
tgagcaggtacatttctg

SEQ ID NO: 6742564 - DNA, 23 bp, Homo sapiens
tgagcaggtacatttctgattct

SEQ ID NO: 6742565 - DNA, 21 bp, Homo sapiens
tgagcaggtatcaactagggg

SEQ ID NO: 6742566 - DNA, 19 bp, Homo sapiens
tgagcagtaactgtccctg

SEQ ID NO: 6742567 - DNA, 15 bp, Homo sapiens
tgagcagtcaggaaa

SEQ ID NO: 6742568 - DNA, 12 bp, Homo sapiens
tgagcagtccag

SEQ ID NO: 6742569 - DNA, 16 bp, Homo sapiens
tgagcagtccttggcc

SEQ ID NO: 6742570 - DNA, 17 bp, Homo sapiens
tgagcagtcgcctgcct

SEQ ID NO: 6742571 - DNA, 18 bp, Homo sapiens
tgagcagtcgcctgcctg

SEQ ID NO: 6742572 - DNA, 19 bp, Homo sapiens
tgagcagtcgcctgcctgc

SEQ ID NO: 6742573 - DNA, 17 bp, Homo sapiens
tgagcagtctacttctg

SEQ ID NO: 6742574 - DNA, 18 bp, Homo sapiens
tgagcagtctacttctgt

SEQ ID NO: 6742575 - DNA, 20 bp, Homo sapiens
tgagcagtgagcactgaaac

SEQ ID NO: 6742576 - DNA, 14 bp, Homo sapiens
tgagcagtgatatt

SEQ ID NO: 6742577 - DNA, 20 bp, Homo sapiens
tgagcagtgatattctttgt

SEQ ID NO: 6742578 - DNA, 13 bp, Homo sapiens
tgagcagtggctg

SEQ ID NO: 6742579 - DNA, 12 bp, Homo sapiens
tgagcagtgggg

SEQ ID NO: 6742580 - DNA, 13 bp, Homo sapiens
tgagcagtgggga

SEQ ID NO: 6742581 - DNA, 17 bp, Homo sapiens
tgagcagtggggagcgg

SEQ ID NO: 6742582 - DNA, 15 bp, Homo sapiens
tgagcagtgtgtctc

SEQ ID NO: 6742583 - DNA, 22 bp, Homo sapiens
tgagcagtgttgcgtttttcct

SEQ ID NO: 6742584 - DNA, 17 bp, Homo sapiens
tgagcagttcccaagga

SEQ ID NO: 6742585 - DNA, 16 bp, Homo sapiens
tgagcagttcccctgg

SEQ ID NO: 6742586 - DNA, 21 bp, Homo sapiens
tgagcagttgttatattcatt

SEQ ID NO: 6742587 - DNA, 15 bp, Homo sapiens
tgagcataatgctcc

SEQ ID NO: 6742588 - DNA, 22 bp, Homo sapiens
tgagcatagagaacaaagtaaa

SEQ ID NO: 6742589 - DNA, 21 bp, Homo sapiens
tgagcataggtgatccatgta

SEQ ID NO: 6742590 - DNA, 23 bp, Homo sapiens
tgagcataggtgatccatgtaac

SEQ ID NO: 6742591 - DNA, 12 bp, Homo sapiens
tgagcatatctg

SEQ ID NO: 6742592 - DNA, 14 bp, Homo sapiens
tgagcatatctggt

SEQ ID NO: 6742593 - DNA, 13 bp, Homo sapiens
tgagcatattttc

SEQ ID NO: 6742594 - DNA, 15 bp, Homo sapiens
tgagcatattttctt

SEQ ID NO: 6742595 - DNA, 22 bp, Homo sapiens
tgagcatattttcttactttta

SEQ ID NO: 6742596 - DNA, 18 bp, Homo sapiens
tgagcatcaatcttgtta

SEQ ID NO: 6742597 - DNA, 21 bp, Homo sapiens
tgagcatcaatcttgttactg

SEQ ID NO: 6742598 - DNA, 21 bp, Homo sapiens
tgagcatcaggccaggccctc

SEQ ID NO: 6742599 - DNA, 23 bp, Homo sapiens
tgagcatcctgagccccgccctc

SEQ ID NO: 6742600 - DNA, 14 bp, Homo sapiens
tgagcatcctgcaa

SEQ ID NO: 6742601 - DNA, 16 bp, Homo sapiens
tgagcatctcaaatgt

SEQ ID NO: 6742602 - DNA, 20 bp, Homo sapiens
tgagcatctcaaatgttttc

SEQ ID NO: 6742603 - DNA, 21 bp, Homo sapiens
tgagcatctcaaatgttttct

SEQ ID NO: 6742604 - DNA, 19 bp, Homo sapiens
tgagcatgacagcctgcag

SEQ ID NO: 6742605 - DNA, 14 bp, Homo sapiens
tgagcatgatggga

SEQ ID NO: 6742606 - DNA, 19 bp, Homo sapiens
tgagcatgcacactgagaa

SEQ ID NO: 6742607 - DNA, 20 bp, Homo sapiens
tgagcatgcacactgagaat

SEQ ID NO: 6742608 - DNA, 17 bp, Homo sapiens
tgagcatgcattttctt

SEQ ID NO: 6742609 - DNA, 19 bp, Homo sapiens
tgagcatggaacacttcga

SEQ ID NO: 6742610 - DNA, 16 bp, Homo sapiens
tgagcatggagacagc

SEQ ID NO: 6742611 - DNA, 23 bp, Homo sapiens
tgagcatggagctgtcacctctc

SEQ ID NO: 6742612 - DNA, 18 bp, Homo sapiens
tgagcatggggccaggaa

SEQ ID NO: 6742613 - DNA, 16 bp, Homo sapiens
tgagcatgttactgac

SEQ ID NO: 6742614 - DNA, 14 bp, Homo sapiens
tgagcatgtttaga

SEQ ID NO: 6742615 - DNA, 14 bp, Homo sapiens
tgagcattagattt

SEQ ID NO: 6742616 - DNA, 19 bp, Homo sapiens
tgagcattagctacttttc

SEQ ID NO: 6742617 - DNA, 20 bp, Homo sapiens
tgagcattcaggcagcactg

SEQ ID NO: 6742618 - DNA, 20 bp, Homo sapiens
tgagcattggatacagcagt

SEQ ID NO: 6742619 - DNA, 21 bp, Homo sapiens
tgagcattgtggctgtcagca

SEQ ID NO: 6742620 - DNA, 22 bp, Homo sapiens
tgagcattgtggctgtcagcag

SEQ ID NO: 6742621 - DNA, 13 bp, Homo sapiens
tgagcatttgcac

SEQ ID NO: 6742622 - DNA, 21 bp, Homo sapiens
tgagcattttatatccacatc

SEQ ID NO: 6742623 - DNA, 21 bp, Homo sapiens
tgagccaaaatgactttgaac

SEQ ID NO: 6742624 - DNA, 19 bp, Homo sapiens
tgagccaaacacactgtaa

SEQ ID NO: 6742625 - DNA, 20 bp, Homo sapiens
tgagccaaacacactgtaaa

SEQ ID NO: 6742626 - DNA, 22 bp, Homo sapiens
tgagccaaacacactgtaaata

SEQ ID NO: 6742627 - DNA, 13 bp, Homo sapiens
tgagccaaaccag

SEQ ID NO: 6742628 - DNA, 22 bp, Homo sapiens
tgagccaaaccagcagggagtt

SEQ ID NO: 6742629 - DNA, 14 bp, Homo sapiens
tgagccaaagagaa

SEQ ID NO: 6742630 - DNA, 23 bp, Homo sapiens
tgagccaaagagaaaagattaaa

SEQ ID NO: 6742631 - DNA, 12 bp, Homo sapiens
tgagccaacctt

SEQ ID NO: 6742632 - DNA, 14 bp, Homo sapiens
tgagccaagaaaca

SEQ ID NO: 6742633 - DNA, 19 bp, Homo sapiens
tgagccaagcttcaaccct

SEQ ID NO: 6742634 - DNA, 15 bp, Homo sapiens
tgagccaaggacagg

SEQ ID NO: 6742635 - DNA, 14 bp, Homo sapiens
tgagccaaggaggc

SEQ ID NO: 6742636 - DNA, 19 bp, Homo sapiens
tgagccaaggaggcctggg

SEQ ID NO: 6742637 - DNA, 20 bp, Homo sapiens
tgagccaataaagctcacac

SEQ ID NO: 6742638 - DNA, 24 bp, Homo sapiens
tgagccacagaccacctgcttctg

SEQ ID NO: 6742639 - DNA, 15 bp, Homo sapiens
tgagccacagcactc

SEQ ID NO: 6742640 - DNA, 17 bp, Homo sapiens
tgagccacagcagcatt

SEQ ID NO: 6742641 - DNA, 20 bp, Homo sapiens
tgagccacagcagcattttt

SEQ ID NO: 6742642 - DNA, 18 bp, Homo sapiens
tgagccaccacacccagc

SEQ ID NO: 6742643 - DNA, 12 bp, Homo sapiens
tgagccaccacg

SEQ ID NO: 6742644 - DNA, 21 bp, Homo sapiens
tgagccaccgtgcctggccac

SEQ ID NO: 6742645 - DNA, 21 bp, Homo sapiens
tgagccactcagtctcttcca

SEQ ID NO: 6742646 - DNA, 22 bp, Homo sapiens
tgagccactcgcagtcgcagga

SEQ ID NO: 6742647 - DNA, 17 bp, Homo sapiens
tgagccactgagcctgg

SEQ ID NO: 6742648 - DNA, 18 bp, Homo sapiens
tgagccactgagcctggc

SEQ ID NO: 6742649 - DNA, 22 bp, Homo sapiens
tgagccactgcacctgcccagc

SEQ ID NO: 6742650 - DNA, 23 bp, Homo sapiens
tgagccactgcacctgcccagct

SEQ ID NO: 6742651 - DNA, 14 bp, Homo sapiens
tgagccactgcgcc

SEQ ID NO: 6742652 - DNA, 13 bp, Homo sapiens
tgagccactgctc

SEQ ID NO: 6742653 - DNA, 14 bp, Homo sapiens
tgagccactggagg

SEQ ID NO: 6742654 - DNA, 20 bp, Homo sapiens
tgagccactgtgcttggcca

SEQ ID NO: 6742655 - DNA, 21 bp, Homo sapiens
tgagccagaaacgcagattgg

SEQ ID NO: 6742656 - DNA, 13 bp, Homo sapiens
tgagccagattac

SEQ ID NO: 6742657 - DNA, 14 bp, Homo sapiens
tgagccagatttca

SEQ ID NO: 6742658 - DNA, 16 bp, Homo sapiens
tgagccagatttcact

SEQ ID NO: 6742659 - DNA, 18 bp, Homo sapiens
tgagccagatttcactct

SEQ ID NO: 6742660 - DNA, 19 bp, Homo sapiens
tgagccagatttcactctc

SEQ ID NO: 6742661 - DNA, 13 bp, Homo sapiens
tgagccagcagac

SEQ ID NO: 6742662 - DNA, 23 bp, Homo sapiens
tgagccagcagacattgtcagca

SEQ ID NO: 6742663 - DNA, 20 bp, Homo sapiens
tgagccagccaggccctgcc

SEQ ID NO: 6742664 - DNA, 14 bp, Homo sapiens
tgagccaggagcct

SEQ ID NO: 6742665 - DNA, 15 bp, Homo sapiens
tgagctgtgacccag

SEQ ID NO: 6742666 - DNA, 18 bp, Homo sapiens
tgagctgtgccagctgct

SEQ ID NO: 6742667 - DNA, 23 bp, Homo sapiens
tgagctgtgccagctgcttctgc

SEQ ID NO: 6742668 - DNA, 19 bp, Homo sapiens
tgagctgtgttcacagacc

SEQ ID NO: 6742669 - DNA, 15 bp, Homo sapiens
tgagctgtgttcttg

SEQ ID NO: 6742670 - DNA, 14 bp, Homo sapiens
tgagctgttgcctc

SEQ ID NO: 6742671 - DNA, 15 bp, Homo sapiens
tgagctgttgcctca

SEQ ID NO: 6742672 - DNA, 13 bp, Homo sapiens
tgagctgtttcct

SEQ ID NO: 6742673 - DNA, 16 bp, Homo sapiens
tgagcttaaaatacaa

SEQ ID NO: 6742674 - DNA, 17 bp, Homo sapiens
tgagcttaaaatacaag

SEQ ID NO: 6742675 - DNA, 21 bp, Homo sapiens
tgagcttaaaatacaagactg

SEQ ID NO: 6742676 - DNA, 20 bp, Homo sapiens
tgagcttagccttgtgccct

SEQ ID NO: 6742677 - DNA, 20 bp, Homo sapiens
tgagcttatttcaaaaggaa

SEQ ID NO: 6742678 - DNA, 21 bp, Homo sapiens
tgagcttatttcaaaaggaag

SEQ ID NO: 6742679 - DNA, 14 bp, Homo sapiens
tgagcttctcctct

SEQ ID NO: 6742680 - DNA, 15 bp, Homo sapiens
tgagcttctcctctg

SEQ ID NO: 6742681 - DNA, 17 bp, Homo sapiens
tgagcttctcctctgct

SEQ ID NO: 6742682 - DNA, 19 bp, Homo sapiens
tgagcttctcctctgctcc

SEQ ID NO: 6742683 - DNA, 21 bp, Homo sapiens
tgagcttctcctctgctccaa

SEQ ID NO: 6742684 - DNA, 15 bp, Homo sapiens
tgagcttctctgtga

SEQ ID NO: 6742685 - DNA, 16 bp, Homo sapiens
tgagcttctctgtgaa

SEQ ID NO: 6742686 - DNA, 24 bp, Homo sapiens
tgagcttgagctcccctggagcca

SEQ ID NO: 6742687 - DNA, 15 bp, Homo sapiens
tgagcttgattctaa

SEQ ID NO: 6742688 - DNA, 19 bp, Homo sapiens
tgagcttggcagctgaact

SEQ ID NO: 6742689 - DNA, 13 bp, Homo sapiens
tgagcttggccag

SEQ ID NO: 6742690 - DNA, 19 bp, Homo sapiens
tgagcttggccagaagggg

SEQ ID NO: 6742691 - DNA, 23 bp, Homo sapiens
tgagcttgggaagtcgaggctgc

SEQ ID NO: 6742692 - DNA, 21 bp, Homo sapiens
tgagctttagctctctctaga

SEQ ID NO: 6742693 - DNA, 22 bp, Homo sapiens
tgagctttccagttagggctgt

SEQ ID NO: 6742694 - DNA, 19 bp, Homo sapiens
tgagctttccatgttgctg

SEQ ID NO: 6742695 - DNA, 20 bp, Homo sapiens
tgagctttccggggaggagc

SEQ ID NO: 6742696 - DNA, 13 bp, Homo sapiens
tgagctttctgaa

SEQ ID NO: 6742697 - DNA, 16 bp, Homo sapiens
tgagctttctgaacag

SEQ ID NO: 6742698 - DNA, 17 bp, Homo sapiens
tgagctttctgaacagc

SEQ ID NO: 6742699 - DNA, 22 bp, Homo sapiens
tgagctttctgaacagctggtg

SEQ ID NO: 6742700 - DNA, 15 bp, Homo sapiens
tgagctttctgtgca

SEQ ID NO: 6742701 - DNA, 16 bp, Homo sapiens
tgagctttctgtgcat

SEQ ID NO: 6742702 - DNA, 18 bp, Homo sapiens
tgagctttctgtgcatgt

SEQ ID NO: 6742703 - DNA, 19 bp, Homo sapiens
tgagctttctgtgcatgtg

SEQ ID NO: 6742704 - DNA, 21 bp, Homo sapiens
tgagctttctgtgcatgtgca

SEQ ID NO: 6742705 - DNA, 16 bp, Homo sapiens
tgagctttctttgcac

SEQ ID NO: 6742706 - DNA, 19 bp, Homo sapiens
tgagctttctttttaaagc

SEQ ID NO: 6742707 - DNA, 23 bp, Homo sapiens
tgagctttgcatgttccactaac

SEQ ID NO: 6742708 - DNA, 17 bp, Homo sapiens
tgagctttggacacaca

SEQ ID NO: 6742709 - DNA, 21 bp, Homo sapiens
tgagctttggacgcacacagc

SEQ ID NO: 6742710 - DNA, 23 bp, Homo sapiens
tgagctttggggacagttggcag

SEQ ID NO: 6742711 - DNA, 23 bp, Homo sapiens
tgagcttttcagttaagttgctg

SEQ ID NO: 6742712 - DNA, 13 bp, Homo sapiens
tgagcttttctag

SEQ ID NO: 6742713 - DNA, 18 bp, Homo sapiens
tgaggaaaaatatgtgaa

SEQ ID NO: 6742714 - DNA, 23 bp, Homo sapiens
tgaggaaaagactgtgggtgggg

SEQ ID NO: 6742715 - DNA, 15 bp, Homo sapiens
tgaggaaaattctta

SEQ ID NO: 6742716 - DNA, 16 bp, Homo sapiens
tgaggaaacaacagct

SEQ ID NO: 6742717 - DNA, 15 bp, Homo sapiens
tgaggaaactactga

SEQ ID NO: 6742718 - DNA, 18 bp, Homo sapiens
tgaggaaagcaagaatca

SEQ ID NO: 6742719 - DNA, 18 bp, Homo sapiens
tgaggaaaggccagctgg

SEQ ID NO: 6742720 - DNA, 17 bp, Homo sapiens
tgaggaaagtcattggc

SEQ ID NO: 6742721 - DNA, 19 bp, Homo sapiens
tgaggaaagtcattggctt

SEQ ID NO: 6742722 - DNA, 21 bp, Homo sapiens
tgaggaaagtcattggcttta

SEQ ID NO: 6742723 - DNA, 11 bp, Homo sapiens
tgaggaaatgt

SEQ ID NO: 6742724 - DNA, 12 bp, Homo sapiens
tgaggaaatgtg

SEQ ID NO: 6742725 - DNA, 14 bp, Homo sapiens
tgaggaaatttgca

SEQ ID NO: 6742726 - DNA, 16 bp, Homo sapiens
tgaggaaatttgcagc

SEQ ID NO: 6742727 - DNA, 18 bp, Homo sapiens
tgaggaacggatcagatg

SEQ ID NO: 6742728 - DNA, 14 bp, Homo sapiens
tgaggaagaggttg

SEQ ID NO: 6742729 - DNA, 17 bp, Homo sapiens
tgaggaagaggttgcag

SEQ ID NO: 6742730 - DNA, 15 bp, Homo sapiens
tgaggaagagtttat

SEQ ID NO: 6742731 - DNA, 22 bp, Homo sapiens
tgaggaagcaaaagcatctatg

SEQ ID NO: 6742732 - DNA, 14 bp, Homo sapiens
tgaggaagcagttg

SEQ ID NO: 6742733 - DNA, 15 bp, Homo sapiens
tgaggaagcagttgg

SEQ ID NO: 6742734 - DNA, 21 bp, Homo sapiens
tgaggaagcagttggggccct

SEQ ID NO: 6742735 - DNA, 22 bp, Homo sapiens
tgaggaagcgtgaaggccgaga

SEQ ID NO: 6742736 - DNA, 22 bp, Homo sapiens
tgaggaagctgttggggggctg

SEQ ID NO: 6742737 - DNA, 11 bp, Homo sapiens
tgaggaataaa

SEQ ID NO: 6742738 - DNA, 12 bp, Homo sapiens
tgaggaataaag

SEQ ID NO: 6742739 - DNA, 14 bp, Homo sapiens
tgaggaataaagct

SEQ ID NO: 6742740 - DNA, 19 bp, Homo sapiens
tgaggaatagcaaaattcc

SEQ ID NO: 6742741 - DNA, 19 bp, Homo sapiens
tgaggaatagttgagcccc

SEQ ID NO: 6742742 - DNA, 15 bp, Homo sapiens
tgaggaatatcacac

SEQ ID NO: 6742743 - DNA, 21 bp, Homo sapiens
tgaggaatatgactgttttta

SEQ ID NO: 6742744 - DNA, 22 bp, Homo sapiens
tgaggaatccagacccggctgc

SEQ ID NO: 6742745 - DNA, 15 bp, Homo sapiens
tgaggaatttgaagc

SEQ ID NO: 6742746 - DNA, 13 bp, Homo sapiens
tgaggaattttct

SEQ ID NO: 6742747 - DNA, 14 bp, Homo sapiens
tgaggaattttctt

SEQ ID NO: 6742748 - DNA, 15 bp, Homo sapiens
tgaggacaaagagaa

SEQ ID NO: 6742749 - DNA, 22 bp, Homo sapiens
tgaggacaaagtggaggagggc

SEQ ID NO: 6742750 - DNA, 13 bp, Homo sapiens
tgaggacaagaga

SEQ ID NO: 6742751 - DNA, 14 bp, Homo sapiens
tgaggacaaggaaa

SEQ ID NO: 6742752 - DNA, 20 bp, Homo sapiens
tgaggacacaccccacaccc

SEQ ID NO: 6742753 - DNA, 12 bp, Homo sapiens
tgaggacacatg

SEQ ID NO: 6742754 - DNA, 15 bp, Homo sapiens
tgaggacacatgtcc

SEQ ID NO: 6742755 - DNA, 21 bp, Homo sapiens
tgaggacacgtggcctgcacc

SEQ ID NO: 6742756 - DNA, 10 bp, Homo sapiens
tgaggacaga

SEQ ID NO: 6742757 - DNA, 14 bp, Homo sapiens
tgaggacagaagga

SEQ ID NO: 6742758 - DNA, 22 bp, Homo sapiens
tgaggacagaaggactggtgcg

SEQ ID NO: 6742759 - DNA, 17 bp, Homo sapiens
tgaggacagacagaagg

SEQ ID NO: 6742760 - DNA, 19 bp, Homo sapiens
tgaggacagagcttgaagc

SEQ ID NO: 6742761 - DNA, 15 bp, Homo sapiens
tgaggacagaggccg

SEQ ID NO: 6742762 - DNA, 15 bp, Homo sapiens
tgaggacagatgcct

SEQ ID NO: 6742763 - DNA, 16 bp, Homo sapiens
tgaggacagctgtcct

SEQ ID NO: 6742764 - DNA, 17 bp, Homo sapiens
tgaggacagctgtcctc

SEQ ID NO: 6742765 - DNA, 14 bp, Homo sapiens
tgaggacaggagag

SEQ ID NO: 6742766 - DNA, 15 bp, Homo sapiens
tgaggacaggagagg

SEQ ID NO: 6742767 - DNA, 14 bp, Homo sapiens
tgaggacaggcccc

SEQ ID NO: 6742768 - DNA, 12 bp, Homo sapiens
tgaggacatgga

SEQ ID NO: 6742769 - DNA, 17 bp, Homo sapiens
tgaggacatggagagag

SEQ ID NO: 6742770 - DNA, 21 bp, Homo sapiens
tgaggaccagggtggagctga

SEQ ID NO: 6742771 - DNA, 22 bp, Homo sapiens
tgaggaccagggtggagctgag

SEQ ID NO: 6742772 - DNA, 14 bp, Homo sapiens
tgaggacccgccgg

SEQ ID NO: 6742773 - DNA, 19 bp, Homo sapiens
tgaggacccgccggatgac

SEQ ID NO: 6742774 - DNA, 21 bp, Homo sapiens
tgaggaccgctgataagcatt

SEQ ID NO: 6742775 - DNA, 17 bp, Homo sapiens
tgaggaccgtaaggcct

SEQ ID NO: 6742776 - DNA, 21 bp, Homo sapiens
tgaggacctctcagcatagcc

SEQ ID NO: 6742777 - DNA, 17 bp, Homo sapiens
tgaggacgagaccccca

SEQ ID NO: 6742778 - DNA, 15 bp, Homo sapiens
tgaggacgcaccgcc

SEQ ID NO: 6742779 - DNA, 17 bp, Homo sapiens
tgaggacggggcagagc

SEQ ID NO: 6742780 - DNA, 17 bp, Homo sapiens
tgaggactcatatattt

SEQ ID NO: 6742781 - DNA, 20 bp, Homo sapiens
tgaggactcatatatttaag

SEQ ID NO: 6742782 - DNA, 15 bp, Homo sapiens
tgaggactcctgagg

SEQ ID NO: 6742783 - DNA, 22 bp, Homo sapiens
tgaggactcggccactgtgtct

SEQ ID NO: 6742784 - DNA, 22 bp, Homo sapiens
tgaggactctgcaagtgtctgg

SEQ ID NO: 6742785 - DNA, 16 bp, Homo sapiens
tgaggactgaagctgg

SEQ ID NO: 6742786 - DNA, 17 bp, Homo sapiens
tgaggactttgcccagg

SEQ ID NO: 6742787 - DNA, 18 bp, Homo sapiens
tgaggactttgcccagga

SEQ ID NO: 6742788 - DNA, 20 bp, Homo sapiens
tgaggactttggtcacccag

SEQ ID NO: 6742789 - DNA, 23 bp, Homo sapiens
tgaggagaaatttgataatgaca

SEQ ID NO: 6742790 - DNA, 20 bp, Homo sapiens
tgaggagaagggggtctctg

SEQ ID NO: 6742791 - DNA, 11 bp, Homo sapiens
tgaggagaagt

SEQ ID NO: 6742792 - DNA, 17 bp, Homo sapiens
tgaggagacagaaagcc

SEQ ID NO: 6742793 - DNA, 19 bp, Homo sapiens
tgaggagacagaaagcctc

SEQ ID NO: 6742794 - DNA, 20 bp, Homo sapiens
tgaggagacagaaagcctcc

SEQ ID NO: 6742795 - DNA, 12 bp, Homo sapiens
tgaggagacatc

SEQ ID NO: 6742796 - DNA, 17 bp, Homo sapiens
tgaggagacattctgtc

SEQ ID NO: 6742797 - DNA, 16 bp, Homo sapiens
tgaggagagaaggaca

SEQ ID NO: 6742798 - DNA, 14 bp, Homo sapiens
tgaggagcaaagca

SEQ ID NO: 6742799 - DNA, 16 bp, Homo sapiens
tgaggagcaaagcagc

SEQ ID NO: 6742800 - DNA, 12 bp, Homo sapiens
tgaggagcagcc

SEQ ID NO: 6742801 - DNA, 14 bp, Homo sapiens
tgaggagcagccag

SEQ ID NO: 6742802 - DNA, 20 bp, Homo sapiens
tgaggagcagcttcagttgt

SEQ ID NO: 6742803 - DNA, 19 bp, Homo sapiens
tgaggagcatgttttgtat

SEQ ID NO: 6742804 - DNA, 23 bp, Homo sapiens
tgaggagcatgttttgtatacaa

SEQ ID NO: 6742805 - DNA, 21 bp, Homo sapiens
tgaggagcccatactcagcct

SEQ ID NO: 6742806 - DNA, 23 bp, Homo sapiens
tgaggagcccatactcagcctgc

SEQ ID NO: 6742807 - DNA, 14 bp, Homo sapiens
tgaggagccccagc

SEQ ID NO: 6742808 - DNA, 16 bp, Homo sapiens
tgaggagccccagcta

SEQ ID NO: 6742809 - DNA, 13 bp, Homo sapiens
tgaggagccctga

SEQ ID NO: 6742810 - DNA, 14 bp, Homo sapiens
tgaggagccctgag

SEQ ID NO: 6742811 - DNA, 16 bp, Homo sapiens
tgaggagccctgagga

SEQ ID NO: 6742812 - DNA, 15 bp, Homo sapiens
tgaggagctcagggc

SEQ ID NO: 6742813 - DNA, 17 bp, Homo sapiens
tgaggagctcagggctg

SEQ ID NO: 6742814 - DNA, 19 bp, Homo sapiens
tgaggagctcagggctgga

SEQ ID NO: 6742815 - DNA, 15 bp, Homo sapiens
tgaggagctgctggc

SEQ ID NO: 6742816 - DNA, 16 bp, Homo sapiens
tgaggagctgctggct

SEQ ID NO: 6742817 - DNA, 11 bp, Homo sapiens
tgaggagctgg

SEQ ID NO: 6742818 - DNA, 14 bp, Homo sapiens
tgaggagctggagg

SEQ ID NO: 6742819 - DNA, 17 bp, Homo sapiens
tgaggagctggaggggt

SEQ ID NO: 6742820 - DNA, 18 bp, Homo sapiens
tgaggagctggaggggtg

SEQ ID NO: 6742821 - DNA, 15 bp, Homo sapiens
tgaggaggaagcaga

SEQ ID NO: 6742822 - DNA, 18 bp, Homo sapiens
tgaggaggaaggagagaa

SEQ ID NO: 6742823 - DNA, 18 bp, Homo sapiens
tgaggaggagctggcctg

SEQ ID NO: 6742824 - DNA, 18 bp, Homo sapiens
tgaggaggaggacacagc

SEQ ID NO: 6742825 - DNA, 17 bp, Homo sapiens
tgaggaggcagaaagca

SEQ ID NO: 6742826 - DNA, 23 bp, Homo sapiens
tgaggaggcagaaagcagaggct

SEQ ID NO: 6742827 - DNA, 21 bp, Homo sapiens
tgaggaggccgcttagtgctg

SEQ ID NO: 6742828 - DNA, 17 bp, Homo sapiens
tgaggaggcctccatct

SEQ ID NO: 6742829 - DNA, 23 bp, Homo sapiens
tgaggaggccttgggctctgctg

SEQ ID NO: 6742830 - DNA, 13 bp, Homo sapiens
tgaggagggatgt

SEQ ID NO: 6742831 - DNA, 12 bp, Homo sapiens
tgaggaggggag

SEQ ID NO: 6742832 - DNA, 18 bp, Homo sapiens
tgaggaggggagcaaggc

SEQ ID NO: 6742833 - DNA, 17 bp, Homo sapiens
tgaggaggggcacctgc

SEQ ID NO: 6742834 - DNA, 20 bp, Homo sapiens
tgaggaggggcacctgccac

SEQ ID NO: 6742835 - DNA, 14 bp, Homo sapiens
tgaggagggggaga

SEQ ID NO: 6742836 - DNA, 19 bp, Homo sapiens
tgaggagggggaggacgga

SEQ ID NO: 6742837 - DNA, 14 bp, Homo sapiens
tgaggagggtgccc

SEQ ID NO: 6742838 - DNA, 16 bp, Homo sapiens
tgaggaggtgctgcag

SEQ ID NO: 6742839 - DNA, 15 bp, Homo sapiens
tgaggagtaaaattc

SEQ ID NO: 6742840 - DNA, 13 bp, Homo sapiens
tgaggagtctgag

SEQ ID NO: 6742841 - DNA, 16 bp, Homo sapiens
tgaggagtctgaggac

SEQ ID NO: 6742842 - DNA, 17 bp, Homo sapiens
tgaggagtctgaggtcc

SEQ ID NO: 6742843 - DNA, 22 bp, Homo sapiens
tgaggggttcctcccctccagc

SEQ ID NO: 6742844 - DNA, 22 bp, Homo sapiens
tgaggggtttcttttggaaata

SEQ ID NO: 6742845 - DNA, 22 bp, Homo sapiens
tgagggtatgaagagctgtctt

SEQ ID NO: 6742846 - DNA, 22 bp, Homo sapiens
tgagggtcagagaggagtcaga

SEQ ID NO: 6742847 - DNA, 20 bp, Homo sapiens
tgagggtcctgattctccct

SEQ ID NO: 6742848 - DNA, 14 bp, Homo sapiens
tgagggtcctgcag

SEQ ID NO: 6742849 - DNA, 18 bp, Homo sapiens
tgagggtcctgcagcctg

SEQ ID NO: 6742850 - DNA, 14 bp, Homo sapiens
tgagggtcctgctg

SEQ ID NO: 6742851 - DNA, 16 bp, Homo sapiens
tgagggtcgtgggaaa

SEQ ID NO: 6742852 - DNA, 15 bp, Homo sapiens
tgagggtctgtaggt

SEQ ID NO: 6742853 - DNA, 18 bp, Homo sapiens
tgagggtctgtaggttgc

SEQ ID NO: 6742854 - DNA, 22 bp, Homo sapiens
tgagggtctgtaggttgcacac

SEQ ID NO: 6742855 - DNA, 23 bp, Homo sapiens
tgagggtgacagagggacagtgg

SEQ ID NO: 6742856 - DNA, 12 bp, Homo sapiens
tgagggtgactg

SEQ ID NO: 6742857 - DNA, 13 bp, Homo sapiens
tgagggtgcaggg

SEQ ID NO: 6742858 - DNA, 14 bp, Homo sapiens
tgagggtgcaggga

SEQ ID NO: 6742859 - DNA, 20 bp, Homo sapiens
tgagggtgccccgcctgagt

SEQ ID NO: 6742860 - DNA, 20 bp, Homo sapiens
tgagggtgcggggcctgcag

SEQ ID NO: 6742861 - DNA, 21 bp, Homo sapiens
tgagggtgcggggcctgcagg

SEQ ID NO: 6742862 - DNA, 14 bp, Homo sapiens
tgagggtggagact

SEQ ID NO: 6742863 - DNA, 14 bp, Homo sapiens
tgagggtgggccag

SEQ ID NO: 6742864 - DNA, 15 bp, Homo sapiens
tgagggtgggccagc

SEQ ID NO: 6742865 - DNA, 16 bp, Homo sapiens
tgagggtgggggtgct

SEQ ID NO: 6742866 - DNA, 21 bp, Homo sapiens
tgagggtggggtgccccagct

SEQ ID NO: 6742867 - DNA, 18 bp, Homo sapiens
tgagggtgtccgctgctg

SEQ ID NO: 6742868 - DNA, 22 bp, Homo sapiens
tgagggtgtccgctgctgcttt

SEQ ID NO: 6742869 - DNA, 15 bp, Homo sapiens
tgagggtgtttcctc

SEQ ID NO: 6742870 - DNA, 18 bp, Homo sapiens
tgagggtgtttcctctaa

SEQ ID NO: 6742871 - DNA, 21 bp, Homo sapiens
tgagggtttctgatctgtact

SEQ ID NO: 6742872 - DNA, 17 bp, Homo sapiens
tgagggtttgagagccc

SEQ ID NO: 6742873 - DNA, 18 bp, Homo sapiens
tgagggtttgtgctacca

SEQ ID NO: 6742874 - DNA, 21 bp, Homo sapiens
tgagggtttttctaagtaaga

SEQ ID NO: 6742875 - DNA, 21 bp, Homo sapiens
tgaggtaacagggtcaactgg

SEQ ID NO: 6742876 - DNA, 15 bp, Homo sapiens
tgaggtaagtggaat

SEQ ID NO: 6742877 - DNA, 23 bp, Homo sapiens
tgaggtaagtggaattagagggc

SEQ ID NO: 6742878 - DNA, 15 bp, Homo sapiens
tgaggtaagtttttt

SEQ ID NO: 6742879 - DNA, 19 bp, Homo sapiens
tgaggtacaacctgttctg

SEQ ID NO: 6742880 - DNA, 22 bp, Homo sapiens
tgaggtacctttccacccagac

SEQ ID NO: 6742881 - DNA, 18 bp, Homo sapiens
tgaggtactggtcccttc

SEQ ID NO: 6742882 - DNA, 21 bp, Homo sapiens
tgaggtagaggggaaggaaat

SEQ ID NO: 6742883 - DNA, 16 bp, Homo sapiens
tgaggtaggagaggcg

SEQ ID NO: 6742884 - DNA, 22 bp, Homo sapiens
tgaggtagtgccaatgacagga

SEQ ID NO: 6742885 - DNA, 15 bp, Homo sapiens
tgaggtataaagaca

SEQ ID NO: 6742886 - DNA, 21 bp, Homo sapiens
tgaggtatggccatgccctag

SEQ ID NO: 6742887 - DNA, 21 bp, Homo sapiens
tgaggtcaataaagcagagcc

SEQ ID NO: 6742888 - DNA, 19 bp, Homo sapiens
tgaggtcagagcctgcagt

SEQ ID NO: 6742889 - DNA, 12 bp, Homo sapiens
tgaggtcaggga

SEQ ID NO: 6742890 - DNA, 14 bp, Homo sapiens
tgaggtcagggagt

SEQ ID NO: 6742891 - DNA, 18 bp, Homo sapiens
tgaggtcagggagtgctg

SEQ ID NO: 6742892 - DNA, 13 bp, Homo sapiens
tgaggtcatgcat

SEQ ID NO: 6742893 - DNA, 21 bp, Homo sapiens
tgaggtcatttctaaggtgtg

SEQ ID NO: 6742894 - DNA, 19 bp, Homo sapiens
tgaggtccaccggcccctg

SEQ ID NO: 6742895 - DNA, 21 bp, Homo sapiens
tgaggtccaccggcccctggc

SEQ ID NO: 6742896 - DNA, 19 bp, Homo sapiens
tgaggtcccaggcagagaa

SEQ ID NO: 6742897 - DNA, 21 bp, Homo sapiens
tgaggtcccttcaaggcctcc

SEQ ID NO: 6742898 - DNA, 22 bp, Homo sapiens
tgaggtcccttcaaggcctccc

SEQ ID NO: 6742899 - DNA, 14 bp, Homo sapiens
tgaggtcctcaggt

SEQ ID NO: 6742900 - DNA, 15 bp, Homo sapiens
tgaggtcctcaggtc

SEQ ID NO: 6742901 - DNA, 21 bp, Homo sapiens
tgaggtcctcaggtcagctgg

SEQ ID NO: 6742902 - DNA, 22 bp, Homo sapiens
tgaggtcctcaggtcagctggg

SEQ ID NO: 6742903 - DNA, 23 bp, Homo sapiens
tgaggtcctcaggtcagctggga

SEQ ID NO: 6742904 - DNA, 16 bp, Homo sapiens
tgaggtcctgagcact

SEQ ID NO: 6742905 - DNA, 19 bp, Homo sapiens
tgaggtcctgagcactgcc

SEQ ID NO: 6742906 - DNA, 22 bp, Homo sapiens
tgaggtcctgagcactgccagg

SEQ ID NO: 6742907 - DNA, 16 bp, Homo sapiens
tgaggtcctgggggcc

SEQ ID NO: 6742908 - DNA, 20 bp, Homo sapiens
tgaggtcgggagtttgagac

SEQ ID NO: 6742909 - DNA, 21 bp, Homo sapiens
tgaggtcgggagtttgagacc

SEQ ID NO: 6742910 - DNA, 18 bp, Homo sapiens
tgaggtctcgaccctgtc

SEQ ID NO: 6742911 - DNA, 14 bp, Homo sapiens
tgaggtctcttttc

SEQ ID NO: 6742912 - DNA, 23 bp, Homo sapiens
tgaggtctgctcggccgtcttca

SEQ ID NO: 6742913 - DNA, 13 bp, Homo sapiens
tgaggtctggatt

SEQ ID NO: 6742914 - DNA, 15 bp, Homo sapiens
tgaggtctggctgct

SEQ ID NO: 6742915 - DNA, 14 bp, Homo sapiens
tgaggtctgttcct

SEQ ID NO: 6742916 - DNA, 16 bp, Homo sapiens
tgaggtctgttccttt

SEQ ID NO: 6742917 - DNA, 20 bp, Homo sapiens
tgaggtctgttctttccaaa

SEQ ID NO: 6742918 - DNA, 17 bp, Homo sapiens
tgaggtctgtttaaagt

SEQ ID NO: 6742919 - DNA, 16 bp, Homo sapiens
tgaggtctgtttctct

SEQ ID NO: 6742920 - DNA, 23 bp, Homo sapiens
tgaggtctttctcctcaggacaa

SEQ ID NO: 6742921 - DNA, 17 bp, Homo sapiens
tgaggtcttttgacatg

SEQ ID NO: 6742922 - DNA, 23 bp, Homo sapiens
tgaggtcttttgacatgtggaaa

SEQ ID NO: 6742923 - DNA, 15 bp, Homo sapiens
tgaggtgaaagggag

SEQ ID NO: 6742924 - DNA, 16 bp, Homo sapiens
tgaggtgaaagggagc

SEQ ID NO: 6742925 - DNA, 18 bp, Homo sapiens
tgaggtgaaagggagcta

SEQ ID NO: 6742926 - DNA, 15 bp, Homo sapiens
tgaggtgaaattcag

SEQ ID NO: 6742927 - DNA, 19 bp, Homo sapiens
tgaggtgaactccaggcat

SEQ ID NO: 6742928 - DNA, 20 bp, Homo sapiens
tgaggtgaactccaggcatg

SEQ ID NO: 6742929 - DNA, 16 bp, Homo sapiens
tgaggtgaatttcatt

SEQ ID NO: 6742930 - DNA, 23 bp, Homo sapiens
tgaggtgacactccagttgcaga

SEQ ID NO: 6742931 - DNA, 22 bp, Homo sapiens
tgaggtgagttgggggtatcta

SEQ ID NO: 6742932 - DNA, 23 bp, Homo sapiens
tgaggtgatatttttatgtgcag

SEQ ID NO: 6742933 - DNA, 19 bp, Homo sapiens
tgaggtgcactgggaggct

SEQ ID NO: 6742934 - DNA, 20 bp, Homo sapiens
tgaggtgcagagtgcccaga

SEQ ID NO: 6742935 - DNA, 22 bp, Homo sapiens
tgaggtgcccagctagctgcag

SEQ ID NO: 6742936 - DNA, 14 bp, Homo sapiens
tgaggtgcctccca

SEQ ID NO: 6742937 - DNA, 15 bp, Homo sapiens
tgaggtgcctcccag

SEQ ID NO: 6742938 - DNA, 16 bp, Homo sapiens
tgaggtgcctcccagt

SEQ ID NO: 6742939 - DNA, 21 bp, Homo sapiens
tgaggtgcctcccagtggcct

SEQ ID NO: 6742940 - DNA, 15 bp, Homo sapiens
tgaggtgcctgctca

SEQ ID NO: 6742941 - DNA, 19 bp, Homo sapiens
tgaggtgcctgctcaggtg

SEQ ID NO: 6742942 - DNA, 14 bp, Homo sapiens
tgaggtgcctgtcc

SEQ ID NO: 6742943 - DNA, 16 bp, Homo sapiens
tgaggtgctgggaggg

SEQ ID NO: 6742944 - DNA, 17 bp, Homo sapiens
tgaggtgcttgccccca

SEQ ID NO: 6742945 - DNA, 15 bp, Homo sapiens
tgaggtggaagccct

SEQ ID NO: 6742946 - DNA, 14 bp, Homo sapiens
tgaggtggcacttt

SEQ ID NO: 6742947 - DNA, 20 bp, Homo sapiens
tgaggtggcactttttcatt

SEQ ID NO: 6742948 - DNA, 14 bp, Homo sapiens
tgaggtggcccagg

SEQ ID NO: 6742949 - DNA, 17 bp, Homo sapiens
tgaggtggcccaggccc

SEQ ID NO: 6742950 - DNA, 18 bp, Homo sapiens
tgaggtggcccaggcccc

SEQ ID NO: 6742951 - DNA, 16 bp, Homo sapiens
tgaggtggctgtagat

SEQ ID NO: 6742952 - DNA, 14 bp, Homo sapiens
tgaggtgggagatg

SEQ ID NO: 6742953 - DNA, 12 bp, Homo sapiens
tgaggtgggagg

SEQ ID NO: 6742954 - DNA, 22 bp, Homo sapiens
tgaggtgggaggtggaagaagg

SEQ ID NO: 6742955 - DNA, 13 bp, Homo sapiens
tgaggtgggcaga

SEQ ID NO: 6742956 - DNA, 11 bp, Homo sapiens
tgaggtgggcc

SEQ ID NO: 6742957 - DNA, 17 bp, Homo sapiens
tgaggtgggcctttgag

SEQ ID NO: 6742958 - DNA, 16 bp, Homo sapiens
tgaggtgggctggggc

SEQ ID NO: 6742959 - DNA, 17 bp, Homo sapiens
tgaggtgggctggggct

SEQ ID NO: 6742960 - DNA, 13 bp, Homo sapiens
tgaggtggggaag

SEQ ID NO: 6742961 - DNA, 18 bp, Homo sapiens
tgaggtggggaaggaggg

SEQ ID NO: 6742962 - DNA, 20 bp, Homo sapiens
tgaggtggggaaggagggac

SEQ ID NO: 6742963 - DNA, 12 bp, Homo sapiens
tgaggtgggggc

SEQ ID NO: 6742964 - DNA, 18 bp, Homo sapiens
tgaggtgggtctacctca

SEQ ID NO: 6742965 - DNA, 21 bp, Homo sapiens
tgaggtgggttttcttcccat

SEQ ID NO: 6742966 - DNA, 23 bp, Homo sapiens
tgaggtggtagtaaaacacagag

SEQ ID NO: 6742967 - DNA, 20 bp, Homo sapiens
tgaggtggtctgaatgttct

SEQ ID NO: 6742968 - DNA, 12 bp, Homo sapiens
tgaggtgtacca

SEQ ID NO: 6742969 - DNA, 21 bp, Homo sapiens
tgaggtgtattggtgttgcag

SEQ ID NO: 6742970 - DNA, 20 bp, Homo sapiens
tgaggtgtcagagaaaatga

SEQ ID NO: 6742971 - DNA, 15 bp, Homo sapiens
tgaggtgtccaactg

SEQ ID NO: 6742972 - DNA, 16 bp, Homo sapiens
tgaggtgtctggcctg

SEQ ID NO: 6742973 - DNA, 18 bp, Homo sapiens
tgaggtgtgcctggcctc

SEQ ID NO: 6742974 - DNA, 14 bp, Homo sapiens
tgaggtgttgcagc

SEQ ID NO: 6742975 - DNA, 17 bp, Homo sapiens
tgaggtgttgcagccca

SEQ ID NO: 6742976 - DNA, 15 bp, Homo sapiens
tgaggttaaaatata

SEQ ID NO: 6742977 - DNA, 22 bp, Homo sapiens
tgaggttaaacggtgcccatcc

SEQ ID NO: 6742978 - DNA, 22 bp, Homo sapiens
tgaggttaagtttctcttcacc

SEQ ID NO: 6742979 - DNA, 14 bp, Homo sapiens
tgaggttactggaa

SEQ ID NO: 6742980 - DNA, 20 bp, Homo sapiens
tgaggttagcccaatggaga

SEQ ID NO: 6742981 - DNA, 16 bp, Homo sapiens
tgaggttatgagaaaa

SEQ ID NO: 6742982 - DNA, 16 bp, Homo sapiens
tgaggttcctctgcct

SEQ ID NO: 6742983 - DNA, 17 bp, Homo sapiens
tgaggttcctctgcctg

SEQ ID NO: 6742984 - DNA, 20 bp, Homo sapiens
tgaggttcctctgcctgccc

SEQ ID NO: 6742985 - DNA, 16 bp, Homo sapiens
tgaggttctgagacca

SEQ ID NO: 6742986 - DNA, 17 bp, Homo sapiens
tgaggttctgagaccag

SEQ ID NO: 6742987 - DNA, 19 bp, Homo sapiens
tgaggttctgagaccagtg

SEQ ID NO: 6742988 - DNA, 19 bp, Homo sapiens
tgaggttgacctgtttctc

SEQ ID NO: 6742989 - DNA, 14 bp, Homo sapiens
tgaggttgggaagg

SEQ ID NO: 6742990 - DNA, 13 bp, Homo sapiens
tgaggtttaacat

SEQ ID NO: 6742991 - DNA, 17 bp, Homo sapiens
tgaggtttaacattaaa

SEQ ID NO: 6742992 - DNA, 14 bp, Homo sapiens
tgaggtttcagtag

SEQ ID NO: 6742993 - DNA, 15 bp, Homo sapiens
tgaggtttttaagcc

SEQ ID NO: 6742994 - DNA, 21 bp, Homo sapiens
tgagtaaaatagattttataa

SEQ ID NO: 6742995 - DNA, 22 bp, Homo sapiens
tgagtaaaatcacagatttttt

SEQ ID NO: 6742996 - DNA, 17 bp, Homo sapiens
tgagtaaataaactctt

SEQ ID NO: 6742997 - DNA, 21 bp, Homo sapiens
tgagtaaataaactcttcaag

SEQ ID NO: 6742998 - DNA, 12 bp, Homo sapiens
tgagtaaatatt

SEQ ID NO: 6742999 - DNA, 20 bp, Homo sapiens
tgagtaaatattgaggcttt

SEQ ID NO: 6743000 - DNA, 23 bp, Homo sapiens
tgagtaaatattgaggctttgtg

SEQ ID NO: 6743001 - DNA, 17 bp, Homo sapiens
tgagtaaatcagatgtt

SEQ ID NO: 6743002 - DNA, 16 bp, Homo sapiens
tgagtaacatttgctg

SEQ ID NO: 6743003 - DNA, 18 bp, Homo sapiens
tgagtaacatttgctgtt

SEQ ID NO: 6743004 - DNA, 15 bp, Homo sapiens
tgagtaactattatt

SEQ ID NO: 6743005 - DNA, 22 bp, Homo sapiens
tgagtaactgatttgtaacaag

SEQ ID NO: 6743006 - DNA, 15 bp, Homo sapiens
tgagtaacttagaaa

SEQ ID NO: 6743007 - DNA, 13 bp, Homo sapiens
tgagtaagagctg

SEQ ID NO: 6743008 - DNA, 23 bp, Homo sapiens
tgagtaagagctggtgtctgatt

SEQ ID NO: 6743009 - DNA, 22 bp, Homo sapiens
tgagtaagccagttggcttcta

SEQ ID NO: 6743010 - DNA, 23 bp, Homo sapiens
tgagtaagtgaaggtctcctaaa

SEQ ID NO: 6743011 - DNA, 17 bp, Homo sapiens
tgagtaatcaatacaga

SEQ ID NO: 6743012 - DNA, 17 bp, Homo sapiens
tgagtaatggtgtagaa

SEQ ID NO: 6743013 - DNA, 20 bp, Homo sapiens
tgagtaattaataaagaaaa

SEQ ID NO: 6743014 - DNA, 23 bp, Homo sapiens
tgagtaattcaagcctctaaaca

SEQ ID NO: 6743015 - DNA, 13 bp, Homo sapiens
tgagtaatttaaa

SEQ ID NO: 6743016 - DNA, 15 bp, Homo sapiens
tgagtacaaatgtgt

SEQ ID NO: 6743017 - DNA, 15 bp, Homo sapiens
tgagtacagaattca

SEQ ID NO: 6743018 - DNA, 22 bp, Homo sapiens
tgagtacagaattcaacagtta

SEQ ID NO: 6743019 - DNA, 19 bp, Homo sapiens
tgatattgttatatacata

SEQ ID NO: 6743020 - DNA, 16 bp, Homo sapiens
tgatattgtttaaaat

SEQ ID NO: 6743021 - DNA, 21 bp, Homo sapiens
tgatattgtttgctgttgggt

SEQ ID NO: 6743022 - DNA, 17 bp, Homo sapiens
tgatatttaagcagctt

SEQ ID NO: 6743023 - DNA, 16 bp, Homo sapiens
tgatatttatagaaca

SEQ ID NO: 6743024 - DNA, 19 bp, Homo sapiens
tgatatttattatattttt

SEQ ID NO: 6743025 - DNA, 13 bp, Homo sapiens
tgatatttatttc

SEQ ID NO: 6743026 - DNA, 15 bp, Homo sapiens
tgatatttatttcct

SEQ ID NO: 6743027 - DNA, 23 bp, Homo sapiens
tgatatttccctcccctggggac

SEQ ID NO: 6743028 - DNA, 14 bp, Homo sapiens
tgatatttccttca

SEQ ID NO: 6743029 - DNA, 14 bp, Homo sapiens
tgatatttctctag

SEQ ID NO: 6743030 - DNA, 18 bp, Homo sapiens
tgatatttctctagtagt

SEQ ID NO: 6743031 - DNA, 11 bp, Homo sapiens
tgatatttggt

SEQ ID NO: 6743032 - DNA, 12 bp, Homo sapiens
tgatatttggtt

SEQ ID NO: 6743033 - DNA, 17 bp, Homo sapiens
tgatatttgtgcatttt

SEQ ID NO: 6743034 - DNA, 15 bp, Homo sapiens
tgatatttgtgtaaa

SEQ ID NO: 6743035 - DNA, 16 bp, Homo sapiens
tgatatttgtgtaaag

SEQ ID NO: 6743036 - DNA, 21 bp, Homo sapiens
tgatattttcaacgcagccct

SEQ ID NO: 6743037 - DNA, 14 bp, Homo sapiens
tgatattttctcta

SEQ ID NO: 6743038 - DNA, 15 bp, Homo sapiens
tgatattttctctag

SEQ ID NO: 6743039 - DNA, 18 bp, Homo sapiens
tgatatttttatgtgcag

SEQ ID NO: 6743040 - DNA, 18 bp, Homo sapiens
tgatatttttccatttat

SEQ ID NO: 6743041 - DNA, 21 bp, Homo sapiens
tgatcaaaaactgccttcccc

SEQ ID NO: 6743042 - DNA, 16 bp, Homo sapiens
tgatcaaaaataatgc

SEQ ID NO: 6743043 - DNA, 15 bp, Homo sapiens
tgatcaaaacctgtg

SEQ ID NO: 6743044 - DNA, 23 bp, Homo sapiens
tgatcaaaacctgtgccaggctg

SEQ ID NO: 6743045 - DNA, 13 bp, Homo sapiens
tgatcaaaataaa

SEQ ID NO: 6743046 - DNA, 17 bp, Homo sapiens
tgatcaaacatgtctct

SEQ ID NO: 6743047 - DNA, 18 bp, Homo sapiens
tgatcaaagccacactct

SEQ ID NO: 6743048 - DNA, 20 bp, Homo sapiens
tgatcaaagtccgaggggcg

SEQ ID NO: 6743049 - DNA, 13 bp, Homo sapiens
tgatcaaatgtac

SEQ ID NO: 6743050 - DNA, 15 bp, Homo sapiens
tgatcaaatgtacat

SEQ ID NO: 6743051 - DNA, 17 bp, Homo sapiens
tgatcaaatgtacatct

SEQ ID NO: 6743052 - DNA, 15 bp, Homo sapiens
tgatcaaattcattt

SEQ ID NO: 6743053 - DNA, 22 bp, Homo sapiens
tgatcaaattggctacaatctt

SEQ ID NO: 6743054 - DNA, 16 bp, Homo sapiens
tgatcaacataatgga

SEQ ID NO: 6743055 - DNA, 19 bp, Homo sapiens
tgatcaacataatggacca

SEQ ID NO: 6743056 - DNA, 15 bp, Homo sapiens
tgatcaactcttcga

SEQ ID NO: 6743057 - DNA, 14 bp, Homo sapiens
tgatcaagagtccg

SEQ ID NO: 6743058 - DNA, 16 bp, Homo sapiens
tgatcaagatattaaa

SEQ ID NO: 6743059 - DNA, 23 bp, Homo sapiens
tgatcaaggagggagaaaggcaa

SEQ ID NO: 6743060 - DNA, 18 bp, Homo sapiens
tgatcaaggagtgaagta

SEQ ID NO: 6743061 - DNA, 11 bp, Homo sapiens
tgatcaaggcc

SEQ ID NO: 6743062 - DNA, 13 bp, Homo sapiens
tgatcaaggcctt

SEQ ID NO: 6743063 - DNA, 17 bp, Homo sapiens
tgatcaagggaatgtaa

SEQ ID NO: 6743064 - DNA, 16 bp, Homo sapiens
tgatcaaggtgctctt

SEQ ID NO: 6743065 - DNA, 20 bp, Homo sapiens
tgatcaaggtgctcttctca

SEQ ID NO: 6743066 - DNA, 24 bp, Homo sapiens
tgatcaatctgcagtttgtgaact

SEQ ID NO: 6743067 - DNA, 14 bp, Homo sapiens
tgatcaatgacaga

SEQ ID NO: 6743068 - DNA, 14 bp, Homo sapiens
tgatcaattaaatg

SEQ ID NO: 6743069 - DNA, 17 bp, Homo sapiens
tgatcaattaaatgtag

SEQ ID NO: 6743070 - DNA, 18 bp, Homo sapiens
tgatcaattgaccttgtg

SEQ ID NO: 6743071 - DNA, 12 bp, Homo sapiens
tgatcacacagt

SEQ ID NO: 6743072 - DNA, 13 bp, Homo sapiens
tgatcacacagtg

SEQ ID NO: 6743073 - DNA, 22 bp, Homo sapiens
tgatcacacagtgttagtgctg

SEQ ID NO: 6743074 - DNA, 12 bp, Homo sapiens
tgatcacactct

SEQ ID NO: 6743075 - DNA, 12 bp, Homo sapiens
tgatcacagatg

SEQ ID NO: 6743076 - DNA, 14 bp, Homo sapiens
tgatcacagcagct

SEQ ID NO: 6743077 - DNA, 12 bp, Homo sapiens
tgatcacaggag

SEQ ID NO: 6743078 - DNA, 20 bp, Homo sapiens
tgatcacagtggcgagagga

SEQ ID NO: 6743079 - DNA, 18 bp, Homo sapiens
tgatcacatctaaagctt

SEQ ID NO: 6743080 - DNA, 21 bp, Homo sapiens
tgatcacatctaaagctttat

SEQ ID NO: 6743081 - DNA, 15 bp, Homo sapiens
tgatcacattgtttc

SEQ ID NO: 6743082 - DNA, 15 bp, Homo sapiens
tgatcacccaatgca

SEQ ID NO: 6743083 - DNA, 19 bp, Homo sapiens
tgatcacccaatgcatcac

SEQ ID NO: 6743084 - DNA, 17 bp, Homo sapiens
tgatcacccccctgctt

SEQ ID NO: 6743085 - DNA, 23 bp, Homo sapiens
tgatcaccctgaattcattgtct

SEQ ID NO: 6743086 - DNA, 17 bp, Homo sapiens
tgatcaccgactgaaaa

SEQ ID NO: 6743087 - DNA, 17 bp, Homo sapiens
tgatcacctcttgggga

SEQ ID NO: 6743088 - DNA, 14 bp, Homo sapiens
tgatcacggctcac

SEQ ID NO: 6743089 - DNA, 21 bp, Homo sapiens
tgatcacggctcactgcagcc

SEQ ID NO: 6743090 - DNA, 22 bp, Homo sapiens
tgatcacggctcactgcagcct

SEQ ID NO: 6743091 - DNA, 15 bp, Homo sapiens
tgatcactcccagca

SEQ ID NO: 6743092 - DNA, 16 bp, Homo sapiens
tgatcactcccagcac

SEQ ID NO: 6743093 - DNA, 17 bp, Homo sapiens
tgatcactcccagcact

SEQ ID NO: 6743094 - DNA, 18 bp, Homo sapiens
tgatcactcccagcactc

SEQ ID NO: 6743095 - DNA, 23 bp, Homo sapiens
tgatcactcccagcactcccctt

SEQ ID NO: 6743096 - DNA, 16 bp, Homo sapiens
tgatcactgaaataaa

SEQ ID NO: 6743097 - DNA, 14 bp, Homo sapiens
tgatcactgagcca

SEQ ID NO: 6743098 - DNA, 21 bp, Homo sapiens
tgatcactgagccatcatttc

SEQ ID NO: 6743099 - DNA, 14 bp, Homo sapiens
tgatcactgtgaaa

SEQ ID NO: 6743100 - DNA, 22 bp, Homo sapiens
tgatcactttatgtctcacagg

SEQ ID NO: 6743101 - DNA, 24 bp, Homo sapiens
tgatcactttctgaaattcacaaa

SEQ ID NO: 6743102 - DNA, 12 bp, Homo sapiens
tgatcagaaggc

SEQ ID NO: 6743103 - DNA, 13 bp, Homo sapiens
tgatcagaaggct

SEQ ID NO: 6743104 - DNA, 17 bp, Homo sapiens
tgatcagacattcagag

SEQ ID NO: 6743105 - DNA, 19 bp, Homo sapiens
tgatcagacttgatttaca

SEQ ID NO: 6743106 - DNA, 18 bp, Homo sapiens
tgatcagagcattgtgca

SEQ ID NO: 6743107 - DNA, 22 bp, Homo sapiens
tgatcagagccgtggtcctttg

SEQ ID NO: 6743108 - DNA, 23 bp, Homo sapiens
tgatcagaggcatttgagcagct

SEQ ID NO: 6743109 - DNA, 17 bp, Homo sapiens
tgatcagatctgacatg

SEQ ID NO: 6743110 - DNA, 17 bp, Homo sapiens
tgatcagatcttacaag

SEQ ID NO: 6743111 - DNA, 17 bp, Homo sapiens
tgatcagatgctgaatt

SEQ ID NO: 6743112 - DNA, 15 bp, Homo sapiens
tgatcagcaaattta

SEQ ID NO: 6743113 - DNA, 13 bp, Homo sapiens
tgatcagcagaga

SEQ ID NO: 6743114 - DNA, 15 bp, Homo sapiens
tgatcagcattgtga

SEQ ID NO: 6743115 - DNA, 16 bp, Homo sapiens
tgatcagccttatgtg

SEQ ID NO: 6743116 - DNA, 16 bp, Homo sapiens
tgatcagctgtttgtc

SEQ ID NO: 6743117 - DNA, 24 bp, Homo sapiens
tgatcagcttattgtctagtgaaa

SEQ ID NO: 6743118 - DNA, 12 bp, Homo sapiens
tgatcaggcccc

SEQ ID NO: 6743119 - DNA, 16 bp, Homo sapiens
tgatcaggccccaccc

SEQ ID NO: 6743120 - DNA, 20 bp, Homo sapiens
tgatcaggccccacccctgt

SEQ ID NO: 6743121 - DNA, 17 bp, Homo sapiens
tgatcaggcttcctggt

SEQ ID NO: 6743122 - DNA, 21 bp, Homo sapiens
tgatcaggcttcctggtgaga

SEQ ID NO: 6743123 - DNA, 21 bp, Homo sapiens
tgatcagtagtttgcatttca

SEQ ID NO: 6743124 - DNA, 22 bp, Homo sapiens
tgatcagtagtttgcatttcag

SEQ ID NO: 6743125 - DNA, 18 bp, Homo sapiens
tgatcagtatgctgtttt

SEQ ID NO: 6743126 - DNA, 13 bp, Homo sapiens
tgatcagtgtgct

SEQ ID NO: 6743127 - DNA, 11 bp, Homo sapiens
tgatcagtgtt

SEQ ID NO: 6743128 - DNA, 18 bp, Homo sapiens
tgatcagtgttgttgctc

SEQ ID NO: 6743129 - DNA, 18 bp, Homo sapiens
tgatcataagtgaattta

SEQ ID NO: 6743130 - DNA, 18 bp, Homo sapiens
tgatcataattaaactgt

SEQ ID NO: 6743131 - DNA, 18 bp, Homo sapiens
tgatcatacaaatgggtt

SEQ ID NO: 6743132 - DNA, 16 bp, Homo sapiens
tgatcatagaattgtg

SEQ ID NO: 6743133 - DNA, 20 bp, Homo sapiens
tgatcatagctcactgcacc

SEQ ID NO: 6743134 - DNA, 21 bp, Homo sapiens
tgatcataggggcatagccag

SEQ ID NO: 6743135 - DNA, 16 bp, Homo sapiens
tgatcatcatgtagaa

SEQ ID NO: 6743136 - DNA, 24 bp, Homo sapiens
tgatcatccactgtgccatgtgcc

SEQ ID NO: 6743137 - DNA, 15 bp, Homo sapiens
tgatcatccaggcct

SEQ ID NO: 6743138 - DNA, 14 bp, Homo sapiens
tgatcatctgctgt

SEQ ID NO: 6743139 - DNA, 15 bp, Homo sapiens
tgatcatctgctgtg

SEQ ID NO: 6743140 - DNA, 17 bp, Homo sapiens
tgatcatgatgatgatg

SEQ ID NO: 6743141 - DNA, 16 bp, Homo sapiens
tgatcatgcaggaact

SEQ ID NO: 6743142 - DNA, 16 bp, Homo sapiens
tgatcatgcattgttg

SEQ ID NO: 6743143 - DNA, 23 bp, Homo sapiens
tgatcatgcattgttgaggtggt

SEQ ID NO: 6743144 - DNA, 13 bp, Homo sapiens
tgatcatgggaat

SEQ ID NO: 6743145 - DNA, 14 bp, Homo sapiens
tgatcatggtcagc

SEQ ID NO: 6743146 - DNA, 19 bp, Homo sapiens
tgatcatggtcagctcaca

SEQ ID NO: 6743147 - DNA, 16 bp, Homo sapiens
tgatcatgtaaatgat

SEQ ID NO: 6743148 - DNA, 17 bp, Homo sapiens
tgatcatgtacttttta

SEQ ID NO: 6743149 - DNA, 18 bp, Homo sapiens
tgatcatgtttatgagaa

SEQ ID NO: 6743150 - DNA, 14 bp, Homo sapiens
tgatcattaattag

SEQ ID NO: 6743151 - DNA, 22 bp, Homo sapiens
tgatcattcataattttatcta

SEQ ID NO: 6743152 - DNA, 14 bp, Homo sapiens
tgatcattctggag

SEQ ID NO: 6743153 - DNA, 12 bp, Homo sapiens
tgatcattgaaa

SEQ ID NO: 6743154 - DNA, 17 bp, Homo sapiens
tgatcattgaaatactt

SEQ ID NO: 6743155 - DNA, 20 bp, Homo sapiens
tgatcattgcagtatcagag

SEQ ID NO: 6743156 - DNA, 22 bp, Homo sapiens
tgatcatttaaaaagctcactg

SEQ ID NO: 6743157 - DNA, 12 bp, Homo sapiens
tgatcatttctg

SEQ ID NO: 6743158 - DNA, 16 bp, Homo sapiens
tgatcatttctgccat

SEQ ID NO: 6743159 - DNA, 16 bp, Homo sapiens
tgatcattttcccccc

SEQ ID NO: 6743160 - DNA, 20 bp, Homo sapiens
tgatcattttccccccactc

SEQ ID NO: 6743161 - DNA, 14 bp, Homo sapiens
tgatccaactaatg

SEQ ID NO: 6743162 - DNA, 14 bp, Homo sapiens
tgatccacccacct

SEQ ID NO: 6743163 - DNA, 16 bp, Homo sapiens
tgatccacccacctca

SEQ ID NO: 6743164 - DNA, 19 bp, Homo sapiens
tgatccacccacctcagcc

SEQ ID NO: 6743165 - DNA, 20 bp, Homo sapiens
tgatccacccacctcggcct

SEQ ID NO: 6743166 - DNA, 16 bp, Homo sapiens
tgatccacccacctgg

SEQ ID NO: 6743167 - DNA, 14 bp, Homo sapiens
tgatccactcgcct

SEQ ID NO: 6743168 - DNA, 23 bp, Homo sapiens
tgatccagaaagaaaacttgtat

SEQ ID NO: 6743169 - DNA, 12 bp, Homo sapiens
tgatccagaaga

SEQ ID NO: 6743170 - DNA, 18 bp, Homo sapiens
tgatccagaagagcccat

SEQ ID NO: 6743171 - DNA, 22 bp, Homo sapiens
tgatccagaagagcccatatca

SEQ ID NO: 6743172 - DNA, 15 bp, Homo sapiens
tgatccagagcacag

SEQ ID NO: 6743173 - DNA, 20 bp, Homo sapiens
tgatccagcagattattcac

SEQ ID NO: 6743174 - DNA, 15 bp, Homo sapiens
tgatccagccctgag

SEQ ID NO: 6743175 - DNA, 17 bp, Homo sapiens
tgatccagccctgagtt

SEQ ID NO: 6743176 - DNA, 18 bp, Homo sapiens
tgatccagccctgagttc

SEQ ID NO: 6743177 - DNA, 18 bp, Homo sapiens
tgatccagccctggttct

SEQ ID NO: 6743178 - DNA, 12 bp, Homo sapiens
tgatccagcctt

SEQ ID NO: 6743179 - DNA, 23 bp, Homo sapiens
tgatccaggaaaatgtgagggga

SEQ ID NO: 6743180 - DNA, 18 bp, Homo sapiens
tgatccaggaaagatgtc

SEQ ID NO: 6743181 - DNA, 17 bp, Homo sapiens
tgatccaggcaatcgtt

SEQ ID NO: 6743182 - DNA, 22 bp, Homo sapiens
tgatccaggcaatcgttctgct

SEQ ID NO: 6743183 - DNA, 22 bp, Homo sapiens
tgatccagtttccggaaacaaa

SEQ ID NO: 6743184 - DNA, 22 bp, Homo sapiens
tgatccagttttgtttggacca

SEQ ID NO: 6743185 - DNA, 19 bp, Homo sapiens
tgatccatccagcttgcca

SEQ ID NO: 6743186 - DNA, 13 bp, Homo sapiens
tgatccatgtaac

SEQ ID NO: 6743187 - DNA, 17 bp, Homo sapiens
tgatccatgtaactgcc

SEQ ID NO: 6743188 - DNA, 18 bp, Homo sapiens
tgatccatgtaactgcct

SEQ ID NO: 6743189 - DNA, 20 bp, Homo sapiens
tgatccatgtaactgcctag

SEQ ID NO: 6743190 - DNA, 14 bp, Homo sapiens
tgatccatttctaa

SEQ ID NO: 6743191 - DNA, 18 bp, Homo sapiens
tgatccatttctaattat

SEQ ID NO: 6743192 - DNA, 15 bp, Homo sapiens
tgatcccaatagaat

SEQ ID NO: 6743193 - DNA, 19 bp, Homo sapiens
tgatcccacttcactgtga

SEQ ID NO: 6743194 - DNA, 19 bp, Homo sapiens
tgatcccagagagcccgag

SEQ ID NO: 6743195 - DNA, 13 bp, Homo sapiens
tgatcccagctca

SEQ ID NO: 6743196 - DNA, 16 bp, Homo sapiens
tgatcccagctcactg

SEQ ID NO: 6743197 - DNA, 15 bp, Homo sapiens
tgatcccattttcct

SEQ ID NO: 6743198 - DNA, 17 bp, Homo sapiens
tgatgtaaatatttcaa

SEQ ID NO: 6743199 - DNA, 15 bp, Homo sapiens
tgatgtaaggactgt

SEQ ID NO: 6743200 - DNA, 17 bp, Homo sapiens
tgatgtaaggactgtaa

SEQ ID NO: 6743201 - DNA, 21 bp, Homo sapiens
tgatgtaaggactgtaaacat

SEQ ID NO: 6743202 - DNA, 19 bp, Homo sapiens
tgatgtaagtttacctatg

SEQ ID NO: 6743203 - DNA, 17 bp, Homo sapiens
tgatgtaatctctctgc

SEQ ID NO: 6743204 - DNA, 22 bp, Homo sapiens
tgatgtaatctctctgcagctg

SEQ ID NO: 6743205 - DNA, 23 bp, Homo sapiens
tgatgtaatctctctgcagctgc

SEQ ID NO: 6743206 - DNA, 14 bp, Homo sapiens
tgatgtaatgaaat

SEQ ID NO: 6743207 - DNA, 21 bp, Homo sapiens
tgatgtaatgaaattccagat

SEQ ID NO: 6743208 - DNA, 17 bp, Homo sapiens
tgatgtaattaaaaaat

SEQ ID NO: 6743209 - DNA, 23 bp, Homo sapiens
tgatgtacagaacacaaatgtct

SEQ ID NO: 6743210 - DNA, 19 bp, Homo sapiens
tgatgtacagtctgtcatg

SEQ ID NO: 6743211 - DNA, 15 bp, Homo sapiens
tgatgtacagttggg

SEQ ID NO: 6743212 - DNA, 24 bp, Homo sapiens
tgatgtacataactcctgtccctt

SEQ ID NO: 6743213 - DNA, 13 bp, Homo sapiens
tgatgtacatgta

SEQ ID NO: 6743214 - DNA, 16 bp, Homo sapiens
tgatgtacatgtgtag

SEQ ID NO: 6743215 - DNA, 20 bp, Homo sapiens
tgatgtaccatgaaacaaag

SEQ ID NO: 6743216 - DNA, 21 bp, Homo sapiens
tgatgtacgctgcgtgccatg

SEQ ID NO: 6743217 - DNA, 17 bp, Homo sapiens
tgatgtactaaagtaga

SEQ ID NO: 6743218 - DNA, 21 bp, Homo sapiens
tgatgtactgattgagaagtt

SEQ ID NO: 6743219 - DNA, 22 bp, Homo sapiens
tgatgtaggaaatggtttccat

SEQ ID NO: 6743220 - DNA, 20 bp, Homo sapiens
tgatgtagggtaaggtgcct

SEQ ID NO: 6743221 - DNA, 12 bp, Homo sapiens
tgatgtataatg

SEQ ID NO: 6743222 - DNA, 22 bp, Homo sapiens
tgatgtatagctttaacatttt

SEQ ID NO: 6743223 - DNA, 19 bp, Homo sapiens
tgatgtatgtgtgaaacaa

SEQ ID NO: 6743224 - DNA, 19 bp, Homo sapiens
tgatgtatgttggtttttt

SEQ ID NO: 6743225 - DNA, 15 bp, Homo sapiens
tgatgtattacatga

SEQ ID NO: 6743226 - DNA, 14 bp, Homo sapiens
tgatgtattctagc

SEQ ID NO: 6743227 - DNA, 18 bp, Homo sapiens
tgatgtcaataacagtat

SEQ ID NO: 6743228 - DNA, 18 bp, Homo sapiens
tgatgtcaatttctgtgt

SEQ ID NO: 6743229 - DNA, 23 bp, Homo sapiens
tgatgtcaatttctgtgttgcca

SEQ ID NO: 6743230 - DNA, 14 bp, Homo sapiens
tgatgtcagaaaca

SEQ ID NO: 6743231 - DNA, 13 bp, Homo sapiens
tgatgtcagcctt

SEQ ID NO: 6743232 - DNA, 16 bp, Homo sapiens
tgatgtcagtatttca

SEQ ID NO: 6743233 - DNA, 20 bp, Homo sapiens
tgatgtcagtatttcaactg

SEQ ID NO: 6743234 - DNA, 15 bp, Homo sapiens
tgatgtcatacagag

SEQ ID NO: 6743235 - DNA, 21 bp, Homo sapiens
tgatgtcatacagagaagtca

SEQ ID NO: 6743236 - DNA, 11 bp, Homo sapiens
tgatgtcatct

SEQ ID NO: 6743237 - DNA, 17 bp, Homo sapiens
tgatgtcatctgtcact

SEQ ID NO: 6743238 - DNA, 13 bp, Homo sapiens
tgatgtcatcttg

SEQ ID NO: 6743239 - DNA, 16 bp, Homo sapiens
tgatgtcatcttgagc

SEQ ID NO: 6743240 - DNA, 22 bp, Homo sapiens
tgatgtcatgtacttcctgtgt

SEQ ID NO: 6743241 - DNA, 15 bp, Homo sapiens
tgatgtcatgtgttc

SEQ ID NO: 6743242 - DNA, 13 bp, Homo sapiens
tgatgtccagaag

SEQ ID NO: 6743243 - DNA, 23 bp, Homo sapiens
tgatgtccagaagaatattcagg

SEQ ID NO: 6743244 - DNA, 21 bp, Homo sapiens
tgatgtccagggggagaagga

SEQ ID NO: 6743245 - DNA, 22 bp, Homo sapiens
tgatgtccagggggagaaggaa

SEQ ID NO: 6743246 - DNA, 14 bp, Homo sapiens
tgatgtcccagtgc

SEQ ID NO: 6743247 - DNA, 16 bp, Homo sapiens
tgatgtccccaaagta

SEQ ID NO: 6743248 - DNA, 19 bp, Homo sapiens
tgatgtcctgtaaacactc

SEQ ID NO: 6743249 - DNA, 17 bp, Homo sapiens
tgatgtccttggactcc

SEQ ID NO: 6743250 - DNA, 18 bp, Homo sapiens
tgatgtccttggactcca

SEQ ID NO: 6743251 - DNA, 17 bp, Homo sapiens
tgatgtctagataacat

SEQ ID NO: 6743252 - DNA, 12 bp, Homo sapiens
tgatgtctccta

SEQ ID NO: 6743253 - DNA, 16 bp, Homo sapiens
tgatgtctcttgtaga

SEQ ID NO: 6743254 - DNA, 12 bp, Homo sapiens
tgatgtctgcaa

SEQ ID NO: 6743255 - DNA, 15 bp, Homo sapiens
tgatgtcttgagagc

SEQ ID NO: 6743256 - DNA, 19 bp, Homo sapiens
tgatgtcttgagagcgctg

SEQ ID NO: 6743257 - DNA, 20 bp, Homo sapiens
tgatgtcttgagagcgctgg

SEQ ID NO: 6743258 - DNA, 12 bp, Homo sapiens
tgatgtgaaaga

SEQ ID NO: 6743259 - DNA, 21 bp, Homo sapiens
tgatgtgaagagtttcacaaa

SEQ ID NO: 6743260 - DNA, 22 bp, Homo sapiens
tgatgtgaagccaattcagaca

SEQ ID NO: 6743261 - DNA, 19 bp, Homo sapiens
tgatgtgacaggaattctc

SEQ ID NO: 6743262 - DNA, 16 bp, Homo sapiens
tgatgtgacattccat

SEQ ID NO: 6743263 - DNA, 13 bp, Homo sapiens
tgatgtgacattt

SEQ ID NO: 6743264 - DNA, 14 bp, Homo sapiens
tgatgtgacttttt

SEQ ID NO: 6743265 - DNA, 17 bp, Homo sapiens
tgatgtgagtgtgtgtg

SEQ ID NO: 6743266 - DNA, 20 bp, Homo sapiens
tgatgtgatggaacacacac

SEQ ID NO: 6743267 - DNA, 17 bp, Homo sapiens
tgatgtgcaaaaatttt

SEQ ID NO: 6743268 - DNA, 18 bp, Homo sapiens
tgatgtgcaaaaattttt

SEQ ID NO: 6743269 - DNA, 23 bp, Homo sapiens
tgatgtgcaaaaccttttactgg

SEQ ID NO: 6743270 - DNA, 13 bp, Homo sapiens
tgatgtgcaagga

SEQ ID NO: 6743271 - DNA, 19 bp, Homo sapiens
tgatgtgcacgtaaagtac

SEQ ID NO: 6743272 - DNA, 12 bp, Homo sapiens
tgatgtgcctgt

SEQ ID NO: 6743273 - DNA, 18 bp, Homo sapiens
tgatgtgcgtgctgtctg

SEQ ID NO: 6743274 - DNA, 22 bp, Homo sapiens
tgatgtgcgtgctgtctgtcct

SEQ ID NO: 6743275 - DNA, 19 bp, Homo sapiens
tgatgtgctcatcagaaac

SEQ ID NO: 6743276 - DNA, 13 bp, Homo sapiens
tgatgtgcttaac

SEQ ID NO: 6743277 - DNA, 17 bp, Homo sapiens
tgatgtgcttaacaggg

SEQ ID NO: 6743278 - DNA, 16 bp, Homo sapiens
tgatgtggactgtctt

SEQ ID NO: 6743279 - DNA, 16 bp, Homo sapiens
tgatgtggaggaagag

SEQ ID NO: 6743280 - DNA, 23 bp, Homo sapiens
tgatgtggaggaagagccacctg

SEQ ID NO: 6743281 - DNA, 14 bp, Homo sapiens
tgatgtggcaactg

SEQ ID NO: 6743282 - DNA, 19 bp, Homo sapiens
tgatgtggccctggctgcc

SEQ ID NO: 6743283 - DNA, 15 bp, Homo sapiens
tgatgtgggaagaag

SEQ ID NO: 6743284 - DNA, 13 bp, Homo sapiens
tgatgtggttttt

SEQ ID NO: 6743285 - DNA, 16 bp, Homo sapiens
tgatgtgtgagtgtaa

SEQ ID NO: 6743286 - DNA, 16 bp, Homo sapiens
tgatgtgttatctctt

SEQ ID NO: 6743287 - DNA, 17 bp, Homo sapiens
tgatgtgtttacattta

SEQ ID NO: 6743288 - DNA, 14 bp, Homo sapiens
tgatgtgtttattt

SEQ ID NO: 6743289 - DNA, 16 bp, Homo sapiens
tgatgtgtttttgtat

SEQ ID NO: 6743290 - DNA, 14 bp, Homo sapiens
tgatgttaaaaaaa

SEQ ID NO: 6743291 - DNA, 23 bp, Homo sapiens
tgatgttaaaaaaataagaagaa

SEQ ID NO: 6743292 - DNA, 16 bp, Homo sapiens
tgatgttaaaattcca

SEQ ID NO: 6743293 - DNA, 16 bp, Homo sapiens
tgatgttaacacattt

SEQ ID NO: 6743294 - DNA, 20 bp, Homo sapiens
tgatgttaacccattccagt

SEQ ID NO: 6743295 - DNA, 21 bp, Homo sapiens
tgatgttaacccattccagta

SEQ ID NO: 6743296 - DNA, 23 bp, Homo sapiens
tgatgttaactattattaataaa

SEQ ID NO: 6743297 - DNA, 22 bp, Homo sapiens
tgatgttacaaggtgttgttaa

SEQ ID NO: 6743298 - DNA, 23 bp, Homo sapiens
tgatgttacaaggtgttgttaaa

SEQ ID NO: 6743299 - DNA, 21 bp, Homo sapiens
tgatgttagaagaagaggaag

SEQ ID NO: 6743300 - DNA, 23 bp, Homo sapiens
tgatgttagaagaagaggaagaa

SEQ ID NO: 6743301 - DNA, 17 bp, Homo sapiens
tgatgttaggctgggcc

SEQ ID NO: 6743302 - DNA, 23 bp, Homo sapiens
tgatgttatacatcaatatgtat

SEQ ID NO: 6743303 - DNA, 13 bp, Homo sapiens
tgatgttatctta

SEQ ID NO: 6743304 - DNA, 17 bp, Homo sapiens
tgatgttcagagtggct

SEQ ID NO: 6743305 - DNA, 23 bp, Homo sapiens
tgatgttcagagtggctcactgg

SEQ ID NO: 6743306 - DNA, 15 bp, Homo sapiens
tgatgttcagtgtaa

SEQ ID NO: 6743307 - DNA, 22 bp, Homo sapiens
tgatgttcatgatagaaagaat

SEQ ID NO: 6743308 - DNA, 18 bp, Homo sapiens
tgatgttccacctgccac

SEQ ID NO: 6743309 - DNA, 13 bp, Homo sapiens
tgatgttccttcc

SEQ ID NO: 6743310 - DNA, 20 bp, Homo sapiens
tgatgttctaaggctctgag

SEQ ID NO: 6743311 - DNA, 16 bp, Homo sapiens
tgatgttctgaaatgg

SEQ ID NO: 6743312 - DNA, 20 bp, Homo sapiens
tgatgttctttcaccctttt

SEQ ID NO: 6743313 - DNA, 17 bp, Homo sapiens
tgatgttctttccatga

SEQ ID NO: 6743314 - DNA, 14 bp, Homo sapiens
tgatgttgaaatat

SEQ ID NO: 6743315 - DNA, 16 bp, Homo sapiens
tgatgttgaaatatgc

SEQ ID NO: 6743316 - DNA, 18 bp, Homo sapiens
tgatgttgaaatatgcat

SEQ ID NO: 6743317 - DNA, 20 bp, Homo sapiens
tgatgttgacatcactggca

SEQ ID NO: 6743318 - DNA, 15 bp, Homo sapiens
tgatgttgagctgag

SEQ ID NO: 6743319 - DNA, 14 bp, Homo sapiens
tgatgttgatgcaa

SEQ ID NO: 6743320 - DNA, 19 bp, Homo sapiens
tgatgttgatgcaatcctt

SEQ ID NO: 6743321 - DNA, 16 bp, Homo sapiens
tgatgttgccttaata

SEQ ID NO: 6743322 - DNA, 13 bp, Homo sapiens
tgatgttgctgtt

SEQ ID NO: 6743323 - DNA, 16 bp, Homo sapiens
tgatgttgtaaaatga

SEQ ID NO: 6743324 - DNA, 18 bp, Homo sapiens
tgatgttgtttgggagag

SEQ ID NO: 6743325 - DNA, 19 bp, Homo sapiens
tgatgttgtttgggagagt

SEQ ID NO: 6743326 - DNA, 16 bp, Homo sapiens
tgatgtttaaaagtcc

SEQ ID NO: 6743327 - DNA, 17 bp, Homo sapiens
tgatgtttataaactga

SEQ ID NO: 6743328 - DNA, 17 bp, Homo sapiens
tgatgtttccagaaaat

SEQ ID NO: 6743329 - DNA, 16 bp, Homo sapiens
tgatgtttccagctgc

SEQ ID NO: 6743330 - DNA, 17 bp, Homo sapiens
tgatgtttccagctgcc

SEQ ID NO: 6743331 - DNA, 19 bp, Homo sapiens
tgatgtttccctctccttc

SEQ ID NO: 6743332 - DNA, 15 bp, Homo sapiens
tgatgtttcctggaa

SEQ ID NO: 6743333 - DNA, 17 bp, Homo sapiens
tgatgtttcctggaagc

SEQ ID NO: 6743334 - DNA, 17 bp, Homo sapiens
tgatgtttctgtgaaat

SEQ ID NO: 6743335 - DNA, 12 bp, Homo sapiens
tgatgtttgaaa

SEQ ID NO: 6743336 - DNA, 15 bp, Homo sapiens
tgatgtttgcccaaa

SEQ ID NO: 6743337 - DNA, 14 bp, Homo sapiens
tgatgtttgtgcag

SEQ ID NO: 6743338 - DNA, 20 bp, Homo sapiens
tgatgtttgtgcagtaactt

SEQ ID NO: 6743339 - DNA, 20 bp, Homo sapiens
tgatgtttgtgtgttttgta

SEQ ID NO: 6743340 - DNA, 15 bp, Homo sapiens
tgatgtttgttttcg

SEQ ID NO: 6743341 - DNA, 17 bp, Homo sapiens
tgatgttttaaggatgc

SEQ ID NO: 6743342 - DNA, 18 bp, Homo sapiens
tgatgttttaaggatgct

SEQ ID NO: 6743343 - DNA, 21 bp, Homo sapiens
tgatgttttaaggatgcttgt

SEQ ID NO: 6743344 - DNA, 22 bp, Homo sapiens
tgatgttttatccttacaatgt

SEQ ID NO: 6743345 - DNA, 13 bp, Homo sapiens
tgatgttttcaca

SEQ ID NO: 6743346 - DNA, 14 bp, Homo sapiens
tgatgttttgatat

SEQ ID NO: 6743347 - DNA, 13 bp, Homo sapiens
tgatgttttgcaa

SEQ ID NO: 6743348 - DNA, 17 bp, Homo sapiens
tgatgtttttaaaatct

SEQ ID NO: 6743349 - DNA, 19 bp, Homo sapiens
tgatgtttttaaaatctta

SEQ ID NO: 6743350 - DNA, 19 bp, Homo sapiens
tgattaaaaataccttcta

SEQ ID NO: 6743351 - DNA, 20 bp, Homo sapiens
tgattaaaaataccttctat

SEQ ID NO: 6743352 - DNA, 16 bp, Homo sapiens
tgattaaaaatgcttt

SEQ ID NO: 6743353 - DNA, 20 bp, Homo sapiens
tgattaaaaatgcttttaga

SEQ ID NO: 6743354 - DNA, 23 bp, Homo sapiens
tgattaaaacacacataaaccaa

SEQ ID NO: 6743355 - DNA, 11 bp, Homo sapiens
tgattaaaatc

SEQ ID NO: 6743356 - DNA, 15 bp, Homo sapiens
tgattaaaatctctt

SEQ ID NO: 6743357 - DNA, 16 bp, Homo sapiens
tgattaaaatgtttga

SEQ ID NO: 6743358 - DNA, 22 bp, Homo sapiens
tgattaaacagcaaagccatat

SEQ ID NO: 6743359 - DNA, 19 bp, Homo sapiens
tgattaaaggcagcatttg

SEQ ID NO: 6743360 - DNA, 15 bp, Homo sapiens
tgattaaagtgcctt

SEQ ID NO: 6743361 - DNA, 20 bp, Homo sapiens
tgattaaagtgctcacgtta

SEQ ID NO: 6743362 - DNA, 18 bp, Homo sapiens
tgattaaataagattcta

SEQ ID NO: 6743363 - DNA, 15 bp, Homo sapiens
tgattaaatatttga

SEQ ID NO: 6743364 - DNA, 18 bp, Homo sapiens
tgattaaatatttgaaga

SEQ ID NO: 6743365 - DNA, 12 bp, Homo sapiens
tgattaaattat

SEQ ID NO: 6743366 - DNA, 19 bp, Homo sapiens
tgattaaattatcattgtt

SEQ ID NO: 6743367 - DNA, 14 bp, Homo sapiens
tgattaaattatga

SEQ ID NO: 6743368 - DNA, 17 bp, Homo sapiens
tgattaaattatgaatg

SEQ ID NO: 6743369 - DNA, 16 bp, Homo sapiens
tgattaaattcttgca

SEQ ID NO: 6743370 - DNA, 14 bp, Homo sapiens
tgattaaattttag

SEQ ID NO: 6743371 - DNA, 15 bp, Homo sapiens
tgattaacaaatatg

SEQ ID NO: 6743372 - DNA, 17 bp, Homo sapiens
tgattaacaaatatgct

SEQ ID NO: 6743373 - DNA, 18 bp, Homo sapiens
tgattaacaatgtatttt

SEQ ID NO: 6743374 - DNA, 23 bp, Homo sapiens
tgattaacaatgtattttaataa

SEQ ID NO: 6743375 - DNA, 17 bp, Homo sapiens
tgattaacatctacaat

SEQ ID NO: 6743376 - DNA, 15 bp, Homo sapiens
tgatttttctttaca

SEQ ID NO: 6743377 - DNA, 18 bp, Homo sapiens
tgatttttcttttttaat

SEQ ID NO: 6743378 - DNA, 21 bp, Homo sapiens
tgatttttgcctcttccagtc

SEQ ID NO: 6743379 - DNA, 19 bp, Homo sapiens
tgatttttggtatttatgt

SEQ ID NO: 6743380 - DNA, 21 bp, Homo sapiens
tgatttttggtcttctgttga

SEQ ID NO: 6743381 - DNA, 21 bp, Homo sapiens
tgattttttaaggagctgggg

SEQ ID NO: 6743382 - DNA, 18 bp, Homo sapiens
tgattttttcaaaaaagt

SEQ ID NO: 6743383 - DNA, 15 bp, Homo sapiens
tgatttttttaaagt

SEQ ID NO: 6743384 - DNA, 13 bp, Homo sapiens
tgatttttttcca

SEQ ID NO: 6743385 - DNA, 23 bp, Homo sapiens
tgattttttttcccatttagaat

SEQ ID NO: 6743386 - DNA, 18 bp, Homo sapiens
tgatttttttttcataca

SEQ ID NO: 6743387 - DNA, 17 bp, Homo sapiens
tgatttttttttccttc

SEQ ID NO: 6743388 - DNA, 19 bp, Homo sapiens
tgatttttttttccttcag

SEQ ID NO: 6743389 - DNA, 19 bp, Homo sapiens
tgcaaaaaaaaaaatgtca

SEQ ID NO: 6743390 - DNA, 21 bp, Homo sapiens
tgcaaaaaacatacttacatt

SEQ ID NO: 6743391 - DNA, 19 bp, Homo sapiens
tgcaaaaaatcttaatact

SEQ ID NO: 6743392 - DNA, 21 bp, Homo sapiens
tgcaaaaaatcttaatactgt

SEQ ID NO: 6743393 - DNA, 14 bp, Homo sapiens
tgcaaaaaattctt

SEQ ID NO: 6743394 - DNA, 16 bp, Homo sapiens
tgcaaaaaattcttta

SEQ ID NO: 6743395 - DNA, 18 bp, Homo sapiens
tgcaaaaaattctttaga

SEQ ID NO: 6743396 - DNA, 21 bp, Homo sapiens
tgcaaaaaattctttagagat

SEQ ID NO: 6743397 - DNA, 19 bp, Homo sapiens
tgcaaaaactacaaccaat

SEQ ID NO: 6743398 - DNA, 14 bp, Homo sapiens
tgcaaaaactgtaa

SEQ ID NO: 6743399 - DNA, 17 bp, Homo sapiens
tgcaaaaagaaaaaaag

SEQ ID NO: 6743400 - DNA, 21 bp, Homo sapiens
tgcaaaaagatttaacaaata

SEQ ID NO: 6743401 - DNA, 23 bp, Homo sapiens
tgcaaaaaggactggaaaaatga

SEQ ID NO: 6743402 - DNA, 13 bp, Homo sapiens
tgcaaaaagtaca

SEQ ID NO: 6743403 - DNA, 14 bp, Homo sapiens
tgcaaaaataatca

SEQ ID NO: 6743404 - DNA, 17 bp, Homo sapiens
tgcaaaaataatcatga

SEQ ID NO: 6743405 - DNA, 13 bp, Homo sapiens
tgcaaaaatataa

SEQ ID NO: 6743406 - DNA, 18 bp, Homo sapiens
tgcaaaaatatttataaa

SEQ ID NO: 6743407 - DNA, 18 bp, Homo sapiens
tgcaaaaatccaaatatt

SEQ ID NO: 6743408 - DNA, 14 bp, Homo sapiens
tgcaaaaatgaatt

SEQ ID NO: 6743409 - DNA, 12 bp, Homo sapiens
tgcaaaaatgag

SEQ ID NO: 6743410 - DNA, 17 bp, Homo sapiens
tgcaaaaattatatatt

SEQ ID NO: 6743411 - DNA, 17 bp, Homo sapiens
tgcaaaaatttttggat

SEQ ID NO: 6743412 - DNA, 23 bp, Homo sapiens
tgcaaaacagcgtttaagactgt

SEQ ID NO: 6743413 - DNA, 19 bp, Homo sapiens
tgcaaaactccaggcagga

SEQ ID NO: 6743414 - DNA, 20 bp, Homo sapiens
tgcaaaagactaatttaaaa

SEQ ID NO: 6743415 - DNA, 12 bp, Homo sapiens
tgcaaaagcagc

SEQ ID NO: 6743416 - DNA, 15 bp, Homo sapiens
tgcaaaagcaggctt

SEQ ID NO: 6743417 - DNA, 21 bp, Homo sapiens
tgcaaaaggcctgtgatccag

SEQ ID NO: 6743418 - DNA, 21 bp, Homo sapiens
tgcaaaaggctgattactgaa

SEQ ID NO: 6743419 - DNA, 23 bp, Homo sapiens
tgcaaaaggttcactaaagcagt

SEQ ID NO: 6743420 - DNA, 13 bp, Homo sapiens
tgcaaaagtgggg

SEQ ID NO: 6743421 - DNA, 16 bp, Homo sapiens
tgcaaaagtggggcta

SEQ ID NO: 6743422 - DNA, 14 bp, Homo sapiens
tgcaaaagttctca

SEQ ID NO: 6743423 - DNA, 15 bp, Homo sapiens
tgcaaaataaagaat

SEQ ID NO: 6743424 - DNA, 12 bp, Homo sapiens
tgcaaaatacat

SEQ ID NO: 6743425 - DNA, 14 bp, Homo sapiens
tgcaaaatacatga

SEQ ID NO: 6743426 - DNA, 14 bp, Homo sapiens
tgcaaaatcagttt

SEQ ID NO: 6743427 - DNA, 13 bp, Homo sapiens
tgcaaaatgaaga

SEQ ID NO: 6743428 - DNA, 17 bp, Homo sapiens
tgcaaaatgagaccctc

SEQ ID NO: 6743429 - DNA, 20 bp, Homo sapiens
tgcaaaatgcgtatttgcat

SEQ ID NO: 6743430 - DNA, 12 bp, Homo sapiens
tgcaaaatggaa

SEQ ID NO: 6743431 - DNA, 19 bp, Homo sapiens
tgcaaaatggaaatgtaat

SEQ ID NO: 6743432 - DNA, 24 bp, Homo sapiens
tgcaaaatgtagaaataaattact

SEQ ID NO: 6743433 - DNA, 17 bp, Homo sapiens
tgcaaaatgtcttgtgt

SEQ ID NO: 6743434 - DNA, 21 bp, Homo sapiens
tgcaaaatgtcttgtgtattt

SEQ ID NO: 6743435 - DNA, 13 bp, Homo sapiens
tgcaaaattaaat

SEQ ID NO: 6743436 - DNA, 14 bp, Homo sapiens
tgcaaaattcctga

SEQ ID NO: 6743437 - DNA, 22 bp, Homo sapiens
tgcaaaattgtctaaaatgtca

SEQ ID NO: 6743438 - DNA, 20 bp, Homo sapiens
tgcaaaattgttttcacttg

SEQ ID NO: 6743439 - DNA, 22 bp, Homo sapiens
tgcaaaattgttttcacttgta

SEQ ID NO: 6743440 - DNA, 23 bp, Homo sapiens
tgcaaaattgttttcacttgtat

SEQ ID NO: 6743441 - DNA, 12 bp, Homo sapiens
tgcaaaatttag

SEQ ID NO: 6743442 - DNA, 22 bp, Homo sapiens
tgcaaaatttgatgccaggaca

SEQ ID NO: 6743443 - DNA, 19 bp, Homo sapiens
tgcaaaatttttttaatct

SEQ ID NO: 6743444 - DNA, 18 bp, Homo sapiens
tgcaaacaacctgaatct

SEQ ID NO: 6743445 - DNA, 23 bp, Homo sapiens
tgcaaacaagaaacgtgtcacac

SEQ ID NO: 6743446 - DNA, 12 bp, Homo sapiens
tgcaaacaatga

SEQ ID NO: 6743447 - DNA, 16 bp, Homo sapiens
tgcaaacaatgaagaa

SEQ ID NO: 6743448 - DNA, 23 bp, Homo sapiens
tgcaaacaatgaagaattatgta

SEQ ID NO: 6743449 - DNA, 22 bp, Homo sapiens
tgcaaacactgtgattactctt

SEQ ID NO: 6743450 - DNA, 19 bp, Homo sapiens
tgcaaacactgtgtattta

SEQ ID NO: 6743451 - DNA, 15 bp, Homo sapiens
tgcaaacagaacagg

SEQ ID NO: 6743452 - DNA, 13 bp, Homo sapiens
tgcaaacagaagt

SEQ ID NO: 6743453 - DNA, 18 bp, Homo sapiens
tgcaaacagaagtgcatc

SEQ ID NO: 6743454 - DNA, 23 bp, Homo sapiens
tgcaaacagaagtgcatcctgat

SEQ ID NO: 6743455 - DNA, 19 bp, Homo sapiens
tgcaaaccacttctccatg

SEQ ID NO: 6743456 - DNA, 18 bp, Homo sapiens
tgcaaaccatcattgaaa

SEQ ID NO: 6743457 - DNA, 20 bp, Homo sapiens
tgcaaacccagtgagacaga

SEQ ID NO: 6743458 - DNA, 14 bp, Homo sapiens
tgcaaaccctgctg

SEQ ID NO: 6743459 - DNA, 13 bp, Homo sapiens
tgcaaacctcaga

SEQ ID NO: 6743460 - DNA, 17 bp, Homo sapiens
tgcaaacctcatctttc

SEQ ID NO: 6743461 - DNA, 19 bp, Homo sapiens
tgcaaacctgcagttttta

SEQ ID NO: 6743462 - DNA, 14 bp, Homo sapiens
tgcaaaccttcctg

SEQ ID NO: 6743463 - DNA, 14 bp, Homo sapiens
tgcaaacgctgcct

SEQ ID NO: 6743464 - DNA, 15 bp, Homo sapiens
tgcaaacgctgcctg

SEQ ID NO: 6743465 - DNA, 19 bp, Homo sapiens
tgcaaacgctgcctgccca

SEQ ID NO: 6743466 - DNA, 17 bp, Homo sapiens
tgcaaactatgagttca

SEQ ID NO: 6743467 - DNA, 19 bp, Homo sapiens
tgcaaactctataaagaaa

SEQ ID NO: 6743468 - DNA, 17 bp, Homo sapiens
tgcaaactgctttattt

SEQ ID NO: 6743469 - DNA, 13 bp, Homo sapiens
tgcaaactgggaa

SEQ ID NO: 6743470 - DNA, 17 bp, Homo sapiens
tgcaaacttggatcaga

SEQ ID NO: 6743471 - DNA, 12 bp, Homo sapiens
tgcaaactttat

SEQ ID NO: 6743472 - DNA, 18 bp, Homo sapiens
tgcaaagaaaattctcaa

SEQ ID NO: 6743473 - DNA, 16 bp, Homo sapiens
tgcaaagaaagaaaaa

SEQ ID NO: 6743474 - DNA, 23 bp, Homo sapiens
tgcaaagaaagaaaaaaaaccat

SEQ ID NO: 6743475 - DNA, 21 bp, Homo sapiens
tgcaaagacagtatttattgg

SEQ ID NO: 6743476 - DNA, 17 bp, Homo sapiens
tgcaaagacctacctcc

SEQ ID NO: 6743477 - DNA, 20 bp, Homo sapiens
tgcaaagacctacctccaga

SEQ ID NO: 6743478 - DNA, 17 bp, Homo sapiens
tgcaaagactctgagcc

SEQ ID NO: 6743479 - DNA, 21 bp, Homo sapiens
tgcaaagcaatcttttataca

SEQ ID NO: 6743480 - DNA, 14 bp, Homo sapiens
tgcaaagcaatgaa

SEQ ID NO: 6743481 - DNA, 18 bp, Homo sapiens
tgcaaagcactctctgca

SEQ ID NO: 6743482 - DNA, 22 bp, Homo sapiens
tgcaaagcactgacttctaagt

SEQ ID NO: 6743483 - DNA, 17 bp, Homo sapiens
tgcaaagcagagtgaaa

SEQ ID NO: 6743484 - DNA, 14 bp, Homo sapiens
tgcaaagccaaggc

SEQ ID NO: 6743485 - DNA, 16 bp, Homo sapiens
tgcaaagcctttaaat

SEQ ID NO: 6743486 - DNA, 12 bp, Homo sapiens
tgcaaagctgct

SEQ ID NO: 6743487 - DNA, 17 bp, Homo sapiens
tgcaaagctgcttgaat

SEQ ID NO: 6743488 - DNA, 16 bp, Homo sapiens
tgcaaaggaaatacca

SEQ ID NO: 6743489 - DNA, 12 bp, Homo sapiens
tgcaaaggactg

SEQ ID NO: 6743490 - DNA, 13 bp, Homo sapiens
tgcaaaggagaag

SEQ ID NO: 6743491 - DNA, 12 bp, Homo sapiens
tgcaaaggccct

SEQ ID NO: 6743492 - DNA, 14 bp, Homo sapiens
tgcaaaggcccttg

SEQ ID NO: 6743493 - DNA, 21 bp, Homo sapiens
tgcaaagggtatcaggtgctg

SEQ ID NO: 6743494 - DNA, 20 bp, Homo sapiens
tgcaaaggtggggagaaggg

SEQ ID NO: 6743495 - DNA, 14 bp, Homo sapiens
tgcaaagtaaaaaa

SEQ ID NO: 6743496 - DNA, 15 bp, Homo sapiens
tgcaaagtacaatgt

SEQ ID NO: 6743497 - DNA, 19 bp, Homo sapiens
tgcaaagtacaatgtgttt

SEQ ID NO: 6743498 - DNA, 17 bp, Homo sapiens
tgcaaagtacaggtact

SEQ ID NO: 6743499 - DNA, 22 bp, Homo sapiens
tgcaaagtaccaactgagccaa

SEQ ID NO: 6743500 - DNA, 20 bp, Homo sapiens
tgcaaagtatccctactgta

SEQ ID NO: 6743501 - DNA, 13 bp, Homo sapiens
tgcaaagtatttt

SEQ ID NO: 6743502 - DNA, 23 bp, Homo sapiens
tgcaaagtcatgcaaaggctggg

SEQ ID NO: 6743503 - DNA, 22 bp, Homo sapiens
tgcaaagtctccagaagaaaat

SEQ ID NO: 6743504 - DNA, 12 bp, Homo sapiens
tgcaaagtgcaa

SEQ ID NO: 6743505 - DNA, 19 bp, Homo sapiens
tgcaaagtggaattaaagg

SEQ ID NO: 6743506 - DNA, 21 bp, Homo sapiens
tgcaaagtgttttgtaccagt

SEQ ID NO: 6743507 - DNA, 17 bp, Homo sapiens
tgcaaagttctgtgttt

SEQ ID NO: 6743508 - DNA, 15 bp, Homo sapiens
tgcaaagtttgtgtc

SEQ ID NO: 6743509 - DNA, 17 bp, Homo sapiens
tgcaaataaagcctgct

SEQ ID NO: 6743510 - DNA, 16 bp, Homo sapiens
tgcaaataaagccttt

SEQ ID NO: 6743511 - DNA, 21 bp, Homo sapiens
tgcaaataaaggctctggaag

SEQ ID NO: 6743512 - DNA, 23 bp, Homo sapiens
tgcaaataaatatcctttaattg

SEQ ID NO: 6743513 - DNA, 13 bp, Homo sapiens
tgcaaataacaaa

SEQ ID NO: 6743514 - DNA, 21 bp, Homo sapiens
tgcaaataagactcttaccta

SEQ ID NO: 6743515 - DNA, 17 bp, Homo sapiens
tgcaaataaggacagca

SEQ ID NO: 6743516 - DNA, 19 bp, Homo sapiens
tgcaaataaggacagcagc

SEQ ID NO: 6743517 - DNA, 23 bp, Homo sapiens
tgcaaataagtgtattttgaaat

SEQ ID NO: 6743518 - DNA, 21 bp, Homo sapiens
tgcaaatactccaagcttcaa

SEQ ID NO: 6743519 - DNA, 23 bp, Homo sapiens
tgcaaatactgtatattcaggac

SEQ ID NO: 6743520 - DNA, 20 bp, Homo sapiens
tgcaaatacttccaaagagt

SEQ ID NO: 6743521 - DNA, 20 bp, Homo sapiens
tgcaaatagtagacatttgt

SEQ ID NO: 6743522 - DNA, 15 bp, Homo sapiens
tgcaaatagtttcaa

SEQ ID NO: 6743523 - DNA, 17 bp, Homo sapiens
tgcaaatagtttcaaat

SEQ ID NO: 6743524 - DNA, 17 bp, Homo sapiens
tgcaaatataaacatct

SEQ ID NO: 6743525 - DNA, 18 bp, Homo sapiens
tgcaaatatactttactt

SEQ ID NO: 6743526 - DNA, 22 bp, Homo sapiens
tgcaaatattggttagtattta

SEQ ID NO: 6743527 - DNA, 18 bp, Homo sapiens
tgcaaatccatagcacaa

SEQ ID NO: 6743528 - DNA, 17 bp, Homo sapiens
tgcaaatcctatgtgat

SEQ ID NO: 6743529 - DNA, 18 bp, Homo sapiens
tgcaaatcctatgtgatt

SEQ ID NO: 6743530 - DNA, 16 bp, Homo sapiens
tgcaaatctgacaata

SEQ ID NO: 6743531 - DNA, 18 bp, Homo sapiens
tgcaaatctggcttagta

SEQ ID NO: 6743532 - DNA, 14 bp, Homo sapiens
tgcaaatcttgaaa

SEQ ID NO: 6743533 - DNA, 20 bp, Homo sapiens
tgcaaatgaaggaatgcaat

SEQ ID NO: 6743534 - DNA, 15 bp, Homo sapiens
tgcaaatgaatcatt

SEQ ID NO: 6743535 - DNA, 16 bp, Homo sapiens
tgcaaatgaatgcctt

SEQ ID NO: 6743536 - DNA, 21 bp, Homo sapiens
tgcaaatgagatttctttgaa

SEQ ID NO: 6743537 - DNA, 20 bp, Homo sapiens
tgcaaatgagttcaggacta

SEQ ID NO: 6743538 - DNA, 15 bp, Homo sapiens
tgcaaatgcacattt

SEQ ID NO: 6743539 - DNA, 17 bp, Homo sapiens
tgcaaatgcacatttgt

SEQ ID NO: 6743540 - DNA, 19 bp, Homo sapiens
tgcaaatgcacatttgtca

SEQ ID NO: 6743541 - DNA, 21 bp, Homo sapiens
tgcaaatgctatgagatgcat

SEQ ID NO: 6743542 - DNA, 15 bp, Homo sapiens
tgcaaatgctgtatt

SEQ ID NO: 6743543 - DNA, 19 bp, Homo sapiens
tgcaaatggagataaaagc

SEQ ID NO: 6743544 - DNA, 14 bp, Homo sapiens
tgcaaatgggagct

SEQ ID NO: 6743545 - DNA, 15 bp, Homo sapiens
tgcaaatgtctaatt

SEQ ID NO: 6743546 - DNA, 19 bp, Homo sapiens
tgcaaatgttgtatttcaa

SEQ ID NO: 6743547 - DNA, 20 bp, Homo sapiens
tgcaaatgttgtatttcaaa

SEQ ID NO: 6743548 - DNA, 15 bp, Homo sapiens
tgcaaattaaaacat

SEQ ID NO: 6743549 - DNA, 18 bp, Homo sapiens
tgcaaattaaagggcaga

SEQ ID NO: 6743550 - DNA, 19 bp, Homo sapiens
tgcaaattaaagggcagat

SEQ ID NO: 6743551 - DNA, 23 bp, Homo sapiens
tgcaaattaatgtataatttgag

SEQ ID NO: 6743552 - DNA, 21 bp, Homo sapiens
tgcaaattcaagagcctcccc

SEQ ID NO: 6743553 - DNA, 16 bp, Homo sapiens
tgcaattaaaactatg

SEQ ID NO: 6743554 - DNA, 21 bp, Homo sapiens
tgcaattactgcctgcagaga

SEQ ID NO: 6743555 - DNA, 16 bp, Homo sapiens
tgcaattagcattctg

SEQ ID NO: 6743556 - DNA, 17 bp, Homo sapiens
tgcaattagcattctgt

SEQ ID NO: 6743557 - DNA, 20 bp, Homo sapiens
tgcaattaggtttttcctta

SEQ ID NO: 6743558 - DNA, 21 bp, Homo sapiens
tgcaattcaaaagttccaaga

SEQ ID NO: 6743559 - DNA, 12 bp, Homo sapiens
tgcaattcaact

SEQ ID NO: 6743560 - DNA, 15 bp, Homo sapiens
tgcaattcaatgcaa

SEQ ID NO: 6743561 - DNA, 20 bp, Homo sapiens
tgcaattcaatgcaatgaaa

SEQ ID NO: 6743562 - DNA, 14 bp, Homo sapiens
tgcaattcatgtaa

SEQ ID NO: 6743563 - DNA, 19 bp, Homo sapiens
tgcaattcatgtaacagtt

SEQ ID NO: 6743564 - DNA, 22 bp, Homo sapiens
tgcaattcatgtaacagttgtg

SEQ ID NO: 6743565 - DNA, 23 bp, Homo sapiens
tgcaattcatgtaacagttgtgt

SEQ ID NO: 6743566 - DNA, 13 bp, Homo sapiens
tgcaattcccctc

SEQ ID NO: 6743567 - DNA, 14 bp, Homo sapiens
tgcaattcccctct

SEQ ID NO: 6743568 - DNA, 14 bp, Homo sapiens
tgcaattgctcttc

SEQ ID NO: 6743569 - DNA, 15 bp, Homo sapiens
tgcaattgctcttct

SEQ ID NO: 6743570 - DNA, 17 bp, Homo sapiens
tgcaattgctcttctcc

SEQ ID NO: 6743571 - DNA, 19 bp, Homo sapiens
tgcaattgctcttctccac

SEQ ID NO: 6743572 - DNA, 23 bp, Homo sapiens
tgcaattggcaccgaagcccaga

SEQ ID NO: 6743573 - DNA, 18 bp, Homo sapiens
tgcaattggggaagaaaa

SEQ ID NO: 6743574 - DNA, 13 bp, Homo sapiens
tgcaattgtacaa

SEQ ID NO: 6743575 - DNA, 21 bp, Homo sapiens
tgcaattgtaggggtgtgtgt

SEQ ID NO: 6743576 - DNA, 13 bp, Homo sapiens
tgcaattgtcttt

SEQ ID NO: 6743577 - DNA, 16 bp, Homo sapiens
tgcaatttaaaattat

SEQ ID NO: 6743578 - DNA, 22 bp, Homo sapiens
tgcaatttattaaaatgattgt

SEQ ID NO: 6743579 - DNA, 13 bp, Homo sapiens
tgcaatttcaagg

SEQ ID NO: 6743580 - DNA, 18 bp, Homo sapiens
tgcaatttcaggaattta

SEQ ID NO: 6743581 - DNA, 23 bp, Homo sapiens
tgcaatttcaggaatttaattta

SEQ ID NO: 6743582 - DNA, 14 bp, Homo sapiens
tgcaatttctacta

SEQ ID NO: 6743583 - DNA, 14 bp, Homo sapiens
tgcaatttcttctg

SEQ ID NO: 6743584 - DNA, 20 bp, Homo sapiens
tgcaatttgacttggcataa

SEQ ID NO: 6743585 - DNA, 22 bp, Homo sapiens
tgcaatttgagccatttaaaga

SEQ ID NO: 6743586 - DNA, 23 bp, Homo sapiens
tgcaatttgattgactgcccatt

SEQ ID NO: 6743587 - DNA, 20 bp, Homo sapiens
tgcaatttgggatttactag

SEQ ID NO: 6743588 - DNA, 20 bp, Homo sapiens
tgcaatttgtctttggaaaa

SEQ ID NO: 6743589 - DNA, 17 bp, Homo sapiens
tgcaattttaacacaca

SEQ ID NO: 6743590 - DNA, 20 bp, Homo sapiens
tgcaattttaattgattatt

SEQ ID NO: 6743591 - DNA, 12 bp, Homo sapiens
tgcaattttact

SEQ ID NO: 6743592 - DNA, 22 bp, Homo sapiens
tgcaattttctataggtgactt

SEQ ID NO: 6743593 - DNA, 22 bp, Homo sapiens
tgcaatttttaaactagtaatg

SEQ ID NO: 6743594 - DNA, 16 bp, Homo sapiens
tgcacaaaaagcacaa

SEQ ID NO: 6743595 - DNA, 18 bp, Homo sapiens
tgcacaaaacccagacct

SEQ ID NO: 6743596 - DNA, 19 bp, Homo sapiens
tgcacaaaacccagacctg

SEQ ID NO: 6743597 - DNA, 23 bp, Homo sapiens
tgcacaaaactacttttctaaaa

SEQ ID NO: 6743598 - DNA, 14 bp, Homo sapiens
tgcacaaacataga

SEQ ID NO: 6743599 - DNA, 15 bp, Homo sapiens
tgcacaaacatagac

SEQ ID NO: 6743600 - DNA, 16 bp, Homo sapiens
tgcacaaacatagaca

SEQ ID NO: 6743601 - DNA, 14 bp, Homo sapiens
tgcacaaacatgaa

SEQ ID NO: 6743602 - DNA, 15 bp, Homo sapiens
tgcacaaacatgaaa

SEQ ID NO: 6743603 - DNA, 16 bp, Homo sapiens
tgcacaaaccttcttt

SEQ ID NO: 6743604 - DNA, 24 bp, Homo sapiens
tgcacaaaccttcttttcaatgca

SEQ ID NO: 6743605 - DNA, 18 bp, Homo sapiens
tgcacaaacttgtgagca

SEQ ID NO: 6743606 - DNA, 15 bp, Homo sapiens
tgcacaaagcccttc

SEQ ID NO: 6743607 - DNA, 14 bp, Homo sapiens
tgcacaaagtggca

SEQ ID NO: 6743608 - DNA, 12 bp, Homo sapiens
tgcacaaataca

SEQ ID NO: 6743609 - DNA, 21 bp, Homo sapiens
tgcacaaatacggatcctgca

SEQ ID NO: 6743610 - DNA, 21 bp, Homo sapiens
tgcacaaatatttattttctt

SEQ ID NO: 6743611 - DNA, 14 bp, Homo sapiens
tgcacaacagccct

SEQ ID NO: 6743612 - DNA, 19 bp, Homo sapiens
tgcacaacagccctgcctg

SEQ ID NO: 6743613 - DNA, 21 bp, Homo sapiens
tgcacaaccatctgtccctgc

SEQ ID NO: 6743614 - DNA, 14 bp, Homo sapiens
tgcacaacttttga

SEQ ID NO: 6743615 - DNA, 15 bp, Homo sapiens
tgcacaagaatggat

SEQ ID NO: 6743616 - DNA, 23 bp, Homo sapiens
tgcacaagaatggatcacaagat

SEQ ID NO: 6743617 - DNA, 15 bp, Homo sapiens
tgcacaagctccaag

SEQ ID NO: 6743618 - DNA, 20 bp, Homo sapiens
tgcacaagctccaagctccc

SEQ ID NO: 6743619 - DNA, 21 bp, Homo sapiens
tgcacaagctgcaccctcagg

SEQ ID NO: 6743620 - DNA, 17 bp, Homo sapiens
tgcacaagcttgtatat

SEQ ID NO: 6743621 - DNA, 21 bp, Homo sapiens
tgcacaagcttgtatatacat

SEQ ID NO: 6743622 - DNA, 23 bp, Homo sapiens
tgcacaagcttgtatatacatat

SEQ ID NO: 6743623 - DNA, 13 bp, Homo sapiens
tgcacaaggaaat

SEQ ID NO: 6743624 - DNA, 17 bp, Homo sapiens
tgcacaaggattgaaaa

SEQ ID NO: 6743625 - DNA, 19 bp, Homo sapiens
tgcacaaggattgaaaatt

SEQ ID NO: 6743626 - DNA, 20 bp, Homo sapiens
tgcacaagtctttccagagg

SEQ ID NO: 6743627 - DNA, 16 bp, Homo sapiens
tgcacaagttccctgg

SEQ ID NO: 6743628 - DNA, 19 bp, Homo sapiens
tgcacaagttccctggaga

SEQ ID NO: 6743629 - DNA, 13 bp, Homo sapiens
tgcacaatgtaga

SEQ ID NO: 6743630 - DNA, 14 bp, Homo sapiens
tgcacaatgtcttg

SEQ ID NO: 6743631 - DNA, 9 bp, Homo sapiens
tgcacaatt

SEQ ID NO: 6743632 - DNA, 21 bp, Homo sapiens
tgcacaattccatgacaatat

SEQ ID NO: 6743633 - DNA, 11 bp, Homo sapiens
tgcacaattta

SEQ ID NO: 6743634 - DNA, 17 bp, Homo sapiens
tgcacaatttagaaaac

SEQ ID NO: 6743635 - DNA, 19 bp, Homo sapiens
tgcacaatttagaaaacat

SEQ ID NO: 6743636 - DNA, 15 bp, Homo sapiens
tgcacaatttgagca

SEQ ID NO: 6743637 - DNA, 16 bp, Homo sapiens
tgcacaatttgagcaa

SEQ ID NO: 6743638 - DNA, 20 bp, Homo sapiens
tgcacaatttgagcaattca

SEQ ID NO: 6743639 - DNA, 21 bp, Homo sapiens
tgcacaatttgagcaattcat

SEQ ID NO: 6743640 - DNA, 15 bp, Homo sapiens
tgcacacaaaaataa

SEQ ID NO: 6743641 - DNA, 21 bp, Homo sapiens
tgcacacaaaaataaagacta

SEQ ID NO: 6743642 - DNA, 18 bp, Homo sapiens
tgcacacaaacacctcct

SEQ ID NO: 6743643 - DNA, 14 bp, Homo sapiens
tgcacacaaatatt

SEQ ID NO: 6743644 - DNA, 20 bp, Homo sapiens
tgcacacaagcccacagcac

SEQ ID NO: 6743645 - DNA, 15 bp, Homo sapiens
tgcacacaattagat

SEQ ID NO: 6743646 - DNA, 19 bp, Homo sapiens
tgcacacacactagccttc

SEQ ID NO: 6743647 - DNA, 12 bp, Homo sapiens
tgcacacacagc

SEQ ID NO: 6743648 - DNA, 14 bp, Homo sapiens
tgcacacacagctc

SEQ ID NO: 6743649 - DNA, 15 bp, Homo sapiens
tgcacacacagctcc

SEQ ID NO: 6743650 - DNA, 23 bp, Homo sapiens
tgcacacacagtctgttcagagg

SEQ ID NO: 6743651 - DNA, 15 bp, Homo sapiens
tgcacacacatatat

SEQ ID NO: 6743652 - DNA, 13 bp, Homo sapiens
tgcacacacctcc

SEQ ID NO: 6743653 - DNA, 18 bp, Homo sapiens
tgcacacagaaatatata

SEQ ID NO: 6743654 - DNA, 14 bp, Homo sapiens
tgcacacagaatgc

SEQ ID NO: 6743655 - DNA, 11 bp, Homo sapiens
tgcacacagag

SEQ ID NO: 6743656 - DNA, 15 bp, Homo sapiens
tgcacacagagtgag

SEQ ID NO: 6743657 - DNA, 21 bp, Homo sapiens
tgcacacagatgtgaaatgaa

SEQ ID NO: 6743658 - DNA, 16 bp, Homo sapiens
tgcacacagcggctgc

SEQ ID NO: 6743659 - DNA, 20 bp, Homo sapiens
tgcacacagcggctgcctcc

SEQ ID NO: 6743660 - DNA, 22 bp, Homo sapiens
tgcacacagcggctgcctcctg

SEQ ID NO: 6743661 - DNA, 12 bp, Homo sapiens
tgcacacaggac

SEQ ID NO: 6743662 - DNA, 16 bp, Homo sapiens
tgcacacaggacagcg

SEQ ID NO: 6743663 - DNA, 20 bp, Homo sapiens
tgcacacataacacacatca

SEQ ID NO: 6743664 - DNA, 21 bp, Homo sapiens
tgcacacataacacacatcag

SEQ ID NO: 6743665 - DNA, 17 bp, Homo sapiens
tgcacacatcaccaggt

SEQ ID NO: 6743666 - DNA, 19 bp, Homo sapiens
tgcacacatcaccaggtgc

SEQ ID NO: 6743667 - DNA, 20 bp, Homo sapiens
tgcacacatcaccaggtgca

SEQ ID NO: 6743668 - DNA, 21 bp, Homo sapiens
tgcacacatcaccaggtgcat

SEQ ID NO: 6743669 - DNA, 19 bp, Homo sapiens
tgcacaccaaattgctgag

SEQ ID NO: 6743670 - DNA, 17 bp, Homo sapiens
tgcacaccaaggccctg

SEQ ID NO: 6743671 - DNA, 15 bp, Homo sapiens
tgcacaccaccctcc

SEQ ID NO: 6743672 - DNA, 18 bp, Homo sapiens
tgcacaccagttactgtt

SEQ ID NO: 6743673 - DNA, 16 bp, Homo sapiens
tgcacacccactcagc

SEQ ID NO: 6743674 - DNA, 18 bp, Homo sapiens
tgcacacccactcagctc

SEQ ID NO: 6743675 - DNA, 14 bp, Homo sapiens
tgcacacccactgc

SEQ ID NO: 6743676 - DNA, 16 bp, Homo sapiens
tgcacaccccactccc

SEQ ID NO: 6743677 - DNA, 13 bp, Homo sapiens
tgcacacccctgc

SEQ ID NO: 6743678 - DNA, 15 bp, Homo sapiens
tgcacacccctgcac

SEQ ID NO: 6743679 - DNA, 22 bp, Homo sapiens
tgcacacctactagtcaccaga

SEQ ID NO: 6743680 - DNA, 19 bp, Homo sapiens
tgcacacctgttattgcca

SEQ ID NO: 6743681 - DNA, 19 bp, Homo sapiens
tgcacacctttattcagaa

SEQ ID NO: 6743682 - DNA, 19 bp, Homo sapiens
tgcacaccttttccccagg

SEQ ID NO: 6743683 - DNA, 23 bp, Homo sapiens
tgcacacgagcagacacccttgg

SEQ ID NO: 6743684 - DNA, 16 bp, Homo sapiens
tgcacacggatgcaca

SEQ ID NO: 6743685 - DNA, 17 bp, Homo sapiens
tgcacacggctggtcac

SEQ ID NO: 6743686 - DNA, 21 bp, Homo sapiens
tgcacacggctggtcactctg

SEQ ID NO: 6743687 - DNA, 23 bp, Homo sapiens
tgcacacgggcgagctttctctc

SEQ ID NO: 6743688 - DNA, 21 bp, Homo sapiens
tgcacacgtgtgtatgagtgc

SEQ ID NO: 6743689 - DNA, 19 bp, Homo sapiens
tgcacactagcctctccag

SEQ ID NO: 6743690 - DNA, 13 bp, Homo sapiens
tgcacactcagtg

SEQ ID NO: 6743691 - DNA, 15 bp, Homo sapiens
tgcacactcagtggg

SEQ ID NO: 6743692 - DNA, 19 bp, Homo sapiens
tgcacactcatacacatgt

SEQ ID NO: 6743693 - DNA, 16 bp, Homo sapiens
tgcacactccatctcc

SEQ ID NO: 6743694 - DNA, 18 bp, Homo sapiens
tgcacactcccctgcact

SEQ ID NO: 6743695 - DNA, 21 bp, Homo sapiens
tgcacactctcccattatatt

SEQ ID NO: 6743696 - DNA, 17 bp, Homo sapiens
tgcacactctcttctcc

SEQ ID NO: 6743697 - DNA, 14 bp, Homo sapiens
tgcacactgtccta

SEQ ID NO: 6743698 - DNA, 14 bp, Homo sapiens
tgcacacttcaaat

SEQ ID NO: 6743699 - DNA, 14 bp, Homo sapiens
tgcacacttctgac

SEQ ID NO: 6743700 - DNA, 14 bp, Homo sapiens
tgcacactttgcca

SEQ ID NO: 6743701 - DNA, 18 bp, Homo sapiens
tgcacactttggcccagg

SEQ ID NO: 6743702 - DNA, 13 bp, Homo sapiens
tgcacactttggt

SEQ ID NO: 6743703 - DNA, 22 bp, Homo sapiens
tgcacactttggtaccagataa

SEQ ID NO: 6743704 - DNA, 22 bp, Homo sapiens
tgcacagaaaaccgagaatatt

SEQ ID NO: 6743705 - DNA, 22 bp, Homo sapiens
tgcacagaagtcctgtatgtct

SEQ ID NO: 6743706 - DNA, 19 bp, Homo sapiens
tgcacagacctcagagatg

SEQ ID NO: 6743707 - DNA, 19 bp, Homo sapiens
tgcacagagacggtctgga

SEQ ID NO: 6743708 - DNA, 18 bp, Homo sapiens
tgcacagagcaagtcctc

SEQ ID NO: 6743709 - DNA, 22 bp, Homo sapiens
tgcacagagcaagtcctcactc

SEQ ID NO: 6743710 - DNA, 12 bp, Homo sapiens
tgcacagagggt

SEQ ID NO: 6743711 - DNA, 21 bp, Homo sapiens
tgcacagagttgttacatttt

SEQ ID NO: 6743712 - DNA, 16 bp, Homo sapiens
tgcacagatacacata

SEQ ID NO: 6743713 - DNA, 21 bp, Homo sapiens
tgcacagatacctcatcatcc

SEQ ID NO: 6743714 - DNA, 16 bp, Homo sapiens
tgcacagatatacttt

SEQ ID NO: 6743715 - DNA, 21 bp, Homo sapiens
tgcacagatatttccatttct

SEQ ID NO: 6743716 - DNA, 17 bp, Homo sapiens
tgcacagatgccatggc

SEQ ID NO: 6743717 - DNA, 19 bp, Homo sapiens
tgcacagattaaacttcac

SEQ ID NO: 6743718 - DNA, 20 bp, Homo sapiens
tgcacagattcccaggccag

SEQ ID NO: 6743719 - DNA, 21 bp, Homo sapiens
tgcacagattcccaggccagg

SEQ ID NO: 6743720 - DNA, 16 bp, Homo sapiens
tgcacagattgctgaa

SEQ ID NO: 6743721 - DNA, 21 bp, Homo sapiens
tgcacagcagcaattgtttta

SEQ ID NO: 6743722 - DNA, 20 bp, Homo sapiens
tgcacagcaggacctgtgct

SEQ ID NO: 6743723 - DNA, 22 bp, Homo sapiens
tgcacagcaggacctgtgcttt

SEQ ID NO: 6743724 - DNA, 14 bp, Homo sapiens
tgcacagcatctca

SEQ ID NO: 6743725 - DNA, 21 bp, Homo sapiens
tgcacagcatttgctttcctc

SEQ ID NO: 6743726 - DNA, 18 bp, Homo sapiens
tgcacagccaacgagaca

SEQ ID NO: 6743727 - DNA, 21 bp, Homo sapiens
tgcacagccaacgagacacat

SEQ ID NO: 6743728 - DNA, 12 bp, Homo sapiens
tgcacagcccaa

SEQ ID NO: 6743729 - DNA, 14 bp, Homo sapiens
tgcacagcccacac

SEQ ID NO: 6743730 - DNA, 20 bp, Homo sapiens
tgcagacagccatgcgtggc

SEQ ID NO: 6743731 - DNA, 16 bp, Homo sapiens
tgcagacaggaatctt

SEQ ID NO: 6743732 - DNA, 13 bp, Homo sapiens
tgcagacaggcca

SEQ ID NO: 6743733 - DNA, 23 bp, Homo sapiens
tgcagacaggctctgaggggcac

SEQ ID NO: 6743734 - DNA, 21 bp, Homo sapiens
tgcagacagggggccagaaca

SEQ ID NO: 6743735 - DNA, 21 bp, Homo sapiens
tgcagacagtgtcagagtcat

SEQ ID NO: 6743736 - DNA, 21 bp, Homo sapiens
tgcagacagtgttttgcacat

SEQ ID NO: 6743737 - DNA, 16 bp, Homo sapiens
tgcagaccaggaagga

SEQ ID NO: 6743738 - DNA, 18 bp, Homo sapiens
tgcagaccaggaaggaag

SEQ ID NO: 6743739 - DNA, 23 bp, Homo sapiens
tgcagaccatgaagtaaattatg

SEQ ID NO: 6743740 - DNA, 15 bp, Homo sapiens
tgcagaccatgccag

SEQ ID NO: 6743741 - DNA, 16 bp, Homo sapiens
tgcagacccagtccca

SEQ ID NO: 6743742 - DNA, 15 bp, Homo sapiens
tgcagaccccaggtt

SEQ ID NO: 6743743 - DNA, 12 bp, Homo sapiens
tgcagaccctgc

SEQ ID NO: 6743744 - DNA, 14 bp, Homo sapiens
tgcagacctgggac

SEQ ID NO: 6743745 - DNA, 18 bp, Homo sapiens
tgcagacctgtcctcctg

SEQ ID NO: 6743746 - DNA, 17 bp, Homo sapiens
tgcagacgggaatgcct

SEQ ID NO: 6743747 - DNA, 17 bp, Homo sapiens
tgcagacgggcaagaag

SEQ ID NO: 6743748 - DNA, 20 bp, Homo sapiens
tgcagacgggcaagaagctg

SEQ ID NO: 6743749 - DNA, 16 bp, Homo sapiens
tgcagacgtctggccc

SEQ ID NO: 6743750 - DNA, 14 bp, Homo sapiens
tgcagactagaatt

SEQ ID NO: 6743751 - DNA, 17 bp, Homo sapiens
tgcagactagaattcta

SEQ ID NO: 6743752 - DNA, 14 bp, Homo sapiens
tgcagactcactgt

SEQ ID NO: 6743753 - DNA, 21 bp, Homo sapiens
tgcagactccaatggggccag

SEQ ID NO: 6743754 - DNA, 23 bp, Homo sapiens
tgcagactccaatggggccagca

SEQ ID NO: 6743755 - DNA, 20 bp, Homo sapiens
tgcagactcctcagatctga

SEQ ID NO: 6743756 - DNA, 19 bp, Homo sapiens
tgcagactcgttctcgtga

SEQ ID NO: 6743757 - DNA, 18 bp, Homo sapiens
tgcagactctacagaggc

SEQ ID NO: 6743758 - DNA, 19 bp, Homo sapiens
tgcagactctacagaggcc

SEQ ID NO: 6743759 - DNA, 12 bp, Homo sapiens
tgcagactgcta

SEQ ID NO: 6743760 - DNA, 22 bp, Homo sapiens
tgcagactgctgctagagccag

SEQ ID NO: 6743761 - DNA, 13 bp, Homo sapiens
tgcagactggagg

SEQ ID NO: 6743762 - DNA, 14 bp, Homo sapiens
tgcagactggcagt

SEQ ID NO: 6743763 - DNA, 16 bp, Homo sapiens
tgcagactggtgttaa

SEQ ID NO: 6743764 - DNA, 19 bp, Homo sapiens
tgcagactggtgttaatga

SEQ ID NO: 6743765 - DNA, 22 bp, Homo sapiens
tgcagactgtggctgcagagac

SEQ ID NO: 6743766 - DNA, 15 bp, Homo sapiens
tgcagacttcccagc

SEQ ID NO: 6743767 - DNA, 19 bp, Homo sapiens
tgcagacttttcagactga

SEQ ID NO: 6743768 - DNA, 19 bp, Homo sapiens
tgcagagaaacttaagcaa

SEQ ID NO: 6743769 - DNA, 20 bp, Homo sapiens
tgcagagaaacttaagcaaa

SEQ ID NO: 6743770 - DNA, 18 bp, Homo sapiens
tgcagagaagctggactt

SEQ ID NO: 6743771 - DNA, 23 bp, Homo sapiens
tgcagagactttatccatgccaa

SEQ ID NO: 6743772 - DNA, 13 bp, Homo sapiens
tgcagagagaagc

SEQ ID NO: 6743773 - DNA, 19 bp, Homo sapiens
tgcagagagcacctggtgg

SEQ ID NO: 6743774 - DNA, 15 bp, Homo sapiens
tgcagagagccattt

SEQ ID NO: 6743775 - DNA, 23 bp, Homo sapiens
tgcagagagccattttgtgaatg

SEQ ID NO: 6743776 - DNA, 18 bp, Homo sapiens
tgcagagaggttgtgaaa

SEQ ID NO: 6743777 - DNA, 19 bp, Homo sapiens
tgcagagatgcggtggcta

SEQ ID NO: 6743778 - DNA, 18 bp, Homo sapiens
tgcagagatgtgccccca

SEQ ID NO: 6743779 - DNA, 13 bp, Homo sapiens
tgcagagatttct

SEQ ID NO: 6743780 - DNA, 12 bp, Homo sapiens
tgcagagcacaa

SEQ ID NO: 6743781 - DNA, 23 bp, Homo sapiens
tgcagagcacctttgcacaggat

SEQ ID NO: 6743782 - DNA, 18 bp, Homo sapiens
tgcagagcagcagcacct

SEQ ID NO: 6743783 - DNA, 21 bp, Homo sapiens
tgcagagcaggaaacatgact

SEQ ID NO: 6743784 - DNA, 12 bp, Homo sapiens
tgcagagcccgg

SEQ ID NO: 6743785 - DNA, 10 bp, Homo sapiens
tgcagagcct

SEQ ID NO: 6743786 - DNA, 17 bp, Homo sapiens
tgcagagccttctcaga

SEQ ID NO: 6743787 - DNA, 19 bp, Homo sapiens
tgcagagccttttacccct

SEQ ID NO: 6743788 - DNA, 20 bp, Homo sapiens
tgcagagctaggttgtccta

SEQ ID NO: 6743789 - DNA, 11 bp, Homo sapiens
tgcagagctgc

SEQ ID NO: 6743790 - DNA, 12 bp, Homo sapiens
tgcagagctgca

SEQ ID NO: 6743791 - DNA, 22 bp, Homo sapiens
tgcagagctggggctgccagcc

SEQ ID NO: 6743792 - DNA, 10 bp, Homo sapiens
tgcagagctt

SEQ ID NO: 6743793 - DNA, 17 bp, Homo sapiens
tgcagaggagccacctg

SEQ ID NO: 6743794 - DNA, 16 bp, Homo sapiens
tgcagaggagcccagt

SEQ ID NO: 6743795 - DNA, 21 bp, Homo sapiens
tgcagaggaggagaaaagtga

SEQ ID NO: 6743796 - DNA, 14 bp, Homo sapiens
tgcagaggaggtga

SEQ ID NO: 6743797 - DNA, 14 bp, Homo sapiens
tgcagaggcagcag

SEQ ID NO: 6743798 - DNA, 16 bp, Homo sapiens
tgcagaggcagcagga

SEQ ID NO: 6743799 - DNA, 14 bp, Homo sapiens
tgcagaggccagag

SEQ ID NO: 6743800 - DNA, 19 bp, Homo sapiens
tgcagaggctatgggaaga

SEQ ID NO: 6743801 - DNA, 14 bp, Homo sapiens
tgcagaggctgtgg

SEQ ID NO: 6743802 - DNA, 15 bp, Homo sapiens
tgcagaggctgtggc

SEQ ID NO: 6743803 - DNA, 16 bp, Homo sapiens
tgcagaggggaaagac

SEQ ID NO: 6743804 - DNA, 18 bp, Homo sapiens
tgcagaggggaaagactt

SEQ ID NO: 6743805 - DNA, 17 bp, Homo sapiens
tgcagaggggcaggccc

SEQ ID NO: 6743806 - DNA, 18 bp, Homo sapiens
tgcagaggggcaggccct

SEQ ID NO: 6743807 - DNA, 22 bp, Homo sapiens
tgcagaggggcaggccctgcac

SEQ ID NO: 6743808 - DNA, 20 bp, Homo sapiens
tgcagaggggctttctggag

SEQ ID NO: 6743809 - DNA, 14 bp, Homo sapiens
tgcagaggtctcca

SEQ ID NO: 6743810 - DNA, 14 bp, Homo sapiens
tgcagaggtctgtg

SEQ ID NO: 6743811 - DNA, 16 bp, Homo sapiens
tgcagaggtctgtgct

SEQ ID NO: 6743812 - DNA, 19 bp, Homo sapiens
tgcagaggtctgtgctgag

SEQ ID NO: 6743813 - DNA, 21 bp, Homo sapiens
tgcagaggtctgtgctgaggc

SEQ ID NO: 6743814 - DNA, 23 bp, Homo sapiens
tgcagagtaaatcccacgacata

SEQ ID NO: 6743815 - DNA, 23 bp, Homo sapiens
tgcagagtaaattgctctgttcc

SEQ ID NO: 6743816 - DNA, 11 bp, Homo sapiens
tgcagagtaag

SEQ ID NO: 6743817 - DNA, 19 bp, Homo sapiens
tgcagagtatacaagtgtt

SEQ ID NO: 6743818 - DNA, 19 bp, Homo sapiens
tgcagagtatttctaaagt

SEQ ID NO: 6743819 - DNA, 14 bp, Homo sapiens
tgcagagtccattt

SEQ ID NO: 6743820 - DNA, 20 bp, Homo sapiens
tgcagagtccatttcccaca

SEQ ID NO: 6743821 - DNA, 18 bp, Homo sapiens
tgcagagtgaccagcaca

SEQ ID NO: 6743822 - DNA, 18 bp, Homo sapiens
tgcagagtgcccagaact

SEQ ID NO: 6743823 - DNA, 20 bp, Homo sapiens
tgcagagtggaaactcagcc

SEQ ID NO: 6743824 - DNA, 21 bp, Homo sapiens
tgcagagtggaaactcagccg

SEQ ID NO: 6743825 - DNA, 15 bp, Homo sapiens
tgcagagttcagact

SEQ ID NO: 6743826 - DNA, 17 bp, Homo sapiens
tgcagagttcagacttc

SEQ ID NO: 6743827 - DNA, 16 bp, Homo sapiens
tgcagagttcatggaa

SEQ ID NO: 6743828 - DNA, 16 bp, Homo sapiens
tgcagagttgtgcatg

SEQ ID NO: 6743829 - DNA, 20 bp, Homo sapiens
tgcagagtttccaaaaccag

SEQ ID NO: 6743830 - DNA, 15 bp, Homo sapiens
tgcagataaaatatt

SEQ ID NO: 6743831 - DNA, 22 bp, Homo sapiens
tgcagataaacagaaatgctct

SEQ ID NO: 6743832 - DNA, 17 bp, Homo sapiens
tgcagataaacagtagt

SEQ ID NO: 6743833 - DNA, 19 bp, Homo sapiens
tgcagataaacagtagtga

SEQ ID NO: 6743834 - DNA, 22 bp, Homo sapiens
tgcagataaatacatttatatt

SEQ ID NO: 6743835 - DNA, 19 bp, Homo sapiens
tgcagatactactgaccag

SEQ ID NO: 6743836 - DNA, 16 bp, Homo sapiens
tgcagatagaaagcat

SEQ ID NO: 6743837 - DNA, 23 bp, Homo sapiens
tgcagatagaatttggcccagag

SEQ ID NO: 6743838 - DNA, 14 bp, Homo sapiens
tgcagatagcccag

SEQ ID NO: 6743839 - DNA, 15 bp, Homo sapiens
tgcagatagcccagg

SEQ ID NO: 6743840 - DNA, 22 bp, Homo sapiens
tgcagatattctctagtcattt

SEQ ID NO: 6743841 - DNA, 14 bp, Homo sapiens
tgcagatctagcca

SEQ ID NO: 6743842 - DNA, 15 bp, Homo sapiens
tgcagatctagccag

SEQ ID NO: 6743843 - DNA, 18 bp, Homo sapiens
tgcagatctagccaggcc

SEQ ID NO: 6743844 - DNA, 19 bp, Homo sapiens
tgcagatctagccaggcct

SEQ ID NO: 6743845 - DNA, 19 bp, Homo sapiens
tgcagatgaaatgttctgt

SEQ ID NO: 6743846 - DNA, 20 bp, Homo sapiens
tgcagatgagcagtcacact

SEQ ID NO: 6743847 - DNA, 15 bp, Homo sapiens
tgcagatgcaattgt

SEQ ID NO: 6743848 - DNA, 17 bp, Homo sapiens
tgcagatgccaccctag

SEQ ID NO: 6743849 - DNA, 16 bp, Homo sapiens
tgcagatgccagagca

SEQ ID NO: 6743850 - DNA, 16 bp, Homo sapiens
tgcagatgctttgccc

SEQ ID NO: 6743851 - DNA, 17 bp, Homo sapiens
tgcagatgctttgccca

SEQ ID NO: 6743852 - DNA, 18 bp, Homo sapiens
tgcagatggggctcccgc

SEQ ID NO: 6743853 - DNA, 20 bp, Homo sapiens
tgcagatggtactgctgagg

SEQ ID NO: 6743854 - DNA, 16 bp, Homo sapiens
tgcagatgttcaaata

SEQ ID NO: 6743855 - DNA, 22 bp, Homo sapiens
tgcagattattttagtctgtca

SEQ ID NO: 6743856 - DNA, 16 bp, Homo sapiens
tgcagattcctgggcc

SEQ ID NO: 6743857 - DNA, 18 bp, Homo sapiens
tgcagattcctgggcctg

SEQ ID NO: 6743858 - DNA, 16 bp, Homo sapiens
tgcagattctatttcc

SEQ ID NO: 6743859 - DNA, 18 bp, Homo sapiens
tgcagattctgagcaaag

SEQ ID NO: 6743860 - DNA, 22 bp, Homo sapiens
tgcagattgcagttctgattca

SEQ ID NO: 6743861 - DNA, 18 bp, Homo sapiens
tgcagatttatttagtga

SEQ ID NO: 6743862 - DNA, 18 bp, Homo sapiens
tgcagatttcctgtgtgg

SEQ ID NO: 6743863 - DNA, 15 bp, Homo sapiens
tgcagattttcttaa

SEQ ID NO: 6743864 - DNA, 16 bp, Homo sapiens
tgcagcaaaataataa

SEQ ID NO: 6743865 - DNA, 18 bp, Homo sapiens
tgcagcaaaataataaaa

SEQ ID NO: 6743866 - DNA, 14 bp, Homo sapiens
tgcagcaactccca

SEQ ID NO: 6743867 - DNA, 15 bp, Homo sapiens
tgcagcaactcccac

SEQ ID NO: 6743868 - DNA, 19 bp, Homo sapiens
tgcagcaactcccacgact

SEQ ID NO: 6743869 - DNA, 14 bp, Homo sapiens
tgcagcaagcctgg

SEQ ID NO: 6743870 - DNA, 20 bp, Homo sapiens
tgcagcaaggccctgctgcc

SEQ ID NO: 6743871 - DNA, 16 bp, Homo sapiens
tgcagcaataaagcag

SEQ ID NO: 6743872 - DNA, 18 bp, Homo sapiens
tgcagcaattaaaaattg

SEQ ID NO: 6743873 - DNA, 14 bp, Homo sapiens
tgcagcaattactc

SEQ ID NO: 6743874 - DNA, 12 bp, Homo sapiens
tgcagcacagga

SEQ ID NO: 6743875 - DNA, 23 bp, Homo sapiens
tgcagcacatgcgggctcgccca

SEQ ID NO: 6743876 - DNA, 22 bp, Homo sapiens
tgcagcacattgccctgagggg

SEQ ID NO: 6743877 - DNA, 22 bp, Homo sapiens
tgcagcaccactagcttgtgct

SEQ ID NO: 6743878 - DNA, 17 bp, Homo sapiens
tgcagcacctcacctga

SEQ ID NO: 6743879 - DNA, 12 bp, Homo sapiens
tgcagcacctcc

SEQ ID NO: 6743880 - DNA, 16 bp, Homo sapiens
tgcagcacctccaggc

SEQ ID NO: 6743881 - DNA, 18 bp, Homo sapiens
tgcagcacctccaggcct

SEQ ID NO: 6743882 - DNA, 13 bp, Homo sapiens
tgcagcacctgtc

SEQ ID NO: 6743883 - DNA, 16 bp, Homo sapiens
tgcagcacggacaata

SEQ ID NO: 6743884 - DNA, 18 bp, Homo sapiens
tgcagcacggacaataaa

SEQ ID NO: 6743885 - DNA, 20 bp, Homo sapiens
tgcagcacggacaataaacc

SEQ ID NO: 6743886 - DNA, 15 bp, Homo sapiens
tgcagcacgtctcag

SEQ ID NO: 6743887 - DNA, 18 bp, Homo sapiens
tgcagcacgtctcagaga

SEQ ID NO: 6743888 - DNA, 17 bp, Homo sapiens
tgcagcactgctgcctc

SEQ ID NO: 6743889 - DNA, 18 bp, Homo sapiens
tgcagcactgctgcctca

SEQ ID NO: 6743890 - DNA, 21 bp, Homo sapiens
tgcagcactgctgcctcagct

SEQ ID NO: 6743891 - DNA, 22 bp, Homo sapiens
tgcagcactgctgcctcagctc

SEQ ID NO: 6743892 - DNA, 22 bp, Homo sapiens
tgcagcactttaaccctctctt

SEQ ID NO: 6743893 - DNA, 15 bp, Homo sapiens
tgcagcagaagccaa

SEQ ID NO: 6743894 - DNA, 16 bp, Homo sapiens
tgcagcagaagccaaa

SEQ ID NO: 6743895 - DNA, 13 bp, Homo sapiens
tgcagcagagcct

SEQ ID NO: 6743896 - DNA, 13 bp, Homo sapiens
tgcagcagaggac

SEQ ID NO: 6743897 - DNA, 23 bp, Homo sapiens
tgcagcagaggacagtctggaga

SEQ ID NO: 6743898 - DNA, 16 bp, Homo sapiens
tgcagcagaggagctg

SEQ ID NO: 6743899 - DNA, 13 bp, Homo sapiens
tgcagcagaggca

SEQ ID NO: 6743900 - DNA, 22 bp, Homo sapiens
tgcagcagaggcctgaggagtg

SEQ ID NO: 6743901 - DNA, 14 bp, Homo sapiens
tgcagcagataact

SEQ ID NO: 6743902 - DNA, 16 bp, Homo sapiens
tgcagcagataacttt

SEQ ID NO: 6743903 - DNA, 11 bp, Homo sapiens
tgcagcagccc

SEQ ID NO: 6743904 - DNA, 15 bp, Homo sapiens
tgcagcagcccagct

SEQ ID NO: 6743905 - DNA, 19 bp, Homo sapiens
tgcagcagcccagcttcct

SEQ ID NO: 6743906 - DNA, 20 bp, Homo sapiens
tgcagcagcggtggcctctt

SEQ ID NO: 6743907 - DNA, 23 bp, Homo sapiens
tgcagcaggagtggtgcagacag

SEQ ID NO: 6743908 - DNA, 19 bp, Homo sapiens
tgcagttcatactgaatga

SEQ ID NO: 6743909 - DNA, 16 bp, Homo sapiens
tgcagttcattatttt

SEQ ID NO: 6743910 - DNA, 21 bp, Homo sapiens
tgcagttcccacattaaagaa

SEQ ID NO: 6743911 - DNA, 17 bp, Homo sapiens
tgcagttctactcaggc

SEQ ID NO: 6743912 - DNA, 19 bp, Homo sapiens
tgcagttctagtttgcatt

SEQ ID NO: 6743913 - DNA, 20 bp, Homo sapiens
tgcagttctagtttgcattc

SEQ ID NO: 6743914 - DNA, 14 bp, Homo sapiens
tgcagttctgaaga

SEQ ID NO: 6743915 - DNA, 22 bp, Homo sapiens
tgcagttctgaagaagatggta

SEQ ID NO: 6743916 - DNA, 13 bp, Homo sapiens
tgcagttcttgag

SEQ ID NO: 6743917 - DNA, 16 bp, Homo sapiens
tgcagttcttgagttg

SEQ ID NO: 6743918 - DNA, 12 bp, Homo sapiens
tgcagttcttgt

SEQ ID NO: 6743919 - DNA, 21 bp, Homo sapiens
tgcagttcttgtggaagacac

SEQ ID NO: 6743920 - DNA, 16 bp, Homo sapiens
tgcagttgacagcagg

SEQ ID NO: 6743921 - DNA, 14 bp, Homo sapiens
tgcagttgccagtc

SEQ ID NO: 6743922 - DNA, 16 bp, Homo sapiens
tgcagttgccagtcac

SEQ ID NO: 6743923 - DNA, 19 bp, Homo sapiens
tgcagttggactctcaggg

SEQ ID NO: 6743924 - DNA, 18 bp, Homo sapiens
tgcagttggcctcagcag

SEQ ID NO: 6743925 - DNA, 14 bp, Homo sapiens
tgcagttgtctctg

SEQ ID NO: 6743926 - DNA, 17 bp, Homo sapiens
tgcagttgtgatataaa

SEQ ID NO: 6743927 - DNA, 16 bp, Homo sapiens
tgcagtttacagtatt

SEQ ID NO: 6743928 - DNA, 19 bp, Homo sapiens
tgcagtttacagtatttct

SEQ ID NO: 6743929 - DNA, 16 bp, Homo sapiens
tgcagtttatcattca

SEQ ID NO: 6743930 - DNA, 13 bp, Homo sapiens
tgcagtttcctgg

SEQ ID NO: 6743931 - DNA, 16 bp, Homo sapiens
tgcagtttcttgtgta

SEQ ID NO: 6743932 - DNA, 16 bp, Homo sapiens
tgcagtttcttttcac

SEQ ID NO: 6743933 - DNA, 13 bp, Homo sapiens
tgcagtttgaaat

SEQ ID NO: 6743934 - DNA, 14 bp, Homo sapiens
tgcagtttgaaatt

SEQ ID NO: 6743935 - DNA, 15 bp, Homo sapiens
tgcagtttgaaattc

SEQ ID NO: 6743936 - DNA, 16 bp, Homo sapiens
tgcagtttgaaattct

SEQ ID NO: 6743937 - DNA, 18 bp, Homo sapiens
tgcagtttgaaattctga

SEQ ID NO: 6743938 - DNA, 19 bp, Homo sapiens
tgcagtttgaaattctgaa

SEQ ID NO: 6743939 - DNA, 23 bp, Homo sapiens
tgcagtttgaaattctgaatttg

SEQ ID NO: 6743940 - DNA, 22 bp, Homo sapiens
tgcagtttggccctggagccag

SEQ ID NO: 6743941 - DNA, 23 bp, Homo sapiens
tgcagtttggccctggagccagg

SEQ ID NO: 6743942 - DNA, 14 bp, Homo sapiens
tgcagtttgtgaac

SEQ ID NO: 6743943 - DNA, 14 bp, Homo sapiens
tgcagttttaagaa

SEQ ID NO: 6743944 - DNA, 13 bp, Homo sapiens
tgcagttttgtaa

SEQ ID NO: 6743945 - DNA, 14 bp, Homo sapiens
tgcagttttgtaag

SEQ ID NO: 6743946 - DNA, 21 bp, Homo sapiens
tgcagttttgtttggtttact

SEQ ID NO: 6743947 - DNA, 15 bp, Homo sapiens
tgcagtttttataat

SEQ ID NO: 6743948 - DNA, 16 bp, Homo sapiens
tgcagtttttcagagt

SEQ ID NO: 6743949 - DNA, 14 bp, Homo sapiens
tgcagtttttcagg

SEQ ID NO: 6743950 - DNA, 20 bp, Homo sapiens
tgcagttttttggaagaaaa

SEQ ID NO: 6743951 - DNA, 18 bp, Homo sapiens
tgcataaaaaaatgatgc

SEQ ID NO: 6743952 - DNA, 11 bp, Homo sapiens
tgcataaaaac

SEQ ID NO: 6743953 - DNA, 15 bp, Homo sapiens
tgcataaaaattaaa

SEQ ID NO: 6743954 - DNA, 16 bp, Homo sapiens
tgcataaaattctaga

SEQ ID NO: 6743955 - DNA, 23 bp, Homo sapiens
tgcataaacaatccaaatgcatt

SEQ ID NO: 6743956 - DNA, 18 bp, Homo sapiens
tgcataaataattttgtt

SEQ ID NO: 6743957 - DNA, 22 bp, Homo sapiens
tgcataaataattttgttttaa

SEQ ID NO: 6743958 - DNA, 23 bp, Homo sapiens
tgcataaatttgtaatatatcct

SEQ ID NO: 6743959 - DNA, 17 bp, Homo sapiens
tgcataacaattcctct

SEQ ID NO: 6743960 - DNA, 19 bp, Homo sapiens
tgcataacctttacactcc

SEQ ID NO: 6743961 - DNA, 15 bp, Homo sapiens
tgcataactgacaaa

SEQ ID NO: 6743962 - DNA, 23 bp, Homo sapiens
tgcataagattaaaggaaggaaa

SEQ ID NO: 6743963 - DNA, 13 bp, Homo sapiens
tgcataagattat

SEQ ID NO: 6743964 - DNA, 15 bp, Homo sapiens
tgcataagcctcagg

SEQ ID NO: 6743965 - DNA, 16 bp, Homo sapiens
tgcataagcctcaggc

SEQ ID NO: 6743966 - DNA, 22 bp, Homo sapiens
tgcataagctttttaatgctgt

SEQ ID NO: 6743967 - DNA, 14 bp, Homo sapiens
tgcataagttaact

SEQ ID NO: 6743968 - DNA, 13 bp, Homo sapiens
tgcataataagca

SEQ ID NO: 6743969 - DNA, 11 bp, Homo sapiens
tgcataataat

SEQ ID NO: 6743970 - DNA, 17 bp, Homo sapiens
tgcataatgataaaata

SEQ ID NO: 6743971 - DNA, 20 bp, Homo sapiens
tgcataatgataaaataaat

SEQ ID NO: 6743972 - DNA, 13 bp, Homo sapiens
tgcataatgcaat

SEQ ID NO: 6743973 - DNA, 15 bp, Homo sapiens
tgcataatgcaatca

SEQ ID NO: 6743974 - DNA, 13 bp, Homo sapiens
tgcataatgcttt

SEQ ID NO: 6743975 - DNA, 20 bp, Homo sapiens
tgcataatgctttggaaaaa

SEQ ID NO: 6743976 - DNA, 19 bp, Homo sapiens
tgcataatgtccctctctt

SEQ ID NO: 6743977 - DNA, 23 bp, Homo sapiens
tgcataatgtccctctcttggct

SEQ ID NO: 6743978 - DNA, 17 bp, Homo sapiens
tgcataatgtttctgga

SEQ ID NO: 6743979 - DNA, 23 bp, Homo sapiens
tgcataattctgaagttatattt

SEQ ID NO: 6743980 - DNA, 15 bp, Homo sapiens
tgcataatttatggt

SEQ ID NO: 6743981 - DNA, 20 bp, Homo sapiens
tgcatacaaacaagcatata

SEQ ID NO: 6743982 - DNA, 22 bp, Homo sapiens
tgcatacaaacaagcatataaa

SEQ ID NO: 6743983 - DNA, 17 bp, Homo sapiens
tgcatacaataaaagag

SEQ ID NO: 6743984 - DNA, 19 bp, Homo sapiens
tgcatacaataaaagagct

SEQ ID NO: 6743985 - DNA, 13 bp, Homo sapiens
tgcatacacacac

SEQ ID NO: 6743986 - DNA, 22 bp, Homo sapiens
tgcatacacacacacacacagc

SEQ ID NO: 6743987 - DNA, 21 bp, Homo sapiens
tgcatacagttttctagcaat

SEQ ID NO: 6743988 - DNA, 16 bp, Homo sapiens
tgcataccacaagaca

SEQ ID NO: 6743989 - DNA, 12 bp, Homo sapiens
tgcataccactt

SEQ ID NO: 6743990 - DNA, 16 bp, Homo sapiens
tgcataccacttttgt

SEQ ID NO: 6743991 - DNA, 22 bp, Homo sapiens
tgcataccacttttgttcttgg

SEQ ID NO: 6743992 - DNA, 23 bp, Homo sapiens
tgcataccaggggttccccagga

SEQ ID NO: 6743993 - DNA, 15 bp, Homo sapiens
tgcatacgtaaaaat

SEQ ID NO: 6743994 - DNA, 22 bp, Homo sapiens
tgcatacgtattgttaaatgat

SEQ ID NO: 6743995 - DNA, 18 bp, Homo sapiens
tgcatactaacctatttt

SEQ ID NO: 6743996 - DNA, 17 bp, Homo sapiens
tgcatactattaaacat

SEQ ID NO: 6743997 - DNA, 16 bp, Homo sapiens
tgcatactcaaggtga

SEQ ID NO: 6743998 - DNA, 13 bp, Homo sapiens
tgcatactgaaaa

SEQ ID NO: 6743999 - DNA, 17 bp, Homo sapiens
tgcatactgaaaatcca

SEQ ID NO: 6744000 - DNA, 20 bp, Homo sapiens
tgcatactggactcttcaaa

SEQ ID NO: 6744001 - DNA, 20 bp, Homo sapiens
tgcatacttacctagtgaaa

SEQ ID NO: 6744002 - DNA, 15 bp, Homo sapiens
tgcatacttcaaaag

SEQ ID NO: 6744003 - DNA, 18 bp, Homo sapiens
tgcatacttcctggattt

SEQ ID NO: 6744004 - DNA, 21 bp, Homo sapiens
tgcatacttcctggattttct

SEQ ID NO: 6744005 - DNA, 14 bp, Homo sapiens
tgcatactttattg

SEQ ID NO: 6744006 - DNA, 13 bp, Homo sapiens
tgcatactttgta

SEQ ID NO: 6744007 - DNA, 18 bp, Homo sapiens
tgcatagaacaaaagatt

SEQ ID NO: 6744008 - DNA, 16 bp, Homo sapiens
tgcatagaactgggta

SEQ ID NO: 6744009 - DNA, 18 bp, Homo sapiens
tgcatagaaggaggagag

SEQ ID NO: 6744010 - DNA, 13 bp, Homo sapiens
tgcatagacaaag

SEQ ID NO: 6744011 - DNA, 16 bp, Homo sapiens
tgcatagacaagtgtt

SEQ ID NO: 6744012 - DNA, 14 bp, Homo sapiens
tgcatagagcaatt

SEQ ID NO: 6744013 - DNA, 19 bp, Homo sapiens
tgcatagagccacgtatgt

SEQ ID NO: 6744014 - DNA, 17 bp, Homo sapiens
tgcatagagccctggcc

SEQ ID NO: 6744015 - DNA, 22 bp, Homo sapiens
tgcatagagccctggccagccc

SEQ ID NO: 6744016 - DNA, 16 bp, Homo sapiens
tgcatagcgtcctgcc

SEQ ID NO: 6744017 - DNA, 20 bp, Homo sapiens
tgcatagcgtcctgccctgc

SEQ ID NO: 6744018 - DNA, 18 bp, Homo sapiens
tgcataggaatttagaac

SEQ ID NO: 6744019 - DNA, 20 bp, Homo sapiens
tgcataggagtttggaggaa

SEQ ID NO: 6744020 - DNA, 18 bp, Homo sapiens
tgcataggctccttcctg

SEQ ID NO: 6744021 - DNA, 20 bp, Homo sapiens
tgcataggtgatctcattta

SEQ ID NO: 6744022 - DNA, 20 bp, Homo sapiens
tgcatagtaccaatcatttt

SEQ ID NO: 6744023 - DNA, 19 bp, Homo sapiens
tgcatagtgctaagaaagc

SEQ ID NO: 6744024 - DNA, 14 bp, Homo sapiens
tgcatagtgctggg

SEQ ID NO: 6744025 - DNA, 19 bp, Homo sapiens
tgcatagttcccatgttaa

SEQ ID NO: 6744026 - DNA, 15 bp, Homo sapiens
tgcatagtttcttta

SEQ ID NO: 6744027 - DNA, 18 bp, Homo sapiens
tgcatagtttctttattt

SEQ ID NO: 6744028 - DNA, 23 bp, Homo sapiens
tgcatagtttctttattttgtgt

SEQ ID NO: 6744029 - DNA, 20 bp, Homo sapiens
tgcatataacttatattgta

SEQ ID NO: 6744030 - DNA, 15 bp, Homo sapiens
tgcatatagaaaaca

SEQ ID NO: 6744031 - DNA, 23 bp, Homo sapiens
tgcatatagatttagttttgtaa

SEQ ID NO: 6744032 - DNA, 18 bp, Homo sapiens
tgcatatagttaaactga

SEQ ID NO: 6744033 - DNA, 20 bp, Homo sapiens
tgcatatagttaaactgaga

SEQ ID NO: 6744034 - DNA, 17 bp, Homo sapiens
tgcatatatacatatat

SEQ ID NO: 6744035 - DNA, 15 bp, Homo sapiens
tgcatatatatatgt

SEQ ID NO: 6744036 - DNA, 14 bp, Homo sapiens
tgcatatatatgta

SEQ ID NO: 6744037 - DNA, 15 bp, Homo sapiens
tgcatatatgttctt

SEQ ID NO: 6744038 - DNA, 19 bp, Homo sapiens
tgcatatcacccttccctg

SEQ ID NO: 6744039 - DNA, 13 bp, Homo sapiens
tgcatatcctgag

SEQ ID NO: 6744040 - DNA, 16 bp, Homo sapiens
tgcatatcctgagcca

SEQ ID NO: 6744041 - DNA, 17 bp, Homo sapiens
tgcatatcctgagccat

SEQ ID NO: 6744042 - DNA, 20 bp, Homo sapiens
tgcatatcctggtgtctagt

SEQ ID NO: 6744043 - DNA, 17 bp, Homo sapiens
tgcatatcggaggtggt

SEQ ID NO: 6744044 - DNA, 20 bp, Homo sapiens
tgcatatcggaggtggtgga

SEQ ID NO: 6744045 - DNA, 23 bp, Homo sapiens
tgcatatcggaggtggtggagga

SEQ ID NO: 6744046 - DNA, 16 bp, Homo sapiens
tgcatatctgcctccc

SEQ ID NO: 6744047 - DNA, 15 bp, Homo sapiens
tgcatatgaaatcct

SEQ ID NO: 6744048 - DNA, 15 bp, Homo sapiens
tgcatatgcttctga

SEQ ID NO: 6744049 - DNA, 13 bp, Homo sapiens
tgcatatgtttcg

SEQ ID NO: 6744050 - DNA, 14 bp, Homo sapiens
tgcatattaaagaa

SEQ ID NO: 6744051 - DNA, 22 bp, Homo sapiens
tgcatattactgtacatgggac

SEQ ID NO: 6744052 - DNA, 16 bp, Homo sapiens
tgcatattataaagga

SEQ ID NO: 6744053 - DNA, 15 bp, Homo sapiens
tgcatattcaacaca

SEQ ID NO: 6744054 - DNA, 13 bp, Homo sapiens
tgcatattccttt

SEQ ID NO: 6744055 - DNA, 13 bp, Homo sapiens
tgcatattctatt

SEQ ID NO: 6744056 - DNA, 18 bp, Homo sapiens
tgcatattctattgtatt

SEQ ID NO: 6744057 - DNA, 13 bp, Homo sapiens
tgcatattgtaca

SEQ ID NO: 6744058 - DNA, 14 bp, Homo sapiens
tgcatattgtacac

SEQ ID NO: 6744059 - DNA, 17 bp, Homo sapiens
tgcatattgtacacttt

SEQ ID NO: 6744060 - DNA, 15 bp, Homo sapiens
tgcatatttatccaa

SEQ ID NO: 6744061 - DNA, 18 bp, Homo sapiens
tgcatatttattgcattg

SEQ ID NO: 6744062 - DNA, 13 bp, Homo sapiens
tgcatatttattt

SEQ ID NO: 6744063 - DNA, 14 bp, Homo sapiens
tgcatatttctgta

SEQ ID NO: 6744064 - DNA, 18 bp, Homo sapiens
tgcatatttctgtatatt

SEQ ID NO: 6744065 - DNA, 21 bp, Homo sapiens
tgcatatttctgtatatttgt

SEQ ID NO: 6744066 - DNA, 23 bp, Homo sapiens
tgcatatttgccacaaaacctgt

SEQ ID NO: 6744067 - DNA, 18 bp, Homo sapiens
tgcatatttgttacttta

SEQ ID NO: 6744068 - DNA, 15 bp, Homo sapiens
tgcatattttgagaa

SEQ ID NO: 6744069 - DNA, 16 bp, Homo sapiens
tgcatattttgagaaa

SEQ ID NO: 6744070 - DNA, 15 bp, Homo sapiens
tgcatattttgttat

SEQ ID NO: 6744071 - DNA, 19 bp, Homo sapiens
tgcatatttttctaaagaa

SEQ ID NO: 6744072 - DNA, 15 bp, Homo sapiens
tgcatatttttgcac

SEQ ID NO: 6744073 - DNA, 13 bp, Homo sapiens
tgcatcaaaggag

SEQ ID NO: 6744074 - DNA, 17 bp, Homo sapiens
tgcatcaaatgcatgcg

SEQ ID NO: 6744075 - DNA, 14 bp, Homo sapiens
tgcatcaagatgtg

SEQ ID NO: 6744076 - DNA, 19 bp, Homo sapiens
tgcatcaagatgtgacatg

SEQ ID NO: 6744077 - DNA, 18 bp, Homo sapiens
tgcatcaagtctccacgt

SEQ ID NO: 6744078 - DNA, 15 bp, Homo sapiens
tgcatcaatcctgtg

SEQ ID NO: 6744079 - DNA, 19 bp, Homo sapiens
tgcatcacactcaaggaca

SEQ ID NO: 6744080 - DNA, 16 bp, Homo sapiens
tgcatcacatctgcac

SEQ ID NO: 6744081 - DNA, 22 bp, Homo sapiens
tgcatcacatctgcacactctc

SEQ ID NO: 6744082 - DNA, 16 bp, Homo sapiens
tgcatcacgtgtctta

SEQ ID NO: 6744083 - DNA, 12 bp, Homo sapiens
tgcatcactggg

SEQ ID NO: 6744084 - DNA, 13 bp, Homo sapiens
tgcatcactgggt

SEQ ID NO: 6744085 - DNA, 13 bp, Homo sapiens
tgcatcagaaagc

SEQ ID NO: 6744086 - DNA, 18 bp, Homo sapiens
tgcatcagaaagggaggg

SEQ ID NO: 6744087 - DNA, 17 bp, Homo sapiens
tgccaactgttggaatt

SEQ ID NO: 6744088 - DNA, 13 bp, Homo sapiens
tgccaacttccca

SEQ ID NO: 6744089 - DNA, 18 bp, Homo sapiens
tgccaacttcccctctaa

SEQ ID NO: 6744090 - DNA, 13 bp, Homo sapiens
tgccaacttgtga

SEQ ID NO: 6744091 - DNA, 21 bp, Homo sapiens
tgccaagaaaagggctgacat

SEQ ID NO: 6744092 - DNA, 16 bp, Homo sapiens
tgccaagaaaatgaag

SEQ ID NO: 6744093 - DNA, 19 bp, Homo sapiens
tgccaagaaatcgccttat

SEQ ID NO: 6744094 - DNA, 16 bp, Homo sapiens
tgccaagaactgaaaa

SEQ ID NO: 6744095 - DNA, 17 bp, Homo sapiens
tgccaagaactgaaaac

SEQ ID NO: 6744096 - DNA, 14 bp, Homo sapiens
tgccaagacatgat

SEQ ID NO: 6744097 - DNA, 15 bp, Homo sapiens
tgccaagacattaat

SEQ ID NO: 6744098 - DNA, 19 bp, Homo sapiens
tgccaagacattaattttt

SEQ ID NO: 6744099 - DNA, 14 bp, Homo sapiens
tgccaagactctat

SEQ ID NO: 6744100 - DNA, 21 bp, Homo sapiens
tgccaagactctatgctctgg

SEQ ID NO: 6744101 - DNA, 14 bp, Homo sapiens
tgccaagactgctg

SEQ ID NO: 6744102 - DNA, 22 bp, Homo sapiens
tgccaagactgctgtggccagg

SEQ ID NO: 6744103 - DNA, 23 bp, Homo sapiens
tgccaagactgctgtggccagga

SEQ ID NO: 6744104 - DNA, 23 bp, Homo sapiens
tgccaagagagatgtatgtgtca

SEQ ID NO: 6744105 - DNA, 12 bp, Homo sapiens
tgccaagagagg

SEQ ID NO: 6744106 - DNA, 19 bp, Homo sapiens
tgccaagagcccgtctgct

SEQ ID NO: 6744107 - DNA, 23 bp, Homo sapiens
tgccaagagcccgtctgctcctg

SEQ ID NO: 6744108 - DNA, 12 bp, Homo sapiens
tgccaagagcta

SEQ ID NO: 6744109 - DNA, 21 bp, Homo sapiens
tgccaagagctactcccacag

SEQ ID NO: 6744110 - DNA, 22 bp, Homo sapiens
tgccaagagctactcccacagc

SEQ ID NO: 6744111 - DNA, 16 bp, Homo sapiens
tgccaagagtccaagc

SEQ ID NO: 6744112 - DNA, 20 bp, Homo sapiens
tgccaagcaaggaaaactta

SEQ ID NO: 6744113 - DNA, 14 bp, Homo sapiens
tgccaagcagcaga

SEQ ID NO: 6744114 - DNA, 14 bp, Homo sapiens
tgccaagcaggcct

SEQ ID NO: 6744115 - DNA, 18 bp, Homo sapiens
tgccaagccccatcctgc

SEQ ID NO: 6744116 - DNA, 22 bp, Homo sapiens
tgccaagcccctgccctgggga

SEQ ID NO: 6744117 - DNA, 23 bp, Homo sapiens
tgccaagcccctgccctggggag

SEQ ID NO: 6744118 - DNA, 15 bp, Homo sapiens
tgccaagccctggcc

SEQ ID NO: 6744119 - DNA, 16 bp, Homo sapiens
tgccaagccctttgct

SEQ ID NO: 6744120 - DNA, 20 bp, Homo sapiens
tgccaagccctttgctgttc

SEQ ID NO: 6744121 - DNA, 13 bp, Homo sapiens
tgccaagcctgga

SEQ ID NO: 6744122 - DNA, 14 bp, Homo sapiens
tgccaagcctggag

SEQ ID NO: 6744123 - DNA, 23 bp, Homo sapiens
tgccaagcgagaatgcaggcccc

SEQ ID NO: 6744124 - DNA, 14 bp, Homo sapiens
tgccaagctcagga

SEQ ID NO: 6744125 - DNA, 15 bp, Homo sapiens
tgccaagcttcctgt

SEQ ID NO: 6744126 - DNA, 12 bp, Homo sapiens
tgccaaggagca

SEQ ID NO: 6744127 - DNA, 19 bp, Homo sapiens
tgccaaggaggtcccagga

SEQ ID NO: 6744128 - DNA, 20 bp, Homo sapiens
tgccaaggccagagtggcct

SEQ ID NO: 6744129 - DNA, 20 bp, Homo sapiens
tgccaaggccggagacccac

SEQ ID NO: 6744130 - DNA, 23 bp, Homo sapiens
tgccaaggccggagacccacagc

SEQ ID NO: 6744131 - DNA, 17 bp, Homo sapiens
tgccaagggcataaatt

SEQ ID NO: 6744132 - DNA, 21 bp, Homo sapiens
tgccaagggcataaattattg

SEQ ID NO: 6744133 - DNA, 12 bp, Homo sapiens
tgccaagggccc

SEQ ID NO: 6744134 - DNA, 20 bp, Homo sapiens
tgccaagggccccaggggca

SEQ ID NO: 6744135 - DNA, 23 bp, Homo sapiens
tgccaagggccccaggggcagca

SEQ ID NO: 6744136 - DNA, 21 bp, Homo sapiens
tgccaagggctttgttttgca

SEQ ID NO: 6744137 - DNA, 20 bp, Homo sapiens
tgccaaggtggagggaagga

SEQ ID NO: 6744138 - DNA, 20 bp, Homo sapiens
tgccaaggtgtggcctgcac

SEQ ID NO: 6744139 - DNA, 18 bp, Homo sapiens
tgccaagtaacaatgcat

SEQ ID NO: 6744140 - DNA, 15 bp, Homo sapiens
tgccaagtaagagtg

SEQ ID NO: 6744141 - DNA, 20 bp, Homo sapiens
tgccaagtccaggtcctggt

SEQ ID NO: 6744142 - DNA, 21 bp, Homo sapiens
tgccaagtccaggtcctggtg

SEQ ID NO: 6744143 - DNA, 21 bp, Homo sapiens
tgccaagtcctagctcctcct

SEQ ID NO: 6744144 - DNA, 17 bp, Homo sapiens
tgccaagtcctcctaga

SEQ ID NO: 6744145 - DNA, 17 bp, Homo sapiens
tgccaagtcctgccttt

SEQ ID NO: 6744146 - DNA, 15 bp, Homo sapiens
tgccaagtctcagaa

SEQ ID NO: 6744147 - DNA, 18 bp, Homo sapiens
tgccaagtctcagaagag

SEQ ID NO: 6744148 - DNA, 20 bp, Homo sapiens
tgccaagtctcaggaggagg

SEQ ID NO: 6744149 - DNA, 13 bp, Homo sapiens
tgccaagtgccta

SEQ ID NO: 6744150 - DNA, 14 bp, Homo sapiens
tgccaagtgcctgc

SEQ ID NO: 6744151 - DNA, 14 bp, Homo sapiens
tgccaagtggccct

SEQ ID NO: 6744152 - DNA, 19 bp, Homo sapiens
tgccaagtggggatggggc

SEQ ID NO: 6744153 - DNA, 18 bp, Homo sapiens
tgccaagttagctattgg

SEQ ID NO: 6744154 - DNA, 20 bp, Homo sapiens
tgccaagttgtttgagaaat

SEQ ID NO: 6744155 - DNA, 13 bp, Homo sapiens
tgccaagtttgtt

SEQ ID NO: 6744156 - DNA, 11 bp, Homo sapiens
tgccaataaag

SEQ ID NO: 6744157 - DNA, 12 bp, Homo sapiens
tgccaataaagc

SEQ ID NO: 6744158 - DNA, 22 bp, Homo sapiens
tgccaataaagcttttggaagc

SEQ ID NO: 6744159 - DNA, 16 bp, Homo sapiens
tgccaataaagtgatc

SEQ ID NO: 6744160 - DNA, 14 bp, Homo sapiens
tgccaataaattct

SEQ ID NO: 6744161 - DNA, 22 bp, Homo sapiens
tgccaataataatacctccctt

SEQ ID NO: 6744162 - DNA, 21 bp, Homo sapiens
tgccaatactagtcaccccaa

SEQ ID NO: 6744163 - DNA, 17 bp, Homo sapiens
tgccaatatcctaataa

SEQ ID NO: 6744164 - DNA, 18 bp, Homo sapiens
tgccaatatcctaataaa

SEQ ID NO: 6744165 - DNA, 19 bp, Homo sapiens
tgccaatatcctaataaaa

SEQ ID NO: 6744166 - DNA, 15 bp, Homo sapiens
tgccaatatgtattg

SEQ ID NO: 6744167 - DNA, 16 bp, Homo sapiens
tgccaatatgtattgt

SEQ ID NO: 6744168 - DNA, 21 bp, Homo sapiens
tgccaatcattgcaaacaact

SEQ ID NO: 6744169 - DNA, 13 bp, Homo sapiens
tgccaatctaaaa

SEQ ID NO: 6744170 - DNA, 16 bp, Homo sapiens
tgccaatctaaaatgg

SEQ ID NO: 6744171 - DNA, 17 bp, Homo sapiens
tgccaatctaaaatggc

SEQ ID NO: 6744172 - DNA, 16 bp, Homo sapiens
tgccaatctcaacacc

SEQ ID NO: 6744173 - DNA, 16 bp, Homo sapiens
tgccaatctgtacaaa

SEQ ID NO: 6744174 - DNA, 20 bp, Homo sapiens
tgccaatctgtacaaaatgg

SEQ ID NO: 6744175 - DNA, 18 bp, Homo sapiens
tgccaatcttaaagacaa

SEQ ID NO: 6744176 - DNA, 17 bp, Homo sapiens
tgccaatgctacagtaa

SEQ ID NO: 6744177 - DNA, 22 bp, Homo sapiens
tgccaatgctccagctgtcgtc

SEQ ID NO: 6744178 - DNA, 14 bp, Homo sapiens
tgccaatgggagct

SEQ ID NO: 6744179 - DNA, 22 bp, Homo sapiens
tgccaatggtgtagctgtcctc

SEQ ID NO: 6744180 - DNA, 15 bp, Homo sapiens
tgccaatgtccaggt

SEQ ID NO: 6744181 - DNA, 21 bp, Homo sapiens
tgccaatgtccaggtcacagg

SEQ ID NO: 6744182 - DNA, 23 bp, Homo sapiens
tgccaatgtccaggtcacaggca

SEQ ID NO: 6744183 - DNA, 20 bp, Homo sapiens
tgccaatgtgaaatgtaaat

SEQ ID NO: 6744184 - DNA, 17 bp, Homo sapiens
tgccaatgtgggctgcc

SEQ ID NO: 6744185 - DNA, 22 bp, Homo sapiens
tgccaatgttcctgctaataat

SEQ ID NO: 6744186 - DNA, 17 bp, Homo sapiens
tgccaatgttgtgtgtt

SEQ ID NO: 6744187 - DNA, 22 bp, Homo sapiens
tgccaatgttgtgtgttgcact

SEQ ID NO: 6744188 - DNA, 16 bp, Homo sapiens
tgccaattacggtgta

SEQ ID NO: 6744189 - DNA, 19 bp, Homo sapiens
tgccaattacggtgtacag

SEQ ID NO: 6744190 - DNA, 21 bp, Homo sapiens
tgccaattatagtttgacagg

SEQ ID NO: 6744191 - DNA, 21 bp, Homo sapiens
tgccaattattgttacacatt

SEQ ID NO: 6744192 - DNA, 23 bp, Homo sapiens
tgccaatttcctctccactgctg

SEQ ID NO: 6744193 - DNA, 13 bp, Homo sapiens
tgccaatttgcac

SEQ ID NO: 6744194 - DNA, 15 bp, Homo sapiens
tgccaatttgcacat

SEQ ID NO: 6744195 - DNA, 21 bp, Homo sapiens
tgccaattttgtcacagctct

SEQ ID NO: 6744196 - DNA, 18 bp, Homo sapiens
tgccaatttttgccttca

SEQ ID NO: 6744197 - DNA, 19 bp, Homo sapiens
tgccaatttttgccttcat

SEQ ID NO: 6744198 - DNA, 21 bp, Homo sapiens
tgccacaaaccaccaggactg

SEQ ID NO: 6744199 - DNA, 18 bp, Homo sapiens
tgccacaaattgaaagct

SEQ ID NO: 6744200 - DNA, 15 bp, Homo sapiens
tgccacaagcacaat

SEQ ID NO: 6744201 - DNA, 16 bp, Homo sapiens
tgccacaagcacaatt

SEQ ID NO: 6744202 - DNA, 17 bp, Homo sapiens
tgccacaaggaagaaat

SEQ ID NO: 6744203 - DNA, 18 bp, Homo sapiens
tgccacaaggaagaaatt

SEQ ID NO: 6744204 - DNA, 15 bp, Homo sapiens
tgccacaaggacttc

SEQ ID NO: 6744205 - DNA, 16 bp, Homo sapiens
tgccacaaggacttcc

SEQ ID NO: 6744206 - DNA, 14 bp, Homo sapiens
tgccacaatcacta

SEQ ID NO: 6744207 - DNA, 19 bp, Homo sapiens
tgccacaatgcctctccca

SEQ ID NO: 6744208 - DNA, 15 bp, Homo sapiens
tgccacaatgtgata

SEQ ID NO: 6744209 - DNA, 14 bp, Homo sapiens
tgccacacaaacgt

SEQ ID NO: 6744210 - DNA, 14 bp, Homo sapiens
tgccacacactgtt

SEQ ID NO: 6744211 - DNA, 21 bp, Homo sapiens
tgccacacagtgacttggccc

SEQ ID NO: 6744212 - DNA, 19 bp, Homo sapiens
tgccacacagtgggccggc

SEQ ID NO: 6744213 - DNA, 18 bp, Homo sapiens
tgccacacattgtgcttg

SEQ ID NO: 6744214 - DNA, 20 bp, Homo sapiens
tgccacaccaagctgtgcca

SEQ ID NO: 6744215 - DNA, 21 bp, Homo sapiens
tgccacaccaagctgtgccac

SEQ ID NO: 6744216 - DNA, 19 bp, Homo sapiens
tgccacaccaatcagagag

SEQ ID NO: 6744217 - DNA, 21 bp, Homo sapiens
tgccacaccccccacccctag

SEQ ID NO: 6744218 - DNA, 14 bp, Homo sapiens
tgccacaccctccc

SEQ ID NO: 6744219 - DNA, 16 bp, Homo sapiens
tgccacaccctcccca

SEQ ID NO: 6744220 - DNA, 17 bp, Homo sapiens
tgccacacctggcctta

SEQ ID NO: 6744221 - DNA, 20 bp, Homo sapiens
tgccacacgcatgggcattg

SEQ ID NO: 6744222 - DNA, 16 bp, Homo sapiens
tgccacacgtctgacc

SEQ ID NO: 6744223 - DNA, 16 bp, Homo sapiens
tgccacactgatggct

SEQ ID NO: 6744224 - DNA, 21 bp, Homo sapiens
tgccacactgatggctcaaga

SEQ ID NO: 6744225 - DNA, 22 bp, Homo sapiens
tgccacactgatggctcaagac

SEQ ID NO: 6744226 - DNA, 22 bp, Homo sapiens
tgccacacttcaggctcttctc

SEQ ID NO: 6744227 - DNA, 20 bp, Homo sapiens
tgccacacttcgctcttgag

SEQ ID NO: 6744228 - DNA, 13 bp, Homo sapiens
tgccacactttca

SEQ ID NO: 6744229 - DNA, 20 bp, Homo sapiens
tgccacactttcactgggga

SEQ ID NO: 6744230 - DNA, 23 bp, Homo sapiens
tgccacagagaagtttgtagcca

SEQ ID NO: 6744231 - DNA, 22 bp, Homo sapiens
tgccacagagtgtagccaggtc

SEQ ID NO: 6744232 - DNA, 14 bp, Homo sapiens
tgccacagcaagga

SEQ ID NO: 6744233 - DNA, 15 bp, Homo sapiens
tgccacagccaagcc

SEQ ID NO: 6744234 - DNA, 13 bp, Homo sapiens
tgccacagccaga

SEQ ID NO: 6744235 - DNA, 16 bp, Homo sapiens
tgccacagccccacag

SEQ ID NO: 6744236 - DNA, 19 bp, Homo sapiens
tgccacagccccacagcac

SEQ ID NO: 6744237 - DNA, 21 bp, Homo sapiens
tgccacagccccacagcaccc

SEQ ID NO: 6744238 - DNA, 22 bp, Homo sapiens
tgccacagccccacagcaccca

SEQ ID NO: 6744239 - DNA, 16 bp, Homo sapiens
tgccacagccctgtca

SEQ ID NO: 6744240 - DNA, 13 bp, Homo sapiens
tgccacagcctcc

SEQ ID NO: 6744241 - DNA, 14 bp, Homo sapiens
tgccacagcctgct

SEQ ID NO: 6744242 - DNA, 15 bp, Homo sapiens
tgccacagcctgctg

SEQ ID NO: 6744243 - DNA, 22 bp, Homo sapiens
tgccacagctggagctctcaaa

SEQ ID NO: 6744244 - DNA, 12 bp, Homo sapiens
tgccacaggaca

SEQ ID NO: 6744245 - DNA, 14 bp, Homo sapiens
tgccacaggacaca

SEQ ID NO: 6744246 - DNA, 20 bp, Homo sapiens
tgccacaggacacagtcaga

SEQ ID NO: 6744247 - DNA, 13 bp, Homo sapiens
tgccacaggcctc

SEQ ID NO: 6744248 - DNA, 17 bp, Homo sapiens
tgccacaggcctccctg

SEQ ID NO: 6744249 - DNA, 22 bp, Homo sapiens
tgccacaggcctccctgtttga

SEQ ID NO: 6744250 - DNA, 17 bp, Homo sapiens
tgccacaggcttaggga

SEQ ID NO: 6744251 - DNA, 20 bp, Homo sapiens
tgccacaggcttagggacag

SEQ ID NO: 6744252 - DNA, 23 bp, Homo sapiens
tgccacataattcattaaaaaca

SEQ ID NO: 6744253 - DNA, 17 bp, Homo sapiens
tgccacatacaggtgct

SEQ ID NO: 6744254 - DNA, 12 bp, Homo sapiens
tgccacatccct

SEQ ID NO: 6744255 - DNA, 13 bp, Homo sapiens
tgccacatcccta

SEQ ID NO: 6744256 - DNA, 22 bp, Homo sapiens
tgccacatcgcagcccctgttg

SEQ ID NO: 6744257 - DNA, 16 bp, Homo sapiens
tgccacatcttaaact

SEQ ID NO: 6744258 - DNA, 15 bp, Homo sapiens
tgccacatggagccc

SEQ ID NO: 6744259 - DNA, 21 bp, Homo sapiens
tgccacatggccgctgcccac

SEQ ID NO: 6744260 - DNA, 17 bp, Homo sapiens
tgccacattagaacttc

SEQ ID NO: 6744261 - DNA, 19 bp, Homo sapiens
tgccacattgcttcattaa

SEQ ID NO: 6744262 - DNA, 20 bp, Homo sapiens
tgccacattgcttcattaaa

SEQ ID NO: 6744263 - DNA, 20 bp, Homo sapiens
tgccaggagcctggagggaa

SEQ ID NO: 6744264 - DNA, 11 bp, Homo sapiens
tgccaggagga

SEQ ID NO: 6744265 - DNA, 20 bp, Homo sapiens
tgccaggaggaacaaagaga

SEQ ID NO: 6744266 - DNA, 20 bp, Homo sapiens
tgccaggaggacccagggct

SEQ ID NO: 6744267 - DNA, 23 bp, Homo sapiens
tgccaggaggacccagggctctg

SEQ ID NO: 6744268 - DNA, 21 bp, Homo sapiens
tgccaggaggctgcggcctag

SEQ ID NO: 6744269 - DNA, 13 bp, Homo sapiens
tgccaggagggac

SEQ ID NO: 6744270 - DNA, 24 bp, Homo sapiens
tgccaggagggacaaaggagcctg

SEQ ID NO: 6744271 - DNA, 18 bp, Homo sapiens
tgccaggatggaatgatg

SEQ ID NO: 6744272 - DNA, 16 bp, Homo sapiens
tgccaggattttgtat

SEQ ID NO: 6744273 - DNA, 20 bp, Homo sapiens
tgccaggcacacacagcccc

SEQ ID NO: 6744274 - DNA, 14 bp, Homo sapiens
tgccaggcacaggc

SEQ ID NO: 6744275 - DNA, 20 bp, Homo sapiens
tgccaggcaccatctgccaa

SEQ ID NO: 6744276 - DNA, 14 bp, Homo sapiens
tgccaggcacctgg

SEQ ID NO: 6744277 - DNA, 17 bp, Homo sapiens
tgccaggcacctggcct

SEQ ID NO: 6744278 - DNA, 19 bp, Homo sapiens
tgccaggcacctggcctgc

SEQ ID NO: 6744279 - DNA, 23 bp, Homo sapiens
tgccaggcacctggcctgctggg

SEQ ID NO: 6744280 - DNA, 11 bp, Homo sapiens
tgccaggcagg

SEQ ID NO: 6744281 - DNA, 15 bp, Homo sapiens
tgccaggcaggggtg

SEQ ID NO: 6744282 - DNA, 10 bp, Homo sapiens
tgccaggcat

SEQ ID NO: 6744283 - DNA, 15 bp, Homo sapiens
tgccaggccagcctc

SEQ ID NO: 6744284 - DNA, 18 bp, Homo sapiens
tgccaggccagcctccga

SEQ ID NO: 6744285 - DNA, 12 bp, Homo sapiens
tgccaggcccat

SEQ ID NO: 6744286 - DNA, 17 bp, Homo sapiens
tgccaggcccccaccac

SEQ ID NO: 6744287 - DNA, 19 bp, Homo sapiens
tgccaggcccccaccacac

SEQ ID NO: 6744288 - DNA, 20 bp, Homo sapiens
tgccaggcccccaccacaca

SEQ ID NO: 6744289 - DNA, 23 bp, Homo sapiens
tgccaggcccccgctggctcctc

SEQ ID NO: 6744290 - DNA, 21 bp, Homo sapiens
tgccaggcccggcatgaggcc

SEQ ID NO: 6744291 - DNA, 14 bp, Homo sapiens
tgccaggccctcca

SEQ ID NO: 6744292 - DNA, 15 bp, Homo sapiens
tgccaggccctccag

SEQ ID NO: 6744293 - DNA, 16 bp, Homo sapiens
tgccaggccctccagc

SEQ ID NO: 6744294 - DNA, 17 bp, Homo sapiens
tgccaggcggccctggg

SEQ ID NO: 6744295 - DNA, 18 bp, Homo sapiens
tgccaggcgttggtgcca

SEQ ID NO: 6744296 - DNA, 22 bp, Homo sapiens
tgccaggcgttggtgccacttc

SEQ ID NO: 6744297 - DNA, 17 bp, Homo sapiens
tgccaggctaatttttt

SEQ ID NO: 6744298 - DNA, 18 bp, Homo sapiens
tgccaggctagactagga

SEQ ID NO: 6744299 - DNA, 21 bp, Homo sapiens
tgccaggctcccactgcccct

SEQ ID NO: 6744300 - DNA, 14 bp, Homo sapiens
tgccaggctccctt

SEQ ID NO: 6744301 - DNA, 22 bp, Homo sapiens
tgccaggctctccctctctgca

SEQ ID NO: 6744302 - DNA, 12 bp, Homo sapiens
tgccaggctgca

SEQ ID NO: 6744303 - DNA, 13 bp, Homo sapiens
tgccaggctgcag

SEQ ID NO: 6744304 - DNA, 16 bp, Homo sapiens
tgccaggctgcaggga

SEQ ID NO: 6744305 - DNA, 14 bp, Homo sapiens
tgccaggctgcctc

SEQ ID NO: 6744306 - DNA, 16 bp, Homo sapiens
tgccaggctgcctcct

SEQ ID NO: 6744307 - DNA, 17 bp, Homo sapiens
tgccaggctgcctcctg

SEQ ID NO: 6744308 - DNA, 21 bp, Homo sapiens
tgccaggctgcctcctgccct

SEQ ID NO: 6744309 - DNA, 15 bp, Homo sapiens
tgccaggctgggcac

SEQ ID NO: 6744310 - DNA, 13 bp, Homo sapiens
tgccaggctgtgc

SEQ ID NO: 6744311 - DNA, 18 bp, Homo sapiens
tgccaggctgtgctagca

SEQ ID NO: 6744312 - DNA, 14 bp, Homo sapiens
tgccaggcttgcct

SEQ ID NO: 6744313 - DNA, 18 bp, Homo sapiens
tgccaggcttgcctgggc

SEQ ID NO: 6744314 - DNA, 17 bp, Homo sapiens
tgccagggaaaaagacc

SEQ ID NO: 6744315 - DNA, 18 bp, Homo sapiens
tgccagggaactggcctg

SEQ ID NO: 6744316 - DNA, 16 bp, Homo sapiens
tgccagggaagacaga

SEQ ID NO: 6744317 - DNA, 22 bp, Homo sapiens
tgccagggaagacagagcaggc

SEQ ID NO: 6744318 - DNA, 23 bp, Homo sapiens
tgccagggaagacagagcaggct

SEQ ID NO: 6744319 - DNA, 22 bp, Homo sapiens
tgccagggacagagggggtggc

SEQ ID NO: 6744320 - DNA, 18 bp, Homo sapiens
tgccagggagacagagct

SEQ ID NO: 6744321 - DNA, 11 bp, Homo sapiens
tgccagggagc

SEQ ID NO: 6744322 - DNA, 11 bp, Homo sapiens
tgccagggatg

SEQ ID NO: 6744323 - DNA, 15 bp, Homo sapiens
tgccagggatgggca

SEQ ID NO: 6744324 - DNA, 17 bp, Homo sapiens
tgccagggatgggcagc

SEQ ID NO: 6744325 - DNA, 17 bp, Homo sapiens
tgccagggcaatgatga

SEQ ID NO: 6744326 - DNA, 14 bp, Homo sapiens
tgccagggcagggt

SEQ ID NO: 6744327 - DNA, 17 bp, Homo sapiens
tgccagggcagggtctg

SEQ ID NO: 6744328 - DNA, 18 bp, Homo sapiens
tgccagggcagggtctgg

SEQ ID NO: 6744329 - DNA, 21 bp, Homo sapiens
tgccagggcagggtctgggct

SEQ ID NO: 6744330 - DNA, 22 bp, Homo sapiens
tgccagggcagggtctgggctg

SEQ ID NO: 6744331 - DNA, 19 bp, Homo sapiens
tgccagggcagtgctagtg

SEQ ID NO: 6744332 - DNA, 23 bp, Homo sapiens
tgccagggccatgtcagacacag

SEQ ID NO: 6744333 - DNA, 14 bp, Homo sapiens
tgccagggcccacc

SEQ ID NO: 6744334 - DNA, 15 bp, Homo sapiens
tgccagggcccaccc

SEQ ID NO: 6744335 - DNA, 18 bp, Homo sapiens
tgccagggcccaccccag

SEQ ID NO: 6744336 - DNA, 19 bp, Homo sapiens
tgccagggcccaccccagc

SEQ ID NO: 6744337 - DNA, 14 bp, Homo sapiens
tgccagggcccagg

SEQ ID NO: 6744338 - DNA, 23 bp, Homo sapiens
tgccagggcccctctccccaggg

SEQ ID NO: 6744339 - DNA, 16 bp, Homo sapiens
tgccagggccgaccag

SEQ ID NO: 6744340 - DNA, 19 bp, Homo sapiens
tgccagggctcgggcgctg

SEQ ID NO: 6744341 - DNA, 22 bp, Homo sapiens
tgccagggctcgggcgctgtgg

SEQ ID NO: 6744342 - DNA, 14 bp, Homo sapiens
tgccagggctctgg

SEQ ID NO: 6744343 - DNA, 13 bp, Homo sapiens
tgccagggcttcc

SEQ ID NO: 6744344 - DNA, 22 bp, Homo sapiens
tgccaggggctctgtggcaaaa

SEQ ID NO: 6744345 - DNA, 17 bp, Homo sapiens
tgccaggggcttgagaa

SEQ ID NO: 6744346 - DNA, 19 bp, Homo sapiens
tgccagggggcaaggagaa

SEQ ID NO: 6744347 - DNA, 21 bp, Homo sapiens
tgccaggggtaacctggccac

SEQ ID NO: 6744348 - DNA, 19 bp, Homo sapiens
tgccagggtgggctgggga

SEQ ID NO: 6744349 - DNA, 18 bp, Homo sapiens
tgccaggtccctttcatt

SEQ ID NO: 6744350 - DNA, 20 bp, Homo sapiens
tgccaggtccttgccctttg

SEQ ID NO: 6744351 - DNA, 14 bp, Homo sapiens
tgccaggtgagaaa

SEQ ID NO: 6744352 - DNA, 17 bp, Homo sapiens
tgccaggtgagaaactg

SEQ ID NO: 6744353 - DNA, 17 bp, Homo sapiens
tgccaggtgaggtcagc

SEQ ID NO: 6744354 - DNA, 17 bp, Homo sapiens
tgccaggtggctcagtg

SEQ ID NO: 6744355 - DNA, 16 bp, Homo sapiens
tgccaggttgcagctg

SEQ ID NO: 6744356 - DNA, 19 bp, Homo sapiens
tgccaggttgcagctgctc

SEQ ID NO: 6744357 - DNA, 19 bp, Homo sapiens
tgccaggttttctgggtgt

SEQ ID NO: 6744358 - DNA, 14 bp, Homo sapiens
tgccagtaaaaaaa

SEQ ID NO: 6744359 - DNA, 23 bp, Homo sapiens
tgccagtaacacaggccaccctg

SEQ ID NO: 6744360 - DNA, 18 bp, Homo sapiens
tgccagtaacgcgtcttc

SEQ ID NO: 6744361 - DNA, 23 bp, Homo sapiens
tgccagtaccagccccaccctgt

SEQ ID NO: 6744362 - DNA, 19 bp, Homo sapiens
tgccagtatataagctgtt

SEQ ID NO: 6744363 - DNA, 16 bp, Homo sapiens
tgccagtcaccccggc

SEQ ID NO: 6744364 - DNA, 18 bp, Homo sapiens
tgccagtcaccccggcca

SEQ ID NO: 6744365 - DNA, 20 bp, Homo sapiens
tgccagtcaccccggccacc

SEQ ID NO: 6744366 - DNA, 16 bp, Homo sapiens
tgccagtcagcctgga

SEQ ID NO: 6744367 - DNA, 19 bp, Homo sapiens
tgccagtccccctgcccca

SEQ ID NO: 6744368 - DNA, 23 bp, Homo sapiens
tgccagtcctaggcccctgccct

SEQ ID NO: 6744369 - DNA, 14 bp, Homo sapiens
tgccagtcctgggg

SEQ ID NO: 6744370 - DNA, 15 bp, Homo sapiens
tgccagtcctgtcct

SEQ ID NO: 6744371 - DNA, 20 bp, Homo sapiens
tgccagtcgcgctgcctgtg

SEQ ID NO: 6744372 - DNA, 22 bp, Homo sapiens
tgccagtcgcgctgcctgtgtg

SEQ ID NO: 6744373 - DNA, 23 bp, Homo sapiens
tgccagtcgcgctgcctgtgtgg

SEQ ID NO: 6744374 - DNA, 23 bp, Homo sapiens
tgccagtcgggagagccaggctt

SEQ ID NO: 6744375 - DNA, 15 bp, Homo sapiens
tgccagtgaagactt

SEQ ID NO: 6744376 - DNA, 22 bp, Homo sapiens
tgccagtgaagacttcttgggt

SEQ ID NO: 6744377 - DNA, 17 bp, Homo sapiens
tgccagtgacagacagg

SEQ ID NO: 6744378 - DNA, 22 bp, Homo sapiens
tgccagtgacagacaggctctt

SEQ ID NO: 6744379 - DNA, 15 bp, Homo sapiens
tgccagtgactgctg

SEQ ID NO: 6744380 - DNA, 15 bp, Homo sapiens
tgccagtgcagccac

SEQ ID NO: 6744381 - DNA, 17 bp, Homo sapiens
tgccagtgcatgccagg

SEQ ID NO: 6744382 - DNA, 22 bp, Homo sapiens
tgccagtgcatgccaggaagca

SEQ ID NO: 6744383 - DNA, 14 bp, Homo sapiens
tgccagtgccaggg

SEQ ID NO: 6744384 - DNA, 15 bp, Homo sapiens
tgccagtgccagggt

SEQ ID NO: 6744385 - DNA, 11 bp, Homo sapiens
tgccagtgcct

SEQ ID NO: 6744386 - DNA, 12 bp, Homo sapiens
tgccagtgcctg

SEQ ID NO: 6744387 - DNA, 16 bp, Homo sapiens
tgccagtgcctgggtg

SEQ ID NO: 6744388 - DNA, 22 bp, Homo sapiens
tgccagtgctaagctgccctga

SEQ ID NO: 6744389 - DNA, 23 bp, Homo sapiens
tgccagtgctaagctgccctgag

SEQ ID NO: 6744390 - DNA, 16 bp, Homo sapiens
tgccagtgctcaaggt

SEQ ID NO: 6744391 - DNA, 14 bp, Homo sapiens
tgccagtggaatac

SEQ ID NO: 6744392 - DNA, 16 bp, Homo sapiens
tgccagtggagacgga

SEQ ID NO: 6744393 - DNA, 17 bp, Homo sapiens
tgccagtggatcccctg

SEQ ID NO: 6744394 - DNA, 15 bp, Homo sapiens
tgccagtggtggagg

SEQ ID NO: 6744395 - DNA, 17 bp, Homo sapiens
tgccagtggtgtccaag

SEQ ID NO: 6744396 - DNA, 12 bp, Homo sapiens
tgccagtgtctt

SEQ ID NO: 6744397 - DNA, 13 bp, Homo sapiens
tgccagtgtcttt

SEQ ID NO: 6744398 - DNA, 14 bp, Homo sapiens
tgccagtgtctttc

SEQ ID NO: 6744399 - DNA, 22 bp, Homo sapiens
tgccagtgtgttactcatcttt

SEQ ID NO: 6744400 - DNA, 17 bp, Homo sapiens
tgccagttacttgggct

SEQ ID NO: 6744401 - DNA, 14 bp, Homo sapiens
tgccagttcctgta

SEQ ID NO: 6744402 - DNA, 23 bp, Homo sapiens
tgccagttgaaaatggattttta

SEQ ID NO: 6744403 - DNA, 15 bp, Homo sapiens
tgccagttgcctgga

SEQ ID NO: 6744404 - DNA, 15 bp, Homo sapiens
tgccagttgggctcg

SEQ ID NO: 6744405 - DNA, 21 bp, Homo sapiens
tgccagtttttaaaatgctgc

SEQ ID NO: 6744406 - DNA, 13 bp, Homo sapiens
tgccataaaacat

SEQ ID NO: 6744407 - DNA, 21 bp, Homo sapiens
tgccataaaacattaagaaaa

SEQ ID NO: 6744408 - DNA, 19 bp, Homo sapiens
tgccataacataccaccta

SEQ ID NO: 6744409 - DNA, 17 bp, Homo sapiens
tgccataaccacattta

SEQ ID NO: 6744410 - DNA, 18 bp, Homo sapiens
tgccataacttgtttgta

SEQ ID NO: 6744411 - DNA, 19 bp, Homo sapiens
tgccataactttatgaagt

SEQ ID NO: 6744412 - DNA, 21 bp, Homo sapiens
tgccataactttatgaagtgc

SEQ ID NO: 6744413 - DNA, 13 bp, Homo sapiens
tgccataattact

SEQ ID NO: 6744414 - DNA, 23 bp, Homo sapiens
tgccataattctaagttatttac

SEQ ID NO: 6744415 - DNA, 16 bp, Homo sapiens
tgccatacatgttatt

SEQ ID NO: 6744416 - DNA, 17 bp, Homo sapiens
tgccataccttctccca

SEQ ID NO: 6744417 - DNA, 18 bp, Homo sapiens
tgccataccttctcccag

SEQ ID NO: 6744418 - DNA, 21 bp, Homo sapiens
tgccataccttctcccaggcc

SEQ ID NO: 6744419 - DNA, 16 bp, Homo sapiens
tgccataccttgagac

SEQ ID NO: 6744420 - DNA, 13 bp, Homo sapiens
tgccatactaatg

SEQ ID NO: 6744421 - DNA, 14 bp, Homo sapiens
tgccatactaatga

SEQ ID NO: 6744422 - DNA, 17 bp, Homo sapiens
tgccatacttgttctgt

SEQ ID NO: 6744423 - DNA, 15 bp, Homo sapiens
tgccatactttgtct

SEQ ID NO: 6744424 - DNA, 22 bp, Homo sapiens
tgccatactttgtctgaaaaat

SEQ ID NO: 6744425 - DNA, 20 bp, Homo sapiens
tgccatagagtttaacacaa

SEQ ID NO: 6744426 - DNA, 19 bp, Homo sapiens
tgccatagccaggagcgca

SEQ ID NO: 6744427 - DNA, 23 bp, Homo sapiens
tgccatagccaggagcgcatctc

SEQ ID NO: 6744428 - DNA, 17 bp, Homo sapiens
tgccatagtcaaagaga

SEQ ID NO: 6744429 - DNA, 18 bp, Homo sapiens
tgccatagtcacatggcc

SEQ ID NO: 6744430 - DNA, 18 bp, Homo sapiens
tgccatatgatttacatt

SEQ ID NO: 6744431 - DNA, 23 bp, Homo sapiens
tgccatattaaattttttgttga

SEQ ID NO: 6744432 - DNA, 17 bp, Homo sapiens
tgccatattctggttct

SEQ ID NO: 6744433 - DNA, 21 bp, Homo sapiens
tgccatattctggttcttgaa

SEQ ID NO: 6744434 - DNA, 16 bp, Homo sapiens
tgccatattctgttgg

SEQ ID NO: 6744435 - DNA, 20 bp, Homo sapiens
tgccatattctgttggccag

SEQ ID NO: 6744436 - DNA, 15 bp, Homo sapiens
tgccatattgcacat

SEQ ID NO: 6744437 - DNA, 15 bp, Homo sapiens
tgccatatttttctg

SEQ ID NO: 6744438 - DNA, 16 bp, Homo sapiens
tgccatatttttctgt

SEQ ID NO: 6744439 - DNA, 19 bp, Homo sapiens
tgccatatttttgagggct

SEQ ID NO: 6744440 - DNA, 21 bp, Homo sapiens
tgccccacctttattaaaatc

SEQ ID NO: 6744441 - DNA, 23 bp, Homo sapiens
tgccccacgctgtggccctggag

SEQ ID NO: 6744442 - DNA, 19 bp, Homo sapiens
tgccccacgttgtccctga

SEQ ID NO: 6744443 - DNA, 11 bp, Homo sapiens
tgccccactcc

SEQ ID NO: 6744444 - DNA, 12 bp, Homo sapiens
tgccccactcca

SEQ ID NO: 6744445 - DNA, 19 bp, Homo sapiens
tgccccactccagcctggg

SEQ ID NO: 6744446 - DNA, 19 bp, Homo sapiens
tgccccactctgcctgcct

SEQ ID NO: 6744447 - DNA, 14 bp, Homo sapiens
tgccccactgggag

SEQ ID NO: 6744448 - DNA, 17 bp, Homo sapiens
tgccccacttctggcat

SEQ ID NO: 6744449 - DNA, 12 bp, Homo sapiens
tgccccagactg

SEQ ID NO: 6744450 - DNA, 19 bp, Homo sapiens
tgccccagactgagctctc

SEQ ID NO: 6744451 - DNA, 23 bp, Homo sapiens
tgccccagactgagctctccagg

SEQ ID NO: 6744452 - DNA, 13 bp, Homo sapiens
tgccccagagaag

SEQ ID NO: 6744453 - DNA, 20 bp, Homo sapiens
tgccccagagaagcctcagt

SEQ ID NO: 6744454 - DNA, 17 bp, Homo sapiens
tgccccagagctgttta

SEQ ID NO: 6744455 - DNA, 13 bp, Homo sapiens
tgccccagccaac

SEQ ID NO: 6744456 - DNA, 12 bp, Homo sapiens
tgccccagccag

SEQ ID NO: 6744457 - DNA, 12 bp, Homo sapiens
tgccccagcccc

SEQ ID NO: 6744458 - DNA, 13 bp, Homo sapiens
tgccccagcccct

SEQ ID NO: 6744459 - DNA, 14 bp, Homo sapiens
tgccccagccccta

SEQ ID NO: 6744460 - DNA, 11 bp, Homo sapiens
tgccccagcgc

SEQ ID NO: 6744461 - DNA, 16 bp, Homo sapiens
tgccccagctctggct

SEQ ID NO: 6744462 - DNA, 20 bp, Homo sapiens
tgccccagctgactgtggcc

SEQ ID NO: 6744463 - DNA, 14 bp, Homo sapiens
tgccccagctgcca

SEQ ID NO: 6744464 - DNA, 17 bp, Homo sapiens
tgccccagctgccaggc

SEQ ID NO: 6744465 - DNA, 17 bp, Homo sapiens
tgccccagctgggctgt

SEQ ID NO: 6744466 - DNA, 15 bp, Homo sapiens
tgccccagcttgggc

SEQ ID NO: 6744467 - DNA, 14 bp, Homo sapiens
tgccccaggaccag

SEQ ID NO: 6744468 - DNA, 19 bp, Homo sapiens
tgccccaggaccagctcag

SEQ ID NO: 6744469 - DNA, 20 bp, Homo sapiens
tgccccaggaccagctcagg

SEQ ID NO: 6744470 - DNA, 21 bp, Homo sapiens
tgccccaggactctggcactt

SEQ ID NO: 6744471 - DNA, 13 bp, Homo sapiens
tgccccaggccag

SEQ ID NO: 6744472 - DNA, 15 bp, Homo sapiens
tgccccaggccaggt

SEQ ID NO: 6744473 - DNA, 21 bp, Homo sapiens
tgccccaggccggagcccaga

SEQ ID NO: 6744474 - DNA, 14 bp, Homo sapiens
tgccccaggcctga

SEQ ID NO: 6744475 - DNA, 21 bp, Homo sapiens
tgccccaggctcaggctgccc

SEQ ID NO: 6744476 - DNA, 24 bp, Homo sapiens
tgccccaggctcaggctgcccagc

SEQ ID NO: 6744477 - DNA, 18 bp, Homo sapiens
tgccccagggagtccagg

SEQ ID NO: 6744478 - DNA, 19 bp, Homo sapiens
tgccccagggatgggaggt

SEQ ID NO: 6744479 - DNA, 18 bp, Homo sapiens
tgccccagtcagcctggc

SEQ ID NO: 6744480 - DNA, 13 bp, Homo sapiens
tgccccagtcctg

SEQ ID NO: 6744481 - DNA, 22 bp, Homo sapiens
tgccccagtcggccccatctct

SEQ ID NO: 6744482 - DNA, 22 bp, Homo sapiens
tgccccagtggtgcgggccagg

SEQ ID NO: 6744483 - DNA, 14 bp, Homo sapiens
tgccccatcctggg

SEQ ID NO: 6744484 - DNA, 21 bp, Homo sapiens
tgccccatctcctcccatggc

SEQ ID NO: 6744485 - DNA, 21 bp, Homo sapiens
tgccccatgaagccacagccc

SEQ ID NO: 6744486 - DNA, 23 bp, Homo sapiens
tgccccatgaagccacagcccag

SEQ ID NO: 6744487 - DNA, 23 bp, Homo sapiens
tgccccatgacttgatgcagttt

SEQ ID NO: 6744488 - DNA, 19 bp, Homo sapiens
tgccccatgataaaataag

SEQ ID NO: 6744489 - DNA, 15 bp, Homo sapiens
tgccccatgtgtcct

SEQ ID NO: 6744490 - DNA, 16 bp, Homo sapiens
tgccccattccagctc

SEQ ID NO: 6744491 - DNA, 20 bp, Homo sapiens
tgccccattccttgcgcctc

SEQ ID NO: 6744492 - DNA, 18 bp, Homo sapiens
tgccccattcttttgtaa

SEQ ID NO: 6744493 - DNA, 23 bp, Homo sapiens
tgcccccaaaggtggtctgcttt

SEQ ID NO: 6744494 - DNA, 22 bp, Homo sapiens
tgcccccaacactccaggccct

SEQ ID NO: 6744495 - DNA, 17 bp, Homo sapiens
tgcccccacacctggcc

SEQ ID NO: 6744496 - DNA, 14 bp, Homo sapiens
tgcccccacagatc

SEQ ID NO: 6744497 - DNA, 15 bp, Homo sapiens
tgcccccacagatcc

SEQ ID NO: 6744498 - DNA, 11 bp, Homo sapiens
tgcccccaccc

SEQ ID NO: 6744499 - DNA, 16 bp, Homo sapiens
tgcccccacccagtcc

SEQ ID NO: 6744500 - DNA, 20 bp, Homo sapiens
tgcccccaccccaggctggg

SEQ ID NO: 6744501 - DNA, 19 bp, Homo sapiens
tgcccccaccccattcccg

SEQ ID NO: 6744502 - DNA, 22 bp, Homo sapiens
tgcccccaccccggggaccctg

SEQ ID NO: 6744503 - DNA, 22 bp, Homo sapiens
tgcccccaccccttcctgtctc

SEQ ID NO: 6744504 - DNA, 16 bp, Homo sapiens
tgcccccaccctgctt

SEQ ID NO: 6744505 - DNA, 19 bp, Homo sapiens
tgcccccactgtcccccta

SEQ ID NO: 6744506 - DNA, 18 bp, Homo sapiens
tgcccccagagccacagt

SEQ ID NO: 6744507 - DNA, 12 bp, Homo sapiens
tgcccccagagt

SEQ ID NO: 6744508 - DNA, 20 bp, Homo sapiens
tgcccccagcactcctctgt

SEQ ID NO: 6744509 - DNA, 23 bp, Homo sapiens
tgcccccagcactcctctgtctc

SEQ ID NO: 6744510 - DNA, 17 bp, Homo sapiens
tgcccccagcccaaagg

SEQ ID NO: 6744511 - DNA, 19 bp, Homo sapiens
tgcccccagcccagagccc

SEQ ID NO: 6744512 - DNA, 13 bp, Homo sapiens
tgcccccagcctc

SEQ ID NO: 6744513 - DNA, 18 bp, Homo sapiens
tgcccccagcctcagccc

SEQ ID NO: 6744514 - DNA, 14 bp, Homo sapiens
tgcccccagcgtgg

SEQ ID NO: 6744515 - DNA, 15 bp, Homo sapiens
tgcccccaggactgg

SEQ ID NO: 6744516 - DNA, 16 bp, Homo sapiens
tgcccccaggactggg

SEQ ID NO: 6744517 - DNA, 17 bp, Homo sapiens
tgcccccaggactgggc

SEQ ID NO: 6744518 - DNA, 19 bp, Homo sapiens
tgcccccaggactgggcca

SEQ ID NO: 6744519 - DNA, 16 bp, Homo sapiens
tgcccccaggcagcca

SEQ ID NO: 6744520 - DNA, 12 bp, Homo sapiens
tgcccccaggtg

SEQ ID NO: 6744521 - DNA, 13 bp, Homo sapiens
tgcccccaggtga

SEQ ID NO: 6744522 - DNA, 13 bp, Homo sapiens
tgcccccatcacc

SEQ ID NO: 6744523 - DNA, 12 bp, Homo sapiens
tgcccccatcca

SEQ ID NO: 6744524 - DNA, 17 bp, Homo sapiens
tgcccccatccagccac

SEQ ID NO: 6744525 - DNA, 20 bp, Homo sapiens
tgcccccatccagccacgga

SEQ ID NO: 6744526 - DNA, 17 bp, Homo sapiens
tgcccccatctccccag

SEQ ID NO: 6744527 - DNA, 16 bp, Homo sapiens
tgcccccatctttcct

SEQ ID NO: 6744528 - DNA, 17 bp, Homo sapiens
tgcccccattcccagcc

SEQ ID NO: 6744529 - DNA, 20 bp, Homo sapiens
tgcccccattcccagcctga

SEQ ID NO: 6744530 - DNA, 17 bp, Homo sapiens
tgcccccattctcccag

SEQ ID NO: 6744531 - DNA, 17 bp, Homo sapiens
tgccccccacattctgg

SEQ ID NO: 6744532 - DNA, 21 bp, Homo sapiens
tgccccccacattctggctcc

SEQ ID NO: 6744533 - DNA, 12 bp, Homo sapiens
tgccccccaccc

SEQ ID NO: 6744534 - DNA, 15 bp, Homo sapiens
tgccccccaccccag

SEQ ID NO: 6744535 - DNA, 16 bp, Homo sapiens
tgccccccaccccagc

SEQ ID NO: 6744536 - DNA, 17 bp, Homo sapiens
tgccccccacccctgga

SEQ ID NO: 6744537 - DNA, 12 bp, Homo sapiens
tgccccccatcc

SEQ ID NO: 6744538 - DNA, 13 bp, Homo sapiens
tgccccccatcct

SEQ ID NO: 6744539 - DNA, 14 bp, Homo sapiens
tgccccccatcctg

SEQ ID NO: 6744540 - DNA, 16 bp, Homo sapiens
tgccccccatcctggc

SEQ ID NO: 6744541 - DNA, 17 bp, Homo sapiens
tgccccccatcctggcc

SEQ ID NO: 6744542 - DNA, 19 bp, Homo sapiens
tgccccccatcctggccca

SEQ ID NO: 6744543 - DNA, 18 bp, Homo sapiens
tgccccccatgccctccc

SEQ ID NO: 6744544 - DNA, 19 bp, Homo sapiens
tgccccccatgccctccct

SEQ ID NO: 6744545 - DNA, 15 bp, Homo sapiens
tgcccccccacccca

SEQ ID NO: 6744546 - DNA, 17 bp, Homo sapiens
tgccccccgaggctgct

SEQ ID NO: 6744547 - DNA, 15 bp, Homo sapiens
tgcccccctcctcca

SEQ ID NO: 6744548 - DNA, 17 bp, Homo sapiens
tgcccccctcctccagt

SEQ ID NO: 6744549 - DNA, 20 bp, Homo sapiens
tgccccccttcccaccccta

SEQ ID NO: 6744550 - DNA, 18 bp, Homo sapiens
tgcccccgacggctgtga

SEQ ID NO: 6744551 - DNA, 18 bp, Homo sapiens
tgcccccgcgggttctag

SEQ ID NO: 6744552 - DNA, 19 bp, Homo sapiens
tgcccccgcgggttctaga

SEQ ID NO: 6744553 - DNA, 19 bp, Homo sapiens
tgcccccgcttagccccgc

SEQ ID NO: 6744554 - DNA, 14 bp, Homo sapiens
tgcccccggccccc

SEQ ID NO: 6744555 - DNA, 18 bp, Homo sapiens
tgcccccggccccctggt

SEQ ID NO: 6744556 - DNA, 13 bp, Homo sapiens
tgccccctcacct

SEQ ID NO: 6744557 - DNA, 17 bp, Homo sapiens
tgccccctcatctcact

SEQ ID NO: 6744558 - DNA, 15 bp, Homo sapiens
tgccccctcccactc

SEQ ID NO: 6744559 - DNA, 14 bp, Homo sapiens
tgccccctcccccg

SEQ ID NO: 6744560 - DNA, 13 bp, Homo sapiens
tgccccctcccct

SEQ ID NO: 6744561 - DNA, 21 bp, Homo sapiens
tgccccctcccctcctttacc

SEQ ID NO: 6744562 - DNA, 13 bp, Homo sapiens
tgccccctccctt

SEQ ID NO: 6744563 - DNA, 11 bp, Homo sapiens
tgccccctcct

SEQ ID NO: 6744564 - DNA, 17 bp, Homo sapiens
tgccccctcctctccca

SEQ ID NO: 6744565 - DNA, 20 bp, Homo sapiens
tgccccctcctctcccatcc

SEQ ID NO: 6744566 - DNA, 22 bp, Homo sapiens
tgccccctcgggggcctgtggt

SEQ ID NO: 6744567 - DNA, 18 bp, Homo sapiens
tgccccctcgtgccagtc

SEQ ID NO: 6744568 - DNA, 14 bp, Homo sapiens
tgccccctctcact

SEQ ID NO: 6744569 - DNA, 15 bp, Homo sapiens
tgccccctctcactt

SEQ ID NO: 6744570 - DNA, 17 bp, Homo sapiens
tgccccctctgccctgc

SEQ ID NO: 6744571 - DNA, 18 bp, Homo sapiens
tgccccctgcaggaagga

SEQ ID NO: 6744572 - DNA, 23 bp, Homo sapiens
tgccccctgcaggaaggagctgc

SEQ ID NO: 6744573 - DNA, 11 bp, Homo sapiens
tgccccctgcc

SEQ ID NO: 6744574 - DNA, 12 bp, Homo sapiens
tgccccctgcca

SEQ ID NO: 6744575 - DNA, 13 bp, Homo sapiens
tgccccctgccag

SEQ ID NO: 6744576 - DNA, 14 bp, Homo sapiens
tgccccctgccagt

SEQ ID NO: 6744577 - DNA, 13 bp, Homo sapiens
tgccccctgctta

SEQ ID NO: 6744578 - DNA, 14 bp, Homo sapiens
tgccccctggctga

SEQ ID NO: 6744579 - DNA, 13 bp, Homo sapiens
tgccccctggctt

SEQ ID NO: 6744580 - DNA, 12 bp, Homo sapiens
tgccccctgggg

SEQ ID NO: 6744581 - DNA, 22 bp, Homo sapiens
tgccccctggggggcacagcca

SEQ ID NO: 6744582 - DNA, 12 bp, Homo sapiens
tgccccctggtg

SEQ ID NO: 6744583 - DNA, 17 bp, Homo sapiens
tgcccccttccccagcc

SEQ ID NO: 6744584 - DNA, 18 bp, Homo sapiens
tgcccccttccccagccc

SEQ ID NO: 6744585 - DNA, 19 bp, Homo sapiens
tgcccccttccccagccct

SEQ ID NO: 6744586 - DNA, 16 bp, Homo sapiens
tgcccccttctcccac

SEQ ID NO: 6744587 - DNA, 17 bp, Homo sapiens
tgcccccttctcccaca

SEQ ID NO: 6744588 - DNA, 19 bp, Homo sapiens
tgcccccttctcccacact

SEQ ID NO: 6744589 - DNA, 22 bp, Homo sapiens
tgcccccttctcccacactgct

SEQ ID NO: 6744590 - DNA, 17 bp, Homo sapiens
tgcccccttgcccatca

SEQ ID NO: 6744591 - DNA, 16 bp, Homo sapiens
tgccccctttcagatg

SEQ ID NO: 6744592 - DNA, 23 bp, Homo sapiens
tgccccctttcagatgtcttctg

SEQ ID NO: 6744593 - DNA, 20 bp, Homo sapiens
tgccccctttgaccttcccc

SEQ ID NO: 6744594 - DNA, 19 bp, Homo sapiens
tgccccgaatttagtcaca

SEQ ID NO: 6744595 - DNA, 21 bp, Homo sapiens
tgccccgagcccaggcagcta

SEQ ID NO: 6744596 - DNA, 15 bp, Homo sapiens
tgccccgcaggcctg

SEQ ID NO: 6744597 - DNA, 22 bp, Homo sapiens
tgccccgcaggcctgccttctc

SEQ ID NO: 6744598 - DNA, 13 bp, Homo sapiens
tgccccgccatgg

SEQ ID NO: 6744599 - DNA, 13 bp, Homo sapiens
tgccccgcccagc

SEQ ID NO: 6744600 - DNA, 18 bp, Homo sapiens
tgccccgcccccaagctc

SEQ ID NO: 6744601 - DNA, 17 bp, Homo sapiens
tgccccgccccccagag

SEQ ID NO: 6744602 - DNA, 18 bp, Homo sapiens
tgccccgccccccagagc

SEQ ID NO: 6744603 - DNA, 22 bp, Homo sapiens
tgccccgccccccagagccagg

SEQ ID NO: 6744604 - DNA, 13 bp, Homo sapiens
tgccccgcctccc

SEQ ID NO: 6744605 - DNA, 15 bp, Homo sapiens
tgccccgcctccccg

SEQ ID NO: 6744606 - DNA, 14 bp, Homo sapiens
tgccccgcctcccg

SEQ ID NO: 6744607 - DNA, 18 bp, Homo sapiens
tgccccgccttcgtgtgc

SEQ ID NO: 6744608 - DNA, 20 bp, Homo sapiens
tgccccgccttcgtgtgctg

SEQ ID NO: 6744609 - DNA, 22 bp, Homo sapiens
tgccccgcgggctttgttgctg

SEQ ID NO: 6744610 - DNA, 17 bp, Homo sapiens
tgccccgctttgcggac

SEQ ID NO: 6744611 - DNA, 22 bp, Homo sapiens
tgccccggacctacctccctcc

SEQ ID NO: 6744612 - DNA, 18 bp, Homo sapiens
tgccccggaggaagcttg

SEQ ID NO: 6744613 - DNA, 18 bp, Homo sapiens
tgccccggccacctctgc

SEQ ID NO: 6744614 - DNA, 14 bp, Homo sapiens
tgccccggccactc

SEQ ID NO: 6744615 - DNA, 22 bp, Homo sapiens
tgccccggcccaacctcgccct

SEQ ID NO: 6744616 - DNA, 22 bp, Homo sapiens
tgccccggccccggccccagcc

SEQ ID NO: 6744617 - DNA, 21 bp, Homo sapiens
tgccccggcgaggccggagag

SEQ ID NO: 6744618 - DNA, 19 bp, Homo sapiens
tgccccggggaggggcgct

SEQ ID NO: 6744619 - DNA, 15 bp, Homo sapiens
tgccctgcccaagtg

SEQ ID NO: 6744620 - DNA, 14 bp, Homo sapiens
tgccctgcccacct

SEQ ID NO: 6744621 - DNA, 20 bp, Homo sapiens
tgccctgcccacctggcctc

SEQ ID NO: 6744622 - DNA, 22 bp, Homo sapiens
tgccctgcccacctggcctctg

SEQ ID NO: 6744623 - DNA, 12 bp, Homo sapiens
tgccctgcccag

SEQ ID NO: 6744624 - DNA, 13 bp, Homo sapiens
tgccctgccccca

SEQ ID NO: 6744625 - DNA, 14 bp, Homo sapiens
tgccctgccccctg

SEQ ID NO: 6744626 - DNA, 22 bp, Homo sapiens
tgccctgccccctggctgactg

SEQ ID NO: 6744627 - DNA, 13 bp, Homo sapiens
tgccctgccctgg

SEQ ID NO: 6744628 - DNA, 14 bp, Homo sapiens
tgccctgccctggc

SEQ ID NO: 6744629 - DNA, 16 bp, Homo sapiens
tgccctgccctggcca

SEQ ID NO: 6744630 - DNA, 13 bp, Homo sapiens
tgccctgcctccc

SEQ ID NO: 6744631 - DNA, 14 bp, Homo sapiens
tgccctgcctccct

SEQ ID NO: 6744632 - DNA, 15 bp, Homo sapiens
tgccctgcctgagga

SEQ ID NO: 6744633 - DNA, 16 bp, Homo sapiens
tgccctgcctgaggag

SEQ ID NO: 6744634 - DNA, 13 bp, Homo sapiens
tgccctgccttca

SEQ ID NO: 6744635 - DNA, 12 bp, Homo sapiens
tgccctgccttg

SEQ ID NO: 6744636 - DNA, 13 bp, Homo sapiens
tgccctgccttgc

SEQ ID NO: 6744637 - DNA, 14 bp, Homo sapiens
tgccctgccttgcc

SEQ ID NO: 6744638 - DNA, 15 bp, Homo sapiens
tgccctgccttgctg

SEQ ID NO: 6744639 - DNA, 14 bp, Homo sapiens
tgccctgcggctct

SEQ ID NO: 6744640 - DNA, 16 bp, Homo sapiens
tgccctgcggctctgg

SEQ ID NO: 6744641 - DNA, 17 bp, Homo sapiens
tgccctgcggctctgga

SEQ ID NO: 6744642 - DNA, 20 bp, Homo sapiens
tgccctgcggctctggaaag

SEQ ID NO: 6744643 - DNA, 19 bp, Homo sapiens
tgccctgcgtcccttctct

SEQ ID NO: 6744644 - DNA, 20 bp, Homo sapiens
tgccctgctatttcaggccc

SEQ ID NO: 6744645 - DNA, 12 bp, Homo sapiens
tgccctgctccc

SEQ ID NO: 6744646 - DNA, 13 bp, Homo sapiens
tgccctgctccct

SEQ ID NO: 6744647 - DNA, 18 bp, Homo sapiens
tgccctgctctgcccagg

SEQ ID NO: 6744648 - DNA, 23 bp, Homo sapiens
tgccctgctgagtcccaggctga

SEQ ID NO: 6744649 - DNA, 14 bp, Homo sapiens
tgccctgctggcct

SEQ ID NO: 6744650 - DNA, 15 bp, Homo sapiens
tgccctgctggcctg

SEQ ID NO: 6744651 - DNA, 14 bp, Homo sapiens
tgccctgctgttta

SEQ ID NO: 6744652 - DNA, 17 bp, Homo sapiens
tgccctgctttgcaaac

SEQ ID NO: 6744653 - DNA, 20 bp, Homo sapiens
tgccctggaggctgacacag

SEQ ID NO: 6744654 - DNA, 18 bp, Homo sapiens
tgccctggatccatcagg

SEQ ID NO: 6744655 - DNA, 16 bp, Homo sapiens
tgccctggatgcccag

SEQ ID NO: 6744656 - DNA, 17 bp, Homo sapiens
tgccctggcagcagcag

SEQ ID NO: 6744657 - DNA, 15 bp, Homo sapiens
tgccctggccactgg

SEQ ID NO: 6744658 - DNA, 20 bp, Homo sapiens
tgccctggccactggccctg

SEQ ID NO: 6744659 - DNA, 22 bp, Homo sapiens
tgccctggccactggccctgtt

SEQ ID NO: 6744660 - DNA, 13 bp, Homo sapiens
tgccctggcccag

SEQ ID NO: 6744661 - DNA, 15 bp, Homo sapiens
tgccctggcccagcc

SEQ ID NO: 6744662 - DNA, 17 bp, Homo sapiens
tgccctggcccagcctg

SEQ ID NO: 6744663 - DNA, 12 bp, Homo sapiens
tgccctggccct

SEQ ID NO: 6744664 - DNA, 12 bp, Homo sapiens
tgccctggctcc

SEQ ID NO: 6744665 - DNA, 22 bp, Homo sapiens
tgccctggctcccaagggaggc

SEQ ID NO: 6744666 - DNA, 23 bp, Homo sapiens
tgccctggctccttgcagcaggg

SEQ ID NO: 6744667 - DNA, 11 bp, Homo sapiens
tgccctggctg

SEQ ID NO: 6744668 - DNA, 12 bp, Homo sapiens
tgccctggctgc

SEQ ID NO: 6744669 - DNA, 14 bp, Homo sapiens
tgccctggctgctg

SEQ ID NO: 6744670 - DNA, 17 bp, Homo sapiens
tgccctggctgctgccc

SEQ ID NO: 6744671 - DNA, 20 bp, Homo sapiens
tgccctggctgctgccccca

SEQ ID NO: 6744672 - DNA, 13 bp, Homo sapiens
tgccctgggaaac

SEQ ID NO: 6744673 - DNA, 22 bp, Homo sapiens
tgccctgggagctctgggactg

SEQ ID NO: 6744674 - DNA, 20 bp, Homo sapiens
tgccctgggccagcccagga

SEQ ID NO: 6744675 - DNA, 14 bp, Homo sapiens
tgccctgggccagg

SEQ ID NO: 6744676 - DNA, 15 bp, Homo sapiens
tgccctgggccaggc

SEQ ID NO: 6744677 - DNA, 16 bp, Homo sapiens
tgccctgggccaggca

SEQ ID NO: 6744678 - DNA, 19 bp, Homo sapiens
tgccctgggccaggcaggc

SEQ ID NO: 6744679 - DNA, 12 bp, Homo sapiens
tgccctgggctc

SEQ ID NO: 6744680 - DNA, 15 bp, Homo sapiens
tgccctgggctcctc

SEQ ID NO: 6744681 - DNA, 14 bp, Homo sapiens
tgccctgggctgcc

SEQ ID NO: 6744682 - DNA, 17 bp, Homo sapiens
tgccctgggctgcctcc

SEQ ID NO: 6744683 - DNA, 19 bp, Homo sapiens
tgccctggggcatcatggg

SEQ ID NO: 6744684 - DNA, 23 bp, Homo sapiens
tgccctggggctgatctcaggga

SEQ ID NO: 6744685 - DNA, 21 bp, Homo sapiens
tgccctgggggataccagctg

SEQ ID NO: 6744686 - DNA, 11 bp, Homo sapiens
tgccctgggtc

SEQ ID NO: 6744687 - DNA, 23 bp, Homo sapiens
tgccctgggtcacctagctggtt

SEQ ID NO: 6744688 - DNA, 18 bp, Homo sapiens
tgccctgggtcctgcctg

SEQ ID NO: 6744689 - DNA, 16 bp, Homo sapiens
tgccctgggttcttcc

SEQ ID NO: 6744690 - DNA, 18 bp, Homo sapiens
tgccctggtgaatcacct

SEQ ID NO: 6744691 - DNA, 13 bp, Homo sapiens
tgccctggtggag

SEQ ID NO: 6744692 - DNA, 14 bp, Homo sapiens
tgccctggtggaga

SEQ ID NO: 6744693 - DNA, 23 bp, Homo sapiens
tgccctggtggagaaagcactga

SEQ ID NO: 6744694 - DNA, 13 bp, Homo sapiens
tgccctggtggcc

SEQ ID NO: 6744695 - DNA, 17 bp, Homo sapiens
tgccctggtggcctgcc

SEQ ID NO: 6744696 - DNA, 17 bp, Homo sapiens
tgccctggtttcactgg

SEQ ID NO: 6744697 - DNA, 20 bp, Homo sapiens
tgccctggtttcctgccctg

SEQ ID NO: 6744698 - DNA, 16 bp, Homo sapiens
tgccctgtagctcctt

SEQ ID NO: 6744699 - DNA, 21 bp, Homo sapiens
tgccctgtagctccttagcta

SEQ ID NO: 6744700 - DNA, 16 bp, Homo sapiens
tgccctgtaggaaggc

SEQ ID NO: 6744701 - DNA, 17 bp, Homo sapiens
tgccctgtatataatac

SEQ ID NO: 6744702 - DNA, 20 bp, Homo sapiens
tgccctgtatataatactaa

SEQ ID NO: 6744703 - DNA, 24 bp, Homo sapiens
tgccctgtatataatactaaagtg

SEQ ID NO: 6744704 - DNA, 16 bp, Homo sapiens
tgccctgtccctagct

SEQ ID NO: 6744705 - DNA, 17 bp, Homo sapiens
tgccctgtcctccagct

SEQ ID NO: 6744706 - DNA, 13 bp, Homo sapiens
tgccctgtgccgc

SEQ ID NO: 6744707 - DNA, 18 bp, Homo sapiens
tgccctgtggacaggatg

SEQ ID NO: 6744708 - DNA, 20 bp, Homo sapiens
tgccctgtggattccagcat

SEQ ID NO: 6744709 - DNA, 11 bp, Homo sapiens
tgccctgtggg

SEQ ID NO: 6744710 - DNA, 14 bp, Homo sapiens
tgccctgtgggacc

SEQ ID NO: 6744711 - DNA, 11 bp, Homo sapiens
tgccctgtgta

SEQ ID NO: 6744712 - DNA, 11 bp, Homo sapiens
tgccctgtgtc

SEQ ID NO: 6744713 - DNA, 15 bp, Homo sapiens
tgccctgtgtggctg

SEQ ID NO: 6744714 - DNA, 16 bp, Homo sapiens
tgccctgtgtggctgg

SEQ ID NO: 6744715 - DNA, 16 bp, Homo sapiens
tgccctgttcaaagta

SEQ ID NO: 6744716 - DNA, 19 bp, Homo sapiens
tgccctgttctctaccaag

SEQ ID NO: 6744717 - DNA, 20 bp, Homo sapiens
tgccctgttgggggcttcag

SEQ ID NO: 6744718 - DNA, 18 bp, Homo sapiens
tgccctgtttcctgctgc

SEQ ID NO: 6744719 - DNA, 21 bp, Homo sapiens
tgcccttaaaataatgattta

SEQ ID NO: 6744720 - DNA, 22 bp, Homo sapiens
tgcccttacacgtgcgtgtgag

SEQ ID NO: 6744721 - DNA, 21 bp, Homo sapiens
tgcccttacctgtctctctct

SEQ ID NO: 6744722 - DNA, 15 bp, Homo sapiens
tgcccttagagggga

SEQ ID NO: 6744723 - DNA, 15 bp, Homo sapiens
tgcccttcaccccag

SEQ ID NO: 6744724 - DNA, 20 bp, Homo sapiens
tgcccttcaccccagtggcc

SEQ ID NO: 6744725 - DNA, 21 bp, Homo sapiens
tgcccttcactttctcctggt

SEQ ID NO: 6744726 - DNA, 18 bp, Homo sapiens
tgcccttcattcagcctt

SEQ ID NO: 6744727 - DNA, 11 bp, Homo sapiens
tgcccttccct

SEQ ID NO: 6744728 - DNA, 15 bp, Homo sapiens
tgcccttccctggag

SEQ ID NO: 6744729 - DNA, 16 bp, Homo sapiens
tgcccttccctggagg

SEQ ID NO: 6744730 - DNA, 15 bp, Homo sapiens
tgcccttccctgtcc

SEQ ID NO: 6744731 - DNA, 11 bp, Homo sapiens
tgcccttcctc

SEQ ID NO: 6744732 - DNA, 20 bp, Homo sapiens
tgcccttcctcagggcccct

SEQ ID NO: 6744733 - DNA, 14 bp, Homo sapiens
tgcccttcctccag

SEQ ID NO: 6744734 - DNA, 16 bp, Homo sapiens
tgcccttcctccagga

SEQ ID NO: 6744735 - DNA, 14 bp, Homo sapiens
tgcccttcctcctg

SEQ ID NO: 6744736 - DNA, 15 bp, Homo sapiens
tgcccttcctcctga

SEQ ID NO: 6744737 - DNA, 23 bp, Homo sapiens
tgcccttcctcctgcctttctca

SEQ ID NO: 6744738 - DNA, 17 bp, Homo sapiens
tgcccttcgctgccagg

SEQ ID NO: 6744739 - DNA, 14 bp, Homo sapiens
tgcccttctcaaga

SEQ ID NO: 6744740 - DNA, 17 bp, Homo sapiens
tgcccttctcaagactt

SEQ ID NO: 6744741 - DNA, 11 bp, Homo sapiens
tgcccttctcc

SEQ ID NO: 6744742 - DNA, 14 bp, Homo sapiens
tgcccttctcccca

SEQ ID NO: 6744743 - DNA, 12 bp, Homo sapiens
tgcccttctgat

SEQ ID NO: 6744744 - DNA, 18 bp, Homo sapiens
tgcccttcttccattccc

SEQ ID NO: 6744745 - DNA, 16 bp, Homo sapiens
tgcccttctttctacc

SEQ ID NO: 6744746 - DNA, 23 bp, Homo sapiens
tgcccttgaattcttttcctctc

SEQ ID NO: 6744747 - DNA, 15 bp, Homo sapiens
tgcccttgagtctag

SEQ ID NO: 6744748 - DNA, 13 bp, Homo sapiens
tgcccttgccctg

SEQ ID NO: 6744749 - DNA, 15 bp, Homo sapiens
tgcccttgccctgac

SEQ ID NO: 6744750 - DNA, 19 bp, Homo sapiens
tgcccttgctccagcctga

SEQ ID NO: 6744751 - DNA, 16 bp, Homo sapiens
tgcccttgctgggcct

SEQ ID NO: 6744752 - DNA, 20 bp, Homo sapiens
tgcccttgctgggcctgggg

SEQ ID NO: 6744753 - DNA, 14 bp, Homo sapiens
tgcccttgctgggt

SEQ ID NO: 6744754 - DNA, 17 bp, Homo sapiens
tgcccttggaggccagc

SEQ ID NO: 6744755 - DNA, 21 bp, Homo sapiens
tgcccttggcaccaccagggt

SEQ ID NO: 6744756 - DNA, 18 bp, Homo sapiens
tgcccttggcacccaaga

SEQ ID NO: 6744757 - DNA, 22 bp, Homo sapiens
tgcccttggggtaagccagagc

SEQ ID NO: 6744758 - DNA, 19 bp, Homo sapiens
tgcccttggtagcagcctg

SEQ ID NO: 6744759 - DNA, 21 bp, Homo sapiens
tgcccttggtagcagcctggg

SEQ ID NO: 6744760 - DNA, 15 bp, Homo sapiens
tgcccttggtttctg

SEQ ID NO: 6744761 - DNA, 17 bp, Homo sapiens
tgcccttgtcccactca

SEQ ID NO: 6744762 - DNA, 13 bp, Homo sapiens
tgcccttgtctga

SEQ ID NO: 6744763 - DNA, 20 bp, Homo sapiens
tgcccttgtttggggcagga

SEQ ID NO: 6744764 - DNA, 17 bp, Homo sapiens
tgccctttaagagcacc

SEQ ID NO: 6744765 - DNA, 18 bp, Homo sapiens
tgccctttagccagatgc

SEQ ID NO: 6744766 - DNA, 20 bp, Homo sapiens
tgccctttagggctgttgct

SEQ ID NO: 6744767 - DNA, 21 bp, Homo sapiens
tgccctttagggctgttgcta

SEQ ID NO: 6744768 - DNA, 22 bp, Homo sapiens
tgccctttcaaagcacttaagt

SEQ ID NO: 6744769 - DNA, 15 bp, Homo sapiens
tgccctttccctgca

SEQ ID NO: 6744770 - DNA, 14 bp, Homo sapiens
tgccctttcctagg

SEQ ID NO: 6744771 - DNA, 17 bp, Homo sapiens
tgccctttcctggcagt

SEQ ID NO: 6744772 - DNA, 15 bp, Homo sapiens
tgccctttctgggca

SEQ ID NO: 6744773 - DNA, 22 bp, Homo sapiens
tgccctttgcagtgtgcagggt

SEQ ID NO: 6744774 - DNA, 14 bp, Homo sapiens
tgccctttggggtc

SEQ ID NO: 6744775 - DNA, 19 bp, Homo sapiens
tgccctttggggttgccca

SEQ ID NO: 6744776 - DNA, 22 bp, Homo sapiens
tgccctttggggttgcccagcc

SEQ ID NO: 6744777 - DNA, 23 bp, Homo sapiens
tgcccttttcatctccagtgtga

SEQ ID NO: 6744778 - DNA, 22 bp, Homo sapiens
tgcccttttcctgggccttctc

SEQ ID NO: 6744779 - DNA, 18 bp, Homo sapiens
tgccgaacacacatccca

SEQ ID NO: 6744780 - DNA, 21 bp, Homo sapiens
tgccgaacacacatcccagga

SEQ ID NO: 6744781 - DNA, 19 bp, Homo sapiens
tgccgaatttggtacacat

SEQ ID NO: 6744782 - DNA, 14 bp, Homo sapiens
tgccgacacgctcc

SEQ ID NO: 6744783 - DNA, 15 bp, Homo sapiens
tgccgacactgagct

SEQ ID NO: 6744784 - DNA, 22 bp, Homo sapiens
tgccgaccgaggctggagctgg

SEQ ID NO: 6744785 - DNA, 18 bp, Homo sapiens
tgccgaccgcctgcttca

SEQ ID NO: 6744786 - DNA, 22 bp, Homo sapiens
tgccgactcccccaaccaagga

SEQ ID NO: 6744787 - DNA, 15 bp, Homo sapiens
tgccgactcctgggt

SEQ ID NO: 6744788 - DNA, 19 bp, Homo sapiens
tgccgacttggagactcct

SEQ ID NO: 6744789 - DNA, 17 bp, Homo sapiens
tgccgagacctcaagcc

SEQ ID NO: 6744790 - DNA, 16 bp, Homo sapiens
tgccgagagaggcgcg

SEQ ID NO: 6744791 - DNA, 22 bp, Homo sapiens
tgccgagagaggcgcgtctgcc

SEQ ID NO: 6744792 - DNA, 20 bp, Homo sapiens
tgccgagcaaccgtggccct

SEQ ID NO: 6744793 - DNA, 12 bp, Homo sapiens
tgccgagccagc

SEQ ID NO: 6744794 - DNA, 13 bp, Homo sapiens
tgccgagcccagc

SEQ ID NO: 6744795 - DNA, 16 bp, Homo sapiens
tgccgagcccttgccc

SEQ ID NO: 6744796 - DNA, 16 bp, Homo sapiens
tgccgagcctaatgaa

SEQ ID NO: 6744797 - DNA, 14 bp, Homo sapiens
tgccgaggaccctc

SEQ ID NO: 6744798 - DNA, 13 bp, Homo sapiens
tgccgagggctgg

SEQ ID NO: 6744799 - DNA, 20 bp, Homo sapiens
tgcctcttggcttctcagcc

SEQ ID NO: 6744800 - DNA, 22 bp, Homo sapiens
tgcctcttggcttctcagcccc

SEQ ID NO: 6744801 - DNA, 23 bp, Homo sapiens
tgcctcttggcttctcagcccct

SEQ ID NO: 6744802 - DNA, 14 bp, Homo sapiens
tgcctcttgggaga

SEQ ID NO: 6744803 - DNA, 18 bp, Homo sapiens
tgcctcttgtctgaggga

SEQ ID NO: 6744804 - DNA, 12 bp, Homo sapiens
tgcctctttaaa

SEQ ID NO: 6744805 - DNA, 15 bp, Homo sapiens
tgcctctttcatcca

SEQ ID NO: 6744806 - DNA, 17 bp, Homo sapiens
tgcctctttcatccact

SEQ ID NO: 6744807 - DNA, 19 bp, Homo sapiens
tgcctctttcctcctcatg

SEQ ID NO: 6744808 - DNA, 18 bp, Homo sapiens
tgcctctttcctgttgtt

SEQ ID NO: 6744809 - DNA, 18 bp, Homo sapiens
tgcctcttttacctgctg

SEQ ID NO: 6744810 - DNA, 21 bp, Homo sapiens
tgcctcttttacctgctgctt

SEQ ID NO: 6744811 - DNA, 22 bp, Homo sapiens
tgcctcttttacctgctgcttc

SEQ ID NO: 6744812 - DNA, 23 bp, Homo sapiens
tgcctgaaaaaactggtatgttg

SEQ ID NO: 6744813 - DNA, 12 bp, Homo sapiens
tgcctgaaacag

SEQ ID NO: 6744814 - DNA, 14 bp, Homo sapiens
tgcctgaaacagcc

SEQ ID NO: 6744815 - DNA, 20 bp, Homo sapiens
tgcctgaaacagccatgtcc

SEQ ID NO: 6744816 - DNA, 22 bp, Homo sapiens
tgcctgaaacagccatgtccaa

SEQ ID NO: 6744817 - DNA, 21 bp, Homo sapiens
tgcctgaaacccatttactta

SEQ ID NO: 6744818 - DNA, 23 bp, Homo sapiens
tgcctgaacagccctctctctca

SEQ ID NO: 6744819 - DNA, 13 bp, Homo sapiens
tgcctgaacatcc

SEQ ID NO: 6744820 - DNA, 17 bp, Homo sapiens
tgcctgaacatccttcc

SEQ ID NO: 6744821 - DNA, 21 bp, Homo sapiens
tgcctgaagcttcggccgcgc

SEQ ID NO: 6744822 - DNA, 22 bp, Homo sapiens
tgcctgaagtcacacagtgagt

SEQ ID NO: 6744823 - DNA, 13 bp, Homo sapiens
tgcctgaataaag

SEQ ID NO: 6744824 - DNA, 18 bp, Homo sapiens
tgcctgaatccacctgca

SEQ ID NO: 6744825 - DNA, 21 bp, Homo sapiens
tgcctgaatccatcaggactt

SEQ ID NO: 6744826 - DNA, 15 bp, Homo sapiens
tgcctgacaaggcca

SEQ ID NO: 6744827 - DNA, 18 bp, Homo sapiens
tgcctgacaaggccagca

SEQ ID NO: 6744828 - DNA, 18 bp, Homo sapiens
tgcctgacaattatgaaa

SEQ ID NO: 6744829 - DNA, 13 bp, Homo sapiens
tgcctgacacact

SEQ ID NO: 6744830 - DNA, 15 bp, Homo sapiens
tgcctgacactgagc

SEQ ID NO: 6744831 - DNA, 18 bp, Homo sapiens
tgcctgacactgagcccc

SEQ ID NO: 6744832 - DNA, 18 bp, Homo sapiens
tgcctgacagcatcctct

SEQ ID NO: 6744833 - DNA, 18 bp, Homo sapiens
tgcctgacatttggagtg

SEQ ID NO: 6744834 - DNA, 18 bp, Homo sapiens
tgcctgaccatcccatga

SEQ ID NO: 6744835 - DNA, 23 bp, Homo sapiens
tgcctgaccatcccatgagcagt

SEQ ID NO: 6744836 - DNA, 18 bp, Homo sapiens
tgcctgacccatcccttt

SEQ ID NO: 6744837 - DNA, 19 bp, Homo sapiens
tgcctgacccatccctttt

SEQ ID NO: 6744838 - DNA, 17 bp, Homo sapiens
tgcctgaccccttgctc

SEQ ID NO: 6744839 - DNA, 23 bp, Homo sapiens
tgcctgaccctacttcttttgct

SEQ ID NO: 6744840 - DNA, 15 bp, Homo sapiens
tgcctgaccttggaa

SEQ ID NO: 6744841 - DNA, 17 bp, Homo sapiens
tgcctgactctgtgctg

SEQ ID NO: 6744842 - DNA, 19 bp, Homo sapiens
tgcctgactctgtgctgag

SEQ ID NO: 6744843 - DNA, 21 bp, Homo sapiens
tgcctgactctgtgctgagca

SEQ ID NO: 6744844 - DNA, 21 bp, Homo sapiens
tgcctgactgcccagcatttg

SEQ ID NO: 6744845 - DNA, 16 bp, Homo sapiens
tgcctgagaatgccta

SEQ ID NO: 6744846 - DNA, 19 bp, Homo sapiens
tgcctgagaatgcctaggc

SEQ ID NO: 6744847 - DNA, 14 bp, Homo sapiens
tgcctgagaccacg

SEQ ID NO: 6744848 - DNA, 14 bp, Homo sapiens
tgcctgagaccagg

SEQ ID NO: 6744849 - DNA, 15 bp, Homo sapiens
tgcctgagaccaggg

SEQ ID NO: 6744850 - DNA, 16 bp, Homo sapiens
tgcctgagaccagggt

SEQ ID NO: 6744851 - DNA, 21 bp, Homo sapiens
tgcctgagaccagggtggcca

SEQ ID NO: 6744852 - DNA, 23 bp, Homo sapiens
tgcctgagaccagggtggccaca

SEQ ID NO: 6744853 - DNA, 18 bp, Homo sapiens
tgcctgagaggcaggcat

SEQ ID NO: 6744854 - DNA, 14 bp, Homo sapiens
tgcctgagattctt

SEQ ID NO: 6744855 - DNA, 22 bp, Homo sapiens
tgcctgagattctttaaggaga

SEQ ID NO: 6744856 - DNA, 23 bp, Homo sapiens
tgcctgagattctttaaggagat

SEQ ID NO: 6744857 - DNA, 20 bp, Homo sapiens
tgcctgagcacctcccagcc

SEQ ID NO: 6744858 - DNA, 11 bp, Homo sapiens
tgcctgagccc

SEQ ID NO: 6744859 - DNA, 15 bp, Homo sapiens
tgcctgagcccagga

SEQ ID NO: 6744860 - DNA, 12 bp, Homo sapiens
tgcctgagcccc

SEQ ID NO: 6744861 - DNA, 13 bp, Homo sapiens
tgcctgagccccc

SEQ ID NO: 6744862 - DNA, 14 bp, Homo sapiens
tgcctgagccccct

SEQ ID NO: 6744863 - DNA, 13 bp, Homo sapiens
tgcctgagctggg

SEQ ID NO: 6744864 - DNA, 15 bp, Homo sapiens
tgcctgagctgggga

SEQ ID NO: 6744865 - DNA, 11 bp, Homo sapiens
tgcctgaggag

SEQ ID NO: 6744866 - DNA, 20 bp, Homo sapiens
tgcctgaggctcaagaggcc

SEQ ID NO: 6744867 - DNA, 23 bp, Homo sapiens
tgcctgaggctcaagaggcccag

SEQ ID NO: 6744868 - DNA, 14 bp, Homo sapiens
tgcctgaggctgta

SEQ ID NO: 6744869 - DNA, 14 bp, Homo sapiens
tgcctgagggcagt

SEQ ID NO: 6744870 - DNA, 17 bp, Homo sapiens
tgcctgagggtgggctt

SEQ ID NO: 6744871 - DNA, 16 bp, Homo sapiens
tgcctgaggtctgtac

SEQ ID NO: 6744872 - DNA, 20 bp, Homo sapiens
tgcctgagtcgtgacctgct

SEQ ID NO: 6744873 - DNA, 16 bp, Homo sapiens
tgcctgagttataaat

SEQ ID NO: 6744874 - DNA, 21 bp, Homo sapiens
tgcctgagttataaatatttt

SEQ ID NO: 6744875 - DNA, 22 bp, Homo sapiens
tgcctgatatttccctcccctg

SEQ ID NO: 6744876 - DNA, 18 bp, Homo sapiens
tgcctgatccagcctctc

SEQ ID NO: 6744877 - DNA, 16 bp, Homo sapiens
tgcctgatccctgaac

SEQ ID NO: 6744878 - DNA, 23 bp, Homo sapiens
tgcctgatccctgaacccctggc

SEQ ID NO: 6744879 - DNA, 14 bp, Homo sapiens
tgcctgattatttt

SEQ ID NO: 6744880 - DNA, 21 bp, Homo sapiens
tgcctgattcggctgtctcag

SEQ ID NO: 6744881 - DNA, 17 bp, Homo sapiens
tgcctgatttcattcct

SEQ ID NO: 6744882 - DNA, 20 bp, Homo sapiens
tgcctgcaaccttgcatcca

SEQ ID NO: 6744883 - DNA, 14 bp, Homo sapiens
tgcctgcacatcat

SEQ ID NO: 6744884 - DNA, 17 bp, Homo sapiens
tgcctgcacccttccct

SEQ ID NO: 6744885 - DNA, 17 bp, Homo sapiens
tgcctgcacccttcctc

SEQ ID NO: 6744886 - DNA, 19 bp, Homo sapiens
tgcctgcacccttcctcct

SEQ ID NO: 6744887 - DNA, 20 bp, Homo sapiens
tgcctgcacccttcctcctc

SEQ ID NO: 6744888 - DNA, 21 bp, Homo sapiens
tgcctgcacctccgcgggctg

SEQ ID NO: 6744889 - DNA, 16 bp, Homo sapiens
tgcctgcacctttcgg

SEQ ID NO: 6744890 - DNA, 16 bp, Homo sapiens
tgcctgcactgggaag

SEQ ID NO: 6744891 - DNA, 20 bp, Homo sapiens
tgcctgcagaggtctgtgct

SEQ ID NO: 6744892 - DNA, 13 bp, Homo sapiens
tgcctgcagcaca

SEQ ID NO: 6744893 - DNA, 20 bp, Homo sapiens
tgcctgcagcacatgcgggc

SEQ ID NO: 6744894 - DNA, 14 bp, Homo sapiens
tgcctgcagccagg

SEQ ID NO: 6744895 - DNA, 18 bp, Homo sapiens
tgcctgcagccagggctg

SEQ ID NO: 6744896 - DNA, 14 bp, Homo sapiens
tgcctgcagcctcc

SEQ ID NO: 6744897 - DNA, 16 bp, Homo sapiens
tgcctgcagggccatg

SEQ ID NO: 6744898 - DNA, 22 bp, Homo sapiens
tgcctgcagggccatggctcag

SEQ ID NO: 6744899 - DNA, 23 bp, Homo sapiens
tgcctgcagggccatggctcagg

SEQ ID NO: 6744900 - DNA, 17 bp, Homo sapiens
tgcctgcatgagctggc

SEQ ID NO: 6744901 - DNA, 15 bp, Homo sapiens
tgcctgcatgtattt

SEQ ID NO: 6744902 - DNA, 21 bp, Homo sapiens
tgcctgccaaagtagtcctgg

SEQ ID NO: 6744903 - DNA, 14 bp, Homo sapiens
tgcctgccaccgcg

SEQ ID NO: 6744904 - DNA, 15 bp, Homo sapiens
tgcctgccaccttca

SEQ ID NO: 6744905 - DNA, 15 bp, Homo sapiens
tgcctgccactctct

SEQ ID NO: 6744906 - DNA, 16 bp, Homo sapiens
tgcctgccactctctg

SEQ ID NO: 6744907 - DNA, 12 bp, Homo sapiens
tgcctgccactg

SEQ ID NO: 6744908 - DNA, 15 bp, Homo sapiens
tgcctgccagctgca

SEQ ID NO: 6744909 - DNA, 16 bp, Homo sapiens
tgcctgccagctgcac

SEQ ID NO: 6744910 - DNA, 14 bp, Homo sapiens
tgcctgccagggcc

SEQ ID NO: 6744911 - DNA, 19 bp, Homo sapiens
tgcctgccatagccaggag

SEQ ID NO: 6744912 - DNA, 11 bp, Homo sapiens
tgcctgccatg

SEQ ID NO: 6744913 - DNA, 12 bp, Homo sapiens
tgcctgccatgg

SEQ ID NO: 6744914 - DNA, 14 bp, Homo sapiens
tgcctgccatggct

SEQ ID NO: 6744915 - DNA, 17 bp, Homo sapiens
tgcctgccatggctgtg

SEQ ID NO: 6744916 - DNA, 19 bp, Homo sapiens
tgcctgccatggctgtgac

SEQ ID NO: 6744917 - DNA, 19 bp, Homo sapiens
tgcctgccatgggccagcc

SEQ ID NO: 6744918 - DNA, 21 bp, Homo sapiens
tgcctgccatgggccagccta

SEQ ID NO: 6744919 - DNA, 15 bp, Homo sapiens
tgcctgccatgtgtg

SEQ ID NO: 6744920 - DNA, 13 bp, Homo sapiens
tgcctgcccaccc

SEQ ID NO: 6744921 - DNA, 14 bp, Homo sapiens
tgcctgcccaggcc

SEQ ID NO: 6744922 - DNA, 19 bp, Homo sapiens
tgcctgcccaggcccctgc

SEQ ID NO: 6744923 - DNA, 20 bp, Homo sapiens
tgcctgcccaggcccctgcc

SEQ ID NO: 6744924 - DNA, 20 bp, Homo sapiens
tgcctgcccattagagaagt

SEQ ID NO: 6744925 - DNA, 18 bp, Homo sapiens
tgcctgccccaaacaaat

SEQ ID NO: 6744926 - DNA, 20 bp, Homo sapiens
tgcctgccccaaacaaatat

SEQ ID NO: 6744927 - DNA, 14 bp, Homo sapiens
tgcctgccccacac

SEQ ID NO: 6744928 - DNA, 12 bp, Homo sapiens
tgcctgccccgc

SEQ ID NO: 6744929 - DNA, 21 bp, Homo sapiens
tgcctgcccgcaccctggcct

SEQ ID NO: 6744930 - DNA, 10 bp, Homo sapiens
tgcctgccct

SEQ ID NO: 6744931 - DNA, 11 bp, Homo sapiens
tgcctgccctg

SEQ ID NO: 6744932 - DNA, 12 bp, Homo sapiens
tgcctgccctga

SEQ ID NO: 6744933 - DNA, 21 bp, Homo sapiens
tgcctgccctgcctcagccag

SEQ ID NO: 6744934 - DNA, 15 bp, Homo sapiens
tgcctgccctttgtc

SEQ ID NO: 6744935 - DNA, 21 bp, Homo sapiens
tgcctgccctttgtcctcctg

SEQ ID NO: 6744936 - DNA, 13 bp, Homo sapiens
tgcctgccgctgc

SEQ ID NO: 6744937 - DNA, 15 bp, Homo sapiens
tgcctgccgctgcag

SEQ ID NO: 6744938 - DNA, 20 bp, Homo sapiens
tgcctgccgctgcaggaaac

SEQ ID NO: 6744939 - DNA, 15 bp, Homo sapiens
tgcctgcctcatgct

SEQ ID NO: 6744940 - DNA, 13 bp, Homo sapiens
tgcctgcctccac

SEQ ID NO: 6744941 - DNA, 16 bp, Homo sapiens
tgcctgcctccggccc

SEQ ID NO: 6744942 - DNA, 21 bp, Homo sapiens
tgcctgcctccggccctgccc

SEQ ID NO: 6744943 - DNA, 13 bp, Homo sapiens
tgcctgcctccta

SEQ ID NO: 6744944 - DNA, 20 bp, Homo sapiens
tgcctgcctcctaggctgga

SEQ ID NO: 6744945 - DNA, 17 bp, Homo sapiens
tgcctgcctcctccctc

SEQ ID NO: 6744946 - DNA, 21 bp, Homo sapiens
tgcctgcctctgccatgccca

SEQ ID NO: 6744947 - DNA, 19 bp, Homo sapiens
tgcctgcctcttggcctca

SEQ ID NO: 6744948 - DNA, 22 bp, Homo sapiens
tgcctgcctcttggcctcacgg

SEQ ID NO: 6744949 - DNA, 14 bp, Homo sapiens
tgcctgcctgggaa

SEQ ID NO: 6744950 - DNA, 13 bp, Homo sapiens
tgcctgcctgggc

SEQ ID NO: 6744951 - DNA, 15 bp, Homo sapiens
tgcctgcctgggcct

SEQ ID NO: 6744952 - DNA, 18 bp, Homo sapiens
tgcctgcctgggcctccc

SEQ ID NO: 6744953 - DNA, 14 bp, Homo sapiens
tgcctgccttctcc

SEQ ID NO: 6744954 - DNA, 14 bp, Homo sapiens
tgcctgcctttcca

SEQ ID NO: 6744955 - DNA, 15 bp, Homo sapiens
tgcctgcctttccat

SEQ ID NO: 6744956 - DNA, 22 bp, Homo sapiens
tgcctgcctttccatccatggc

SEQ ID NO: 6744957 - DNA, 18 bp, Homo sapiens
tgcctgcctttgtgtcag

SEQ ID NO: 6744958 - DNA, 21 bp, Homo sapiens
tgcctgcgaaacccagcgttc

SEQ ID NO: 6744959 - DNA, 21 bp, Homo sapiens
tgcctgcgcccaccccgctct

SEQ ID NO: 6744960 - DNA, 15 bp, Homo sapiens
tgcctgcgcctgctg

SEQ ID NO: 6744961 - DNA, 19 bp, Homo sapiens
tgcctgcggagttgtgcac

SEQ ID NO: 6744962 - DNA, 15 bp, Homo sapiens
tgcctgcgtcttccg

SEQ ID NO: 6744963 - DNA, 16 bp, Homo sapiens
tgcctgcgtcttccgc

SEQ ID NO: 6744964 - DNA, 19 bp, Homo sapiens
tgcctgcgtcttccgcccc

SEQ ID NO: 6744965 - DNA, 23 bp, Homo sapiens
tgcctgctacttgagggccagga

SEQ ID NO: 6744966 - DNA, 12 bp, Homo sapiens
tgcctgctagag

SEQ ID NO: 6744967 - DNA, 14 bp, Homo sapiens
tgcctgctagagca

SEQ ID NO: 6744968 - DNA, 14 bp, Homo sapiens
tgcctgctatccag

SEQ ID NO: 6744969 - DNA, 16 bp, Homo sapiens
tgcctgctatccagcc

SEQ ID NO: 6744970 - DNA, 19 bp, Homo sapiens
tgcctgctatccagccgca

SEQ ID NO: 6744971 - DNA, 17 bp, Homo sapiens
tgcctgctcagcagcca

SEQ ID NO: 6744972 - DNA, 21 bp, Homo sapiens
tgcctgctcagcagccagtct

SEQ ID NO: 6744973 - DNA, 15 bp, Homo sapiens
tgcctgctcaggtgc

SEQ ID NO: 6744974 - DNA, 14 bp, Homo sapiens
tgcctgctccctgt

SEQ ID NO: 6744975 - DNA, 11 bp, Homo sapiens
tgcctgctcct

SEQ ID NO: 6744976 - DNA, 24 bp, Homo sapiens
tgcctgctcctgcttaaacacaag

SEQ ID NO: 6744977 - DNA, 19 bp, Homo sapiens
tgccttcggtacccaccac

SEQ ID NO: 6744978 - DNA, 20 bp, Homo sapiens
tgccttcgtctttcccatgg

SEQ ID NO: 6744979 - DNA, 15 bp, Homo sapiens
tgccttctaaaggtg

SEQ ID NO: 6744980 - DNA, 16 bp, Homo sapiens
tgccttctaaaggtgt

SEQ ID NO: 6744981 - DNA, 17 bp, Homo sapiens
tgccttctaccctctgg

SEQ ID NO: 6744982 - DNA, 17 bp, Homo sapiens
tgccttctactcccctt

SEQ ID NO: 6744983 - DNA, 17 bp, Homo sapiens
tgccttctcaactccaa

SEQ ID NO: 6744984 - DNA, 19 bp, Homo sapiens
tgccttctcaccagctgca

SEQ ID NO: 6744985 - DNA, 22 bp, Homo sapiens
tgccttctcaccagctgcaaag

SEQ ID NO: 6744986 - DNA, 16 bp, Homo sapiens
tgccttctcaggcccc

SEQ ID NO: 6744987 - DNA, 13 bp, Homo sapiens
tgccttctccctg

SEQ ID NO: 6744988 - DNA, 22 bp, Homo sapiens
tgccttctccttccccaggatg

SEQ ID NO: 6744989 - DNA, 23 bp, Homo sapiens
tgccttctccttccccaggatgg

SEQ ID NO: 6744990 - DNA, 19 bp, Homo sapiens
tgccttctctcagctccca

SEQ ID NO: 6744991 - DNA, 22 bp, Homo sapiens
tgccttctctcagctcccaggc

SEQ ID NO: 6744992 - DNA, 14 bp, Homo sapiens
tgccttctcttcta

SEQ ID NO: 6744993 - DNA, 16 bp, Homo sapiens
tgccttctcttctatc

SEQ ID NO: 6744994 - DNA, 20 bp, Homo sapiens
tgccttctgacggccctgca

SEQ ID NO: 6744995 - DNA, 14 bp, Homo sapiens
tgccttctgggaag

SEQ ID NO: 6744996 - DNA, 13 bp, Homo sapiens
tgccttctgggca

SEQ ID NO: 6744997 - DNA, 14 bp, Homo sapiens
tgccttctgggctt

SEQ ID NO: 6744998 - DNA, 15 bp, Homo sapiens
tgccttctgggcttt

SEQ ID NO: 6744999 - DNA, 17 bp, Homo sapiens
tgccttctgggcttttt

SEQ ID NO: 6745000 - DNA, 14 bp, Homo sapiens
tgccttctggggag

SEQ ID NO: 6745001 - DNA, 18 bp, Homo sapiens
tgccttctggttacaatt

SEQ ID NO: 6745002 - DNA, 17 bp, Homo sapiens
tgccttctgtcctggtg

SEQ ID NO: 6745003 - DNA, 20 bp, Homo sapiens
tgccttctgtcctggtgtca

SEQ ID NO: 6745004 - DNA, 16 bp, Homo sapiens
tgccttctgtctgctc

SEQ ID NO: 6745005 - DNA, 14 bp, Homo sapiens
tgccttcttcaccc

SEQ ID NO: 6745006 - DNA, 20 bp, Homo sapiens
tgccttcttcagggcctggt

SEQ ID NO: 6745007 - DNA, 15 bp, Homo sapiens
tgccttcttccttga

SEQ ID NO: 6745008 - DNA, 22 bp, Homo sapiens
tgccttctttagaccctcgggc

SEQ ID NO: 6745009 - DNA, 14 bp, Homo sapiens
tgccttctttccat

SEQ ID NO: 6745010 - DNA, 17 bp, Homo sapiens
tgccttctttgaagaag

SEQ ID NO: 6745011 - DNA, 14 bp, Homo sapiens
tgccttcttttgta

SEQ ID NO: 6745012 - DNA, 15 bp, Homo sapiens
tgccttgaaatcaag

SEQ ID NO: 6745013 - DNA, 22 bp, Homo sapiens
tgccttgaaatttacacagtga

SEQ ID NO: 6745014 - DNA, 15 bp, Homo sapiens
tgccttgaaccactt

SEQ ID NO: 6745015 - DNA, 18 bp, Homo sapiens
tgccttgaactgttgtct

SEQ ID NO: 6745016 - DNA, 13 bp, Homo sapiens
tgccttgaattgt

SEQ ID NO: 6745017 - DNA, 17 bp, Homo sapiens
tgccttgaattgtctag

SEQ ID NO: 6745018 - DNA, 21 bp, Homo sapiens
tgccttgacaacagactgaat

SEQ ID NO: 6745019 - DNA, 13 bp, Homo sapiens
tgccttgagctgc

SEQ ID NO: 6745020 - DNA, 14 bp, Homo sapiens
tgccttgagctgcc

SEQ ID NO: 6745021 - DNA, 20 bp, Homo sapiens
tgccttgataaatatatatg

SEQ ID NO: 6745022 - DNA, 20 bp, Homo sapiens
tgccttgatgaagcctgtgc

SEQ ID NO: 6745023 - DNA, 15 bp, Homo sapiens
tgccttgatgtttct

SEQ ID NO: 6745024 - DNA, 12 bp, Homo sapiens
tgccttgatttt

SEQ ID NO: 6745025 - DNA, 14 bp, Homo sapiens
tgccttgcacagga

SEQ ID NO: 6745026 - DNA, 15 bp, Homo sapiens
tgccttgcactgtgg

SEQ ID NO: 6745027 - DNA, 16 bp, Homo sapiens
tgccttgcagaactgc

SEQ ID NO: 6745028 - DNA, 14 bp, Homo sapiens
tgccttgcagccac

SEQ ID NO: 6745029 - DNA, 19 bp, Homo sapiens
tgccttgcagccacatggc

SEQ ID NO: 6745030 - DNA, 22 bp, Homo sapiens
tgccttgcagccacatggcccc

SEQ ID NO: 6745031 - DNA, 13 bp, Homo sapiens
tgccttgcatttg

SEQ ID NO: 6745032 - DNA, 13 bp, Homo sapiens
tgccttgcccaca

SEQ ID NO: 6745033 - DNA, 15 bp, Homo sapiens
tgccttgcccacagg

SEQ ID NO: 6745034 - DNA, 23 bp, Homo sapiens
tgccttgcccactcctgctctgc

SEQ ID NO: 6745035 - DNA, 12 bp, Homo sapiens
tgccttgcctcc

SEQ ID NO: 6745036 - DNA, 13 bp, Homo sapiens
tgccttgcctcct

SEQ ID NO: 6745037 - DNA, 13 bp, Homo sapiens
tgccttgctattt

SEQ ID NO: 6745038 - DNA, 18 bp, Homo sapiens
tgccttgctcctagcaga

SEQ ID NO: 6745039 - DNA, 18 bp, Homo sapiens
tgccttgctgacaataaa

SEQ ID NO: 6745040 - DNA, 19 bp, Homo sapiens
tgccttgctgacaataaag

SEQ ID NO: 6745041 - DNA, 16 bp, Homo sapiens
tgccttgctgccttca

SEQ ID NO: 6745042 - DNA, 13 bp, Homo sapiens
tgccttgctgttt

SEQ ID NO: 6745043 - DNA, 20 bp, Homo sapiens
tgccttgctgtttgtcctga

SEQ ID NO: 6745044 - DNA, 17 bp, Homo sapiens
tgccttgcttctcccat

SEQ ID NO: 6745045 - DNA, 13 bp, Homo sapiens
tgccttggaaaca

SEQ ID NO: 6745046 - DNA, 13 bp, Homo sapiens
tgccttggagagg

SEQ ID NO: 6745047 - DNA, 19 bp, Homo sapiens
tgccttggagggtcccaag

SEQ ID NO: 6745048 - DNA, 20 bp, Homo sapiens
tgccttggagggtcccaagc

SEQ ID NO: 6745049 - DNA, 13 bp, Homo sapiens
tgccttggcccct

SEQ ID NO: 6745050 - DNA, 12 bp, Homo sapiens
tgccttggcctc

SEQ ID NO: 6745051 - DNA, 18 bp, Homo sapiens
tgccttggcctcccaaag

SEQ ID NO: 6745052 - DNA, 13 bp, Homo sapiens
tgccttggctcag

SEQ ID NO: 6745053 - DNA, 19 bp, Homo sapiens
tgccttggctcagacatgt

SEQ ID NO: 6745054 - DNA, 13 bp, Homo sapiens
tgccttggcttca

SEQ ID NO: 6745055 - DNA, 15 bp, Homo sapiens
tgccttgggctgctc

SEQ ID NO: 6745056 - DNA, 16 bp, Homo sapiens
tgccttgggctgctcc

SEQ ID NO: 6745057 - DNA, 16 bp, Homo sapiens
tgccttggggaaatgt

SEQ ID NO: 6745058 - DNA, 18 bp, Homo sapiens
tgccttggggaatttcct

SEQ ID NO: 6745059 - DNA, 19 bp, Homo sapiens
tgccttggggaatttcctc

SEQ ID NO: 6745060 - DNA, 21 bp, Homo sapiens
tgccttggggaatttcctcta

SEQ ID NO: 6745061 - DNA, 23 bp, Homo sapiens
tgccttggggaggacaaaacttc

SEQ ID NO: 6745062 - DNA, 18 bp, Homo sapiens
tgccttggttctggccac

SEQ ID NO: 6745063 - DNA, 23 bp, Homo sapiens
tgccttggttctggccaccccag

SEQ ID NO: 6745064 - DNA, 19 bp, Homo sapiens
tgccttggttcttcctagt

SEQ ID NO: 6745065 - DNA, 19 bp, Homo sapiens
tgccttggtttgatttcta

SEQ ID NO: 6745066 - DNA, 13 bp, Homo sapiens
tgccttggttttt

SEQ ID NO: 6745067 - DNA, 11 bp, Homo sapiens
tgccttgtata

SEQ ID NO: 6745068 - DNA, 17 bp, Homo sapiens
tgccttgtccaggaact

SEQ ID NO: 6745069 - DNA, 22 bp, Homo sapiens
tgccttgtccaggaactgcctg

SEQ ID NO: 6745070 - DNA, 13 bp, Homo sapiens
tgccttgtccctc

SEQ ID NO: 6745071 - DNA, 18 bp, Homo sapiens
tgccttgtccctctcact

SEQ ID NO: 6745072 - DNA, 19 bp, Homo sapiens
tgccttgttgtattcctgc

SEQ ID NO: 6745073 - DNA, 12 bp, Homo sapiens
tgccttgtttaa

SEQ ID NO: 6745074 - DNA, 21 bp, Homo sapiens
tgccttgtttaatgttaatta

SEQ ID NO: 6745075 - DNA, 13 bp, Homo sapiens
tgccttgtttcat

SEQ ID NO: 6745076 - DNA, 17 bp, Homo sapiens
tgcctttaaagtatgaa

SEQ ID NO: 6745077 - DNA, 14 bp, Homo sapiens
tgcctttaaatctg

SEQ ID NO: 6745078 - DNA, 15 bp, Homo sapiens
tgcctttaaatctgt

SEQ ID NO: 6745079 - DNA, 16 bp, Homo sapiens
tgcctttaaatgaaac

SEQ ID NO: 6745080 - DNA, 23 bp, Homo sapiens
tgcctttaacagaaactttcaaa

SEQ ID NO: 6745081 - DNA, 22 bp, Homo sapiens
tgcctttaagccaaagaaacaa

SEQ ID NO: 6745082 - DNA, 19 bp, Homo sapiens
tgcctttaatattttgtaa

SEQ ID NO: 6745083 - DNA, 22 bp, Homo sapiens
tgcctttaatattttgtaatat

SEQ ID NO: 6745084 - DNA, 19 bp, Homo sapiens
tgcctttaattttcttgtt

SEQ ID NO: 6745085 - DNA, 15 bp, Homo sapiens
tgcctttactatatg

SEQ ID NO: 6745086 - DNA, 15 bp, Homo sapiens
tgcctttagaaaata

SEQ ID NO: 6745087 - DNA, 23 bp, Homo sapiens
tgcctttagaaaatataagtaaa

SEQ ID NO: 6745088 - DNA, 20 bp, Homo sapiens
tgcctttagcccctcccaag

SEQ ID NO: 6745089 - DNA, 21 bp, Homo sapiens
tgcctttaggggtgtgtattc

SEQ ID NO: 6745090 - DNA, 18 bp, Homo sapiens
tgcctttatctcagccat

SEQ ID NO: 6745091 - DNA, 22 bp, Homo sapiens
tgcctttatctcagccatccgc

SEQ ID NO: 6745092 - DNA, 13 bp, Homo sapiens
tgcctttcaaagt

SEQ ID NO: 6745093 - DNA, 23 bp, Homo sapiens
tgcctttcaaagtgcacacacac

SEQ ID NO: 6745094 - DNA, 20 bp, Homo sapiens
tgcctttcagaagtgattta

SEQ ID NO: 6745095 - DNA, 17 bp, Homo sapiens
tgcctttcaggatctat

SEQ ID NO: 6745096 - DNA, 21 bp, Homo sapiens
tgcctttcaggcccattacct

SEQ ID NO: 6745097 - DNA, 21 bp, Homo sapiens
tgcctttccatccatggccag

SEQ ID NO: 6745098 - DNA, 22 bp, Homo sapiens
tgcctttccccattcattcctg

SEQ ID NO: 6745099 - DNA, 21 bp, Homo sapiens
tgcctttcccgggccctcagc

SEQ ID NO: 6745100 - DNA, 15 bp, Homo sapiens
tgcctttcctatcac

SEQ ID NO: 6745101 - DNA, 23 bp, Homo sapiens
tgcctttcctatcacctcgagaa

SEQ ID NO: 6745102 - DNA, 13 bp, Homo sapiens
tgcctttcctgtt

SEQ ID NO: 6745103 - DNA, 19 bp, Homo sapiens
tgcctttcctgttcagcat

SEQ ID NO: 6745104 - DNA, 17 bp, Homo sapiens
tgcctttcgtgatctta

SEQ ID NO: 6745105 - DNA, 13 bp, Homo sapiens
tgcctttctagtc

SEQ ID NO: 6745106 - DNA, 11 bp, Homo sapiens
tgcctttctca

SEQ ID NO: 6745107 - DNA, 20 bp, Homo sapiens
tgcctttctcaactgtccca

SEQ ID NO: 6745108 - DNA, 18 bp, Homo sapiens
tgcctttctctggctcca

SEQ ID NO: 6745109 - DNA, 19 bp, Homo sapiens
tgcctttctctggctccag

SEQ ID NO: 6745110 - DNA, 20 bp, Homo sapiens
tgcctttctctggctccaga

SEQ ID NO: 6745111 - DNA, 21 bp, Homo sapiens
tgcctttctctggctccagaa

SEQ ID NO: 6745112 - DNA, 18 bp, Homo sapiens
tgcctttctgggagcaga

SEQ ID NO: 6745113 - DNA, 14 bp, Homo sapiens
tgcctttcttctgc

SEQ ID NO: 6745114 - DNA, 17 bp, Homo sapiens
tgcctttcttctgccct

SEQ ID NO: 6745115 - DNA, 16 bp, Homo sapiens
tgcctttctttgcctc

SEQ ID NO: 6745116 - DNA, 17 bp, Homo sapiens
tgcctttctttgcctct

SEQ ID NO: 6745117 - DNA, 20 bp, Homo sapiens
tgcctttgaaattcccccac

SEQ ID NO: 6745118 - DNA, 13 bp, Homo sapiens
tgcctttgaagag

SEQ ID NO: 6745119 - DNA, 16 bp, Homo sapiens
tgcctttgaagagtga

SEQ ID NO: 6745120 - DNA, 15 bp, Homo sapiens
tgcctttgagacagt

SEQ ID NO: 6745121 - DNA, 17 bp, Homo sapiens
tgcctttgagacagttt

SEQ ID NO: 6745122 - DNA, 21 bp, Homo sapiens
tgcctttgagacagtttctta

SEQ ID NO: 6745123 - DNA, 23 bp, Homo sapiens
tgcctttgagacagtttcttagc

SEQ ID NO: 6745124 - DNA, 18 bp, Homo sapiens
tgcctttgagcttctcct

SEQ ID NO: 6745125 - DNA, 18 bp, Homo sapiens
tgcctttgagtttcctca

SEQ ID NO: 6745126 - DNA, 22 bp, Homo sapiens
tgcctttgagtttcctcaggct

SEQ ID NO: 6745127 - DNA, 13 bp, Homo sapiens
tgcctttgatgtg

SEQ ID NO: 6745128 - DNA, 19 bp, Homo sapiens
tgcctttgcaccacgggac

SEQ ID NO: 6745129 - DNA, 18 bp, Homo sapiens
tgcctttgcagctcagaa

SEQ ID NO: 6745130 - DNA, 13 bp, Homo sapiens
tgcctttgctgcc

SEQ ID NO: 6745131 - DNA, 14 bp, Homo sapiens
tgcctttgctgcct

SEQ ID NO: 6745132 - DNA, 22 bp, Homo sapiens
tgcctttgctgtttagcttcct

SEQ ID NO: 6745133 - DNA, 19 bp, Homo sapiens
tgcctttggcaattcttct

SEQ ID NO: 6745134 - DNA, 12 bp, Homo sapiens
tgcctttggcct

SEQ ID NO: 6745135 - DNA, 13 bp, Homo sapiens
tgcctttggcctg

SEQ ID NO: 6745136 - DNA, 15 bp, Homo sapiens
tgcctttgggcacgg

SEQ ID NO: 6745137 - DNA, 12 bp, Homo sapiens
tgcctttgtaag

SEQ ID NO: 6745138 - DNA, 16 bp, Homo sapiens
tgcctttgtaagttat

SEQ ID NO: 6745139 - DNA, 20 bp, Homo sapiens
tgcctttgtaatatgagaat

SEQ ID NO: 6745140 - DNA, 21 bp, Homo sapiens
tgcctttgtaatatgagaatg

SEQ ID NO: 6745141 - DNA, 13 bp, Homo sapiens
tgcctttgtatgt

SEQ ID NO: 6745142 - DNA, 18 bp, Homo sapiens
tgcctttgtatgtggaag

SEQ ID NO: 6745143 - DNA, 14 bp, Homo sapiens
tgcctttgtcccca

SEQ ID NO: 6745144 - DNA, 17 bp, Homo sapiens
tgcctttgtccccacac

SEQ ID NO: 6745145 - DNA, 21 bp, Homo sapiens
tgcctttgtggcccatgaaag

SEQ ID NO: 6745146 - DNA, 10 bp, Homo sapiens
tgcctttgtt

SEQ ID NO: 6745147 - DNA, 15 bp, Homo sapiens
tgcctttgttttgat

SEQ ID NO: 6745148 - DNA, 15 bp, Homo sapiens
tgccttttaaaagaa

SEQ ID NO: 6745149 - DNA, 13 bp, Homo sapiens
tgccttttaagtt

SEQ ID NO: 6745150 - DNA, 16 bp, Homo sapiens
tgccttttaattttta

SEQ ID NO: 6745151 - DNA, 17 bp, Homo sapiens
tgccttttatagctatt

SEQ ID NO: 6745152 - DNA, 12 bp, Homo sapiens
tgccttttcaaa

SEQ ID NO: 6745153 - DNA, 21 bp, Homo sapiens
tgccttttcaaatcaagaaaa

SEQ ID NO: 6745154 - DNA, 19 bp, Homo sapiens
tgccttttcacgttttctt

SEQ ID NO: 6745155 - DNA, 19 bp, Homo sapiens
tgccttttgaatacatttg

SEQ ID NO: 6745156 - DNA, 23 bp, Homo sapiens
tgcgctgctctgcaggctgggga

SEQ ID NO: 6745157 - DNA, 17 bp, Homo sapiens
tgcgctgctttttcaaa

SEQ ID NO: 6745158 - DNA, 15 bp, Homo sapiens
tgcgctgtcccaggc

SEQ ID NO: 6745159 - DNA, 16 bp, Homo sapiens
tgcgctgtcccaggca

SEQ ID NO: 6745160 - DNA, 17 bp, Homo sapiens
tgcgctgtcccaggcat

SEQ ID NO: 6745161 - DNA, 23 bp, Homo sapiens
tgcgctgtgctggtctctaggcc

SEQ ID NO: 6745162 - DNA, 14 bp, Homo sapiens
tgcgcttatttgga

SEQ ID NO: 6745163 - DNA, 18 bp, Homo sapiens
tgcgcttatttggaaatt

SEQ ID NO: 6745164 - DNA, 14 bp, Homo sapiens
tgcgcttcacttgg

SEQ ID NO: 6745165 - DNA, 16 bp, Homo sapiens
tgcgcttcatctcatg

SEQ ID NO: 6745166 - DNA, 22 bp, Homo sapiens
tgcgcttggtaggtgtggtggc

SEQ ID NO: 6745167 - DNA, 19 bp, Homo sapiens
tgcgcttgttttaaagtgg

SEQ ID NO: 6745168 - DNA, 22 bp, Homo sapiens
tgcgctttattgcccatgggat

SEQ ID NO: 6745169 - DNA, 16 bp, Homo sapiens
tgcgctttattttctt

SEQ ID NO: 6745170 - DNA, 18 bp, Homo sapiens
tgcgcttttgctggtcac

SEQ ID NO: 6745171 - DNA, 15 bp, Homo sapiens
tgcggaaaggtattt

SEQ ID NO: 6745172 - DNA, 22 bp, Homo sapiens
tgcggaaaggtatttgggaaac

SEQ ID NO: 6745173 - DNA, 15 bp, Homo sapiens
tgcggaacaggagtg

SEQ ID NO: 6745174 - DNA, 22 bp, Homo sapiens
tgcggacaccatgttcccagct

SEQ ID NO: 6745175 - DNA, 20 bp, Homo sapiens
tgcggacagccacggccagg

SEQ ID NO: 6745176 - DNA, 21 bp, Homo sapiens
tgcggacagccacggccaggc

SEQ ID NO: 6745177 - DNA, 22 bp, Homo sapiens
tgcggacagccacggccaggcc

SEQ ID NO: 6745178 - DNA, 23 bp, Homo sapiens
tgcggacagccacggccaggcca

SEQ ID NO: 6745179 - DNA, 17 bp, Homo sapiens
tgcggaccaagggactc

SEQ ID NO: 6745180 - DNA, 13 bp, Homo sapiens
tgcggaccccagc

SEQ ID NO: 6745181 - DNA, 22 bp, Homo sapiens
tgcggaccggagcggctgagga

SEQ ID NO: 6745182 - DNA, 15 bp, Homo sapiens
tgcggactccatggc

SEQ ID NO: 6745183 - DNA, 21 bp, Homo sapiens
tgcggactccatggcccttcc

SEQ ID NO: 6745184 - DNA, 13 bp, Homo sapiens
tgcggagaacaaa

SEQ ID NO: 6745185 - DNA, 15 bp, Homo sapiens
tgcggagcacactgg

SEQ ID NO: 6745186 - DNA, 15 bp, Homo sapiens
tgcggagcagcctcc

SEQ ID NO: 6745187 - DNA, 18 bp, Homo sapiens
tgcggagcttctccagcc

SEQ ID NO: 6745188 - DNA, 19 bp, Homo sapiens
tgcggagcttctccagcca

SEQ ID NO: 6745189 - DNA, 23 bp, Homo sapiens
tgcggaggaaggaggacccagga

SEQ ID NO: 6745190 - DNA, 19 bp, Homo sapiens
tgcggaggagctgcctgct

SEQ ID NO: 6745191 - DNA, 13 bp, Homo sapiens
tgcggaggcagga

SEQ ID NO: 6745192 - DNA, 15 bp, Homo sapiens
tgcggagtctcctct

SEQ ID NO: 6745193 - DNA, 15 bp, Homo sapiens
tgcggagtgaagagg

SEQ ID NO: 6745194 - DNA, 20 bp, Homo sapiens
tgcggatactcttggagagt

SEQ ID NO: 6745195 - DNA, 17 bp, Homo sapiens
tgcggatctcagctttg

SEQ ID NO: 6745196 - DNA, 14 bp, Homo sapiens
tgcggatctctgga

SEQ ID NO: 6745197 - DNA, 23 bp, Homo sapiens
tgcggatgataactactgacgaa

SEQ ID NO: 6745198 - DNA, 23 bp, Homo sapiens
tgcggatggacactaatgcagcc

SEQ ID NO: 6745199 - DNA, 16 bp, Homo sapiens
tgcggcaccgcccacc

SEQ ID NO: 6745200 - DNA, 18 bp, Homo sapiens
tgcggcaccgcccaccca

SEQ ID NO: 6745201 - DNA, 19 bp, Homo sapiens
tgcggcaccgcccacccac

SEQ ID NO: 6745202 - DNA, 20 bp, Homo sapiens
tgcggcaccgcccacccaca

SEQ ID NO: 6745203 - DNA, 13 bp, Homo sapiens
tgcggcaggagca

SEQ ID NO: 6745204 - DNA, 16 bp, Homo sapiens
tgcggcaggagcagga

SEQ ID NO: 6745205 - DNA, 21 bp, Homo sapiens
tgcggcaggagcaggaacaga

SEQ ID NO: 6745206 - DNA, 14 bp, Homo sapiens
tgcggcagggaaga

SEQ ID NO: 6745207 - DNA, 14 bp, Homo sapiens
tgcggccacagcac

SEQ ID NO: 6745208 - DNA, 19 bp, Homo sapiens
tgcggcccactttcctgag

SEQ ID NO: 6745209 - DNA, 22 bp, Homo sapiens
tgcggcccactttcctgagctg

SEQ ID NO: 6745210 - DNA, 14 bp, Homo sapiens
tgcggcccagccat

SEQ ID NO: 6745211 - DNA, 15 bp, Homo sapiens
tgcggccccaggagg

SEQ ID NO: 6745212 - DNA, 23 bp, Homo sapiens
tgcggccccctctcggccaggca

SEQ ID NO: 6745213 - DNA, 13 bp, Homo sapiens
tgcggcccctccc

SEQ ID NO: 6745214 - DNA, 18 bp, Homo sapiens
tgcggcccgtgcgcagcc

SEQ ID NO: 6745215 - DNA, 18 bp, Homo sapiens
tgcggccggcctggggcc

SEQ ID NO: 6745216 - DNA, 15 bp, Homo sapiens
tgcggccgggctgcc

SEQ ID NO: 6745217 - DNA, 21 bp, Homo sapiens
tgcggccgtcaccccgccagc

SEQ ID NO: 6745218 - DNA, 17 bp, Homo sapiens
tgcggcctttggcttca

SEQ ID NO: 6745219 - DNA, 19 bp, Homo sapiens
tgcggcctttggcttcacg

SEQ ID NO: 6745220 - DNA, 14 bp, Homo sapiens
tgcggcggtcccag

SEQ ID NO: 6745221 - DNA, 18 bp, Homo sapiens
tgcggcggtcccagctcc

SEQ ID NO: 6745222 - DNA, 18 bp, Homo sapiens
tgcggcgtggagactggc

SEQ ID NO: 6745223 - DNA, 16 bp, Homo sapiens
tgcggctcagccttgc

SEQ ID NO: 6745224 - DNA, 23 bp, Homo sapiens
tgcggctggccatggagaaagct

SEQ ID NO: 6745225 - DNA, 19 bp, Homo sapiens
tgcggcttccgagggcact

SEQ ID NO: 6745226 - DNA, 14 bp, Homo sapiens
tgcggctttctctg

SEQ ID NO: 6745227 - DNA, 18 bp, Homo sapiens
tgcggctttctctgcctc

SEQ ID NO: 6745228 - DNA, 20 bp, Homo sapiens
tgcggctttctctgcctctg

SEQ ID NO: 6745229 - DNA, 23 bp, Homo sapiens
tgcggctttctctgcctctgggc

SEQ ID NO: 6745230 - DNA, 13 bp, Homo sapiens
tgcgggaagctga

SEQ ID NO: 6745231 - DNA, 16 bp, Homo sapiens
tgcgggacagagggtg

SEQ ID NO: 6745232 - DNA, 13 bp, Homo sapiens
tgcgggagccaga

SEQ ID NO: 6745233 - DNA, 14 bp, Homo sapiens
tgcgggagccagac

SEQ ID NO: 6745234 - DNA, 16 bp, Homo sapiens
tgcgggagccagactg

SEQ ID NO: 6745235 - DNA, 21 bp, Homo sapiens
tgcgggagccagactgtccag

SEQ ID NO: 6745236 - DNA, 16 bp, Homo sapiens
tgcgggagctctgtat

SEQ ID NO: 6745237 - DNA, 17 bp, Homo sapiens
tgcgggaggccctggcc

SEQ ID NO: 6745238 - DNA, 17 bp, Homo sapiens
tgcgggagtagttggaa

SEQ ID NO: 6745239 - DNA, 17 bp, Homo sapiens
tgcgggatacagctgag

SEQ ID NO: 6745240 - DNA, 14 bp, Homo sapiens
tgcgggatatttag

SEQ ID NO: 6745241 - DNA, 18 bp, Homo sapiens
tgcgggatggtcctgggg

SEQ ID NO: 6745242 - DNA, 12 bp, Homo sapiens
tgcgggccacag

SEQ ID NO: 6745243 - DNA, 17 bp, Homo sapiens
tgcgggccagggtcctg

SEQ ID NO: 6745244 - DNA, 21 bp, Homo sapiens
tgcgggccaggtctggcgcca

SEQ ID NO: 6745245 - DNA, 14 bp, Homo sapiens
tgcgggcccctggt

SEQ ID NO: 6745246 - DNA, 17 bp, Homo sapiens
tgcgggcctggccctca

SEQ ID NO: 6745247 - DNA, 17 bp, Homo sapiens
tgcgggctcgcccatac

SEQ ID NO: 6745248 - DNA, 16 bp, Homo sapiens
tgcgggctgaggccag

SEQ ID NO: 6745249 - DNA, 14 bp, Homo sapiens
tgcgggctgagggc

SEQ ID NO: 6745250 - DNA, 19 bp, Homo sapiens
tgcgggctgagggcatctc

SEQ ID NO: 6745251 - DNA, 23 bp, Homo sapiens
tgcggggacaggctggaatgagg

SEQ ID NO: 6745252 - DNA, 14 bp, Homo sapiens
tgcggggccccgga

SEQ ID NO: 6745253 - DNA, 17 bp, Homo sapiens
tgcggggcctgtctcag

SEQ ID NO: 6745254 - DNA, 14 bp, Homo sapiens
tgcgggggagccag

SEQ ID NO: 6745255 - DNA, 19 bp, Homo sapiens
tgcgggggagctggaaata

SEQ ID NO: 6745256 - DNA, 20 bp, Homo sapiens
tgcgggggagctggaaataa

SEQ ID NO: 6745257 - DNA, 22 bp, Homo sapiens
tgcgggggttccgtgtccaccc

SEQ ID NO: 6745258 - DNA, 16 bp, Homo sapiens
tgcgggtcacaggagg

SEQ ID NO: 6745259 - DNA, 17 bp, Homo sapiens
tgcgggtcctcagctgc

SEQ ID NO: 6745260 - DNA, 18 bp, Homo sapiens
tgcgggtcctcagctgct

SEQ ID NO: 6745261 - DNA, 20 bp, Homo sapiens
tgcgggtcctcagctgctcc

SEQ ID NO: 6745262 - DNA, 23 bp, Homo sapiens
tgcgggtgaacaaagcagccacg

SEQ ID NO: 6745263 - DNA, 16 bp, Homo sapiens
tgcgggtgagagtaat

SEQ ID NO: 6745264 - DNA, 18 bp, Homo sapiens
tgcgggtgggtatcccac

SEQ ID NO: 6745265 - DNA, 21 bp, Homo sapiens
tgcggtacaggagtcagccat

SEQ ID NO: 6745266 - DNA, 16 bp, Homo sapiens
tgcggtagccagcaca

SEQ ID NO: 6745267 - DNA, 19 bp, Homo sapiens
tgcggtaggtgctggcctc

SEQ ID NO: 6745268 - DNA, 22 bp, Homo sapiens
tgcggtatacattttacatatg

SEQ ID NO: 6745269 - DNA, 19 bp, Homo sapiens
tgcggtcaggctgggcagc

SEQ ID NO: 6745270 - DNA, 14 bp, Homo sapiens
tgcggtctagggaa

SEQ ID NO: 6745271 - DNA, 18 bp, Homo sapiens
tgcggtgacggcggggtg

SEQ ID NO: 6745272 - DNA, 23 bp, Homo sapiens
tgcggtgaggcaggggagtctgc

SEQ ID NO: 6745273 - DNA, 23 bp, Homo sapiens
tgcggtgctatctcccccagccc

SEQ ID NO: 6745274 - DNA, 17 bp, Homo sapiens
tgcggtggtgccagagg

SEQ ID NO: 6745275 - DNA, 20 bp, Homo sapiens
tgcggttataaaaaatggtt

SEQ ID NO: 6745276 - DNA, 16 bp, Homo sapiens
tgcggttgggaggcag

SEQ ID NO: 6745277 - DNA, 21 bp, Homo sapiens
tgcggtttgttggatcttcaa

SEQ ID NO: 6745278 - DNA, 22 bp, Homo sapiens
tgcgtaaatggttttcaacaag

SEQ ID NO: 6745279 - DNA, 17 bp, Homo sapiens
tgcgtaactggctgtgt

SEQ ID NO: 6745280 - DNA, 15 bp, Homo sapiens
tgcgtaatttaatgg

SEQ ID NO: 6745281 - DNA, 15 bp, Homo sapiens
tgcgtacgtttcctg

SEQ ID NO: 6745282 - DNA, 23 bp, Homo sapiens
tgcgtacgtttcctgagaagtgt

SEQ ID NO: 6745283 - DNA, 13 bp, Homo sapiens
tgcgtagaggcta

SEQ ID NO: 6745284 - DNA, 17 bp, Homo sapiens
tgcgtagaggctacagg

SEQ ID NO: 6745285 - DNA, 17 bp, Homo sapiens
tgcgtatatgtgcgtct

SEQ ID NO: 6745286 - DNA, 23 bp, Homo sapiens
tgcgtatatgtgcgtctctcttt

SEQ ID NO: 6745287 - DNA, 12 bp, Homo sapiens
tgcgtattctgt

SEQ ID NO: 6745288 - DNA, 16 bp, Homo sapiens
tgcgtattctgtggcc

SEQ ID NO: 6745289 - DNA, 20 bp, Homo sapiens
tgcgtcaggcacgtctcctg

SEQ ID NO: 6745290 - DNA, 22 bp, Homo sapiens
tgcgtcatggctcaaggattca

SEQ ID NO: 6745291 - DNA, 14 bp, Homo sapiens
tgcgtcatgggccc

SEQ ID NO: 6745292 - DNA, 16 bp, Homo sapiens
tgcgtccaccaggcct

SEQ ID NO: 6745293 - DNA, 17 bp, Homo sapiens
tgcgtccaccaggcctc

SEQ ID NO: 6745294 - DNA, 23 bp, Homo sapiens
tgcgtccaccaggcctcactggc

SEQ ID NO: 6745295 - DNA, 18 bp, Homo sapiens
tgcgtccaccctgagctc

SEQ ID NO: 6745296 - DNA, 18 bp, Homo sapiens
tgcgtcccccagccctca

SEQ ID NO: 6745297 - DNA, 20 bp, Homo sapiens
tgcgtcccccgttgtgcctg

SEQ ID NO: 6745298 - DNA, 18 bp, Homo sapiens
tgcgtccctccgagcttg

SEQ ID NO: 6745299 - DNA, 19 bp, Homo sapiens
tgcgtcctgacgccctgcg

SEQ ID NO: 6745300 - DNA, 13 bp, Homo sapiens
tgcgtcctgcaga

SEQ ID NO: 6745301 - DNA, 14 bp, Homo sapiens
tgcgtcctgcagag

SEQ ID NO: 6745302 - DNA, 19 bp, Homo sapiens
tgcgtcctgcagaggacca

SEQ ID NO: 6745303 - DNA, 15 bp, Homo sapiens
tgcgtcggccctggg

SEQ ID NO: 6745304 - DNA, 17 bp, Homo sapiens
tgcgtctctctttctcc

SEQ ID NO: 6745305 - DNA, 22 bp, Homo sapiens
tgcgtctctctttctccctcac

SEQ ID NO: 6745306 - DNA, 21 bp, Homo sapiens
tgcgtctctggccctcgtggg

SEQ ID NO: 6745307 - DNA, 20 bp, Homo sapiens
tgcgtcttccgcccctgcct

SEQ ID NO: 6745308 - DNA, 15 bp, Homo sapiens
tgcgtcttggtgtaa

SEQ ID NO: 6745309 - DNA, 12 bp, Homo sapiens
tgcgtcttgtga

SEQ ID NO: 6745310 - DNA, 20 bp, Homo sapiens
tgcgtcttgtgaaattgtgt

SEQ ID NO: 6745311 - DNA, 16 bp, Homo sapiens
tgcgtcttttttctct

SEQ ID NO: 6745312 - DNA, 14 bp, Homo sapiens
tgcgtgaaacacac

SEQ ID NO: 6745313 - DNA, 14 bp, Homo sapiens
tgcgtgacaataaa

SEQ ID NO: 6745314 - DNA, 15 bp, Homo sapiens
tgcgtgacactctcc

SEQ ID NO: 6745315 - DNA, 21 bp, Homo sapiens
tgcgtgacactctccttgcag

SEQ ID NO: 6745316 - DNA, 19 bp, Homo sapiens
tgcgtgactattttttaat

SEQ ID NO: 6745317 - DNA, 22 bp, Homo sapiens
tgcgtgccctgacccctgcacc

SEQ ID NO: 6745318 - DNA, 19 bp, Homo sapiens
tgcgtgccgtgtgagtgtg

SEQ ID NO: 6745319 - DNA, 13 bp, Homo sapiens
tgcgtgcgtgtgc

SEQ ID NO: 6745320 - DNA, 12 bp, Homo sapiens
tgcgtgctggga

SEQ ID NO: 6745321 - DNA, 21 bp, Homo sapiens
tgcgtgctttatttatggctt

SEQ ID NO: 6745322 - DNA, 19 bp, Homo sapiens
tgcgtggaagtgttcctgt

SEQ ID NO: 6745323 - DNA, 21 bp, Homo sapiens
tgcgtggaagtgttcctgtct

SEQ ID NO: 6745324 - DNA, 16 bp, Homo sapiens
tgcgtggactctgcac

SEQ ID NO: 6745325 - DNA, 13 bp, Homo sapiens
tgcgtggatcaag

SEQ ID NO: 6745326 - DNA, 17 bp, Homo sapiens
tgcgtggcacatctaaa

SEQ ID NO: 6745327 - DNA, 17 bp, Homo sapiens
tgcgtggcctggggctg

SEQ ID NO: 6745328 - DNA, 17 bp, Homo sapiens
tgcgtggctgacccccc

SEQ ID NO: 6745329 - DNA, 14 bp, Homo sapiens
tgcgtggctgtggc

SEQ ID NO: 6745330 - DNA, 15 bp, Homo sapiens
tgcgtgggaggcaga

SEQ ID NO: 6745331 - DNA, 20 bp, Homo sapiens
tgcgtggggcaggaaagcat

SEQ ID NO: 6745332 - DNA, 21 bp, Homo sapiens
tgcgtgggtggggagggaggt

SEQ ID NO: 6745333 - DNA, 22 bp, Homo sapiens
tgctcaataaacttgtgcctcc

SEQ ID NO: 6745334 - DNA, 20 bp, Homo sapiens
tgctcaataaatatttgttt

SEQ ID NO: 6745335 - DNA, 22 bp, Homo sapiens
tgctcaatacctggcctcattt

SEQ ID NO: 6745336 - DNA, 22 bp, Homo sapiens
tgctcaatctctgttgcacctg

SEQ ID NO: 6745337 - DNA, 18 bp, Homo sapiens
tgctcaatgactctctgg

SEQ ID NO: 6745338 - DNA, 16 bp, Homo sapiens
tgctcaatgtgctgtt

SEQ ID NO: 6745339 - DNA, 17 bp, Homo sapiens
tgctcaatgtgctgttg

SEQ ID NO: 6745340 - DNA, 20 bp, Homo sapiens
tgctcaatgtgctgttgatt

SEQ ID NO: 6745341 - DNA, 22 bp, Homo sapiens
tgctcaatgtgctgttgattct

SEQ ID NO: 6745342 - DNA, 13 bp, Homo sapiens
tgctcacacaatc

SEQ ID NO: 6745343 - DNA, 14 bp, Homo sapiens
tgctcacacaatca

SEQ ID NO: 6745344 - DNA, 15 bp, Homo sapiens
tgctcacaccccatt

SEQ ID NO: 6745345 - DNA, 18 bp, Homo sapiens
tgctcacactacttgaga

SEQ ID NO: 6745346 - DNA, 16 bp, Homo sapiens
tgctcacatgtctttg

SEQ ID NO: 6745347 - DNA, 18 bp, Homo sapiens
tgctcacattccctctca

SEQ ID NO: 6745348 - DNA, 19 bp, Homo sapiens
tgctcaccaagctgttcca

SEQ ID NO: 6745349 - DNA, 15 bp, Homo sapiens
tgctcaccacctgcc

SEQ ID NO: 6745350 - DNA, 13 bp, Homo sapiens
tgctcaccagccc

SEQ ID NO: 6745351 - DNA, 16 bp, Homo sapiens
tgctcaccagccctgc

SEQ ID NO: 6745352 - DNA, 17 bp, Homo sapiens
tgctcaccagccctgca

SEQ ID NO: 6745353 - DNA, 23 bp, Homo sapiens
tgctcaccagtaaaagataacct

SEQ ID NO: 6745354 - DNA, 17 bp, Homo sapiens
tgctcaccatgcttcca

SEQ ID NO: 6745355 - DNA, 21 bp, Homo sapiens
tgctcacccaggacctctggg

SEQ ID NO: 6745356 - DNA, 19 bp, Homo sapiens
tgctcacccagtgccctct

SEQ ID NO: 6745357 - DNA, 20 bp, Homo sapiens
tgctcaccgactcacctgcg

SEQ ID NO: 6745358 - DNA, 22 bp, Homo sapiens
tgctcaccgactcacctgcgca

SEQ ID NO: 6745359 - DNA, 19 bp, Homo sapiens
tgctcaccgcccatcaggg

SEQ ID NO: 6745360 - DNA, 12 bp, Homo sapiens
tgctcacctctg

SEQ ID NO: 6745361 - DNA, 15 bp, Homo sapiens
tgctcacgactcttc

SEQ ID NO: 6745362 - DNA, 18 bp, Homo sapiens
tgctcacgactcttcctg

SEQ ID NO: 6745363 - DNA, 19 bp, Homo sapiens
tgctcacgactcttcctgc

SEQ ID NO: 6745364 - DNA, 20 bp, Homo sapiens
tgctcacgactcttcctgca

SEQ ID NO: 6745365 - DNA, 21 bp, Homo sapiens
tgctcacgactcttcctgcaa

SEQ ID NO: 6745366 - DNA, 14 bp, Homo sapiens
tgctcacgtctctg

SEQ ID NO: 6745367 - DNA, 15 bp, Homo sapiens
tgctcacgtctctgc

SEQ ID NO: 6745368 - DNA, 16 bp, Homo sapiens
tgctcacgtctctgcc

SEQ ID NO: 6745369 - DNA, 16 bp, Homo sapiens
tgctcacgtctgtgag

SEQ ID NO: 6745370 - DNA, 17 bp, Homo sapiens
tgctcacgtctgtgagt

SEQ ID NO: 6745371 - DNA, 22 bp, Homo sapiens
tgctcacgtctgtgagtctgtc

SEQ ID NO: 6745372 - DNA, 13 bp, Homo sapiens
tgctcactacctc

SEQ ID NO: 6745373 - DNA, 14 bp, Homo sapiens
tgctcactcaggac

SEQ ID NO: 6745374 - DNA, 16 bp, Homo sapiens
tgctcactcaggactt

SEQ ID NO: 6745375 - DNA, 22 bp, Homo sapiens
tgctcactcccaagggacagca

SEQ ID NO: 6745376 - DNA, 21 bp, Homo sapiens
tgctcactccctaaagccctc

SEQ ID NO: 6745377 - DNA, 22 bp, Homo sapiens
tgctcactccctaaagccctct

SEQ ID NO: 6745378 - DNA, 22 bp, Homo sapiens
tgctcactcggacgacgccctg

SEQ ID NO: 6745379 - DNA, 12 bp, Homo sapiens
tgctcactgtgt

SEQ ID NO: 6745380 - DNA, 14 bp, Homo sapiens
tgctcactgttcta

SEQ ID NO: 6745381 - DNA, 16 bp, Homo sapiens
tgctcactttccaccc

SEQ ID NO: 6745382 - DNA, 13 bp, Homo sapiens
tgctcagaacaca

SEQ ID NO: 6745383 - DNA, 17 bp, Homo sapiens
tgctcagaacttgctgc

SEQ ID NO: 6745384 - DNA, 14 bp, Homo sapiens
tgctcagaagccag

SEQ ID NO: 6745385 - DNA, 23 bp, Homo sapiens
tgctcagaagccagtctgcgtca

SEQ ID NO: 6745386 - DNA, 16 bp, Homo sapiens
tgctcagaatgccgca

SEQ ID NO: 6745387 - DNA, 13 bp, Homo sapiens
tgctcagacagaa

SEQ ID NO: 6745388 - DNA, 14 bp, Homo sapiens
tgctcagaccagct

SEQ ID NO: 6745389 - DNA, 21 bp, Homo sapiens
tgctcagacgagacaccctaa

SEQ ID NO: 6745390 - DNA, 17 bp, Homo sapiens
tgctcagagcagtgttt

SEQ ID NO: 6745391 - DNA, 17 bp, Homo sapiens
tgctcagagctttaaaa

SEQ ID NO: 6745392 - DNA, 20 bp, Homo sapiens
tgctcagagctttaaaagta

SEQ ID NO: 6745393 - DNA, 19 bp, Homo sapiens
tgctcagagtctatcaaca

SEQ ID NO: 6745394 - DNA, 22 bp, Homo sapiens
tgctcagagtgaagagtgaaga

SEQ ID NO: 6745395 - DNA, 15 bp, Homo sapiens
tgctcagatgctggt

SEQ ID NO: 6745396 - DNA, 17 bp, Homo sapiens
tgctcagcagccagtct

SEQ ID NO: 6745397 - DNA, 18 bp, Homo sapiens
tgctcagcagccagtctc

SEQ ID NO: 6745398 - DNA, 19 bp, Homo sapiens
tgctcagcagccagtctca

SEQ ID NO: 6745399 - DNA, 20 bp, Homo sapiens
tgctcagcagccagtctcag

SEQ ID NO: 6745400 - DNA, 21 bp, Homo sapiens
tgctcagcagccagtctcaga

SEQ ID NO: 6745401 - DNA, 23 bp, Homo sapiens
tgctcagcagccagtctcagaga

SEQ ID NO: 6745402 - DNA, 14 bp, Homo sapiens
tgctcagcagcccc

SEQ ID NO: 6745403 - DNA, 15 bp, Homo sapiens
tgctcagcagcccca

SEQ ID NO: 6745404 - DNA, 15 bp, Homo sapiens
tgctcagcagtgaga

SEQ ID NO: 6745405 - DNA, 19 bp, Homo sapiens
tgctcagccaaatttcctg

SEQ ID NO: 6745406 - DNA, 14 bp, Homo sapiens
tgctcagcccaggc

SEQ ID NO: 6745407 - DNA, 18 bp, Homo sapiens
tgctcagcccaggcacaa

SEQ ID NO: 6745408 - DNA, 13 bp, Homo sapiens
tgctcagcccatc

SEQ ID NO: 6745409 - DNA, 21 bp, Homo sapiens
tgctcagcccatcccctgcct

SEQ ID NO: 6745410 - DNA, 14 bp, Homo sapiens
tgctcagccccaga

SEQ ID NO: 6745411 - DNA, 13 bp, Homo sapiens
tgctcagccctga

SEQ ID NO: 6745412 - DNA, 14 bp, Homo sapiens
tgctcagccctgga

SEQ ID NO: 6745413 - DNA, 21 bp, Homo sapiens
tgctcagccctggaggtgcca

SEQ ID NO: 6745414 - DNA, 19 bp, Homo sapiens
tgctcagcccttcctagaa

SEQ ID NO: 6745415 - DNA, 22 bp, Homo sapiens
tgctcagcgcttaaaaaaacaa

SEQ ID NO: 6745416 - DNA, 12 bp, Homo sapiens
tgctcagctcct

SEQ ID NO: 6745417 - DNA, 19 bp, Homo sapiens
tgctcagctcctacctctg

SEQ ID NO: 6745418 - DNA, 18 bp, Homo sapiens
tgctcagctctgggccat

SEQ ID NO: 6745419 - DNA, 15 bp, Homo sapiens
tgctcagctgcgccc

SEQ ID NO: 6745420 - DNA, 12 bp, Homo sapiens
tgctcagctggc

SEQ ID NO: 6745421 - DNA, 15 bp, Homo sapiens
tgctcagctggccgg

SEQ ID NO: 6745422 - DNA, 16 bp, Homo sapiens
tgctcagctgtcaagg

SEQ ID NO: 6745423 - DNA, 17 bp, Homo sapiens
tgctcagcttctccaac

SEQ ID NO: 6745424 - DNA, 17 bp, Homo sapiens
tgctcaggactcagaag

SEQ ID NO: 6745425 - DNA, 15 bp, Homo sapiens
tgctcaggagccctg

SEQ ID NO: 6745426 - DNA, 12 bp, Homo sapiens
tgctcaggcctc

SEQ ID NO: 6745427 - DNA, 14 bp, Homo sapiens
tgctcaggcctcac

SEQ ID NO: 6745428 - DNA, 17 bp, Homo sapiens
tgctcaggcctcacctg

SEQ ID NO: 6745429 - DNA, 13 bp, Homo sapiens
tgctcaggcctcc

SEQ ID NO: 6745430 - DNA, 14 bp, Homo sapiens
tgctcaggcctccc

SEQ ID NO: 6745431 - DNA, 22 bp, Homo sapiens
tgctcaggctgcagctggacag

SEQ ID NO: 6745432 - DNA, 18 bp, Homo sapiens
tgctcaggcttggcggag

SEQ ID NO: 6745433 - DNA, 12 bp, Homo sapiens
tgctcagggaaa

SEQ ID NO: 6745434 - DNA, 22 bp, Homo sapiens
tgctcagggaaaagcagctctc

SEQ ID NO: 6745435 - DNA, 17 bp, Homo sapiens
tgctcagggaaatggcc

SEQ ID NO: 6745436 - DNA, 23 bp, Homo sapiens
tgctcagggactcatctttccct

SEQ ID NO: 6745437 - DNA, 17 bp, Homo sapiens
tgctcagggcatgctta

SEQ ID NO: 6745438 - DNA, 14 bp, Homo sapiens
tgctcagggctgac

SEQ ID NO: 6745439 - DNA, 20 bp, Homo sapiens
tgctcaggggccctggagca

SEQ ID NO: 6745440 - DNA, 17 bp, Homo sapiens
tgctcagggtcactgaa

SEQ ID NO: 6745441 - DNA, 22 bp, Homo sapiens
tgctcaggtacagagaaggaat

SEQ ID NO: 6745442 - DNA, 14 bp, Homo sapiens
tgctcagtaatata

SEQ ID NO: 6745443 - DNA, 17 bp, Homo sapiens
tgctcagtaatttgagg

SEQ ID NO: 6745444 - DNA, 22 bp, Homo sapiens
tgctcagtattgagacactgtc

SEQ ID NO: 6745445 - DNA, 15 bp, Homo sapiens
tgctcagtcgccctg

SEQ ID NO: 6745446 - DNA, 16 bp, Homo sapiens
tgctcagtctccttgg

SEQ ID NO: 6745447 - DNA, 16 bp, Homo sapiens
tgctcagtgcctcctg

SEQ ID NO: 6745448 - DNA, 17 bp, Homo sapiens
tgctcagtgcctcctgg

SEQ ID NO: 6745449 - DNA, 16 bp, Homo sapiens
tgctcagtgccttttg

SEQ ID NO: 6745450 - DNA, 17 bp, Homo sapiens
tgctcagtgccttttgg

SEQ ID NO: 6745451 - DNA, 13 bp, Homo sapiens
tgctcagtgcttg

SEQ ID NO: 6745452 - DNA, 18 bp, Homo sapiens
tgctcagtgcttgggctc

SEQ ID NO: 6745453 - DNA, 21 bp, Homo sapiens
tgctcagtgcttgggctccac

SEQ ID NO: 6745454 - DNA, 21 bp, Homo sapiens
tgctcagtgggtaaaattaga

SEQ ID NO: 6745455 - DNA, 18 bp, Homo sapiens
tgctcagttcagaatcac

SEQ ID NO: 6745456 - DNA, 23 bp, Homo sapiens
tgctcagttcagaatcacttctg

SEQ ID NO: 6745457 - DNA, 19 bp, Homo sapiens
tgctcagttgctaaacact

SEQ ID NO: 6745458 - DNA, 22 bp, Homo sapiens
tgctcagttgtagaatgtattg

SEQ ID NO: 6745459 - DNA, 14 bp, Homo sapiens
tgctcagtttctga

SEQ ID NO: 6745460 - DNA, 22 bp, Homo sapiens
tgctcataaagatgttaaatgg

SEQ ID NO: 6745461 - DNA, 16 bp, Homo sapiens
tgctcataacatcttt

SEQ ID NO: 6745462 - DNA, 18 bp, Homo sapiens
tgctcataacatctttga

SEQ ID NO: 6745463 - DNA, 19 bp, Homo sapiens
tgctcataacatctttgaa

SEQ ID NO: 6745464 - DNA, 14 bp, Homo sapiens
tgctcataacggat

SEQ ID NO: 6745465 - DNA, 16 bp, Homo sapiens
tgctcataacggatca

SEQ ID NO: 6745466 - DNA, 17 bp, Homo sapiens
tgctcataagtaaatgt

SEQ ID NO: 6745467 - DNA, 16 bp, Homo sapiens
tgctcataggacctgc

SEQ ID NO: 6745468 - DNA, 22 bp, Homo sapiens
tgctcatcattccttgagaaaa

SEQ ID NO: 6745469 - DNA, 17 bp, Homo sapiens
tgctcatcattctctgt

SEQ ID NO: 6745470 - DNA, 20 bp, Homo sapiens
tgctcatcattctctgtctc

SEQ ID NO: 6745471 - DNA, 18 bp, Homo sapiens
tgctcatcggagactgcc

SEQ ID NO: 6745472 - DNA, 16 bp, Homo sapiens
tgctcatctacacata

SEQ ID NO: 6745473 - DNA, 20 bp, Homo sapiens
tgctcatctacacatataaa

SEQ ID NO: 6745474 - DNA, 11 bp, Homo sapiens
tgctcatctga

SEQ ID NO: 6745475 - DNA, 16 bp, Homo sapiens
tgctcatctgctggtc

SEQ ID NO: 6745476 - DNA, 16 bp, Homo sapiens
tgctcatgagctcctg

SEQ ID NO: 6745477 - DNA, 17 bp, Homo sapiens
tgctcatgagctcctga

SEQ ID NO: 6745478 - DNA, 21 bp, Homo sapiens
tgctcatgagctcctgatcag

SEQ ID NO: 6745479 - DNA, 15 bp, Homo sapiens
tgctcatgggaagaa

SEQ ID NO: 6745480 - DNA, 16 bp, Homo sapiens
tgctcatgggtggctg

SEQ ID NO: 6745481 - DNA, 16 bp, Homo sapiens
tgctcatgttggccaa

SEQ ID NO: 6745482 - DNA, 21 bp, Homo sapiens
tgctcattacagttctttcct

SEQ ID NO: 6745483 - DNA, 17 bp, Homo sapiens
tgctcattatgccactt

SEQ ID NO: 6745484 - DNA, 18 bp, Homo sapiens
tgctcattcatattcctg

SEQ ID NO: 6745485 - DNA, 20 bp, Homo sapiens
tgctcattcatattcctgcc

SEQ ID NO: 6745486 - DNA, 23 bp, Homo sapiens
tgctcattcatattcctgccttt

SEQ ID NO: 6745487 - DNA, 22 bp, Homo sapiens
tgctcattccgagggtgaaaca

SEQ ID NO: 6745488 - DNA, 17 bp, Homo sapiens
tgctcattcttcagttc

SEQ ID NO: 6745489 - DNA, 22 bp, Homo sapiens
tgctcattcttgaggagcatta

SEQ ID NO: 6745490 - DNA, 18 bp, Homo sapiens
tgctcatttgaaaatgga

SEQ ID NO: 6745491 - DNA, 16 bp, Homo sapiens
tgctcattttctggtt

SEQ ID NO: 6745492 - DNA, 14 bp, Homo sapiens
tgctccaaatttaa

SEQ ID NO: 6745493 - DNA, 14 bp, Homo sapiens
tgctccaactccat

SEQ ID NO: 6745494 - DNA, 23 bp, Homo sapiens
tgctccaactccatactccactc

SEQ ID NO: 6745495 - DNA, 14 bp, Homo sapiens
tgctccaagattct

SEQ ID NO: 6745496 - DNA, 15 bp, Homo sapiens
tgctccaagattcta

SEQ ID NO: 6745497 - DNA, 16 bp, Homo sapiens
tgctccaagattctag

SEQ ID NO: 6745498 - DNA, 17 bp, Homo sapiens
tgctccaagattctaga

SEQ ID NO: 6745499 - DNA, 19 bp, Homo sapiens
tgctccaagggacaggtgg

SEQ ID NO: 6745500 - DNA, 22 bp, Homo sapiens
tgctccaagtggtgggaatcag

SEQ ID NO: 6745501 - DNA, 16 bp, Homo sapiens
tgctccaatctgtcac

SEQ ID NO: 6745502 - DNA, 18 bp, Homo sapiens
tgctccaatgactgagca

SEQ ID NO: 6745503 - DNA, 17 bp, Homo sapiens
tgctccacactcagaaa

SEQ ID NO: 6745504 - DNA, 13 bp, Homo sapiens
tgctccacagtgt

SEQ ID NO: 6745505 - DNA, 14 bp, Homo sapiens
tgctccaccacatc

SEQ ID NO: 6745506 - DNA, 15 bp, Homo sapiens
tgctccaccagcagc

SEQ ID NO: 6745507 - DNA, 18 bp, Homo sapiens
tgctccaccagcagcatg

SEQ ID NO: 6745508 - DNA, 13 bp, Homo sapiens
tgctccaccctcc

SEQ ID NO: 6745509 - DNA, 18 bp, Homo sapiens
tgctccacccttggcctg

SEQ ID NO: 6745510 - DNA, 19 bp, Homo sapiens
tgctccacccttggcctgt

SEQ ID NO: 6745511 - DNA, 21 bp, Homo sapiens
tgctgaagattcagtttaaga

SEQ ID NO: 6745512 - DNA, 20 bp, Homo sapiens
tgctgaagcttattaatgct

SEQ ID NO: 6745513 - DNA, 23 bp, Homo sapiens
tgctgaagcttattaatgctaag

SEQ ID NO: 6745514 - DNA, 13 bp, Homo sapiens
tgctgaaggagaa

SEQ ID NO: 6745515 - DNA, 20 bp, Homo sapiens
tgctgaaggattatatgtat

SEQ ID NO: 6745516 - DNA, 13 bp, Homo sapiens
tgctgaagggacc

SEQ ID NO: 6745517 - DNA, 14 bp, Homo sapiens
tgctgaagggaggg

SEQ ID NO: 6745518 - DNA, 17 bp, Homo sapiens
tgctgaaggtccaggct

SEQ ID NO: 6745519 - DNA, 19 bp, Homo sapiens
tgctgaagtacagtcccag

SEQ ID NO: 6745520 - DNA, 21 bp, Homo sapiens
tgctgaataggcgatcacaac

SEQ ID NO: 6745521 - DNA, 14 bp, Homo sapiens
tgctgaatatctgt

SEQ ID NO: 6745522 - DNA, 15 bp, Homo sapiens
tgctgaatgcaggga

SEQ ID NO: 6745523 - DNA, 23 bp, Homo sapiens
tgctgaatgccgcgatgggtcag

SEQ ID NO: 6745524 - DNA, 18 bp, Homo sapiens
tgctgaatggttttcaaa

SEQ ID NO: 6745525 - DNA, 22 bp, Homo sapiens
tgctgaatggttttcaaaataa

SEQ ID NO: 6745526 - DNA, 17 bp, Homo sapiens
tgctgaatgtaaaagaa

SEQ ID NO: 6745527 - DNA, 20 bp, Homo sapiens
tgctgaatgtaaaagaaaat

SEQ ID NO: 6745528 - DNA, 14 bp, Homo sapiens
tgctgaattatttt

SEQ ID NO: 6745529 - DNA, 13 bp, Homo sapiens
tgctgaattcctt

SEQ ID NO: 6745530 - DNA, 20 bp, Homo sapiens
tgctgaatttattgcctgga

SEQ ID NO: 6745531 - DNA, 22 bp, Homo sapiens
tgctgaattttcacatgaacat

SEQ ID NO: 6745532 - DNA, 23 bp, Homo sapiens
tgctgaattttcacatgaacata

SEQ ID NO: 6745533 - DNA, 19 bp, Homo sapiens
tgctgacaacttagctcag

SEQ ID NO: 6745534 - DNA, 17 bp, Homo sapiens
tgctgacaataaagata

SEQ ID NO: 6745535 - DNA, 19 bp, Homo sapiens
tgctgacaatgctgccatg

SEQ ID NO: 6745536 - DNA, 21 bp, Homo sapiens
tgctgacactgtgaccctggg

SEQ ID NO: 6745537 - DNA, 14 bp, Homo sapiens
tgctgacagacact

SEQ ID NO: 6745538 - DNA, 22 bp, Homo sapiens
tgctgacagacactaactttgt

SEQ ID NO: 6745539 - DNA, 19 bp, Homo sapiens
tgctgacagagccctatct

SEQ ID NO: 6745540 - DNA, 14 bp, Homo sapiens
tgctgacagctctt

SEQ ID NO: 6745541 - DNA, 14 bp, Homo sapiens
tgctgacagctgct

SEQ ID NO: 6745542 - DNA, 18 bp, Homo sapiens
tgctgacagctgctccta

SEQ ID NO: 6745543 - DNA, 21 bp, Homo sapiens
tgctgacaggtgatgctctgg

SEQ ID NO: 6745544 - DNA, 13 bp, Homo sapiens
tgctgacatcaga

SEQ ID NO: 6745545 - DNA, 14 bp, Homo sapiens
tgctgacatcattt

SEQ ID NO: 6745546 - DNA, 20 bp, Homo sapiens
tgctgacatggctctggact

SEQ ID NO: 6745547 - DNA, 19 bp, Homo sapiens
tgctgacatggctttgctt

SEQ ID NO: 6745548 - DNA, 23 bp, Homo sapiens
tgctgacccaacagcctctgtgg

SEQ ID NO: 6745549 - DNA, 13 bp, Homo sapiens
tgctgacccacca

SEQ ID NO: 6745550 - DNA, 13 bp, Homo sapiens
tgctgacccagga

SEQ ID NO: 6745551 - DNA, 16 bp, Homo sapiens
tgctgacccaggaata

SEQ ID NO: 6745552 - DNA, 23 bp, Homo sapiens
tgctgacccaggaatagtggaca

SEQ ID NO: 6745553 - DNA, 16 bp, Homo sapiens
tgctgaccccaggaag

SEQ ID NO: 6745554 - DNA, 17 bp, Homo sapiens
tgctgaccccaggaagt

SEQ ID NO: 6745555 - DNA, 23 bp, Homo sapiens
tgctgaccccaggaagtgggaga

SEQ ID NO: 6745556 - DNA, 18 bp, Homo sapiens
tgctgaccccaggtcagc

SEQ ID NO: 6745557 - DNA, 16 bp, Homo sapiens
tgctgacccctgtgtg

SEQ ID NO: 6745558 - DNA, 13 bp, Homo sapiens
tgctgaccctccc

SEQ ID NO: 6745559 - DNA, 17 bp, Homo sapiens
tgctgaccctccccaaa

SEQ ID NO: 6745560 - DNA, 18 bp, Homo sapiens
tgctgacctcacctggtc

SEQ ID NO: 6745561 - DNA, 14 bp, Homo sapiens
tgctgaccttggag

SEQ ID NO: 6745562 - DNA, 13 bp, Homo sapiens
tgctgactgaaca

SEQ ID NO: 6745563 - DNA, 14 bp, Homo sapiens
tgctgactgaacat

SEQ ID NO: 6745564 - DNA, 15 bp, Homo sapiens
tgctgactgaggcct

SEQ ID NO: 6745565 - DNA, 18 bp, Homo sapiens
tgctgactgtttcattca

SEQ ID NO: 6745566 - DNA, 15 bp, Homo sapiens
tgctgacttagaatc

SEQ ID NO: 6745567 - DNA, 15 bp, Homo sapiens
tgctgacttcccaag

SEQ ID NO: 6745568 - DNA, 21 bp, Homo sapiens
tgctgacttcccaagccctgg

SEQ ID NO: 6745569 - DNA, 14 bp, Homo sapiens
tgctgacttctgag

SEQ ID NO: 6745570 - DNA, 15 bp, Homo sapiens
tgctgagaaaacatg

SEQ ID NO: 6745571 - DNA, 12 bp, Homo sapiens
tgctgagaaatg

SEQ ID NO: 6745572 - DNA, 15 bp, Homo sapiens
tgctgagaaatgggg

SEQ ID NO: 6745573 - DNA, 17 bp, Homo sapiens
tgctgagaacctggcct

SEQ ID NO: 6745574 - DNA, 10 bp, Homo sapiens
tgctgagact

SEQ ID NO: 6745575 - DNA, 23 bp, Homo sapiens
tgctgagagaaatatggaactta

SEQ ID NO: 6745576 - DNA, 15 bp, Homo sapiens
tgctgagagacccaa

SEQ ID NO: 6745577 - DNA, 22 bp, Homo sapiens
tgctgagagacccaaggaggaa

SEQ ID NO: 6745578 - DNA, 21 bp, Homo sapiens
tgctgagagacggtgggaaaa

SEQ ID NO: 6745579 - DNA, 17 bp, Homo sapiens
tgctgagagcccccacc

SEQ ID NO: 6745580 - DNA, 19 bp, Homo sapiens
tgctgagatacatacagaa

SEQ ID NO: 6745581 - DNA, 21 bp, Homo sapiens
tgctgagatgaggaggggagc

SEQ ID NO: 6745582 - DNA, 20 bp, Homo sapiens
tgctgagatgtttagtagct

SEQ ID NO: 6745583 - DNA, 19 bp, Homo sapiens
tgctgagattgcagatgtg

SEQ ID NO: 6745584 - DNA, 20 bp, Homo sapiens
tgctgagcacacaacaggct

SEQ ID NO: 6745585 - DNA, 17 bp, Homo sapiens
tgctgagcaccctctcc

SEQ ID NO: 6745586 - DNA, 18 bp, Homo sapiens
tgctgagcctcacagcag

SEQ ID NO: 6745587 - DNA, 20 bp, Homo sapiens
tgctgagcctctgctcccca

SEQ ID NO: 6745588 - DNA, 12 bp, Homo sapiens
tgctgagcctgc

SEQ ID NO: 6745589 - DNA, 23 bp, Homo sapiens
tgctgagcctgtaaaataaaagg

SEQ ID NO: 6745590 - DNA, 13 bp, Homo sapiens
tgctgagctctga

SEQ ID NO: 6745591 - DNA, 14 bp, Homo sapiens
tgctgagctctgag

SEQ ID NO: 6745592 - DNA, 17 bp, Homo sapiens
tgctgagctgaagaaat

SEQ ID NO: 6745593 - DNA, 11 bp, Homo sapiens
tgctgagctgc

SEQ ID NO: 6745594 - DNA, 12 bp, Homo sapiens
tgctgagctggc

SEQ ID NO: 6745595 - DNA, 19 bp, Homo sapiens
tgctgagctgggcccagcc

SEQ ID NO: 6745596 - DNA, 14 bp, Homo sapiens
tgctgagcttagcc

SEQ ID NO: 6745597 - DNA, 15 bp, Homo sapiens
tgctgagcttagcct

SEQ ID NO: 6745598 - DNA, 21 bp, Homo sapiens
tgctgagcttagccttgtgcc

SEQ ID NO: 6745599 - DNA, 23 bp, Homo sapiens
tgctgagcttgtcttttctgctg

SEQ ID NO: 6745600 - DNA, 17 bp, Homo sapiens
tgctgaggactccctcc

SEQ ID NO: 6745601 - DNA, 18 bp, Homo sapiens
tgctgaggactccctcca

SEQ ID NO: 6745602 - DNA, 18 bp, Homo sapiens
tgctgaggagtctgagga

SEQ ID NO: 6745603 - DNA, 19 bp, Homo sapiens
tgctgaggatacagctctt

SEQ ID NO: 6745604 - DNA, 20 bp, Homo sapiens
tgctgaggatataagctttt

SEQ ID NO: 6745605 - DNA, 12 bp, Homo sapiens
tgctgaggcacc

SEQ ID NO: 6745606 - DNA, 13 bp, Homo sapiens
tgctgaggcaccg

SEQ ID NO: 6745607 - DNA, 14 bp, Homo sapiens
tgctgaggccaccc

SEQ ID NO: 6745608 - DNA, 13 bp, Homo sapiens
tgctgaggccagg

SEQ ID NO: 6745609 - DNA, 15 bp, Homo sapiens
tgctgaggcccagtg

SEQ ID NO: 6745610 - DNA, 14 bp, Homo sapiens
tgctgaggcctggg

SEQ ID NO: 6745611 - DNA, 17 bp, Homo sapiens
tgctgaggcctgggccg

SEQ ID NO: 6745612 - DNA, 12 bp, Homo sapiens
tgctgaggcctt

SEQ ID NO: 6745613 - DNA, 13 bp, Homo sapiens
tgctgaggccttc

SEQ ID NO: 6745614 - DNA, 19 bp, Homo sapiens
tgctgagggaccagccaag

SEQ ID NO: 6745615 - DNA, 20 bp, Homo sapiens
tgctgagggaccagccaaga

SEQ ID NO: 6745616 - DNA, 17 bp, Homo sapiens
tgctgaggggcactctc

SEQ ID NO: 6745617 - DNA, 19 bp, Homo sapiens
tgctgagggggctctttcc

SEQ ID NO: 6745618 - DNA, 21 bp, Homo sapiens
tgctgagggggctctttccct

SEQ ID NO: 6745619 - DNA, 12 bp, Homo sapiens
tgctgagggtcc

SEQ ID NO: 6745620 - DNA, 23 bp, Homo sapiens
tgctgagggtgtttcttcctgca

SEQ ID NO: 6745621 - DNA, 16 bp, Homo sapiens
tgctgaggttgggaag

SEQ ID NO: 6745622 - DNA, 20 bp, Homo sapiens
tgctgaggttttgaataaaa

SEQ ID NO: 6745623 - DNA, 21 bp, Homo sapiens
tgctgagtcatctgttagggc

SEQ ID NO: 6745624 - DNA, 18 bp, Homo sapiens
tgctgagtcccaggctga

SEQ ID NO: 6745625 - DNA, 16 bp, Homo sapiens
tgctgagtctcccaag

SEQ ID NO: 6745626 - DNA, 21 bp, Homo sapiens
tgctgagtctgaaggctgggt

SEQ ID NO: 6745627 - DNA, 19 bp, Homo sapiens
tgctgagtctgtgaataaa

SEQ ID NO: 6745628 - DNA, 17 bp, Homo sapiens
tgctgagtgaaggaaat

SEQ ID NO: 6745629 - DNA, 14 bp, Homo sapiens
tgctgagtgctatg

SEQ ID NO: 6745630 - DNA, 14 bp, Homo sapiens
tgctgagtgctggg

SEQ ID NO: 6745631 - DNA, 17 bp, Homo sapiens
tgctgagtgctgggcac

SEQ ID NO: 6745632 - DNA, 23 bp, Homo sapiens
tgctgagtggcgcaaggccgagc

SEQ ID NO: 6745633 - DNA, 17 bp, Homo sapiens
tgctgagtggtccacat

SEQ ID NO: 6745634 - DNA, 23 bp, Homo sapiens
tgctgagtgtacagagtggaata

SEQ ID NO: 6745635 - DNA, 16 bp, Homo sapiens
tgctgataatcatttt

SEQ ID NO: 6745636 - DNA, 14 bp, Homo sapiens
tgctgataattgtg

SEQ ID NO: 6745637 - DNA, 15 bp, Homo sapiens
tgctgataattgtgt

SEQ ID NO: 6745638 - DNA, 19 bp, Homo sapiens
tgctgatagctaagtgagt

SEQ ID NO: 6745639 - DNA, 15 bp, Homo sapiens
tgctgatattttctc

SEQ ID NO: 6745640 - DNA, 18 bp, Homo sapiens
tgctgatattttctctag

SEQ ID NO: 6745641 - DNA, 18 bp, Homo sapiens
tgctgatcccggccggcc

SEQ ID NO: 6745642 - DNA, 20 bp, Homo sapiens
tgctgatccggctgctcctc

SEQ ID NO: 6745643 - DNA, 16 bp, Homo sapiens
tgctgatcctaagaat

SEQ ID NO: 6745644 - DNA, 14 bp, Homo sapiens
tgctgatcctgctg

SEQ ID NO: 6745645 - DNA, 15 bp, Homo sapiens
tgctgatcgtagaaa

SEQ ID NO: 6745646 - DNA, 19 bp, Homo sapiens
tgctgatcgtagaaaattt

SEQ ID NO: 6745647 - DNA, 14 bp, Homo sapiens
tgctgatctctgta

SEQ ID NO: 6745648 - DNA, 15 bp, Homo sapiens
tgctgatcttttaaa

SEQ ID NO: 6745649 - DNA, 14 bp, Homo sapiens
tgctgatgaatcac

SEQ ID NO: 6745650 - DNA, 20 bp, Homo sapiens
tgctgatgattttgcaaaat

SEQ ID NO: 6745651 - DNA, 16 bp, Homo sapiens
tgctgatggagggagg

SEQ ID NO: 6745652 - DNA, 14 bp, Homo sapiens
tgctgatggccctc

SEQ ID NO: 6745653 - DNA, 17 bp, Homo sapiens
tgctgatggctgctgga

SEQ ID NO: 6745654 - DNA, 24 bp, Homo sapiens
tgctgatggcttgacatgtgcaat

SEQ ID NO: 6745655 - DNA, 19 bp, Homo sapiens
tgctgatgggaaggagggg

SEQ ID NO: 6745656 - DNA, 13 bp, Homo sapiens
tgctgatggtgca

SEQ ID NO: 6745657 - DNA, 23 bp, Homo sapiens
tgctgatggtgcaatgacctttc

SEQ ID NO: 6745658 - DNA, 17 bp, Homo sapiens
tgctgatgtaggagctg

SEQ ID NO: 6745659 - DNA, 14 bp, Homo sapiens
tgctgatgtcaaag

SEQ ID NO: 6745660 - DNA, 22 bp, Homo sapiens
tgctgatgtcaaagtgtaacag

SEQ ID NO: 6745661 - DNA, 17 bp, Homo sapiens
tgctgatgtcctcacca

SEQ ID NO: 6745662 - DNA, 17 bp, Homo sapiens
tgctgatgtggcaactg

SEQ ID NO: 6745663 - DNA, 14 bp, Homo sapiens
tgctgatgttcagt

SEQ ID NO: 6745664 - DNA, 15 bp, Homo sapiens
tgctgatgttcagtg

SEQ ID NO: 6745665 - DNA, 18 bp, Homo sapiens
tgctgatgttcagtgtaa

SEQ ID NO: 6745666 - DNA, 21 bp, Homo sapiens
tgctgatgttcagtgtaattt

SEQ ID NO: 6745667 - DNA, 23 bp, Homo sapiens
tgctgatgttcagtgtaatttct

SEQ ID NO: 6745668 - DNA, 14 bp, Homo sapiens
tgctgattatttat

SEQ ID NO: 6745669 - DNA, 23 bp, Homo sapiens
tgctgattcaaaccaaagctgcc

SEQ ID NO: 6745670 - DNA, 20 bp, Homo sapiens
tgctgattcaaggcattatt

SEQ ID NO: 6745671 - DNA, 17 bp, Homo sapiens
tgctgattctcccgttc

SEQ ID NO: 6745672 - DNA, 15 bp, Homo sapiens
tgctgattcttgtaa

SEQ ID NO: 6745673 - DNA, 14 bp, Homo sapiens
tgctgatttaaaca

SEQ ID NO: 6745674 - DNA, 17 bp, Homo sapiens
tgctgatttctagtgta

SEQ ID NO: 6745675 - DNA, 21 bp, Homo sapiens
tgctgatttctagtgtatact

SEQ ID NO: 6745676 - DNA, 13 bp, Homo sapiens
tgctgattttaat

SEQ ID NO: 6745677 - DNA, 14 bp, Homo sapiens
tgctgattttaatg

SEQ ID NO: 6745678 - DNA, 13 bp, Homo sapiens
tgctgattttatt

SEQ ID NO: 6745679 - DNA, 16 bp, Homo sapiens
tgctgattttattctt

SEQ ID NO: 6745680 - DNA, 19 bp, Homo sapiens
tgctgattttattcttgat

SEQ ID NO: 6745681 - DNA, 17 bp, Homo sapiens
tgctgattttgaccttg

SEQ ID NO: 6745682 - DNA, 16 bp, Homo sapiens
tgctgcaaagagaaac

SEQ ID NO: 6745683 - DNA, 16 bp, Homo sapiens
tgctgcaaaggagaag

SEQ ID NO: 6745684 - DNA, 14 bp, Homo sapiens
tgctgcaaagtgca

SEQ ID NO: 6745685 - DNA, 21 bp, Homo sapiens
tgctgcaaagtgcaaatactc

SEQ ID NO: 6745686 - DNA, 21 bp, Homo sapiens
tgctgcaacaagctcatccct

SEQ ID NO: 6745687 - DNA, 19 bp, Homo sapiens
tgctgcaagcacagccctt

SEQ ID NO: 6745688 - DNA, 13 bp, Homo sapiens
tgctgcaaggcct

SEQ ID NO: 6745689 - DNA, 23 bp, Homo sapiens
tgctgtaactgctgagccactcg

SEQ ID NO: 6745690 - DNA, 15 bp, Homo sapiens
tgctgtacaacttct

SEQ ID NO: 6745691 - DNA, 11 bp, Homo sapiens
tgctgtacata

SEQ ID NO: 6745692 - DNA, 16 bp, Homo sapiens
tgctgtacattactgt

SEQ ID NO: 6745693 - DNA, 18 bp, Homo sapiens
tgctgtacattactgtat

SEQ ID NO: 6745694 - DNA, 22 bp, Homo sapiens
tgctgtaccacatctgctctag

SEQ ID NO: 6745695 - DNA, 19 bp, Homo sapiens
tgctgtaccatattcagca

SEQ ID NO: 6745696 - DNA, 15 bp, Homo sapiens
tgctgtacccagatg

SEQ ID NO: 6745697 - DNA, 17 bp, Homo sapiens
tgctgtacccagatgcc

SEQ ID NO: 6745698 - DNA, 19 bp, Homo sapiens
tgctgtacccttccacctc

SEQ ID NO: 6745699 - DNA, 15 bp, Homo sapiens
tgctgtacctggctg

SEQ ID NO: 6745700 - DNA, 14 bp, Homo sapiens
tgctgtactagaga

SEQ ID NO: 6745701 - DNA, 19 bp, Homo sapiens
tgctgtactagagatctgg

SEQ ID NO: 6745702 - DNA, 18 bp, Homo sapiens
tgctgtactcttgctgat

SEQ ID NO: 6745703 - DNA, 21 bp, Homo sapiens
tgctgtactgaagtaaaacaa

SEQ ID NO: 6745704 - DNA, 18 bp, Homo sapiens
tgctgtagaaacacataa

SEQ ID NO: 6745705 - DNA, 22 bp, Homo sapiens
tgctgtagaaacacataacaaa

SEQ ID NO: 6745706 - DNA, 16 bp, Homo sapiens
tgctgtagacatctgt

SEQ ID NO: 6745707 - DNA, 17 bp, Homo sapiens
tgctgtagcctattttt

SEQ ID NO: 6745708 - DNA, 23 bp, Homo sapiens
tgctgtagctaggtatcttactc

SEQ ID NO: 6745709 - DNA, 19 bp, Homo sapiens
tgctgtagtcctttctgcc

SEQ ID NO: 6745710 - DNA, 17 bp, Homo sapiens
tgctgtataaaatcagc

SEQ ID NO: 6745711 - DNA, 19 bp, Homo sapiens
tgctgtatacaaacaggtg

SEQ ID NO: 6745712 - DNA, 21 bp, Homo sapiens
tgctgtatatttgtgatagca

SEQ ID NO: 6745713 - DNA, 19 bp, Homo sapiens
tgctgtatgacccctggcc

SEQ ID NO: 6745714 - DNA, 20 bp, Homo sapiens
tgctgtatgacccctggcca

SEQ ID NO: 6745715 - DNA, 14 bp, Homo sapiens
tgctgtatggccca

SEQ ID NO: 6745716 - DNA, 15 bp, Homo sapiens
tgctgtatggcccag

SEQ ID NO: 6745717 - DNA, 16 bp, Homo sapiens
tgctgtatggcccagg

SEQ ID NO: 6745718 - DNA, 17 bp, Homo sapiens
tgctgtatggcccaggc

SEQ ID NO: 6745719 - DNA, 17 bp, Homo sapiens
tgctgtatttctttgta

SEQ ID NO: 6745720 - DNA, 19 bp, Homo sapiens
tgctgtatttgctgccaga

SEQ ID NO: 6745721 - DNA, 13 bp, Homo sapiens
tgctgtattttaa

SEQ ID NO: 6745722 - DNA, 21 bp, Homo sapiens
tgctgtattttaaaagaatga

SEQ ID NO: 6745723 - DNA, 22 bp, Homo sapiens
tgctgtattttaaaagaatgat

SEQ ID NO: 6745724 - DNA, 10 bp, Homo sapiens
tgctgtcacc

SEQ ID NO: 6745725 - DNA, 21 bp, Homo sapiens
tgctgtcacctctcccacggg

SEQ ID NO: 6745726 - DNA, 17 bp, Homo sapiens
tgctgtcactggcagag

SEQ ID NO: 6745727 - DNA, 19 bp, Homo sapiens
tgctgtcactggcagagca

SEQ ID NO: 6745728 - DNA, 16 bp, Homo sapiens
tgctgtcacttcttca

SEQ ID NO: 6745729 - DNA, 16 bp, Homo sapiens
tgctgtcactttctct

SEQ ID NO: 6745730 - DNA, 23 bp, Homo sapiens
tgctgtcagaccttcttccacag

SEQ ID NO: 6745731 - DNA, 20 bp, Homo sapiens
tgctgtcagccctgctgtca

SEQ ID NO: 6745732 - DNA, 15 bp, Homo sapiens
tgctgtcagcctggc

SEQ ID NO: 6745733 - DNA, 18 bp, Homo sapiens
tgctgtcagtcttgacct

SEQ ID NO: 6745734 - DNA, 17 bp, Homo sapiens
tgctgtcatgcccagct

SEQ ID NO: 6745735 - DNA, 20 bp, Homo sapiens
tgctgtcattgcttcttctg

SEQ ID NO: 6745736 - DNA, 20 bp, Homo sapiens
tgctgtcattgtccatgcct

SEQ ID NO: 6745737 - DNA, 17 bp, Homo sapiens
tgctgtcattttatgct

SEQ ID NO: 6745738 - DNA, 20 bp, Homo sapiens
tgctgtccaaaccagcaaac

SEQ ID NO: 6745739 - DNA, 12 bp, Homo sapiens
tgctgtccaatt

SEQ ID NO: 6745740 - DNA, 13 bp, Homo sapiens
tgctgtccacatg

SEQ ID NO: 6745741 - DNA, 21 bp, Homo sapiens
tgctgtccagacagcctgtat

SEQ ID NO: 6745742 - DNA, 13 bp, Homo sapiens
tgctgtccagtgc

SEQ ID NO: 6745743 - DNA, 17 bp, Homo sapiens
tgctgtccatgcttctc

SEQ ID NO: 6745744 - DNA, 21 bp, Homo sapiens
tgctgtcccatagtccctgcc

SEQ ID NO: 6745745 - DNA, 15 bp, Homo sapiens
tgctgtcccctcttg

SEQ ID NO: 6745746 - DNA, 15 bp, Homo sapiens
tgctgtccctcctga

SEQ ID NO: 6745747 - DNA, 11 bp, Homo sapiens
tgctgtccctg

SEQ ID NO: 6745748 - DNA, 15 bp, Homo sapiens
tgctgtccctgcact

SEQ ID NO: 6745749 - DNA, 20 bp, Homo sapiens
tgctgtccctgcactgtgcc

SEQ ID NO: 6745750 - DNA, 14 bp, Homo sapiens
tgctgtccctgtca

SEQ ID NO: 6745751 - DNA, 13 bp, Homo sapiens
tgctgtccctgtg

SEQ ID NO: 6745752 - DNA, 17 bp, Homo sapiens
tgctgtccggcctggga

SEQ ID NO: 6745753 - DNA, 14 bp, Homo sapiens
tgctgtcctaggcc

SEQ ID NO: 6745754 - DNA, 16 bp, Homo sapiens
tgctgtcctaggccac

SEQ ID NO: 6745755 - DNA, 12 bp, Homo sapiens
tgctgtcctcag

SEQ ID NO: 6745756 - DNA, 19 bp, Homo sapiens
tgctgtcctcaggtggcca

SEQ ID NO: 6745757 - DNA, 20 bp, Homo sapiens
tgctgtcctccagggcgagc

SEQ ID NO: 6745758 - DNA, 14 bp, Homo sapiens
tgctgtcctctccc

SEQ ID NO: 6745759 - DNA, 14 bp, Homo sapiens
tgctgtcctgatct

SEQ ID NO: 6745760 - DNA, 16 bp, Homo sapiens
tgctgtcggcaccatg

SEQ ID NO: 6745761 - DNA, 22 bp, Homo sapiens
tgctgtctagccttagtcaata

SEQ ID NO: 6745762 - DNA, 18 bp, Homo sapiens
tgctgtctccataatgcc

SEQ ID NO: 6745763 - DNA, 10 bp, Homo sapiens
tgctgtctct

SEQ ID NO: 6745764 - DNA, 18 bp, Homo sapiens
tgctgtctctctgggctg

SEQ ID NO: 6745765 - DNA, 16 bp, Homo sapiens
tgctgtctctgctcgc

SEQ ID NO: 6745766 - DNA, 19 bp, Homo sapiens
tgctgtctcttaaatctct

SEQ ID NO: 6745767 - DNA, 22 bp, Homo sapiens
tgctgtctgaaaaagtgttttt

SEQ ID NO: 6745768 - DNA, 15 bp, Homo sapiens
tgctgtctgcagcct

SEQ ID NO: 6745769 - DNA, 14 bp, Homo sapiens
tgctgtctggccct

SEQ ID NO: 6745770 - DNA, 17 bp, Homo sapiens
tgctgtctggccctggg

SEQ ID NO: 6745771 - DNA, 17 bp, Homo sapiens
tgctgtctggctttccc

SEQ ID NO: 6745772 - DNA, 15 bp, Homo sapiens
tgctgtctgggactc

SEQ ID NO: 6745773 - DNA, 15 bp, Homo sapiens
tgctgtctgggtgct

SEQ ID NO: 6745774 - DNA, 19 bp, Homo sapiens
tgctgtctgggtggctcac

SEQ ID NO: 6745775 - DNA, 21 bp, Homo sapiens
tgctgtcttcagtctcacaga

SEQ ID NO: 6745776 - DNA, 16 bp, Homo sapiens
tgctgtcttccccacc

SEQ ID NO: 6745777 - DNA, 21 bp, Homo sapiens
tgctgtcttccccaccgcagt

SEQ ID NO: 6745778 - DNA, 13 bp, Homo sapiens
tgctgtcttctcc

SEQ ID NO: 6745779 - DNA, 14 bp, Homo sapiens
tgctgtcttctccc

SEQ ID NO: 6745780 - DNA, 15 bp, Homo sapiens
tgctgtcttctggac

SEQ ID NO: 6745781 - DNA, 15 bp, Homo sapiens
tgctgtcttctggtc

SEQ ID NO: 6745782 - DNA, 18 bp, Homo sapiens
tgctgtcttctggtctgt

SEQ ID NO: 6745783 - DNA, 22 bp, Homo sapiens
tgctgtcttgatgactgctgat

SEQ ID NO: 6745784 - DNA, 15 bp, Homo sapiens
tgctgtcttgcccca

SEQ ID NO: 6745785 - DNA, 16 bp, Homo sapiens
tgctgtcttgccccag

SEQ ID NO: 6745786 - DNA, 18 bp, Homo sapiens
tgctgtcttgccccagtt

SEQ ID NO: 6745787 - DNA, 14 bp, Homo sapiens
tgctgtctttgtgg

SEQ ID NO: 6745788 - DNA, 14 bp, Homo sapiens
tgctgtcttttctt

SEQ ID NO: 6745789 - DNA, 18 bp, Homo sapiens
tgctgtcttttgttctct

SEQ ID NO: 6745790 - DNA, 20 bp, Homo sapiens
tgctgtcttttgttctctga

SEQ ID NO: 6745791 - DNA, 22 bp, Homo sapiens
tgctgtgaaaaaaaaaatgctg

SEQ ID NO: 6745792 - DNA, 18 bp, Homo sapiens
tgctgtgaacaagtgaac

SEQ ID NO: 6745793 - DNA, 22 bp, Homo sapiens
tgctgtgaacatgcctcctcct

SEQ ID NO: 6745794 - DNA, 17 bp, Homo sapiens
tgctgtgaagctggaac

SEQ ID NO: 6745795 - DNA, 18 bp, Homo sapiens
tgctgtgaagctggaact

SEQ ID NO: 6745796 - DNA, 18 bp, Homo sapiens
tgctgtgaattagctcac

SEQ ID NO: 6745797 - DNA, 13 bp, Homo sapiens
tgctgtgacaggc

SEQ ID NO: 6745798 - DNA, 16 bp, Homo sapiens
tgctgtgactgtgtcc

SEQ ID NO: 6745799 - DNA, 19 bp, Homo sapiens
tgctgtgaggaatgctctg

SEQ ID NO: 6745800 - DNA, 12 bp, Homo sapiens
tgctgtgaggct

SEQ ID NO: 6745801 - DNA, 17 bp, Homo sapiens
tgctgtgaggctgtcct

SEQ ID NO: 6745802 - DNA, 19 bp, Homo sapiens
tgctgtgaggctgtcctgt

SEQ ID NO: 6745803 - DNA, 18 bp, Homo sapiens
tgctgtgagggaggggaa

SEQ ID NO: 6745804 - DNA, 23 bp, Homo sapiens
tgctgtgagggaggggaaaagca

SEQ ID NO: 6745805 - DNA, 17 bp, Homo sapiens
tgctgtgagtgcgcctc

SEQ ID NO: 6745806 - DNA, 18 bp, Homo sapiens
tgctgtgcaaacagtgta

SEQ ID NO: 6745807 - DNA, 16 bp, Homo sapiens
tgctgtgcagctctct

SEQ ID NO: 6745808 - DNA, 22 bp, Homo sapiens
tgctgtgcattagatattaggg

SEQ ID NO: 6745809 - DNA, 11 bp, Homo sapiens
tgctgtgccaa

SEQ ID NO: 6745810 - DNA, 16 bp, Homo sapiens
tgctgtgccaaagcag

SEQ ID NO: 6745811 - DNA, 15 bp, Homo sapiens
tgctgtgccaggagg

SEQ ID NO: 6745812 - DNA, 19 bp, Homo sapiens
tgctgtgccatgctgggcc

SEQ ID NO: 6745813 - DNA, 12 bp, Homo sapiens
tgctgtgcctgc

SEQ ID NO: 6745814 - DNA, 22 bp, Homo sapiens
tgctgtgctacgtgtgaaatct

SEQ ID NO: 6745815 - DNA, 19 bp, Homo sapiens
tgctgtgctctggcaccat

SEQ ID NO: 6745816 - DNA, 10 bp, Homo sapiens
tgctgtgctg

SEQ ID NO: 6745817 - DNA, 12 bp, Homo sapiens
tgctgtgctgga

SEQ ID NO: 6745818 - DNA, 15 bp, Homo sapiens
tgctgtgctgggagg

SEQ ID NO: 6745819 - DNA, 16 bp, Homo sapiens
tgctgtgctgtacatt

SEQ ID NO: 6745820 - DNA, 15 bp, Homo sapiens
tgctgtgctgtgcta

SEQ ID NO: 6745821 - DNA, 18 bp, Homo sapiens
tgctgtgctgtgctatgg

SEQ ID NO: 6745822 - DNA, 16 bp, Homo sapiens
tgctgtgctgtgttta

SEQ ID NO: 6745823 - DNA, 11 bp, Homo sapiens
tgctgtgcttt

SEQ ID NO: 6745824 - DNA, 16 bp, Homo sapiens
tgctgtgctttggaac

SEQ ID NO: 6745825 - DNA, 23 bp, Homo sapiens
tgctgtgctttggaacaatcaca

SEQ ID NO: 6745826 - DNA, 13 bp, Homo sapiens
tgctgtggaagca

SEQ ID NO: 6745827 - DNA, 16 bp, Homo sapiens
tgctgtggacatgtgg

SEQ ID NO: 6745828 - DNA, 19 bp, Homo sapiens
tgctgtggagctccactgc

SEQ ID NO: 6745829 - DNA, 15 bp, Homo sapiens
tgctgtggagtgagg

SEQ ID NO: 6745830 - DNA, 17 bp, Homo sapiens
tgctgtggatgtcccta

SEQ ID NO: 6745831 - DNA, 12 bp, Homo sapiens
tgctgtggattt

SEQ ID NO: 6745832 - DNA, 13 bp, Homo sapiens
tgctgtggcatca

SEQ ID NO: 6745833 - DNA, 13 bp, Homo sapiens
tgctgtggccagg

SEQ ID NO: 6745834 - DNA, 14 bp, Homo sapiens
tgctgtggccagga

SEQ ID NO: 6745835 - DNA, 16 bp, Homo sapiens
tgctgtggccaggagg

SEQ ID NO: 6745836 - DNA, 14 bp, Homo sapiens
tgctgtggccaggc

SEQ ID NO: 6745837 - DNA, 16 bp, Homo sapiens
tgctgtggccaggcct

SEQ ID NO: 6745838 - DNA, 17 bp, Homo sapiens
tgctgtggccccctgtc

SEQ ID NO: 6745839 - DNA, 14 bp, Homo sapiens
tgctgtggcctcac

SEQ ID NO: 6745840 - DNA, 14 bp, Homo sapiens
tgctgtggcctggg

SEQ ID NO: 6745841 - DNA, 14 bp, Homo sapiens
tgctgtggccttcc

SEQ ID NO: 6745842 - DNA, 19 bp, Homo sapiens
tgctgtgggaacgagaggg

SEQ ID NO: 6745843 - DNA, 14 bp, Homo sapiens
tgctgtgggagagc

SEQ ID NO: 6745844 - DNA, 17 bp, Homo sapiens
tgctgtgggcagcaccc

SEQ ID NO: 6745845 - DNA, 18 bp, Homo sapiens
tgctgtggggctggtagc

SEQ ID NO: 6745846 - DNA, 22 bp, Homo sapiens
tgctgtggggtatacagcattg

SEQ ID NO: 6745847 - DNA, 19 bp, Homo sapiens
tgctgtgggtcagtgtgcc

SEQ ID NO: 6745848 - DNA, 23 bp, Homo sapiens
tgctgtgggtcagtgtgccaccc

SEQ ID NO: 6745849 - DNA, 15 bp, Homo sapiens
tgctgtggtctataa

SEQ ID NO: 6745850 - DNA, 16 bp, Homo sapiens
tgctgtggttcactgc

SEQ ID NO: 6745851 - DNA, 19 bp, Homo sapiens
tgctgtggttcactgcact

SEQ ID NO: 6745852 - DNA, 12 bp, Homo sapiens
tgctgtgtaaag

SEQ ID NO: 6745853 - DNA, 13 bp, Homo sapiens
tgctgtgtaaagt

SEQ ID NO: 6745854 - DNA, 16 bp, Homo sapiens
tgctgtgtaacactgt

SEQ ID NO: 6745855 - DNA, 11 bp, Homo sapiens
tgctgtgtagc

SEQ ID NO: 6745856 - DNA, 19 bp, Homo sapiens
tgctgtgtagctctgtcca

SEQ ID NO: 6745857 - DNA, 17 bp, Homo sapiens
tgctgtgtagttccctc

SEQ ID NO: 6745858 - DNA, 19 bp, Homo sapiens
tgctgtgtagttccctctg

SEQ ID NO: 6745859 - DNA, 21 bp, Homo sapiens
tgctgtgtatctgatagctct

SEQ ID NO: 6745860 - DNA, 15 bp, Homo sapiens
tgctgtgtccaactc

SEQ ID NO: 6745861 - DNA, 18 bp, Homo sapiens
tgctgtgtccaactccag

SEQ ID NO: 6745862 - DNA, 12 bp, Homo sapiens
tgctgtgtcctt

SEQ ID NO: 6745863 - DNA, 17 bp, Homo sapiens
tgctgtgtccttcctcc

SEQ ID NO: 6745864 - DNA, 20 bp, Homo sapiens
tgctgtgtcttcattttcat

SEQ ID NO: 6745865 - DNA, 17 bp, Homo sapiens
tgctgtgtgaaatcttt

SEQ ID NO: 6745866 - DNA, 18 bp, Homo sapiens
tgctgtgtgaaatctttc

SEQ ID NO: 6745867 - DNA, 20 bp, Homo sapiens
tgctgtgtgcccaagtgggc

SEQ ID NO: 6745868 - DNA, 21 bp, Homo sapiens
tgctgtgtgcccaagtgggca

SEQ ID NO: 6745869 - DNA, 14 bp, Homo sapiens
tgcttctctccttg

SEQ ID NO: 6745870 - DNA, 15 bp, Homo sapiens
tgcttctctcttctc

SEQ ID NO: 6745871 - DNA, 13 bp, Homo sapiens
tgcttctctgact

SEQ ID NO: 6745872 - DNA, 17 bp, Homo sapiens
tgcttctctgacttctg

SEQ ID NO: 6745873 - DNA, 20 bp, Homo sapiens
tgcttctctgacttctgcct

SEQ ID NO: 6745874 - DNA, 18 bp, Homo sapiens
tgcttctctgcccagctt

SEQ ID NO: 6745875 - DNA, 11 bp, Homo sapiens
tgcttctcttt

SEQ ID NO: 6745876 - DNA, 14 bp, Homo sapiens
tgcttctctttgtg

SEQ ID NO: 6745877 - DNA, 22 bp, Homo sapiens
tgcttctgaactcaagctgcgt

SEQ ID NO: 6745878 - DNA, 16 bp, Homo sapiens
tgcttctgaatacaaa

SEQ ID NO: 6745879 - DNA, 14 bp, Homo sapiens
tgcttctgaatcac

SEQ ID NO: 6745880 - DNA, 16 bp, Homo sapiens
tgcttctgaatcactg

SEQ ID NO: 6745881 - DNA, 20 bp, Homo sapiens
tgcttctgagtggtgttttt

SEQ ID NO: 6745882 - DNA, 13 bp, Homo sapiens
tgcttctgcagca

SEQ ID NO: 6745883 - DNA, 14 bp, Homo sapiens
tgcttctgcagcaa

SEQ ID NO: 6745884 - DNA, 18 bp, Homo sapiens
tgcttctgcagcaactcc

SEQ ID NO: 6745885 - DNA, 13 bp, Homo sapiens
tgcttctgccacc

SEQ ID NO: 6745886 - DNA, 13 bp, Homo sapiens
tgcttctgcccac

SEQ ID NO: 6745887 - DNA, 17 bp, Homo sapiens
tgcttctgcccaccccg

SEQ ID NO: 6745888 - DNA, 14 bp, Homo sapiens
tgcttctgcctcag

SEQ ID NO: 6745889 - DNA, 12 bp, Homo sapiens
tgcttctgctca

SEQ ID NO: 6745890 - DNA, 17 bp, Homo sapiens
tgcttctgctccagccc

SEQ ID NO: 6745891 - DNA, 13 bp, Homo sapiens
tgcttctggaaac

SEQ ID NO: 6745892 - DNA, 16 bp, Homo sapiens
tgcttctggctttgtt

SEQ ID NO: 6745893 - DNA, 13 bp, Homo sapiens
tgcttctgggaga

SEQ ID NO: 6745894 - DNA, 12 bp, Homo sapiens
tgcttctgggcc

SEQ ID NO: 6745895 - DNA, 16 bp, Homo sapiens
tgcttctgggcctgat

SEQ ID NO: 6745896 - DNA, 13 bp, Homo sapiens
tgcttctggggga

SEQ ID NO: 6745897 - DNA, 14 bp, Homo sapiens
tgcttctgtagctt

SEQ ID NO: 6745898 - DNA, 17 bp, Homo sapiens
tgcttctgtatttcctt

SEQ ID NO: 6745899 - DNA, 14 bp, Homo sapiens
tgcttctgtccagg

SEQ ID NO: 6745900 - DNA, 23 bp, Homo sapiens
tgcttctgttgtaatagtccatg

SEQ ID NO: 6745901 - DNA, 14 bp, Homo sapiens
tgcttctgttttat

SEQ ID NO: 6745902 - DNA, 17 bp, Homo sapiens
tgcttcttactgataat

SEQ ID NO: 6745903 - DNA, 13 bp, Homo sapiens
tgcttcttcagag

SEQ ID NO: 6745904 - DNA, 16 bp, Homo sapiens
tgcttcttcagagact

SEQ ID NO: 6745905 - DNA, 16 bp, Homo sapiens
tgcttcttcatcttga

SEQ ID NO: 6745906 - DNA, 15 bp, Homo sapiens
tgcttcttccccagg

SEQ ID NO: 6745907 - DNA, 19 bp, Homo sapiens
tgcttcttccccagggttc

SEQ ID NO: 6745908 - DNA, 14 bp, Homo sapiens
tgcttcttgcccct

SEQ ID NO: 6745909 - DNA, 19 bp, Homo sapiens
tgcttcttgccccttgggc

SEQ ID NO: 6745910 - DNA, 13 bp, Homo sapiens
tgcttcttgcttc

SEQ ID NO: 6745911 - DNA, 14 bp, Homo sapiens
tgcttcttggagct

SEQ ID NO: 6745912 - DNA, 20 bp, Homo sapiens
tgcttcttggagctttggaa

SEQ ID NO: 6745913 - DNA, 21 bp, Homo sapiens
tgcttcttggagctttggaat

SEQ ID NO: 6745914 - DNA, 16 bp, Homo sapiens
tgcttcttgtaatatt

SEQ ID NO: 6745915 - DNA, 20 bp, Homo sapiens
tgcttcttgtaatatttctt

SEQ ID NO: 6745916 - DNA, 21 bp, Homo sapiens
tgcttcttgtaatatttcttc

SEQ ID NO: 6745917 - DNA, 13 bp, Homo sapiens
tgcttcttgtgtt

SEQ ID NO: 6745918 - DNA, 14 bp, Homo sapiens
tgcttcttgtgttt

SEQ ID NO: 6745919 - DNA, 21 bp, Homo sapiens
tgcttcttgtgtttgaaacac

SEQ ID NO: 6745920 - DNA, 14 bp, Homo sapiens
tgcttctttataaa

SEQ ID NO: 6745921 - DNA, 13 bp, Homo sapiens
tgcttctttccag

SEQ ID NO: 6745922 - DNA, 14 bp, Homo sapiens
tgcttctttccaga

SEQ ID NO: 6745923 - DNA, 15 bp, Homo sapiens
tgcttctttccagaa

SEQ ID NO: 6745924 - DNA, 17 bp, Homo sapiens
tgcttctttcctcttaa

SEQ ID NO: 6745925 - DNA, 15 bp, Homo sapiens
tgcttctttctagaa

SEQ ID NO: 6745926 - DNA, 15 bp, Homo sapiens
tgcttctttgtaatg

SEQ ID NO: 6745927 - DNA, 13 bp, Homo sapiens
tgcttctttttct

SEQ ID NO: 6745928 - DNA, 16 bp, Homo sapiens
tgcttgaaaaatgtgc

SEQ ID NO: 6745929 - DNA, 14 bp, Homo sapiens
tgcttgaaagaaaa

SEQ ID NO: 6745930 - DNA, 18 bp, Homo sapiens
tgcttgaaattactgtgt

SEQ ID NO: 6745931 - DNA, 12 bp, Homo sapiens
tgcttgaacaca

SEQ ID NO: 6745932 - DNA, 14 bp, Homo sapiens
tgcttgaacacagt

SEQ ID NO: 6745933 - DNA, 16 bp, Homo sapiens
tgcttgaacacagtat

SEQ ID NO: 6745934 - DNA, 17 bp, Homo sapiens
tgcttgaacccaggagg

SEQ ID NO: 6745935 - DNA, 17 bp, Homo sapiens
tgcttgaactgctgcca

SEQ ID NO: 6745936 - DNA, 15 bp, Homo sapiens
tgcttgaataaacac

SEQ ID NO: 6745937 - DNA, 22 bp, Homo sapiens
tgcttgacaaaggagcattgca

SEQ ID NO: 6745938 - DNA, 20 bp, Homo sapiens
tgcttgacaaatattttcat

SEQ ID NO: 6745939 - DNA, 16 bp, Homo sapiens
tgcttgacccttatct

SEQ ID NO: 6745940 - DNA, 20 bp, Homo sapiens
tgcttgaccgtactctcaca

SEQ ID NO: 6745941 - DNA, 21 bp, Homo sapiens
tgcttgactatcacatacaat

SEQ ID NO: 6745942 - DNA, 18 bp, Homo sapiens
tgcttgagcatgcccaaa

SEQ ID NO: 6745943 - DNA, 22 bp, Homo sapiens
tgcttgagcatgcccaaatata

SEQ ID NO: 6745944 - DNA, 14 bp, Homo sapiens
tgcttgagcccagg

SEQ ID NO: 6745945 - DNA, 20 bp, Homo sapiens
tgcttgagcctggctgtcca

SEQ ID NO: 6745946 - DNA, 21 bp, Homo sapiens
tgcttgagcctggctgtccaa

SEQ ID NO: 6745947 - DNA, 18 bp, Homo sapiens
tgcttgagctcaggagtt

SEQ ID NO: 6745948 - DNA, 20 bp, Homo sapiens
tgcttgagctttctgtgcat

SEQ ID NO: 6745949 - DNA, 19 bp, Homo sapiens
tgcttgaggaatgaagacc

SEQ ID NO: 6745950 - DNA, 22 bp, Homo sapiens
tgcttgaggaggggcacctgcc

SEQ ID NO: 6745951 - DNA, 23 bp, Homo sapiens
tgcttgaggaggggcacctgcca

SEQ ID NO: 6745952 - DNA, 20 bp, Homo sapiens
tgcttgagtcaggtttgagt

SEQ ID NO: 6745953 - DNA, 23 bp, Homo sapiens
tgcttgagtggacagcagctgga

SEQ ID NO: 6745954 - DNA, 13 bp, Homo sapiens
tgcttgatagaaa

SEQ ID NO: 6745955 - DNA, 21 bp, Homo sapiens
tgcttgataggaattcatctt

SEQ ID NO: 6745956 - DNA, 17 bp, Homo sapiens
tgcttgatatcccaagt

SEQ ID NO: 6745957 - DNA, 14 bp, Homo sapiens
tgcttgatgaagca

SEQ ID NO: 6745958 - DNA, 17 bp, Homo sapiens
tgcttgatgaagcaagg

SEQ ID NO: 6745959 - DNA, 20 bp, Homo sapiens
tgcttgatgaagcaaggaag

SEQ ID NO: 6745960 - DNA, 15 bp, Homo sapiens
tgcttgatggtttat

SEQ ID NO: 6745961 - DNA, 12 bp, Homo sapiens
tgcttgattttt

SEQ ID NO: 6745962 - DNA, 16 bp, Homo sapiens
tgcttgcacacttccc

SEQ ID NO: 6745963 - DNA, 22 bp, Homo sapiens
tgcttgcactttgtaacatgtt

SEQ ID NO: 6745964 - DNA, 17 bp, Homo sapiens
tgcttgcaggaggccaa

SEQ ID NO: 6745965 - DNA, 20 bp, Homo sapiens
tgcttgcagtaattcaactg

SEQ ID NO: 6745966 - DNA, 20 bp, Homo sapiens
tgcttgcatcacttggggtc

SEQ ID NO: 6745967 - DNA, 17 bp, Homo sapiens
tgcttgcatcctatttg

SEQ ID NO: 6745968 - DNA, 15 bp, Homo sapiens
tgcttgccaaagtac

SEQ ID NO: 6745969 - DNA, 23 bp, Homo sapiens
tgcttgccaccaccagatgagaa

SEQ ID NO: 6745970 - DNA, 12 bp, Homo sapiens
tgcttgccagcc

SEQ ID NO: 6745971 - DNA, 14 bp, Homo sapiens
tgcttgccagccag

SEQ ID NO: 6745972 - DNA, 15 bp, Homo sapiens
tgcttgccagccagg

SEQ ID NO: 6745973 - DNA, 15 bp, Homo sapiens
tgcttgccatccctc

SEQ ID NO: 6745974 - DNA, 17 bp, Homo sapiens
tgcttgcccaagtcaca

SEQ ID NO: 6745975 - DNA, 21 bp, Homo sapiens
tgcttgccctaagcagaaagt

SEQ ID NO: 6745976 - DNA, 20 bp, Homo sapiens
tgcttgccgaaactggaagt

SEQ ID NO: 6745977 - DNA, 21 bp, Homo sapiens
tgcttgccgactggctgtgag

SEQ ID NO: 6745978 - DNA, 14 bp, Homo sapiens
tgcttgcctagggc

SEQ ID NO: 6745979 - DNA, 19 bp, Homo sapiens
tgcttgcctagggcctggt

SEQ ID NO: 6745980 - DNA, 15 bp, Homo sapiens
tgcttgcctgaagct

SEQ ID NO: 6745981 - DNA, 15 bp, Homo sapiens
tgcttgcctgcaggg

SEQ ID NO: 6745982 - DNA, 18 bp, Homo sapiens
tgcttgcctgcagggcca

SEQ ID NO: 6745983 - DNA, 17 bp, Homo sapiens
tgcttgcggcaaaagga

SEQ ID NO: 6745984 - DNA, 19 bp, Homo sapiens
tgcttgcgtgctgggacag

SEQ ID NO: 6745985 - DNA, 19 bp, Homo sapiens
tgcttgctaatatttccag

SEQ ID NO: 6745986 - DNA, 22 bp, Homo sapiens
tgcttgctaccaatctgtgaga

SEQ ID NO: 6745987 - DNA, 13 bp, Homo sapiens
tgcttgctcccca

SEQ ID NO: 6745988 - DNA, 15 bp, Homo sapiens
tgcttgctggaaaac

SEQ ID NO: 6745989 - DNA, 18 bp, Homo sapiens
tgcttgctggaaaactgc

SEQ ID NO: 6745990 - DNA, 20 bp, Homo sapiens
tgcttgctggaaaactgcca

SEQ ID NO: 6745991 - DNA, 22 bp, Homo sapiens
tgcttgctggaaaactgccaca

SEQ ID NO: 6745992 - DNA, 21 bp, Homo sapiens
tgcttgctgttcccatccctg

SEQ ID NO: 6745993 - DNA, 23 bp, Homo sapiens
tgcttgcttagagtgcccagcag

SEQ ID NO: 6745994 - DNA, 15 bp, Homo sapiens
tgcttgctttgaagt

SEQ ID NO: 6745995 - DNA, 17 bp, Homo sapiens
tgcttggaaattccttg

SEQ ID NO: 6745996 - DNA, 22 bp, Homo sapiens
tgcttggaaattccttgcccca

SEQ ID NO: 6745997 - DNA, 22 bp, Homo sapiens
tgcttggaacatactgttcact

SEQ ID NO: 6745998 - DNA, 13 bp, Homo sapiens
tgcttggaaccag

SEQ ID NO: 6745999 - DNA, 22 bp, Homo sapiens
tgcttggaagaaggaaacggaa

SEQ ID NO: 6746000 - DNA, 13 bp, Homo sapiens
tgcttggaagcca

SEQ ID NO: 6746001 - DNA, 15 bp, Homo sapiens
tgcttggaagccagg

SEQ ID NO: 6746002 - DNA, 15 bp, Homo sapiens
tgcttggagctgagc

SEQ ID NO: 6746003 - DNA, 16 bp, Homo sapiens
tgcttggaggaaggaa

SEQ ID NO: 6746004 - DNA, 15 bp, Homo sapiens
tgcttggagtgcccc

SEQ ID NO: 6746005 - DNA, 19 bp, Homo sapiens
tgcttggagtgccccaagg

SEQ ID NO: 6746006 - DNA, 14 bp, Homo sapiens
tgcttggattcact

SEQ ID NO: 6746007 - DNA, 21 bp, Homo sapiens
tgcttggattctctgagaaat

SEQ ID NO: 6746008 - DNA, 13 bp, Homo sapiens
tgcttggcagaga

SEQ ID NO: 6746009 - DNA, 16 bp, Homo sapiens
tgcttggccaggattt

SEQ ID NO: 6746010 - DNA, 23 bp, Homo sapiens
tgcttggcccaggagtttggcca

SEQ ID NO: 6746011 - DNA, 15 bp, Homo sapiens
tgcttggcccagggg

SEQ ID NO: 6746012 - DNA, 14 bp, Homo sapiens
tgcttggcccggcc

SEQ ID NO: 6746013 - DNA, 15 bp, Homo sapiens
tgcttggcccttcaa

SEQ ID NO: 6746014 - DNA, 13 bp, Homo sapiens
tgcttggctgccc

SEQ ID NO: 6746015 - DNA, 17 bp, Homo sapiens
tgcttggctgccccaca

SEQ ID NO: 6746016 - DNA, 14 bp, Homo sapiens
tgcttggctgtccc

SEQ ID NO: 6746017 - DNA, 15 bp, Homo sapiens
tgcttggcttcccct

SEQ ID NO: 6746018 - DNA, 19 bp, Homo sapiens
tgcttggcttcccctccac

SEQ ID NO: 6746019 - DNA, 23 bp, Homo sapiens
tgcttggcttcccctccacccta

SEQ ID NO: 6746020 - DNA, 17 bp, Homo sapiens
tgcttgggaccagaagt

SEQ ID NO: 6746021 - DNA, 14 bp, Homo sapiens
tgcttgggacgtgt

SEQ ID NO: 6746022 - DNA, 21 bp, Homo sapiens
tgcttgggcctccctggcact

SEQ ID NO: 6746023 - DNA, 13 bp, Homo sapiens
tgcttgggctcca

SEQ ID NO: 6746024 - DNA, 14 bp, Homo sapiens
tgcttgggctccac

SEQ ID NO: 6746025 - DNA, 21 bp, Homo sapiens
tgcttgggctgacccagcatc

SEQ ID NO: 6746026 - DNA, 17 bp, Homo sapiens
tgcttgggcttctgcgg

SEQ ID NO: 6746027 - DNA, 17 bp, Homo sapiens
tgcttggggcctggcgt

SEQ ID NO: 6746028 - DNA, 17 bp, Homo sapiens
tgcttggggctatttgt

SEQ ID NO: 6746029 - DNA, 20 bp, Homo sapiens
tgcttggggggtgatgaggg

SEQ ID NO: 6746030 - DNA, 21 bp, Homo sapiens
tgcttggggggtgatgagggc

SEQ ID NO: 6746031 - DNA, 17 bp, Homo sapiens
tgcttgggggtttttga

SEQ ID NO: 6746032 - DNA, 18 bp, Homo sapiens
tgcttgggggtttttgaa

SEQ ID NO: 6746033 - DNA, 20 bp, Homo sapiens
tgcttgggggtttttgaagt

SEQ ID NO: 6746034 - DNA, 18 bp, Homo sapiens
tgcttgggtggagaagcc

SEQ ID NO: 6746035 - DNA, 14 bp, Homo sapiens
tgcttggtgctggt

SEQ ID NO: 6746036 - DNA, 16 bp, Homo sapiens
tgcttggtgctggttt

SEQ ID NO: 6746037 - DNA, 15 bp, Homo sapiens
tgcttggtggggctc

SEQ ID NO: 6746038 - DNA, 22 bp, Homo sapiens
tgcttggtggggctcgtggcct

SEQ ID NO: 6746039 - DNA, 21 bp, Homo sapiens
tgcttggtgtgacccacggag

SEQ ID NO: 6746040 - DNA, 13 bp, Homo sapiens
tgcttggttcatt

SEQ ID NO: 6746041 - DNA, 16 bp, Homo sapiens
tgcttgtaaaaatatg

SEQ ID NO: 6746042 - DNA, 18 bp, Homo sapiens
tgcttgtaacaagaaaac

SEQ ID NO: 6746043 - DNA, 19 bp, Homo sapiens
tgcttgtaacaagaaaaca

SEQ ID NO: 6746044 - DNA, 18 bp, Homo sapiens
tgcttgtaatcaagcctt

SEQ ID NO: 6746045 - DNA, 22 bp, Homo sapiens
tgcttgtaatttaaacatttgt

SEQ ID NO: 6746046 - DNA, 19 bp, Homo sapiens
tgcttgtacactcattcat

SEQ ID NO: 6746047 - DNA, 17 bp, Homo sapiens
tgcttgtacagtgtcag

SEQ ID NO: 6746048 - DNA, 22 bp, Homo sapiens
tgcttgtacctctggctgacta

SEQ ID NO: 6746049 - DNA, 15 bp, Homo sapiens
tggaacaccctggat

SEQ ID NO: 6746050 - DNA, 20 bp, Homo sapiens
tggaacactaaagagctagg

SEQ ID NO: 6746051 - DNA, 19 bp, Homo sapiens
tggaacactactcttacat

SEQ ID NO: 6746052 - DNA, 21 bp, Homo sapiens
tggaacactagacaagccaga

SEQ ID NO: 6746053 - DNA, 19 bp, Homo sapiens
tggaacactcatgtctgga

SEQ ID NO: 6746054 - DNA, 19 bp, Homo sapiens
tggaacactctataacaaa

SEQ ID NO: 6746055 - DNA, 14 bp, Homo sapiens
tggaacactctgag

SEQ ID NO: 6746056 - DNA, 17 bp, Homo sapiens
tggaacactctgagact

SEQ ID NO: 6746057 - DNA, 21 bp, Homo sapiens
tggaacagaatgttttactgt

SEQ ID NO: 6746058 - DNA, 21 bp, Homo sapiens
tggaacagatatttagctctg

SEQ ID NO: 6746059 - DNA, 12 bp, Homo sapiens
tggaacagccct

SEQ ID NO: 6746060 - DNA, 19 bp, Homo sapiens
tggaacagcgggagacctg

SEQ ID NO: 6746061 - DNA, 14 bp, Homo sapiens
tggaacaggaggaa

SEQ ID NO: 6746062 - DNA, 23 bp, Homo sapiens
tggaacaggaggaactggtccag

SEQ ID NO: 6746063 - DNA, 17 bp, Homo sapiens
tggaacagggttggcat

SEQ ID NO: 6746064 - DNA, 13 bp, Homo sapiens
tggaacagtaatt

SEQ ID NO: 6746065 - DNA, 18 bp, Homo sapiens
tggaacagtcacccttct

SEQ ID NO: 6746066 - DNA, 12 bp, Homo sapiens
tggaacagtgta

SEQ ID NO: 6746067 - DNA, 20 bp, Homo sapiens
tggaacataaaatacaatgt

SEQ ID NO: 6746068 - DNA, 21 bp, Homo sapiens
tggaacataaaatacaatgtt

SEQ ID NO: 6746069 - DNA, 16 bp, Homo sapiens
tggaacatactgttca

SEQ ID NO: 6746070 - DNA, 17 bp, Homo sapiens
tggaacatactgttcac

SEQ ID NO: 6746071 - DNA, 21 bp, Homo sapiens
tggaacatgcttttactttat

SEQ ID NO: 6746072 - DNA, 18 bp, Homo sapiens
tggaacatttgatatttt

SEQ ID NO: 6746073 - DNA, 22 bp, Homo sapiens
tggaacatttgatatttttcca

SEQ ID NO: 6746074 - DNA, 23 bp, Homo sapiens
tggaacattttttttttttcctt

SEQ ID NO: 6746075 - DNA, 15 bp, Homo sapiens
tggaaccaaagtcta

SEQ ID NO: 6746076 - DNA, 11 bp, Homo sapiens
tggaaccaatc

SEQ ID NO: 6746077 - DNA, 15 bp, Homo sapiens
tggaaccacctggac

SEQ ID NO: 6746078 - DNA, 12 bp, Homo sapiens
tggaaccagact

SEQ ID NO: 6746079 - DNA, 13 bp, Homo sapiens
tggaaccagcccc

SEQ ID NO: 6746080 - DNA, 23 bp, Homo sapiens
tggaaccagccccatcagaacct

SEQ ID NO: 6746081 - DNA, 21 bp, Homo sapiens
tggaaccaggcttgcctggga

SEQ ID NO: 6746082 - DNA, 15 bp, Homo sapiens
tggaaccaggcttgg

SEQ ID NO: 6746083 - DNA, 19 bp, Homo sapiens
tggaaccagggaggagagg

SEQ ID NO: 6746084 - DNA, 19 bp, Homo sapiens
tggaaccagtgtaactggc

SEQ ID NO: 6746085 - DNA, 18 bp, Homo sapiens
tggaaccatcctctgtta

SEQ ID NO: 6746086 - DNA, 15 bp, Homo sapiens
tggaacccaggaggt

SEQ ID NO: 6746087 - DNA, 16 bp, Homo sapiens
tggaacccccagccca

SEQ ID NO: 6746088 - DNA, 22 bp, Homo sapiens
tggaacccccagcccagcagac

SEQ ID NO: 6746089 - DNA, 19 bp, Homo sapiens
tggaaccctaaataataaa

SEQ ID NO: 6746090 - DNA, 22 bp, Homo sapiens
tggaacccttttaaagttgata

SEQ ID NO: 6746091 - DNA, 18 bp, Homo sapiens
tggaacccttttggcccc

SEQ ID NO: 6746092 - DNA, 17 bp, Homo sapiens
tggaaccgcaggaagct

SEQ ID NO: 6746093 - DNA, 19 bp, Homo sapiens
tggaaccgcaggaagctgc

SEQ ID NO: 6746094 - DNA, 18 bp, Homo sapiens
tggaaccgttgccaaccg

SEQ ID NO: 6746095 - DNA, 22 bp, Homo sapiens
tggaacctaatgggaatcattc

SEQ ID NO: 6746096 - DNA, 15 bp, Homo sapiens
tggaacctcagcctg

SEQ ID NO: 6746097 - DNA, 21 bp, Homo sapiens
tggaacctcattgctaccaca

SEQ ID NO: 6746098 - DNA, 12 bp, Homo sapiens
tggaacctccct

SEQ ID NO: 6746099 - DNA, 15 bp, Homo sapiens
tggaacctcctttct

SEQ ID NO: 6746100 - DNA, 21 bp, Homo sapiens
tggaacctcctttctcttctc

SEQ ID NO: 6746101 - DNA, 13 bp, Homo sapiens
tggaacctctgtc

SEQ ID NO: 6746102 - DNA, 17 bp, Homo sapiens
tggaacctggaccccag

SEQ ID NO: 6746103 - DNA, 21 bp, Homo sapiens
tggaacctggaccccagcctt

SEQ ID NO: 6746104 - DNA, 23 bp, Homo sapiens
tggaacctgtctccattgtgtga

SEQ ID NO: 6746105 - DNA, 15 bp, Homo sapiens
tggaaccttgctgtc

SEQ ID NO: 6746106 - DNA, 23 bp, Homo sapiens
tggaaccttgctgtcctgatctg

SEQ ID NO: 6746107 - DNA, 13 bp, Homo sapiens
tggaaccttgttt

SEQ ID NO: 6746108 - DNA, 16 bp, Homo sapiens
tggaacgcagttgatt

SEQ ID NO: 6746109 - DNA, 16 bp, Homo sapiens
tggaacgcgttgaaat

SEQ ID NO: 6746110 - DNA, 17 bp, Homo sapiens
tggaacgcgttgaaatt

SEQ ID NO: 6746111 - DNA, 18 bp, Homo sapiens
tggaacgctaatgaaaca

SEQ ID NO: 6746112 - DNA, 14 bp, Homo sapiens
tggaacgctctagg

SEQ ID NO: 6746113 - DNA, 19 bp, Homo sapiens
tggaacgggcatgggcctc

SEQ ID NO: 6746114 - DNA, 23 bp, Homo sapiens
tggaacgggcatgggcctctctg

SEQ ID NO: 6746115 - DNA, 20 bp, Homo sapiens
tggaacggtgaaggtgacag

SEQ ID NO: 6746116 - DNA, 13 bp, Homo sapiens
tggaactcaatat

SEQ ID NO: 6746117 - DNA, 18 bp, Homo sapiens
tggaactccccagggcct

SEQ ID NO: 6746118 - DNA, 17 bp, Homo sapiens
tggaactcctggccttt

SEQ ID NO: 6746119 - DNA, 23 bp, Homo sapiens
tggaactctcctgctcctcagga

SEQ ID NO: 6746120 - DNA, 11 bp, Homo sapiens
tggaactcttg

SEQ ID NO: 6746121 - DNA, 23 bp, Homo sapiens
tggaactcttgacagctataatt

SEQ ID NO: 6746122 - DNA, 21 bp, Homo sapiens
tggaactgaagggggcggcct

SEQ ID NO: 6746123 - DNA, 22 bp, Homo sapiens
tggaactgaagggggcggccta

SEQ ID NO: 6746124 - DNA, 23 bp, Homo sapiens
tggaactgaagtccaaattgttt

SEQ ID NO: 6746125 - DNA, 21 bp, Homo sapiens
tggaactgaccccctcccctg

SEQ ID NO: 6746126 - DNA, 22 bp, Homo sapiens
tggaactgaccccctcccctga

SEQ ID NO: 6746127 - DNA, 17 bp, Homo sapiens
tggaactgctgccactg

SEQ ID NO: 6746128 - DNA, 19 bp, Homo sapiens
tggaactgctgccactgag

SEQ ID NO: 6746129 - DNA, 13 bp, Homo sapiens
tggaactgctgct

SEQ ID NO: 6746130 - DNA, 17 bp, Homo sapiens
tggaactgctgctgacc

SEQ ID NO: 6746131 - DNA, 13 bp, Homo sapiens
tggaactggaggc

SEQ ID NO: 6746132 - DNA, 12 bp, Homo sapiens
tggaactgtccc

SEQ ID NO: 6746133 - DNA, 20 bp, Homo sapiens
tggaactgtgtatttattta

SEQ ID NO: 6746134 - DNA, 14 bp, Homo sapiens
tggaacttagccat

SEQ ID NO: 6746135 - DNA, 16 bp, Homo sapiens
tggaacttagccattt

SEQ ID NO: 6746136 - DNA, 21 bp, Homo sapiens
tggaacttctaatatattttt

SEQ ID NO: 6746137 - DNA, 18 bp, Homo sapiens
tggaacttgcctgccttt

SEQ ID NO: 6746138 - DNA, 21 bp, Homo sapiens
tggaacttttattagataaca

SEQ ID NO: 6746139 - DNA, 23 bp, Homo sapiens
tggaagaaaatggaattactcca

SEQ ID NO: 6746140 - DNA, 13 bp, Homo sapiens
tggaagaaagaag

SEQ ID NO: 6746141 - DNA, 15 bp, Homo sapiens
tggaagaaagaagca

SEQ ID NO: 6746142 - DNA, 17 bp, Homo sapiens
tggaagaaagccctgtg

SEQ ID NO: 6746143 - DNA, 16 bp, Homo sapiens
tggaagaaaggctgtg

SEQ ID NO: 6746144 - DNA, 13 bp, Homo sapiens
tggaagaaagtaa

SEQ ID NO: 6746145 - DNA, 14 bp, Homo sapiens
tggaagaaagtaag

SEQ ID NO: 6746146 - DNA, 22 bp, Homo sapiens
tggaagaaatggctatgaacag

SEQ ID NO: 6746147 - DNA, 23 bp, Homo sapiens
tggaagaaatggctatgaacaga

SEQ ID NO: 6746148 - DNA, 13 bp, Homo sapiens
tggaagaacatca

SEQ ID NO: 6746149 - DNA, 21 bp, Homo sapiens
tggaagaacatcaagatacct

SEQ ID NO: 6746150 - DNA, 12 bp, Homo sapiens
tggaagaaccac

SEQ ID NO: 6746151 - DNA, 16 bp, Homo sapiens
tggaagaacccttctc

SEQ ID NO: 6746152 - DNA, 19 bp, Homo sapiens
tggaagaactgcatgggga

SEQ ID NO: 6746153 - DNA, 17 bp, Homo sapiens
tggaagaagaaaggact

SEQ ID NO: 6746154 - DNA, 20 bp, Homo sapiens
tggaagaagaaccaggcatg

SEQ ID NO: 6746155 - DNA, 12 bp, Homo sapiens
tggaagaagagg

SEQ ID NO: 6746156 - DNA, 16 bp, Homo sapiens
tggaagaagaggagga

SEQ ID NO: 6746157 - DNA, 12 bp, Homo sapiens
tggaagaagcag

SEQ ID NO: 6746158 - DNA, 14 bp, Homo sapiens
tggaagaagcagcg

SEQ ID NO: 6746159 - DNA, 17 bp, Homo sapiens
tggaagaagggagaaga

SEQ ID NO: 6746160 - DNA, 19 bp, Homo sapiens
tggaagaagggagaagaaa

SEQ ID NO: 6746161 - DNA, 16 bp, Homo sapiens
tggaagaaggggcagg

SEQ ID NO: 6746162 - DNA, 21 bp, Homo sapiens
tggaagaataaaattgcctct

SEQ ID NO: 6746163 - DNA, 12 bp, Homo sapiens
tggaagaattca

SEQ ID NO: 6746164 - DNA, 17 bp, Homo sapiens
tggaagaattcatgatg

SEQ ID NO: 6746165 - DNA, 21 bp, Homo sapiens
tggaagaattctagcatgcta

SEQ ID NO: 6746166 - DNA, 15 bp, Homo sapiens
tggaagacaaataca

SEQ ID NO: 6746167 - DNA, 14 bp, Homo sapiens
tggaagacacttca

SEQ ID NO: 6746168 - DNA, 23 bp, Homo sapiens
tggaagacacttgctgagtgaag

SEQ ID NO: 6746169 - DNA, 16 bp, Homo sapiens
tggaagacagctctta

SEQ ID NO: 6746170 - DNA, 21 bp, Homo sapiens
tggaagacatatattatatat

SEQ ID NO: 6746171 - DNA, 14 bp, Homo sapiens
tggaagacctaagg

SEQ ID NO: 6746172 - DNA, 18 bp, Homo sapiens
tggaagacctaaggcaga

SEQ ID NO: 6746173 - DNA, 17 bp, Homo sapiens
tggaagacgcaagggcc

SEQ ID NO: 6746174 - DNA, 12 bp, Homo sapiens
tggaagacgtgg

SEQ ID NO: 6746175 - DNA, 13 bp, Homo sapiens
tggaagagaaatc

SEQ ID NO: 6746176 - DNA, 12 bp, Homo sapiens
tggaagagaatc

SEQ ID NO: 6746177 - DNA, 15 bp, Homo sapiens
tggaagagaggcacc

SEQ ID NO: 6746178 - DNA, 17 bp, Homo sapiens
tggaagagcagcctgat

SEQ ID NO: 6746179 - DNA, 17 bp, Homo sapiens
tggaagagcccagtctg

SEQ ID NO: 6746180 - DNA, 22 bp, Homo sapiens
tggaagagcccgccgtctgcag

SEQ ID NO: 6746181 - DNA, 23 bp, Homo sapiens
tggaagagcctgcaggtgctgct

SEQ ID NO: 6746182 - DNA, 18 bp, Homo sapiens
tggaagagctaggcaggg

SEQ ID NO: 6746183 - DNA, 13 bp, Homo sapiens
tggaagagctctt

SEQ ID NO: 6746184 - DNA, 14 bp, Homo sapiens
tggaagagctcttc

SEQ ID NO: 6746185 - DNA, 22 bp, Homo sapiens
tggaagagctgctgtatttgag

SEQ ID NO: 6746186 - DNA, 22 bp, Homo sapiens
tggaagagggagggtcagtgcc

SEQ ID NO: 6746187 - DNA, 15 bp, Homo sapiens
tggaagagggctgca

SEQ ID NO: 6746188 - DNA, 13 bp, Homo sapiens
tggaagagggtga

SEQ ID NO: 6746189 - DNA, 18 bp, Homo sapiens
tggaagagggtgaaaggc

SEQ ID NO: 6746190 - DNA, 17 bp, Homo sapiens
tggaagaggttctcagc

SEQ ID NO: 6746191 - DNA, 18 bp, Homo sapiens
tggaagaggttctcagca

SEQ ID NO: 6746192 - DNA, 20 bp, Homo sapiens
tggaagaggttctcagcaag

SEQ ID NO: 6746193 - DNA, 21 bp, Homo sapiens
tggaagaggttctcagcaagt

SEQ ID NO: 6746194 - DNA, 22 bp, Homo sapiens
tggaagaggttctcagcaagtg

SEQ ID NO: 6746195 - DNA, 16 bp, Homo sapiens
tggaagataattttat

SEQ ID NO: 6746196 - DNA, 19 bp, Homo sapiens
tggaagatagttttctcct

SEQ ID NO: 6746197 - DNA, 16 bp, Homo sapiens
tggaagatcatggacc

SEQ ID NO: 6746198 - DNA, 21 bp, Homo sapiens
tggaagatcctgcgggtgggg

SEQ ID NO: 6746199 - DNA, 17 bp, Homo sapiens
tggaagatgcagaagca

SEQ ID NO: 6746200 - DNA, 21 bp, Homo sapiens
tggaagatgcagaagcaataa

SEQ ID NO: 6746201 - DNA, 21 bp, Homo sapiens
tggaagatggggaccagcagc

SEQ ID NO: 6746202 - DNA, 23 bp, Homo sapiens
tggaagatggggaccagcagccc

SEQ ID NO: 6746203 - DNA, 18 bp, Homo sapiens
tggaagattattgagagc

SEQ ID NO: 6746204 - DNA, 14 bp, Homo sapiens
tggaagattcagct

SEQ ID NO: 6746205 - DNA, 21 bp, Homo sapiens
tggaagattctatttaattga

SEQ ID NO: 6746206 - DNA, 23 bp, Homo sapiens
tggaagattctatttaattgaaa

SEQ ID NO: 6746207 - DNA, 22 bp, Homo sapiens
tggaagatttaccttttctgtt

SEQ ID NO: 6746208 - DNA, 14 bp, Homo sapiens
tggaagattttaaa

SEQ ID NO: 6746209 - DNA, 17 bp, Homo sapiens
tggaagattttcagtct

SEQ ID NO: 6746210 - DNA, 18 bp, Homo sapiens
tggaagattttcattgag

SEQ ID NO: 6746211 - DNA, 19 bp, Homo sapiens
tggaagcaaagacaaaaga

SEQ ID NO: 6746212 - DNA, 16 bp, Homo sapiens
tggaagcaacgtgtta

SEQ ID NO: 6746213 - DNA, 22 bp, Homo sapiens
tggaagcacagaaaactagaat

SEQ ID NO: 6746214 - DNA, 14 bp, Homo sapiens
tggaagcacaggca

SEQ ID NO: 6746215 - DNA, 20 bp, Homo sapiens
tggaagcactttttctgcat

SEQ ID NO: 6746216 - DNA, 15 bp, Homo sapiens
tggaagcagaaacaa

SEQ ID NO: 6746217 - DNA, 16 bp, Homo sapiens
tggaagcagaggccct

SEQ ID NO: 6746218 - DNA, 18 bp, Homo sapiens
tggaagcagaggccctgc

SEQ ID NO: 6746219 - DNA, 21 bp, Homo sapiens
tggaagcagaggccctgcccc

SEQ ID NO: 6746220 - DNA, 13 bp, Homo sapiens
tggaagcaggtgc

SEQ ID NO: 6746221 - DNA, 18 bp, Homo sapiens
tggaagcaggttaaatgt

SEQ ID NO: 6746222 - DNA, 20 bp, Homo sapiens
tggaagcaggttaaatgttt

SEQ ID NO: 6746223 - DNA, 21 bp, Homo sapiens
tggaagcaggttaaatgtttt

SEQ ID NO: 6746224 - DNA, 14 bp, Homo sapiens
tggaagcagtgccc

SEQ ID NO: 6746225 - DNA, 19 bp, Homo sapiens
tggaagcatgtaggagaat

SEQ ID NO: 6746226 - DNA, 20 bp, Homo sapiens
tggaccccctgcccgccaca

SEQ ID NO: 6746227 - DNA, 14 bp, Homo sapiens
tggaccccgcctcc

SEQ ID NO: 6746228 - DNA, 22 bp, Homo sapiens
tggacccctggggtggccaggg

SEQ ID NO: 6746229 - DNA, 22 bp, Homo sapiens
tggacccgttcatgggggaggg

SEQ ID NO: 6746230 - DNA, 21 bp, Homo sapiens
tggaccctactattcatgttt

SEQ ID NO: 6746231 - DNA, 22 bp, Homo sapiens
tggaccctactattcatgtttt

SEQ ID NO: 6746232 - DNA, 19 bp, Homo sapiens
tggaccctcgctctctgtc

SEQ ID NO: 6746233 - DNA, 16 bp, Homo sapiens
tggaccctctcctgga

SEQ ID NO: 6746234 - DNA, 15 bp, Homo sapiens
tggaccctgaaatgt

SEQ ID NO: 6746235 - DNA, 16 bp, Homo sapiens
tggaccctgaaatgtg

SEQ ID NO: 6746236 - DNA, 18 bp, Homo sapiens
tggaccctgaaatgtgtg

SEQ ID NO: 6746237 - DNA, 13 bp, Homo sapiens
tggaccctgacca

SEQ ID NO: 6746238 - DNA, 11 bp, Homo sapiens
tggaccctggg

SEQ ID NO: 6746239 - DNA, 13 bp, Homo sapiens
tggaccctgggag

SEQ ID NO: 6746240 - DNA, 14 bp, Homo sapiens
tggaccctggtgac

SEQ ID NO: 6746241 - DNA, 18 bp, Homo sapiens
tggaccctgtcttctggg

SEQ ID NO: 6746242 - DNA, 15 bp, Homo sapiens
tggaccctgtggcca

SEQ ID NO: 6746243 - DNA, 14 bp, Homo sapiens
tggaccctgttgct

SEQ ID NO: 6746244 - DNA, 17 bp, Homo sapiens
tggaccgagatgtgagt

SEQ ID NO: 6746245 - DNA, 21 bp, Homo sapiens
tggaccgagatgtgagtcctg

SEQ ID NO: 6746246 - DNA, 22 bp, Homo sapiens
tggaccgaggttcccactctgg

SEQ ID NO: 6746247 - DNA, 15 bp, Homo sapiens
tggaccggagagtgg

SEQ ID NO: 6746248 - DNA, 14 bp, Homo sapiens
tggaccggccgcag

SEQ ID NO: 6746249 - DNA, 17 bp, Homo sapiens
tggaccggccgcagccc

SEQ ID NO: 6746250 - DNA, 18 bp, Homo sapiens
tggaccggccgcagcccc

SEQ ID NO: 6746251 - DNA, 16 bp, Homo sapiens
tggaccgggtgggcct

SEQ ID NO: 6746252 - DNA, 20 bp, Homo sapiens
tggaccgggtgggcctggcc

SEQ ID NO: 6746253 - DNA, 21 bp, Homo sapiens
tggaccgggtgggcctggcct

SEQ ID NO: 6746254 - DNA, 15 bp, Homo sapiens
tggaccgtggacagg

SEQ ID NO: 6746255 - DNA, 18 bp, Homo sapiens
tggaccgtggacaggccc

SEQ ID NO: 6746256 - DNA, 20 bp, Homo sapiens
tggaccgtggacaggcccag

SEQ ID NO: 6746257 - DNA, 18 bp, Homo sapiens
tggacctaaagggtatga

SEQ ID NO: 6746258 - DNA, 21 bp, Homo sapiens
tggacctaaatggcctcatgt

SEQ ID NO: 6746259 - DNA, 17 bp, Homo sapiens
tggacctagcctggatg

SEQ ID NO: 6746260 - DNA, 19 bp, Homo sapiens
tggacctatgcagggaggc

SEQ ID NO: 6746261 - DNA, 13 bp, Homo sapiens
tggacctcagcaa

SEQ ID NO: 6746262 - DNA, 17 bp, Homo sapiens
tggacctcagcaagctg

SEQ ID NO: 6746263 - DNA, 22 bp, Homo sapiens
tggacctcagcaagctgcccag

SEQ ID NO: 6746264 - DNA, 22 bp, Homo sapiens
tggacctcaggagggcaggctg

SEQ ID NO: 6746265 - DNA, 15 bp, Homo sapiens
tggacctccaggggc

SEQ ID NO: 6746266 - DNA, 16 bp, Homo sapiens
tggacctccaggggct

SEQ ID NO: 6746267 - DNA, 23 bp, Homo sapiens
tggacctccaggggctcctgggt

SEQ ID NO: 6746268 - DNA, 19 bp, Homo sapiens
tggacctccatccctgctc

SEQ ID NO: 6746269 - DNA, 17 bp, Homo sapiens
tggacctcgtgctttaa

SEQ ID NO: 6746270 - DNA, 21 bp, Homo sapiens
tggacctctatcatctgctaa

SEQ ID NO: 6746271 - DNA, 14 bp, Homo sapiens
tggacctctgacag

SEQ ID NO: 6746272 - DNA, 13 bp, Homo sapiens
tggacctctgctc

SEQ ID NO: 6746273 - DNA, 17 bp, Homo sapiens
tggacctgaccagactg

SEQ ID NO: 6746274 - DNA, 21 bp, Homo sapiens
tggacctgcagttggcctcag

SEQ ID NO: 6746275 - DNA, 23 bp, Homo sapiens
tggacctgcagttggcctcagca

SEQ ID NO: 6746276 - DNA, 15 bp, Homo sapiens
tggacctgcatattt

SEQ ID NO: 6746277 - DNA, 22 bp, Homo sapiens
tggacctgcatatttagctgtt

SEQ ID NO: 6746278 - DNA, 21 bp, Homo sapiens
tggacctgcctacggagggtg

SEQ ID NO: 6746279 - DNA, 17 bp, Homo sapiens
tggacctgcctcctgcc

SEQ ID NO: 6746280 - DNA, 19 bp, Homo sapiens
tggacctggcggcaggaag

SEQ ID NO: 6746281 - DNA, 23 bp, Homo sapiens
tggacctgggaacgactggactg

SEQ ID NO: 6746282 - DNA, 16 bp, Homo sapiens
tggacctggggagtgg

SEQ ID NO: 6746283 - DNA, 17 bp, Homo sapiens
tggacctgggggtagcc

SEQ ID NO: 6746284 - DNA, 17 bp, Homo sapiens
tggacctggtgcccctg

SEQ ID NO: 6746285 - DNA, 16 bp, Homo sapiens
tggaccttaggccttc

SEQ ID NO: 6746286 - DNA, 21 bp, Homo sapiens
tggaccttaggccttcctctc

SEQ ID NO: 6746287 - DNA, 19 bp, Homo sapiens
tggaccttcctgccaccag

SEQ ID NO: 6746288 - DNA, 21 bp, Homo sapiens
tggaccttgacagagcagcta

SEQ ID NO: 6746289 - DNA, 21 bp, Homo sapiens
tggacctttggggaaggggga

SEQ ID NO: 6746290 - DNA, 20 bp, Homo sapiens
tggacctttgggttctttct

SEQ ID NO: 6746291 - DNA, 16 bp, Homo sapiens
tggaccttttctttac

SEQ ID NO: 6746292 - DNA, 20 bp, Homo sapiens
tggacgaagagcaggccagc

SEQ ID NO: 6746293 - DNA, 13 bp, Homo sapiens
tggacgaaggtct

SEQ ID NO: 6746294 - DNA, 22 bp, Homo sapiens
tggacgaatatgaatgtcacat

SEQ ID NO: 6746295 - DNA, 14 bp, Homo sapiens
tggacgagaaggtg

SEQ ID NO: 6746296 - DNA, 14 bp, Homo sapiens
tggacgcagccaca

SEQ ID NO: 6746297 - DNA, 16 bp, Homo sapiens
tggacgcagccacaca

SEQ ID NO: 6746298 - DNA, 18 bp, Homo sapiens
tggacgcagccacacagt

SEQ ID NO: 6746299 - DNA, 15 bp, Homo sapiens
tggacgcccagctga

SEQ ID NO: 6746300 - DNA, 14 bp, Homo sapiens
tggacgcctggctc

SEQ ID NO: 6746301 - DNA, 15 bp, Homo sapiens
tggacgcctggctcc

SEQ ID NO: 6746302 - DNA, 12 bp, Homo sapiens
tggacgctgcag

SEQ ID NO: 6746303 - DNA, 16 bp, Homo sapiens
tggacgctgccctgca

SEQ ID NO: 6746304 - DNA, 18 bp, Homo sapiens
tggacgctgccctgcatg

SEQ ID NO: 6746305 - DNA, 20 bp, Homo sapiens
tggacgctgccgggagactg

SEQ ID NO: 6746306 - DNA, 14 bp, Homo sapiens
tggacgctgtccat

SEQ ID NO: 6746307 - DNA, 14 bp, Homo sapiens
tggacgctgtgctg

SEQ ID NO: 6746308 - DNA, 15 bp, Homo sapiens
tggacggagagcctt

SEQ ID NO: 6746309 - DNA, 16 bp, Homo sapiens
tggacggagccaaagg

SEQ ID NO: 6746310 - DNA, 21 bp, Homo sapiens
tggacggattccttggcagcc

SEQ ID NO: 6746311 - DNA, 13 bp, Homo sapiens
tggacggcaggct

SEQ ID NO: 6746312 - DNA, 21 bp, Homo sapiens
tggacggcaggctcactgcca

SEQ ID NO: 6746313 - DNA, 15 bp, Homo sapiens
tggacggcgctgcct

SEQ ID NO: 6746314 - DNA, 19 bp, Homo sapiens
tggacgggatgacctccag

SEQ ID NO: 6746315 - DNA, 23 bp, Homo sapiens
tggacgggatgacctccagaagt

SEQ ID NO: 6746316 - DNA, 23 bp, Homo sapiens
tggacggggatggttccccagga

SEQ ID NO: 6746317 - DNA, 22 bp, Homo sapiens
tggacggggcgggccctgcctg

SEQ ID NO: 6746318 - DNA, 23 bp, Homo sapiens
tggacggggcgggccctgcctga

SEQ ID NO: 6746319 - DNA, 24 bp, Homo sapiens
tggacggggcgggccctgcctgag

SEQ ID NO: 6746320 - DNA, 14 bp, Homo sapiens
tggacggtgctcca

SEQ ID NO: 6746321 - DNA, 16 bp, Homo sapiens
tggacggtgctccagg

SEQ ID NO: 6746322 - DNA, 21 bp, Homo sapiens
tggacggtttctagcctctga

SEQ ID NO: 6746323 - DNA, 13 bp, Homo sapiens
tggacgtagagtt

SEQ ID NO: 6746324 - DNA, 15 bp, Homo sapiens
tggacgtaggatatt

SEQ ID NO: 6746325 - DNA, 18 bp, Homo sapiens
tggacgtcagcctgtgga

SEQ ID NO: 6746326 - DNA, 12 bp, Homo sapiens
tggacgtgaaat

SEQ ID NO: 6746327 - DNA, 13 bp, Homo sapiens
tggacgtgaaata

SEQ ID NO: 6746328 - DNA, 16 bp, Homo sapiens
tggacgtgggctccag

SEQ ID NO: 6746329 - DNA, 19 bp, Homo sapiens
tggacgtgttatgactcca

SEQ ID NO: 6746330 - DNA, 19 bp, Homo sapiens
tggacgttaggccaggcct

SEQ ID NO: 6746331 - DNA, 21 bp, Homo sapiens
tggactaaaagatataagtgc

SEQ ID NO: 6746332 - DNA, 18 bp, Homo sapiens
tggactaaatatctgtca

SEQ ID NO: 6746333 - DNA, 22 bp, Homo sapiens
tggactaaatgcctagttttta

SEQ ID NO: 6746334 - DNA, 21 bp, Homo sapiens
tggactaaccccaacgcacag

SEQ ID NO: 6746335 - DNA, 22 bp, Homo sapiens
tggactaaccccaacgcacagg

SEQ ID NO: 6746336 - DNA, 20 bp, Homo sapiens
tggactaacttgtctttgga

SEQ ID NO: 6746337 - DNA, 13 bp, Homo sapiens
tggactaagaaga

SEQ ID NO: 6746338 - DNA, 14 bp, Homo sapiens
tggactaagcaatt

SEQ ID NO: 6746339 - DNA, 19 bp, Homo sapiens
tggactacacaatacagta

SEQ ID NO: 6746340 - DNA, 22 bp, Homo sapiens
tggactacacaatacagtatta

SEQ ID NO: 6746341 - DNA, 24 bp, Homo sapiens
tggactacccacgttctcacaccc

SEQ ID NO: 6746342 - DNA, 19 bp, Homo sapiens
tggactagcaaaggaaaat

SEQ ID NO: 6746343 - DNA, 14 bp, Homo sapiens
tggactagccagaa

SEQ ID NO: 6746344 - DNA, 16 bp, Homo sapiens
tggactatagcagggc

SEQ ID NO: 6746345 - DNA, 19 bp, Homo sapiens
tggactatagcagggctgg

SEQ ID NO: 6746346 - DNA, 22 bp, Homo sapiens
tggactatctgtctggtggccc

SEQ ID NO: 6746347 - DNA, 23 bp, Homo sapiens
tggactatctgtctggtggcccc

SEQ ID NO: 6746348 - DNA, 14 bp, Homo sapiens
tggactatgcacac

SEQ ID NO: 6746349 - DNA, 18 bp, Homo sapiens
tggactattataatttaa

SEQ ID NO: 6746350 - DNA, 14 bp, Homo sapiens
tggactcagcccac

SEQ ID NO: 6746351 - DNA, 19 bp, Homo sapiens
tggactcagccttgcaaat

SEQ ID NO: 6746352 - DNA, 20 bp, Homo sapiens
tggactcagctctgtctgct

SEQ ID NO: 6746353 - DNA, 20 bp, Homo sapiens
tggactcaggatccagtgac

SEQ ID NO: 6746354 - DNA, 18 bp, Homo sapiens
tggactcaggatgcccag

SEQ ID NO: 6746355 - DNA, 18 bp, Homo sapiens
tggactcagggcagcgcc

SEQ ID NO: 6746356 - DNA, 21 bp, Homo sapiens
tggactccacgatgcctttga

SEQ ID NO: 6746357 - DNA, 22 bp, Homo sapiens
tggactccacgatgcctttgag

SEQ ID NO: 6746358 - DNA, 19 bp, Homo sapiens
tggactccagactctctgt

SEQ ID NO: 6746359 - DNA, 21 bp, Homo sapiens
tggactccagactctctgtga

SEQ ID NO: 6746360 - DNA, 18 bp, Homo sapiens
tggactccagatctgcac

SEQ ID NO: 6746361 - DNA, 21 bp, Homo sapiens
tggactccaggatcctcctgg

SEQ ID NO: 6746362 - DNA, 12 bp, Homo sapiens
tggactccaggc

SEQ ID NO: 6746363 - DNA, 14 bp, Homo sapiens
tggactccaggcct

SEQ ID NO: 6746364 - DNA, 17 bp, Homo sapiens
tggactcccactctttg

SEQ ID NO: 6746365 - DNA, 15 bp, Homo sapiens
tggactccctcccca

SEQ ID NO: 6746366 - DNA, 21 bp, Homo sapiens
tggactccggaggactgagcc

SEQ ID NO: 6746367 - DNA, 22 bp, Homo sapiens
tggactccggaggactgagccc

SEQ ID NO: 6746368 - DNA, 14 bp, Homo sapiens
tggactccggccct

SEQ ID NO: 6746369 - DNA, 13 bp, Homo sapiens
tggactcctccca

SEQ ID NO: 6746370 - DNA, 13 bp, Homo sapiens
tggactcctctgt

SEQ ID NO: 6746371 - DNA, 14 bp, Homo sapiens
tggactcctcttgg

SEQ ID NO: 6746372 - DNA, 15 bp, Homo sapiens
tggactcctgcacac

SEQ ID NO: 6746373 - DNA, 18 bp, Homo sapiens
tggactctaaagaccaaa

SEQ ID NO: 6746374 - DNA, 23 bp, Homo sapiens
tggactctaagctggagctcttg

SEQ ID NO: 6746375 - DNA, 23 bp, Homo sapiens
tggactctagtccttggctggac

SEQ ID NO: 6746376 - DNA, 15 bp, Homo sapiens
tggactctcagtctc

SEQ ID NO: 6746377 - DNA, 17 bp, Homo sapiens
tggactctcccctctta

SEQ ID NO: 6746378 - DNA, 12 bp, Homo sapiens
tggactctctgt

SEQ ID NO: 6746379 - DNA, 16 bp, Homo sapiens
tggactctctgtggtc

SEQ ID NO: 6746380 - DNA, 14 bp, Homo sapiens
tggactctgagctc

SEQ ID NO: 6746381 - DNA, 20 bp, Homo sapiens
tggactctgaggactcctga

SEQ ID NO: 6746382 - DNA, 15 bp, Homo sapiens
tggactctgcacatg

SEQ ID NO: 6746383 - DNA, 17 bp, Homo sapiens
tggactctgcacatgaa

SEQ ID NO: 6746384 - DNA, 13 bp, Homo sapiens
tggactctgcatc

SEQ ID NO: 6746385 - DNA, 16 bp, Homo sapiens
tggactctgcatccca

SEQ ID NO: 6746386 - DNA, 13 bp, Homo sapiens
tggactctgcccc

SEQ ID NO: 6746387 - DNA, 17 bp, Homo sapiens
tggactctgccccaatc

SEQ ID NO: 6746388 - DNA, 13 bp, Homo sapiens
tggactctgctag

SEQ ID NO: 6746389 - DNA, 14 bp, Homo sapiens
tggactctgctaga

SEQ ID NO: 6746390 - DNA, 20 bp, Homo sapiens
tggactctgctagactcctc

SEQ ID NO: 6746391 - DNA, 16 bp, Homo sapiens
tggactctggactggg

SEQ ID NO: 6746392 - DNA, 18 bp, Homo sapiens
tggactctggactttctc

SEQ ID NO: 6746393 - DNA, 13 bp, Homo sapiens
tggactctgtcct

SEQ ID NO: 6746394 - DNA, 22 bp, Homo sapiens
tggactctgtcctgaaggcctg

SEQ ID NO: 6746395 - DNA, 23 bp, Homo sapiens
tggactctgtcctgaaggcctga

SEQ ID NO: 6746396 - DNA, 17 bp, Homo sapiens
tggactcttctcggctc

SEQ ID NO: 6746397 - DNA, 14 bp, Homo sapiens
tggactcttgctct

SEQ ID NO: 6746398 - DNA, 18 bp, Homo sapiens
tggactcttgctctttct

SEQ ID NO: 6746399 - DNA, 17 bp, Homo sapiens
tggactgaagcctgcag

SEQ ID NO: 6746400 - DNA, 22 bp, Homo sapiens
tggactgaatgggatcatgaaa

SEQ ID NO: 6746401 - DNA, 14 bp, Homo sapiens
tggactgacagcat

SEQ ID NO: 6746402 - DNA, 10 bp, Homo sapiens
tggactgacc

SEQ ID NO: 6746403 - DNA, 14 bp, Homo sapiens
tggaggcaagaggg

SEQ ID NO: 6746404 - DNA, 17 bp, Homo sapiens
tggaggcaagagggagg

SEQ ID NO: 6746405 - DNA, 14 bp, Homo sapiens
tggaggcaatccta

SEQ ID NO: 6746406 - DNA, 14 bp, Homo sapiens
tggaggcaatgtgg

SEQ ID NO: 6746407 - DNA, 22 bp, Homo sapiens
tggaggcacacagctgcagaga

SEQ ID NO: 6746408 - DNA, 15 bp, Homo sapiens
tggaggcacgcacca

SEQ ID NO: 6746409 - DNA, 17 bp, Homo sapiens
tggaggcacgcaccact

SEQ ID NO: 6746410 - DNA, 14 bp, Homo sapiens
tggaggcactttag

SEQ ID NO: 6746411 - DNA, 16 bp, Homo sapiens
tggaggcagatgccct

SEQ ID NO: 6746412 - DNA, 11 bp, Homo sapiens
tggaggcaggg

SEQ ID NO: 6746413 - DNA, 14 bp, Homo sapiens
tggaggcaggggct

SEQ ID NO: 6746414 - DNA, 17 bp, Homo sapiens
tggaggcaggggcttcc

SEQ ID NO: 6746415 - DNA, 19 bp, Homo sapiens
tggaggcaggggcttcctg

SEQ ID NO: 6746416 - DNA, 22 bp, Homo sapiens
tggaggcatgtgatgagaggaa

SEQ ID NO: 6746417 - DNA, 19 bp, Homo sapiens
tggaggcattcccagaggt

SEQ ID NO: 6746418 - DNA, 22 bp, Homo sapiens
tggaggcattcccagaggtggg

SEQ ID NO: 6746419 - DNA, 13 bp, Homo sapiens
tggaggccaagcc

SEQ ID NO: 6746420 - DNA, 14 bp, Homo sapiens
tggaggccaagcct

SEQ ID NO: 6746421 - DNA, 24 bp, Homo sapiens
tggaggccaccgggacagacctgg

SEQ ID NO: 6746422 - DNA, 23 bp, Homo sapiens
tggaggccagagtctcccagtgg

SEQ ID NO: 6746423 - DNA, 14 bp, Homo sapiens
tggaggccagccag

SEQ ID NO: 6746424 - DNA, 14 bp, Homo sapiens
tggaggccaggaat

SEQ ID NO: 6746425 - DNA, 22 bp, Homo sapiens
tggaggccattgtgtgagccta

SEQ ID NO: 6746426 - DNA, 12 bp, Homo sapiens
tggaggcccagg

SEQ ID NO: 6746427 - DNA, 14 bp, Homo sapiens
tggaggcccaggct

SEQ ID NO: 6746428 - DNA, 19 bp, Homo sapiens
tggaggccgaggaccacca

SEQ ID NO: 6746429 - DNA, 20 bp, Homo sapiens
tggaggccgaggaccaccag

SEQ ID NO: 6746430 - DNA, 23 bp, Homo sapiens
tggaggccgaggaccaccagcag

SEQ ID NO: 6746431 - DNA, 15 bp, Homo sapiens
tggaggccgctgctg

SEQ ID NO: 6746432 - DNA, 19 bp, Homo sapiens
tggaggccgggtgctcagg

SEQ ID NO: 6746433 - DNA, 12 bp, Homo sapiens
tggaggcctcac

SEQ ID NO: 6746434 - DNA, 14 bp, Homo sapiens
tggaggcctcacac

SEQ ID NO: 6746435 - DNA, 14 bp, Homo sapiens
tggaggcctcaccc

SEQ ID NO: 6746436 - DNA, 15 bp, Homo sapiens
tggaggcctcaggga

SEQ ID NO: 6746437 - DNA, 17 bp, Homo sapiens
tggaggcctcaggtgct

SEQ ID NO: 6746438 - DNA, 13 bp, Homo sapiens
tggaggcctctgg

SEQ ID NO: 6746439 - DNA, 14 bp, Homo sapiens
tggaggcctctggc

SEQ ID NO: 6746440 - DNA, 17 bp, Homo sapiens
tggaggcctctggccct

SEQ ID NO: 6746441 - DNA, 16 bp, Homo sapiens
tggaggcctctgggcc

SEQ ID NO: 6746442 - DNA, 22 bp, Homo sapiens
tggaggcctctgggcctcctct

SEQ ID NO: 6746443 - DNA, 15 bp, Homo sapiens
tggaggcctgatgct

SEQ ID NO: 6746444 - DNA, 15 bp, Homo sapiens
tggaggcgagccaga

SEQ ID NO: 6746445 - DNA, 22 bp, Homo sapiens
tggaggcgagccagattaggcc

SEQ ID NO: 6746446 - DNA, 22 bp, Homo sapiens
tggaggcgccttcctgggttgg

SEQ ID NO: 6746447 - DNA, 18 bp, Homo sapiens
tggaggctaagcctggac

SEQ ID NO: 6746448 - DNA, 21 bp, Homo sapiens
tggaggctcagcccaccctcc

SEQ ID NO: 6746449 - DNA, 16 bp, Homo sapiens
tggaggctccaggact

SEQ ID NO: 6746450 - DNA, 20 bp, Homo sapiens
tggaggctccaggactccac

SEQ ID NO: 6746451 - DNA, 21 bp, Homo sapiens
tggaggctcccatgggctagg

SEQ ID NO: 6746452 - DNA, 11 bp, Homo sapiens
tggaggctcct

SEQ ID NO: 6746453 - DNA, 21 bp, Homo sapiens
tggaggctcctctaggccctg

SEQ ID NO: 6746454 - DNA, 15 bp, Homo sapiens
tggaggctcctgtgg

SEQ ID NO: 6746455 - DNA, 19 bp, Homo sapiens
tggaggctctgttctgcct

SEQ ID NO: 6746456 - DNA, 12 bp, Homo sapiens
tggaggctgagg

SEQ ID NO: 6746457 - DNA, 15 bp, Homo sapiens
tggaggctgcagtga

SEQ ID NO: 6746458 - DNA, 18 bp, Homo sapiens
tggaggctgcagtgagcc

SEQ ID NO: 6746459 - DNA, 17 bp, Homo sapiens
tggaggctgcctcccaa

SEQ ID NO: 6746460 - DNA, 19 bp, Homo sapiens
tggaggctgcgtcctgagg

SEQ ID NO: 6746461 - DNA, 12 bp, Homo sapiens
tggaggctgctg

SEQ ID NO: 6746462 - DNA, 14 bp, Homo sapiens
tggaggctgctgcc

SEQ ID NO: 6746463 - DNA, 21 bp, Homo sapiens
tggaggctgctgccccctggc

SEQ ID NO: 6746464 - DNA, 12 bp, Homo sapiens
tggaggctggac

SEQ ID NO: 6746465 - DNA, 13 bp, Homo sapiens
tggaggctggatg

SEQ ID NO: 6746466 - DNA, 14 bp, Homo sapiens
tggaggctgtcttc

SEQ ID NO: 6746467 - DNA, 15 bp, Homo sapiens
tggaggcttcctgcg

SEQ ID NO: 6746468 - DNA, 21 bp, Homo sapiens
tggaggcttggctgctcttcc

SEQ ID NO: 6746469 - DNA, 22 bp, Homo sapiens
tggaggcttttatggggccctg

SEQ ID NO: 6746470 - DNA, 16 bp, Homo sapiens
tggagggaagacaggt

SEQ ID NO: 6746471 - DNA, 16 bp, Homo sapiens
tggagggaagacctga

SEQ ID NO: 6746472 - DNA, 12 bp, Homo sapiens
tggagggaagcc

SEQ ID NO: 6746473 - DNA, 12 bp, Homo sapiens
tggagggagact

SEQ ID NO: 6746474 - DNA, 13 bp, Homo sapiens
tggagggagactg

SEQ ID NO: 6746475 - DNA, 18 bp, Homo sapiens
tggagggagactgaccca

SEQ ID NO: 6746476 - DNA, 16 bp, Homo sapiens
tggagggaggccccag

SEQ ID NO: 6746477 - DNA, 18 bp, Homo sapiens
tggagggaggccccaggg

SEQ ID NO: 6746478 - DNA, 17 bp, Homo sapiens
tggagggagggcagctg

SEQ ID NO: 6746479 - DNA, 18 bp, Homo sapiens
tggagggagggggaagtc

SEQ ID NO: 6746480 - DNA, 20 bp, Homo sapiens
tggagggatcagttgccccc

SEQ ID NO: 6746481 - DNA, 13 bp, Homo sapiens
tggagggatgcca

SEQ ID NO: 6746482 - DNA, 16 bp, Homo sapiens
tggagggatgccccca

SEQ ID NO: 6746483 - DNA, 17 bp, Homo sapiens
tggagggatgcccccag

SEQ ID NO: 6746484 - DNA, 21 bp, Homo sapiens
tggagggatgcccccaggcag

SEQ ID NO: 6746485 - DNA, 22 bp, Homo sapiens
tggagggatgcccccaggcagc

SEQ ID NO: 6746486 - DNA, 22 bp, Homo sapiens
tggagggcaacattccacagct

SEQ ID NO: 6746487 - DNA, 20 bp, Homo sapiens
tggagggcaaggggtttcca

SEQ ID NO: 6746488 - DNA, 12 bp, Homo sapiens
tggagggcagag

SEQ ID NO: 6746489 - DNA, 19 bp, Homo sapiens
tggagggcagagtgggctg

SEQ ID NO: 6746490 - DNA, 12 bp, Homo sapiens
tggagggcctgg

SEQ ID NO: 6746491 - DNA, 22 bp, Homo sapiens
tggagggcctgggcctggctcc

SEQ ID NO: 6746492 - DNA, 21 bp, Homo sapiens
tggagggcgcccagcagcctg

SEQ ID NO: 6746493 - DNA, 22 bp, Homo sapiens
tggagggcgcccagcagcctgc

SEQ ID NO: 6746494 - DNA, 20 bp, Homo sapiens
tggagggctagaacctggag

SEQ ID NO: 6746495 - DNA, 22 bp, Homo sapiens
tggagggctagaatctggagag

SEQ ID NO: 6746496 - DNA, 23 bp, Homo sapiens
tggagggctagaatctggagagc

SEQ ID NO: 6746497 - DNA, 20 bp, Homo sapiens
tggagggctatggcctccct

SEQ ID NO: 6746498 - DNA, 20 bp, Homo sapiens
tggagggctcatgggtggga

SEQ ID NO: 6746499 - DNA, 20 bp, Homo sapiens
tggagggcttggtaaaacac

SEQ ID NO: 6746500 - DNA, 22 bp, Homo sapiens
tggaggggaaatggggaaagca

SEQ ID NO: 6746501 - DNA, 15 bp, Homo sapiens
tggaggggagagggg

SEQ ID NO: 6746502 - DNA, 16 bp, Homo sapiens
tggaggggagctgctg

SEQ ID NO: 6746503 - DNA, 21 bp, Homo sapiens
tggaggggagctgctggccat

SEQ ID NO: 6746504 - DNA, 21 bp, Homo sapiens
tggaggggatgataaaggaaa

SEQ ID NO: 6746505 - DNA, 14 bp, Homo sapiens
tggaggggcagagc

SEQ ID NO: 6746506 - DNA, 23 bp, Homo sapiens
tggaggggcagagccaggaagat

SEQ ID NO: 6746507 - DNA, 14 bp, Homo sapiens
tggaggggcaggcc

SEQ ID NO: 6746508 - DNA, 16 bp, Homo sapiens
tggaggggcaggcctt

SEQ ID NO: 6746509 - DNA, 14 bp, Homo sapiens
tggaggggcccacc

SEQ ID NO: 6746510 - DNA, 14 bp, Homo sapiens
tggaggggcccctg

SEQ ID NO: 6746511 - DNA, 13 bp, Homo sapiens
tggaggggccctc

SEQ ID NO: 6746512 - DNA, 14 bp, Homo sapiens
tggaggggccctcc

SEQ ID NO: 6746513 - DNA, 17 bp, Homo sapiens
tggaggggcgcccaggg

SEQ ID NO: 6746514 - DNA, 21 bp, Homo sapiens
tggaggggctgtcctccttcc

SEQ ID NO: 6746515 - DNA, 22 bp, Homo sapiens
tggaggggcttgggcctgcacc

SEQ ID NO: 6746516 - DNA, 22 bp, Homo sapiens
tggagggggaggggagaagcca

SEQ ID NO: 6746517 - DNA, 15 bp, Homo sapiens
tggagggggcagagt

SEQ ID NO: 6746518 - DNA, 16 bp, Homo sapiens
tggagggggcagagtg

SEQ ID NO: 6746519 - DNA, 17 bp, Homo sapiens
tggagggggcagagtgg

SEQ ID NO: 6746520 - DNA, 22 bp, Homo sapiens
tggagggggcagagtggcctgt

SEQ ID NO: 6746521 - DNA, 17 bp, Homo sapiens
tggagggggctgggctc

SEQ ID NO: 6746522 - DNA, 20 bp, Homo sapiens
tggagggggctgggctcaca

SEQ ID NO: 6746523 - DNA, 21 bp, Homo sapiens
tggagggggctgggctcacag

SEQ ID NO: 6746524 - DNA, 15 bp, Homo sapiens
tggagggggctgggg

SEQ ID NO: 6746525 - DNA, 16 bp, Homo sapiens
tggagggggctggggt

SEQ ID NO: 6746526 - DNA, 21 bp, Homo sapiens
tggagggggtgtctggaagct

SEQ ID NO: 6746527 - DNA, 20 bp, Homo sapiens
tggaggggtaggggctggga

SEQ ID NO: 6746528 - DNA, 16 bp, Homo sapiens
tggaggggtcagcagg

SEQ ID NO: 6746529 - DNA, 21 bp, Homo sapiens
tggaggggtcatccttgccca

SEQ ID NO: 6746530 - DNA, 23 bp, Homo sapiens
tggaggggtggcccagagccata

SEQ ID NO: 6746531 - DNA, 14 bp, Homo sapiens
tggaggggtgtggc

SEQ ID NO: 6746532 - DNA, 18 bp, Homo sapiens
tggaggggtgtggcagtg

SEQ ID NO: 6746533 - DNA, 16 bp, Homo sapiens
tggaggggtgttgtat

SEQ ID NO: 6746534 - DNA, 16 bp, Homo sapiens
tggagggtaactgggg

SEQ ID NO: 6746535 - DNA, 20 bp, Homo sapiens
tggagggtagccctggggcc

SEQ ID NO: 6746536 - DNA, 17 bp, Homo sapiens
tggagggtaggggagtg

SEQ ID NO: 6746537 - DNA, 19 bp, Homo sapiens
tggagggtcccaagctggg

SEQ ID NO: 6746538 - DNA, 22 bp, Homo sapiens
tggagggtcccaagctgggccc

SEQ ID NO: 6746539 - DNA, 18 bp, Homo sapiens
tggagggtcgcctggctt

SEQ ID NO: 6746540 - DNA, 18 bp, Homo sapiens
tggagggtctgggggcag

SEQ ID NO: 6746541 - DNA, 21 bp, Homo sapiens
tggagggtctgggggcagctg

SEQ ID NO: 6746542 - DNA, 22 bp, Homo sapiens
tggagggtctgggggcagctgt

SEQ ID NO: 6746543 - DNA, 15 bp, Homo sapiens
tggaggtacaggata

SEQ ID NO: 6746544 - DNA, 16 bp, Homo sapiens
tggaggtacaggatat

SEQ ID NO: 6746545 - DNA, 15 bp, Homo sapiens
tggaggtactgagac

SEQ ID NO: 6746546 - DNA, 16 bp, Homo sapiens
tggaggtagggctggc

SEQ ID NO: 6746547 - DNA, 15 bp, Homo sapiens
tggaggtcacagctg

SEQ ID NO: 6746548 - DNA, 20 bp, Homo sapiens
tggaggtcacagctggatct

SEQ ID NO: 6746549 - DNA, 20 bp, Homo sapiens
tggaggtcagcatttgatct

SEQ ID NO: 6746550 - DNA, 22 bp, Homo sapiens
tggaggtcccagacatgctgcc

SEQ ID NO: 6746551 - DNA, 17 bp, Homo sapiens
tggaggtcgaagcaatc

SEQ ID NO: 6746552 - DNA, 22 bp, Homo sapiens
tggaggtcgaagcaatcagcaa

SEQ ID NO: 6746553 - DNA, 20 bp, Homo sapiens
tggaggtcggtaggttcagc

SEQ ID NO: 6746554 - DNA, 15 bp, Homo sapiens
tggaggtctccaggg

SEQ ID NO: 6746555 - DNA, 17 bp, Homo sapiens
tggaggtctccaggggc

SEQ ID NO: 6746556 - DNA, 22 bp, Homo sapiens
tggaggtctccaggggcctgca

SEQ ID NO: 6746557 - DNA, 22 bp, Homo sapiens
tggaggtctcccctgatccaga

SEQ ID NO: 6746558 - DNA, 17 bp, Homo sapiens
tggaggtgaagtccctg

SEQ ID NO: 6746559 - DNA, 20 bp, Homo sapiens
tggaggtgagatcacagcct

SEQ ID NO: 6746560 - DNA, 22 bp, Homo sapiens
tggaggtgagatcacagcctcc

SEQ ID NO: 6746561 - DNA, 23 bp, Homo sapiens
tggaggtgagatcacagcctcca

SEQ ID NO: 6746562 - DNA, 12 bp, Homo sapiens
tggaggtgatga

SEQ ID NO: 6746563 - DNA, 17 bp, Homo sapiens
tggaggtgccagcaaag

SEQ ID NO: 6746564 - DNA, 14 bp, Homo sapiens
tggaggtgccagga

SEQ ID NO: 6746565 - DNA, 17 bp, Homo sapiens
tggaggtgccaggaagc

SEQ ID NO: 6746566 - DNA, 22 bp, Homo sapiens
tggaggtgctgctctagggcag

SEQ ID NO: 6746567 - DNA, 16 bp, Homo sapiens
tggaggtgctggtagc

SEQ ID NO: 6746568 - DNA, 22 bp, Homo sapiens
tggaggtggcgccccctggtgg

SEQ ID NO: 6746569 - DNA, 11 bp, Homo sapiens
tggaggtggct

SEQ ID NO: 6746570 - DNA, 23 bp, Homo sapiens
tggaggtgggagacaaggaacca

SEQ ID NO: 6746571 - DNA, 17 bp, Homo sapiens
tggaggtgggagcagga

SEQ ID NO: 6746572 - DNA, 18 bp, Homo sapiens
tggaggtgggagcaggag

SEQ ID NO: 6746573 - DNA, 18 bp, Homo sapiens
tggaggtgggcatgccac

SEQ ID NO: 6746574 - DNA, 15 bp, Homo sapiens
tggaggtgggctgat

SEQ ID NO: 6746575 - DNA, 21 bp, Homo sapiens
tggaggtgggctgatggcctg

SEQ ID NO: 6746576 - DNA, 14 bp, Homo sapiens
tggaggtggggaag

SEQ ID NO: 6746577 - DNA, 17 bp, Homo sapiens
tggaggtggggaaggct

SEQ ID NO: 6746578 - DNA, 15 bp, Homo sapiens
tggaggtggggaggg

SEQ ID NO: 6746579 - DNA, 19 bp, Homo sapiens
tggaggtggggcctggagc

SEQ ID NO: 6746580 - DNA, 15 bp, Homo sapiens
tggcaaatcaggggc

SEQ ID NO: 6746581 - DNA, 19 bp, Homo sapiens
tggcaaatcaggggccaga

SEQ ID NO: 6746582 - DNA, 20 bp, Homo sapiens
tggcaaatcaggggccagag

SEQ ID NO: 6746583 - DNA, 15 bp, Homo sapiens
tggcaaatccaggct

SEQ ID NO: 6746584 - DNA, 16 bp, Homo sapiens
tggcaaatgaaagttt

SEQ ID NO: 6746585 - DNA, 23 bp, Homo sapiens
tggcaaatgtaactgtgccagtt

SEQ ID NO: 6746586 - DNA, 13 bp, Homo sapiens
tggcaaattaaac

SEQ ID NO: 6746587 - DNA, 16 bp, Homo sapiens
tggcaaatttgtgaac

SEQ ID NO: 6746588 - DNA, 20 bp, Homo sapiens
tggcaaatttgtgaactgtc

SEQ ID NO: 6746589 - DNA, 19 bp, Homo sapiens
tggcaaattttaaaacatt

SEQ ID NO: 6746590 - DNA, 23 bp, Homo sapiens
tggcaacaaacacattgtgaata

SEQ ID NO: 6746591 - DNA, 17 bp, Homo sapiens
tggcaacaacagcttca

SEQ ID NO: 6746592 - DNA, 13 bp, Homo sapiens
tggcaacacagag

SEQ ID NO: 6746593 - DNA, 13 bp, Homo sapiens
tggcaacagaagc

SEQ ID NO: 6746594 - DNA, 15 bp, Homo sapiens
tggcaacagaagcag

SEQ ID NO: 6746595 - DNA, 13 bp, Homo sapiens
tggcaacagagca

SEQ ID NO: 6746596 - DNA, 14 bp, Homo sapiens
tggcaacagagcga

SEQ ID NO: 6746597 - DNA, 13 bp, Homo sapiens
tggcaacagatct

SEQ ID NO: 6746598 - DNA, 15 bp, Homo sapiens
tggcaacagatctgg

SEQ ID NO: 6746599 - DNA, 17 bp, Homo sapiens
tggcaacagatctggaa

SEQ ID NO: 6746600 - DNA, 19 bp, Homo sapiens
tggcaacaggacagagttc

SEQ ID NO: 6746601 - DNA, 21 bp, Homo sapiens
tggcaacagttagctggagct

SEQ ID NO: 6746602 - DNA, 13 bp, Homo sapiens
tggcaacatcttg

SEQ ID NO: 6746603 - DNA, 16 bp, Homo sapiens
tggcaacattcattgc

SEQ ID NO: 6746604 - DNA, 14 bp, Homo sapiens
tggcaaccaatggc

SEQ ID NO: 6746605 - DNA, 15 bp, Homo sapiens
tggcaaccagccagc

SEQ ID NO: 6746606 - DNA, 16 bp, Homo sapiens
tggcaaccctcagctg

SEQ ID NO: 6746607 - DNA, 14 bp, Homo sapiens
tggcaacctgttct

SEQ ID NO: 6746608 - DNA, 22 bp, Homo sapiens
tggcaaccttgtctctatgcca

SEQ ID NO: 6746609 - DNA, 19 bp, Homo sapiens
tggcaacgttcatgttcat

SEQ ID NO: 6746610 - DNA, 14 bp, Homo sapiens
tggcaactgtggaa

SEQ ID NO: 6746611 - DNA, 16 bp, Homo sapiens
tggcaagaaatcccct

SEQ ID NO: 6746612 - DNA, 14 bp, Homo sapiens
tggcaagaacttgt

SEQ ID NO: 6746613 - DNA, 15 bp, Homo sapiens
tggcaagaacttgtt

SEQ ID NO: 6746614 - DNA, 19 bp, Homo sapiens
tggcaagaacttgtttaca

SEQ ID NO: 6746615 - DNA, 19 bp, Homo sapiens
tggcaagagactactctgc

SEQ ID NO: 6746616 - DNA, 22 bp, Homo sapiens
tggcaagagcgttactgtagac

SEQ ID NO: 6746617 - DNA, 21 bp, Homo sapiens
tggcaagaggcctcatgcctg

SEQ ID NO: 6746618 - DNA, 17 bp, Homo sapiens
tggcaagagtgtggagg

SEQ ID NO: 6746619 - DNA, 15 bp, Homo sapiens
tggcaagattgaagt

SEQ ID NO: 6746620 - DNA, 13 bp, Homo sapiens
tggcaagctgcag

SEQ ID NO: 6746621 - DNA, 16 bp, Homo sapiens
tggcaagctgcaggtt

SEQ ID NO: 6746622 - DNA, 17 bp, Homo sapiens
tggcaagctgcaggttt

SEQ ID NO: 6746623 - DNA, 13 bp, Homo sapiens
tggcaagctgtga

SEQ ID NO: 6746624 - DNA, 19 bp, Homo sapiens
tggcaaggacacagatgaa

SEQ ID NO: 6746625 - DNA, 23 bp, Homo sapiens
tggcaaggacgcttcacaggaca

SEQ ID NO: 6746626 - DNA, 19 bp, Homo sapiens
tggcaaggactttgtacat

SEQ ID NO: 6746627 - DNA, 21 bp, Homo sapiens
tggcaaggactttgtacattt

SEQ ID NO: 6746628 - DNA, 12 bp, Homo sapiens
tggcaaggagaa

SEQ ID NO: 6746629 - DNA, 16 bp, Homo sapiens
tggcaaggagaatatg

SEQ ID NO: 6746630 - DNA, 15 bp, Homo sapiens
tggcaaggctgtgct

SEQ ID NO: 6746631 - DNA, 23 bp, Homo sapiens
tggcaaggctgtgctccctggtt

SEQ ID NO: 6746632 - DNA, 17 bp, Homo sapiens
tggcaagggttcacctg

SEQ ID NO: 6746633 - DNA, 17 bp, Homo sapiens
tggcaaggtcatagaca

SEQ ID NO: 6746634 - DNA, 13 bp, Homo sapiens
tggcaagtttttg

SEQ ID NO: 6746635 - DNA, 11 bp, Homo sapiens
tggcaataaac

SEQ ID NO: 6746636 - DNA, 17 bp, Homo sapiens
tggcaataaattttgaa

SEQ ID NO: 6746637 - DNA, 21 bp, Homo sapiens
tggcaataagatacacagctc

SEQ ID NO: 6746638 - DNA, 17 bp, Homo sapiens
tggcaataatgactaaa

SEQ ID NO: 6746639 - DNA, 15 bp, Homo sapiens
tggcaataggacaaa

SEQ ID NO: 6746640 - DNA, 22 bp, Homo sapiens
tggcaataggacaaaacgggtt

SEQ ID NO: 6746641 - DNA, 19 bp, Homo sapiens
tggcaatagggtagaatga

SEQ ID NO: 6746642 - DNA, 16 bp, Homo sapiens
tggcaatagtcaggag

SEQ ID NO: 6746643 - DNA, 20 bp, Homo sapiens
tggcaatagtgggccctccg

SEQ ID NO: 6746644 - DNA, 18 bp, Homo sapiens
tggcaatagtgtgttctg

SEQ ID NO: 6746645 - DNA, 16 bp, Homo sapiens
tggcaatataatcttt

SEQ ID NO: 6746646 - DNA, 20 bp, Homo sapiens
tggcaatcaatacagcttca

SEQ ID NO: 6746647 - DNA, 23 bp, Homo sapiens
tggcaatcccaccaaatcatcct

SEQ ID NO: 6746648 - DNA, 19 bp, Homo sapiens
tggcaatgactcaaagtct

SEQ ID NO: 6746649 - DNA, 13 bp, Homo sapiens
tggcaatgagtgt

SEQ ID NO: 6746650 - DNA, 15 bp, Homo sapiens
tggcaatgagtgtgc

SEQ ID NO: 6746651 - DNA, 23 bp, Homo sapiens
tggcaatgccacagccctgtcag

SEQ ID NO: 6746652 - DNA, 19 bp, Homo sapiens
tggcaatgccatcatctcc

SEQ ID NO: 6746653 - DNA, 16 bp, Homo sapiens
tggcaatgcttaaact

SEQ ID NO: 6746654 - DNA, 16 bp, Homo sapiens
tggcaatggtagtttc

SEQ ID NO: 6746655 - DNA, 17 bp, Homo sapiens
tggcaatggtagtttct

SEQ ID NO: 6746656 - DNA, 15 bp, Homo sapiens
tggcaattcacaagt

SEQ ID NO: 6746657 - DNA, 19 bp, Homo sapiens
tggcaattccaatatttct

SEQ ID NO: 6746658 - DNA, 20 bp, Homo sapiens
tggcaattcctcttcattgt

SEQ ID NO: 6746659 - DNA, 14 bp, Homo sapiens
tggcaattctttga

SEQ ID NO: 6746660 - DNA, 15 bp, Homo sapiens
tggcaattgcactca

SEQ ID NO: 6746661 - DNA, 17 bp, Homo sapiens
tggcaattgcactcatg

SEQ ID NO: 6746662 - DNA, 18 bp, Homo sapiens
tggcaattgtctatttat

SEQ ID NO: 6746663 - DNA, 18 bp, Homo sapiens
tggcaatttcctggccct

SEQ ID NO: 6746664 - DNA, 19 bp, Homo sapiens
tggcaatttcctggccctc

SEQ ID NO: 6746665 - DNA, 21 bp, Homo sapiens
tggcaatttcctggccctcca

SEQ ID NO: 6746666 - DNA, 18 bp, Homo sapiens
tggcaattttatgttttt

SEQ ID NO: 6746667 - DNA, 13 bp, Homo sapiens
tggcaattttgta

SEQ ID NO: 6746668 - DNA, 14 bp, Homo sapiens
tggcaattttgtaa

SEQ ID NO: 6746669 - DNA, 15 bp, Homo sapiens
tggcaattttgtaac

SEQ ID NO: 6746670 - DNA, 15 bp, Homo sapiens
tggcacaaagttggt

SEQ ID NO: 6746671 - DNA, 22 bp, Homo sapiens
tggcacaacgctctaccctgca

SEQ ID NO: 6746672 - DNA, 22 bp, Homo sapiens
tggcacaactgtctaatgacac

SEQ ID NO: 6746673 - DNA, 21 bp, Homo sapiens
tggcacaagctccctggtgag

SEQ ID NO: 6746674 - DNA, 19 bp, Homo sapiens
tggcacaatctcacacagc

SEQ ID NO: 6746675 - DNA, 18 bp, Homo sapiens
tggcacaatgttggagca

SEQ ID NO: 6746676 - DNA, 19 bp, Homo sapiens
tggcacaatgttggagcag

SEQ ID NO: 6746677 - DNA, 21 bp, Homo sapiens
tggcacaatgttggagcagca

SEQ ID NO: 6746678 - DNA, 22 bp, Homo sapiens
tggcacacacctgtagtcccag

SEQ ID NO: 6746679 - DNA, 17 bp, Homo sapiens
tggcacacactgaccac

SEQ ID NO: 6746680 - DNA, 17 bp, Homo sapiens
tggcacacgcctgtagt

SEQ ID NO: 6746681 - DNA, 12 bp, Homo sapiens
tggcacactccc

SEQ ID NO: 6746682 - DNA, 20 bp, Homo sapiens
tggcacactccctctccttg

SEQ ID NO: 6746683 - DNA, 19 bp, Homo sapiens
tggcacagaaagggcagct

SEQ ID NO: 6746684 - DNA, 14 bp, Homo sapiens
tggcacagaacagg

SEQ ID NO: 6746685 - DNA, 23 bp, Homo sapiens
tggcacagaacaggaggtgtgaa

SEQ ID NO: 6746686 - DNA, 15 bp, Homo sapiens
tggcacagaaggatc

SEQ ID NO: 6746687 - DNA, 22 bp, Homo sapiens
tggcacagacttctggaaggct

SEQ ID NO: 6746688 - DNA, 23 bp, Homo sapiens
tggcacagacttctggaaggctg

SEQ ID NO: 6746689 - DNA, 15 bp, Homo sapiens
tggcacagccctgag

SEQ ID NO: 6746690 - DNA, 16 bp, Homo sapiens
tggcacagccctgagt

SEQ ID NO: 6746691 - DNA, 22 bp, Homo sapiens
tggcacagcttttgtatagaaa

SEQ ID NO: 6746692 - DNA, 14 bp, Homo sapiens
tggcacaggactga

SEQ ID NO: 6746693 - DNA, 12 bp, Homo sapiens
tggcacaggcac

SEQ ID NO: 6746694 - DNA, 19 bp, Homo sapiens
tggcacagggcatgaaatg

SEQ ID NO: 6746695 - DNA, 17 bp, Homo sapiens
tggcacagtgatgccgg

SEQ ID NO: 6746696 - DNA, 17 bp, Homo sapiens
tggcacagtgcttacat

SEQ ID NO: 6746697 - DNA, 19 bp, Homo sapiens
tggcacagtgtctgggctg

SEQ ID NO: 6746698 - DNA, 19 bp, Homo sapiens
tggcacagttttctgagaa

SEQ ID NO: 6746699 - DNA, 20 bp, Homo sapiens
tggcacatcagcacgatttc

SEQ ID NO: 6746700 - DNA, 19 bp, Homo sapiens
tggcacatctgtcctgaca

SEQ ID NO: 6746701 - DNA, 18 bp, Homo sapiens
tggcacattgcccctctg

SEQ ID NO: 6746702 - DNA, 23 bp, Homo sapiens
tggcacattgcccctctgccttg

SEQ ID NO: 6746703 - DNA, 22 bp, Homo sapiens
tggcacatttcagggagaaact

SEQ ID NO: 6746704 - DNA, 20 bp, Homo sapiens
tggcaccaaagatgcagccg

SEQ ID NO: 6746705 - DNA, 23 bp, Homo sapiens
tggcaccaataaaggaggaatca

SEQ ID NO: 6746706 - DNA, 21 bp, Homo sapiens
tggcaccactagggtcctggc

SEQ ID NO: 6746707 - DNA, 21 bp, Homo sapiens
tggcaccactgcactccagcc

SEQ ID NO: 6746708 - DNA, 16 bp, Homo sapiens
tggcaccagacaccca

SEQ ID NO: 6746709 - DNA, 17 bp, Homo sapiens
tggcaccagacacccag

SEQ ID NO: 6746710 - DNA, 23 bp, Homo sapiens
tggcaccagaggctgcagaaggc

SEQ ID NO: 6746711 - DNA, 20 bp, Homo sapiens
tggcaccagaggtgcttctg

SEQ ID NO: 6746712 - DNA, 14 bp, Homo sapiens
tggcaccagatgca

SEQ ID NO: 6746713 - DNA, 16 bp, Homo sapiens
tggcaccagcaggcac

SEQ ID NO: 6746714 - DNA, 17 bp, Homo sapiens
tggcaccagccccctgg

SEQ ID NO: 6746715 - DNA, 15 bp, Homo sapiens
tggcaccatgtgcca

SEQ ID NO: 6746716 - DNA, 17 bp, Homo sapiens
tggcaccattcagactt

SEQ ID NO: 6746717 - DNA, 21 bp, Homo sapiens
tggcacccacacagaggacct

SEQ ID NO: 6746718 - DNA, 22 bp, Homo sapiens
tggcacccacacagaggacctc

SEQ ID NO: 6746719 - DNA, 14 bp, Homo sapiens
tggcacccaccact

SEQ ID NO: 6746720 - DNA, 16 bp, Homo sapiens
tggcacccaccactct

SEQ ID NO: 6746721 - DNA, 22 bp, Homo sapiens
tggcacccaccgtctcggccct

SEQ ID NO: 6746722 - DNA, 21 bp, Homo sapiens
tggcacccaccgtggaggagg

SEQ ID NO: 6746723 - DNA, 13 bp, Homo sapiens
tggcacccactgg

SEQ ID NO: 6746724 - DNA, 14 bp, Homo sapiens
tggcacccccatgc

SEQ ID NO: 6746725 - DNA, 16 bp, Homo sapiens
tggcacccctttctag

SEQ ID NO: 6746726 - DNA, 16 bp, Homo sapiens
tggcaccctgcaccag

SEQ ID NO: 6746727 - DNA, 13 bp, Homo sapiens
tggcaccctggaa

SEQ ID NO: 6746728 - DNA, 16 bp, Homo sapiens
tggcaccgaagcccag

SEQ ID NO: 6746729 - DNA, 17 bp, Homo sapiens
tggcaccgaagcccaga

SEQ ID NO: 6746730 - DNA, 18 bp, Homo sapiens
tggcaccgaagcccagag

SEQ ID NO: 6746731 - DNA, 20 bp, Homo sapiens
tggcacctaatccaggcaga

SEQ ID NO: 6746732 - DNA, 14 bp, Homo sapiens
tggcacctcagaca

SEQ ID NO: 6746733 - DNA, 17 bp, Homo sapiens
tggcacctcaggctgag

SEQ ID NO: 6746734 - DNA, 19 bp, Homo sapiens
tggcacctctgcccttccc

SEQ ID NO: 6746735 - DNA, 19 bp, Homo sapiens
tggcacctgaaattaattt

SEQ ID NO: 6746736 - DNA, 23 bp, Homo sapiens
tggcacctgcacactccatctcc

SEQ ID NO: 6746737 - DNA, 13 bp, Homo sapiens
tggcacctgcagc

SEQ ID NO: 6746738 - DNA, 13 bp, Homo sapiens
tggcacctgggtt

SEQ ID NO: 6746739 - DNA, 20 bp, Homo sapiens
tggcacctgtcgcccagtgc

SEQ ID NO: 6746740 - DNA, 14 bp, Homo sapiens
tggcacctgtctgc

SEQ ID NO: 6746741 - DNA, 16 bp, Homo sapiens
tggcacctgtggccag

SEQ ID NO: 6746742 - DNA, 14 bp, Homo sapiens
tggcacctgtttcc

SEQ ID NO: 6746743 - DNA, 18 bp, Homo sapiens
tggcacgatctcagctca

SEQ ID NO: 6746744 - DNA, 20 bp, Homo sapiens
tggcacgatctcagctcacc

SEQ ID NO: 6746745 - DNA, 19 bp, Homo sapiens
tggcacggagagaaggccc

SEQ ID NO: 6746746 - DNA, 16 bp, Homo sapiens
tggcacgggccctccc

SEQ ID NO: 6746747 - DNA, 19 bp, Homo sapiens
tggcacggtggctcaggcc

SEQ ID NO: 6746748 - DNA, 16 bp, Homo sapiens
tggcacgtattgctgt

SEQ ID NO: 6746749 - DNA, 16 bp, Homo sapiens
tggcacgtcatctagt

SEQ ID NO: 6746750 - DNA, 14 bp, Homo sapiens
tggcacgtcctcca

SEQ ID NO: 6746751 - DNA, 17 bp, Homo sapiens
tggcacgtcctccaccg

SEQ ID NO: 6746752 - DNA, 14 bp, Homo sapiens
tggcacgtgcctgt

SEQ ID NO: 6746753 - DNA, 17 bp, Homo sapiens
tggcacgtggccaggag

SEQ ID NO: 6746754 - DNA, 18 bp, Homo sapiens
tggcactaaaccacttct

SEQ ID NO: 6746755 - DNA, 15 bp, Homo sapiens
tggcactagaatgca

SEQ ID NO: 6746756 - DNA, 12 bp, Homo sapiens
tggcactaggga

SEQ ID NO: 6746757 - DNA, 21 bp, Homo sapiens
tggcactatggtttgttgcct

SEQ ID NO: 6746758 - DNA, 23 bp, Homo sapiens
tggccacttcattccagcagctg

SEQ ID NO: 6746759 - DNA, 22 bp, Homo sapiens
tggccactttgcagacctggga

SEQ ID NO: 6746760 - DNA, 23 bp, Homo sapiens
tggccactttgcagacctgggac

SEQ ID NO: 6746761 - DNA, 16 bp, Homo sapiens
tggccagaagagcttg

SEQ ID NO: 6746762 - DNA, 16 bp, Homo sapiens
tggccagacaagaaga

SEQ ID NO: 6746763 - DNA, 13 bp, Homo sapiens
tggccagacacag

SEQ ID NO: 6746764 - DNA, 15 bp, Homo sapiens
tggccagaccagagc

SEQ ID NO: 6746765 - DNA, 16 bp, Homo sapiens
tggccagaccagagct

SEQ ID NO: 6746766 - DNA, 17 bp, Homo sapiens
tggccagaccagagctc

SEQ ID NO: 6746767 - DNA, 16 bp, Homo sapiens
tggccagactcccttg

SEQ ID NO: 6746768 - DNA, 17 bp, Homo sapiens
tggccagagagggccca

SEQ ID NO: 6746769 - DNA, 20 bp, Homo sapiens
tggccagagagggcccagct

SEQ ID NO: 6746770 - DNA, 19 bp, Homo sapiens
tggccagagcacctcagga

SEQ ID NO: 6746771 - DNA, 15 bp, Homo sapiens
tggccagagcctctg

SEQ ID NO: 6746772 - DNA, 16 bp, Homo sapiens
tggccagagcctctgg

SEQ ID NO: 6746773 - DNA, 17 bp, Homo sapiens
tggccagagcctctggc

SEQ ID NO: 6746774 - DNA, 18 bp, Homo sapiens
tggccagagcctctggcc

SEQ ID NO: 6746775 - DNA, 21 bp, Homo sapiens
tggccagagcctctggcccct

SEQ ID NO: 6746776 - DNA, 13 bp, Homo sapiens
tggccagagctgg

SEQ ID NO: 6746777 - DNA, 21 bp, Homo sapiens
tggccagagctggaaggcagg

SEQ ID NO: 6746778 - DNA, 23 bp, Homo sapiens
tggccagagctggaaggcagggc

SEQ ID NO: 6746779 - DNA, 17 bp, Homo sapiens
tggccagagctgggagg

SEQ ID NO: 6746780 - DNA, 18 bp, Homo sapiens
tggccagagctgggaggc

SEQ ID NO: 6746781 - DNA, 15 bp, Homo sapiens
tggccagaggcattt

SEQ ID NO: 6746782 - DNA, 17 bp, Homo sapiens
tggccagatgcaccagc

SEQ ID NO: 6746783 - DNA, 18 bp, Homo sapiens
tggccagatgcaccagcc

SEQ ID NO: 6746784 - DNA, 22 bp, Homo sapiens
tggccagatgcggggacaggct

SEQ ID NO: 6746785 - DNA, 17 bp, Homo sapiens
tggccagatggcccgga

SEQ ID NO: 6746786 - DNA, 21 bp, Homo sapiens
tggccagatgtcgctgggtcc

SEQ ID NO: 6746787 - DNA, 17 bp, Homo sapiens
tggccagcaaaaactgt

SEQ ID NO: 6746788 - DNA, 19 bp, Homo sapiens
tggccagcacaccaagtgg

SEQ ID NO: 6746789 - DNA, 12 bp, Homo sapiens
tggccagcaccc

SEQ ID NO: 6746790 - DNA, 15 bp, Homo sapiens
tggccagcaccctct

SEQ ID NO: 6746791 - DNA, 18 bp, Homo sapiens
tggccagcaccctctcct

SEQ ID NO: 6746792 - DNA, 20 bp, Homo sapiens
tggccagcaccctctcctgg

SEQ ID NO: 6746793 - DNA, 15 bp, Homo sapiens
tggccagcagcacct

SEQ ID NO: 6746794 - DNA, 16 bp, Homo sapiens
tggccagcagccccca

SEQ ID NO: 6746795 - DNA, 12 bp, Homo sapiens
tggccagcagct

SEQ ID NO: 6746796 - DNA, 13 bp, Homo sapiens
tggccagcagctt

SEQ ID NO: 6746797 - DNA, 12 bp, Homo sapiens
tggccagcccca

SEQ ID NO: 6746798 - DNA, 23 bp, Homo sapiens
tggccagccccacagcccacgtc

SEQ ID NO: 6746799 - DNA, 21 bp, Homo sapiens
tggccagccccttagacagag

SEQ ID NO: 6746800 - DNA, 22 bp, Homo sapiens
tggccagccccttagacagagg

SEQ ID NO: 6746801 - DNA, 15 bp, Homo sapiens
tggccagcccggctg

SEQ ID NO: 6746802 - DNA, 15 bp, Homo sapiens
tggccagcccttcct

SEQ ID NO: 6746803 - DNA, 14 bp, Homo sapiens
tggccagccgctct

SEQ ID NO: 6746804 - DNA, 24 bp, Homo sapiens
tggccagccgctctcctgccacat

SEQ ID NO: 6746805 - DNA, 15 bp, Homo sapiens
tggccagccgggagc

SEQ ID NO: 6746806 - DNA, 13 bp, Homo sapiens
tggccagcctaca

SEQ ID NO: 6746807 - DNA, 12 bp, Homo sapiens
tggccagcctgg

SEQ ID NO: 6746808 - DNA, 16 bp, Homo sapiens
tggccagcctggatct

SEQ ID NO: 6746809 - DNA, 15 bp, Homo sapiens
tggccagcctggcat

SEQ ID NO: 6746810 - DNA, 17 bp, Homo sapiens
tggccagcctggcatca

SEQ ID NO: 6746811 - DNA, 18 bp, Homo sapiens
tggccagcctggcatcag

SEQ ID NO: 6746812 - DNA, 19 bp, Homo sapiens
tggccagcctggggcctgg

SEQ ID NO: 6746813 - DNA, 23 bp, Homo sapiens
tggccagcctggggcctggcagg

SEQ ID NO: 6746814 - DNA, 23 bp, Homo sapiens
tggccagcgagcgcccagctcct

SEQ ID NO: 6746815 - DNA, 22 bp, Homo sapiens
tggccagcgccagggcccaggc

SEQ ID NO: 6746816 - DNA, 23 bp, Homo sapiens
tggccagcgccagggcccaggcc

SEQ ID NO: 6746817 - DNA, 22 bp, Homo sapiens
tggccagcgcccctcagcctct

SEQ ID NO: 6746818 - DNA, 20 bp, Homo sapiens
tggccagcgtcttgctctgt

SEQ ID NO: 6746819 - DNA, 16 bp, Homo sapiens
tggccagctcataaaa

SEQ ID NO: 6746820 - DNA, 14 bp, Homo sapiens
tggccaggacacac

SEQ ID NO: 6746821 - DNA, 16 bp, Homo sapiens
tggccaggacacactg

SEQ ID NO: 6746822 - DNA, 17 bp, Homo sapiens
tggccaggacacactga

SEQ ID NO: 6746823 - DNA, 22 bp, Homo sapiens
tggccaggacacactgaaaagc

SEQ ID NO: 6746824 - DNA, 12 bp, Homo sapiens
tggccaggagca

SEQ ID NO: 6746825 - DNA, 14 bp, Homo sapiens
tggccaggagcagg

SEQ ID NO: 6746826 - DNA, 16 bp, Homo sapiens
tggccaggagccctgg

SEQ ID NO: 6746827 - DNA, 14 bp, Homo sapiens
tggccaggagctct

SEQ ID NO: 6746828 - DNA, 22 bp, Homo sapiens
tggccaggagctcttcaggcct

SEQ ID NO: 6746829 - DNA, 14 bp, Homo sapiens
tggccaggagtggg

SEQ ID NO: 6746830 - DNA, 23 bp, Homo sapiens
tggccaggataatatatttgcag

SEQ ID NO: 6746831 - DNA, 12 bp, Homo sapiens
tggccaggatgg

SEQ ID NO: 6746832 - DNA, 18 bp, Homo sapiens
tggccaggcactgccttc

SEQ ID NO: 6746833 - DNA, 16 bp, Homo sapiens
tggccaggcagatctg

SEQ ID NO: 6746834 - DNA, 19 bp, Homo sapiens
tggccaggcagatctgtgc

SEQ ID NO: 6746835 - DNA, 12 bp, Homo sapiens
tggccaggccct

SEQ ID NO: 6746836 - DNA, 16 bp, Homo sapiens
tggccaggccctgaga

SEQ ID NO: 6746837 - DNA, 14 bp, Homo sapiens
tggccaggccctgg

SEQ ID NO: 6746838 - DNA, 15 bp, Homo sapiens
tggccaggccgggaa

SEQ ID NO: 6746839 - DNA, 19 bp, Homo sapiens
tggccaggcctcttggcag

SEQ ID NO: 6746840 - DNA, 17 bp, Homo sapiens
tggccaggcctgccagc

SEQ ID NO: 6746841 - DNA, 11 bp, Homo sapiens
tggccaggctg

SEQ ID NO: 6746842 - DNA, 13 bp, Homo sapiens
tggccaggctgct

SEQ ID NO: 6746843 - DNA, 15 bp, Homo sapiens
tggccaggctggtct

SEQ ID NO: 6746844 - DNA, 15 bp, Homo sapiens
tggccaggctggttt

SEQ ID NO: 6746845 - DNA, 16 bp, Homo sapiens
tggccaggctggtttc

SEQ ID NO: 6746846 - DNA, 13 bp, Homo sapiens
tggccaggctgtt

SEQ ID NO: 6746847 - DNA, 16 bp, Homo sapiens
tggccagggaggcagc

SEQ ID NO: 6746848 - DNA, 19 bp, Homo sapiens
tggccagggaggcgcaggg

SEQ ID NO: 6746849 - DNA, 14 bp, Homo sapiens
tggccagggcaggg

SEQ ID NO: 6746850 - DNA, 18 bp, Homo sapiens
tggccagggcagggccac

SEQ ID NO: 6746851 - DNA, 19 bp, Homo sapiens
tggccagggcagggccacc

SEQ ID NO: 6746852 - DNA, 16 bp, Homo sapiens
tggccagggcttcccc

SEQ ID NO: 6746853 - DNA, 18 bp, Homo sapiens
tggccaggggccaggagt

SEQ ID NO: 6746854 - DNA, 23 bp, Homo sapiens
tggccaggggccaggagtgggga

SEQ ID NO: 6746855 - DNA, 23 bp, Homo sapiens
tggccaggggcttctccccctca

SEQ ID NO: 6746856 - DNA, 23 bp, Homo sapiens
tggccagggtagacttggagctg

SEQ ID NO: 6746857 - DNA, 13 bp, Homo sapiens
tggccagggtgag

SEQ ID NO: 6746858 - DNA, 18 bp, Homo sapiens
tggccagggtgagagctg

SEQ ID NO: 6746859 - DNA, 12 bp, Homo sapiens
tggccaggtgcc

SEQ ID NO: 6746860 - DNA, 16 bp, Homo sapiens
tggccaggtggccact

SEQ ID NO: 6746861 - DNA, 17 bp, Homo sapiens
tggccaggtggccactc

SEQ ID NO: 6746862 - DNA, 22 bp, Homo sapiens
tggccagtaaaatactattgcc

SEQ ID NO: 6746863 - DNA, 21 bp, Homo sapiens
tggccagtatcctggattcct

SEQ ID NO: 6746864 - DNA, 14 bp, Homo sapiens
tggccagtccaggc

SEQ ID NO: 6746865 - DNA, 21 bp, Homo sapiens
tggccagtccaggctgccgtg

SEQ ID NO: 6746866 - DNA, 15 bp, Homo sapiens
tggccagtcctagag

SEQ ID NO: 6746867 - DNA, 19 bp, Homo sapiens
tggccagtcctagagctcc

SEQ ID NO: 6746868 - DNA, 20 bp, Homo sapiens
tggccagtcctagagctcct

SEQ ID NO: 6746869 - DNA, 22 bp, Homo sapiens
tggccagtcctagagctcctgt

SEQ ID NO: 6746870 - DNA, 23 bp, Homo sapiens
tggccagtgagaagctgaggcct

SEQ ID NO: 6746871 - DNA, 16 bp, Homo sapiens
tggccagtggctggat

SEQ ID NO: 6746872 - DNA, 14 bp, Homo sapiens
tggccagtgtctgt

SEQ ID NO: 6746873 - DNA, 23 bp, Homo sapiens
tggccagtgtgacaaggattgct

SEQ ID NO: 6746874 - DNA, 16 bp, Homo sapiens
tggccagtgtgatccc

SEQ ID NO: 6746875 - DNA, 18 bp, Homo sapiens
tggccagttgcccagagc

SEQ ID NO: 6746876 - DNA, 19 bp, Homo sapiens
tggccagtttgaagcctgt

SEQ ID NO: 6746877 - DNA, 23 bp, Homo sapiens
tggccagtttgaagcctgtgcct

SEQ ID NO: 6746878 - DNA, 16 bp, Homo sapiens
tggccatactgtgtcc

SEQ ID NO: 6746879 - DNA, 16 bp, Homo sapiens
tggccatagaggccca

SEQ ID NO: 6746880 - DNA, 23 bp, Homo sapiens
tggccatagaggcccaggcacca

SEQ ID NO: 6746881 - DNA, 20 bp, Homo sapiens
tggccatatttacctcagcc

SEQ ID NO: 6746882 - DNA, 20 bp, Homo sapiens
tggccatcactcagccccta

SEQ ID NO: 6746883 - DNA, 16 bp, Homo sapiens
tggccatcagggtggg

SEQ ID NO: 6746884 - DNA, 15 bp, Homo sapiens
tggccatcatcctcc

SEQ ID NO: 6746885 - DNA, 14 bp, Homo sapiens
tggccatcatttct

SEQ ID NO: 6746886 - DNA, 14 bp, Homo sapiens
tggccatccctggg

SEQ ID NO: 6746887 - DNA, 15 bp, Homo sapiens
tggccatccctgggc

SEQ ID NO: 6746888 - DNA, 22 bp, Homo sapiens
tggccatccctgggcccctcca

SEQ ID NO: 6746889 - DNA, 17 bp, Homo sapiens
tggccatccctgtgagg

SEQ ID NO: 6746890 - DNA, 15 bp, Homo sapiens
tggccatcctaccca

SEQ ID NO: 6746891 - DNA, 17 bp, Homo sapiens
tggccatccttctgtgt

SEQ ID NO: 6746892 - DNA, 11 bp, Homo sapiens
tggccatctct

SEQ ID NO: 6746893 - DNA, 17 bp, Homo sapiens
tggccatctctggatgc

SEQ ID NO: 6746894 - DNA, 15 bp, Homo sapiens
tggccatctgctcct

SEQ ID NO: 6746895 - DNA, 15 bp, Homo sapiens
tggccatgaccctgc

SEQ ID NO: 6746896 - DNA, 20 bp, Homo sapiens
tggccatgaccctgcctctc

SEQ ID NO: 6746897 - DNA, 15 bp, Homo sapiens
tggccatgcaggagg

SEQ ID NO: 6746898 - DNA, 18 bp, Homo sapiens
tggccatgcaggaggtgg

SEQ ID NO: 6746899 - DNA, 16 bp, Homo sapiens
tggccatgctcctctt

SEQ ID NO: 6746900 - DNA, 12 bp, Homo sapiens
tggccatgctgt

SEQ ID NO: 6746901 - DNA, 22 bp, Homo sapiens
tggccatgctgtccctgcactg

SEQ ID NO: 6746902 - DNA, 18 bp, Homo sapiens
tggccatgcttcttgccc

SEQ ID NO: 6746903 - DNA, 21 bp, Homo sapiens
tggccatggaataaaccattt

SEQ ID NO: 6746904 - DNA, 14 bp, Homo sapiens
tggccatggcctgc

SEQ ID NO: 6746905 - DNA, 14 bp, Homo sapiens
tggccatgggaggc

SEQ ID NO: 6746906 - DNA, 23 bp, Homo sapiens
tggccatgggaggcctttcccta

SEQ ID NO: 6746907 - DNA, 16 bp, Homo sapiens
tggccatggtaccccc

SEQ ID NO: 6746908 - DNA, 18 bp, Homo sapiens
tggccatggtaccccctt

SEQ ID NO: 6746909 - DNA, 18 bp, Homo sapiens
tggccatgtattatgaaa

SEQ ID NO: 6746910 - DNA, 15 bp, Homo sapiens
tggccatgtcgcctg

SEQ ID NO: 6746911 - DNA, 21 bp, Homo sapiens
tggccatgtcgcctgccccca

SEQ ID NO: 6746912 - DNA, 17 bp, Homo sapiens
tggccatgttatgctgg

SEQ ID NO: 6746913 - DNA, 18 bp, Homo sapiens
tggccatgttatgctggt

SEQ ID NO: 6746914 - DNA, 17 bp, Homo sapiens
tggccattctattgtgg

SEQ ID NO: 6746915 - DNA, 21 bp, Homo sapiens
tggccattcttatgttccaga

SEQ ID NO: 6746916 - DNA, 18 bp, Homo sapiens
tggccattgagctgtttc

SEQ ID NO: 6746917 - DNA, 15 bp, Homo sapiens
tggccatttgctttt

SEQ ID NO: 6746918 - DNA, 20 bp, Homo sapiens
tggccattttgtaccagggc

SEQ ID NO: 6746919 - DNA, 19 bp, Homo sapiens
tggcccaaaacgtcttatt

SEQ ID NO: 6746920 - DNA, 20 bp, Homo sapiens
tggcccaacatacgcactgg

SEQ ID NO: 6746921 - DNA, 14 bp, Homo sapiens
tggcccaagactgg

SEQ ID NO: 6746922 - DNA, 15 bp, Homo sapiens
tggcccaagctgggc

SEQ ID NO: 6746923 - DNA, 18 bp, Homo sapiens
tggcccaaggctggcagg

SEQ ID NO: 6746924 - DNA, 15 bp, Homo sapiens
tggcccaagggatgg

SEQ ID NO: 6746925 - DNA, 16 bp, Homo sapiens
tggcccaagggatggc

SEQ ID NO: 6746926 - DNA, 22 bp, Homo sapiens
tggcccaagggatggcaccact

SEQ ID NO: 6746927 - DNA, 21 bp, Homo sapiens
tggcccaagtggcagagcttg

SEQ ID NO: 6746928 - DNA, 18 bp, Homo sapiens
tggcccacacgtgcatag

SEQ ID NO: 6746929 - DNA, 19 bp, Homo sapiens
tggcccacagctctgctgg

SEQ ID NO: 6746930 - DNA, 20 bp, Homo sapiens
tggcccacagctctgctgga

SEQ ID NO: 6746931 - DNA, 22 bp, Homo sapiens
tggcccacagctctgctggaag

SEQ ID NO: 6746932 - DNA, 19 bp, Homo sapiens
tggcccaccccacccactt

SEQ ID NO: 6746933 - DNA, 22 bp, Homo sapiens
tggcccaccccccagcctccag

SEQ ID NO: 6746934 - DNA, 17 bp, Homo sapiens
tggcccacccctcttcc

SEQ ID NO: 6746935 - DNA, 13 bp, Homo sapiens
tggcctggcctgg

SEQ ID NO: 6746936 - DNA, 15 bp, Homo sapiens
tggcctggcctggcc

SEQ ID NO: 6746937 - DNA, 11 bp, Homo sapiens
tggcctggctc

SEQ ID NO: 6746938 - DNA, 12 bp, Homo sapiens
tggcctggctcc

SEQ ID NO: 6746939 - DNA, 16 bp, Homo sapiens
tggcctggcttctggg

SEQ ID NO: 6746940 - DNA, 11 bp, Homo sapiens
tggcctgggcc

SEQ ID NO: 6746941 - DNA, 17 bp, Homo sapiens
tggcctgggccacacct

SEQ ID NO: 6746942 - DNA, 16 bp, Homo sapiens
tggcctgggcgacaga

SEQ ID NO: 6746943 - DNA, 11 bp, Homo sapiens
tggcctggggg

SEQ ID NO: 6746944 - DNA, 23 bp, Homo sapiens
tggcctggggtgcatctcctccc

SEQ ID NO: 6746945 - DNA, 15 bp, Homo sapiens
tggcctgggtcccag

SEQ ID NO: 6746946 - DNA, 18 bp, Homo sapiens
tggcctgggtcccagggc

SEQ ID NO: 6746947 - DNA, 21 bp, Homo sapiens
tggcctgggtcccagggctgg

SEQ ID NO: 6746948 - DNA, 23 bp, Homo sapiens
tggcctgggtcccagggctggcc

SEQ ID NO: 6746949 - DNA, 14 bp, Homo sapiens
tggcctgggtctcc

SEQ ID NO: 6746950 - DNA, 20 bp, Homo sapiens
tggcctgggtgggcaggaac

SEQ ID NO: 6746951 - DNA, 18 bp, Homo sapiens
tggcctgggtggggcagg

SEQ ID NO: 6746952 - DNA, 20 bp, Homo sapiens
tggcctggtccaggcttggg

SEQ ID NO: 6746953 - DNA, 11 bp, Homo sapiens
tggcctggtgg

SEQ ID NO: 6746954 - DNA, 18 bp, Homo sapiens
tggcctgtagtccatctc

SEQ ID NO: 6746955 - DNA, 12 bp, Homo sapiens
tggcctgtccct

SEQ ID NO: 6746956 - DNA, 15 bp, Homo sapiens
tggcctgtccctagg

SEQ ID NO: 6746957 - DNA, 18 bp, Homo sapiens
tggcctgtccctagggct

SEQ ID NO: 6746958 - DNA, 23 bp, Homo sapiens
tggcctgtccctagggctctcca

SEQ ID NO: 6746959 - DNA, 12 bp, Homo sapiens
tggcctgtctca

SEQ ID NO: 6746960 - DNA, 20 bp, Homo sapiens
tggcctgtctctattagctg

SEQ ID NO: 6746961 - DNA, 16 bp, Homo sapiens
tggcctgtctgcgtgg

SEQ ID NO: 6746962 - DNA, 12 bp, Homo sapiens
tggcctgtgagc

SEQ ID NO: 6746963 - DNA, 16 bp, Homo sapiens
tggcctgtgagccatt

SEQ ID NO: 6746964 - DNA, 22 bp, Homo sapiens
tggcctgtgaggggcccctggc

SEQ ID NO: 6746965 - DNA, 13 bp, Homo sapiens
tggcctgtgatgt

SEQ ID NO: 6746966 - DNA, 16 bp, Homo sapiens
tggcctgtgccagcac

SEQ ID NO: 6746967 - DNA, 17 bp, Homo sapiens
tggcctgtgctgggcca

SEQ ID NO: 6746968 - DNA, 22 bp, Homo sapiens
tggcctgtgctgggccagtggc

SEQ ID NO: 6746969 - DNA, 15 bp, Homo sapiens
tggcctgtgcttgga

SEQ ID NO: 6746970 - DNA, 18 bp, Homo sapiens
tggcctgtgcttggaggc

SEQ ID NO: 6746971 - DNA, 19 bp, Homo sapiens
tggcctgtgcttggaggcc

SEQ ID NO: 6746972 - DNA, 23 bp, Homo sapiens
tggcctgtgcttggaggcctcag

SEQ ID NO: 6746973 - DNA, 14 bp, Homo sapiens
tggcctgtggcaca

SEQ ID NO: 6746974 - DNA, 19 bp, Homo sapiens
tggcctgtggcacagccct

SEQ ID NO: 6746975 - DNA, 15 bp, Homo sapiens
tggcctgtggcctgt

SEQ ID NO: 6746976 - DNA, 12 bp, Homo sapiens
tggcctgtgggc

SEQ ID NO: 6746977 - DNA, 18 bp, Homo sapiens
tggcctgtgggcctcacc

SEQ ID NO: 6746978 - DNA, 17 bp, Homo sapiens
tggcctgtgtccagcag

SEQ ID NO: 6746979 - DNA, 18 bp, Homo sapiens
tggcctgtgtccagcagc

SEQ ID NO: 6746980 - DNA, 20 bp, Homo sapiens
tggcctgtgtccagcagctg

SEQ ID NO: 6746981 - DNA, 21 bp, Homo sapiens
tggcctgtgtccagcagctgc

SEQ ID NO: 6746982 - DNA, 12 bp, Homo sapiens
tggcctgtgtgg

SEQ ID NO: 6746983 - DNA, 19 bp, Homo sapiens
tggcctgtgttcttcctgg

SEQ ID NO: 6746984 - DNA, 19 bp, Homo sapiens
tggcctgttatgattctga

SEQ ID NO: 6746985 - DNA, 14 bp, Homo sapiens
tggcctgttcccta

SEQ ID NO: 6746986 - DNA, 21 bp, Homo sapiens
tggcctgttcttctatgggtt

SEQ ID NO: 6746987 - DNA, 20 bp, Homo sapiens
tggcctgtttctgcagccct

SEQ ID NO: 6746988 - DNA, 22 bp, Homo sapiens
tggcctgtttctgcagcccttg

SEQ ID NO: 6746989 - DNA, 17 bp, Homo sapiens
tggcctgtttgatgtat

SEQ ID NO: 6746990 - DNA, 15 bp, Homo sapiens
tggccttaactggcc

SEQ ID NO: 6746991 - DNA, 16 bp, Homo sapiens
tggccttaactgttca

SEQ ID NO: 6746992 - DNA, 13 bp, Homo sapiens
tggccttaagaac

SEQ ID NO: 6746993 - DNA, 20 bp, Homo sapiens
tggccttaagaactgtgtct

SEQ ID NO: 6746994 - DNA, 11 bp, Homo sapiens
tggccttcccc

SEQ ID NO: 6746995 - DNA, 23 bp, Homo sapiens
tggccttccccttttgcctggct

SEQ ID NO: 6746996 - DNA, 21 bp, Homo sapiens
tggccttcccgccggaggcca

SEQ ID NO: 6746997 - DNA, 24 bp, Homo sapiens
tggccttcccgccggaggccagct

SEQ ID NO: 6746998 - DNA, 14 bp, Homo sapiens
tggccttcctgccc

SEQ ID NO: 6746999 - DNA, 17 bp, Homo sapiens
tggccttcggcctccat

SEQ ID NO: 6747000 - DNA, 23 bp, Homo sapiens
tggccttcggcctccatcctgag

SEQ ID NO: 6747001 - DNA, 19 bp, Homo sapiens
tggccttctcagcctacag

SEQ ID NO: 6747002 - DNA, 12 bp, Homo sapiens
tggccttctccc

SEQ ID NO: 6747003 - DNA, 23 bp, Homo sapiens
tggccttctcccctcttctgagc

SEQ ID NO: 6747004 - DNA, 23 bp, Homo sapiens
tggccttctcctacttagggaag

SEQ ID NO: 6747005 - DNA, 19 bp, Homo sapiens
tggccttctgctgcccagg

SEQ ID NO: 6747006 - DNA, 21 bp, Homo sapiens
tggccttctgctgcccaggcc

SEQ ID NO: 6747007 - DNA, 22 bp, Homo sapiens
tggccttctgctgcccaggcca

SEQ ID NO: 6747008 - DNA, 13 bp, Homo sapiens
tggccttgaaaca

SEQ ID NO: 6747009 - DNA, 23 bp, Homo sapiens
tggccttgaaacagttccattta

SEQ ID NO: 6747010 - DNA, 19 bp, Homo sapiens
tggccttgagcaagtccca

SEQ ID NO: 6747011 - DNA, 23 bp, Homo sapiens
tggccttgcagcactcacacagg

SEQ ID NO: 6747012 - DNA, 17 bp, Homo sapiens
tggccttgcagctggcc

SEQ ID NO: 6747013 - DNA, 19 bp, Homo sapiens
tggccttgcagctggccca

SEQ ID NO: 6747014 - DNA, 13 bp, Homo sapiens
tggccttgcccgc

SEQ ID NO: 6747015 - DNA, 12 bp, Homo sapiens
tggccttgctga

SEQ ID NO: 6747016 - DNA, 12 bp, Homo sapiens
tggccttgggag

SEQ ID NO: 6747017 - DNA, 16 bp, Homo sapiens
tggccttgggaggaca

SEQ ID NO: 6747018 - DNA, 14 bp, Homo sapiens
tggccttgggccgg

SEQ ID NO: 6747019 - DNA, 15 bp, Homo sapiens
tggccttgggccggt

SEQ ID NO: 6747020 - DNA, 20 bp, Homo sapiens
tggccttgggccggtgctgg

SEQ ID NO: 6747021 - DNA, 19 bp, Homo sapiens
tggccttggggccagactg

SEQ ID NO: 6747022 - DNA, 21 bp, Homo sapiens
tggccttggtatgtgccaggc

SEQ ID NO: 6747023 - DNA, 23 bp, Homo sapiens
tggccttggtatgtgccaggctt

SEQ ID NO: 6747024 - DNA, 20 bp, Homo sapiens
tggccttggttcctccagca

SEQ ID NO: 6747025 - DNA, 23 bp, Homo sapiens
tggccttgtaagacccttattgc

SEQ ID NO: 6747026 - DNA, 17 bp, Homo sapiens
tggccttgtcaggaccc

SEQ ID NO: 6747027 - DNA, 18 bp, Homo sapiens
tggccttgtcaggaccca

SEQ ID NO: 6747028 - DNA, 19 bp, Homo sapiens
tggccttgtcaggacccag

SEQ ID NO: 6747029 - DNA, 15 bp, Homo sapiens
tggccttgtggtcca

SEQ ID NO: 6747030 - DNA, 18 bp, Homo sapiens
tggccttgtgtcagagct

SEQ ID NO: 6747031 - DNA, 21 bp, Homo sapiens
tggcctttatgttctttcacc

SEQ ID NO: 6747032 - DNA, 12 bp, Homo sapiens
tggcctttatta

SEQ ID NO: 6747033 - DNA, 22 bp, Homo sapiens
tggcctttattaaaaactgagt

SEQ ID NO: 6747034 - DNA, 23 bp, Homo sapiens
tggcctttcacttttagttggca

SEQ ID NO: 6747035 - DNA, 14 bp, Homo sapiens
tggcctttcctctc

SEQ ID NO: 6747036 - DNA, 16 bp, Homo sapiens
tggcctttcctggaag

SEQ ID NO: 6747037 - DNA, 16 bp, Homo sapiens
tggcctttccttccct

SEQ ID NO: 6747038 - DNA, 16 bp, Homo sapiens
tggcctttcttgggga

SEQ ID NO: 6747039 - DNA, 18 bp, Homo sapiens
tggcctttcttggggaga

SEQ ID NO: 6747040 - DNA, 19 bp, Homo sapiens
tggcctttgaggcaaaggc

SEQ ID NO: 6747041 - DNA, 13 bp, Homo sapiens
tggcctttgcatt

SEQ ID NO: 6747042 - DNA, 14 bp, Homo sapiens
tggcctttgcgctc

SEQ ID NO: 6747043 - DNA, 19 bp, Homo sapiens
tggcctttgcgctcctggc

SEQ ID NO: 6747044 - DNA, 24 bp, Homo sapiens
tggcctttgcgctcctggcccagc

SEQ ID NO: 6747045 - DNA, 15 bp, Homo sapiens
tggcctttggaccca

SEQ ID NO: 6747046 - DNA, 11 bp, Homo sapiens
tggcctttgta

SEQ ID NO: 6747047 - DNA, 23 bp, Homo sapiens
tggcctttgtaagacacacagcc

SEQ ID NO: 6747048 - DNA, 24 bp, Homo sapiens
tggcctttgtgctgcgcctgcagg

SEQ ID NO: 6747049 - DNA, 23 bp, Homo sapiens
tggccttttgctacgtgcctccc

SEQ ID NO: 6747050 - DNA, 15 bp, Homo sapiens
tggcctttttaagta

SEQ ID NO: 6747051 - DNA, 22 bp, Homo sapiens
tggcgaaaccccgtctctacta

SEQ ID NO: 6747052 - DNA, 17 bp, Homo sapiens
tggcgaagcctgagcag

SEQ ID NO: 6747053 - DNA, 20 bp, Homo sapiens
tggcgacactaaaggaggag

SEQ ID NO: 6747054 - DNA, 16 bp, Homo sapiens
tggcgacactcagggc

SEQ ID NO: 6747055 - DNA, 17 bp, Homo sapiens
tggcgactctgcagagt

SEQ ID NO: 6747056 - DNA, 16 bp, Homo sapiens
tggcgactgcagctgc

SEQ ID NO: 6747057 - DNA, 17 bp, Homo sapiens
tggcgagaggaggggcc

SEQ ID NO: 6747058 - DNA, 15 bp, Homo sapiens
tggcgagtccagaca

SEQ ID NO: 6747059 - DNA, 17 bp, Homo sapiens
tggcgatctcccagggc

SEQ ID NO: 6747060 - DNA, 14 bp, Homo sapiens
tggcgatgccagcc

SEQ ID NO: 6747061 - DNA, 18 bp, Homo sapiens
tggcgattcccattgaaa

SEQ ID NO: 6747062 - DNA, 18 bp, Homo sapiens
tggcgcaatctcggctca

SEQ ID NO: 6747063 - DNA, 19 bp, Homo sapiens
tggcgcacccggcagcccc

SEQ ID NO: 6747064 - DNA, 22 bp, Homo sapiens
tggcgcagcatattcaggaagc

SEQ ID NO: 6747065 - DNA, 12 bp, Homo sapiens
tggcgcagccaa

SEQ ID NO: 6747066 - DNA, 19 bp, Homo sapiens
tggcgcaggtgccatgcct

SEQ ID NO: 6747067 - DNA, 20 bp, Homo sapiens
tggcgcaggtgccatgcctg

SEQ ID NO: 6747068 - DNA, 21 bp, Homo sapiens
tggcgcaggtgggctggactt

SEQ ID NO: 6747069 - DNA, 18 bp, Homo sapiens
tggcgcagtgcctctggt

SEQ ID NO: 6747070 - DNA, 17 bp, Homo sapiens
tggcgccaccagctctg

SEQ ID NO: 6747071 - DNA, 19 bp, Homo sapiens
tggcgccaggggcaggcag

SEQ ID NO: 6747072 - DNA, 20 bp, Homo sapiens
tggcgccccgggccgcgagc

SEQ ID NO: 6747073 - DNA, 13 bp, Homo sapiens
tggcgccctgcgt

SEQ ID NO: 6747074 - DNA, 15 bp, Homo sapiens
tggcgccttctcgga

SEQ ID NO: 6747075 - DNA, 19 bp, Homo sapiens
tggcgcgatctcagctcac

SEQ ID NO: 6747076 - DNA, 21 bp, Homo sapiens
tggcgcgatctcggctcactg

SEQ ID NO: 6747077 - DNA, 14 bp, Homo sapiens
tggcgcgcctgcct

SEQ ID NO: 6747078 - DNA, 15 bp, Homo sapiens
tggcgcgcctgcctt

SEQ ID NO: 6747079 - DNA, 13 bp, Homo sapiens
tggcgcgggaggc

SEQ ID NO: 6747080 - DNA, 18 bp, Homo sapiens
tggcgctagaggccatgg

SEQ ID NO: 6747081 - DNA, 17 bp, Homo sapiens
tggcgctaggggacttg

SEQ ID NO: 6747082 - DNA, 21 bp, Homo sapiens
tggcgctaggggacttgggga

SEQ ID NO: 6747083 - DNA, 13 bp, Homo sapiens
tggcgctatattg

SEQ ID NO: 6747084 - DNA, 17 bp, Homo sapiens
tggcgctattacaaata

SEQ ID NO: 6747085 - DNA, 15 bp, Homo sapiens
tggcgctcagacccc

SEQ ID NO: 6747086 - DNA, 18 bp, Homo sapiens
tggcgctcagaccccacc

SEQ ID NO: 6747087 - DNA, 20 bp, Homo sapiens
tggcgctcagaccccaccct

SEQ ID NO: 6747088 - DNA, 15 bp, Homo sapiens
tggcgctcagcagcc

SEQ ID NO: 6747089 - DNA, 17 bp, Homo sapiens
tggcgctcagcagccct

SEQ ID NO: 6747090 - DNA, 18 bp, Homo sapiens
tggcgctcagcagcccta

SEQ ID NO: 6747091 - DNA, 13 bp, Homo sapiens
tggcggaggccat

SEQ ID NO: 6747092 - DNA, 18 bp, Homo sapiens
tggcggaggtggagtggc

SEQ ID NO: 6747093 - DNA, 20 bp, Homo sapiens
tggcggcaggggttggcagc

SEQ ID NO: 6747094 - DNA, 21 bp, Homo sapiens
tggcggcaggggttggcagcg

SEQ ID NO: 6747095 - DNA, 23 bp, Homo sapiens
tggcggccccaactcgggctccc

SEQ ID NO: 6747096 - DNA, 14 bp, Homo sapiens
tggcggccccagca

SEQ ID NO: 6747097 - DNA, 22 bp, Homo sapiens
tggcggcccggccggagggcag

SEQ ID NO: 6747098 - DNA, 15 bp, Homo sapiens
tggcggctactcagc

SEQ ID NO: 6747099 - DNA, 17 bp, Homo sapiens
tggcggctactcagcag

SEQ ID NO: 6747100 - DNA, 21 bp, Homo sapiens
tggcggctactcagcagccct

SEQ ID NO: 6747101 - DNA, 23 bp, Homo sapiens
tggcggctactcagcagccctcc

SEQ ID NO: 6747102 - DNA, 21 bp, Homo sapiens
tggcggctggggtcccagcag

SEQ ID NO: 6747103 - DNA, 17 bp, Homo sapiens
tggcgggaagggtgggc

SEQ ID NO: 6747104 - DNA, 21 bp, Homo sapiens
tggcgggaagggtgggccctg

SEQ ID NO: 6747105 - DNA, 14 bp, Homo sapiens
tggcgggcagcccc

SEQ ID NO: 6747106 - DNA, 17 bp, Homo sapiens
tggcgggcagcccctgc

SEQ ID NO: 6747107 - DNA, 20 bp, Homo sapiens
tggcgggcagcccctgctgg

SEQ ID NO: 6747108 - DNA, 13 bp, Homo sapiens
tggcgggccaagg

SEQ ID NO: 6747109 - DNA, 17 bp, Homo sapiens
tggcgggccaaggactg

SEQ ID NO: 6747110 - DNA, 16 bp, Homo sapiens
tggcggggatcagaac

SEQ ID NO: 6747111 - DNA, 15 bp, Homo sapiens
tggcggggcaggagg

SEQ ID NO: 6747112 - DNA, 13 bp, Homo sapiens
tggctgtaatcat

SEQ ID NO: 6747113 - DNA, 19 bp, Homo sapiens
tggctgtaatgacaaaaga

SEQ ID NO: 6747114 - DNA, 20 bp, Homo sapiens
tggctgtaatgacaaaagat

SEQ ID NO: 6747115 - DNA, 14 bp, Homo sapiens
tggctgtaatttaa

SEQ ID NO: 6747116 - DNA, 15 bp, Homo sapiens
tggctgtacccagga

SEQ ID NO: 6747117 - DNA, 15 bp, Homo sapiens
tggctgtactgccaa

SEQ ID NO: 6747118 - DNA, 14 bp, Homo sapiens
tggctgtagataaa

SEQ ID NO: 6747119 - DNA, 18 bp, Homo sapiens
tggctgtagataaataat

SEQ ID NO: 6747120 - DNA, 22 bp, Homo sapiens
tggctgtcaaatccatgtgtcc

SEQ ID NO: 6747121 - DNA, 23 bp, Homo sapiens
tggctgtcaaatccatgtgtccc

SEQ ID NO: 6747122 - DNA, 18 bp, Homo sapiens
tggctgtcaatgggacct

SEQ ID NO: 6747123 - DNA, 21 bp, Homo sapiens
tggctgtcccctccatctggg

SEQ ID NO: 6747124 - DNA, 22 bp, Homo sapiens
tggctgtcctaccatcagctct

SEQ ID NO: 6747125 - DNA, 22 bp, Homo sapiens
tggctgtcctcttaagacacta

SEQ ID NO: 6747126 - DNA, 16 bp, Homo sapiens
tggctgtccttcccct

SEQ ID NO: 6747127 - DNA, 12 bp, Homo sapiens
tggctgtctctg

SEQ ID NO: 6747128 - DNA, 13 bp, Homo sapiens
tggctgtctctgt

SEQ ID NO: 6747129 - DNA, 14 bp, Homo sapiens
tggctgtctctgtc

SEQ ID NO: 6747130 - DNA, 16 bp, Homo sapiens
tggctgtctctgtccc

SEQ ID NO: 6747131 - DNA, 22 bp, Homo sapiens
tggctgtctctgtccctcactg

SEQ ID NO: 6747132 - DNA, 10 bp, Homo sapiens
tggctgtctg

SEQ ID NO: 6747133 - DNA, 19 bp, Homo sapiens
tggctgtctgaccagagaa

SEQ ID NO: 6747134 - DNA, 20 bp, Homo sapiens
tggctgtctgaccagagaat

SEQ ID NO: 6747135 - DNA, 15 bp, Homo sapiens
tggctgtctgcctgt

SEQ ID NO: 6747136 - DNA, 19 bp, Homo sapiens
tggctgtctgcctgtattt

SEQ ID NO: 6747137 - DNA, 11 bp, Homo sapiens
tggctgtgaaa

SEQ ID NO: 6747138 - DNA, 12 bp, Homo sapiens
tggctgtgaaaa

SEQ ID NO: 6747139 - DNA, 12 bp, Homo sapiens
tggctgtgacaa

SEQ ID NO: 6747140 - DNA, 18 bp, Homo sapiens
tggctgtgacacctggtg

SEQ ID NO: 6747141 - DNA, 20 bp, Homo sapiens
tggctgtgacagcctctgca

SEQ ID NO: 6747142 - DNA, 22 bp, Homo sapiens
tggctgtgagacgaggcagggg

SEQ ID NO: 6747143 - DNA, 18 bp, Homo sapiens
tggctgtgagcagcctcc

SEQ ID NO: 6747144 - DNA, 12 bp, Homo sapiens
tggctgtgagga

SEQ ID NO: 6747145 - DNA, 14 bp, Homo sapiens
tggctgtgaggggt

SEQ ID NO: 6747146 - DNA, 22 bp, Homo sapiens
tggctgtgcaatttctgtacat

SEQ ID NO: 6747147 - DNA, 20 bp, Homo sapiens
tggctgtgcccagcaggccc

SEQ ID NO: 6747148 - DNA, 13 bp, Homo sapiens
tggctgtgcccct

SEQ ID NO: 6747149 - DNA, 15 bp, Homo sapiens
tggctgtgcctcccc

SEQ ID NO: 6747150 - DNA, 18 bp, Homo sapiens
tggctgtgcctctgcctg

SEQ ID NO: 6747151 - DNA, 19 bp, Homo sapiens
tggctgtgcctctgcctgt

SEQ ID NO: 6747152 - DNA, 17 bp, Homo sapiens
tggctgtgcctgcttct

SEQ ID NO: 6747153 - DNA, 19 bp, Homo sapiens
tggctgtgcctgcttctgt

SEQ ID NO: 6747154 - DNA, 19 bp, Homo sapiens
tggctgtgctctcaccagc

SEQ ID NO: 6747155 - DNA, 16 bp, Homo sapiens
tggctgtgctgtattt

SEQ ID NO: 6747156 - DNA, 21 bp, Homo sapiens
tggctgtggagacaatgtctg

SEQ ID NO: 6747157 - DNA, 22 bp, Homo sapiens
tggctgtggagacaatgtctgc

SEQ ID NO: 6747158 - DNA, 21 bp, Homo sapiens
tggctgtggaggcctgatgct

SEQ ID NO: 6747159 - DNA, 14 bp, Homo sapiens
tggctgtggcacag

SEQ ID NO: 6747160 - DNA, 17 bp, Homo sapiens
tggctgtggcacagact

SEQ ID NO: 6747161 - DNA, 19 bp, Homo sapiens
tggctgtggcattgttgat

SEQ ID NO: 6747162 - DNA, 22 bp, Homo sapiens
tggctgtggcattgttgatgct

SEQ ID NO: 6747163 - DNA, 14 bp, Homo sapiens
tggctgtggtccta

SEQ ID NO: 6747164 - DNA, 14 bp, Homo sapiens
tggctgtgtctctc

SEQ ID NO: 6747165 - DNA, 19 bp, Homo sapiens
tggctgtgtgtctgcttgt

SEQ ID NO: 6747166 - DNA, 21 bp, Homo sapiens
tggctgtgttcgggggagcag

SEQ ID NO: 6747167 - DNA, 23 bp, Homo sapiens
tggctgtgttcgggggagcagag

SEQ ID NO: 6747168 - DNA, 17 bp, Homo sapiens
tggctgttaaccacccg

SEQ ID NO: 6747169 - DNA, 20 bp, Homo sapiens
tggctgttgacgcacctgtg

SEQ ID NO: 6747170 - DNA, 21 bp, Homo sapiens
tggctgttgagatgtgctttg

SEQ ID NO: 6747171 - DNA, 13 bp, Homo sapiens
tggctgttggctg

SEQ ID NO: 6747172 - DNA, 23 bp, Homo sapiens
tggctgttggctgggggcctcag

SEQ ID NO: 6747173 - DNA, 17 bp, Homo sapiens
tggctgtttagcagaac

SEQ ID NO: 6747174 - DNA, 11 bp, Homo sapiens
tggctgtttgg

SEQ ID NO: 6747175 - DNA, 23 bp, Homo sapiens
tggctgtttgttttgatgataaa

SEQ ID NO: 6747176 - DNA, 18 bp, Homo sapiens
tggcttaaagcatcctcc

SEQ ID NO: 6747177 - DNA, 15 bp, Homo sapiens
tggcttaaagtgaag

SEQ ID NO: 6747178 - DNA, 19 bp, Homo sapiens
tggcttaaagtgaaggaaa

SEQ ID NO: 6747179 - DNA, 21 bp, Homo sapiens
tggcttaaagtgaaggaaata

SEQ ID NO: 6747180 - DNA, 23 bp, Homo sapiens
tggcttaactggactgaattcaa

SEQ ID NO: 6747181 - DNA, 20 bp, Homo sapiens
tggcttaagtgagcagaaca

SEQ ID NO: 6747182 - DNA, 15 bp, Homo sapiens
tggcttaatgcttct

SEQ ID NO: 6747183 - DNA, 13 bp, Homo sapiens
tggcttacactgg

SEQ ID NO: 6747184 - DNA, 20 bp, Homo sapiens
tggcttacctatctgtggaa

SEQ ID NO: 6747185 - DNA, 22 bp, Homo sapiens
tggcttacctgacctcttgctg

SEQ ID NO: 6747186 - DNA, 20 bp, Homo sapiens
tggcttacttacaaaagcag

SEQ ID NO: 6747187 - DNA, 14 bp, Homo sapiens
tggcttagctgcca

SEQ ID NO: 6747188 - DNA, 21 bp, Homo sapiens
tggcttaggaatgacttactt

SEQ ID NO: 6747189 - DNA, 13 bp, Homo sapiens
tggcttagtaaat

SEQ ID NO: 6747190 - DNA, 15 bp, Homo sapiens
tggcttataaacaca

SEQ ID NO: 6747191 - DNA, 21 bp, Homo sapiens
tggcttataaacacattgaat

SEQ ID NO: 6747192 - DNA, 19 bp, Homo sapiens
tggcttataattctttcaa

SEQ ID NO: 6747193 - DNA, 16 bp, Homo sapiens
tggcttataggtgttg

SEQ ID NO: 6747194 - DNA, 23 bp, Homo sapiens
tggcttattttgggttcaggcct

SEQ ID NO: 6747195 - DNA, 21 bp, Homo sapiens
tggcttatttttctgacttct

SEQ ID NO: 6747196 - DNA, 23 bp, Homo sapiens
tggcttcaaaaagccacagcaga

SEQ ID NO: 6747197 - DNA, 17 bp, Homo sapiens
tggcttcaaaatagaga

SEQ ID NO: 6747198 - DNA, 22 bp, Homo sapiens
tggcttcaatctacgatgttaa

SEQ ID NO: 6747199 - DNA, 23 bp, Homo sapiens
tggcttcaccgcattccaggggc

SEQ ID NO: 6747200 - DNA, 14 bp, Homo sapiens
tggcttcacggaag

SEQ ID NO: 6747201 - DNA, 20 bp, Homo sapiens
tggcttcacggaagagcctt

SEQ ID NO: 6747202 - DNA, 19 bp, Homo sapiens
tggcttcactcctgctgta

SEQ ID NO: 6747203 - DNA, 13 bp, Homo sapiens
tggcttcagaatt

SEQ ID NO: 6747204 - DNA, 16 bp, Homo sapiens
tggcttcagcccccac

SEQ ID NO: 6747205 - DNA, 19 bp, Homo sapiens
tggcttcagctccagcccc

SEQ ID NO: 6747206 - DNA, 14 bp, Homo sapiens
tggcttcagggagg

SEQ ID NO: 6747207 - DNA, 16 bp, Homo sapiens
tggcttcagggagggt

SEQ ID NO: 6747208 - DNA, 15 bp, Homo sapiens
tggcttcagggatgc

SEQ ID NO: 6747209 - DNA, 21 bp, Homo sapiens
tggcttcatactctttctttg

SEQ ID NO: 6747210 - DNA, 13 bp, Homo sapiens
tggcttcatgtgg

SEQ ID NO: 6747211 - DNA, 18 bp, Homo sapiens
tggcttcattagagcagg

SEQ ID NO: 6747212 - DNA, 20 bp, Homo sapiens
tggcttcattagagcaggcg

SEQ ID NO: 6747213 - DNA, 18 bp, Homo sapiens
tggcttccagaaggcagc

SEQ ID NO: 6747214 - DNA, 19 bp, Homo sapiens
tggcttccagaaggcagca

SEQ ID NO: 6747215 - DNA, 15 bp, Homo sapiens
tggcttccagcttca

SEQ ID NO: 6747216 - DNA, 19 bp, Homo sapiens
tggcttccagcttcaggca

SEQ ID NO: 6747217 - DNA, 14 bp, Homo sapiens
tggcttccaggtat

SEQ ID NO: 6747218 - DNA, 23 bp, Homo sapiens
tggcttccaggtatctccaggat

SEQ ID NO: 6747219 - DNA, 12 bp, Homo sapiens
tggcttcccagg

SEQ ID NO: 6747220 - DNA, 19 bp, Homo sapiens
tggcttcccatccccagcg

SEQ ID NO: 6747221 - DNA, 20 bp, Homo sapiens
tggcttcccatccccagcga

SEQ ID NO: 6747222 - DNA, 16 bp, Homo sapiens
tggcttccccttcaga

SEQ ID NO: 6747223 - DNA, 18 bp, Homo sapiens
tggcttcccgctcagccc

SEQ ID NO: 6747224 - DNA, 19 bp, Homo sapiens
tggcttcccgctcagccct

SEQ ID NO: 6747225 - DNA, 20 bp, Homo sapiens
tggcttcccgctcagccctc

SEQ ID NO: 6747226 - DNA, 21 bp, Homo sapiens
tggcttcccgctcagccctcc

SEQ ID NO: 6747227 - DNA, 18 bp, Homo sapiens
tggcttccctaaactgca

SEQ ID NO: 6747228 - DNA, 13 bp, Homo sapiens
tggcttccctgcc

SEQ ID NO: 6747229 - DNA, 14 bp, Homo sapiens
tggcttccctgccc

SEQ ID NO: 6747230 - DNA, 15 bp, Homo sapiens
tggcttccctgccca

SEQ ID NO: 6747231 - DNA, 16 bp, Homo sapiens
tggcttccgctgtcac

SEQ ID NO: 6747232 - DNA, 22 bp, Homo sapiens
tggcttcctaaaattcagtgga

SEQ ID NO: 6747233 - DNA, 14 bp, Homo sapiens
tggcttcctaaatg

SEQ ID NO: 6747234 - DNA, 16 bp, Homo sapiens
tggcttcctaaatggc

SEQ ID NO: 6747235 - DNA, 15 bp, Homo sapiens
tggcttcctcactcc

SEQ ID NO: 6747236 - DNA, 16 bp, Homo sapiens
tggcttcctccgtcca

SEQ ID NO: 6747237 - DNA, 23 bp, Homo sapiens
tggcttcctccgtccacccaggc

SEQ ID NO: 6747238 - DNA, 15 bp, Homo sapiens
tggcttcctcctgcg

SEQ ID NO: 6747239 - DNA, 14 bp, Homo sapiens
tggcttcctctgct

SEQ ID NO: 6747240 - DNA, 23 bp, Homo sapiens
tggcttcctgagaaagcccacct

SEQ ID NO: 6747241 - DNA, 16 bp, Homo sapiens
tggcttcctggcaata

SEQ ID NO: 6747242 - DNA, 18 bp, Homo sapiens
tggcttcctggcgccccc

SEQ ID NO: 6747243 - DNA, 18 bp, Homo sapiens
tggcttcggacaaaatat

SEQ ID NO: 6747244 - DNA, 15 bp, Homo sapiens
tggcttcggagggcc

SEQ ID NO: 6747245 - DNA, 19 bp, Homo sapiens
tggcttctagatctggaac

SEQ ID NO: 6747246 - DNA, 18 bp, Homo sapiens
tggcttctagtttgcaac

SEQ ID NO: 6747247 - DNA, 13 bp, Homo sapiens
tggcttctcagcc

SEQ ID NO: 6747248 - DNA, 17 bp, Homo sapiens
tggcttctccatcctca

SEQ ID NO: 6747249 - DNA, 13 bp, Homo sapiens
tggcttctcctgt

SEQ ID NO: 6747250 - DNA, 23 bp, Homo sapiens
tggcttctcgctgcgcagcctcc

SEQ ID NO: 6747251 - DNA, 13 bp, Homo sapiens
tggcttctctctt

SEQ ID NO: 6747252 - DNA, 20 bp, Homo sapiens
tggcttctctgccctgccct

SEQ ID NO: 6747253 - DNA, 21 bp, Homo sapiens
tggcttctctgccctgccctg

SEQ ID NO: 6747254 - DNA, 17 bp, Homo sapiens
tggcttctgatgaatct

SEQ ID NO: 6747255 - DNA, 15 bp, Homo sapiens
tggcttctgattttt

SEQ ID NO: 6747256 - DNA, 20 bp, Homo sapiens
tggcttctgatttttctctt

SEQ ID NO: 6747257 - DNA, 16 bp, Homo sapiens
tggcttctgcaggaat

SEQ ID NO: 6747258 - DNA, 18 bp, Homo sapiens
tggcttctgcttgtcatc

SEQ ID NO: 6747259 - DNA, 21 bp, Homo sapiens
tggcttctgcttgtcatccac

SEQ ID NO: 6747260 - DNA, 21 bp, Homo sapiens
tggcttctggccaggaagctt

SEQ ID NO: 6747261 - DNA, 14 bp, Homo sapiens
tggcttctgggaca

SEQ ID NO: 6747262 - DNA, 19 bp, Homo sapiens
tggcttctgggacctgtgt

SEQ ID NO: 6747263 - DNA, 14 bp, Homo sapiens
tggcttctgggaga

SEQ ID NO: 6747264 - DNA, 13 bp, Homo sapiens
tggcttctgtgat

SEQ ID NO: 6747265 - DNA, 17 bp, Homo sapiens
tggcttctgtgatgagc

SEQ ID NO: 6747266 - DNA, 22 bp, Homo sapiens
tggcttctgtgatgagctgatc

SEQ ID NO: 6747267 - DNA, 22 bp, Homo sapiens
tggcttctgtgcactagcctgt

SEQ ID NO: 6747268 - DNA, 20 bp, Homo sapiens
tggcttctgtggggcccctc

SEQ ID NO: 6747269 - DNA, 19 bp, Homo sapiens
tggcttctgttgtcacctt

SEQ ID NO: 6747270 - DNA, 13 bp, Homo sapiens
tggcttcttaaaa

SEQ ID NO: 6747271 - DNA, 14 bp, Homo sapiens
tggcttctttgctt

SEQ ID NO: 6747272 - DNA, 17 bp, Homo sapiens
tggcttcttttggaaag

SEQ ID NO: 6747273 - DNA, 13 bp, Homo sapiens
tggcttgaacctt

SEQ ID NO: 6747274 - DNA, 18 bp, Homo sapiens
tggcttgacatgtgcaat

SEQ ID NO: 6747275 - DNA, 15 bp, Homo sapiens
tggcttgagctagag

SEQ ID NO: 6747276 - DNA, 21 bp, Homo sapiens
tggcttgagtttaaattgtaa

SEQ ID NO: 6747277 - DNA, 17 bp, Homo sapiens
tggcttgcactttgtga

SEQ ID NO: 6747278 - DNA, 17 bp, Homo sapiens
tggcttgccacagctct

SEQ ID NO: 6747279 - DNA, 20 bp, Homo sapiens
tggcttgccatttttcaaaa

SEQ ID NO: 6747280 - DNA, 15 bp, Homo sapiens
tggcttgccccagga

SEQ ID NO: 6747281 - DNA, 20 bp, Homo sapiens
tggcttgcccgcgctctttc

SEQ ID NO: 6747282 - DNA, 16 bp, Homo sapiens
tggcttgctcccgccc

SEQ ID NO: 6747283 - DNA, 15 bp, Homo sapiens
tggcttgctgatggc

SEQ ID NO: 6747284 - DNA, 14 bp, Homo sapiens
tggcttgctgttta

SEQ ID NO: 6747285 - DNA, 14 bp, Homo sapiens
tggcttgcttatgt

SEQ ID NO: 6747286 - DNA, 15 bp, Homo sapiens
tggcttgcttatgtg

SEQ ID NO: 6747287 - DNA, 12 bp, Homo sapiens
tggcttggagca

SEQ ID NO: 6747288 - DNA, 11 bp, Homo sapiens
tggcttggagg

SEQ ID NO: 6747289 - DNA, 18 bp, Homo sapiens
tggcttggccacagccag

SEQ ID NO: 6747290 - DNA, 15 bp, Homo sapiens
tgggatggggaggga

SEQ ID NO: 6747291 - DNA, 19 bp, Homo sapiens
tgggatgggttccagaggt

SEQ ID NO: 6747292 - DNA, 21 bp, Homo sapiens
tgggatggtcggatctcacag

SEQ ID NO: 6747293 - DNA, 16 bp, Homo sapiens
tgggatggtgggcttc

SEQ ID NO: 6747294 - DNA, 21 bp, Homo sapiens
tgggatgtatgaatacagcag

SEQ ID NO: 6747295 - DNA, 23 bp, Homo sapiens
tgggatgtatttttcttgctgtt

SEQ ID NO: 6747296 - DNA, 16 bp, Homo sapiens
tgggatgtcacagtcc

SEQ ID NO: 6747297 - DNA, 17 bp, Homo sapiens
tgggatgtcacagtcca

SEQ ID NO: 6747298 - DNA, 14 bp, Homo sapiens
tgggatgtgagccc

SEQ ID NO: 6747299 - DNA, 15 bp, Homo sapiens
tgggatgtgagcccc

SEQ ID NO: 6747300 - DNA, 19 bp, Homo sapiens
tgggatgtgagccccaggg

SEQ ID NO: 6747301 - DNA, 22 bp, Homo sapiens
tgggatgtttaatcaagagaga

SEQ ID NO: 6747302 - DNA, 24 bp, Homo sapiens
tgggattaaggcgtgagccactgc

SEQ ID NO: 6747303 - DNA, 14 bp, Homo sapiens
tgggattaagggca

SEQ ID NO: 6747304 - DNA, 21 bp, Homo sapiens
tgggattacaggcgcctgcca

SEQ ID NO: 6747305 - DNA, 17 bp, Homo sapiens
tgggattacaggcgtga

SEQ ID NO: 6747306 - DNA, 21 bp, Homo sapiens
tgggattacagggatgagcca

SEQ ID NO: 6747307 - DNA, 22 bp, Homo sapiens
tgggattacaggtgactgccac

SEQ ID NO: 6747308 - DNA, 18 bp, Homo sapiens
tgggattatgggtcacag

SEQ ID NO: 6747309 - DNA, 20 bp, Homo sapiens
tgggattatgggtcacagga

SEQ ID NO: 6747310 - DNA, 14 bp, Homo sapiens
tgggattattcttt

SEQ ID NO: 6747311 - DNA, 17 bp, Homo sapiens
tgggattcaggaatgtg

SEQ ID NO: 6747312 - DNA, 20 bp, Homo sapiens
tgggattcccaccaaggtct

SEQ ID NO: 6747313 - DNA, 20 bp, Homo sapiens
tgggattcctcccctggaag

SEQ ID NO: 6747314 - DNA, 21 bp, Homo sapiens
tgggattcctcccctggaagt

SEQ ID NO: 6747315 - DNA, 15 bp, Homo sapiens
tgggattcctgaccc

SEQ ID NO: 6747316 - DNA, 23 bp, Homo sapiens
tgggattgacagaagcttctgcc

SEQ ID NO: 6747317 - DNA, 16 bp, Homo sapiens
tgggattgagtctgtg

SEQ ID NO: 6747318 - DNA, 19 bp, Homo sapiens
tgggattgagtctgtgcca

SEQ ID NO: 6747319 - DNA, 14 bp, Homo sapiens
tgggattgggggct

SEQ ID NO: 6747320 - DNA, 19 bp, Homo sapiens
tgggattgggggctggtgc

SEQ ID NO: 6747321 - DNA, 14 bp, Homo sapiens
tgggatttaatttc

SEQ ID NO: 6747322 - DNA, 22 bp, Homo sapiens
tgggatttccagaaccacactt

SEQ ID NO: 6747323 - DNA, 16 bp, Homo sapiens
tgggatttgaatcaat

SEQ ID NO: 6747324 - DNA, 13 bp, Homo sapiens
tgggatttgagat

SEQ ID NO: 6747325 - DNA, 12 bp, Homo sapiens
tgggatttgcaa

SEQ ID NO: 6747326 - DNA, 16 bp, Homo sapiens
tgggatttgcagggtc

SEQ ID NO: 6747327 - DNA, 14 bp, Homo sapiens
tgggatttgctgtg

SEQ ID NO: 6747328 - DNA, 16 bp, Homo sapiens
tgggatttggtcaaca

SEQ ID NO: 6747329 - DNA, 19 bp, Homo sapiens
tgggatttgttgaaatctt

SEQ ID NO: 6747330 - DNA, 17 bp, Homo sapiens
tgggattttcaattata

SEQ ID NO: 6747331 - DNA, 12 bp, Homo sapiens
tgggattttctt

SEQ ID NO: 6747332 - DNA, 17 bp, Homo sapiens
tgggattttcttttctg

SEQ ID NO: 6747333 - DNA, 17 bp, Homo sapiens
tgggatttttgtttgac

SEQ ID NO: 6747334 - DNA, 23 bp, Homo sapiens
tgggcaaaacccaggacatctcc

SEQ ID NO: 6747335 - DNA, 22 bp, Homo sapiens
tgggcaaaactgaattataaga

SEQ ID NO: 6747336 - DNA, 20 bp, Homo sapiens
tgggcaaaagagaaaaagaa

SEQ ID NO: 6747337 - DNA, 16 bp, Homo sapiens
tgggcaaacaggcagt

SEQ ID NO: 6747338 - DNA, 21 bp, Homo sapiens
tgggcaaagccacaaggctgg

SEQ ID NO: 6747339 - DNA, 16 bp, Homo sapiens
tgggcaacattgctgg

SEQ ID NO: 6747340 - DNA, 12 bp, Homo sapiens
tgggcaagcaga

SEQ ID NO: 6747341 - DNA, 22 bp, Homo sapiens
tgggcaagctggcggctggggt

SEQ ID NO: 6747342 - DNA, 23 bp, Homo sapiens
tgggcaaggaagctttggaagca

SEQ ID NO: 6747343 - DNA, 22 bp, Homo sapiens
tgggcaaggatgggtccagaag

SEQ ID NO: 6747344 - DNA, 18 bp, Homo sapiens
tgggcaaggggccaggaa

SEQ ID NO: 6747345 - DNA, 22 bp, Homo sapiens
tgggcaaggtgagggatgccat

SEQ ID NO: 6747346 - DNA, 16 bp, Homo sapiens
tgggcaagtagcagga

SEQ ID NO: 6747347 - DNA, 15 bp, Homo sapiens
tgggcaagtcactta

SEQ ID NO: 6747348 - DNA, 18 bp, Homo sapiens
tgggcaatataaccaatg

SEQ ID NO: 6747349 - DNA, 20 bp, Homo sapiens
tgggcaatattctctgtaca

SEQ ID NO: 6747350 - DNA, 21 bp, Homo sapiens
tgggcaatattctctgtacat

SEQ ID NO: 6747351 - DNA, 19 bp, Homo sapiens
tgggcaatcctgggctggc

SEQ ID NO: 6747352 - DNA, 19 bp, Homo sapiens
tgggcaatgatggcaattt

SEQ ID NO: 6747353 - DNA, 21 bp, Homo sapiens
tgggcaattgttacaagtgtt

SEQ ID NO: 6747354 - DNA, 15 bp, Homo sapiens
tgggcacaaacagaa

SEQ ID NO: 6747355 - DNA, 19 bp, Homo sapiens
tgggcacaaagggcccaga

SEQ ID NO: 6747356 - DNA, 16 bp, Homo sapiens
tgggcacaagcagggc

SEQ ID NO: 6747357 - DNA, 17 bp, Homo sapiens
tgggcacaagcagggca

SEQ ID NO: 6747358 - DNA, 19 bp, Homo sapiens
tgggcacaagcagggcact

SEQ ID NO: 6747359 - DNA, 22 bp, Homo sapiens
tgggcacaagcagggcactctg

SEQ ID NO: 6747360 - DNA, 16 bp, Homo sapiens
tgggcacaattcctgt

SEQ ID NO: 6747361 - DNA, 16 bp, Homo sapiens
tgggcacacgcctccc

SEQ ID NO: 6747362 - DNA, 17 bp, Homo sapiens
tgggcacacgctgctct

SEQ ID NO: 6747363 - DNA, 20 bp, Homo sapiens
tgggcacacgctgctctgcc

SEQ ID NO: 6747364 - DNA, 21 bp, Homo sapiens
tgggcacacgctgctctgccc

SEQ ID NO: 6747365 - DNA, 16 bp, Homo sapiens
tgggcacactctgcca

SEQ ID NO: 6747366 - DNA, 13 bp, Homo sapiens
tgggcacagattg

SEQ ID NO: 6747367 - DNA, 16 bp, Homo sapiens
tgggcacagattgaag

SEQ ID NO: 6747368 - DNA, 18 bp, Homo sapiens
tgggcacagattgaagaa

SEQ ID NO: 6747369 - DNA, 13 bp, Homo sapiens
tgggcacagctct

SEQ ID NO: 6747370 - DNA, 15 bp, Homo sapiens
tgggcacagtccaga

SEQ ID NO: 6747371 - DNA, 15 bp, Homo sapiens
tgggcacagtgctgc

SEQ ID NO: 6747372 - DNA, 20 bp, Homo sapiens
tgggcacagtgctgcccctt

SEQ ID NO: 6747373 - DNA, 21 bp, Homo sapiens
tgggcacagtggtgaccccct

SEQ ID NO: 6747374 - DNA, 15 bp, Homo sapiens
tgggcacatcatttc

SEQ ID NO: 6747375 - DNA, 14 bp, Homo sapiens
tgggcacatgagga

SEQ ID NO: 6747376 - DNA, 22 bp, Homo sapiens
tgggcaccaagagccaatggag

SEQ ID NO: 6747377 - DNA, 22 bp, Homo sapiens
tgggcaccacctctgtgggcac

SEQ ID NO: 6747378 - DNA, 22 bp, Homo sapiens
tgggcaccagcatttggcagca

SEQ ID NO: 6747379 - DNA, 17 bp, Homo sapiens
tgggcacccacctccac

SEQ ID NO: 6747380 - DNA, 17 bp, Homo sapiens
tgggcacccccagcctg

SEQ ID NO: 6747381 - DNA, 19 bp, Homo sapiens
tgggcacccccagcctggg

SEQ ID NO: 6747382 - DNA, 23 bp, Homo sapiens
tgggcacccccagcctgggccta

SEQ ID NO: 6747383 - DNA, 19 bp, Homo sapiens
tgggcacccggtcccctct

SEQ ID NO: 6747384 - DNA, 18 bp, Homo sapiens
tgggcaccctgcaggcag

SEQ ID NO: 6747385 - DNA, 20 bp, Homo sapiens
tgggcaccgtgtcctcctct

SEQ ID NO: 6747386 - DNA, 23 bp, Homo sapiens
tgggcaccgtgtcctcctctgag

SEQ ID NO: 6747387 - DNA, 16 bp, Homo sapiens
tgggcacctgacttgg

SEQ ID NO: 6747388 - DNA, 15 bp, Homo sapiens
tgggcacctggggag

SEQ ID NO: 6747389 - DNA, 17 bp, Homo sapiens
tgggcacctggggagtg

SEQ ID NO: 6747390 - DNA, 17 bp, Homo sapiens
tgggcacggagggggac

SEQ ID NO: 6747391 - DNA, 15 bp, Homo sapiens
tgggcacgggagagc

SEQ ID NO: 6747392 - DNA, 20 bp, Homo sapiens
tgggcactaagggtggagag

SEQ ID NO: 6747393 - DNA, 22 bp, Homo sapiens
tgggcactccgcgccgatgcca

SEQ ID NO: 6747394 - DNA, 14 bp, Homo sapiens
tgggcactgctcca

SEQ ID NO: 6747395 - DNA, 22 bp, Homo sapiens
tgggcactgctgggtggcccat

SEQ ID NO: 6747396 - DNA, 17 bp, Homo sapiens
tgggcactggaaaacat

SEQ ID NO: 6747397 - DNA, 13 bp, Homo sapiens
tgggcactggagc

SEQ ID NO: 6747398 - DNA, 14 bp, Homo sapiens
tgggcactggagca

SEQ ID NO: 6747399 - DNA, 18 bp, Homo sapiens
tgggcactggggcctcag

SEQ ID NO: 6747400 - DNA, 14 bp, Homo sapiens
tgggcactgtgcca

SEQ ID NO: 6747401 - DNA, 15 bp, Homo sapiens
tgggcacttccctgc

SEQ ID NO: 6747402 - DNA, 16 bp, Homo sapiens
tgggcacttccctgct

SEQ ID NO: 6747403 - DNA, 15 bp, Homo sapiens
tgggcactttttaat

SEQ ID NO: 6747404 - DNA, 15 bp, Homo sapiens
tgggcagaaatgtgc

SEQ ID NO: 6747405 - DNA, 12 bp, Homo sapiens
tgggcagaagga

SEQ ID NO: 6747406 - DNA, 17 bp, Homo sapiens
tgggcagaaggccaaga

SEQ ID NO: 6747407 - DNA, 15 bp, Homo sapiens
tgggcagaagggaga

SEQ ID NO: 6747408 - DNA, 17 bp, Homo sapiens
tgggcagaagggagaag

SEQ ID NO: 6747409 - DNA, 19 bp, Homo sapiens
tgggcagaagggagaagga

SEQ ID NO: 6747410 - DNA, 21 bp, Homo sapiens
tgggcagacaggtgggagatg

SEQ ID NO: 6747411 - DNA, 22 bp, Homo sapiens
tgggcagacaggtgggagatgg

SEQ ID NO: 6747412 - DNA, 11 bp, Homo sapiens
tgggcagagca

SEQ ID NO: 6747413 - DNA, 13 bp, Homo sapiens
tgggcagagccca

SEQ ID NO: 6747414 - DNA, 15 bp, Homo sapiens
tgggcagagcctgtc

SEQ ID NO: 6747415 - DNA, 12 bp, Homo sapiens
tgggcagagctg

SEQ ID NO: 6747416 - DNA, 16 bp, Homo sapiens
tgggcagagctggaca

SEQ ID NO: 6747417 - DNA, 21 bp, Homo sapiens
tgggcagaggaatgtgggcta

SEQ ID NO: 6747418 - DNA, 23 bp, Homo sapiens
tgggcagaggaatgtgggctatg

SEQ ID NO: 6747419 - DNA, 15 bp, Homo sapiens
tgggcagaggatgag

SEQ ID NO: 6747420 - DNA, 13 bp, Homo sapiens
tgggcagaggctg

SEQ ID NO: 6747421 - DNA, 14 bp, Homo sapiens
tgggcagagggcct

SEQ ID NO: 6747422 - DNA, 14 bp, Homo sapiens
tgggcagaggggag

SEQ ID NO: 6747423 - DNA, 16 bp, Homo sapiens
tgggcagaggggagag

SEQ ID NO: 6747424 - DNA, 19 bp, Homo sapiens
tgggcagaggggagaggaa

SEQ ID NO: 6747425 - DNA, 16 bp, Homo sapiens
tgggcagatcacttga

SEQ ID NO: 6747426 - DNA, 16 bp, Homo sapiens
tgggcagatctacccc

SEQ ID NO: 6747427 - DNA, 21 bp, Homo sapiens
tgggcagatctaccccttact

SEQ ID NO: 6747428 - DNA, 16 bp, Homo sapiens
tgggcagatttgcaac

SEQ ID NO: 6747429 - DNA, 17 bp, Homo sapiens
tgggcagattttcagca

SEQ ID NO: 6747430 - DNA, 20 bp, Homo sapiens
tgggcagcaaggctgctgcc

SEQ ID NO: 6747431 - DNA, 12 bp, Homo sapiens
tgggcagcaatt

SEQ ID NO: 6747432 - DNA, 17 bp, Homo sapiens
tgggcagcagctcagcc

SEQ ID NO: 6747433 - DNA, 23 bp, Homo sapiens
tgggcagccaggagtgcccccgg

SEQ ID NO: 6747434 - DNA, 16 bp, Homo sapiens
tgggcagccaggctgc

SEQ ID NO: 6747435 - DNA, 15 bp, Homo sapiens
tgggcagcccaacag

SEQ ID NO: 6747436 - DNA, 14 bp, Homo sapiens
tgggcagcccagag

SEQ ID NO: 6747437 - DNA, 14 bp, Homo sapiens
tgggcagccccaca

SEQ ID NO: 6747438 - DNA, 13 bp, Homo sapiens
tgggcagccccag

SEQ ID NO: 6747439 - DNA, 17 bp, Homo sapiens
tgggcagccccagagag

SEQ ID NO: 6747440 - DNA, 12 bp, Homo sapiens
tgggcagcctgc

SEQ ID NO: 6747441 - DNA, 21 bp, Homo sapiens
tgggcagcctgctttggcctt

SEQ ID NO: 6747442 - DNA, 22 bp, Homo sapiens
tgggcagcctgctttggccttt

SEQ ID NO: 6747443 - DNA, 13 bp, Homo sapiens
tgggcagccttgg

SEQ ID NO: 6747444 - DNA, 21 bp, Homo sapiens
tgggcagcgcccttcctctcc

SEQ ID NO: 6747445 - DNA, 18 bp, Homo sapiens
tgggcagctccatcctct

SEQ ID NO: 6747446 - DNA, 17 bp, Homo sapiens
tgggcagctcctccctg

SEQ ID NO: 6747447 - DNA, 24 bp, Homo sapiens
tgggcagctcctccctgtgccccc

SEQ ID NO: 6747448 - DNA, 19 bp, Homo sapiens
tgggcagctgattttgtca

SEQ ID NO: 6747449 - DNA, 23 bp, Homo sapiens
tgggcagctgcctcccctcctct

SEQ ID NO: 6747450 - DNA, 14 bp, Homo sapiens
tgggcagctggctc

SEQ ID NO: 6747451 - DNA, 21 bp, Homo sapiens
tgggcagctggggggctgtcc

SEQ ID NO: 6747452 - DNA, 22 bp, Homo sapiens
tgggcagctggggggctgtcct

SEQ ID NO: 6747453 - DNA, 23 bp, Homo sapiens
tgggcagcttagggccctggagg

SEQ ID NO: 6747454 - DNA, 19 bp, Homo sapiens
tgggcagcttgagagggca

SEQ ID NO: 6747455 - DNA, 20 bp, Homo sapiens
tgggcaggaaaccccagcgg

SEQ ID NO: 6747456 - DNA, 18 bp, Homo sapiens
tgggcaggaccctgctga

SEQ ID NO: 6747457 - DNA, 16 bp, Homo sapiens
tgggcaggacctcaga

SEQ ID NO: 6747458 - DNA, 22 bp, Homo sapiens
tgggcaggactcagctccccag

SEQ ID NO: 6747459 - DNA, 21 bp, Homo sapiens
tgggcaggaggaaaaggcttg

SEQ ID NO: 6747460 - DNA, 15 bp, Homo sapiens
tgggcaggaggcccc

SEQ ID NO: 6747461 - DNA, 18 bp, Homo sapiens
tgggcaggaggccccagg

SEQ ID NO: 6747462 - DNA, 15 bp, Homo sapiens
tgggcaggagggagg

SEQ ID NO: 6747463 - DNA, 16 bp, Homo sapiens
tgggcaggagggaggt

SEQ ID NO: 6747464 - DNA, 22 bp, Homo sapiens
tgggcaggatctcaagccagcc

SEQ ID NO: 6747465 - DNA, 18 bp, Homo sapiens
tgggcaggcaagcccttc

SEQ ID NO: 6747466 - DNA, 17 bp, Homo sapiens
tgggctggcacccactg

SEQ ID NO: 6747467 - DNA, 19 bp, Homo sapiens
tgggctggcagtcctggaa

SEQ ID NO: 6747468 - DNA, 12 bp, Homo sapiens
tgggctggccca

SEQ ID NO: 6747469 - DNA, 21 bp, Homo sapiens
tgggctggcccagccaactgc

SEQ ID NO: 6747470 - DNA, 19 bp, Homo sapiens
tgggctggcgcttggatct

SEQ ID NO: 6747471 - DNA, 21 bp, Homo sapiens
tgggctggcgcttggatctgg

SEQ ID NO: 6747472 - DNA, 17 bp, Homo sapiens
tgggctggcgggccctg

SEQ ID NO: 6747473 - DNA, 14 bp, Homo sapiens
tgggctgggagaag

SEQ ID NO: 6747474 - DNA, 14 bp, Homo sapiens
tgggctgggccctc

SEQ ID NO: 6747475 - DNA, 20 bp, Homo sapiens
tgggctgggccctctcttct

SEQ ID NO: 6747476 - DNA, 16 bp, Homo sapiens
tgggctggggactctg

SEQ ID NO: 6747477 - DNA, 20 bp, Homo sapiens
tgggctggggactctggcac

SEQ ID NO: 6747478 - DNA, 21 bp, Homo sapiens
tgggctggggactctggcaca

SEQ ID NO: 6747479 - DNA, 22 bp, Homo sapiens
tgggctggggactctggcacag

SEQ ID NO: 6747480 - DNA, 21 bp, Homo sapiens
tgggctggggaggaggagaga

SEQ ID NO: 6747481 - DNA, 18 bp, Homo sapiens
tgggctggggcaggggcc

SEQ ID NO: 6747482 - DNA, 18 bp, Homo sapiens
tgggctggggcctgatgg

SEQ ID NO: 6747483 - DNA, 16 bp, Homo sapiens
tgggctgggggactgg

SEQ ID NO: 6747484 - DNA, 12 bp, Homo sapiens
tgggctgggggc

SEQ ID NO: 6747485 - DNA, 22 bp, Homo sapiens
tgggctgggggccagggctgga

SEQ ID NO: 6747486 - DNA, 14 bp, Homo sapiens
tgggctgggtggca

SEQ ID NO: 6747487 - DNA, 18 bp, Homo sapiens
tgggctggtattctctct

SEQ ID NO: 6747488 - DNA, 19 bp, Homo sapiens
tgggctggtattctctcta

SEQ ID NO: 6747489 - DNA, 23 bp, Homo sapiens
tgggctggtattctctctatgca

SEQ ID NO: 6747490 - DNA, 14 bp, Homo sapiens
tgggctggtgcccc

SEQ ID NO: 6747491 - DNA, 17 bp, Homo sapiens
tgggctggtgtcacctg

SEQ ID NO: 6747492 - DNA, 15 bp, Homo sapiens
tgggctggttgctgt

SEQ ID NO: 6747493 - DNA, 13 bp, Homo sapiens
tgggctgtagttg

SEQ ID NO: 6747494 - DNA, 15 bp, Homo sapiens
tgggctgtccagcct

SEQ ID NO: 6747495 - DNA, 12 bp, Homo sapiens
tgggctgtctgt

SEQ ID NO: 6747496 - DNA, 12 bp, Homo sapiens
tgggctgtgagg

SEQ ID NO: 6747497 - DNA, 16 bp, Homo sapiens
tgggctgtgaggacag

SEQ ID NO: 6747498 - DNA, 21 bp, Homo sapiens
tgggctgtgaggacagggccc

SEQ ID NO: 6747499 - DNA, 20 bp, Homo sapiens
tgggctgtgcctgaggctgg

SEQ ID NO: 6747500 - DNA, 14 bp, Homo sapiens
tgggctgtgcctgg

SEQ ID NO: 6747501 - DNA, 12 bp, Homo sapiens
tgggctgtgctg

SEQ ID NO: 6747502 - DNA, 13 bp, Homo sapiens
tgggctgtgctgc

SEQ ID NO: 6747503 - DNA, 14 bp, Homo sapiens
tgggctgtgctgct

SEQ ID NO: 6747504 - DNA, 18 bp, Homo sapiens
tgggctgtgttgactgct

SEQ ID NO: 6747505 - DNA, 14 bp, Homo sapiens
tgggctgttacttg

SEQ ID NO: 6747506 - DNA, 16 bp, Homo sapiens
tgggctgttacttgct

SEQ ID NO: 6747507 - DNA, 19 bp, Homo sapiens
tgggctgttggctgggggc

SEQ ID NO: 6747508 - DNA, 23 bp, Homo sapiens
tgggcttaataagtcactgacat

SEQ ID NO: 6747509 - DNA, 15 bp, Homo sapiens
tgggcttaatataaa

SEQ ID NO: 6747510 - DNA, 22 bp, Homo sapiens
tgggcttaattcccccaagcag

SEQ ID NO: 6747511 - DNA, 19 bp, Homo sapiens
tgggcttagtatttctcag

SEQ ID NO: 6747512 - DNA, 20 bp, Homo sapiens
tgggcttatatctggcctct

SEQ ID NO: 6747513 - DNA, 19 bp, Homo sapiens
tgggcttatgtctctgcct

SEQ ID NO: 6747514 - DNA, 20 bp, Homo sapiens
tgggcttatgtctctgcctt

SEQ ID NO: 6747515 - DNA, 21 bp, Homo sapiens
tgggcttcaacagccaagctg

SEQ ID NO: 6747516 - DNA, 16 bp, Homo sapiens
tgggcttcactgtata

SEQ ID NO: 6747517 - DNA, 17 bp, Homo sapiens
tgggcttcactgtataa

SEQ ID NO: 6747518 - DNA, 19 bp, Homo sapiens
tgggcttcagcctagtggc

SEQ ID NO: 6747519 - DNA, 17 bp, Homo sapiens
tgggcttcagctgccag

SEQ ID NO: 6747520 - DNA, 17 bp, Homo sapiens
tgggcttcaggtgtttt

SEQ ID NO: 6747521 - DNA, 15 bp, Homo sapiens
tgggcttcattccgg

SEQ ID NO: 6747522 - DNA, 24 bp, Homo sapiens
tgggcttcattccggactggcaga

SEQ ID NO: 6747523 - DNA, 15 bp, Homo sapiens
tgggcttccatgcct

SEQ ID NO: 6747524 - DNA, 23 bp, Homo sapiens
tgggcttccatttgtgtgtgtgc

SEQ ID NO: 6747525 - DNA, 14 bp, Homo sapiens
tgggcttcccaagg

SEQ ID NO: 6747526 - DNA, 19 bp, Homo sapiens
tgggcttcccagtggctgc

SEQ ID NO: 6747527 - DNA, 21 bp, Homo sapiens
tgggcttcccagtggctgctg

SEQ ID NO: 6747528 - DNA, 19 bp, Homo sapiens
tgggcttcctgatgatgat

SEQ ID NO: 6747529 - DNA, 14 bp, Homo sapiens
tgggcttcctggag

SEQ ID NO: 6747530 - DNA, 23 bp, Homo sapiens
tgggcttcggagtgaatgtggca

SEQ ID NO: 6747531 - DNA, 14 bp, Homo sapiens
tgggcttctgcgtc

SEQ ID NO: 6747532 - DNA, 22 bp, Homo sapiens
tgggcttctgcgtccaccaggc

SEQ ID NO: 6747533 - DNA, 19 bp, Homo sapiens
tgggcttctgttctctgct

SEQ ID NO: 6747534 - DNA, 23 bp, Homo sapiens
tgggcttctgttctctgctgagg

SEQ ID NO: 6747535 - DNA, 14 bp, Homo sapiens
tgggcttgaccagg

SEQ ID NO: 6747536 - DNA, 11 bp, Homo sapiens
tgggcttgagc

SEQ ID NO: 6747537 - DNA, 13 bp, Homo sapiens
tgggcttgattct

SEQ ID NO: 6747538 - DNA, 14 bp, Homo sapiens
tgggcttgctgtgg

SEQ ID NO: 6747539 - DNA, 20 bp, Homo sapiens
tgggcttggagatggcagga

SEQ ID NO: 6747540 - DNA, 18 bp, Homo sapiens
tgggcttggcccgcggcc

SEQ ID NO: 6747541 - DNA, 20 bp, Homo sapiens
tgggcttggcccgcggcctg

SEQ ID NO: 6747542 - DNA, 16 bp, Homo sapiens
tgggcttggcctgctg

SEQ ID NO: 6747543 - DNA, 17 bp, Homo sapiens
tgggcttggcctgctgt

SEQ ID NO: 6747544 - DNA, 19 bp, Homo sapiens
tgggcttggcctggagagg

SEQ ID NO: 6747545 - DNA, 14 bp, Homo sapiens
tgggcttggccttg

SEQ ID NO: 6747546 - DNA, 18 bp, Homo sapiens
tgggcttggctcttggct

SEQ ID NO: 6747547 - DNA, 22 bp, Homo sapiens
tgggcttgggcctaggctgcat

SEQ ID NO: 6747548 - DNA, 19 bp, Homo sapiens
tgggcttggggaccagagc

SEQ ID NO: 6747549 - DNA, 21 bp, Homo sapiens
tgggcttggggaccagagctg

SEQ ID NO: 6747550 - DNA, 17 bp, Homo sapiens
tgggcttgtctgtagat

SEQ ID NO: 6747551 - DNA, 17 bp, Homo sapiens
tgggcttgtgctcggga

SEQ ID NO: 6747552 - DNA, 20 bp, Homo sapiens
tgggcttgtggggcctggga

SEQ ID NO: 6747553 - DNA, 19 bp, Homo sapiens
tgggcttgtggtggctgct

SEQ ID NO: 6747554 - DNA, 24 bp, Homo sapiens
tgggcttgtggtggctgctccatg

SEQ ID NO: 6747555 - DNA, 23 bp, Homo sapiens
tgggctttccagggtctttactg

SEQ ID NO: 6747556 - DNA, 21 bp, Homo sapiens
tgggctttcccccaactcagg

SEQ ID NO: 6747557 - DNA, 13 bp, Homo sapiens
tgggctttctcct

SEQ ID NO: 6747558 - DNA, 18 bp, Homo sapiens
tgggctttctcctggaga

SEQ ID NO: 6747559 - DNA, 17 bp, Homo sapiens
tgggctttgattccatc

SEQ ID NO: 6747560 - DNA, 23 bp, Homo sapiens
tgggctttgattccatctccttg

SEQ ID NO: 6747561 - DNA, 14 bp, Homo sapiens
tgggctttgcaggc

SEQ ID NO: 6747562 - DNA, 17 bp, Homo sapiens
tgggctttgcaggctct

SEQ ID NO: 6747563 - DNA, 19 bp, Homo sapiens
tgggctttgcaggctctgg

SEQ ID NO: 6747564 - DNA, 16 bp, Homo sapiens
tgggctttgggaagtt

SEQ ID NO: 6747565 - DNA, 22 bp, Homo sapiens
tgggctttgggaagtttgctgt

SEQ ID NO: 6747566 - DNA, 21 bp, Homo sapiens
tgggctttgtggaaacagctg

SEQ ID NO: 6747567 - DNA, 12 bp, Homo sapiens
tgggcttttatt

SEQ ID NO: 6747568 - DNA, 20 bp, Homo sapiens
tgggcttttggggagccaga

SEQ ID NO: 6747569 - DNA, 23 bp, Homo sapiens
tgggcttttggtttgggggcgcc

SEQ ID NO: 6747570 - DNA, 16 bp, Homo sapiens
tgggcttttgttctga

SEQ ID NO: 6747571 - DNA, 22 bp, Homo sapiens
tgggcttttgttctgaggggtg

SEQ ID NO: 6747572 - DNA, 13 bp, Homo sapiens
tggggaaaaaagc

SEQ ID NO: 6747573 - DNA, 20 bp, Homo sapiens
tggggaaaaaagcacataca

SEQ ID NO: 6747574 - DNA, 23 bp, Homo sapiens
tggggaaaaaagcacatacatta

SEQ ID NO: 6747575 - DNA, 15 bp, Homo sapiens
tggggaaaaggatga

SEQ ID NO: 6747576 - DNA, 20 bp, Homo sapiens
tggggaaaccctggagccat

SEQ ID NO: 6747577 - DNA, 14 bp, Homo sapiens
tggggaaacctaga

SEQ ID NO: 6747578 - DNA, 16 bp, Homo sapiens
tggggaaactggccat

SEQ ID NO: 6747579 - DNA, 19 bp, Homo sapiens
tggggaaaggaggtggggg

SEQ ID NO: 6747580 - DNA, 21 bp, Homo sapiens
tggggaaaggggtcggctgac

SEQ ID NO: 6747581 - DNA, 18 bp, Homo sapiens
tggggaaataaagtgcct

SEQ ID NO: 6747582 - DNA, 16 bp, Homo sapiens
tggggaaatgtggaga

SEQ ID NO: 6747583 - DNA, 23 bp, Homo sapiens
tggggaaatttttaagtttttca

SEQ ID NO: 6747584 - DNA, 19 bp, Homo sapiens
tggggaacaagggtggcat

SEQ ID NO: 6747585 - DNA, 15 bp, Homo sapiens
tggggaacaggtccc

SEQ ID NO: 6747586 - DNA, 19 bp, Homo sapiens
tggggaacaggtcttgggg

SEQ ID NO: 6747587 - DNA, 21 bp, Homo sapiens
tggggaacatggctggcctgg

SEQ ID NO: 6747588 - DNA, 23 bp, Homo sapiens
tggggaacatttctgtaaatacc

SEQ ID NO: 6747589 - DNA, 15 bp, Homo sapiens
tggggaacggaggag

SEQ ID NO: 6747590 - DNA, 16 bp, Homo sapiens
tggggaacggaggagg

SEQ ID NO: 6747591 - DNA, 12 bp, Homo sapiens
tggggaagaaaa

SEQ ID NO: 6747592 - DNA, 19 bp, Homo sapiens
tggggaagaacagccccgg

SEQ ID NO: 6747593 - DNA, 14 bp, Homo sapiens
tggggaagactgtg

SEQ ID NO: 6747594 - DNA, 16 bp, Homo sapiens
tggggaagactgtggc

SEQ ID NO: 6747595 - DNA, 17 bp, Homo sapiens
tggggaagactgtggct

SEQ ID NO: 6747596 - DNA, 15 bp, Homo sapiens
tggggaagagagcct

SEQ ID NO: 6747597 - DNA, 16 bp, Homo sapiens
tggggaagaggccttg

SEQ ID NO: 6747598 - DNA, 20 bp, Homo sapiens
tggggaagaggggctggggc

SEQ ID NO: 6747599 - DNA, 21 bp, Homo sapiens
tggggaagaggggctggggca

SEQ ID NO: 6747600 - DNA, 22 bp, Homo sapiens
tggggaagcaagacgtcctgga

SEQ ID NO: 6747601 - DNA, 12 bp, Homo sapiens
tggggaaggagg

SEQ ID NO: 6747602 - DNA, 14 bp, Homo sapiens
tggggaaggaggga

SEQ ID NO: 6747603 - DNA, 18 bp, Homo sapiens
tggggaaggagggacttg

SEQ ID NO: 6747604 - DNA, 22 bp, Homo sapiens
tggggaaggagtacaaaacaat

SEQ ID NO: 6747605 - DNA, 20 bp, Homo sapiens
tggggaagggaaccagccct

SEQ ID NO: 6747606 - DNA, 23 bp, Homo sapiens
tggggaagggaaccagccctcca

SEQ ID NO: 6747607 - DNA, 20 bp, Homo sapiens
tggggaagggagtctctctt

SEQ ID NO: 6747608 - DNA, 16 bp, Homo sapiens
tggggaaggggcctgg

SEQ ID NO: 6747609 - DNA, 16 bp, Homo sapiens
tggggaaggtggagca

SEQ ID NO: 6747610 - DNA, 20 bp, Homo sapiens
tggggaagtcaggggagaag

SEQ ID NO: 6747611 - DNA, 16 bp, Homo sapiens
tggggaagtgaggaag

SEQ ID NO: 6747612 - DNA, 14 bp, Homo sapiens
tggggaagttcaag

SEQ ID NO: 6747613 - DNA, 17 bp, Homo sapiens
tggggaagttcaagtga

SEQ ID NO: 6747614 - DNA, 18 bp, Homo sapiens
tggggaagtttatttgag

SEQ ID NO: 6747615 - DNA, 16 bp, Homo sapiens
tggggaatgggcaggt

SEQ ID NO: 6747616 - DNA, 14 bp, Homo sapiens
tggggaatttcctc

SEQ ID NO: 6747617 - DNA, 21 bp, Homo sapiens
tggggacacacattctgcctt

SEQ ID NO: 6747618 - DNA, 22 bp, Homo sapiens
tggggacacacattctgccttg

SEQ ID NO: 6747619 - DNA, 15 bp, Homo sapiens
tggggacaccccaga

SEQ ID NO: 6747620 - DNA, 16 bp, Homo sapiens
tggggacaccctcctg

SEQ ID NO: 6747621 - DNA, 15 bp, Homo sapiens
tggggacagaccagc

SEQ ID NO: 6747622 - DNA, 16 bp, Homo sapiens
tggggacagagggtgt

SEQ ID NO: 6747623 - DNA, 13 bp, Homo sapiens
tggggacagattc

SEQ ID NO: 6747624 - DNA, 15 bp, Homo sapiens
tggggacagcttcct

SEQ ID NO: 6747625 - DNA, 13 bp, Homo sapiens
tggggacaggccc

SEQ ID NO: 6747626 - DNA, 15 bp, Homo sapiens
tggggacagggaggg

SEQ ID NO: 6747627 - DNA, 23 bp, Homo sapiens
tggggacagggagggggacctgt

SEQ ID NO: 6747628 - DNA, 13 bp, Homo sapiens
tggggacagggct

SEQ ID NO: 6747629 - DNA, 22 bp, Homo sapiens
tggggacaggggcaggaggaag

SEQ ID NO: 6747630 - DNA, 18 bp, Homo sapiens
tggggacagttggcagag

SEQ ID NO: 6747631 - DNA, 23 bp, Homo sapiens
tggggacataaagcctctgactc

SEQ ID NO: 6747632 - DNA, 15 bp, Homo sapiens
tggggaccagagctg

SEQ ID NO: 6747633 - DNA, 17 bp, Homo sapiens
tggggaccagagctgcc

SEQ ID NO: 6747634 - DNA, 18 bp, Homo sapiens
tggggaccagagctgcca

SEQ ID NO: 6747635 - DNA, 15 bp, Homo sapiens
tggggaccagcagcc

SEQ ID NO: 6747636 - DNA, 22 bp, Homo sapiens
tggggaccagcagccccacacc

SEQ ID NO: 6747637 - DNA, 23 bp, Homo sapiens
tggggaccagcagtctgcctgga

SEQ ID NO: 6747638 - DNA, 15 bp, Homo sapiens
tggggaccaggagct

SEQ ID NO: 6747639 - DNA, 11 bp, Homo sapiens
tggggacccac

SEQ ID NO: 6747640 - DNA, 20 bp, Homo sapiens
tggggacccacccagcccct

SEQ ID NO: 6747641 - DNA, 20 bp, Homo sapiens
tggggaccccactccctgct

SEQ ID NO: 6747642 - DNA, 14 bp, Homo sapiens
tggggggccacccg

SEQ ID NO: 6747643 - DNA, 20 bp, Homo sapiens
tggggggccgggcaggtcct

SEQ ID NO: 6747644 - DNA, 16 bp, Homo sapiens
tggggggctgagggtg

SEQ ID NO: 6747645 - DNA, 14 bp, Homo sapiens
tggggggctgtcct

SEQ ID NO: 6747646 - DNA, 15 bp, Homo sapiens
tggggggctgtcctg

SEQ ID NO: 6747647 - DNA, 19 bp, Homo sapiens
tgggggggagaaggcctcc

SEQ ID NO: 6747648 - DNA, 23 bp, Homo sapiens
tgggggggctcccgtggcctgta

SEQ ID NO: 6747649 - DNA, 14 bp, Homo sapiens
tgggggggcttggg

SEQ ID NO: 6747650 - DNA, 20 bp, Homo sapiens
tgggggggcttggggtagag

SEQ ID NO: 6747651 - DNA, 14 bp, Homo sapiens
tgggggggtggccg

SEQ ID NO: 6747652 - DNA, 16 bp, Homo sapiens
tggggggtccagtctg

SEQ ID NO: 6747653 - DNA, 24 bp, Homo sapiens
tggggggtgatgagggcagcagcc

SEQ ID NO: 6747654 - DNA, 12 bp, Homo sapiens
tggggggtgcag

SEQ ID NO: 6747655 - DNA, 15 bp, Homo sapiens
tggggggtgggcttt

SEQ ID NO: 6747656 - DNA, 18 bp, Homo sapiens
tggggggttgcctcgagt

SEQ ID NO: 6747657 - DNA, 19 bp, Homo sapiens
tggggggttggcagcccac

SEQ ID NO: 6747658 - DNA, 15 bp, Homo sapiens
tgggggtagcagctg

SEQ ID NO: 6747659 - DNA, 17 bp, Homo sapiens
tgggggtagcagctgga

SEQ ID NO: 6747660 - DNA, 18 bp, Homo sapiens
tgggggtagcagctggac

SEQ ID NO: 6747661 - DNA, 17 bp, Homo sapiens
tgggggtatcctgtgca

SEQ ID NO: 6747662 - DNA, 18 bp, Homo sapiens
tgggggtatcctgtgcat

SEQ ID NO: 6747663 - DNA, 15 bp, Homo sapiens
tgggggtattttcta

SEQ ID NO: 6747664 - DNA, 22 bp, Homo sapiens
tgggggtcagcatccagtgtga

SEQ ID NO: 6747665 - DNA, 17 bp, Homo sapiens
tgggggtcatcagggag

SEQ ID NO: 6747666 - DNA, 15 bp, Homo sapiens
tgggggtcctctctg

SEQ ID NO: 6747667 - DNA, 23 bp, Homo sapiens
tgggggtctgctctgtgcctggg

SEQ ID NO: 6747668 - DNA, 19 bp, Homo sapiens
tgggggtctgggaggcagg

SEQ ID NO: 6747669 - DNA, 12 bp, Homo sapiens
tgggggtgcatt

SEQ ID NO: 6747670 - DNA, 15 bp, Homo sapiens
tgggggtgcatttga

SEQ ID NO: 6747671 - DNA, 23 bp, Homo sapiens
tgggggtgccaaccacctctggc

SEQ ID NO: 6747672 - DNA, 14 bp, Homo sapiens
tgggggtgccatgg

SEQ ID NO: 6747673 - DNA, 21 bp, Homo sapiens
tgggggtgccgctctaaattg

SEQ ID NO: 6747674 - DNA, 15 bp, Homo sapiens
tgggggtggaataaa

SEQ ID NO: 6747675 - DNA, 13 bp, Homo sapiens
tgggggtggagga

SEQ ID NO: 6747676 - DNA, 14 bp, Homo sapiens
tgggggtggaggac

SEQ ID NO: 6747677 - DNA, 19 bp, Homo sapiens
tgggggtggaggcttcctg

SEQ ID NO: 6747678 - DNA, 15 bp, Homo sapiens
tgggggtggcaggca

SEQ ID NO: 6747679 - DNA, 19 bp, Homo sapiens
tgggggtggccactcctgg

SEQ ID NO: 6747680 - DNA, 14 bp, Homo sapiens
tgggggtggccatc

SEQ ID NO: 6747681 - DNA, 21 bp, Homo sapiens
tgggggtggccatccctgggc

SEQ ID NO: 6747682 - DNA, 23 bp, Homo sapiens
tgggggtggccatccctgggccc

SEQ ID NO: 6747683 - DNA, 13 bp, Homo sapiens
tgggggtggctgg

SEQ ID NO: 6747684 - DNA, 18 bp, Homo sapiens
tgggggtggctgggactc

SEQ ID NO: 6747685 - DNA, 13 bp, Homo sapiens
tgggggtgggaag

SEQ ID NO: 6747686 - DNA, 14 bp, Homo sapiens
tgggggtgggaggt

SEQ ID NO: 6747687 - DNA, 14 bp, Homo sapiens
tgggggtgggcagc

SEQ ID NO: 6747688 - DNA, 17 bp, Homo sapiens
tgggggtgggcagcagc

SEQ ID NO: 6747689 - DNA, 23 bp, Homo sapiens
tgggggtgggctgctggccatga

SEQ ID NO: 6747690 - DNA, 11 bp, Homo sapiens
tgggggtgggg

SEQ ID NO: 6747691 - DNA, 16 bp, Homo sapiens
tgggggtggggctcct

SEQ ID NO: 6747692 - DNA, 17 bp, Homo sapiens
tgggggtggggctccta

SEQ ID NO: 6747693 - DNA, 20 bp, Homo sapiens
tgggggtggggctcctacct

SEQ ID NO: 6747694 - DNA, 14 bp, Homo sapiens
tgggggtgggtcag

SEQ ID NO: 6747695 - DNA, 22 bp, Homo sapiens
tgggggtgtggctctgccctgg

SEQ ID NO: 6747696 - DNA, 15 bp, Homo sapiens
tgggggttctggcag

SEQ ID NO: 6747697 - DNA, 17 bp, Homo sapiens
tgggggttctggcagga

SEQ ID NO: 6747698 - DNA, 18 bp, Homo sapiens
tgggggttctggcaggac

SEQ ID NO: 6747699 - DNA, 20 bp, Homo sapiens
tgggggttctttcttcctct

SEQ ID NO: 6747700 - DNA, 17 bp, Homo sapiens
tgggggttggatgggaa

SEQ ID NO: 6747701 - DNA, 17 bp, Homo sapiens
tgggggttgttgggagg

SEQ ID NO: 6747702 - DNA, 22 bp, Homo sapiens
tggggtaagccagagcctgggg

SEQ ID NO: 6747703 - DNA, 19 bp, Homo sapiens
tggggtaagcggaataaac

SEQ ID NO: 6747704 - DNA, 13 bp, Homo sapiens
tggggtaaggagg

SEQ ID NO: 6747705 - DNA, 17 bp, Homo sapiens
tggggtaaggaggagaa

SEQ ID NO: 6747706 - DNA, 18 bp, Homo sapiens
tggggtacaaggggccca

SEQ ID NO: 6747707 - DNA, 21 bp, Homo sapiens
tggggtaccaagagactcctt

SEQ ID NO: 6747708 - DNA, 14 bp, Homo sapiens
tggggtacccactg

SEQ ID NO: 6747709 - DNA, 15 bp, Homo sapiens
tggggtacccactgc

SEQ ID NO: 6747710 - DNA, 19 bp, Homo sapiens
tggggtacccactgctctg

SEQ ID NO: 6747711 - DNA, 20 bp, Homo sapiens
tggggtacccactgctctgg

SEQ ID NO: 6747712 - DNA, 17 bp, Homo sapiens
tggggtactcttgatgt

SEQ ID NO: 6747713 - DNA, 19 bp, Homo sapiens
tggggtagaaacattgtaa

SEQ ID NO: 6747714 - DNA, 21 bp, Homo sapiens
tggggtagaccttgagggtgg

SEQ ID NO: 6747715 - DNA, 14 bp, Homo sapiens
tggggtagagagga

SEQ ID NO: 6747716 - DNA, 17 bp, Homo sapiens
tggggtagagaggacag

SEQ ID NO: 6747717 - DNA, 21 bp, Homo sapiens
tggggtaggaaaccaccctga

SEQ ID NO: 6747718 - DNA, 23 bp, Homo sapiens
tggggtaggaaaccaccctgagg

SEQ ID NO: 6747719 - DNA, 21 bp, Homo sapiens
tggggtaggaggatgggctcg

SEQ ID NO: 6747720 - DNA, 24 bp, Homo sapiens
tggggtaggctgctccctgagggc

SEQ ID NO: 6747721 - DNA, 16 bp, Homo sapiens
tggggtataggtctca

SEQ ID NO: 6747722 - DNA, 22 bp, Homo sapiens
tggggtattggacatagatatt

SEQ ID NO: 6747723 - DNA, 24 bp, Homo sapiens
tggggtatttaccacagcagctga

SEQ ID NO: 6747724 - DNA, 19 bp, Homo sapiens
tggggtcaagctgagctgg

SEQ ID NO: 6747725 - DNA, 16 bp, Homo sapiens
tggggtcacagaggca

SEQ ID NO: 6747726 - DNA, 16 bp, Homo sapiens
tggggtcactctggca

SEQ ID NO: 6747727 - DNA, 22 bp, Homo sapiens
tggggtcactctggcagctcag

SEQ ID NO: 6747728 - DNA, 16 bp, Homo sapiens
tggggtcagcaggccc

SEQ ID NO: 6747729 - DNA, 13 bp, Homo sapiens
tggggtcagccag

SEQ ID NO: 6747730 - DNA, 14 bp, Homo sapiens
tggggtcagccagg

SEQ ID NO: 6747731 - DNA, 15 bp, Homo sapiens
tggggtcagccaggg

SEQ ID NO: 6747732 - DNA, 16 bp, Homo sapiens
tggggtcagccccaag

SEQ ID NO: 6747733 - DNA, 18 bp, Homo sapiens
tggggtcagccccaaggg

SEQ ID NO: 6747734 - DNA, 22 bp, Homo sapiens
tggggtcagccccaagggctgg

SEQ ID NO: 6747735 - DNA, 23 bp, Homo sapiens
tggggtcagccccaagggctggg

SEQ ID NO: 6747736 - DNA, 13 bp, Homo sapiens
tggggtcaggaac

SEQ ID NO: 6747737 - DNA, 20 bp, Homo sapiens
tggggtcatgaagggctgga

SEQ ID NO: 6747738 - DNA, 13 bp, Homo sapiens
tggggtcatgccc

SEQ ID NO: 6747739 - DNA, 21 bp, Homo sapiens
tggggtcattttgactggctt

SEQ ID NO: 6747740 - DNA, 14 bp, Homo sapiens
tggggtccagggag

SEQ ID NO: 6747741 - DNA, 15 bp, Homo sapiens
tggggtccagggctg

SEQ ID NO: 6747742 - DNA, 19 bp, Homo sapiens
tggggtccatccccttccc

SEQ ID NO: 6747743 - DNA, 19 bp, Homo sapiens
tggggtcccccctccctgt

SEQ ID NO: 6747744 - DNA, 15 bp, Homo sapiens
tggggtccctccacc

SEQ ID NO: 6747745 - DNA, 19 bp, Homo sapiens
tggggtcctcctgtgctat

SEQ ID NO: 6747746 - DNA, 13 bp, Homo sapiens
tggggtccttgga

SEQ ID NO: 6747747 - DNA, 22 bp, Homo sapiens
tggggtccttttttatacagga

SEQ ID NO: 6747748 - DNA, 14 bp, Homo sapiens
tggggtcggagagg

SEQ ID NO: 6747749 - DNA, 23 bp, Homo sapiens
tggggtctcacagtgttgcccag

SEQ ID NO: 6747750 - DNA, 13 bp, Homo sapiens
tggggtctctctc

SEQ ID NO: 6747751 - DNA, 16 bp, Homo sapiens
tggggtctctctccct

SEQ ID NO: 6747752 - DNA, 20 bp, Homo sapiens
tggggtctctgcatcttcag

SEQ ID NO: 6747753 - DNA, 19 bp, Homo sapiens
tggggtctgagcatgatgg

SEQ ID NO: 6747754 - DNA, 17 bp, Homo sapiens
tggggtctggcagcctc

SEQ ID NO: 6747755 - DNA, 19 bp, Homo sapiens
tggggtctgggagggggtg

SEQ ID NO: 6747756 - DNA, 24 bp, Homo sapiens
tggggtctgggagggggtgagagg

SEQ ID NO: 6747757 - DNA, 18 bp, Homo sapiens
tggggtctgggcagtgcc

SEQ ID NO: 6747758 - DNA, 16 bp, Homo sapiens
tggggtctgtgactgg

SEQ ID NO: 6747759 - DNA, 18 bp, Homo sapiens
tggggtctgtgactggat

SEQ ID NO: 6747760 - DNA, 19 bp, Homo sapiens
tggggtctgtgactggatc

SEQ ID NO: 6747761 - DNA, 20 bp, Homo sapiens
tggggtctgtgactggatct

SEQ ID NO: 6747762 - DNA, 20 bp, Homo sapiens
tggggtcttgctatattgcc

SEQ ID NO: 6747763 - DNA, 16 bp, Homo sapiens
tggggtgaacagctgg

SEQ ID NO: 6747764 - DNA, 19 bp, Homo sapiens
tggggtgaatacttatttt

SEQ ID NO: 6747765 - DNA, 21 bp, Homo sapiens
tggggtgacttccctggtcac

SEQ ID NO: 6747766 - DNA, 13 bp, Homo sapiens
tggggtgagagag

SEQ ID NO: 6747767 - DNA, 13 bp, Homo sapiens
tggggtgagcctg

SEQ ID NO: 6747768 - DNA, 19 bp, Homo sapiens
tggggtgagggacagagcc

SEQ ID NO: 6747769 - DNA, 23 bp, Homo sapiens
tggggtgagggagttagggagag

SEQ ID NO: 6747770 - DNA, 21 bp, Homo sapiens
tggggtgcagctgggtggggc

SEQ ID NO: 6747771 - DNA, 11 bp, Homo sapiens
tggggtgcagg

SEQ ID NO: 6747772 - DNA, 16 bp, Homo sapiens
tggggtgcatcctcct

SEQ ID NO: 6747773 - DNA, 19 bp, Homo sapiens
tggggtgccccagctagga

SEQ ID NO: 6747774 - DNA, 15 bp, Homo sapiens
tggggtgccttcact

SEQ ID NO: 6747775 - DNA, 21 bp, Homo sapiens
tggggtgcgggatacagctga

SEQ ID NO: 6747776 - DNA, 22 bp, Homo sapiens
tggggtgcgggatacagctgag

SEQ ID NO: 6747777 - DNA, 18 bp, Homo sapiens
tggggtgctgggaggagg

SEQ ID NO: 6747778 - DNA, 14 bp, Homo sapiens
tggggtgctggggc

SEQ ID NO: 6747779 - DNA, 14 bp, Homo sapiens
tggggtggacctgg

SEQ ID NO: 6747780 - DNA, 21 bp, Homo sapiens
tggggtggaggctaagcctgg

SEQ ID NO: 6747781 - DNA, 17 bp, Homo sapiens
tggggtggagggtcgcc

SEQ ID NO: 6747782 - DNA, 16 bp, Homo sapiens
tggggtggccagggct

SEQ ID NO: 6747783 - DNA, 13 bp, Homo sapiens
tggggtggcctca

SEQ ID NO: 6747784 - DNA, 20 bp, Homo sapiens
tggggtggcgcgcctgcctt

SEQ ID NO: 6747785 - DNA, 14 bp, Homo sapiens
tggggtggctgcag

SEQ ID NO: 6747786 - DNA, 18 bp, Homo sapiens
tggggtggctgcagcctc

SEQ ID NO: 6747787 - DNA, 19 bp, Homo sapiens
tggggtggctgcagcctca

SEQ ID NO: 6747788 - DNA, 9 bp, Homo sapiens
tggggtggg

SEQ ID NO: 6747789 - DNA, 16 bp, Homo sapiens
tggggtgggacaggga

SEQ ID NO: 6747790 - DNA, 16 bp, Homo sapiens
tggggtgggagacttt

SEQ ID NO: 6747791 - DNA, 18 bp, Homo sapiens
tggggtgggagccacagg

SEQ ID NO: 6747792 - DNA, 12 bp, Homo sapiens
tggggtgggagg

SEQ ID NO: 6747793 - DNA, 23 bp, Homo sapiens
tggggtgggagggcgtcaggcag

SEQ ID NO: 6747794 - DNA, 20 bp, Homo sapiens
tggggtgggaggtcttgcta

SEQ ID NO: 6747795 - DNA, 22 bp, Homo sapiens
tggggtgggagtaacagggcag

SEQ ID NO: 6747796 - DNA, 12 bp, Homo sapiens
tggggtgggcag

SEQ ID NO: 6747797 - DNA, 15 bp, Homo sapiens
tggggtgggcagggc

SEQ ID NO: 6747798 - DNA, 13 bp, Homo sapiens
tggggtgggccca

SEQ ID NO: 6747799 - DNA, 20 bp, Homo sapiens
tggggtgggcctctggtttg

SEQ ID NO: 6747800 - DNA, 14 bp, Homo sapiens
tggggtgggctgga

SEQ ID NO: 6747801 - DNA, 10 bp, Homo sapiens
tggggtgggg

SEQ ID NO: 6747802 - DNA, 19 bp, Homo sapiens
tggggtggggcttggaagg

SEQ ID NO: 6747803 - DNA, 15 bp, Homo sapiens
tggggtgggggccag

SEQ ID NO: 6747804 - DNA, 17 bp, Homo sapiens
tggggtgggggccaggc

SEQ ID NO: 6747805 - DNA, 21 bp, Homo sapiens
tggggtggggggggtgctggg

SEQ ID NO: 6747806 - DNA, 20 bp, Homo sapiens
tggggtgggggtgggcagca

SEQ ID NO: 6747807 - DNA, 23 bp, Homo sapiens
tggggtgggggtgggcagcagca

SEQ ID NO: 6747808 - DNA, 23 bp, Homo sapiens
tggggtgggtgtgagcagggtga

SEQ ID NO: 6747809 - DNA, 21 bp, Homo sapiens
tggggtggttatgtttccatg

SEQ ID NO: 6747810 - DNA, 13 bp, Homo sapiens
tggggtgtgctgg

SEQ ID NO: 6747811 - DNA, 16 bp, Homo sapiens
tggggtgtttgggagg

SEQ ID NO: 6747812 - DNA, 19 bp, Homo sapiens
tggggttatctctgtgtta

SEQ ID NO: 6747813 - DNA, 14 bp, Homo sapiens
tggggttcagcccc

SEQ ID NO: 6747814 - DNA, 21 bp, Homo sapiens
tggggttcagcccctcctctg

SEQ ID NO: 6747815 - DNA, 17 bp, Homo sapiens
tggggttcggcctgtgt

SEQ ID NO: 6747816 - DNA, 18 bp, Homo sapiens
tggggttcggcctgtgtc

SEQ ID NO: 6747817 - DNA, 20 bp, Homo sapiens
tggggttcgtggaaagggtg

SEQ ID NO: 6747818 - DNA, 21 bp, Homo sapiens
tggggttctcagactgccaaa

SEQ ID NO: 6747819 - DNA, 17 bp, Homo sapiens
tgggtctggtggtgctg

SEQ ID NO: 6747820 - DNA, 21 bp, Homo sapiens
tgggtctgttttcctttctca

SEQ ID NO: 6747821 - DNA, 14 bp, Homo sapiens
tgggtcttatgctt

SEQ ID NO: 6747822 - DNA, 12 bp, Homo sapiens
tgggtcttcagc

SEQ ID NO: 6747823 - DNA, 14 bp, Homo sapiens
tgggtcttcagctt

SEQ ID NO: 6747824 - DNA, 16 bp, Homo sapiens
tgggtcttcagcttta

SEQ ID NO: 6747825 - DNA, 22 bp, Homo sapiens
tgggtcttcagggggccaggtg

SEQ ID NO: 6747826 - DNA, 18 bp, Homo sapiens
tgggtcttggaccagggc

SEQ ID NO: 6747827 - DNA, 22 bp, Homo sapiens
tgggtcttgttttttttttcca

SEQ ID NO: 6747828 - DNA, 18 bp, Homo sapiens
tgggtgaaagaaatcatg

SEQ ID NO: 6747829 - DNA, 15 bp, Homo sapiens
tgggtgaagacagag

SEQ ID NO: 6747830 - DNA, 18 bp, Homo sapiens
tgggtgaaggcctggctg

SEQ ID NO: 6747831 - DNA, 19 bp, Homo sapiens
tgggtgaaggcctggctgg

SEQ ID NO: 6747832 - DNA, 21 bp, Homo sapiens
tgggtgaaggcctggctggaa

SEQ ID NO: 6747833 - DNA, 22 bp, Homo sapiens
tgggtgaaggcctggctggaag

SEQ ID NO: 6747834 - DNA, 18 bp, Homo sapiens
tgggtgacaagagcctga

SEQ ID NO: 6747835 - DNA, 14 bp, Homo sapiens
tgggtgacagagca

SEQ ID NO: 6747836 - DNA, 16 bp, Homo sapiens
tgggtgacagagcaat

SEQ ID NO: 6747837 - DNA, 17 bp, Homo sapiens
tgggtgacagagcgaga

SEQ ID NO: 6747838 - DNA, 15 bp, Homo sapiens
tgggtgaccaggtcc

SEQ ID NO: 6747839 - DNA, 16 bp, Homo sapiens
tgggtgagccaaggac

SEQ ID NO: 6747840 - DNA, 12 bp, Homo sapiens
tgggtgagccag

SEQ ID NO: 6747841 - DNA, 17 bp, Homo sapiens
tgggtgagcgggtgggg

SEQ ID NO: 6747842 - DNA, 14 bp, Homo sapiens
tgggtgagctctca

SEQ ID NO: 6747843 - DNA, 15 bp, Homo sapiens
tgggtgagctcttcc

SEQ ID NO: 6747844 - DNA, 14 bp, Homo sapiens
tgggtgaggctggg

SEQ ID NO: 6747845 - DNA, 15 bp, Homo sapiens
tgggtgaggctgggc

SEQ ID NO: 6747846 - DNA, 20 bp, Homo sapiens
tgggtgaggctgggcagggc

SEQ ID NO: 6747847 - DNA, 16 bp, Homo sapiens
tgggtgaggtaataaa

SEQ ID NO: 6747848 - DNA, 17 bp, Homo sapiens
tgggtgataattttgaa

SEQ ID NO: 6747849 - DNA, 16 bp, Homo sapiens
tgggtgatcagaaggc

SEQ ID NO: 6747850 - DNA, 18 bp, Homo sapiens
tgggtgatcagaaggctg

SEQ ID NO: 6747851 - DNA, 20 bp, Homo sapiens
tgggtgatcagaaggctggg

SEQ ID NO: 6747852 - DNA, 20 bp, Homo sapiens
tgggtgatttctagaatggt

SEQ ID NO: 6747853 - DNA, 20 bp, Homo sapiens
tgggtgcaggagcgctccct

SEQ ID NO: 6747854 - DNA, 23 bp, Homo sapiens
tgggtgcagtttgaggggcctgt

SEQ ID NO: 6747855 - DNA, 13 bp, Homo sapiens
tgggtgccaggtg

SEQ ID NO: 6747856 - DNA, 15 bp, Homo sapiens
tgggtgccaggtgct

SEQ ID NO: 6747857 - DNA, 17 bp, Homo sapiens
tgggtgccattcccagc

SEQ ID NO: 6747858 - DNA, 18 bp, Homo sapiens
tgggtgcccaagctcaga

SEQ ID NO: 6747859 - DNA, 16 bp, Homo sapiens
tgggtgcccacagccc

SEQ ID NO: 6747860 - DNA, 23 bp, Homo sapiens
tgggtgccccccttgccagacat

SEQ ID NO: 6747861 - DNA, 11 bp, Homo sapiens
tgggtgccctg

SEQ ID NO: 6747862 - DNA, 16 bp, Homo sapiens
tgggtgccctttcctg

SEQ ID NO: 6747863 - DNA, 22 bp, Homo sapiens
tgggtgcctcctccccaggtgg

SEQ ID NO: 6747864 - DNA, 15 bp, Homo sapiens
tgggtgcgtctccag

SEQ ID NO: 6747865 - DNA, 23 bp, Homo sapiens
tgggtgctaagggtaagggagag

SEQ ID NO: 6747866 - DNA, 17 bp, Homo sapiens
tgggtgctactggggaa

SEQ ID NO: 6747867 - DNA, 21 bp, Homo sapiens
tgggtgctagatccagcccaa

SEQ ID NO: 6747868 - DNA, 13 bp, Homo sapiens
tgggtgctcccta

SEQ ID NO: 6747869 - DNA, 14 bp, Homo sapiens
tgggtgctgataat

SEQ ID NO: 6747870 - DNA, 15 bp, Homo sapiens
tgggtgctgccatga

SEQ ID NO: 6747871 - DNA, 15 bp, Homo sapiens
tgggtgctgccctgt

SEQ ID NO: 6747872 - DNA, 16 bp, Homo sapiens
tgggtgctgccctgtg

SEQ ID NO: 6747873 - DNA, 17 bp, Homo sapiens
tgggtgctgccctgtgt

SEQ ID NO: 6747874 - DNA, 13 bp, Homo sapiens
tgggtgctggtcc

SEQ ID NO: 6747875 - DNA, 16 bp, Homo sapiens
tgggtgctggtcctgt

SEQ ID NO: 6747876 - DNA, 15 bp, Homo sapiens
tgggtgcttggagga

SEQ ID NO: 6747877 - DNA, 22 bp, Homo sapiens
tgggtgcttggaggaaggaaac

SEQ ID NO: 6747878 - DNA, 17 bp, Homo sapiens
tgggtggaaactaagac

SEQ ID NO: 6747879 - DNA, 23 bp, Homo sapiens
tgggtggaagtgtgtgccaagag

SEQ ID NO: 6747880 - DNA, 16 bp, Homo sapiens
tgggtggacaggggcc

SEQ ID NO: 6747881 - DNA, 21 bp, Homo sapiens
tgggtggagaagccattgtct

SEQ ID NO: 6747882 - DNA, 22 bp, Homo sapiens
tgggtggagaagccattgtctt

SEQ ID NO: 6747883 - DNA, 23 bp, Homo sapiens
tgggtggagaagccattgtcttc

SEQ ID NO: 6747884 - DNA, 20 bp, Homo sapiens
tgggtggagtcaggcttctc

SEQ ID NO: 6747885 - DNA, 16 bp, Homo sapiens
tgggtggatgtgagca

SEQ ID NO: 6747886 - DNA, 23 bp, Homo sapiens
tgggtggcaacatttggggagag

SEQ ID NO: 6747887 - DNA, 23 bp, Homo sapiens
tgggtggccatcctacccagcgt

SEQ ID NO: 6747888 - DNA, 16 bp, Homo sapiens
tgggtggccggccctg

SEQ ID NO: 6747889 - DNA, 17 bp, Homo sapiens
tgggtggccggccctgc

SEQ ID NO: 6747890 - DNA, 15 bp, Homo sapiens
tgggtggcctcggga

SEQ ID NO: 6747891 - DNA, 19 bp, Homo sapiens
tgggtggctactctgtgcc

SEQ ID NO: 6747892 - DNA, 23 bp, Homo sapiens
tgggtggctactctgtgccagag

SEQ ID NO: 6747893 - DNA, 14 bp, Homo sapiens
tgggtggctcactc

SEQ ID NO: 6747894 - DNA, 17 bp, Homo sapiens
tgggtggctcctgccac

SEQ ID NO: 6747895 - DNA, 18 bp, Homo sapiens
tgggtggctcctgccact

SEQ ID NO: 6747896 - DNA, 19 bp, Homo sapiens
tgggtggctcctgccactg

SEQ ID NO: 6747897 - DNA, 20 bp, Homo sapiens
tgggtggcttaaaaaaaact

SEQ ID NO: 6747898 - DNA, 13 bp, Homo sapiens
tgggtggctttca

SEQ ID NO: 6747899 - DNA, 14 bp, Homo sapiens
tgggtggctttcaa

SEQ ID NO: 6747900 - DNA, 13 bp, Homo sapiens
tgggtgggacaca

SEQ ID NO: 6747901 - DNA, 12 bp, Homo sapiens
tgggtgggacag

SEQ ID NO: 6747902 - DNA, 12 bp, Homo sapiens
tgggtgggagga

SEQ ID NO: 6747903 - DNA, 18 bp, Homo sapiens
tgggtgggaggagatgaa

SEQ ID NO: 6747904 - DNA, 17 bp, Homo sapiens
tgggtgggcagggaggg

SEQ ID NO: 6747905 - DNA, 19 bp, Homo sapiens
tgggtgggcagggaggggc

SEQ ID NO: 6747906 - DNA, 21 bp, Homo sapiens
tgggtgggcagggaggggctg

SEQ ID NO: 6747907 - DNA, 22 bp, Homo sapiens
tgggtgggccccacagtggtca

SEQ ID NO: 6747908 - DNA, 13 bp, Homo sapiens
tgggtgggccctg

SEQ ID NO: 6747909 - DNA, 14 bp, Homo sapiens
tgggtgggccctgc

SEQ ID NO: 6747910 - DNA, 12 bp, Homo sapiens
tgggtgggcctg

SEQ ID NO: 6747911 - DNA, 13 bp, Homo sapiens
tgggtggggacag

SEQ ID NO: 6747912 - DNA, 20 bp, Homo sapiens
tgggtggggacagaccagcc

SEQ ID NO: 6747913 - DNA, 14 bp, Homo sapiens
tgggtggggacagt

SEQ ID NO: 6747914 - DNA, 17 bp, Homo sapiens
tgggtggggaggccctg

SEQ ID NO: 6747915 - DNA, 21 bp, Homo sapiens
tgggtggggaggccctgcctg

SEQ ID NO: 6747916 - DNA, 13 bp, Homo sapiens
tgggtggggctgc

SEQ ID NO: 6747917 - DNA, 21 bp, Homo sapiens
tgggtggggctgctcctccag

SEQ ID NO: 6747918 - DNA, 12 bp, Homo sapiens
tgggtggggctt

SEQ ID NO: 6747919 - DNA, 13 bp, Homo sapiens
tgggtgggggctc

SEQ ID NO: 6747920 - DNA, 17 bp, Homo sapiens
tgggtgggggctcctgg

SEQ ID NO: 6747921 - DNA, 21 bp, Homo sapiens
tgggtgggggctcctggtggc

SEQ ID NO: 6747922 - DNA, 22 bp, Homo sapiens
tgggtgggggctcctggtggcc

SEQ ID NO: 6747923 - DNA, 14 bp, Homo sapiens
tgggtgggtggtgg

SEQ ID NO: 6747924 - DNA, 17 bp, Homo sapiens
tgggtggtaactgccag

SEQ ID NO: 6747925 - DNA, 14 bp, Homo sapiens
tgggtggtaccctc

SEQ ID NO: 6747926 - DNA, 18 bp, Homo sapiens
tgggtggtaccctctgga

SEQ ID NO: 6747927 - DNA, 14 bp, Homo sapiens
tgggtggtggggag

SEQ ID NO: 6747928 - DNA, 22 bp, Homo sapiens
tgggtggtgtcctgaagctgct

SEQ ID NO: 6747929 - DNA, 22 bp, Homo sapiens
tgggtgtaacaggtctcctctt

SEQ ID NO: 6747930 - DNA, 15 bp, Homo sapiens
tgggtgtattctctg

SEQ ID NO: 6747931 - DNA, 14 bp, Homo sapiens
tgggtgtcagtgtc

SEQ ID NO: 6747932 - DNA, 19 bp, Homo sapiens
tgggtgtcatttcattcca

SEQ ID NO: 6747933 - DNA, 18 bp, Homo sapiens
tgggtgtccaaaggaaga

SEQ ID NO: 6747934 - DNA, 19 bp, Homo sapiens
tgggtgtcctgcctgtctg

SEQ ID NO: 6747935 - DNA, 22 bp, Homo sapiens
tgggtgtctgggctcaagcttt

SEQ ID NO: 6747936 - DNA, 16 bp, Homo sapiens
tgggtgtgccaggcta

SEQ ID NO: 6747937 - DNA, 15 bp, Homo sapiens
tgggtgtgccctggc

SEQ ID NO: 6747938 - DNA, 18 bp, Homo sapiens
tgggtgtgctccaggctt

SEQ ID NO: 6747939 - DNA, 21 bp, Homo sapiens
tgggtgtgctttttgggacca

SEQ ID NO: 6747940 - DNA, 14 bp, Homo sapiens
tgggtgtggatggc

SEQ ID NO: 6747941 - DNA, 17 bp, Homo sapiens
tgggtgtggatggcagt

SEQ ID NO: 6747942 - DNA, 14 bp, Homo sapiens
tgggtgtggccagc

SEQ ID NO: 6747943 - DNA, 17 bp, Homo sapiens
tgggtgtggccagcaca

SEQ ID NO: 6747944 - DNA, 14 bp, Homo sapiens
tgggtgtggcgcag

SEQ ID NO: 6747945 - DNA, 19 bp, Homo sapiens
tgggtgtgtgagtgggagg

SEQ ID NO: 6747946 - DNA, 14 bp, Homo sapiens
tgggtgtgtgcgcc

SEQ ID NO: 6747947 - DNA, 15 bp, Homo sapiens
tgggtgtgtggcctc

SEQ ID NO: 6747948 - DNA, 18 bp, Homo sapiens
tgggtgtgtgtagccaag

SEQ ID NO: 6747949 - DNA, 14 bp, Homo sapiens
tgggtgtgtgttac

SEQ ID NO: 6747950 - DNA, 14 bp, Homo sapiens
tgggtgtgtttcag

SEQ ID NO: 6747951 - DNA, 14 bp, Homo sapiens
tgggtgttaatttt

SEQ ID NO: 6747952 - DNA, 22 bp, Homo sapiens
tgggtgttatcacctagctgaa

SEQ ID NO: 6747953 - DNA, 12 bp, Homo sapiens
tgggtgttcata

SEQ ID NO: 6747954 - DNA, 20 bp, Homo sapiens
tgggtgttcctggcagttta

SEQ ID NO: 6747955 - DNA, 15 bp, Homo sapiens
tgggtgttctttcct

SEQ ID NO: 6747956 - DNA, 17 bp, Homo sapiens
tgggtgttctttcctgc

SEQ ID NO: 6747957 - DNA, 16 bp, Homo sapiens
tgggtgttgaccactc

SEQ ID NO: 6747958 - DNA, 15 bp, Homo sapiens
tgggtgtttcagttt

SEQ ID NO: 6747959 - DNA, 14 bp, Homo sapiens
tgggtgtttccaga

SEQ ID NO: 6747960 - DNA, 19 bp, Homo sapiens
tgggtgttttcaaatgtca

SEQ ID NO: 6747961 - DNA, 17 bp, Homo sapiens
tgggtgtttttcatgtt

SEQ ID NO: 6747962 - DNA, 20 bp, Homo sapiens
tgggtgtttttcatgtttta

SEQ ID NO: 6747963 - DNA, 16 bp, Homo sapiens
tgggttaacaaatgag

SEQ ID NO: 6747964 - DNA, 16 bp, Homo sapiens
tgggttaacagtaaat

SEQ ID NO: 6747965 - DNA, 20 bp, Homo sapiens
tgggttaacagtaaatatac

SEQ ID NO: 6747966 - DNA, 14 bp, Homo sapiens
tgggttagactgcc

SEQ ID NO: 6747967 - DNA, 16 bp, Homo sapiens
tgggttagactgccag

SEQ ID NO: 6747968 - DNA, 17 bp, Homo sapiens
tgggttagctaaaccaa

SEQ ID NO: 6747969 - DNA, 22 bp, Homo sapiens
tgggttaggcattaatgtttct

SEQ ID NO: 6747970 - DNA, 19 bp, Homo sapiens
tgggttagggaaaacattc

SEQ ID NO: 6747971 - DNA, 21 bp, Homo sapiens
tgggttagggaaaacattcca

SEQ ID NO: 6747972 - DNA, 20 bp, Homo sapiens
tgggttagtcgggtgccagg

SEQ ID NO: 6747973 - DNA, 15 bp, Homo sapiens
tgggttattctggag

SEQ ID NO: 6747974 - DNA, 16 bp, Homo sapiens
tgggttattctggagt

SEQ ID NO: 6747975 - DNA, 17 bp, Homo sapiens
tgggttattctggagtt

SEQ ID NO: 6747976 - DNA, 21 bp, Homo sapiens
tgggttatttttgtccctgct

SEQ ID NO: 6747977 - DNA, 23 bp, Homo sapiens
tgggttcaagcaatcctcctgcc

SEQ ID NO: 6747978 - DNA, 15 bp, Homo sapiens
tgggttcactagagc

SEQ ID NO: 6747979 - DNA, 16 bp, Homo sapiens
tgggttcactgcaacc

SEQ ID NO: 6747980 - DNA, 20 bp, Homo sapiens
tgggttcagaaatgctgcct

SEQ ID NO: 6747981 - DNA, 13 bp, Homo sapiens
tgggttcaggccc

SEQ ID NO: 6747982 - DNA, 17 bp, Homo sapiens
tgggttcatgtctctga

SEQ ID NO: 6747983 - DNA, 13 bp, Homo sapiens
tgggttcattatt

SEQ ID NO: 6747984 - DNA, 21 bp, Homo sapiens
tgggttcattccccggccctc

SEQ ID NO: 6747985 - DNA, 23 bp, Homo sapiens
tgggttcattccccggccctccg

SEQ ID NO: 6747986 - DNA, 18 bp, Homo sapiens
tgggttccaatcctggct

SEQ ID NO: 6747987 - DNA, 15 bp, Homo sapiens
tgggttcccactccc

SEQ ID NO: 6747988 - DNA, 20 bp, Homo sapiens
tgggttcccactcccggcct

SEQ ID NO: 6747989 - DNA, 21 bp, Homo sapiens
tgggttcctcttccccactcc

SEQ ID NO: 6747990 - DNA, 21 bp, Homo sapiens
tgggttccttcctctgagcct

SEQ ID NO: 6747991 - DNA, 15 bp, Homo sapiens
tgggttcgttgggga

SEQ ID NO: 6747992 - DNA, 16 bp, Homo sapiens
tgggttctacccaggt

SEQ ID NO: 6747993 - DNA, 17 bp, Homo sapiens
tgggttctatgtttact

SEQ ID NO: 6747994 - DNA, 17 bp, Homo sapiens
tgggttctctgctgtcc

SEQ ID NO: 6747995 - DNA, 15 bp, Homo sapiens
tgggttctgactctg

SEQ ID NO: 6747996 - DNA, 14 bp, Homo sapiens
tgggttctgcctgc

SEQ ID NO: 6747997 - DNA, 13 bp, Homo sapiens
tgggttctggggc

SEQ ID NO: 6747998 - DNA, 16 bp, Homo sapiens
tggtcctggacacctc

SEQ ID NO: 6747999 - DNA, 17 bp, Homo sapiens
tggtcctggacacctcc

SEQ ID NO: 6748000 - DNA, 19 bp, Homo sapiens
tggtcctggacacctccca

SEQ ID NO: 6748001 - DNA, 12 bp, Homo sapiens
tggtcctggcct

SEQ ID NO: 6748002 - DNA, 13 bp, Homo sapiens
tggtcctggctgc

SEQ ID NO: 6748003 - DNA, 21 bp, Homo sapiens
tggtcctgggagccactggga

SEQ ID NO: 6748004 - DNA, 14 bp, Homo sapiens
tggtcctggggctc

SEQ ID NO: 6748005 - DNA, 16 bp, Homo sapiens
tggtcctggtgctgcc

SEQ ID NO: 6748006 - DNA, 17 bp, Homo sapiens
tggtcctgtcaccctgg

SEQ ID NO: 6748007 - DNA, 12 bp, Homo sapiens
tggtcctgtctg

SEQ ID NO: 6748008 - DNA, 15 bp, Homo sapiens
tggtcctgtctgtcc

SEQ ID NO: 6748009 - DNA, 13 bp, Homo sapiens
tggtcctgtggat

SEQ ID NO: 6748010 - DNA, 18 bp, Homo sapiens
tggtcctgttttctaaaa

SEQ ID NO: 6748011 - DNA, 18 bp, Homo sapiens
tggtccttaccagagacg

SEQ ID NO: 6748012 - DNA, 12 bp, Homo sapiens
tggtccttattt

SEQ ID NO: 6748013 - DNA, 15 bp, Homo sapiens
tggtccttcactggc

SEQ ID NO: 6748014 - DNA, 18 bp, Homo sapiens
tggtccttcactggcgcc

SEQ ID NO: 6748015 - DNA, 19 bp, Homo sapiens
tggtccttctgaccccact

SEQ ID NO: 6748016 - DNA, 17 bp, Homo sapiens
tggtccttctttcctct

SEQ ID NO: 6748017 - DNA, 12 bp, Homo sapiens
tggtcctttggg

SEQ ID NO: 6748018 - DNA, 18 bp, Homo sapiens
tggtcgagtctttgtgtg

SEQ ID NO: 6748019 - DNA, 19 bp, Homo sapiens
tggtcgagtgacacacctc

SEQ ID NO: 6748020 - DNA, 15 bp, Homo sapiens
tggtcgcccaggaga

SEQ ID NO: 6748021 - DNA, 20 bp, Homo sapiens
tggtcgctcaggccagtaat

SEQ ID NO: 6748022 - DNA, 22 bp, Homo sapiens
tggtcggatctcacaggctgag

SEQ ID NO: 6748023 - DNA, 22 bp, Homo sapiens
tggtctaaaacagctatttccc

SEQ ID NO: 6748024 - DNA, 14 bp, Homo sapiens
tggtctaaagtgtt

SEQ ID NO: 6748025 - DNA, 15 bp, Homo sapiens
tggtctaatgtttaa

SEQ ID NO: 6748026 - DNA, 14 bp, Homo sapiens
tggtctaatgtttg

SEQ ID NO: 6748027 - DNA, 18 bp, Homo sapiens
tggtctacactgtgctga

SEQ ID NO: 6748028 - DNA, 24 bp, Homo sapiens
tggtctagaaatgcggtctggtct

SEQ ID NO: 6748029 - DNA, 16 bp, Homo sapiens
tggtctagaccagggc

SEQ ID NO: 6748030 - DNA, 17 bp, Homo sapiens
tggtctagaccagggct

SEQ ID NO: 6748031 - DNA, 20 bp, Homo sapiens
tggtctagaccagggctgct

SEQ ID NO: 6748032 - DNA, 21 bp, Homo sapiens
tggtctataaaataaacttct

SEQ ID NO: 6748033 - DNA, 19 bp, Homo sapiens
tggtctataccttaagaat

SEQ ID NO: 6748034 - DNA, 17 bp, Homo sapiens
tggtctatataaccaca

SEQ ID NO: 6748035 - DNA, 18 bp, Homo sapiens
tggtctcaaactcctgac

SEQ ID NO: 6748036 - DNA, 23 bp, Homo sapiens
tggtctcaaactcctgacctcag

SEQ ID NO: 6748037 - DNA, 14 bp, Homo sapiens
tggtctcaccctgg

SEQ ID NO: 6748038 - DNA, 16 bp, Homo sapiens
tggtctcagaggaggg

SEQ ID NO: 6748039 - DNA, 19 bp, Homo sapiens
tggtctcagcagcgaccac

SEQ ID NO: 6748040 - DNA, 20 bp, Homo sapiens
tggtctcaggcagcaccaca

SEQ ID NO: 6748041 - DNA, 20 bp, Homo sapiens
tggtctcatctcctttgcta

SEQ ID NO: 6748042 - DNA, 13 bp, Homo sapiens
tggtctcatgccc

SEQ ID NO: 6748043 - DNA, 15 bp, Homo sapiens
tggtctcatgccccg

SEQ ID NO: 6748044 - DNA, 16 bp, Homo sapiens
tggtctcatgccccgc

SEQ ID NO: 6748045 - DNA, 16 bp, Homo sapiens
tggtctcatttggggg

SEQ ID NO: 6748046 - DNA, 14 bp, Homo sapiens
tggtctccacctgt

SEQ ID NO: 6748047 - DNA, 17 bp, Homo sapiens
tggtctccacctgtgct

SEQ ID NO: 6748048 - DNA, 14 bp, Homo sapiens
tggtctccagctcc

SEQ ID NO: 6748049 - DNA, 21 bp, Homo sapiens
tggtctccatttttcccagga

SEQ ID NO: 6748050 - DNA, 17 bp, Homo sapiens
tggtctcctcagcctcc

SEQ ID NO: 6748051 - DNA, 23 bp, Homo sapiens
tggtctcctcagcctcctcatct

SEQ ID NO: 6748052 - DNA, 14 bp, Homo sapiens
tggtctcctctcag

SEQ ID NO: 6748053 - DNA, 17 bp, Homo sapiens
tggtctcctgcccccac

SEQ ID NO: 6748054 - DNA, 18 bp, Homo sapiens
tggtctcctgcccccaca

SEQ ID NO: 6748055 - DNA, 20 bp, Homo sapiens
tggtctcgaactcctgacct

SEQ ID NO: 6748056 - DNA, 20 bp, Homo sapiens
tggtctcgaactcctggcct

SEQ ID NO: 6748057 - DNA, 16 bp, Homo sapiens
tggtctcgatctcctg

SEQ ID NO: 6748058 - DNA, 17 bp, Homo sapiens
tggtctcgatctcctga

SEQ ID NO: 6748059 - DNA, 20 bp, Homo sapiens
tggtctcgatctcctgacct

SEQ ID NO: 6748060 - DNA, 22 bp, Homo sapiens
tggtctcgatgctgctggcctc

SEQ ID NO: 6748061 - DNA, 22 bp, Homo sapiens
tggtctcgtgttcgctggctga

SEQ ID NO: 6748062 - DNA, 14 bp, Homo sapiens
tggtctctaggctg

SEQ ID NO: 6748063 - DNA, 16 bp, Homo sapiens
tggtctctaggctggg

SEQ ID NO: 6748064 - DNA, 19 bp, Homo sapiens
tggtctctcgggcccccca

SEQ ID NO: 6748065 - DNA, 14 bp, Homo sapiens
tggtctctctccct

SEQ ID NO: 6748066 - DNA, 17 bp, Homo sapiens
tggtctctcttggaatt

SEQ ID NO: 6748067 - DNA, 10 bp, Homo sapiens
tggtctctgc

SEQ ID NO: 6748068 - DNA, 13 bp, Homo sapiens
tggtctctgctgg

SEQ ID NO: 6748069 - DNA, 14 bp, Homo sapiens
tggtctctgctggg

SEQ ID NO: 6748070 - DNA, 12 bp, Homo sapiens
tggtctcttcca

SEQ ID NO: 6748071 - DNA, 19 bp, Homo sapiens
tggtctcttcttggggccc

SEQ ID NO: 6748072 - DNA, 19 bp, Homo sapiens
tggtctgaatacaaacatt

SEQ ID NO: 6748073 - DNA, 21 bp, Homo sapiens
tggtctgaatattaaagctct

SEQ ID NO: 6748074 - DNA, 17 bp, Homo sapiens
tggtctgaatgttctga

SEQ ID NO: 6748075 - DNA, 18 bp, Homo sapiens
tggtctgaatgttctgac

SEQ ID NO: 6748076 - DNA, 19 bp, Homo sapiens
tggtctgaatgttctgaca

SEQ ID NO: 6748077 - DNA, 17 bp, Homo sapiens
tggtctgagctgtccca

SEQ ID NO: 6748078 - DNA, 22 bp, Homo sapiens
tggtctgaggggcaactgagtc

SEQ ID NO: 6748079 - DNA, 14 bp, Homo sapiens
tggtctgcaggcag

SEQ ID NO: 6748080 - DNA, 17 bp, Homo sapiens
tggtctgcatcagcttt

SEQ ID NO: 6748081 - DNA, 15 bp, Homo sapiens
tggtctgccaggccc

SEQ ID NO: 6748082 - DNA, 14 bp, Homo sapiens
tggtctgccctggg

SEQ ID NO: 6748083 - DNA, 16 bp, Homo sapiens
tggtctgccttctgct

SEQ ID NO: 6748084 - DNA, 18 bp, Homo sapiens
tggtctgccttctgctga

SEQ ID NO: 6748085 - DNA, 17 bp, Homo sapiens
tggtctgcgccttggga

SEQ ID NO: 6748086 - DNA, 23 bp, Homo sapiens
tggtctgctcaggaattgaagat

SEQ ID NO: 6748087 - DNA, 15 bp, Homo sapiens
tggtctgctgacctg

SEQ ID NO: 6748088 - DNA, 13 bp, Homo sapiens
tggtctggaaaca

SEQ ID NO: 6748089 - DNA, 17 bp, Homo sapiens
tggtctggaatggactg

SEQ ID NO: 6748090 - DNA, 14 bp, Homo sapiens
tggtctggagcccc

SEQ ID NO: 6748091 - DNA, 15 bp, Homo sapiens
tggtctggagcccct

SEQ ID NO: 6748092 - DNA, 16 bp, Homo sapiens
tggtctggagccccta

SEQ ID NO: 6748093 - DNA, 17 bp, Homo sapiens
tggtctggagcccctat

SEQ ID NO: 6748094 - DNA, 15 bp, Homo sapiens
tggtctggctttgga

SEQ ID NO: 6748095 - DNA, 19 bp, Homo sapiens
tggtctgggacttccttgc

SEQ ID NO: 6748096 - DNA, 20 bp, Homo sapiens
tggtctgggtttggcaggca

SEQ ID NO: 6748097 - DNA, 16 bp, Homo sapiens
tggtctggtaaatatg

SEQ ID NO: 6748098 - DNA, 15 bp, Homo sapiens
tggtctggtcaggca

SEQ ID NO: 6748099 - DNA, 23 bp, Homo sapiens
tggtctgtactccttggatttgc

SEQ ID NO: 6748100 - DNA, 12 bp, Homo sapiens
tggtctgtgtga

SEQ ID NO: 6748101 - DNA, 14 bp, Homo sapiens
tggtctgtgtgtga

SEQ ID NO: 6748102 - DNA, 13 bp, Homo sapiens
tggtctgtgttct

SEQ ID NO: 6748103 - DNA, 23 bp, Homo sapiens
tggtctgtgttctcaacacacag

SEQ ID NO: 6748104 - DNA, 21 bp, Homo sapiens
tggtctgtttccaggtcagaa

SEQ ID NO: 6748105 - DNA, 22 bp, Homo sapiens
tggtctgtttgtctgaacaaag

SEQ ID NO: 6748106 - DNA, 16 bp, Homo sapiens
tggtcttaactaatgt

SEQ ID NO: 6748107 - DNA, 20 bp, Homo sapiens
tggtcttaaggaacatctct

SEQ ID NO: 6748108 - DNA, 20 bp, Homo sapiens
tggtcttaatgttgaatgta

SEQ ID NO: 6748109 - DNA, 20 bp, Homo sapiens
tggtcttactttgtgcaaaa

SEQ ID NO: 6748110 - DNA, 18 bp, Homo sapiens
tggtcttactttgttaat

SEQ ID NO: 6748111 - DNA, 15 bp, Homo sapiens
tggtcttagctttac

SEQ ID NO: 6748112 - DNA, 16 bp, Homo sapiens
tggtcttagctttaca

SEQ ID NO: 6748113 - DNA, 18 bp, Homo sapiens
tggtcttagctttacatt

SEQ ID NO: 6748114 - DNA, 14 bp, Homo sapiens
tggtcttaggtctt

SEQ ID NO: 6748115 - DNA, 24 bp, Homo sapiens
tggtcttaggtcttcctgtggctc

SEQ ID NO: 6748116 - DNA, 17 bp, Homo sapiens
tggtcttatagaaagca

SEQ ID NO: 6748117 - DNA, 22 bp, Homo sapiens
tggtcttatagtgtttggacag

SEQ ID NO: 6748118 - DNA, 16 bp, Homo sapiens
tggtcttcagcctccc

SEQ ID NO: 6748119 - DNA, 18 bp, Homo sapiens
tggtcttcagcctccctc

SEQ ID NO: 6748120 - DNA, 15 bp, Homo sapiens
tggtcttcagcctct

SEQ ID NO: 6748121 - DNA, 14 bp, Homo sapiens
tggtcttcccaggc

SEQ ID NO: 6748122 - DNA, 14 bp, Homo sapiens
tggtcttctcagtt

SEQ ID NO: 6748123 - DNA, 21 bp, Homo sapiens
tggtcttctgttgacattcgg

SEQ ID NO: 6748124 - DNA, 17 bp, Homo sapiens
tggtcttgaactcctgg

SEQ ID NO: 6748125 - DNA, 19 bp, Homo sapiens
tggtcttgaagtcctggct

SEQ ID NO: 6748126 - DNA, 17 bp, Homo sapiens
tggtcttgagatgtctt

SEQ ID NO: 6748127 - DNA, 15 bp, Homo sapiens
tggtcttggagagga

SEQ ID NO: 6748128 - DNA, 20 bp, Homo sapiens
tggtcttggcagcacctgtc

SEQ ID NO: 6748129 - DNA, 20 bp, Homo sapiens
tggtcttgtttccaggagca

SEQ ID NO: 6748130 - DNA, 15 bp, Homo sapiens
tggtctttcattgct

SEQ ID NO: 6748131 - DNA, 14 bp, Homo sapiens
tggtctttcctctg

SEQ ID NO: 6748132 - DNA, 17 bp, Homo sapiens
tggtctttctggagagg

SEQ ID NO: 6748133 - DNA, 14 bp, Homo sapiens
tggtctttgaataa

SEQ ID NO: 6748134 - DNA, 17 bp, Homo sapiens
tggtctttgaataaagt

SEQ ID NO: 6748135 - DNA, 21 bp, Homo sapiens
tggtctttgaataaagtctga

SEQ ID NO: 6748136 - DNA, 16 bp, Homo sapiens
tggtctttgctccaga

SEQ ID NO: 6748137 - DNA, 17 bp, Homo sapiens
tggtctttgctccagat

SEQ ID NO: 6748138 - DNA, 16 bp, Homo sapiens
tggtctttgggcaggg

SEQ ID NO: 6748139 - DNA, 13 bp, Homo sapiens
tggtctttgtaag

SEQ ID NO: 6748140 - DNA, 14 bp, Homo sapiens
tggtctttgtttga

SEQ ID NO: 6748141 - DNA, 16 bp, Homo sapiens
tggtcttttataattc

SEQ ID NO: 6748142 - DNA, 17 bp, Homo sapiens
tggtcttttcctcgctt

SEQ ID NO: 6748143 - DNA, 14 bp, Homo sapiens
tggtcttttggtta

SEQ ID NO: 6748144 - DNA, 22 bp, Homo sapiens
tggtgaaaagcaggttgataaa

SEQ ID NO: 6748145 - DNA, 23 bp, Homo sapiens
tggtgaaaagcaggttgataaat

SEQ ID NO: 6748146 - DNA, 14 bp, Homo sapiens
tggtgaaataataa

SEQ ID NO: 6748147 - DNA, 21 bp, Homo sapiens
tggtgaaatcccatctctaca

SEQ ID NO: 6748148 - DNA, 22 bp, Homo sapiens
tggtgaaatcccatctctacaa

SEQ ID NO: 6748149 - DNA, 15 bp, Homo sapiens
tggtgaaatctgctc

SEQ ID NO: 6748150 - DNA, 16 bp, Homo sapiens
tggtgaaatctgctct

SEQ ID NO: 6748151 - DNA, 23 bp, Homo sapiens
tggtgaaatctgctctgtacatc

SEQ ID NO: 6748152 - DNA, 13 bp, Homo sapiens
tggtgaaattatg

SEQ ID NO: 6748153 - DNA, 18 bp, Homo sapiens
tggtgaaatttattagtt

SEQ ID NO: 6748154 - DNA, 19 bp, Homo sapiens
tggtgaacagaacaaaagg

SEQ ID NO: 6748155 - DNA, 11 bp, Homo sapiens
tggtgaacagt

SEQ ID NO: 6748156 - DNA, 18 bp, Homo sapiens
tggtgaactgaagcagag

SEQ ID NO: 6748157 - DNA, 22 bp, Homo sapiens
tggtgaaggtttttgtttcttt

SEQ ID NO: 6748158 - DNA, 20 bp, Homo sapiens
tggtgaagtgaaaaacagaa

SEQ ID NO: 6748159 - DNA, 15 bp, Homo sapiens
tggtgaagtgtgact

SEQ ID NO: 6748160 - DNA, 15 bp, Homo sapiens
tggtgaagtgtggct

SEQ ID NO: 6748161 - DNA, 18 bp, Homo sapiens
tggtgaagtgtggctggt

SEQ ID NO: 6748162 - DNA, 20 bp, Homo sapiens
tggtgaagtgtggctggtgt

SEQ ID NO: 6748163 - DNA, 15 bp, Homo sapiens
tggtgaatcacctgg

SEQ ID NO: 6748164 - DNA, 23 bp, Homo sapiens
tggtgaatcacctggctgagcag

SEQ ID NO: 6748165 - DNA, 16 bp, Homo sapiens
tggtgaatttcacaag

SEQ ID NO: 6748166 - DNA, 16 bp, Homo sapiens
tggtgacaccagcctt

SEQ ID NO: 6748167 - DNA, 14 bp, Homo sapiens
tggtgacacctccc

SEQ ID NO: 6748168 - DNA, 17 bp, Homo sapiens
tggtgacacctccccct

SEQ ID NO: 6748169 - DNA, 21 bp, Homo sapiens
tggtgacagccttgggccttt

SEQ ID NO: 6748170 - DNA, 13 bp, Homo sapiens
tggtgacaggcag

SEQ ID NO: 6748171 - DNA, 19 bp, Homo sapiens
tggtgacaggcagacacat

SEQ ID NO: 6748172 - DNA, 17 bp, Homo sapiens
tggtgacatgtgcctgt

SEQ ID NO: 6748173 - DNA, 15 bp, Homo sapiens
tggtgacatttccca

SEQ ID NO: 6748174 - DNA, 19 bp, Homo sapiens
tggtgacatttcccaagtc

SEQ ID NO: 6748175 - DNA, 17 bp, Homo sapiens
tggtgaccagtttctta

SEQ ID NO: 6748176 - DNA, 22 bp, Homo sapiens
tggtgaccagtttcttaaactg

SEQ ID NO: 6748177 - DNA, 15 bp, Homo sapiens
tggttctacaaattt

SEQ ID NO: 6748178 - DNA, 15 bp, Homo sapiens
tggttctaggctgct

SEQ ID NO: 6748179 - DNA, 15 bp, Homo sapiens
tggttctatgctaaa

SEQ ID NO: 6748180 - DNA, 23 bp, Homo sapiens
tggttctatgctaaactgtgaaa

SEQ ID NO: 6748181 - DNA, 12 bp, Homo sapiens
tggttctatttt

SEQ ID NO: 6748182 - DNA, 12 bp, Homo sapiens
tggttctcaatg

SEQ ID NO: 6748183 - DNA, 16 bp, Homo sapiens
tggttctcaatgaaaa

SEQ ID NO: 6748184 - DNA, 16 bp, Homo sapiens
tggttctcaattccaa

SEQ ID NO: 6748185 - DNA, 20 bp, Homo sapiens
tggttctcaatttatttggg

SEQ ID NO: 6748186 - DNA, 22 bp, Homo sapiens
tggttctcagaaccatttcacc

SEQ ID NO: 6748187 - DNA, 22 bp, Homo sapiens
tggttctcatttggtctgccag

SEQ ID NO: 6748188 - DNA, 21 bp, Homo sapiens
tggttctccttcctcagcctc

SEQ ID NO: 6748189 - DNA, 15 bp, Homo sapiens
tggttctctccagga

SEQ ID NO: 6748190 - DNA, 15 bp, Homo sapiens
tggttctctgccttt

SEQ ID NO: 6748191 - DNA, 22 bp, Homo sapiens
tggttctgagatggctcccagg

SEQ ID NO: 6748192 - DNA, 16 bp, Homo sapiens
tggttctgaggccaga

SEQ ID NO: 6748193 - DNA, 13 bp, Homo sapiens
tggttctgatgcc

SEQ ID NO: 6748194 - DNA, 14 bp, Homo sapiens
tggttctgcctcct

SEQ ID NO: 6748195 - DNA, 15 bp, Homo sapiens
tggttctgcctcctg

SEQ ID NO: 6748196 - DNA, 12 bp, Homo sapiens
tggttctggggc

SEQ ID NO: 6748197 - DNA, 21 bp, Homo sapiens
tggttctgtctagactggcct

SEQ ID NO: 6748198 - DNA, 13 bp, Homo sapiens
tggttctgtgaac

SEQ ID NO: 6748199 - DNA, 14 bp, Homo sapiens
tggttcttaaatgt

SEQ ID NO: 6748200 - DNA, 14 bp, Homo sapiens
tggttcttcccctc

SEQ ID NO: 6748201 - DNA, 22 bp, Homo sapiens
tggttcttcctgttctgtgact

SEQ ID NO: 6748202 - DNA, 16 bp, Homo sapiens
tggttcttcctttccc

SEQ ID NO: 6748203 - DNA, 19 bp, Homo sapiens
tggttcttctcaaaagaac

SEQ ID NO: 6748204 - DNA, 14 bp, Homo sapiens
tggttcttgaaaat

SEQ ID NO: 6748205 - DNA, 15 bp, Homo sapiens
tggttcttgaacagc

SEQ ID NO: 6748206 - DNA, 14 bp, Homo sapiens
tggttcttgccttc

SEQ ID NO: 6748207 - DNA, 19 bp, Homo sapiens
tggttcttgtgttggctgt

SEQ ID NO: 6748208 - DNA, 18 bp, Homo sapiens
tggttcttttaaaattaa

SEQ ID NO: 6748209 - DNA, 18 bp, Homo sapiens
tggttctttttattttaa

SEQ ID NO: 6748210 - DNA, 20 bp, Homo sapiens
tggttgaaagttagagattt

SEQ ID NO: 6748211 - DNA, 20 bp, Homo sapiens
tggttgaactatgctgaaga

SEQ ID NO: 6748212 - DNA, 12 bp, Homo sapiens
tggttgaagaag

SEQ ID NO: 6748213 - DNA, 19 bp, Homo sapiens
tggttgaatgaataaaaca

SEQ ID NO: 6748214 - DNA, 21 bp, Homo sapiens
tggttgaatgaataaaacaat

SEQ ID NO: 6748215 - DNA, 13 bp, Homo sapiens
tggttgaattttt

SEQ ID NO: 6748216 - DNA, 15 bp, Homo sapiens
tggttgactgggttt

SEQ ID NO: 6748217 - DNA, 15 bp, Homo sapiens
tggttgaggtggaag

SEQ ID NO: 6748218 - DNA, 16 bp, Homo sapiens
tggttgagtgggggga

SEQ ID NO: 6748219 - DNA, 22 bp, Homo sapiens
tggttgagtgtgtggtctctgc

SEQ ID NO: 6748220 - DNA, 12 bp, Homo sapiens
tggttgatggaa

SEQ ID NO: 6748221 - DNA, 21 bp, Homo sapiens
tggttgatggaaaataaacat

SEQ ID NO: 6748222 - DNA, 15 bp, Homo sapiens
tggttgatgggttct

SEQ ID NO: 6748223 - DNA, 17 bp, Homo sapiens
tggttgattcccagcat

SEQ ID NO: 6748224 - DNA, 15 bp, Homo sapiens
tggttgattgtttaa

SEQ ID NO: 6748225 - DNA, 16 bp, Homo sapiens
tggttgattgtttaag

SEQ ID NO: 6748226 - DNA, 20 bp, Homo sapiens
tggttgcaaagtgttgtctt

SEQ ID NO: 6748227 - DNA, 14 bp, Homo sapiens
tggttgcaattgtt

SEQ ID NO: 6748228 - DNA, 12 bp, Homo sapiens
tggttgcagcct

SEQ ID NO: 6748229 - DNA, 18 bp, Homo sapiens
tggttgcagcctgaccaa

SEQ ID NO: 6748230 - DNA, 13 bp, Homo sapiens
tggttgcatccta

SEQ ID NO: 6748231 - DNA, 12 bp, Homo sapiens
tggttgcctccc

SEQ ID NO: 6748232 - DNA, 20 bp, Homo sapiens
tggttgcctctcttgcccct

SEQ ID NO: 6748233 - DNA, 21 bp, Homo sapiens
tggttgcctctcttgcccctt

SEQ ID NO: 6748234 - DNA, 21 bp, Homo sapiens
tggttgctgggcctcattcta

SEQ ID NO: 6748235 - DNA, 18 bp, Homo sapiens
tggttgcttaactggctg

SEQ ID NO: 6748236 - DNA, 12 bp, Homo sapiens
tggttgcttcag

SEQ ID NO: 6748237 - DNA, 22 bp, Homo sapiens
tggttgctttctattatcatgg

SEQ ID NO: 6748238 - DNA, 21 bp, Homo sapiens
tggttggacctattgccagga

SEQ ID NO: 6748239 - DNA, 13 bp, Homo sapiens
tggttggagaagg

SEQ ID NO: 6748240 - DNA, 15 bp, Homo sapiens
tggttggagagccct

SEQ ID NO: 6748241 - DNA, 19 bp, Homo sapiens
tggttggagagccctggat

SEQ ID NO: 6748242 - DNA, 17 bp, Homo sapiens
tggttggcatttgctgg

SEQ ID NO: 6748243 - DNA, 19 bp, Homo sapiens
tggttgggaccaggccaat

SEQ ID NO: 6748244 - DNA, 15 bp, Homo sapiens
tggttggggtggggc

SEQ ID NO: 6748245 - DNA, 21 bp, Homo sapiens
tggttgggtcagatttatttg

SEQ ID NO: 6748246 - DNA, 21 bp, Homo sapiens
tggttggtcacagaatgactg

SEQ ID NO: 6748247 - DNA, 18 bp, Homo sapiens
tggttggtgtgaagaaag

SEQ ID NO: 6748248 - DNA, 21 bp, Homo sapiens
tggttgtaccctctccaggca

SEQ ID NO: 6748249 - DNA, 20 bp, Homo sapiens
tggttgtatatttttatatt

SEQ ID NO: 6748250 - DNA, 16 bp, Homo sapiens
tggttgtattagatgt

SEQ ID NO: 6748251 - DNA, 15 bp, Homo sapiens
tggttgtatttctat

SEQ ID NO: 6748252 - DNA, 12 bp, Homo sapiens
tggttgtcagaa

SEQ ID NO: 6748253 - DNA, 14 bp, Homo sapiens
tggttgtcagaatg

SEQ ID NO: 6748254 - DNA, 16 bp, Homo sapiens
tggttgtctagtcatt

SEQ ID NO: 6748255 - DNA, 23 bp, Homo sapiens
tggttgtctctcttcggtggcct

SEQ ID NO: 6748256 - DNA, 15 bp, Homo sapiens
tggttgtgaaatgta

SEQ ID NO: 6748257 - DNA, 16 bp, Homo sapiens
tggttgtgaaatgtaa

SEQ ID NO: 6748258 - DNA, 22 bp, Homo sapiens
tggttgtgaaccaactgcctta

SEQ ID NO: 6748259 - DNA, 11 bp, Homo sapiens
tggttgtgatt

SEQ ID NO: 6748260 - DNA, 22 bp, Homo sapiens
tggttgtgattttttgttcttg

SEQ ID NO: 6748261 - DNA, 17 bp, Homo sapiens
tggttgtgccttccctt

SEQ ID NO: 6748262 - DNA, 16 bp, Homo sapiens
tggttgtgtgtgttct

SEQ ID NO: 6748263 - DNA, 18 bp, Homo sapiens
tggttgtgtgtgttctgt

SEQ ID NO: 6748264 - DNA, 21 bp, Homo sapiens
tggttgttgccaggttgcagc

SEQ ID NO: 6748265 - DNA, 12 bp, Homo sapiens
tggttgtttctc

SEQ ID NO: 6748266 - DNA, 18 bp, Homo sapiens
tggttgtttctctgagct

SEQ ID NO: 6748267 - DNA, 17 bp, Homo sapiens
tggttgtttgctgtttt

SEQ ID NO: 6748268 - DNA, 22 bp, Homo sapiens
tggttgtttttgttctttgtgt

SEQ ID NO: 6748269 - DNA, 20 bp, Homo sapiens
tggttgttttttcattgtgt

SEQ ID NO: 6748270 - DNA, 20 bp, Homo sapiens
tggtttaaaaatacatgttc

SEQ ID NO: 6748271 - DNA, 16 bp, Homo sapiens
tggtttaaagaaagtg

SEQ ID NO: 6748272 - DNA, 19 bp, Homo sapiens
tggtttaaatacataaata

SEQ ID NO: 6748273 - DNA, 18 bp, Homo sapiens
tggtttaaatatgaatga

SEQ ID NO: 6748274 - DNA, 19 bp, Homo sapiens
tggtttacaggccctgctc

SEQ ID NO: 6748275 - DNA, 14 bp, Homo sapiens
tggtttacatttaa

SEQ ID NO: 6748276 - DNA, 15 bp, Homo sapiens
tggtttacatttaaa

SEQ ID NO: 6748277 - DNA, 20 bp, Homo sapiens
tggtttacatttaaagcatt

SEQ ID NO: 6748278 - DNA, 21 bp, Homo sapiens
tggtttacgcctataatccca

SEQ ID NO: 6748279 - DNA, 16 bp, Homo sapiens
tggtttactgctgtca

SEQ ID NO: 6748280 - DNA, 16 bp, Homo sapiens
tggtttactttcaaat

SEQ ID NO: 6748281 - DNA, 19 bp, Homo sapiens
tggtttagcacaatttata

SEQ ID NO: 6748282 - DNA, 21 bp, Homo sapiens
tggtttaggccttgccagttt

SEQ ID NO: 6748283 - DNA, 23 bp, Homo sapiens
tggtttaggccttgccagttttc

SEQ ID NO: 6748284 - DNA, 13 bp, Homo sapiens
tggtttagtgtaa

SEQ ID NO: 6748285 - DNA, 19 bp, Homo sapiens
tggtttagtgttctgtatt

SEQ ID NO: 6748286 - DNA, 15 bp, Homo sapiens
tggtttatactgtat

SEQ ID NO: 6748287 - DNA, 21 bp, Homo sapiens
tggtttatagagggccaagac

SEQ ID NO: 6748288 - DNA, 21 bp, Homo sapiens
tggtttatagccctgtgaagt

SEQ ID NO: 6748289 - DNA, 17 bp, Homo sapiens
tggtttatatatttaaa

SEQ ID NO: 6748290 - DNA, 12 bp, Homo sapiens
tggtttatcatc

SEQ ID NO: 6748291 - DNA, 18 bp, Homo sapiens
tggtttatgcggtgctgt

SEQ ID NO: 6748292 - DNA, 11 bp, Homo sapiens
tggtttatgtc

SEQ ID NO: 6748293 - DNA, 19 bp, Homo sapiens
tggtttatgtcttgttctt

SEQ ID NO: 6748294 - DNA, 16 bp, Homo sapiens
tggtttatttgttgtt

SEQ ID NO: 6748295 - DNA, 16 bp, Homo sapiens
tggtttattttgtatt

SEQ ID NO: 6748296 - DNA, 22 bp, Homo sapiens
tggtttattttgtattgtggta

SEQ ID NO: 6748297 - DNA, 17 bp, Homo sapiens
tggtttcaaactcctga

SEQ ID NO: 6748298 - DNA, 22 bp, Homo sapiens
tggtttcaaagtaaaggcctcc

SEQ ID NO: 6748299 - DNA, 15 bp, Homo sapiens
tggtttcaagaatat

SEQ ID NO: 6748300 - DNA, 21 bp, Homo sapiens
tggtttcaagttattcaaatt

SEQ ID NO: 6748301 - DNA, 20 bp, Homo sapiens
tggtttcaccatccttagac

SEQ ID NO: 6748302 - DNA, 18 bp, Homo sapiens
tggtttcaccttccctcg

SEQ ID NO: 6748303 - DNA, 18 bp, Homo sapiens
tggtttcactggcccaag

SEQ ID NO: 6748304 - DNA, 22 bp, Homo sapiens
tggtttcagcaatatttaagga

SEQ ID NO: 6748305 - DNA, 11 bp, Homo sapiens
tggtttcagtg

SEQ ID NO: 6748306 - DNA, 12 bp, Homo sapiens
tggtttcagttc

SEQ ID NO: 6748307 - DNA, 17 bp, Homo sapiens
tggtttcataggagaca

SEQ ID NO: 6748308 - DNA, 19 bp, Homo sapiens
tggtttcattgccttccta

SEQ ID NO: 6748309 - DNA, 15 bp, Homo sapiens
tggtttccaaagaat

SEQ ID NO: 6748310 - DNA, 23 bp, Homo sapiens
tggtttccaaggagctgagaata

SEQ ID NO: 6748311 - DNA, 21 bp, Homo sapiens
tggtttccatcaaagccctcc

SEQ ID NO: 6748312 - DNA, 16 bp, Homo sapiens
tggtttcccctttctt

SEQ ID NO: 6748313 - DNA, 23 bp, Homo sapiens
tggtttcccctttctttcctttt

SEQ ID NO: 6748314 - DNA, 22 bp, Homo sapiens
tggtttcccggtgacacatcca

SEQ ID NO: 6748315 - DNA, 15 bp, Homo sapiens
tggtttccctgcccc

SEQ ID NO: 6748316 - DNA, 23 bp, Homo sapiens
tggtttcctcattttactaaaat

SEQ ID NO: 6748317 - DNA, 13 bp, Homo sapiens
tggtttcctctgg

SEQ ID NO: 6748318 - DNA, 14 bp, Homo sapiens
tggtttcctgccca

SEQ ID NO: 6748319 - DNA, 20 bp, Homo sapiens
tggtttcctgccctgggagg

SEQ ID NO: 6748320 - DNA, 16 bp, Homo sapiens
tggtttcggaaaaaaa

SEQ ID NO: 6748321 - DNA, 23 bp, Homo sapiens
tggtttctacttcccctgggatg

SEQ ID NO: 6748322 - DNA, 18 bp, Homo sapiens
tggtttctagatcactgt

SEQ ID NO: 6748323 - DNA, 15 bp, Homo sapiens
tggtttctagcatga

SEQ ID NO: 6748324 - DNA, 17 bp, Homo sapiens
tggtttctcattaaact

SEQ ID NO: 6748325 - DNA, 13 bp, Homo sapiens
tggtttctcctgg

SEQ ID NO: 6748326 - DNA, 15 bp, Homo sapiens
tggtttctcctggta

SEQ ID NO: 6748327 - DNA, 14 bp, Homo sapiens
tggtttctgaaaat

SEQ ID NO: 6748328 - DNA, 13 bp, Homo sapiens
tggtttctgccct

SEQ ID NO: 6748329 - DNA, 15 bp, Homo sapiens
tggtttctgggggct

SEQ ID NO: 6748330 - DNA, 13 bp, Homo sapiens
tggtttctgtccc

SEQ ID NO: 6748331 - DNA, 15 bp, Homo sapiens
tggtttctgtgtgtc

SEQ ID NO: 6748332 - DNA, 23 bp, Homo sapiens
tggtttcttcaacaggagaattt

SEQ ID NO: 6748333 - DNA, 12 bp, Homo sapiens
tggtttcttcat

SEQ ID NO: 6748334 - DNA, 15 bp, Homo sapiens
tggtttctttttgaa

SEQ ID NO: 6748335 - DNA, 14 bp, Homo sapiens
tggtttgacaattt

SEQ ID NO: 6748336 - DNA, 17 bp, Homo sapiens
tggtttgacaattttgt

SEQ ID NO: 6748337 - DNA, 21 bp, Homo sapiens
tggtttgactcattaatttct

SEQ ID NO: 6748338 - DNA, 20 bp, Homo sapiens
tggtttgacttgtttgtgca

SEQ ID NO: 6748339 - DNA, 16 bp, Homo sapiens
tggtttgattgtttac

SEQ ID NO: 6748340 - DNA, 18 bp, Homo sapiens
tggtttgattgtttacag

SEQ ID NO: 6748341 - DNA, 22 bp, Homo sapiens
tggtttgcaaagaccacctcca

SEQ ID NO: 6748342 - DNA, 23 bp, Homo sapiens
tggtttgcaacctctttgctcaa

SEQ ID NO: 6748343 - DNA, 14 bp, Homo sapiens
tggtttgcaagaat

SEQ ID NO: 6748344 - DNA, 15 bp, Homo sapiens
tggtttgcaaggaag

SEQ ID NO: 6748345 - DNA, 17 bp, Homo sapiens
tggtttgcaaggaagcc

SEQ ID NO: 6748346 - DNA, 19 bp, Homo sapiens
tggtttgcagatgacaaaa

SEQ ID NO: 6748347 - DNA, 22 bp, Homo sapiens
tggtttgccatgtcgcttttgg

SEQ ID NO: 6748348 - DNA, 19 bp, Homo sapiens
tggtttgcctgaggctgta

SEQ ID NO: 6748349 - DNA, 22 bp, Homo sapiens
tggtttgcctgcttaaaaggta

SEQ ID NO: 6748350 - DNA, 20 bp, Homo sapiens
tggtttgccttttatgtaaa

SEQ ID NO: 6748351 - DNA, 15 bp, Homo sapiens
tggtttggaaaataa

SEQ ID NO: 6748352 - DNA, 23 bp, Homo sapiens
tggtttggcaacacctccttgct

SEQ ID NO: 6748353 - DNA, 18 bp, Homo sapiens
tggtttggggagacaggt

SEQ ID NO: 6748354 - DNA, 22 bp, Homo sapiens
tggtttggggcgaggcagagga

SEQ ID NO: 6748355 - DNA, 15 bp, Homo sapiens
tgtaagcttgtgttt

SEQ ID NO: 6748356 - DNA, 21 bp, Homo sapiens
tgtaaggaaaaataaaagtgc

SEQ ID NO: 6748357 - DNA, 13 bp, Homo sapiens
tgtaaggaatgat

SEQ ID NO: 6748358 - DNA, 15 bp, Homo sapiens
tgtaaggaatgcttg

SEQ ID NO: 6748359 - DNA, 13 bp, Homo sapiens
tgtaaggaattga

SEQ ID NO: 6748360 - DNA, 20 bp, Homo sapiens
tgtaaggactcagtgttgac

SEQ ID NO: 6748361 - DNA, 18 bp, Homo sapiens
tgtaaggactgtaaacat

SEQ ID NO: 6748362 - DNA, 22 bp, Homo sapiens
tgtaaggagtttttttgtcaga

SEQ ID NO: 6748363 - DNA, 18 bp, Homo sapiens
tgtaaggatgagcagcag

SEQ ID NO: 6748364 - DNA, 15 bp, Homo sapiens
tgtaaggcaatcatg

SEQ ID NO: 6748365 - DNA, 22 bp, Homo sapiens
tgtaaggcactgtcaggaatgg

SEQ ID NO: 6748366 - DNA, 22 bp, Homo sapiens
tgtaaggccaagtacactgaga

SEQ ID NO: 6748367 - DNA, 12 bp, Homo sapiens
tgtaaggcctta

SEQ ID NO: 6748368 - DNA, 13 bp, Homo sapiens
tgtaaggccttag

SEQ ID NO: 6748369 - DNA, 14 bp, Homo sapiens
tgtaaggccttagc

SEQ ID NO: 6748370 - DNA, 12 bp, Homo sapiens
tgtaagggcagt

SEQ ID NO: 6748371 - DNA, 16 bp, Homo sapiens
tgtaagggctttaaat

SEQ ID NO: 6748372 - DNA, 16 bp, Homo sapiens
tgtaagggtctgttgt

SEQ ID NO: 6748373 - DNA, 18 bp, Homo sapiens
tgtaagggtctgttgtaa

SEQ ID NO: 6748374 - DNA, 22 bp, Homo sapiens
tgtaaggtcttcttgtgtcctg

SEQ ID NO: 6748375 - DNA, 15 bp, Homo sapiens
tgtaaggtctttgta

SEQ ID NO: 6748376 - DNA, 16 bp, Homo sapiens
tgtaaggttgtgcagg

SEQ ID NO: 6748377 - DNA, 16 bp, Homo sapiens
tgtaaggtttcaatgc

SEQ ID NO: 6748378 - DNA, 13 bp, Homo sapiens
tgtaaggtttttt

SEQ ID NO: 6748379 - DNA, 22 bp, Homo sapiens
tgtaaggttttttttgtacgca

SEQ ID NO: 6748380 - DNA, 15 bp, Homo sapiens
tgtaagtaaacggtc

SEQ ID NO: 6748381 - DNA, 17 bp, Homo sapiens
tgtaagtaaactgccct

SEQ ID NO: 6748382 - DNA, 18 bp, Homo sapiens
tgtaagtaaactgccctg

SEQ ID NO: 6748383 - DNA, 16 bp, Homo sapiens
tgtaagtaacaatatg

SEQ ID NO: 6748384 - DNA, 19 bp, Homo sapiens
tgtaagtaataatttgtaa

SEQ ID NO: 6748385 - DNA, 23 bp, Homo sapiens
tgtaagtaattgcatttctgctc

SEQ ID NO: 6748386 - DNA, 18 bp, Homo sapiens
tgtaagtacccctgataa

SEQ ID NO: 6748387 - DNA, 20 bp, Homo sapiens
tgtaagtactctaatataca

SEQ ID NO: 6748388 - DNA, 21 bp, Homo sapiens
tgtaagtactctaatatacag

SEQ ID NO: 6748389 - DNA, 19 bp, Homo sapiens
tgtaagtagcaaacagggc

SEQ ID NO: 6748390 - DNA, 21 bp, Homo sapiens
tgtaagtagcaaacagggctt

SEQ ID NO: 6748391 - DNA, 12 bp, Homo sapiens
tgtaagtataag

SEQ ID NO: 6748392 - DNA, 18 bp, Homo sapiens
tgtaagtataagaaattt

SEQ ID NO: 6748393 - DNA, 20 bp, Homo sapiens
tgtaagtataagaaatttta

SEQ ID NO: 6748394 - DNA, 18 bp, Homo sapiens
tgtaagtatttaagtgat

SEQ ID NO: 6748395 - DNA, 16 bp, Homo sapiens
tgtaagtcagtgttga

SEQ ID NO: 6748396 - DNA, 19 bp, Homo sapiens
tgtaagtcagtgttgagat

SEQ ID NO: 6748397 - DNA, 23 bp, Homo sapiens
tgtaagtcatctacttaataaat

SEQ ID NO: 6748398 - DNA, 20 bp, Homo sapiens
tgtaagtctgatttttaaga

SEQ ID NO: 6748399 - DNA, 15 bp, Homo sapiens
tgtaagtgaaattaa

SEQ ID NO: 6748400 - DNA, 16 bp, Homo sapiens
tgtaagtgaaattaag

SEQ ID NO: 6748401 - DNA, 17 bp, Homo sapiens
tgtaagtgagtgtgctg

SEQ ID NO: 6748402 - DNA, 22 bp, Homo sapiens
tgtaagtgctacataaattggc

SEQ ID NO: 6748403 - DNA, 15 bp, Homo sapiens
tgtaagtgtaaaaaa

SEQ ID NO: 6748404 - DNA, 12 bp, Homo sapiens
tgtaagtgtgag

SEQ ID NO: 6748405 - DNA, 22 bp, Homo sapiens
tgtaagttatttcttgtttgtt

SEQ ID NO: 6748406 - DNA, 14 bp, Homo sapiens
tgtaagttcacaac

SEQ ID NO: 6748407 - DNA, 18 bp, Homo sapiens
tgtaagttgggcttgcta

SEQ ID NO: 6748408 - DNA, 13 bp, Homo sapiens
tgtaagttgtaca

SEQ ID NO: 6748409 - DNA, 14 bp, Homo sapiens
tgtaagttgtacaa

SEQ ID NO: 6748410 - DNA, 21 bp, Homo sapiens
tgtaagttgtacaaatgtatt

SEQ ID NO: 6748411 - DNA, 20 bp, Homo sapiens
tgtaagttgtgtgcaacaaa

SEQ ID NO: 6748412 - DNA, 12 bp, Homo sapiens
tgtaagtttaat

SEQ ID NO: 6748413 - DNA, 17 bp, Homo sapiens
tgtaagtttataatgca

SEQ ID NO: 6748414 - DNA, 23 bp, Homo sapiens
tgtaagtttatggccttgaagtg

SEQ ID NO: 6748415 - DNA, 20 bp, Homo sapiens
tgtaagtttatgtctaaaga

SEQ ID NO: 6748416 - DNA, 15 bp, Homo sapiens
tgtaagtttattttt

SEQ ID NO: 6748417 - DNA, 18 bp, Homo sapiens
tgtaagtttcaggtgaca

SEQ ID NO: 6748418 - DNA, 16 bp, Homo sapiens
tgtaagtttctaagaa

SEQ ID NO: 6748419 - DNA, 20 bp, Homo sapiens
tgtaataaaaagtatatgtt

SEQ ID NO: 6748420 - DNA, 22 bp, Homo sapiens
tgtaataaaactatttgtataa

SEQ ID NO: 6748421 - DNA, 13 bp, Homo sapiens
tgtaataaaaggt

SEQ ID NO: 6748422 - DNA, 11 bp, Homo sapiens
tgtaataaact

SEQ ID NO: 6748423 - DNA, 15 bp, Homo sapiens
tgtaataaactctct

SEQ ID NO: 6748424 - DNA, 17 bp, Homo sapiens
tgtaataaactctctag

SEQ ID NO: 6748425 - DNA, 13 bp, Homo sapiens
tgtaataaacttt

SEQ ID NO: 6748426 - DNA, 15 bp, Homo sapiens
tgtaataaagtatat

SEQ ID NO: 6748427 - DNA, 19 bp, Homo sapiens
tgtaataaagtatataatt

SEQ ID NO: 6748428 - DNA, 12 bp, Homo sapiens
tgtaataaagtg

SEQ ID NO: 6748429 - DNA, 14 bp, Homo sapiens
tgtaataaagtgaa

SEQ ID NO: 6748430 - DNA, 20 bp, Homo sapiens
tgtaataaagtgaactttgt

SEQ ID NO: 6748431 - DNA, 17 bp, Homo sapiens
tgtaataaagtgttttc

SEQ ID NO: 6748432 - DNA, 20 bp, Homo sapiens
tgtaataaagtgttttcaga

SEQ ID NO: 6748433 - DNA, 13 bp, Homo sapiens
tgtaataaatact

SEQ ID NO: 6748434 - DNA, 15 bp, Homo sapiens
tgtaataaatactgc

SEQ ID NO: 6748435 - DNA, 16 bp, Homo sapiens
tgtaataaattcaaaa

SEQ ID NO: 6748436 - DNA, 13 bp, Homo sapiens
tgtaataacattt

SEQ ID NO: 6748437 - DNA, 15 bp, Homo sapiens
tgtaataacatttaa

SEQ ID NO: 6748438 - DNA, 17 bp, Homo sapiens
tgtaataacatttaatt

SEQ ID NO: 6748439 - DNA, 22 bp, Homo sapiens
tgtaataactgtgaagtttaca

SEQ ID NO: 6748440 - DNA, 11 bp, Homo sapiens
tgtaataagac

SEQ ID NO: 6748441 - DNA, 19 bp, Homo sapiens
tgtaataagcacttgcctg

SEQ ID NO: 6748442 - DNA, 20 bp, Homo sapiens
tgtaataatacctcaatgtt

SEQ ID NO: 6748443 - DNA, 14 bp, Homo sapiens
tgtaataatgtaca

SEQ ID NO: 6748444 - DNA, 15 bp, Homo sapiens
tgtaataatgtacag

SEQ ID NO: 6748445 - DNA, 11 bp, Homo sapiens
tgtaatacaat

SEQ ID NO: 6748446 - DNA, 18 bp, Homo sapiens
tgtaatacaccaaatagc

SEQ ID NO: 6748447 - DNA, 13 bp, Homo sapiens
tgtaatactggaa

SEQ ID NO: 6748448 - DNA, 14 bp, Homo sapiens
tgtaatactggaat

SEQ ID NO: 6748449 - DNA, 17 bp, Homo sapiens
tgtaatactggaataat

SEQ ID NO: 6748450 - DNA, 16 bp, Homo sapiens
tgtaatactgtagaaa

SEQ ID NO: 6748451 - DNA, 15 bp, Homo sapiens
tgtaatacttaaata

SEQ ID NO: 6748452 - DNA, 18 bp, Homo sapiens
tgtaatacttaaataaac

SEQ ID NO: 6748453 - DNA, 20 bp, Homo sapiens
tgtaatacttaaataaacat

SEQ ID NO: 6748454 - DNA, 14 bp, Homo sapiens
tgtaatacttcttt

SEQ ID NO: 6748455 - DNA, 19 bp, Homo sapiens
tgtaatacttctttgttat

SEQ ID NO: 6748456 - DNA, 23 bp, Homo sapiens
tgtaatacttctttgttattata

SEQ ID NO: 6748457 - DNA, 16 bp, Homo sapiens
tgtaatagaaaactga

SEQ ID NO: 6748458 - DNA, 18 bp, Homo sapiens
tgtaatagaaaactgaaa

SEQ ID NO: 6748459 - DNA, 20 bp, Homo sapiens
tgtaatagaaaactgaaaat

SEQ ID NO: 6748460 - DNA, 15 bp, Homo sapiens
tgtaatagaagctta

SEQ ID NO: 6748461 - DNA, 17 bp, Homo sapiens
tgtaatagagaatattt

SEQ ID NO: 6748462 - DNA, 16 bp, Homo sapiens
tgtaatagcctcacct

SEQ ID NO: 6748463 - DNA, 22 bp, Homo sapiens
tgtaatagttcagtagaattac

SEQ ID NO: 6748464 - DNA, 23 bp, Homo sapiens
tgtaatagttctatccttttgcc

SEQ ID NO: 6748465 - DNA, 12 bp, Homo sapiens
tgtaatataaat

SEQ ID NO: 6748466 - DNA, 19 bp, Homo sapiens
tgtaatataaatttaagca

SEQ ID NO: 6748467 - DNA, 14 bp, Homo sapiens
tgtaatataagaca

SEQ ID NO: 6748468 - DNA, 15 bp, Homo sapiens
tgtaatataagacaa

SEQ ID NO: 6748469 - DNA, 17 bp, Homo sapiens
tgtaatataagacaagt

SEQ ID NO: 6748470 - DNA, 23 bp, Homo sapiens
tgtaatatagaaaaaaacattct

SEQ ID NO: 6748471 - DNA, 17 bp, Homo sapiens
tgtaatatataatcaaa

SEQ ID NO: 6748472 - DNA, 16 bp, Homo sapiens
tgtaatatatcctgtt

SEQ ID NO: 6748473 - DNA, 20 bp, Homo sapiens
tgtaatatatcctgtttgta

SEQ ID NO: 6748474 - DNA, 15 bp, Homo sapiens
tgtaatatattgtac

SEQ ID NO: 6748475 - DNA, 16 bp, Homo sapiens
tgtaatatattgtaca

SEQ ID NO: 6748476 - DNA, 20 bp, Homo sapiens
tgtaatatattgtacaaatg

SEQ ID NO: 6748477 - DNA, 21 bp, Homo sapiens
tgtaatatattgtacaaatgt

SEQ ID NO: 6748478 - DNA, 18 bp, Homo sapiens
tgtaatatatttatatac

SEQ ID NO: 6748479 - DNA, 21 bp, Homo sapiens
tgtaatatatttcagacattt

SEQ ID NO: 6748480 - DNA, 12 bp, Homo sapiens
tgtaatatcagt

SEQ ID NO: 6748481 - DNA, 17 bp, Homo sapiens
tgtaatatcattttata

SEQ ID NO: 6748482 - DNA, 21 bp, Homo sapiens
tgtaatatctttaaatgatgt

SEQ ID NO: 6748483 - DNA, 14 bp, Homo sapiens
tgtaatatgagaat

SEQ ID NO: 6748484 - DNA, 17 bp, Homo sapiens
tgtaatattaaattcct

SEQ ID NO: 6748485 - DNA, 19 bp, Homo sapiens
tgtaatattactttaacat

SEQ ID NO: 6748486 - DNA, 16 bp, Homo sapiens
tgtaatattctgtttt

SEQ ID NO: 6748487 - DNA, 13 bp, Homo sapiens
tgtaatatttaca

SEQ ID NO: 6748488 - DNA, 22 bp, Homo sapiens
tgtaatattttgtattattgct

SEQ ID NO: 6748489 - DNA, 23 bp, Homo sapiens
tgtaatattttgtattattgctg

SEQ ID NO: 6748490 - DNA, 15 bp, Homo sapiens
tgtaatcaataaacg

SEQ ID NO: 6748491 - DNA, 18 bp, Homo sapiens
tgtaatcaataaacgatt

SEQ ID NO: 6748492 - DNA, 14 bp, Homo sapiens
tgtaatcacagcta

SEQ ID NO: 6748493 - DNA, 12 bp, Homo sapiens
tgtaatcaggca

SEQ ID NO: 6748494 - DNA, 20 bp, Homo sapiens
tgtaatcaggcaaggaggag

SEQ ID NO: 6748495 - DNA, 14 bp, Homo sapiens
tgtaatcataaata

SEQ ID NO: 6748496 - DNA, 17 bp, Homo sapiens
tgtaatcatataataaa

SEQ ID NO: 6748497 - DNA, 14 bp, Homo sapiens
tgtaatcatttatc

SEQ ID NO: 6748498 - DNA, 21 bp, Homo sapiens
tgtaatcattttaaattccac

SEQ ID NO: 6748499 - DNA, 16 bp, Homo sapiens
tgtaatcccaacactt

SEQ ID NO: 6748500 - DNA, 13 bp, Homo sapiens
tgtaatcccagca

SEQ ID NO: 6748501 - DNA, 14 bp, Homo sapiens
tgtaatcccagcac

SEQ ID NO: 6748502 - DNA, 16 bp, Homo sapiens
tgtaatcccagcactt

SEQ ID NO: 6748503 - DNA, 20 bp, Homo sapiens
tgtaatcccagcactttggg

SEQ ID NO: 6748504 - DNA, 20 bp, Homo sapiens
tgtaatcccagctactcagg

SEQ ID NO: 6748505 - DNA, 23 bp, Homo sapiens
tgtaatcccagctactcaggagg

SEQ ID NO: 6748506 - DNA, 20 bp, Homo sapiens
tgtaatcccagctactcggg

SEQ ID NO: 6748507 - DNA, 17 bp, Homo sapiens
tgtaatcccagctactt

SEQ ID NO: 6748508 - DNA, 21 bp, Homo sapiens
tgtaatcctagctacttggca

SEQ ID NO: 6748509 - DNA, 17 bp, Homo sapiens
tgtaatcggctcccgct

SEQ ID NO: 6748510 - DNA, 15 bp, Homo sapiens
tgtaatcgtgtgcca

SEQ ID NO: 6748511 - DNA, 16 bp, Homo sapiens
tgtaatcgtgtgccat

SEQ ID NO: 6748512 - DNA, 17 bp, Homo sapiens
tgtaatcgtgtgccatg

SEQ ID NO: 6748513 - DNA, 18 bp, Homo sapiens
tgtaatctaagtatatgt

SEQ ID NO: 6748514 - DNA, 24 bp, Homo sapiens
tgtaatctaagtatatgtgagaaa

SEQ ID NO: 6748515 - DNA, 17 bp, Homo sapiens
tgtaatctatgtttata

SEQ ID NO: 6748516 - DNA, 16 bp, Homo sapiens
tgtaatctcaatgcaa

SEQ ID NO: 6748517 - DNA, 17 bp, Homo sapiens
tgtaatctcaatgcaag

SEQ ID NO: 6748518 - DNA, 19 bp, Homo sapiens
tgtaatctcgtttcaaaaa

SEQ ID NO: 6748519 - DNA, 21 bp, Homo sapiens
tgtaatctctctgcagctgcc

SEQ ID NO: 6748520 - DNA, 18 bp, Homo sapiens
tgtaatcttaaaagtgta

SEQ ID NO: 6748521 - DNA, 14 bp, Homo sapiens
tgtaatcttcccca

SEQ ID NO: 6748522 - DNA, 15 bp, Homo sapiens
tgtaatcttgaattg

SEQ ID NO: 6748523 - DNA, 20 bp, Homo sapiens
tgtaatctttcatccaaaat

SEQ ID NO: 6748524 - DNA, 21 bp, Homo sapiens
tgtaatctttcatccaaaata

SEQ ID NO: 6748525 - DNA, 20 bp, Homo sapiens
tgtaatctttttctccaccc

SEQ ID NO: 6748526 - DNA, 17 bp, Homo sapiens
tgtaatgaaacaccttc

SEQ ID NO: 6748527 - DNA, 20 bp, Homo sapiens
tgtaatgaaacaccttctct

SEQ ID NO: 6748528 - DNA, 19 bp, Homo sapiens
tgtaatgaaccgctgaata

SEQ ID NO: 6748529 - DNA, 15 bp, Homo sapiens
tgtaatgaagtaaag

SEQ ID NO: 6748530 - DNA, 21 bp, Homo sapiens
tgtaatgaatctaagcagcat

SEQ ID NO: 6748531 - DNA, 19 bp, Homo sapiens
tgtaatgaattcctagaat

SEQ ID NO: 6748532 - DNA, 22 bp, Homo sapiens
tgtaatgacaaaagatacaaaa

SEQ ID NO: 6748533 - DNA, 13 bp, Homo sapiens
tgtacttttttct

SEQ ID NO: 6748534 - DNA, 16 bp, Homo sapiens
tgtacttttttcttaa

SEQ ID NO: 6748535 - DNA, 19 bp, Homo sapiens
tgtagaaaagaaaacattt

SEQ ID NO: 6748536 - DNA, 20 bp, Homo sapiens
tgtagaaaagaaaacattta

SEQ ID NO: 6748537 - DNA, 21 bp, Homo sapiens
tgtagaaaagggaactgaaca

SEQ ID NO: 6748538 - DNA, 23 bp, Homo sapiens
tgtagaaaagggaactgaacatt

SEQ ID NO: 6748539 - DNA, 23 bp, Homo sapiens
tgtagaaaatttgttattttgca

SEQ ID NO: 6748540 - DNA, 19 bp, Homo sapiens
tgtagaaacaaagggtttt

SEQ ID NO: 6748541 - DNA, 13 bp, Homo sapiens
tgtagaaacattt

SEQ ID NO: 6748542 - DNA, 16 bp, Homo sapiens
tgtagaaaccagctca

SEQ ID NO: 6748543 - DNA, 18 bp, Homo sapiens
tgtagaaataaattactt

SEQ ID NO: 6748544 - DNA, 12 bp, Homo sapiens
tgtagaaatgta

SEQ ID NO: 6748545 - DNA, 17 bp, Homo sapiens
tgtagaacctaattcaa

SEQ ID NO: 6748546 - DNA, 19 bp, Homo sapiens
tgtagaactcactctgggc

SEQ ID NO: 6748547 - DNA, 19 bp, Homo sapiens
tgtagaactgattttacaa

SEQ ID NO: 6748548 - DNA, 18 bp, Homo sapiens
tgtagaactgttcatttc

SEQ ID NO: 6748549 - DNA, 21 bp, Homo sapiens
tgtagaactgttcatttccac

SEQ ID NO: 6748550 - DNA, 12 bp, Homo sapiens
tgtagaacttgt

SEQ ID NO: 6748551 - DNA, 15 bp, Homo sapiens
tgtagaactttatta

SEQ ID NO: 6748552 - DNA, 16 bp, Homo sapiens
tgtagaagaaaatatc

SEQ ID NO: 6748553 - DNA, 19 bp, Homo sapiens
tgtagaagaaaatttaatt

SEQ ID NO: 6748554 - DNA, 22 bp, Homo sapiens
tgtagaagaaaatttaattatt

SEQ ID NO: 6748555 - DNA, 13 bp, Homo sapiens
tgtagaagaggga

SEQ ID NO: 6748556 - DNA, 19 bp, Homo sapiens
tgtagaagagggagaagga

SEQ ID NO: 6748557 - DNA, 24 bp, Homo sapiens
tgtagaagagggagaaggagaggc

SEQ ID NO: 6748558 - DNA, 15 bp, Homo sapiens
tgtagaagcattcct

SEQ ID NO: 6748559 - DNA, 22 bp, Homo sapiens
tgtagaagcattccttctttga

SEQ ID NO: 6748560 - DNA, 23 bp, Homo sapiens
tgtagaagtggcatctgaaaaca

SEQ ID NO: 6748561 - DNA, 14 bp, Homo sapiens
tgtagaataaatga

SEQ ID NO: 6748562 - DNA, 15 bp, Homo sapiens
tgtagaataaatgaa

SEQ ID NO: 6748563 - DNA, 17 bp, Homo sapiens
tgtagaataaatgaaga

SEQ ID NO: 6748564 - DNA, 18 bp, Homo sapiens
tgtagaatagcctgtggc

SEQ ID NO: 6748565 - DNA, 16 bp, Homo sapiens
tgtagaatgatttcat

SEQ ID NO: 6748566 - DNA, 17 bp, Homo sapiens
tgtagaatgatttcatg

SEQ ID NO: 6748567 - DNA, 18 bp, Homo sapiens
tgtagaatgatttcatgc

SEQ ID NO: 6748568 - DNA, 15 bp, Homo sapiens
tgtagaatgattttt

SEQ ID NO: 6748569 - DNA, 21 bp, Homo sapiens
tgtagaatgccgcgaactggg

SEQ ID NO: 6748570 - DNA, 17 bp, Homo sapiens
tgtagaatgtattgtac

SEQ ID NO: 6748571 - DNA, 18 bp, Homo sapiens
tgtagaatgtattgtacc

SEQ ID NO: 6748572 - DNA, 18 bp, Homo sapiens
tgtagaattcgcagtgat

SEQ ID NO: 6748573 - DNA, 17 bp, Homo sapiens
tgtagaattgaaaatgc

SEQ ID NO: 6748574 - DNA, 18 bp, Homo sapiens
tgtagaattgaaaatgca

SEQ ID NO: 6748575 - DNA, 14 bp, Homo sapiens
tgtagaattgttat

SEQ ID NO: 6748576 - DNA, 19 bp, Homo sapiens
tgtagaatttgaaatggtt

SEQ ID NO: 6748577 - DNA, 16 bp, Homo sapiens
tgtagacaaagtacat

SEQ ID NO: 6748578 - DNA, 19 bp, Homo sapiens
tgtagacactctgacaagc

SEQ ID NO: 6748579 - DNA, 20 bp, Homo sapiens
tgtagacactctgacaagct

SEQ ID NO: 6748580 - DNA, 15 bp, Homo sapiens
tgtagacaggaaagc

SEQ ID NO: 6748581 - DNA, 17 bp, Homo sapiens
tgtagacagttgggttt

SEQ ID NO: 6748582 - DNA, 16 bp, Homo sapiens
tgtagacataaagaag

SEQ ID NO: 6748583 - DNA, 17 bp, Homo sapiens
tgtagacattgtaaata

SEQ ID NO: 6748584 - DNA, 18 bp, Homo sapiens
tgtagacattttaagcat

SEQ ID NO: 6748585 - DNA, 15 bp, Homo sapiens
tgtagaccactgtcc

SEQ ID NO: 6748586 - DNA, 20 bp, Homo sapiens
tgtagacgatatactccctg

SEQ ID NO: 6748587 - DNA, 11 bp, Homo sapiens
tgtagactagt

SEQ ID NO: 6748588 - DNA, 20 bp, Homo sapiens
tgtagactatatacatgtgt

SEQ ID NO: 6748589 - DNA, 23 bp, Homo sapiens
tgtagactatatacatgtgtgta

SEQ ID NO: 6748590 - DNA, 21 bp, Homo sapiens
tgtagactatggaatgtcagt

SEQ ID NO: 6748591 - DNA, 21 bp, Homo sapiens
tgtagacttctggttgtattt

SEQ ID NO: 6748592 - DNA, 17 bp, Homo sapiens
tgtagagacaatacagt

SEQ ID NO: 6748593 - DNA, 16 bp, Homo sapiens
tgtagagacagggtct

SEQ ID NO: 6748594 - DNA, 23 bp, Homo sapiens
tgtagagacagggtctcactgtg

SEQ ID NO: 6748595 - DNA, 14 bp, Homo sapiens
tgtagagccagcct

SEQ ID NO: 6748596 - DNA, 16 bp, Homo sapiens
tgtagagccagccttg

SEQ ID NO: 6748597 - DNA, 18 bp, Homo sapiens
tgtagagccagccttggt

SEQ ID NO: 6748598 - DNA, 19 bp, Homo sapiens
tgtagagcccctactgtgg

SEQ ID NO: 6748599 - DNA, 21 bp, Homo sapiens
tgtagagcccctactgtgggc

SEQ ID NO: 6748600 - DNA, 15 bp, Homo sapiens
tgtagaggagcctgg

SEQ ID NO: 6748601 - DNA, 14 bp, Homo sapiens
tgtagagggccctg

SEQ ID NO: 6748602 - DNA, 21 bp, Homo sapiens
tgtagagtggtctatttctcc

SEQ ID NO: 6748603 - DNA, 16 bp, Homo sapiens
tgtagagttaagaagc

SEQ ID NO: 6748604 - DNA, 14 bp, Homo sapiens
tgtagagttgctga

SEQ ID NO: 6748605 - DNA, 16 bp, Homo sapiens
tgtagagtttttggaa

SEQ ID NO: 6748606 - DNA, 13 bp, Homo sapiens
tgtagataagtgt

SEQ ID NO: 6748607 - DNA, 20 bp, Homo sapiens
tgtagatacaaggatgcaca

SEQ ID NO: 6748608 - DNA, 18 bp, Homo sapiens
tgtagatacaatcagctg

SEQ ID NO: 6748609 - DNA, 23 bp, Homo sapiens
tgtagatacagatccgcatgtgt

SEQ ID NO: 6748610 - DNA, 16 bp, Homo sapiens
tgtagatacaggggca

SEQ ID NO: 6748611 - DNA, 21 bp, Homo sapiens
tgtagatatatatttccaaat

SEQ ID NO: 6748612 - DNA, 13 bp, Homo sapiens
tgtagatattatg

SEQ ID NO: 6748613 - DNA, 17 bp, Homo sapiens
tgtagatattatgtata

SEQ ID NO: 6748614 - DNA, 22 bp, Homo sapiens
tgtagatattatgtatagaaaa

SEQ ID NO: 6748615 - DNA, 19 bp, Homo sapiens
tgtagatattgtgaagtac

SEQ ID NO: 6748616 - DNA, 21 bp, Homo sapiens
tgtagatattgtgaagtacat

SEQ ID NO: 6748617 - DNA, 22 bp, Homo sapiens
tgtagatattgttttctgtaaa

SEQ ID NO: 6748618 - DNA, 16 bp, Homo sapiens
tgtagatatttggctt

SEQ ID NO: 6748619 - DNA, 19 bp, Homo sapiens
tgtagatatttggcttaaa

SEQ ID NO: 6748620 - DNA, 20 bp, Homo sapiens
tgtagatcaactcatgttaa

SEQ ID NO: 6748621 - DNA, 18 bp, Homo sapiens
tgtagatcagagcagcag

SEQ ID NO: 6748622 - DNA, 15 bp, Homo sapiens
tgtagatcaggtttg

SEQ ID NO: 6748623 - DNA, 23 bp, Homo sapiens
tgtagatgaaaaagcatgtacag

SEQ ID NO: 6748624 - DNA, 17 bp, Homo sapiens
tgtagatgaacatctct

SEQ ID NO: 6748625 - DNA, 21 bp, Homo sapiens
tgtagatgggggaactgtgaa

SEQ ID NO: 6748626 - DNA, 14 bp, Homo sapiens
tgtagatgtagcat

SEQ ID NO: 6748627 - DNA, 13 bp, Homo sapiens
tgtagattaggat

SEQ ID NO: 6748628 - DNA, 19 bp, Homo sapiens
tgtagattaggattaaaat

SEQ ID NO: 6748629 - DNA, 16 bp, Homo sapiens
tgtagattgtgtaaat

SEQ ID NO: 6748630 - DNA, 12 bp, Homo sapiens
tgtagatttctg

SEQ ID NO: 6748631 - DNA, 13 bp, Homo sapiens
tgtagatttgaaa

SEQ ID NO: 6748632 - DNA, 14 bp, Homo sapiens
tgtagatttgaaaa

SEQ ID NO: 6748633 - DNA, 15 bp, Homo sapiens
tgtagatttgaaaat

SEQ ID NO: 6748634 - DNA, 18 bp, Homo sapiens
tgtagatttgaaaattgt

SEQ ID NO: 6748635 - DNA, 13 bp, Homo sapiens
tgtagatttgatt

SEQ ID NO: 6748636 - DNA, 22 bp, Homo sapiens
tgtagcaaaattcttaagtatg

SEQ ID NO: 6748637 - DNA, 20 bp, Homo sapiens
tgtagcaaattccaatacat

SEQ ID NO: 6748638 - DNA, 23 bp, Homo sapiens
tgtagcaaattccaatacattat

SEQ ID NO: 6748639 - DNA, 14 bp, Homo sapiens
tgtagcaatatatt

SEQ ID NO: 6748640 - DNA, 16 bp, Homo sapiens
tgtagcaatggccaga

SEQ ID NO: 6748641 - DNA, 22 bp, Homo sapiens
tgtagcacggagtgttggggct

SEQ ID NO: 6748642 - DNA, 13 bp, Homo sapiens
tgtagcactgagg

SEQ ID NO: 6748643 - DNA, 12 bp, Homo sapiens
tgtagcacttac

SEQ ID NO: 6748644 - DNA, 13 bp, Homo sapiens
tgtagcagaaacc

SEQ ID NO: 6748645 - DNA, 22 bp, Homo sapiens
tgtagcaggggaattccctccc

SEQ ID NO: 6748646 - DNA, 16 bp, Homo sapiens
tgtagcagtgtaccca

SEQ ID NO: 6748647 - DNA, 12 bp, Homo sapiens
tgtagcatactg

SEQ ID NO: 6748648 - DNA, 13 bp, Homo sapiens
tgtagcatataaa

SEQ ID NO: 6748649 - DNA, 15 bp, Homo sapiens
tgtagcatataaatg

SEQ ID NO: 6748650 - DNA, 18 bp, Homo sapiens
tgtagcatcttcctctgc

SEQ ID NO: 6748651 - DNA, 16 bp, Homo sapiens
tgtagcatcttctgga

SEQ ID NO: 6748652 - DNA, 16 bp, Homo sapiens
tgtagcattaaatata

SEQ ID NO: 6748653 - DNA, 15 bp, Homo sapiens
tgtagcattgttcca

SEQ ID NO: 6748654 - DNA, 17 bp, Homo sapiens
tgtagcattgttccaca

SEQ ID NO: 6748655 - DNA, 13 bp, Homo sapiens
tgtagccacagct

SEQ ID NO: 6748656 - DNA, 16 bp, Homo sapiens
tgtagccacagctgct

SEQ ID NO: 6748657 - DNA, 14 bp, Homo sapiens
tgtagccagacagt

SEQ ID NO: 6748658 - DNA, 16 bp, Homo sapiens
tgtagccagacagttt

SEQ ID NO: 6748659 - DNA, 15 bp, Homo sapiens
tgtagccagcccaca

SEQ ID NO: 6748660 - DNA, 12 bp, Homo sapiens
tgtagccagccg

SEQ ID NO: 6748661 - DNA, 18 bp, Homo sapiens
tgtagccaggtccccctg

SEQ ID NO: 6748662 - DNA, 18 bp, Homo sapiens
tgtagccatggctcaggc

SEQ ID NO: 6748663 - DNA, 16 bp, Homo sapiens
tgtagccatggctggg

SEQ ID NO: 6748664 - DNA, 15 bp, Homo sapiens
tgtagccatgggacc

SEQ ID NO: 6748665 - DNA, 16 bp, Homo sapiens
tgtagccatgggacca

SEQ ID NO: 6748666 - DNA, 16 bp, Homo sapiens
tgtagcccactctgct

SEQ ID NO: 6748667 - DNA, 17 bp, Homo sapiens
tgtagcccactctgctc

SEQ ID NO: 6748668 - DNA, 16 bp, Homo sapiens
tgtagcccaggctgga

SEQ ID NO: 6748669 - DNA, 20 bp, Homo sapiens
tgtagccccgggctgaccca

SEQ ID NO: 6748670 - DNA, 14 bp, Homo sapiens
tgtagcccggccag

SEQ ID NO: 6748671 - DNA, 16 bp, Homo sapiens
tgtagcccggccaggg

SEQ ID NO: 6748672 - DNA, 23 bp, Homo sapiens
tgtagccctggatggcctctggg

SEQ ID NO: 6748673 - DNA, 15 bp, Homo sapiens
tgtagccctggcccg

SEQ ID NO: 6748674 - DNA, 22 bp, Homo sapiens
tgtagccctggcccggtcccag

SEQ ID NO: 6748675 - DNA, 23 bp, Homo sapiens
tgtagccctggcccggtcccagt

SEQ ID NO: 6748676 - DNA, 19 bp, Homo sapiens
tgtagccctttccaagctt

SEQ ID NO: 6748677 - DNA, 23 bp, Homo sapiens
tgtagcctaaagaccatttaatc

SEQ ID NO: 6748678 - DNA, 18 bp, Homo sapiens
tgtagcctaaagggcagg

SEQ ID NO: 6748679 - DNA, 17 bp, Homo sapiens
tgtagcctaatattcat

SEQ ID NO: 6748680 - DNA, 17 bp, Homo sapiens
tgtagcctacagacatg

SEQ ID NO: 6748681 - DNA, 23 bp, Homo sapiens
tgtagcctcaatcgagtgagaca

SEQ ID NO: 6748682 - DNA, 15 bp, Homo sapiens
tgtagcctcagatga

SEQ ID NO: 6748683 - DNA, 22 bp, Homo sapiens
tgtagcctcgccgtctgtgaat

SEQ ID NO: 6748684 - DNA, 18 bp, Homo sapiens
tgtagcctgaagagtttg

SEQ ID NO: 6748685 - DNA, 20 bp, Homo sapiens
tgtagcctgcgtcatggctc

SEQ ID NO: 6748686 - DNA, 12 bp, Homo sapiens
tgtagcctggtc

SEQ ID NO: 6748687 - DNA, 14 bp, Homo sapiens
tgtagcctggtctg

SEQ ID NO: 6748688 - DNA, 13 bp, Homo sapiens
tgtagcctgtgca

SEQ ID NO: 6748689 - DNA, 15 bp, Homo sapiens
tgtagcctgtgcatg

SEQ ID NO: 6748690 - DNA, 16 bp, Homo sapiens
tgtagcctgtgcatgt

SEQ ID NO: 6748691 - DNA, 19 bp, Homo sapiens
tgtagccttagagcatctc

SEQ ID NO: 6748692 - DNA, 15 bp, Homo sapiens
tgtagccttcacaca

SEQ ID NO: 6748693 - DNA, 15 bp, Homo sapiens
tgtagccttcctcca

SEQ ID NO: 6748694 - DNA, 21 bp, Homo sapiens
tgtagccttcctccacatcct

SEQ ID NO: 6748695 - DNA, 17 bp, Homo sapiens
tgtagccttgcccggat

SEQ ID NO: 6748696 - DNA, 19 bp, Homo sapiens
tgtagcgaccccagactgt

SEQ ID NO: 6748697 - DNA, 15 bp, Homo sapiens
tgtagcgtctttctt

SEQ ID NO: 6748698 - DNA, 15 bp, Homo sapiens
tgtagctaaaaataa

SEQ ID NO: 6748699 - DNA, 19 bp, Homo sapiens
tgtagctaacagtgaagat

SEQ ID NO: 6748700 - DNA, 22 bp, Homo sapiens
tgtagctaattaggaagcttga

SEQ ID NO: 6748701 - DNA, 18 bp, Homo sapiens
tgtagctacactgtataa

SEQ ID NO: 6748702 - DNA, 19 bp, Homo sapiens
tgtagctacagagaaacca

SEQ ID NO: 6748703 - DNA, 21 bp, Homo sapiens
tgtagctacagagaaaccagc

SEQ ID NO: 6748704 - DNA, 22 bp, Homo sapiens
tgtagctacagagaaaccagct

SEQ ID NO: 6748705 - DNA, 23 bp, Homo sapiens
tgtagctacagagaaaccagctt

SEQ ID NO: 6748706 - DNA, 15 bp, Homo sapiens
tgtagctagaatatc

SEQ ID NO: 6748707 - DNA, 16 bp, Homo sapiens
tgtagctagaatatcc

SEQ ID NO: 6748708 - DNA, 21 bp, Homo sapiens
tgtagctagtttaaaattatt

SEQ ID NO: 6748709 - DNA, 20 bp, Homo sapiens
tgtagctataatgagcatgt

SEQ ID NO: 6748710 - DNA, 20 bp, Homo sapiens
tgtagctattggtctgtcct

SEQ ID NO: 6748711 - DNA, 20 bp, Homo sapiens
tgtatgagatggttaaaaag

SEQ ID NO: 6748712 - DNA, 19 bp, Homo sapiens
tgtatgaggtcctcaggtc

SEQ ID NO: 6748713 - DNA, 15 bp, Homo sapiens
tgtatgatactaaag

SEQ ID NO: 6748714 - DNA, 16 bp, Homo sapiens
tgtatgatactaaaga

SEQ ID NO: 6748715 - DNA, 13 bp, Homo sapiens
tgtatgatcaaat

SEQ ID NO: 6748716 - DNA, 14 bp, Homo sapiens
tgtatgatcaaatg

SEQ ID NO: 6748717 - DNA, 19 bp, Homo sapiens
tgtatgatcaaatgtttaa

SEQ ID NO: 6748718 - DNA, 20 bp, Homo sapiens
tgtatgatcaaatgtttaat

SEQ ID NO: 6748719 - DNA, 17 bp, Homo sapiens
tgtatgatctgtgcctt

SEQ ID NO: 6748720 - DNA, 12 bp, Homo sapiens
tgtatgattact

SEQ ID NO: 6748721 - DNA, 20 bp, Homo sapiens
tgtatgatttaggcttctat

SEQ ID NO: 6748722 - DNA, 17 bp, Homo sapiens
tgtatgatttctgttgt

SEQ ID NO: 6748723 - DNA, 16 bp, Homo sapiens
tgtatgcaagcagttt

SEQ ID NO: 6748724 - DNA, 20 bp, Homo sapiens
tgtatgcaagcagtttcaat

SEQ ID NO: 6748725 - DNA, 17 bp, Homo sapiens
tgtatgcacatgaactt

SEQ ID NO: 6748726 - DNA, 15 bp, Homo sapiens
tgtatgcactgctca

SEQ ID NO: 6748727 - DNA, 12 bp, Homo sapiens
tgtatgcagcta

SEQ ID NO: 6748728 - DNA, 14 bp, Homo sapiens
tgtatgcagggagc

SEQ ID NO: 6748729 - DNA, 21 bp, Homo sapiens
tgtatgcagtactaaaattaa

SEQ ID NO: 6748730 - DNA, 20 bp, Homo sapiens
tgtatgcagttttgtaaata

SEQ ID NO: 6748731 - DNA, 12 bp, Homo sapiens
tgtatgcataat

SEQ ID NO: 6748732 - DNA, 17 bp, Homo sapiens
tgtatgcataataatcc

SEQ ID NO: 6748733 - DNA, 13 bp, Homo sapiens
tgtatgcatacaa

SEQ ID NO: 6748734 - DNA, 19 bp, Homo sapiens
tgtatgcatggaaacatgg

SEQ ID NO: 6748735 - DNA, 13 bp, Homo sapiens
tgtatgcatgttg

SEQ ID NO: 6748736 - DNA, 22 bp, Homo sapiens
tgtatgccaatcttaaagacaa

SEQ ID NO: 6748737 - DNA, 15 bp, Homo sapiens
tgtatgccttctgta

SEQ ID NO: 6748738 - DNA, 13 bp, Homo sapiens
tgtatgcgtgtgt

SEQ ID NO: 6748739 - DNA, 23 bp, Homo sapiens
tgtatgctgatcatcgccagagg

SEQ ID NO: 6748740 - DNA, 13 bp, Homo sapiens
tgtatggaaacac

SEQ ID NO: 6748741 - DNA, 15 bp, Homo sapiens
tgtatggaaacactg

SEQ ID NO: 6748742 - DNA, 17 bp, Homo sapiens
tgtatggaagacaaata

SEQ ID NO: 6748743 - DNA, 20 bp, Homo sapiens
tgtatggaagacaaatacac

SEQ ID NO: 6748744 - DNA, 17 bp, Homo sapiens
tgtatggacgtgtgtga

SEQ ID NO: 6748745 - DNA, 18 bp, Homo sapiens
tgtatggatatatttgaa

SEQ ID NO: 6748746 - DNA, 16 bp, Homo sapiens
tgtatggatatgtgta

SEQ ID NO: 6748747 - DNA, 17 bp, Homo sapiens
tgtatggatatgtgtaa

SEQ ID NO: 6748748 - DNA, 16 bp, Homo sapiens
tgtatggcccaggcag

SEQ ID NO: 6748749 - DNA, 20 bp, Homo sapiens
tgtatggcccaggcagcctc

SEQ ID NO: 6748750 - DNA, 14 bp, Homo sapiens
tgtatgggcaaaaa

SEQ ID NO: 6748751 - DNA, 17 bp, Homo sapiens
tgtatggggaatctaag

SEQ ID NO: 6748752 - DNA, 22 bp, Homo sapiens
tgtatgggggagattgaacttt

SEQ ID NO: 6748753 - DNA, 23 bp, Homo sapiens
tgtatgggggagattgaactttc

SEQ ID NO: 6748754 - DNA, 23 bp, Homo sapiens
tgtatgggtgtgtgtttgtgtga

SEQ ID NO: 6748755 - DNA, 21 bp, Homo sapiens
tgtatggtatctttagatatt

SEQ ID NO: 6748756 - DNA, 16 bp, Homo sapiens
tgtatggttactaaaa

SEQ ID NO: 6748757 - DNA, 19 bp, Homo sapiens
tgtatggttactaaaaagt

SEQ ID NO: 6748758 - DNA, 23 bp, Homo sapiens
tgtatggtttttgagatattaat

SEQ ID NO: 6748759 - DNA, 14 bp, Homo sapiens
tgtatgtaaagtta

SEQ ID NO: 6748760 - DNA, 16 bp, Homo sapiens
tgtatgtaaagttaaa

SEQ ID NO: 6748761 - DNA, 15 bp, Homo sapiens
tgtatgtaaataggt

SEQ ID NO: 6748762 - DNA, 13 bp, Homo sapiens
tgtatgtaaatct

SEQ ID NO: 6748763 - DNA, 15 bp, Homo sapiens
tgtatgtaaatctgc

SEQ ID NO: 6748764 - DNA, 22 bp, Homo sapiens
tgtatgtaaatgtgcattcttt

SEQ ID NO: 6748765 - DNA, 21 bp, Homo sapiens
tgtatgtaacaattgtttgtt

SEQ ID NO: 6748766 - DNA, 19 bp, Homo sapiens
tgtatgtaagctgagattt

SEQ ID NO: 6748767 - DNA, 12 bp, Homo sapiens
tgtatgtacaat

SEQ ID NO: 6748768 - DNA, 14 bp, Homo sapiens
tgtatgtacaatac

SEQ ID NO: 6748769 - DNA, 23 bp, Homo sapiens
tgtatgtacaatacaatgtacaa

SEQ ID NO: 6748770 - DNA, 13 bp, Homo sapiens
tgtatgtacatat

SEQ ID NO: 6748771 - DNA, 17 bp, Homo sapiens
tgtatgtacttagctgt

SEQ ID NO: 6748772 - DNA, 17 bp, Homo sapiens
tgtatgtaggagctgca

SEQ ID NO: 6748773 - DNA, 18 bp, Homo sapiens
tgtatgtaggagctgcag

SEQ ID NO: 6748774 - DNA, 15 bp, Homo sapiens
tgtatgtataattca

SEQ ID NO: 6748775 - DNA, 12 bp, Homo sapiens
tgtatgtataca

SEQ ID NO: 6748776 - DNA, 13 bp, Homo sapiens
tgtatgtatacac

SEQ ID NO: 6748777 - DNA, 18 bp, Homo sapiens
tgtatgtatacacacaca

SEQ ID NO: 6748778 - DNA, 17 bp, Homo sapiens
tgtatgtatacacacat

SEQ ID NO: 6748779 - DNA, 23 bp, Homo sapiens
tgtatgtatacacacatatacat

SEQ ID NO: 6748780 - DNA, 21 bp, Homo sapiens
tgtatgtatgagacagaaact

SEQ ID NO: 6748781 - DNA, 11 bp, Homo sapiens
tgtatgtatgt

SEQ ID NO: 6748782 - DNA, 14 bp, Homo sapiens
tgtatgtatgtcca

SEQ ID NO: 6748783 - DNA, 15 bp, Homo sapiens
tgtatgtcaaagctt

SEQ ID NO: 6748784 - DNA, 16 bp, Homo sapiens
tgtatgtcaaattgtg

SEQ ID NO: 6748785 - DNA, 21 bp, Homo sapiens
tgtatgtcagacatccatgtt

SEQ ID NO: 6748786 - DNA, 13 bp, Homo sapiens
tgtatgtctatgt

SEQ ID NO: 6748787 - DNA, 16 bp, Homo sapiens
tgtatgtctatgtgta

SEQ ID NO: 6748788 - DNA, 20 bp, Homo sapiens
tgtatgtctatgtgtatata

SEQ ID NO: 6748789 - DNA, 13 bp, Homo sapiens
tgtatgtctgtca

SEQ ID NO: 6748790 - DNA, 12 bp, Homo sapiens
tgtatgtctgtg

SEQ ID NO: 6748791 - DNA, 14 bp, Homo sapiens
tgtatgtctgtgta
